United States Patent 8,119,385 (NUCLEIC ACIDS AND PROTEINS AND METHODS FOR MAKING AND USING THEM) - sequence listing, part 2

SEQ ID NO: 4601 - DNA, 723 bp, Unknown
  Obtained from environmental sample
  misc_feature (1)..(723): n is a, c, g, or t
ttgcggaaattgtccctaagcaagcacacactcgcgctcaatttatataaagatgaagattacgaaatacaagatattaaaattcccttgggtcatcaagtaaaagaacttgaaccattcatttctgaaatttccgattatctacttcaaactgattttcagcaatcaaaattcccatcaaaatataaaaatgttgatgatgaggacgatgatcctgatcggccacaatcattacatattggacaatgtttacttgatgaaaataataatgattcaaaattaccattcaaagtgactctcaaaaacaaagctacaaaaatcgaaaatgatgtcccatgtcagcaaatattaactaatccttcatctcaacccaaaataaccaaaacaattgttaatgctccacctgttatagtaaaaaaaaatcaactgaaaaacaacaaaaatcaaaaaatagaaattaacaaccaatctgaaaaaatgaaaattaacaatcaacatgaaaaaataaaaattaacaatcaacccgaaaaaatagaaattgacaaccaacctgaaaaaatgcaaattagcaatcaatctgaaaaaatacaatctacccaaaaaaaacaagaagcagttcaagttaataaaatcacaaaaaaccaaaaaaaattagtgtttgaatctaaagtcaatagatatacaaaaatgagtattggtcaatgtttattaaatgataattaa

SEQ ID NO: 4602 - protein, 240 aa, Unknown
  Obtained from environmental sample
  misc_feature (1)..(240): Xaa is any amino acid
MRKLSLSKHTLALNLYKDEDYEIQDIKIPLGHQVKELEPFISEISDYLLQTDFQQSKFPSKYKNVDDEDDDPDRPQSLHIGQCLLDENNNDSKLPFKVTLKNKATKIENDVPCQQILTNPSSQPKITKTIVNAPPVIVKKNQLKNNKNQKIEINNQSEKMKINNQHEKIKINNQPEKIEIDNQPEKMQISNQSEKIQSTQKKQEAVQVNKITKNQKKLVFESKVNRYTKMSIGQCLLNDN

SEQ ID NO: 4603 - DNA, 852 bp, Unknown
  Obtained from environmental sample
  misc_feature (1)..(852): n is a, c, g, or t
ttgcaaaaaatattacttttattaattaaatttgattgttttacggtaatctactttaaaaaatatttaaaaatgtcattccatttgtcacttaataaacaaggatacataattaaaaaagattgtgtagataaccaaatcatcaaagatattaaaaaagatctaacagtcaaacctatagtgttaaaagcgtatcaagattttgttaaaccaactccttttcaaatttatcaagaaagtcctaattatttatatttgcctagatattatggaatcgaaaaatttggtattcctgttaacaattcattacctgaaggtcaaccaattgatattaaaattacttatgatgttttacctcatcaaaaaaccgcttatgaaaaatcacttcattgtctcaaagaaaatggtggtggagtcctatcaatattttgtggcggcggaaaatgcgtaggaaagggaacttcaattttgatgtacgacggcagcatcaaaaaagtagaagatgtaatagttggagatcaattaatgggagatgattcaaaaccaagaaatgttttggctttagccagaggacaagaagaaatgtttgaaattataccaataaaaggcgataaatgggtgtgtaatcgatctcatattttatcacttaaatgttcaactaattggactaaatcaatgacaaaaggatcactacatgatatctgtctaaatgatcttttaaaacttccaaaaagctttcatgagagaggtacaccattgcaattatataaagttggtaaccaatttccgtataaaccaaatccattaaatcctattgttaggatattgctaagtgatggcatagcatattag

SEQ ID NO: 4604 - protein, 283 aa, Unknown
  Obtained from environmental sample
  DOMAIN (157)...(282): Hom_end-associated Hint
  misc_feature (1)..(283): Xaa is any amino acid
MQKILLLLIKFDCFTVIYFKKYLKMSFHLSLNKQGYIIKKDCVDNQIIKDIKKDLTVKPIVLKAYQDFVKPTPFQIYQESPNYLYLPRYYGIEKFGIPVNNSLPEGQPIDIKITYDVLPHQKTAYEKSLHCLKENGGGVLSIFCGGGKCVGKGTSILMYDGSIKKVEDVIVGDQLMGDDSKPRNVLALARGQEEMFEIIPIKGDKWVCNRSHILSLKCSTNWTKSMTKGSLHDICLNDLLKLPKSFHERGTPLQLYKVGNQFPYKPNPLNPIVRILLSDGIAY

SEQ ID NO: 4605 - DNA, 732 bp, Unknown
  Obtained from environmental sample
  misc_feature (1)..(732): n is a, c, g, or t
atgtttgtaatggatatcaggaataatatactcgaaacgatcggcaataccccgatgataaggctcaataagatcacaaaaggatttccatgccctgttgttgcgaaagtcgactattttaatcccggtaattccatcaaagacaggatggcactgaaaatggttgaggtggcggaaaaggaaggaaaattgaaacccggcggtacgattatcgaaggcaccagtggcaacacaggtatgggtcttgcactggcggccgtggttaaaggttataaatgcatattcgtaaccaccgataagcaatccaaagaaaaagctgatatcctgaaagcggtcggcgccgaagtcattgtctgccccacgaacgtattgcccgaagaacccatgagctactacagtgtggccaaaaggctggcgctggagattcctaattcttatcatatgaaccactatgataaccttgccaaccggcttgcccattatgaaacaaccggaactgagatctggaaacagaccgatggtaaggtgacgcatgtcgtttgcacggcgggccacggaagcaccgttacgggtgttgcgcagttacttcagagaaaacaatccagttttaaaatttgccctatagatttttacgggatcttatttgacaaattacttcgtaccggcgaaatgatatggacgagttatcctatatttcgaagggtcgacaacacttgtccggtaactaaataa

SEQ ID NO: 4606 - protein, 243 aa, Unknown
  Obtained from environmental sample
  DOMAIN (10)...(242): Pyridoxal-phosphate dependent enzyme
  misc_feature (1)..(243): Xaa is any amino acid
MFVMDIRNNILETIGNTPMIRLNKITKGFPCPVVAKVDYFNPGNSIKDRMALKMVEVAEKEGKLKPGGTIIEGTSGNTGMGLALAAVVKGYKCIFVTTDKQSKEKADILKAVGAEVIVCPTNVLPEEPMSYYSVAKRLALEIPNSYHMNHYDNLANRLAHYETTGTEIWKQTDGKVTHVVCTAGHGSTVTGVAQLLQRKQSSFKICPIDFYGILFDKLLRTGEMIWTSYPIFRRVDNTCPVTK

SEQ ID NO: 4607 - DNA, 432 bp, Unknown
  Obtained from environmental sample
  misc_feature (1)..(432): n is a, c, g, or t
ttgtgcacaaaatgtgccaaaaatatttttttgtgccagatgggcacaaaaattaaaatacccatgaattcagattcaggtaaaaaattaaaaattaaagaagaatcaacaacggataataatatagtatttttgatcgatgaaaaagaatccacaaataatgaaatgagtatttttgagaatgtaagtttgtctagctgtaattttaaaaagagaattcggaaatataatgaaagttttttattatgtggattttattttaaacttgaaaactttgttcaacttccatattgtttaatctgtaaaaagacttttaaaaatagttctatggaaaaatccaaattaaataatcattataccaaccaacattcggatgtaactaacatgatgccaactaacgaattttttattgattcatttaaaaaaaaataa

SEQ ID NO: 4608 - protein, 143 aa, Unknown
  Obtained from environmental sample
  misc_feature (1)..(143): Xaa is any amino acid
MCTKCAKNIFLCQMGTKIKIPMNSDSGKKLKIKEESTTDNNIVFLIDEKESTNNEMSIFENVSLSSCNFKKRIRKYNESFLLCGFYFKLENFVQLPYCLICKKTFKNSSMEKSKLNNHYTNQHSDVTNMMPTNEFFIDSFKKK

SEQ ID NO: 4609 - DNA, 588 bp, Unknown
  Obtained from environmental sample
  misc_feature (1)..(588): n is a, c, g, or t
atgtgtccgatatctggaaatagcatattcttaagaatagctggcaaagatatagaggttagcaagaaaattattattgccctgagtcaagttaagggtttgggttacaatttatcacaagtcatactacaatcattaaatatcaatcctaacatgagaataggatttttaacagaaaaagaagtaagcgacattgagggcgcaataaaaaatccatcagtaatgggaattccaaattggtatcttaatagaagaaaggacagcgatacaggttcagacaagcatttgataacttctgatctcgattttactatttcaaatgatattgaaagggaaaaaacagtgtatagttggagaggctataggcatatgtttggacttagagtaaggggccagtgtacccgaactaccggaagaaaaggcggtgcagtgggtgtaaagaaggttgtaatgaggccaacaggtggcgctggagccccaggtgcagaagtaaaggacgccagtgccgctgcgccagcagtagaatctaccgcttccgagagtggcgcaaaaagcagtacaccaaaaccttcggaaactaaagagtag

SEQ ID NO: 4610 - protein, 195 aa, Unknown
  Obtained from environmental sample
  DOMAIN (12)...(140): Ribosomal protein S13/S18
  misc_feature (1)..(195): Xaa is any amino acid
MCPISGNSIFLRIAGKDIEVSKKIIIALSQVKGLGYNLSQVILQSLNINPNMRIGFLTEKEVSDIEGAIKNPSVMGIPNWYLNRRKDSDTGSDKHLITSDLDFTISNDIEREKTVYSWRGYRHMFGLRVRGQCTRTTGRKGGAVGVKKVVMRPTGGAGAPGAEVKDASAAAPAVESTASESGAKSSTPKPSETKE

SEQ ID NO: 4611 - DNA, 627 bp, Unknown
  Obtained from environmental sample
  misc_feature (1)..(627): n is a, c, g, or t
atggcatttaacgaaaatacacgcgtaaagatacctgcaatattgcatttttgccgccttggttatacctatcttcccttgaagaacatcacctgggatgaaagcagcaacattatccccgatattttggtagaaagcctgaaaagaattaataagaaaattactccagatgagataaataaaacacttcaagagatttctttagccttggataatgatgacctagggcagattttttatcagaaactaatatccgggtcaaatgtaaaattaatcgattttaatgatctcgcgaataattcatatcacgtagtaaccgaactaacctgtaaaaatggtgaagatgaattcaggccagacataacactgttcgtaaatggcttacctctcgcttttgtcgaagttaaaaagccaaacaataaagaaggaattcttgcagaaagagagcgcataaatatgcgctttaaaaacaagaaatttaacgatttattaatattacccaactcctcgtatttacgaacaaacatggagtatgacttcagaatcaattgtgcctatccaggctgctttttattgctaccgcagcctatcaaaatgccgaatttatttgctttaggaaagaattag

SEQ ID NO: 4612 - protein, 208 aa, Unknown
  Obtained from environmental sample
  DOMAIN (2)...(182): Type I restriction enzyme R protein N terminus (HSDR_N)
  misc_feature (1)..(208): Xaa is any amino acid
MAFNENTRVKIPAILHFCRLGYTYLPLKNITWDESSNIIPDILVESLKRINKKITPDEINKTLQEISLALDNDDLGQIFYQKLISGSNVKLIDFNDLANNSYHVVTELTCKNGEDEFRPDITLFVNGLPLAFVEVKKPNNKEGILAERERINMRFKNKKFNDLLILPNSSYLRTNMEYDFRINCAYPGCFLLLPQPIKMPNLFALGKN

SEQ ID NO: 4613 - DNA, 462 bp, Unknown
  Obtained from environmental sample
  misc_feature (1)..(462): n is a, c, g, or t
atgaaagtgcataatgactttaatttaaatgaaatactttggtacaaaattggaggaagagcaaggctttatatagaagtagaaaacaagaatgatgttaaggaggctttcgaccttattaaaaaagaaaaaatcaacaaatacttctttttaggccttggttctaatctcattttctctgatgaatattacgatggagctattattaaattcgttcctgggactgaacctattagattagtaaagcctcacattatagaagctgatgcgggagtggtcttagatgatgttattagattttcatttgaccataatttatccggacttgagtgggcaggagggttacctggggatgttggagcagccgtacgggggaatgttggagcttttggcggagaaataaaggatgtagtaaaagaagtagaagtttntgacattgtaaacaacaagcccaaaatttaa

SEQ ID NO: 4614 - protein, 153 aa, Unknown
  Obtained from environmental sample
  misc_feature (1)..(153): Xaa is any amino acid
MKVHNDFNLNEILWYKIGGRARLYIEVENKNDVKEAFDLIKKEKINKYFFLGLGSNLIFSDEYYDGAIIKFVPGTEPIRLVKPHIIEADAGVVLDDVIRFSFDHNLSGLEWAGGLPGDVGAAVRGNVGAFGGEIKDVVKEVEVXDIVNNKPKI

SEQ ID NO: 4615 - DNA, 762 bp, Unknown
  Obtained from environmental sample
  misc_feature (1)..(762): n is a, c, g, or t
ttgctaggtgaattaaatgtcaaattacctagtatggagagaagaaanacattcttgacaaaaaaagtaaatatcaccagctcacgctttgatcctttcttccaccaactttattttaccaaatacgnaaaggcgctgttgcaatgtaatgctgatgttcacagaatgaaagatgtgataaaattcattgatagtggaagccggcctcaaggtggagtttcaggtgcagaagttggcattttgagtataggtggcgaacacataaataatctttgtgaaattgatacctctaatcctaaatacatcacagaagagtttcatcaaggaataaaaaggacacaaacaaaacttaatgacatccttcttgtgaaagatggagcaacaacaggcaaaattgggattgtaaaagaaaaaaaacacattggacagaacattaacgaacacttatttcttatccgcacgaagggaaatatcattcctgaatatttactctattatttacgtagccaatttggacaaacttttattaagcggattattacaggtgcgactgtaactgggttaacaaaaggggtagtaagacatttaaaaattcctttgccatccatagaaaagcagatggttattgttaaagagatatttgatatcagagaaaaagttaaaaaattacaagccgaagccaaatcaaatttagaaaaggcgaaacgggaaattgaaaaatattttacaatcaaattaaattatgatantnagagtcagtaa

SEQ ID NO: 4616 - protein, 253 aa, Unknown
  Obtained from environmental sample
  DOMAIN (51)...(218): Type I restriction modification DNA specificity domain
  misc_feature (1)..(253): Xaa is any amino acid
MLGELNVKLPSMERRXTFLTKKVNITSSRFDPFFHQLYFTKYXKALLQCNADVHRMKDVIKFIDSGSRPQGGVSGAEVGILSIGGEHINNLCEIDTSNPKYITEEFHQGIKRTQTKLNDILLVKDGATTGKIGIVKEKKHIGQNINEHLFLIRTKGNIIPEYLLYYLRSQFGQTFIKRIITGATVTGLTKGVVRHLKIPLPSIEKQMVIVKEIFDIREKVKKLQAEAKSNLEKAKREIEKYFTIKLNYDXXSQ

SEQ ID NO: 4617 - DNA, 765 bp, Unknown
  Obtained from environmental sample
  misc_feature (1)..(765): n is a, c, g, or t
ttgtcgaagggcgaagtaatttacaggctagagcccaaattttatacaaaagaatttagagtcaatgaagagcgaattagaaactcaaagtatccaattcgtaaacttagggaagtcactcttaaaataagtgatggaacccactttacgccagaatatcagcaagatggtgtgaaatttctcagtgttaaagatgttcgtcaatttaaaataaactacaacgattcaaaatacttattagagaatgatgcaaacgcattagacagaaggtgcaaaccaactcctggtgatattcttttaactaaaataggcgcaacttatggttatgcagcgcagataaaagaggaaaaaagatttcaaatatttgtgtctttagcacttcttcgcccaaataaaaaaattatttcctctgactatcttgaagtttatcttaatacttcactcgcttatcttcaatataaaagagtcataaaaggtgctggtgttcctgatttgcatttagaagatatagatcgtgttctgatcccgatccctgaattgagcgttcaagagaaaataacttcaactttttttaaaacttacaacgagacaattagaatggagcaagaggccgaacaaattcttggcagtattggatattttttgctaggtgaattaaatgtcaaattacctagtatggggagaagaaaaactttcttgacaaaaaagttaatatcaccagctcacgccttgacccttccttcccccactttnttttaccaattn

SEQ ID NO: 4618 - protein, 255 aa, Unknown
  Obtained from environmental sample
  DOMAIN (31)...(195): Type I restriction modification DNA specificity domain
  misc_feature (1)..(255): Xaa is any amino acid
MSKGEVIYRLEPKFYTKEFRVNEERIRNSKYPIRKLREVTLKISDGTHFTPEYQQDGVKFLSVKDVRQFKINYNDSKYLLENDANALDRRCKPTPGDILLTKIGATYGYAAQIKEEKRFQIFVSLALLRPNKKIISSDYLEVYLNTSLAYLQYKRVIKGAGVPDLHLEDIDRVLIPIPELSVQEKITSTFFKTYNETIRMEQEAEQILGSIGYFLLGELNVKLPSMGRRKTFLTKKLISPAHALTLPSPTXFYQX

SEQ ID NO: 4619 - DNA, 831 bp, Unknown
  Obtained from environmental sample
  misc_feature (1)..(831): n is a, c, g, or t
ttgaattctttggatatcgccatgggtcgtgatattcgcgtagtattagtcaagctcgctgatcgattgcataatatgcgcaccctcaatcacatgcctgtagatagacaaatcgtcatcgctcaagagactctcgatatttatgcgccactagcaaacagacttggtatcagctgggtaaaaatagaacttgaagatttaagtctacgctatttgaagccagaaatttattacaagttagtccaaaaggtctctaagaagaaaaaagaacgagaaaaatacatcaatgaagtcatcaacgacatcgaagcagatcttaaaaaagaaggcatcaaggcagaaattcacggcagaccaaaacatttctattcgatctataaaaaaatggaagccagtaacatcgattacgaacaagtttatgatgttttggctttccgcgttctcgtcaatagcgtcgtgcaatgttacgaagttttaggtgtcgttcataatctttggaagcccattcctggaagattcaaagacttcatcgccatgcccaaggctaataactatcaaagtttgcacacgacagtaattgggcccggaggcgagagagttgaaattcaaattagaacccatgaaatgcatctcactgccgagcgtgggattgccgcacactggaaatataaagagggtggtggcattgataaagaaacagaaaaacgatttgaatggctccatcaattattgcaatggcatcaacaactcaaagatccttctgaattnttagagacaatcaagacagacttatttgccggtgacatttacgttttcacgcctcaagggnng

SEQ ID NO: 4620 - protein, 277 aa, Unknown
  Obtained from environmental sample
  DOMAIN (117)...(227): Region found in RelA / SpoT proteins
  misc_feature (1)..(277): Xaa is any amino acid
MNSLDIAMGRDIRVVLVKLADRLHNMRTLNHMPVDRQIVIAQETLDIYAPLANRLGISWVKIELEDLSLRYLKPEIYYKLVQKVSKKKKEREKYINEVINDIEADLKKEGIKAEIHGRPKHFYSIYKKMEASNIDYEQVYDVLAFRVLVNSVVQCYEVLGVVHNLWKPIPGRFKDFIAMPKANNYQSLHTTVIGPGGERVEIQIRTHEMHLTAERGIAAHWKYKEGGGIDKETEKRFEWLHQLLQWHQQLKDPSEXLETIKTDLFAGDIYVFTPQGX

SEQ ID NO: 4621 - DNA, 357 bp, Unknown; identical to SEQ ID NO: 3121
  Obtained from environmental sample
  misc_feature (1)..(357): n is a, c, g, or t

SEQ ID NO: 4622 - protein, 118 aa, Unknown; identical to SEQ ID NO: 3122
  Obtained from environmental sample
  misc_feature (1)..(118): Xaa is any amino acid

SEQ ID NO: 4623 - DNA, 591 bp, Unknown
  Obtained from environmental sample
  misc_feature (1)..(591): n is a, c, g, or t
gtgcataactcttcaccaatgaaaaatcttttaattctttttgcctcttttattttgagttctgtttcttttgctcaaacaagtgtgaacaaacttcctactattgacaaatcgccaatggacatggcgtactaccctatcaattacccggttttaaaaattcaggataaggccactggacctttgattgcacgggttatatatagccggccgcaaaaaaacaaccgtgtagtatttggcgagctggtagaatataatactgtttggcgcatgggagcaaacgaggccactgaaatagagttttatcgggatgtaaaaattggcggtaaaaaaattttaaaaggaaagtataccttatatgcccttgtaaccccaaatgagtggacagtaattttgaataaagaaacggatacctggggcgcattcaaatacgatcagaaaaaagatgttgttcgaacaaccgttcctgtgcaacaaaatatggagcctgcggaagtatttacggtattttttgaaaagataaccaacggcattaatttaaatattgcatgggacacggtacttgtttcattgccaatactattgaaataa

SEQ ID NO: 4624 - protein, 196 aa, Unknown
  Obtained from environmental sample
  SIGNAL (1)...(21)
  misc_feature (1)..(196): Xaa is any amino acid
MHNSSPMKNLLILFASFILSSVSFAQTSVNKLPTIDKSPMDMAYYPINYPVLKIQDKATGPLIARVIYSRPQKNNRVVFGELVEYNTVWRMGANEATEIEFYRDVKIGGKKILKGKYTLYALVTPNEWTVILNKETDTWGAFKYDQKKDVVRTTVPVQQNMEPAEVFTVFFEKITNGINLNIAWDTVLVSLPILLK

SEQ ID NO: 4625 - DNA, 384 bp, Unknown; identical to SEQ ID NO: 2781
  Obtained from environmental sample
  misc_feature (1)..(384): n is a, c, g, or t

SEQ ID NO: 4626 - protein, 127 aa, Unknown; identical to SEQ ID NO: 2782
  Obtained from environmental sample
  misc_feature (1)..(127): Xaa is any amino acid

SEQ ID NO: 4627 - DNA, 306 bp, Unknown
  Obtained from environmental sample
  misc_feature (1)..(306): n is a, c, g, or t
atgcttaaaaaagaagcccggaattgtttcaagcaaaaacgctacaccatttcgccaaccgataaacagaaatgggacgatttgttattgatacaatttcaaaccatcgatctcccttttcttgattatgttttgagtttttatcccattgagcaaaataatgaggtcaatgcttttttaattacagattatttgcacttcaaaaatcctaatcttcagatctgctatccaaagaccaacttaaaagattgcactatgcaggcagtcatttgcaatgctgattctatattcgaggcaaatgaataa

SEQ ID NO: 4628 - protein, 101 aa, Unknown
  Obtained from environmental sample
  misc_feature (1)..(101): Xaa is any amino acid
MLKKEARNCFKQKRYTISPTDKQKWDDLLLIQFQTIDLPFLDYVLSFYPIEQNNEVNAFLITDYLHFKNPNLQICYPKTNLKDCTMQAVICNADSIFEANE

SEQ ID NO: 4629 - DNA, 558 bp, Unknown
  Obtained from environmental sample
  misc_feature (1)..(558): n is a, c, g, or t
ttggatttagttgcttccgcactgctgcttgttgtttggtcaagttggctctttcctttaatgcccttccttataaaatcagattcaaangggccggttttcttttntcagaaaagaaataaaaagaatggagggcttttaatctgcattaagttcagaacaatggttgtaaatgataaagccgatgttttgcccgcagcagaaaatgatagccgcattaccagggttggtgcatttttaagaagacatcatttggatgaactgccccagttgtttaatgttttattgggtgatatgtctatgatcggtccgcgtccttatatggtaaatgacaatgagaaatatgagaagcttataaaaaattacctcgtgcggcatagaataaagccgggaataacaggcctcgcacaggtgatcgactatgttgctcctgttacttcgattgagtatatggaacgaagggtaaataaagatgtgtactatgtttataactggtcgccggtgctcgatgccaaaattatcatccgtactttatttaaaatggttggtgtaaaataa

SEQ ID NO: 4630 - protein, 185 aa, Unknown
  Obtained from environmental sample
  DOMAIN (1)...(185): Bacterial sugar transferase
  misc_feature (1)..(185): Xaa is any amino acid
MDLVASALLLVVWSSWLFPLMPFLIKSDSXGPVFFXQKRNKKNGGLLICIKFRTMVVNDKADVLPAAENDSRITRVGAFLRRHHLDELPQLFNVLLGDMSMIGPRPYMVNDNEKYEKLIKNYLVRHRIKPGITGLAQVIDYVAPVTSIEYMERRVNKDVYYVYNWSPVLDAKIIIRTLFKMVGVK

SEQ ID NO: 4631 - DNA, 369 bp, Unknown
  Obtained from environmental sample
  misc_feature (1)..(369): n is a, c, g, or t
gtggatacattcatttttaaattaatctttcaaatggaaccatcagcaaaatcaaaaatcagacttggattattcattctaacagcagcgttgctttttgtaggagcagtcttttatctgggcaaaaagaaaaacctgttcaccgctacttttaatgtgcacggtactttcaggaatgtaagcgggttgcagttgggaaacaacgtaaggtttgccggaattacagtgggtacgattgggaacatagtaatcctgagtgataccagcgtaaaggtggaaatggtaatcgaaaacagtacgaaaaaatttatcaaaaaggattcatatgccaccatcggatcagaagggttaatgggcgacagggtgtaa

SEQ ID NO: 4632 - protein, 122 aa, Unknown
  Obtained from environmental sample
  DOMAIN (20)...(122): mce related protein
  misc_feature (1)..(122): Xaa is any amino acid
MDTFIFKLIFQMEPSAKSKIRLGLFILTAALLFVGAVFYLGKKKNLFTATFNVHGTFRNVSGLQLGNNVRFAGITVGTIGNIVILSDTSVKVEMVIENSTKKFIKKDSYATIGSEGLMGDRV

SEQ ID NO: 4633 - DNA, 468 bp, Unknown
  Obtained from environmental sample
  misc_feature (1)..(468): n is a, c, g, or t
atgacctttttcgagcggataaaaataattgcaagaaattttaaatccagaaagtacggttattttggagattatgataattggcgtatagcacaacaatattgtgctggttacgaagctgagaatattttggagaagataaaaacctcaactttagaagtgaaaaatggcaaagccgtatttgaaagagattctgttatttttgagaaaattcaatattcgtggccgttattaagtgcattaatgtgggtagcagctttaaataaaggaaggataaatgtgatagactttggaggctcattgggcagctcttactttcaaaataaacaatatttagatacgctgtctagtgtgaaatggaatattattgagcaagcccctttcataaaatacggtcaggagtcaattcaagacgataggcttcaatttttttattccgttgaagatgcaattagagtaaatggcctn

SEQ ID NO: 4634 - protein, 156 aa, Unknown
  Obtained from environmental sample
  misc_feature (1)..(156): Xaa is any amino acid
MTFFERIKIIARNFKSRKYGYFGDYDNWRIAQQYCAGYEAENILEKIKTSTLEVKNGKAVFERDSVIFEKIQYSWPLLSALMWVAALNKGRINVIDFGGSLGSSYFQNKQYLDTLSSVKWNIIEQAPFIKYGQESIQDDRLQFFYSVEDAIRVNGL

SEQ ID NO: 4635 - DNA, 729 bp, Unknown
  Obtained from environmental sample
  misc_feature (1)..(729): n is a, c, g, or t
ttgtggtatgatttacagtttactactcgggnttatccaaaatnacagtcaggttgtttntcaagtttcttnncaaggtananaggaagggtgaaacattcctttctgaataaacctttattgattgtagccaatcatcccagtacttttatggatcctatcgtaatggcaatcgcagccaatcgcaaaatacattttatagcaaaaggagaagcttttcgttccaaattcgctaaatggattttacctaaattcaatatgattccgatttatagaaaagnacatgatccgcatttgacccataagaatgatgaaacatttgaaaaggtttttgagatactggaaaagggcggagcggtgattatttttccggagggaatcagtatcaccgatcgtattttgaaaaaattgaaatcaggcacgatgcgcatggctttaggtgctgaagcccgtaatgattttaaattggatgttcatattttaccaatgggactgaatttttctaatcctcatcgtttcagaagtaaagttgaaattcgtatcggttatccgattccggtgaaagaatacaaagagatatttttgaaagataatatgaaaggaatccatgaattgaaagagcgggttcgtatttccattgaaggcttgattttctgtgtggattctcccgatacagatcagttgatttgcaagaatagaatctatttacaaaagaaattatttggataa

SEQ ID NO: 4636 - protein, 242 aa, Unknown
  Obtained from environmental sample
  DOMAIN (26)...(166): Acyltransferase
  misc_feature (1)..(242): Xaa is any amino acid
MWYDLQFTTRXYPKXQSGCXSSFXXRXXGRVKHSFLNKPLLIVANHPSTFMDPIVMAIAANRKIHFIAKGEAFRSKFAKWILPKFNMIPIYRKXHDPHLTHKNDETFEKVFEILEKGGAVIIFPEGISITDRILKKLKSGTMRMALGAEARNDFKLDVHILPMGLNFSNPHRFRSKVEIRIGYPIPVKEYKEIFLKDNMKGIHELKERVRISIEGLIFCVDSPDTDQLICKNRIYLQKKLFG

SEQ ID NO: 4637 - DNA, 564 bp, Unknown
  Obtained from environmental sample
  misc_feature (1)..(564): n is a, c, g, or t
atgggcattcacctcatgctgaccggcgacttacatttctttgaagaatcaaatgagcggaaatcgaccattgtagagttgcggtttaaagatggcaccggcctggcgcttactgaccgtatgaaaaatgctaacgttaaattgaatcctgttgacaaagcgggcattgatgcacttgacatcaattataaaacgctcaaagaaattttaaaccgaaaagcggtcatcaaaaatgttcttttggaccaggatatcatacaaggcatcggcaattcttattccgacgagattttgtggcaaacaagaatttcaccattctcaaaagcgaatgccatacctgatgaaaaaatcaaggaattggctaccactataaagaaagttttaaaagcggccactgaaaaaatttacaaaaatcatcctggcaagattaatagcgaggtgaaagactacctgcaaattcacaccaagaagaaagcagaaagccccaccggcaaaccaatactcactgcagagcgaggcatgcttttgacttactatacggatgagcagattttgtatgagtga

SEQ ID NO: 4638 - protein, 187 aa, Unknown
  Obtained from environmental sample
  DOMAIN (54)...(151): Formamidopyrimidine-DNA glycosylase H2TH domain
  misc_feature (1)..(187): Xaa is any amino acid
MGIHLMLTGDLHFFEESNERKSTIVELRFKDGTGLALTDRMKNANVKLNPVDKAGIDALDINYKTLKEILNRKAVIKNVLLDQDIIQGIGNSYSDEILWQTRISPFSKANAIPDEKIKELATTIKKVLKAATEKIYKNHPGKINSEVKDYLQIHTKKKAESPTGKPILTAERGMLLTYYTDEQILYE

SEQ ID NO: 4639 - DNA, 678 bp, Unknown
  Obtained from environmental sample
  misc_feature (1)..(678): n is a, c, g, or t
atgggatacggcaacaaccaggaattcagaaaggggtatttcggtttttcagaagatgatactgattctgtttacttatcagacaagaaaattattaaattatcgagacatgatttcagcaataacaaaacccttgagcaggtacgggacatgtttgtgttcggttcatttatcgggctcaggcatagcgatacaatttccatcggaccagaaaacattgtaaacatagacggggacttatttataaaaacaataaccaaaaagacaaatgatctagtgattgttccttgcaatcccattgtattaaaaatatttgagaggtatgaaaacaatccgaaccgtttacccaaagcctataagaatcaagtcttcaatcgatacataaaacaggtttgtaaaatagctggattaacagaaaaaggaagactttcaacaaaaccagaaaaagaactttgggaagctgtttctagtcatacttgtcgccgttcatttgctacaaatctctatttggatggatatcctgtaagcgagatcatgaagtgcacgtcacacaaaactgaaaaagctttttggaaatatattaaagtaagtaaacttgatagtgccaagagattaattaaacaccaaaaagcaaattggttcgaaaagattgcacaggttgaaaaagcagttgcttaa

SEQ ID NO: 4640 - protein, 225 aa, Unknown
  Obtained from environmental sample
  DOMAIN (26)...(203): Phage integrase family
  misc_feature (1)..(225): Xaa is any amino acid
MGYGNNQEFRKGYFGFSEDDTDSVYLSDKKIIKLSRHDFSNNKTLEQVRDMFVFGSFIGLRHSDTISIGPENIVNIDGDLFIKTITKKTNDLVIVPCNPIVLKIFERYENNPNRLPKAYKNQVFNRYIKQVCKIAGLTEKGRLSTKPEKELWEAVSSHTCRRSFATNLYLDGYPVSEIMKCTSHKTEKAFWKYIKVSKLDSAKRLIKHQKANWFEKIAQVEKAVA

SEQ ID NO: 4641 - DNA, 420 bp, Unknown
  Obtained from environmental sample
  misc_feature (1)..(420): n is a, c, g, or t
atgaaaagaatgataataataacaggaatgcttgccttcttagggacaacagggtttggccagcaaaaaaagctcaaagatctgatcggtctttgggaaatagtaggtgagcaaaatgacagtgccagtcttgaagtgattgacagctcgacaataatcctaaaatatatgggagagaaaaaaaagatcattgattataaaattgatttccaaaaatctcccatctggtttgatttctcgacgggcgatagtagcacagtcgttttggtgaaaagtcttttggagatcatgaatgataacatgatcaaatggcagcttttcgttgatgaagaccgtacggatcatttctcgtcaaccaaagaagaattatattatttgcgaaaagtaaacaacaacacagtagtcattcttgatcactag

SEQ ID NO: 4642 - protein, 139 aa, Unknown
  Obtained from environmental sample
  SIGNAL (1)...(20)
  misc_feature (1)..(139): Xaa is any amino acid
MKRMIIITGMLAFLGTTGFGQQKKLKDLIGLWEIVGEQNDSASLEVIDSSTIILKYMGEKKKIIDYKIDFQKSPIWFDFSTGDSSTVVLVKSLLEIMNDNMIKWQLFVDEDRTDHFSSTKEELYYLRKVNNNTVVILDH

SEQ ID NO: 4643 - DNA, 648 bp, Unknown
  Obtained from environmental sample
  misc_feature (1)..(648): n is a, c, g, or t
ttgaaccgcgttactgatacctgtatccgggaagaagaagctttcagacgaattcaacgtcatatccacaagcttggaaagaagcaggatgaaaaaggagaacgttattttccacatgagtatatgtacaaattattattaagtggcgtaatgaaacaagattaccagatcgatgccaaaaacagttggatgattgctgccgcagaaaagaatttgccgatcgtagtgggaggttgggaagacagtacaatgggaaatatttttgcatcctacgtttataaagaagaaataaaggcctctaccatgaagagtggaattgagtatatggtatggcttgccaattattataaagataatagtgctggcaaaggcattggcttcttccaggtaggtggtggtattgctggcgactttccaatttgcgtggtgcctatgatgtaccaggatttagaaatgcacgagatccctttctggacatatttctgccagatatcagattctactacttcttatggttcttattcaggagcacacccaaatgaaaaaattacctggggcaaattggatatacatacaccaaaatatattatagaaagcgatgcaacgattgtagcgccactagtatttgcatgggtgcttggctggtaa

SEQ ID NO: 4644 - protein, 215 aa, Unknown
  Obtained from environmental sample
  misc_feature (1)..(215): Xaa is any amino acid
MNRVTDTCIREEEAFRRIQRHIHKLGKKQDEKGERYFPHEYMYKLLLSGVMKQDYQIDAKNSWMIAAAEKNLPIVVGGWEDSTMGNIFASYVYKEEIKASTMKSGIEYMVWLANYYKDNSAGKGIGFFQVGGGIAGDFPICVVPMMYQDLEMHEIPFWTYFCQISDSTTSYGSYSGAHPNEKITWGKLDIHTPKYIIESDATIVAPLVFAWVLGW

SEQ ID NO: 4645 - DNA, 663 bp, Unknown
  Obtained from environmental sample
  misc_feature (1)..(663): n is a, c, g, or t
ttgatacaaattcaatataaattctttataggcgatgatagaattacaaaagctggttacaatcataaactcttcataaaactggttcacgagcaattaactttgcaggccatgacgcaatttccacacgatagtattaagcctttttcgcaggaaggtaaaaagaaagaacaggtgggtaagatgtttgacagcattgccggcaagtacgattttatgaactggtttttaagtgccggtattgataaaagctggcgcacaagggccattgaagaattaatcagtgacaatccacagcatattttagatgtggccacaggaacgggtgacatggctatacgggcagctaaaattttggatccgcaaaaaattacggggatagatatttcggaaaaaatgctggaaataggaagaaagaaagttgatacagaagggttaacaaacataattgagttacagagtggagatagcgagacaataaaatttcccagtaatacgtttgatggcgtgatggtggcgtttggtgtgcggaatttcgaaaacctgcaactggggttgacagaaattttaagagtaatgaagccaggagctaaactggtggtacttgaatttagtaagccaaaagcaggattaataaaccattatacattcttgatcagctag

SEQ ID NO: 4646 - protein, 220 aa, Unknown
  Obtained from environmental sample
  DOMAIN (51)...(218): ubiE/COQ5 methyltransferase family
  misc_feature (1)..(220): Xaa is any amino acid
MIQIQYKFFIGDDRITKAGYNHKLFIKLVHEQLTLQAMTQFPHDSIKPFSQEGKKKEQVGKMFDSIAGKYDFMNWFLSAGIDKSWRTRAIEELISDNPQHILDVATGTGDMAIRAAKILDPQKITGIDISEKMLEIGRKKVDTEGLTNIIELQSGDSETIKFPSNTFDGVMVAFGVRNFENLQLGLTEILRVMKPGAKLVVLEFSKPKAGLINHYTFLIS

SEQ ID NO: 4647 - DNA, 732 bp, Unknown
  Obtained from environmental sample
  misc_feature (1)..(732): n is a, c, g, or t
atgaaaaaaattaagatatgccatatctcaacgtatgaagggggaggggctggaacggctgcagtccgactacataaaggattgatctcagaagatattgactcgagttttgtttgtgcgtaccttaccggcaataacgaaaacgtttatcgatgctcacaaattttgcatcctagatggaagagtgttttgcaaaaggttaacctatatagaggtgtagtaaaaaaagaaagggaagctgtaattcgaagccaaggttcttacgattacttcagcatacctttttcagattatagggtagaaaatcatgctaaggttcttgaggcagatatcattcatttgcattggattgcggattttgtaaattattcgagtttttttgaaactgtcaacaagcctatcgtgtggacatttcacgacatgaatccatttatgggtggatttcactaccaaggtgatcttgagaagaataggcacaatgccgaaataataaatcttgagaacaggtatattaagcagaaagaggatattctctcaaaaagcgaatctattgaggtagtgacaccttctaaatggctatatgaggcgtcaagtaaaagcaacgtaactgggcgattttctcatcattacgtgccatattggctggatacaaatctttttaagcctataccaaaggatacttcgcgtgaaatattcgggttgcccaaggataaaaaatcattgtgtatgtga

SEQ ID NO: 4648 - protein, 243 aa, Unknown
  Obtained from environmental sample
  misc_feature (1)..(243): Xaa is any amino acid
MKKIKICHISTYEGGGAGTAAVRLHKGLISEDIDSSFVCAYLTGNNENVYRCSQILHPRWKSVLQKVNLYRGVVKKEREAVIRSQGSYDYFSIPFSDYRVENHAKVLEADIIHLHWIADFVNYSSFFETVNKPIVWTFHDMNPFMGGFHYQGDLEKNRHNAEIINLENRYIKQKEDILSKSESIEVVTPSKWLYEASSKSNVTGRFSHHYVPYWLDTNLFKPIPKDTSREIFGLPKDKKSLCM

SEQ ID NO: 4649 - DNA, 510 bp, Unknown
  Obtained from environmental sample
  misc_feature (1)..(510): n is a, c, g, or t
atgggtcgtaatctaaacacagactttgttttggcagaactcgaacaaaataatagttcccacatatacctattgaaccaaaccctgaaaaattgtattgacgattttgtagaaggatacaacatttgggaaacaagcaaaggtgaacttattaataaaatggcactaacattagaaaaacttcatttcctgggtgaatatcctgacgcattaaacacaatttcaacttatattaaaaaacaattagcagctcgtggcgtctctgaaggacaattaaattatgtccaaaaagttttaccatcaaaatataaaaatgaaaatttagctcgtgatcaaagtggcgataatattatcgccgattctggatctgaaataagatcagtagaagaacaaccagaagtaccaacagttaatatctattctctcaagaaaaaattagaaaattattcaccaactgaattaccgagattatgcttcaggattagaacaaaaacaaaaacatatccgtag

SEQ ID NO: 4650 - protein, 169 aa, Unknown
  Obtained from environmental sample
  misc_feature (1)..(169): Xaa is any amino acid
MGRNLNTDFVLAELEQNNSSHIYLLNQTLKNCIDDFVEGYNIWETSKGELINKMALTLEKLHFLGEYPDALNTISTYIKKQLAARGVSEGQLNYVQKVLPSKYKNENLARDQSGDNIIADSGSEIRSVEEQPEVPTVNIYSLKKKLENYSPTELPRLCFRIRTKTKTYP

SEQ ID NO: 4651 - DNA, 369 bp, Unknown
  Obtained from environmental sample
  misc_feature (1)..(369): n is a, c, g, or t
atgttaaaaaataactttttctttccggttggttcaataaccggggatgatggaactattaaggccaccatccgtctcataaaaactcaccctatttttgcaggtcatttccccggtttgccgatagtacccggggtatgcatgatggctatgattaaggaagttcttgaggaaaaagtaaatcgaccccttcaactgcaaactgcagccaatatcaaattcctttcattgattgatcccatgaaaaatgaacaggtggatattgaaataaaatataaaaaagctgagggtgattcctttatttcagatgggatcattgtcgtgaataatcatgtgttctttaaaattaccggggcagtttaccattaa

SEQ ID NO: 4652 - protein, 122 aa, Unknown
  Obtained from environmental sample
  misc_feature (1)..(122): Xaa is any amino acid
MLKNNFFFPVGSITGDDGTIKATIRLIKTHPIFAGHFPGLPIVPGVCMMAMIKEVLEEKVNRPLQLQTAANIKFLSLIDPMKNEQVDIEIKYKKAEGDSFISDGIIVVNNHVFFKITGAVYH

SEQ ID NO: 4653 - DNA, 336 bp, Unknown
  Obtained from environmental sample
  misc_feature (1)..(336): n is a, c, g, or t
gtgcaaatacgtgtacgggtagaaaaaataatatcagggaaaaccgcttcatctattgattgcaagataaagcgtaaatattctaatcaaaaactagtaaaaacaattaactattttaagttttctaattcttcagcggtaaaagaattttgccgtcccttgtgtttagcccttattgcctttatatcttcttcatttaatttttctgctttgttgttccaggaattgcgaataaaacttaatagttgtgcaatgtcgacatcagaaaattcttgttctcaaaaatgcccggcttgtcgccatttatttcaggtgctttgtaaactctggcattga

SEQ ID NO: 4654 - protein, 111 aa, Unknown
  Obtained from environmental sample
  misc_feature (1)..(111): Xaa is any amino acid
MQIRVRVEKIISGKTASSIDCKIKRKYSNQKLVKTINYFKFSNSSAVKEFCRPLCLALIAFISSSFNFSALLFQELRIKLNSCAMSTSENSCSQKCPACRHLFQVLCKLWH

SEQ ID NO: 4655 - DNA, 672 bp, Unknown
  Obtained from environmental sample
  misc_feature (1)..(672): n is a, c, g, or t
atgcatccacacattcagaaattattgaagtgtattgacctgcaggagaaagagcaggcacagcgttaccggctggatcagcaacatacgctgaaagtcttaaaagccgaagggcttgcattgcatcctgttatcgttacccgcaaaaattttggttatgccgattaccccgagatcagttttaagctggggttcccacctgaggcaaatttgttcaaagatggggcagccattgactgttttgttgcaggggaagaacccgtcaaaggagttttgctaagccttgaagggttgagtggtgaattccgcctgtttgcgccggactatccggactggattgaagatgatggcgtcggcatcaagctggcgccggacacccgtacctccgccattatgaaaaaagtgctgaatgaattagaaaccaatcgatcgctgttcaaattatttgagcaatttcacgatgataagcaaacaacgtctcccgcatcgtcgttgaaaaatagccccgtcaactttcgaaatcaacaattgaatcaaagtcagcaacggtctgtatcggcaattttgcaaaacgaacagatcacgatcgttcacggtccggccggaacgggaaaaactacaacacttatcgaagccatcatccaattgatcaggaatgaggaaaaggtgtag

SEQ ID NO: 4656 - protein, 223 aa, Unknown
  Obtained from environmental sample
  misc_feature (1)..(223): Xaa is any amino acid
MHPHIQKLLKCIDLQEKEQAQRYRLDQQHTLKVLKAEGLALHPVIVTRKNFGYADYPEISFKLGFPPEANLFKDGAAIDCFVAGEEPVKGVLLSLEGLSGEFRLFAPDYPDWIEDDGVGIKLAPDTRTSAIMKKVLNELETNRSLFKLFEQFHDDKQTTSPASSLKNSPVNFRNQQLNQSQQRSVSAILQNEQITIVHGPAGTGKTTTLIEAIIQLIRNEEKV

SEQ ID NO: 4657 - DNA, 435 bp, Unknown
  Obtained from environmental sample
  misc_feature (1)..(435): n is a, c, g, or t
gtgaagaaggaaaagacatataaaaccaatgaagaccttgaaaaggaattggaagagttgcgtcatcaactcgacgaagcaaatgaaaccattgaagctatccgcacaggccaggtagatgcgttggttgttcgcagtgataatggcccccagctttatactttaaaaacggctgatttaacctaccggatatttattgagaaaatgaccgaaggcgctgtaacgctgaatctccagggaattattgtttattgcaattcgcagtttgccaggatggtggaacttccgttatcaaaggttatcggtttttcatttgagcaatttatagccctcgaaaacagagcacaatatgccgtgcttttcaaaaaatgttgggaaattgatggtaaaggcgaagtttactccttactgctgagagcaacgccgtacagttaa

SEQ ID NO: 4658 - protein, 144 aa, Unknown
  Obtained from environmental sample
  misc_feature (1)..(144): Xaa is any amino acid
MKKEKTYKTNEDLEKELEELRHQLDEANETIEAIRTGQVDALVVRSDNGPQLYTLKTADLTYRIFIEKMTEGAVTLNLQGIIVYCNSQFARMVELPLSKVIGFSFEQFIALENRAQYAVLFKKCWEIDGKGEVYSLLLRATPYS

SEQ ID NO: 4659 - DNA, 456 bp, Unknown
  Obtained from environmental sample
  misc_feature (1)..(456): n is a, c, g, or t
atggatatttcaccagatggttctaaaatcgctttatcctgttatcataaaattcaagtttggagtttgataagccaaaagcaactcttatcagttgatgataattcagtaaatggttttgctattaaatatagccatgacggcaaaaaattagctgtcggtttgggaagtggagaaataaaaatcttggattctgaaacattgaatttgctttattcattgcaaggtcattttaaaccagttctttctgttgcatttagcaaagacgacaagaatttgattagtggttcatctgaccaaatggctaaactttggaatctccaaactaaagttgaattaaaatcattagtcaatgagcataaaggtcaggtgagttctgttgcttttagtccaacttcaaatttatttgcgacaacaggtgatgacaaactaatcagattatggaagattcaatga

SEQ ID NO: 4660 - protein, 151 aa, Unknown
  Obtained from environmental sample
  DOMAIN (69)...(106): WD domain, G-beta repeat
  misc_feature (1)..(151): Xaa is any amino acid
MDISPDGSKIALSCYHKIQVWSLISQKQLLSVDDNSVNGFAIKYSHDGKKLAVGLGSGEIKILDSETLNLLYSLQGHFKPVLSVAFSKDDKNLISGSSDQMAKLWNLQTKVELKSLVNEHKGQVSSVAFSPTSNLFATTGDDKLIRLWKIQ

SEQ ID NO: 4661 - DNA, 417 bp, Unknown; identical to SEQ ID NO: 751
  Obtained from environmental sample
  misc_feature (1)..(417): n is a, c, g, or t

SEQ ID NO: 4662 - protein, 138 aa, Unknown; identical to SEQ ID NO: 752
  Obtained from environmental sample
  misc_feature (1)..(138): Xaa is any amino acid

SEQ ID NO: 4663 - DNA, 318 bp, Unknown
  Obtained from environmental sample
  misc_feature (1)..(318): n is a, c, g, or t
gtgcaaaaagggcatggatctaatcttcaccgatggggaccaagttttacatatctgcaaacgctgcggaaaggtgctctaatgcctcaaaccacaaaaacaacgaccatacccgccttctcagaaatcaagcccacaactgagcggatcgctaataacctccatgcgggaatttatctgctacacgaggcatctaaagacttacggtttttaggccacaacgcggattcattatccattctaagggtcctttcctctgtcatcattccaatttgtgaccgatacaaggacgaattagacggaaagaaaagggagtga

SEQ ID NO: 4664 - protein, 105 aa, Unknown
  Obtained from environmental sample
  misc_feature (1)..(105): Xaa is any amino acid
MQKGHGSNLHRWGPSFTYLQTLRKGALMPQTTKTTTIPAFSEIKPTTERIANNLHAGIYLLHEASKDLRFLGHNADSLSILRVLSSVIIPICDRYKDELDGKKRE

SEQ ID NO: 4665 - DNA, 858 bp, Unknown
  Obtained from environmental sample
  misc_feature (1)..(858): n is a, c, g, or t
ttgcaaaaagaaatattcattgatagggacaatatccatttaaaagcaacatatattaccaaacaatctgacagtttcattattgaattttcctggcaatcacaacattcatttggtgaagttcttcatagtgccggagcaatccctctaccaccttatataaaaagaaaggtaaccgaagaagacaaagaaaggtaccagacaatttttagcaaaaaagatggttcagttgctgcgcccactgccgctttacattttacagaaaaagtttttcaaaatttggttgcaaaaaatattaatacagaatttatcacacttcatgtaggtgcaggaacatttaagccagtgaaaaccgaaaccgttgcggaacatcagatgcatgaagaacctttcgcggtttcaagtgctgttttgaaaaatatactgtcttcaaaaaagataatagccgttggaactacatcgttgcgaacgcttgaaacaatttactggcttggagtaaaactattaaatggattgctcaaagaagattggactttgcaacaatgggaggcatatgaccttgctactatgcatccgaatatttccatggaagaaagtttgagtgcattgattacatatctggaagataatcagcaaacagaactgcattgccagacgagtctgataattgttccaggttaccaattcaaaataccgcatggcctgataacgaattttcatcaaccacaatcgacattgcttttattagtgagtgcgtttatcggtgaggattggaagaaagtttacaatcacgccttagaaaatggctatcgatttttaagttatggtgacagtagcttgttgtggaaaaaaacttag

SEQ ID NO: 4666 - protein, 285 aa, Unknown
  Obtained from environmental sample
  DOMAIN (1)...(118): Queuosine biosynthesis protein
  misc_feature (1)..(285): Xaa is any amino acid
MQKEIFIDRDNIHLKATYITKQSDSFIIEFSWQSQHSFGEVLHSAGAIPLPPYIKRKVTEEDKERYQTIFSKKDGSVAAPTAALHFTEKVFQNLVAKNINTEFITLHVGAGTFKPVKTETVAEHQMHEEPFAVSSAVLKNILSSKKIIAVGTTSLRTLETIYWLGVKLLNGLLKEDWTLQQWEAYDLATMHPNISMEESLSALITYLEDNQQTELHCQTSLIIVPGYQFKIPHGLITNFHQPQSTLLLLVSAFIGEDWKKVYNHALENGYRFLSYGDSSLLWKKT

SEQ ID NO: 4667 - DNA, 489 bp, Unknown
  Obtained from environmental sample
  misc_feature (1)..(489): n is a, c, g, or t
ttgaaagctctggttattatagatatgactaacgatttcgtgtatgagacctacgaatatgcaggaacgttatatgagggaaaacttgtagcccctatggcaaaggaaattgttgacaaaatagccaggctaattataaaggtagtaaaagggggaacagtcagtgttatcagaattccgaaagatcaccttaatgcctttatgaacccggaactcgaactgaaagcagcagagctcggaatcgatgaagtattcgttacaggcctggttgaggaagtctgcatatacattaatagccttggtttccttgaaagaggttttcgaacaaacatcgtaaaaaggtgtacagctccatttgatgaagaanaaggtagggaagcctttagcgaacttacggaatgcggagcaaactggttgacgatattcctgatgacantaaagttatcctgctcctcgaagacgaaacacatgaaaattccgaagaaataa

SEQ ID NO: 4668 - protein, 162 aa, Unknown
  Obtained from environmental sample
  DOMAIN (1)...(147): Isochorismatase family
  misc_feature (1)..(162): Xaa is any amino acid
MKALVIIDMTNDFVYETYEYAGTLYEGKLVAPMAKEIVDKIARLIIKVVKGGTVSVIRIPKDHLNAFMNPELELKAAELGIDEVFVTGLVEEVCIYINSLGFLERGFRTNIVKRCTAPFDEEXGREAFSELTECGANWLTIFLMTXKLSCSSKTKHMKIPKK

SEQ ID NO: 4669 - DNA, 615 bp, Unknown
  Obtained from environmental sample
  misc_feature (1)..(615): n is a, c, g, or t
gtgaacaccaactacaggatagagatattttattctccttctgagcataaaacatattcaggagaattgccacatggtatcaaaggtgaatttggtcatgggatcaaatctgtgataatcacacttaaccatgttgctaatgtttcagagcccaaaatacatgaatttctggaaaatattggtgtttatatatccaaagccactatttctcgaattttgacaaaagatgttgatattttccatcaggagaaaactgagatttttctggaaggtcttaaggctacgccttatcagcagattgacgatacaggtgcgagagtcaatggtaacaatcattatactcagatcctttgtaatccttattatgttgcttattttacagttcccaacaagagtcgagaaaatattttagatgtacttttatgtggaaaagaaaaaacgtactgctttaatgatgaagcatttgatctgatgaaaacgtttaatgtttcccaaatctggatggaaaaactctcttcttttaaaaacaaaatattcagtgacgaagaaatgagtcgaaaactggattgttttttctcgcttaatggatataaaactactaagaagaaagtctga

SEQ ID NO: 4670 - protein, 204 aa, Unknown
  Obtained from environmental sample
  misc_feature (1)..(204): Xaa is any amino acid
MNTNYRIEIFYSPSEHKTYSGELPHGIKGEFGHGIKSVIITLNHVANVSEPKIHEFLENIGVYISKATISRILTKDVDIFHQEKTEIFLEGLKATPYQQIDDTGARVNGNNHYTQILCNPYYVAYFTVPNKSRENILDVLLCGKEKTYCFNDEAFDLMKTFNVSQIWMEKLSSFKNKIFSDEEMSRKLDCFFSLNGYKTTKKKV

SEQ ID NO: 4671 - DNA, 360 bp, Unknown
  Obtained from environmental sample
  misc_feature (1)..(360): n is a, c, g, or t
atgatgaataccaccaaaacaatcaattatagtattgacagtttgtgggaggtaaatggcattactaaaataagattggaaaacatagggcaaatgcctatgccggttgatgtaaaatttacgttcagggatagtacatcagaatggcattatattccgctaagtttaatgtttggagaaaaatctgcagagccgtggcaaacgccaagagtagtgtataatgaatggaaatggacgcaccctacttatgaaattcaaaccaaaagaaaattaacggatattatttctgttgagattgacccaacgcaaaggctggcagatatcgatagaaaaaataacaggatagagttgaagtggtaa

SEQ ID NO: 4672 - protein, 119 aa, Unknown
  Obtained from environmental sample
  misc_feature (1)..(119): Xaa is any amino acid
MMNTTKTINYSIDSLWEVNGITKIRLENIGQMPMPVDVKFTFRDSTSEWHYIPLSLMFGEKSAEPWQTPRVVYNEWKWTHPTYEIQTKRKLTDIISVEIDPTQRLADIDRKNNRIELKW

SEQ ID NO: 4673 - DNA, 567 bp, Unknown
  Obtained from environmental sample
  misc_feature (1)..(567): n is a, c, g, or t
atgaacgaaaagataaacgtcatttcaagaaaggacattgaaaggctgtatgaaaaacatgtacttcattcactagctatcgcagcagcttttgactttccaccaggactaaatattattgacataggaaccggcggtggctttcccggagtgccgcttgctatattttttcctgaagtaaattttcatttagtggacagcattggcaaaaaattaaaaattgttgatgtagtgtcagaggctatcggtttaaataacataaccacacagcatattcgtgcagaagaaataaagaacaggaaatttgatttcgcggtaagtcgcgccgtggcatcgttaaaagatctttggcgatggagcaaacccttgttgaaaggatcaaactacaagacacagggtataagtgaagaacaaatattgcttaaatcaggattgatttgcctcaaaggtggtgacttaagacaagagataattgaaagcggaaccaaaccaaaaagcatagagatcacagatttgtttgatgaagaattttttaaagagaaatatttattgtacgtgtctacttaa

SEQ ID NO: 4674 - protein, 188 aa, Unknown
  Obtained from environmental sample
  DOMAIN (1)...(158): Glucose inhibited division protein
  misc_feature (1)..(188): Xaa is any amino acid
MNEKINVISRKDIERLYEKHVLHSLAIAAAFDFPPGLNIIDIGTGGGFPGVPLAIFFPEVNFHLVDSIGKKLKIVDVVSEAIGLNNITTQHIRAEEIKNRKFDFAVSRAVASLKDLWRWSKPLLKGSNYKTQGISEEQILLKSGLICLKGGDLRQEIIESGTKPKSIEITDLFDEEFFKEKYLLYVST

SEQ ID NO: 4675 - DNA, 459 bp, Unknown; identical to SEQ ID NO: 3947
  Obtained from environmental sample
  misc_feature (1)..(459): n is a, c, g, or t

SEQ ID NO: 4676 - protein, 152 aa, Unknown; identical to SEQ ID NO: 3948
  Obtained from environmental sample
  DOMAIN (2)...(152): S1/P1 Nuclease
  misc_feature (1)..(152): Xaa is any amino acid

SEQ ID NO: 4677 - DNA, 579 bp, Unknown
  Obtained from environmental sample
  misc_feature (1)..(579): n is a, c, g, or t
atgctgaaaatgactaagatcaacacaaatgatcaaaatacccattacaagaaggtgagcgaaagtattaccttacgatttgacaaggcgttacttaatgaattacgtgatgaatcggaacaaaacatggaaagtgtcaatacccttttgaatcagatagtgaagtcatatatcaaatggcataaaccttcaaagattgcagggttaatttacatcaacaggtttctttatagagatattgtggaacaacttcctgatgaaacagtaaaggagatagccaataactatgctcaacattactttattgatactatcgcaatgtttgacggagatccgtctgtttccttttatatacactatttgttaacatggcttagaatatcaggcttcaattaccgaattgataaagaaaataaggagcatgtgactatcaagattcagctagatctaggtctcaagtttagtaaatatgtttccgtcaagataaagagtatacttgaaactttaaaacaaactgaagttaaagtggattttacagatcatcttgtgatagttcaaatttcgggatttagattttaa

SEQ ID NO: 4678 - protein, 192 aa, Unknown
  Obtained from environmental sample
  misc_feature (1)..(192): Xaa is any amino acid
MLKMTKINTNDQNTHYKKVSESITLRFDKALLNELRDESEQNMESVNTLLNQIVKSYIKWHKPSKIAGLIYINRFLYRDIVEQLPDETVKEIANNYAQHYFIDTIAMFDGDPSVSFYIHYLLTWLRISGFNYRIDKENKEHVTIKIQLDLGLKFSKYVSVKIKSILETLKQTEVKVDFTDHLVIVQISGFRF

SEQ ID NO: 4679 - DNA, 405 bp, Unknown
  Obtained from environmental sample
  misc_feature (1)..(405): n is a, c, g, or t
ttgtttagaagctttaccatccaaaccaaaatcctaatggaagtccttgaaagattgcctcaaaagcacggcaaattaaaacctcctgatctcgtgcaatggtttaaactcttctggcaaaaaactcttcttcttcttgaaaaaataaagagcatcggcttttcaaacaccatggatgattatgaaaagcgcaagcttggcatttttaaccaacttaattttttgcaactgcttactggtattattattccaatggttggcgcattgcgaaatggcaacctgccttttaccgtatggattacagcctgtattcctgccataacaagcattctcatcttatatcttaataataaaaaaagtacctggccgcacttttttcttattttctactttatccttttttaa

SEQ ID NO: 4680 - protein, 134 aa, Unknown
  Obtained from environmental sample
  misc_feature (1)..(134): Xaa is any amino acid
MFRSFTIQTKILMEVLERLPQKHGKLKPPDLVQWFKLFWQKTLLLLEKIKSIGFSNTMDDYEKRKLGIFNQLNFLQLLTGIIIPMVGALRNGNLPFTVWITACIPAITSILILYLNNKKSTWPHFFLIFYFILF

SEQ ID NO: 4681 - DNA, 837 bp, Unknown
  Obtained from environmental sample
  misc_feature (1)..(837): n is a, c, g, or t
atgtcgtgtgttgcgcagggacaaacggatatttatttgtataaacccattggcaattcattggataaattaaccgatgacctgtacgatgatataaatcctgaatttgtaaaccgtggacgaagcattattttttcatcgaacagaccttccgatacaacggtatttaaaaaaattgataaaaaaccatttgtattgcattacgatgtttttgtgatggacataagttcaaagcgaaagatcatgacacgtgtgacaaatacaccgtttgtgaatgaaacacaacccgcgcaatacgataccagtgcttatacctatttgactgatgagaatggtgtatttaaccgtgtggtaagcacacgcgacagcgctatttcctttgttgatactgccttgcattaccgttattttttaaacacacagtataaatcaaattataaccgaagtgttttggaatacgatgtaaactttaaaaagggtcgttacaatatgttgatgcttgaaaatggtaaatactcgttttacagcgcaaaaataaaagacgataaggatgttgatctggggcaggtgcctttaacccgttggcgaatgaattataaccgccttaacgaattaatggtgcaaaaacaaatattgaataaacaaagtgatacggtaagtgataagcgcataacaataattacgcgtgacccgcacaaaaccgatacaacaaaccttgattttaattattatattttcaaggacgaaaaacctgtatatgaaaaggacaaagttgtcatcaacaataaacgcgatatttcaaacatgcccgactcggcaacagcccgcaagaaataa

SEQ ID NO: 4682 - protein, 278 aa, Unknown
  Obtained from environmental sample
  misc_feature (1)..(278): Xaa is any amino acid
MSCVAQGQTDIYLYKPIGNSLDKLTDDLYDDINPEFVNRGRSIIFSSNRPSDTTVFKKIDKKPFVLHYDVFVMDISSKRKIMTRVTNTPFVNETQPAQYDTSAYTYLTDENGVFNRVVSTRDSAISFVDTALHYRYFLNTQYKSNYNRSVLEYDVNFKKGRYNMLMLENGKYSFYSAKIKDDKDVDLGQVPLTRWRMNYNRLNELMVQKQILNKQSDTVSDKRITIITRDPHKTDTTNLDFNYYIFKDEKPVYEKDKVVINNKRDISNMPDSATARKK

SEQ ID NO: 4683 - DNA, 789 bp, Unknown
  Obtained from environmental sample
  misc_feature (1)..(789): n is a, c, g, or t
atgtttaaaagaaaaacagatggcacttttgaaaaagtagaggtgagaaagagaccaggtacggtaggaatttgtgctgcaatcatgaaccgttataaagtagatgccgtggcccatcttatttgtggtggctttagcaaacaggaaacagaagacgctttgattgatcttaatttccttggcgttgacaatgttttggtactccggggtgacgcacccaggaatgaaagcgtttttgagccggagccaggcggccataaatatgccatagagctgcttcaacaggtaatgaatatgaataatgccatttacctcgaagaagatctgaaaaatgcagtaaaaactaatttttccataggtgtggccggttatcctgaaaaacattttgaatgccctaaccttcaaacagaccttctttttctaaaagccaaaatagatgcaggcgctgattacgtggttacgcaaatgttttacgacaacaaaaaatattttgaatacgtaaaggcttgcaaggaaataggcattcaagcacctattgtaccaggcctgaaacccatcacttcaaaaaaacaattaacagtgatcccacgcacttttcatgtggatataccggaagaactatcaaatgaaattttgaaatgcaaaacagataaggacgtggaagaagtgggtaccgaatggctattgcaccaatccaaagaattgaaggctgctaatgtgcccgtattgcattattatactttaggaaagcctaatgttatttcaaatgtagtgaagggtattttttaa

SEQ ID NO: 4684 - protein, 262 aa, Unknown
  Obtained from environmental sample
  DOMAIN (1)...(262): Methylenetetrahydrofolate reductase
  misc_feature (1)..(262): Xaa is any amino acid
MFKRKTDGTFEKVEVRKRPGTVGICAAIMNRYKVDAVAHLICGGFSKQETEDALIDLNFLGVDNVLVLRGDAPRNESVFEPEPGGHKYAIELLQQVMNMNNAIYLEEDLKNAVKTNFSIGVAGYPEKHFECPNLQTDLLFLKAKIDAGADYVVTQMFYDNKKYFEYVKACKEIGIQAPIVPGLKPITSKKQLTVIPRTFHVDIPEELSNEILKCKTDKDVEEVGTEWLLHQSKELKAANVPVLHYYTLGKPNVISNVVKGIF

SEQ ID NO: 4685 - DNA, 753 bp, Unknown
  Obtained from environmental sample
  misc_feature (1)..(753): n is a, c, g, or t
atgaaatctgaagaaatacacaaacgtgctcataatattgtaacaaagcccattccggttcccgataaaataaaattagaaaaagcactctctgaaataaaatccagaactaaaaagtcgcaagaactaaccgaaagggccaaacatgttttaccaaacggatcgcaacacaccttaccattatccaatccttatcccttttttatgcaaaaaggaaatggggccaaactgttagatgttgacggcaactattacctggattatattttgagtgggggtgctattagtatgggacacaacgaacccgggcttgtaaaatttattaccgaaactattaataccaaaacacattttcacggacattttgatgaaatggaaattaaagcggcagaagaagtgatcgccttttttccttccattgaaaaagtaagatttaccgccagtggcagtgaggctaatctggctgctttaaaaattgcacgctcttatacagggaaaaagaaaatgataaaatttttaggcaattaccacggatgggggcatgaattttttattgacctggaagttccgggttcgggaaaatttatttcgcacggcataccggatgagtttatgaatgaaaccattttggtgcctcaaaataatttgcaggccctggaagaaccctttaaagccaatgaaaaatttgggaaggaattgcagctattatttgcgagccttttgggtgccgaatctggattagtttccttttga

SEQ ID NO: 4686 - protein, 250 aa, Unknown
  Obtained from environmental sample
  DOMAIN (58)...(249): Aminotransferase class-III
  misc_feature (1)..(250): Xaa is any amino acid
MKSEEIHKRAHNIVTKPIPVPDKIKLEKALSEIKSRTKKSQELTERAKHVLPNGSQHTLPLSNPYPFFMQKGNGAKLLDVDGNYYLDYILSGGAISMGHNEPGLVKFITETINTKTHFHGHFDEMEIKAAEEVIAFFPSIEKVRFTASGSEANLAALKIARSYTGKKKMIKFLGNYHGWGHEFFIDLEVPGSGKFISHGIPDEFMNETILVPQNNLQALEEPFKANEKFGKELQLLFASLLGAESGLVSF

SEQ ID NO: 4687 - DNA, 888 bp, Unknown
  Obtained from environmental sample
  misc_feature (1)..(888): n is a, c, g, or t
ttgcgccacactacttcaagacaaacggatgcttacggtgggcggcttaaggccaaactgattgattcatttaaaaaaatgagtttaaaaaagaaaattttggttacaggggtctctaaaggaattggaaaagccattgccttagatctaattggtaagggccatgaaatattgggtacctgtagaaatcctcacacactatcagataaaatttccggtgtaaaatactttgcgcttgatctgaaggacgaaaactccattcaaaactgttttgaagctgttggggaaattgatgtactgatcaataatgccggtgaaagtcaaatgggacccgcggaagaaatgagcgacaaagaagtgagggatatttttgaaaccaacttttttggcaccatcagtctcactaaaaaattcattccggccatgcgcaggaaaaaaaagggattaattattaatatcagctccttatccggccgtttcgcggttccgtttcaatccagttatgcttcgtcaaaaattgctttaaacacctggacactttgtatcagaaaagaattaaggccctttcacgtaagtgtaagtttactggaaccttattttattaaaagcggtataaaaacagattatattgtagatgagagatcggcttacaaaaaaatgacggatagagtgagtgaaagcagaaaagccaccttaaataaagccaaggaacctgaagtggttgcaaaaaccgtggccaaaataattgaatccaaatctcccaaaggcatttacatttccgggggcatgggtccgttttatgccttactcaatcgttttcttacttcgagccgggccgaaaaaatgaccaacaaggttaccgggcttaccggtgatgacctggtttag

SEQ ID NO: 4688 - protein, 295 aa, Unknown
  Obtained from environmental sample
  DOMAIN (33)...(263): short chain dehydrogenase
  misc_feature (1)..(295): Xaa is any amino acid
MRHTTSRQTDAYGGRLKAKLIDSFKKMSLKKKILVTGVSKGIGKAIALDLIGKGHEILGTCRNPHTLSDKISGVKYFALDLKDENSIQNCFEAVGEIDVLINNAGESQMGPAEEMSDKEVRDIFETNFFGTISLTKKFIPAMRRKKKGLIINISSLSGRFAVPFQSSYASSKIALNTWTLCIRKELRPFHVSVSLLEPYFIKSGIKTDYIVDERSAYKKMTDRVSESRKATLNKAKEPEVVAKTVAKIIESKSPKGIYISGGMGPFYALLNRFLTSSRAEKMTNKVTGLTGDDLV

SEQ ID NO: 4689 - DNA, 672 bp, Unknown
  Obtained from environmental sample
  misc_feature (1)..(672): n is a, c, g, or t
atgaggacaataaaccatattttaaaacaccccgtaacacttagcaatggcacgcacaaattaacaaagtttattattgatttaggtgcaggacatgcaatctcattagagaaggtggctgataaaaccctttattcgcaacagcttattaatgctaacctgggcatagggctaaatggattaattagtggatataaagggcgggtgaaacaaatacagatcggaaaatataaaattaaaaatgtgcttgcctcttaccccgatgataatggccgggtatcgatagtgcatcgtgatggaaacttaggtgtagaggtattaaaaagatttaccctggtatttaattattccggtaacgaaatgtacataaaatcaaatgtagagtttaaagcgccttttgaacacgacatgagcgggttgcaatattatgccgcgggcaagggatataaacatattattgttgaacgcgttgaacccggatcgccgggagatgaggcgggaatatgtgaagatgatgaaattacggccataaattttaaacctgttgctgatatgaccctcgaagagatagaccagttgtttaaatcaagaaataaccgatcgttattgcttagtatataccgcaatgagacaaccgagagagtaattgtgacattaaatcgcagaatatag

SEQ ID NO: 4690 - protein, 223 aa, Unknown
  Obtained from environmental sample
  DOMAIN (128)...(207): PDZ domain (Also known as DHR or GLGF)
  misc_feature (1)..(223): Xaa is any amino acid
MRTINHILKHPVTLSNGTHKLTKFIIDLGAGHAISLEKVADKTLYSQQLINANLGIGLNGLISGYKGRVKQIQIGKYKIKNVLASYPDDNGRVSIVHRDGNLGVEVLKRFTLVFNYSGNEMYIKSNVEFKAPFEHDMSGLQYYAAGKGYKHIIVERVEPGSPGDEAGICEDDEITAINFKPVADMTLEEIDQLFKSRNNRSLLLSIYRNETTERVIVTLNRRI

SEQ ID NO: 4691 - DNA, 825 bp, Unknown
  Obtained from environmental sample
  misc_feature (1)..(825): n is a, c, g, or t
gtgatcatttgccaaaaccatgtagaagctattgcggaatttgaatggatgatacaggatgcaaaattcggtgaggccagccgcaaggttgttgtggaagaatttttagatggtattgaactttctgtttttgtattaacagatgggaaaaattatgtgcttttaccagaggcaaaagattacaaacgaataggagaaggcgataaagggctaaatactggtggtatgggagctgtaagcccagtgccctttgctgatgatgcatttataaaaaagacaattgaaaaaatagtaaaacctactattaacggattgcaaaaagatggtttggattataaaggctttgtgtttatcggcattattaaagttagcgatgaaccatatattattgaatataactgccgcatgggcgatcctgaaactgaagtagtaatgcctcgtttaaaaaatgatttggtagaattatttattgctacagctaaacaacaacttgacaccgtaaaaatttctatagacgaacgttatgctgccgctactgtagctgtgagcggagggtatccaaacaattttgaaaaaggatttgagataaccggtttaaataacgacgttgatgatacgatcttatttcaatccggaacaaaacaagagggcaaaaaaactgtaaccagtggtggcagggttttatgcgttaccgcattagccggttcattggaagatgcagtgcataaaacacaggaaagacttcgccagattaaatacgacggaatgtattaccgcagggatattggctatgaatttgccgaaacctactctggcgaggaatag

SEQ ID NO: 4692 - protein, 274 aa, Unknown
  Obtained from environmental sample
  DOMAIN (176)...(267): Phosphoribosylglycinamide synthetase, C domain
  misc_feature (1)..(274): Xaa is any amino acid
MIICQNHVEAIAEFEWMIQDAKFGEASRKVVVEEFLDGIELSVFVLTDGKNYVLLPEAKDYKRIGEGDKGLNTGGMGAVSPVPFADDAFIKKTIEKIVKPTINGLQKDGLDYKGFVFIGIIKVSDEPYIIEYNCRMGDPETEVVMPRLKNDLVELFIATAKQQLDTVKISIDERYAAATVAVSGGYPNNFEKGFEITGLNNDVDDTILFQSGTKQEGKKTVTSGGRVLCVTALAGSLEDAVHKTQERLRQIKYDGMYYRRDIGYEFAETYSGEE

SEQ ID NO: 4693 - DNA, 594 bp, Unknown; identical to SEQ ID NO: 3497
  Obtained from environmental sample
  misc_feature (1)..(594): n is a, c, g, or t

SEQ ID NO: 4694 - protein, 197 aa, Unknown; identical to SEQ ID NO: 3498
  Obtained from environmental sample
  misc_feature (1)..(197): Xaa is any amino acid

SEQ ID NO: 4695 - DNA, 351 bp, Unknown; identical to SEQ ID NO: 459
  Obtained from environmental sample
  misc_feature (1)..(351): n is a, c, g, or t

SEQ ID NO: 4696 - protein, 116 aa, Unknown; identical to SEQ ID NO: 460
  Obtained from environmental sample
  misc_feature (1)..(116): Xaa is any amino acid

SEQ ID NO: 4697 - DNA, 744 bp, Unknown; identical to SEQ ID NO: 1485
  Obtained from environmental sample
  misc_feature (1)..(744): n is a, c, g, or t

SEQ ID NO: 4698 - protein, 247 aa, Unknown; identical to SEQ ID NO: 1486
  Obtained from environmental sample
  misc_feature (1)..(247): Xaa is any amino acid

SEQ ID NO: 4699 - DNA, 789 bp, Unknown
  Obtained from environmental sample
  misc_feature (1)..(789): n is a, c, g, or t
ttgggtattgtctctgttttattcccggttaaaagcgatccacctgcacaggaatctaatttacctgtcaatacaaccttcgactggtattattattttggctattacctgatgaagctgttcagtgtgtcgcaaaactgggccatcatgatcggctcaggtttatttctttccatcattccgtacataataaaaagaaaaaaccgtccacctgtatttattgatcttgaaaaatgtgatgcctgtaacctatgttcttatgactgtccttatgaagccattgatatgctggtgagaaatggagcaaccaaggctattctttcaccagataaatgtgttggctgtggcatatgtattggctcgtgcagggaacatgcaattacgcatctgcaattcccgatgcctgatctgataccaaaagaaaaagaagatatcactgttttcagttgcagttattttcccgaacctgactttccggatcatttaaaaattaaacactataaagttccctgtatcggcagcgtgatggcaaaagatgtgcaggccattttagaaaataacagccaatctgttgcattgcttggctgcgaaaattgctattaccgtcttggaaaaacctgggcactaaaaagatttttgagaaaaagagcgccggcaatttcaaaaaaatttgatgcttcccttgtgcagtttttcacattgacaaaatacagncaagagaaactcatagaattttaccgcgcagcaaatgaaaacagcgttcgggaaaaatcagttaaatatagatga

SEQ ID NO: 4700 - protein, 262 aa, Unknown
  Obtained from environmental sample
  DOMAIN (72)...(95): 4Fe-4S binding domain
  misc_feature (1)..(262): Xaa is any amino acid
MGIVSVLFPVKSDPPAQESNLPVNTTFDWYYYFGYYLMKLFSVSQNWAIMIGSGLFLSIIPYIIKRKNRPPVFIDLEKCDACNLCSYDCPYEAIDMLVRNGATKAILSPDKCVGCGICIGSCREHAITHLQFPMPDLIPKEKEDITVFSCSYFPEPDFPDHLKIKHYKVPCIGSVMAKDVQAILENNSQSVALLGCENCYYRLGKTWALKRFLRKRAPAISKKFDASLVQFFTLTKYXQEKLIEFYRAANENSVREKSVKYR

SEQ ID NO: 4701 - DNA, 963 bp, Unknown
  Obtained from environmental sample
  misc_feature (1)..(963): n is a, c, g, or t
ttgcattttggattgagaggtgaggagagtgaaagagacgaaaactttgtaagaagtcttgctgcaaagtacggcgccgaggtttctgtaaaaacgttccacacggaaatgtatgctaatgaaaaaaggatttctattcaggaagctgcaagagatttgagataccattggtttgttcaattaaaggaagaaaatggtttttccttcaccctgcttgcgcatcatgctgatgataatattgaaacacttttgatgaattttttccggggaacaggcatgcagggattaacagccatgcctgaagaaaatattgatgacaagtttttcctacggcctttgctcggtgtaagaagaatagaaatttttgcatttgcaaagcaaaacaaattggaatgggtagaggattcttccaatctttcttcaaaatatacccgcaatttttttaggaatgaattattgccagcgataaaaaaagtgtatccacaagtggaagaaaatttgttagataacattgaccgcttcaaaaaaatacattcgctctatgagacatcagtgcaggatttgaaaaagaaagtttgtgagcatcatatatctgaaatccgcattcctattttaaaattgatgaagtaccgcaatacttcattgatttttgagatcatcaaagattatggcttcagtgaaaagcaggtagatgaagtcattaagctcgccgatgcaccatcaggcaagtttattcagaacgatacccatcagatcatcaaacatcgcaactggtttatcattgcgccgaaagcggaaattgcggaaactattgccatcgaagggggaaatcaaacgattgatttcgccagtggaaaattggatctgataacgattcccatagaaaaatttgaacgtcaaaaaaaagaaaccattgcgcaactcgatacgaagcatatagaatatccttttgatcttgcgtaa

SEQ ID NO: 4702 - protein, 320 aa, Unknown
  Obtained from environmental sample
  DOMAIN (2)...(173): PP-loop family
  misc_feature (1)..(320): Xaa is any amino acid
MHFGLRGEESERDENFVRSLAAKYGAEVSVKTFHTEMYANEKRISIQEAARDLRYHWFVQLKEENGFSFTLLAHHADDNIETLLMNFFRGTGMQGLTAMPEENIDDKFFLRPLLGVRRIEIFAFAKQNKLEWVEDSSNLSSKYTRNFFRNELLPAIKKVYPQVEENLLDNIDRFKKIHSLYETSVQDLKKKVCEHHISEIRIPILKLMKYRNTSLIFEIIKDYGFSEKQVDEVIKLADAPSGKFIQNDTHQIIKHRNWFIIAPKAEIAETIAIEGGNQTIDFASGKLDLITIPIEKFERQKKETIAQLDTKHIEYPFDLA

SEQ ID NO: 4703 - DNA, 756 bp, Unknown
  Obtained from environmental sample
  misc_feature (1)..(756): n is a, c, g, or t
atgaatattggaataatcggaacaggattaatggggtccgcaatagccgagagactgattgaaagaggatttaatgtttttgttcataatagaaccaaacaaagatcagatgcgctggtaagaaaaggtggcattaggattggaaatccatcagaattaggcaagaaatgtaattatgtaattatcagcgttaccgacggtaatgcagtgaaagaaattttgtttggtaataatgggttgatttattccaataacaatcaactccgtattatagataccagtacagttttgccggaagattccatatattgtgctaacctcatgaaaagaaaaggatatgcgattatacaggcgcccataatgggtggccctgatgcaacaaggaagggagatgtaatatcgattgtttctggcgataagaaaataatggaaaaatgcagacggattctaactaatttcagcaagaaaatattttatgtggggcaccgtgacggcgctgccaactatctaaagcttggattaaatcttaacatagcgttaatagcgatctcattgtcggaatcactaatattcataaaaaaatcaaatactaatccaacagtctttctggacattctaaattcaacttattttaagacaggtctcagtgaagtaaaaggtccaaagatgatcaggaataattttgagccaaagttttttttaaaaaatatgctgaaggatgttcaactgctcaatgaatgccgcaaaaagaaataa

SEQ ID NO: 4704 - protein, 251 aa, Unknown
  Obtained from environmental sample
  DOMAIN (2)...(162): NAD binding domain of 6-phosphogluconate dehydrogenase
  misc_feature (1)..(251): Xaa is any amino acid
MNIGIIGTGLMGSAIAERLIERGFNVFVHNRTKQRSDALVRKGGIRIGNPSELGKKCNYVIISVTDGNAVKEILFGNNGLIYSNNNQLRIIDTSTVLPEDSIYCANLMKRKGYAIIQAPIMGGPDATRKGDVISIVSGDKKIMEKCRRILTNFSKKIFYVGHRDGAANYLKLGLNLNIALIAISLSESLIFIKKSNTNPTVFLDILNSTYFKTGLSEVKGPKMIRNNFEPKFFLKNMLKDVQLLNECRKKK

SEQ ID NO: 4705 - DNA, 906 bp, Unknown
  Obtained from environmental sample
  misc_feature (1)..(906): n is a, c, g, or t
gtgaagtggggaccggagcttgaaggcagcaagagaggtactataacccagacaattgggtatgacgacaacggatattacatccgttcagttgagaaaaatgaccaataccttgtgaagctcgataaaaaaatgaatacagtagcaactgttaaaattgaggaaaaagatgaacagactaaactaaggctttattttgaggacatgtacttcttcaacgatcagttgcttttgttccagtcgtatgtggacaagaaaacaaagaagaatgtacttgctgtgcgaaaaattgacatgcagacaatgttgccaatcggaaaaatggttaatctaaaagaaatagaaatattatcaaggaaaaatgccggtaatttcactatatattcttccaaggatgaatcaaagctgatgattggttataatctcccctatgaaaagaaggagaatgagaagttcggagcgataatatgcgataaagatctaaatgttttatggactaaagaatttgaattaccatatacagataagtttttcagtgtagttaatttcaattgtgataatgacggcaacctatacgttatgggcaagctgtataatggaaaagtaaaggaaatcgttagcggaaaacagaatttcaggtatcatcttgtatgctacatggataaaggtaacaataagactgaatatgaaatcaagctgaacgacaagtttattacggatataacctatgcaattggtaataatggcgacattattacaagtggattttattctaaagaaagtatctcatcaatagatggctgcttttatatgacacttgatcgcgcaactaaaaatgtaaagaccacaagcctgaaagaatttgatcttgatttcctcacacaggggttatcagaaaaaggctga

SEQ ID NO: 4706 - protein, 301 aa, Unknown
  Obtained from environmental sample
  misc_feature (1)..(301): Xaa is any amino acid
MKWGPELEGSKRGTITQTIGYDDNGYYIRSVEKNDQYLVKLDKKMNTVATVKIEEKDEQTKLRLYFEDMYFFNDQLLLFQSYVDKKTKKNVLAVRKIDMQTMLPIGKMVNLKEIEILSRKNAGNFTIYSSKDESKLMIGYNLPYEKKENEKFGAIICDKDLNVLWTKEFELPYTDKFFSVVNFNCDNDGNLYVMGKLYNGKVKEIVSGKQNFRYHLVCYMDKGNNKTEYEIKLNDKFITDITYAIGNNGDIITSGFYSKESISSIDGCFYMTLDRATKNVKTTSLKEFDLDFLTQGLSEKG

SEQ ID NO: 4707 - DNA, 681 bp, Unknown
  Obtained from environmental sample
  misc_feature (1)..(681): n is a, c, g, or t
ttgtcggatctgcttcgctttcagaattatcagcacggaggtgctataatcataacagggattgaaaacccgcctattgatatcaagtataaactggaatataacaggctaagaactgcaatgactaatctttcaaaacataccattgaaaaatatagttatgaaaatgaaatcttcataaattatacaaatgtcgaagaagaaaatatgccggtttctctgtatttaagcgaaagtgttgctgatattgacaaggatgatacaaagaacgaattaaagggtgccattcgctttataggatctcttagctgcgtagatggtctcgtattactagatcagcagttaaatataaaggggtttggtgccgtcgtaagagtgattgatccgccagagaacatttatgtttcaggcacttcgattatcaatcccaagaaactaacagcagtaaaccccaatagttacggaacaagacaccgctctgttttttcctattgctggaaaaatccaggaagcttgggatttgtaatttcccaagatggagacataagggctgtcatgaggataaatgaccaggttatattatgggataatataagagttcataaattctctcaaagtccgaagttgaaaaaatccaagaccagacgaccaaccaagtcaaagaaaaaagctaagttataa

SEQ ID NO: 4708 - protein, 226 aa, Unknown
  Obtained from environmental sample
  misc_feature (1)..(226): Xaa is any amino acid
MSDLLRFQNYQHGGAIIITGIENPPIDIKYKLEYNRLRTAMTNLSKHTIEKYSYENEIFINYTNVEEENMPVSLYLSESVADIDKDDTKNELKGAIRFIGSLSCVDGLVLLDQQLNIKGFGAVVRVIDPPENIYVSGTSIINPKKLTAVNPNSYGTRHRSVFSYCWKNPGSLGFVISQDGDIRAVMRINDQVILWDNIRVHKFSQSPKLKKSKTRRPTKSKKKAKL

SEQ ID NO: 4709 - DNA, 408 bp, Unknown
  Obtained from environmental sample
  misc_feature (1)..(408): n is a, c, g, or t
ttggtgaacttttttgaaagccaaaagcgtttaaggaagaaaaccgctggtgatttattttacccaaaagataatacgccaggatgtacaaccgaagcttgcagttttcgggatcaatacgaagattttaaagatttaggagctgaggtaattggtattagcagtgatagtgtaaaatcacatcataaatttgctgctaaacacaaattgccttttattttgctttctgatcaggataaaagattaagaaaactttttggtgtccgcaataacttgttcggacttctgccaggacgcgttacctatataattgataaaaatggtttgcttatttcgatatttgacagtgcaaatgctgtaaagcatataccgaaagccttagaaatcgttcaagaattagtatcgtag

SEQ ID NO: 4710 - protein, 135 aa, Unknown
  Obtained from environmental sample
  DOMAIN (2)...(121): AhpC/TSA family
  misc_feature (1)..(135): Xaa is any amino acid
MVNFFESQKRLRKKTAGDLFYPKDNTPGCTTEACSFRDQYEDFKDLGAEVIGISSDSVKSHHKFAAKHKLPFILLSDQDKRLRKLFGVRNNLFGLLPGRVTYIIDKNGLLISIFDSANAVKHIPKALEIVQELVS

SEQ ID NO: 4711 - DNA, 501 bp, Unknown
  Obtained from environmental sample
  misc_feature (1)..(501): n is a, c, g, or t
gtggtaatagaaaaagagacattattacttcagggattagctaaaaacgatagaaaagccgtagaaaccatttataaggacaattataacttggttcaggcgctggttattaaaaataatggcactgctgaagacgctaaagatatttttcaggaaacgatgatcgtactcttcgaaaaagcgaaatctgactccttcaaccttaattgttctcttagcacttatatatattcagtcagcaggcgcctatggttaaaacgcctcttgcagcaaaacaggtttttaattatagaagaatctganaatgaattggttaaagttgaagatgatattgaagagcatgagcgcataaatactgagtttataatgatggaaagatcaattaatagccttggcgaaccttgtaaagcctctttgaacgctactatactcaaaagcgttctatgcaggaaatatcaacaaagctttggttatactaatgccgataatgcccaaaactag

SEQ ID NO: 4712 - protein, 166 aa, Unknown
  Obtained from environmental sample
  DOMAIN (24)...(94): Sigma-70 region 2
  misc_feature (1)..(166): Xaa is any amino acid
MVIEKETLLLQGLAKNDRKAVETIYKDNYNLVQALVIKNNGTAEDAKDIFQETMIVLFEKAKSDSFNLNCSLSTYIYSVSRRLWLKRLLQQNRFLIIEESXNELVKVEDDIEEHERINTEFIMMERSINSLGEPCKASLNATILKSVLCRKYQQSFGYTNADNAQN

SEQ ID NO: 4713 - DNA, 315 bp, Unknown
  Obtained from environmental sample
  misc_feature (1)..(315): n is a, c, g, or t
gtgatagaaaatttaaaattactggacgatgttgaacgctatattaatggccagatgagcccggatgaacgcgttcaatttgagggtctgcgtaaaagcaactccgaaattgaccagttagtggttgagcataccttctttttacaccaaatgagtcgctttgatgagatgaaatcctttaaaagcggcctgaatgatatccatatcgacctggccgaaaaaggcgccatcaaatcaacccgcttgaaaggcaaggctaaagtggtttacctgatcaatagatataaaagagtggctgccatgccgctcatctga

SEQ ID NO: 4714 - protein, 104 aa, Unknown
  Obtained from environmental sample
  misc_feature (1)..(104): Xaa is any amino acid
MIENLKLLDDVERYINGQMSPDERVQFEGLRKSNSEIDQLVVEHTFFLHQMSRFDEMKSFKSGLNDIHIDLAEKGAIKSTRLKGKAKVVYLINRYKRVAAMPLI

SEQ ID NO: 4715 - DNA, 567 bp, Unknown
  Obtained from environmental sample
  misc_feature (1)..(567): n is a, c, g, or t
gtggtaatagaaanagagacattattacttcagggattagctaaaaacgatagaaaagccgtagaaaccatttataaggacaattataacttggttcaggcgctggttattaaaaataatggcactgctgaagacgctaaagatatttttcaggaaacgatgatcgtactcttcgaaaaagcgaaatctgactccttcaaccttaattgttctcttagcacttatatatattcagtcagcaggcgcctatggttaaaacgcctcttgcagcaaaacaggtttttaattatagaagaatctgaaaatgaattggttaaagttgaagatgatattgaagagcatgagcgcataaatactgagtttataatgatggaaagatcaattaatagccttggcgaaccttgtaaaagcctcttgaacgcttactatactcaaaagcgttctatgcaggaaatatcagcaagctttggttatactaatgccgataatgccaaaactcagaaatataaatgcctgatgcgtcttaaaaaactattctttagtcaatataaaaattacgaaccgtga

SEQ ID NO: 4716 - protein, 188 aa, Unknown
  Obtained from environmental sample
  DOMAIN (24)...(94): Sigma-70 region 2
  misc_feature (1)..(188): Xaa is any amino acid
MVIEXETLLLQGLAKNDRKAVETIYKDNYNLVQALVIKNNGTAEDAKDIFQETMIVLFEKAKSDSFNLNCSLSTYIYSVSRRLWLKRLLQQNRFLIIEESENELVKVEDDIEEHERINTEFIMMERSINSLGEPCKSLLNAYYTQKRSMQEISASFGYTNADNAKTQKYKCLMRLKKLFFSQYKNYEP

SEQ ID NO: 4717 - DNA, 837 bp, Unknown
  Obtained from environmental sample
  misc_feature (1)..(837): n is a, c, g, or t
ttgatgatgagagcgtcccttactgggaacagaagcttctgctgcattaggttttggattccgttgcggtttccttggattanacacatggaaattatccaggaacgattggaacgtgaatttaagatgaccgtgatcaccactgttcctaacgttagctattatgcgtataccccgaagggagaaaaacttttcgtcaataatccttccgatttacctgatgccaacaagttggattatgtagaggaaccatatataaaagctcagatcattagtaaaagtgaattcattggttcgatcatgactttatgtattggtaaacgtggaattttagtgaatcaaaattacctgacaacagatcgggtggaattggttttcgaaatgccattgggcgaaattgtattcgatttttacgataaattgaaaaccatttcaaaaggttatgcttcttttgattatcatccgattggatatagagaaagcaaactggtaaagatggatattttgttgaatggtgaacaggtggatgcattatcagctttgatccatagagacaatgcacacgggcttggtaaaaagatgtgtgaaaaattgaaagaattaatcccgcgtcagcaatttgaaattcctattcaggcagccattggcgcaaaaatcattgcccgtgaaactatcaaggctttacgtaaagatgtaactgctaaatgttatggtggtgatatttcacgtaagcgtaagcttcttgaaaaacaaaaagaaggaaagaagagaatgagatctgtagggaatgttgagattcctcaggatgcatttatggcggtactgaagttggattag

SEQ ID NO: 4718 - protein, 278 aa, Unknown
  Obtained from environmental sample
  DOMAIN (80)...(169): Elongation factor G C-terminus
  misc_feature (1)..(278): Xaa is any amino acid
MMMRASLTGNRSFCCIRFWIPLRFPWIXHMEIIQERLEREFKMTVITTVPNVSYYAYTPKGEKLFVNNPSDLPDANKLDYVEEPYIKAQIISKSEFIGSIMTLCIGKRGILVNQNYLTTDRVELVFEMPLGEIVFDFYDKLKTISKGYASFDYHPIGYRESKLVKMDILLNGEQVDALSALIHRDNAHGLGKKMCEKLKELIPRQQFEIPIQAAIGAKIIARETIKALRKDVTAKCYGGDISRKRKLLEKQKEGKKRMRSVGNVEIPQDAFMAVLKLD

SEQ ID NO: 4719 - DNA, 969 bp, Unknown
  Obtained from environmental sample
  misc_feature (1)..(969): n is a, c, g, or t
ttgggttttattgcgggctatcaaaccaaaacctataaacccgaagatccgggtaacatcgaagccgctgaacgaatgggtaaacttcatgataaactaagtgaaataggctatcatggtcatgaatttgaactttatcttgtaaggattctcttttgcctgtttgccgaagatacctccattttcgaaaaaagaaccttccaggattatattgaagtaaaaaccaaagaagatgggagtgatttgggtccgtatattgccacccttttccatgtactcaataccccccaggaaaaaagattaaaaaacctggatgaacacctgatcgcatttccgtatgtaaatggtaaattatttgaagaaactatttcgccggcatcctttgatagccaaatgcgtgaattattgttgcattgttgtgcacttgattggagcaaaatatccccggccatttttggttcgttgttccaaagtgtaatgaatccaaagcaaaggcgtaatcttggtgcacattatacatcggagaaaaatattttaaaattgattaagcccttattccttgatgaattatgggaagagtttgaaaagaacaagaaagataaaaagaaactaagcgtactacataatcaaataggtaatcttaaatttctagacccggcctgtggttgtggtaactttttagtaattacttacagggagctgcgatcattagaattagagatcattaaagttttatacaaatcaactgataatccttatttaaatgtaaagctggatgtagatcaaatgtacggaattgaatacgaagaatttccggcacaaattgcccaggttgcactttggcttactgatcaccaaatgaacatgagattaaacgaggagtttgggagttattttgccaggttaccgttgcataaatcagcccatattgtgcagggcaatgccctgagctcatctgatcattggtga

SEQ ID NO: 4720 - protein, 322 aa, Unknown
  Obtained from environmental sample
  misc_feature (1)..(322): Xaa is any amino acid
MGFIAGYQTKTYKPEDPGNIEAAERMGKLHDKLSEIGYHGHEFELYLVRILFCLFAEDTSIFEKRTFQDYIEVKTKEDGSDLGPYIATLFHVLNTPQEKRLKNLDEHLIAFPYVNGKLFEETISPASFDSQMRELLLHCCALDWSKISPAIFGSLFQSVMNPKQRRNLGAHYTSEKNILKLIKPLFLDELWEEFEKNKKDKKKLSVLHNQIGNLKFLDPACGCGNFLVITYRELRSLELEIIKVLYKSTDNPYLNVKLDVDQMYGIEYEEFPAQIAQVALWLTDHQMNMRLNEEFGSYFARLPLHKSAHIVQGNALSSSDHW

SEQ ID NO: 4721 - DNA, 414 bp, Unknown
  Obtained from environmental sample
  misc_feature (1)..(414): n is a, c, g, or t
atgtctcanattttatctcacacgcaattagttgaattggccaataggtttggtacgcccttgtatgtttatcatgcggaaaaaataaaagaacagtgcgaaaaacttacttcagcattttctgttattgattcaatgttcttttttgcctgcaaggcattaaccaacatcaatattcttaagtatatacattcacttggttgcggaattgattgcagcagcatgaacgaagtgaagctggctttgcatgcaggcgtgccccctgaaaaattctttatacatcaaatggaattgcttttgagaaaattgaaaagctgtccaaggtgggtgcatataaatattgacagtttatctaacctcgaaaaagtttggaaaaaattatgccacaccttatcctgtaagcgttcggaatag

SEQ ID NO: 4722 - protein, 137 aa, Unknown
  Obtained from environmental sample
  misc_feature (1)..(137): Xaa is any amino acid
MSXILSHTQLVELANRFGTPLYVYHAEKIKEQCEKLTSAFSVIDSMFFFACKALTNINILKYIHSLGCGIDCSSMNEVKLALHAGVPPEKFFIHQMELLLRKLKSCPRWVHINIDSLSNLEKVWKKLCHTLSCKRSE

SEQ ID NO: 4723 - DNA, 447 bp, Unknown
  Obtained from environmental sample
  misc_feature (1)..(447): n is a, c, g, or t
gtggtagtagagattatctgtaacagtagttacccgcctaaatgtaagttgaggagaatagtaatgagtgtaatgatttataatcattatcttaaatgggaggggggggaggttttgactccggagatatattttctggtaggagaggcactcatcttaggagtctatcccacagaaaagaggagagggaagaagacggtagagcacgatctttatctgtgctttgcttgttgtgggaagagggagagaacatataattttttttttgagggggggtggaggttagaatatagcataactaaattatataaaaaagtgaaaaaacacattattaagaggtggggaggtagtattattaatcctcaatcactccacgaaggttttttttttttttttgaaagatggaagaaccctccacccccacttagatttttttgtttatactga

SEQ ID NO: 4724 - protein, 148 aa, Unknown
  Obtained from environmental sample
  misc_feature (1)..(148): Xaa is any amino acid
MVVEIICNSSYPPKCKLRRIVMSVMIYNHYLKWEGGEVLTPEIYFLVGEALILGVYPTEKRRGKKTVEHDLYLCFACCGKRERTYNFFFEGGWRLEYSITKLYKKVKKHIIKRWGGSIINPQSLHEGFFFFFERWKNPPPPLRFFCLY

SEQ ID NO: 4725 - DNA, 555 bp, Unknown
  Obtained from environmental sample
  misc_feature (1)..(555): n is a, c, g, or t
gtgaagaatatttgtcttattcttgagtatgacggcaccgccttcaatggtttccagaaacagcctgataaaagtctcagaacaattcagggtgaattagaaaaagcgatattaaaaatcacgggaagtgaaattaatattaccggtgccggcaggactgactcaggggttagcgcctctgaacagtttgttaatttttttacggatgttaatatccctccggaaaaattctgcatggcactgaatacaaaacttccgccggaaattagcatttacaaatcatttgaagtgccgattgattttaatgcccggtattcagctatccgcaggacttaccgctataaaattttaaattctaaaatcaggagcgccctcaggagaaatagtgtttatcatattaaaacccccctcgattttgacaggatgcttgaggcatggctcagtttaanggggaaatatgatttcagcgccttttgcaaaagtgatcaccaccgggtttatatgaagtgggaaatctttaatacaaaaagcttggaaaagaagataaagaattaa

SEQ ID NO: 4726 - protein, 184 aa, Unknown
  Obtained from environmental sample
  DOMAIN (6)...(106): tRNA pseudouridine synthase
  misc_feature (1)..(184): Xaa is any amino acid
MKNICLILEYDGTAFNGFQKQPDKSLRTIQGELEKAILKITGSEINITGAGRTDSGVSASEQFVNFFTDVNIPPEKFCMALNTKLPPEISIYKSFEVPIDFNARYSAIRRTYRYKILNSKIRSALRRNSVYHIKTPLDFDRMLEAWLSLXGKYDFSAFCKSDHHRVYMKWEIFNTKSLEKKIKN

SEQ ID NO: 4727 - DNA, 387 bp, Unknown; identical to SEQ ID NO: 1989
  Obtained from environmental sample
  misc_feature (1)..(387): n is a, c, g, or t

SEQ ID NO: 4728 - protein, 128 aa, Unknown; identical to SEQ ID NO: 1990
  Obtained from environmental sample
  misc_feature (1)..(128): Xaa is any amino acid

SEQ ID NO: 4729 - DNA, 750 bp, Unknown
  Obtained from environmental sample
  misc_feature (1)..(750): n is a, c, g, or t
atgaaaaatagtttaattttattttctgattcaaaacattttatcaatacaattcagcagaaaaagacgcatnttaatcgaaataataaaactgttttaattatacagccatatggttcaagtattgcattattaaaaagagggatggaaattggttacaatattattgttttgaccagtcaaacagaactgtgtgtggttgcaaatgaaatactcgatcaggttaaacttgcaattcagttaaatacagcaaacgactgggaggtgatacgtgcgctaaaaatattaaataagcatattgatattcacgctgtcatccctggattcgaatatttcgtgccagttgcggctaaagccagttattttttgaaattacctggcattgatgtggaagatgttccaaaaatacgaagaaaggacttcatgcggttagagttaagagaaaaagggatcattacgcctaaatttcgagtcgttaactctattgttgaattggacaaagccattcgctcaattggatttcctgcggtatgcaaacccgtcgatgcggctgggagtgtaaatgtaaaacgagtagcgaaacattcagaggctttcactgcgggattacgaattctcgaagctgaagatgtgttgtgggggcataaattaacgaatattttagtgtttgaagaatatattgaagggaatgaatttagtttagaaggncgtggtccaaaatggaagagtaatttttttcagtattactga

SEQ ID NO: 4730 - protein, 249 aa, Unknown
  Obtained from environmental sample
  DOMAIN (138)...(212): Phosphoribosylglycinamide synthetase, B domain
  misc_feature (1)..(249): Xaa is any amino acid
MKNSLILFSDSKHFINTIQQKKTHXNRNNKTVLIIQPYGSSIALLKRGMEIGYNIIVLTSQTELCVVANEILDQVKLAIQLNTANDWEVIRALKILNKHIDIHAVIPGFEYFVPVAAKASYFLKLPGIDVEDVPKIRRKDFMRLELREKGIITPKFRVVNSIVELDKAIRSIGFPAVCKPVDAAGSVNVKRVAKHSEAFTAGLRILEAEDVLWGHKLTNILVFEEYIEGNEFSLEGRGPKWKSNFFQYY

SEQ ID NO: 4731 - DNA, 933 bp, Unknown
  Obtained from environmental sample
  misc_feature (1)..(933): n is a, c, g, or t
atgntgaggcaagccttgtcgcatgaaattcaccagcaaatcgcttttgagataaccgcgcggaaagaagccggcaaaaaaattccgttgctcgctgcggtgttggttggtaacgacggcggcagcgaaacatacgttgcgtccaaaatcaaaacgtgtgaaaaggttggcatgggatcgaaattgtatcgttatgaatctaacgtttccgaaattgaattgctggacctgattgacaaactgaacaacgacagtgacgtcaccggaattcttgtacagctgccgttaccaaaacatatcagcgacgaaaaaattatcaacgcggtagctccgataaaagatgttgacggctttcacccgctgaacaccggtcgcatgatgaaaggattgccgtgccatttacccgcgacgccgaaaggaatattgttgctgctcgagcgttataaaatcgaaacggaaggaaagctttgcgtggtaattggccggagcgatattgtaggtagaccaatgagcgtgttgatgagccgtgcggcgtatcccgggaacagcacggtaatattgacgcacagcaaaacaaaaaatctcaaagactttacccaccgggccgatatcgtgatagccgcgcttggcaagccggcgtttttaaaagcggatatggtaaaggaaggtgcggtgatagtagacgtaggtacgacgcgcgttccggatgaaacgaagaagagcggattccggttatccggtgacgtggatttcgaaaacgttgcgccgaaatgcagttggatcaccccggttcccggcggcgtcgggccaatgaccattgcatcgctcatgctcaacacacttcaatcaccgagcttaattttgaaaacgttgtcgatcaactcagcatggattgttccttcggtgatggaagtgtcggtaccatcagggtga

SEQ ID NO: 4732 - protein, 310 aa, Unknown
  Obtained from environmental sample
  DOMAIN (4)...(116): Tetrahydrofolate dehydrogenase/cyclohydrolase, catalytic domain
  misc_feature (1)..(310): Xaa is any amino acid
MXRQALSHEIHQQIAFEITARKEAGKKIPLLAAVLVGNDGGSETYVASKIKTCEKVGMGSKLYRYESNVSEIELLDLIDKLNNDSDVTGILVQLPLPKHISDEKIINAVAPIKDVDGFHPLNTGRMMKGLPCHLPATPKGILLLLERYKIETEGKLCVVIGRSDIVGRPMSVLMSRAAYPGNSTVILTHSKTKNLKDFTHRADIVIAALGKPAFLKADMVKEGAVIVDVGTTRVPDETKKSGFRLSGDVDFENVAPKCSWITPVPGGVGPMTIASLMLNTLQSPSLILKTLSINSAWIVPSVMEVSVPSG

SEQ ID NO: 4733 - DNA, 909 bp, Unknown
  Obtained from environmental sample
  misc_feature (1)..(909): n is a, c, g, or t
atggctgaaaagttggtatttaagttgtttcccacaactaatacgcattatctcaaaaaagaacatgcgtcaatacatgacgtgttgctcgcgattggagcaatgcagccaacgtattcaaatgcacgactaaagtataatgtaccagaactttatttaaaatcatatgatgaagtgaagagttttttctcaagaaactttggagagaagttcgcagaagaaatttgtgcaaataccttatacttcgctgataaatgtgaagttcccgattggatcgatcctaaattctctaatccaaacggcaaagagttgccaatctttgcagttaaagaagtagatgactatgatcagtttcaagattggctaagtaaacaaccagatacagttaaaaagttagcagaagattctgcatacttgcggtaccgttgttttaatgtttttgaaaaaataatgaaaaacaagacctcaattttgaaagaaaaagaatatattgaccgcattgaggaggaactgtcggtacttgatttccaaggattcagttcctacatgcttatcgttgctgattatatcgactgggctaagaaaaataatattgctgttggtccaggtagaggtagcgttggtggaagtttaattgcatatctattagatattcacaaagccgatccaatacggtacggtttaatctttgcgcgctttcaaaaccgtgaacgctccagtccaccagatattgatcaagatatcgcaacgtcaggtagagaggctgttattcagtacatacaacgtaagtatggtagcgataaggttgcattcatttctaactttagtcgcattacgccaaaagtatatacaagagacattgctcgctctttagagtttggtggctcaagaaaagatgcggtagaatag

SEQ ID NO: 4734 - protein, 302 aa, Unknown
  Obtained from environmental sample
  misc_feature (1)..(302): Xaa is any amino acid
MAEKLVFKLFPTTNTHYLKKEHASIHDVLLAIGAMQPTYSNARLKYNVPELYLKSYDEVKSFFSRNFGEKFAEEICANTLYFADKCEVPDWIDPKFSNPNGKELPIFAVKEVDDYDQFQDWLSKQPDTVKKLAEDSAYLRYRCFNVFEKIMKNKTSILKEKEYIDRIEEELSVLDFQGFSSYMLIVADYIDWAKKNNIAVGPGRGSVGGSLIAYLLDIHKADPIRYGLIFARFQNRERSSPPDIDQDIATSGREAVIQYIQRKYGSDKVAFISNFSRITPKVYTRDIARSLEFGGSRKDAVE

SEQ ID NO: 4735 - DNA, 651 bp, Unknown
  Obtained from environmental sample
  misc_feature (1)..(651): n is a, c, g, or t
atggtttacgccgacgccgaactggtcaacgaatcgctcgaacttctggaaccgtcaatgtggcaaaaaacgggtttcgacgccgaaaacaaaaaattattcaccgtcggaaaagccttcgatttgcttcttgtccggggctacgtttacggttcgagcatggcgtttcgcgccggctacagagatttgtttttgccgtttcctgataatacggcttttatacacgacaattggatcgcttttatgatctcgacagtcgccgatatttcattgatagataaaaaattaaccaaatatcgtcagcatgaacggcagtttgtcggcatcattaaagatgaaaagtcaaaactggattctctggtcgaatcgggaaagagaattaatgaatacgagggtaaaatcaatcaactgtgcgttgcggaagagagatttaagaaaacgtcttacccggtaaacttggatgaaattttgccaaaaatattggcggttagaaaccacattttgacgagagccggtttgccgaaaaatctcgtttcgagattaataaaggtcggtcgggaattattaaccggaaattatcatcattattcaaacggctttcgcagcgcggcgaaagatttaattattgcaggaaaaacgaatttcaggtaa

SEQ ID NO: 4736 - protein, 216 aa, Unknown
  Obtained from environmental sample
  misc_feature (1)..(216): Xaa is any amino acid
MVYADAELVNESLELLEPSMWQKTGFDAENKKLFTVGKAFDLLLVRGYVYGSSMAFRAGYRDLFLPFPDNTAFIHDNWIAFMISTVADISLIDKKLTKYRQHERQFVGIIKDEKSKLDSLVESGKRINEYEGKINQLCVAEERFKKTSYPVNLDEILPKILAVRNHILTRAGLPKNLVSRLIKVGRELLTGNYHHYSNGFRSAAKDLIIAGKTNFR

SEQ ID NO: 4737 - DNA, 393 bp, Unknown
  Obtained from environmental sample
  misc_feature (1)..(393): n is a, c, g, or t
atggagaagtcattcatttcaatgtctgataaaaataaaaaaggatatggagccgaaaagaaggtctgggatgcggtggagaatgctttttccgctcgggaatgttttgcttactggaactatccgatttttcattcggactatgatagccgtaaggaacctgatatattgctgttcgataaagagctgggtatcacgatcatagaggttaaagggataagaatcgataatatagaattcatacaggggcacgaatggagttatctgaactatttcgtcgaaaaagtgatccctatcaacaagcagaacatcaaatgtatgctttgccagaatggaatcctaaaatacatcataaattcgcgaaacgtgtcctggtggccttaccgtacataa

SEQ ID NO: 4738 - protein, 130 aa, Unknown
  Obtained from environmental sample
  misc_feature (1)..(130): Xaa is any amino acid
MEKSFISMSDKNKKGYGAEKKVWDAVENAFSARECFAYWNYPIFHSDYDSRKEPDILLFDKELGITIIEVKGIRIDNIEFIQGHEWSYLNYFVEKVIPINKQNIKCMLCQNGILKYIINSRNVSWWPYRT

SEQ ID NO: 4739 - DNA, 804 bp, Unknown
  Obtained from environmental sample
  misc_feature (1)..(804): n is a, c, g, or t
atgagcaattcaaaaacgatcaaaagcgcattggtttcggtttattacaaagataatttggagccgatcattaaaaaactttatagcctcggtgtaaaattatacagcacaggtggcacgctttcgtttattgaaaaattaggtatcccggtaacagctgtagattcagtaactacctatcctgaaatttttggaggccgtgtaaaaacccttcaccctgcgatttttggaggcattttaaaccgcagagacaatgcctctgataaaaaagaaaaagaacaacataacatcccggatattgacctggtgatcgtagatctgtatccttttgaagaaaccgtggcttccaaggcctcagaagaagataccatcgagaagatcgacatcggtggtatttcattgatccgtgctgccgctaaaaattttaatgacgtgatcattgtttcgtcccgtaatgattatgcagatcttttaagcttattagaaacaaagaacggtacttctgatatctccgatcgtaaacactttgcagcgaaagcgtttgcaacctcatcacattacgacactgccatctttaactattttaatcaaagcgaaaatattcccgaattcaagcagagtgtccaaaaaagccaggtgttgcgctacggagaaaaccctcatcaaaaaggaaccttctacggcgacctggatgccttgttcaccaaattaaacggcaaagaactttcgtataacaatttattagatgtagacgccgctgtgaatcttatcggtgattttacagagccaaccttcgccatttaa

SEQ ID NO: 4740 - protein, 267 aa, Unknown
  Obtained from environmental sample
  DOMAIN (138)...(267): AICARFT/IMPCHase bienzyme
  misc_feature (1)..(267): Xaa is any amino acid
MSNSKTIKSALVSVYYKDNLEPIIKKLYSLGVKLYSTGGTLSFIEKLGIPVTAVDSVTTYPEIFGGRVKTLHPAIFGGILNRRDNASDKKEKEQHNIPDIDLVIVDLYPFEETVASKASEEDTIEKIDIGGISLIRAAAKNFNDVIIVSSRNDYADLLSLLETKNGTSDISDRKHFAAKAFATSSHYDTAIFNYFNQSENIPEFKQSVQKSQVLRYGENPHQKGTFYGDLDALFTKLNGKELSYNNLLDVDAAVNLIGDFTEPTFAI

SEQ ID NO: 4741 - DNA, 453 bp, Unknown
  Obtained from environmental sample
  misc_feature (1)..(453): n is a, c, g, or t
gtgtatgatataaatggagcgatgctgaaatcacgactaaaaagccggcgtaatactttattggaaggtgttatgaaatattaccggtttattgctggcaccgttgatatttccggaacagaagaggaggagctttttgaaataaaaaataatggcgagctattaagtataagtgtataccgtttaaaagaaaataacgaaaaagataagaaaatatatgagcggtcttttgatccggaggatacacggcgcattaatttgacaggctttggaggaaatgatcaatttcttgttgaaaaaaatatttcatcagaaattaaattaaagatcagtggtggggaggggaaagatgtttacgaactaaatggaaaaataaaaaccgttgtttatgattctttatcggataaaaatgaaattatcaataagtcaaaagcaaaaattattcttaattga

SEQ ID NO: 4742 - protein, 150 aa, Unknown
  Obtained from environmental sample
  misc_feature (1)..(150): Xaa is any amino acid
MYDINGAMLKSRLKSRRNTLLEGVMKYYRFIAGTVDISGTEEEELFEIKNNGELLSISVYRLKENNEKDKKIYERSFDPEDTRRINLTGFGGNDQFLVEKNISSEIKLKISGGEGKDVYELNGKIKTVVYDSLSDKNEIINKSKAKIILN

SEQ ID NO: 4743 - DNA, 561 bp, Unknown
  Obtained from environmental sample
  misc_feature (1)..(561): n is a, c, g, or t
ttgccctgcaaaggggaaaaaccattaaacgaagatgccatgaaagcaatttggtcaggttccattggcttcggcctcgtcaacatccctgttaagctattcagcgctattcaggatagccggcttgagctcgacatgctggacagcaaaacgcatgcgccgatccgctataaacgggtcaatgaaaacaccgggaaagaagtaccctgggaacagatccgcaaaggatttctctataatgataactatgtcatcctcgaaaacgaagactttgaagctgcaagcccgaagaaatcgaagatcatcgagatcgaagcttttgtcaacgaggaagagatcgatgatatttattttgaaaccccctattttatcgaaccggctaaaggaggagaaaaagcataccagcttttattgaaagcattggagaaaaccaaaaaatcgggattgtgccgcttcgtcatgcgtacctctgagcacctcagtatcatccgtcccaaggagattttactcgtctgcagcaacttcgatttgaagaagaaatacgctcggccgacaccctga

SEQ ID NO: 4744 - protein, 186 aa, Unknown
  Obtained from environmental sample
  DOMAIN (22)...(185): Ku70/Ku80 beta-barrel domain
  misc_feature (1)..(186): Xaa is any amino acid
MPCKGEKPLNEDAMKAIWSGSIGFGLVNIPVKLFSAIQDSRLELDMLDSKTHAPIRYKRVNENTGKEVPWEQIRKGFLYNDNYVILENEDFEAASPKKSKIIEIEAFVNEEEIDDIYFETPYFIEPAKGGEKAYQLLLKALEKTKKSGLCRFVMRTSEHLSIIRPKEILLVCSNFDLKKKYARPTP

SEQ ID NO: 4745 - DNA, 1047 bp, Unknown
  Obtained from environmental sample
  misc_feature (1)..(1047): n is a, c, g, or t
ttgcggtctcatattttacttgtggacgataagccggagaatttaatttctctggaaagcatcctggatcaccctaagcgtaatttgttgaaagccaacagtgggaatgaagcattgaagattgctttcgaagaagacattgctgtcattttactcgatgttcagatgccagagatggatgggtttgaagtagctagaatattaaatgagaatcctaaaactaaagacatcgcgatcatatttgtaactgctatcagcaaagaagaaaaatatacgctgcaaggctatgaagaaggtgcagtagattacttgcataaacctcttgatataaatattgtaaaggctaaggttgcagtatttgaaaaactttatcgctcaaagcaggaattaaaaatgtacgtcgaaaaaaccgagcagatcaataagcaacttgatgagtttgtatacatcgtatcacatgatctcaaggctccattgcgtggattatccagcgtcacaagttttcttgaagatgaacttggtaatgatttaaagcctgaggttaggaatttgcttgatatggttaagagcagaactgttcggatgcaaaatctgattgatggtattctccactactctcgtatggcaaataacaagacagaaaaggaaaccgtgaggttgtcggaagtaattgccaatataatcgacctgctttcagttcccaatcatgttagaatcgaatatcctgatcagcttccagttttgtttgatgagaaaataaaactgcatgaagtatttcagaaccttatttcanatgctataaaatataataacaaggaaaaggcagttgtgaaaatcacttgccaggaaaaggagaaccactacgagtttgctattaccgataacggtattggaatcaagcctgaacatttcgagaaagatcttggtgtatttcaaacactacaatccnnaggacaagcaggaaagcactggtatcggccttacattgtaaagaagatcattgagcagcaaggtgaaaaatgtggatggagtccgattttgaaatga

SEQ ID NO: 4746 - protein, 348 aa, Unknown
  Obtained from environmental sample
  DOMAIN (250)...(348): Histidine kinase-, DNA gyrase B-, and HSP90-like ATPase
  misc_feature (1)..(348): Xaa is any amino acid
MRSHILLVDDKPENLISLESILDHPKRNLLKANSGNEALKIAFEEDIAVILLDVQMPEMDGFEVARILNENPKTKDIAIIFVTAISKEEKYTLQGYEEGAVDYLHKPLDINIVKAKVAVFEKLYRSKQELKMYVEKTEQINKQLDEFVYIVSHDLKAPLRGLSSVTSFLEDELGNDLKPEVRNLLDMVKSRTVRMQNLIDGILHYSRMANNKTEKETVRLSEVIANIIDLLSVPNHVRIEYPDQLPVLFDEKIKLHEVFQNLISXAIKYNNKEKAVVKITCQEKENHYEFAITDNGIGIKPEHFEKDLGVFQTLQSXGQAGKHWYRPYIVKKIIEQQGEKCGWSPILK

SEQ ID NO: 4747 - DNA, 408 bp, Unknown
  Obtained from environmental sample
  misc_feature (1)..(408): n is a, c, g, or t
atgacatactccttaactagagaacagtttttagacgcccttgagtcaggtaaatatattaaagctacaggtactacattagaagtagatgtaaatggaaatatatgtcactgtgccttaggtgtggctatggcagaagccggtataaaatataaagaagagaaaatagagtgggaagatcatctatttaggaaacgttctagaacgcagattacttgggatttaaaggacgaagattgggaagaggattctaggttctcgtttatccctgatgatttagctctttccttagagattgatgttgaagaagaagattttatttggaatgaaaatgatgccgatcaaaaagaaagttttatcgatttagcaaaaaaattaagagaacgttggaatatacctaaggtataa

SEQ ID NO: 4748 - protein, 135 aa, Unknown
  Obtained from environmental sample
  misc_feature (1)..(135): Xaa is any amino acid
MTYSLTREQFLDALESGKYIKATGTTLEVDVNGNICHCALGVAMAEAGIKYKEEKIEWEDHLFRKRSRTQITWDLKDEDWEEDSRFSFIPDDLALSLEIDVEEEDFIWNENDADQKESFIDLAKKLRERWNIPKV

SEQ ID NO: 4749 - DNA, 330 bp, Unknown
  Obtained from environmental sample
  misc_feature (1)..(330): n is a, c, g, or t
atggcacaaatatgcagtaaagaatatctaaattactcagatgttcttattaaacctcacgatggtatttctaaatttaaatcaagaaacgatgtatctgtaactgctaatatatttggctataatattgtgcctatagttgtatcgaatatggatacagtaggtactgttgaaatggcactcgcagttcaaacaaaaggattacgagtagcccttcataaattctatagtgaagaggatattagaaaagccgtagataaaggaatgaatacaactcattttctttctattggtcagagtgatgccgacctnaaaaaagtaaagaaataa

SEQ ID NO: 4750 - protein, 109 aa, Unknown
  Obtained from environmental sample
  misc_feature (1)..(109): Xaa is any amino acid
MAQICSKEYLNYSDVLIKPHDGISKFKSRNDVSVTANIFGYNIVPIVVSNMDTVGTVEMALAVQTKGLRVALHKFYSEEDIRKAVDKGMNTTHFLSIGQSDADLKKVKK

SEQ ID NO: 4751 - DNA, 501 bp, Unknown
  Obtained from environmental sample
  misc_feature (1)..(501): n is a, c, g, or t
ttgcagtcttcaccgttacctgtcagtggtaaaagcagtttgcaaacctatcttccctattttacacagcagcaatccattttacttgtacacaatacttttattcaacaggaggatatttcttttgcggcagattatgcaaacaaaaataaaatcagtcttgcttattgcctttgcccaaacgctaatttgtacatcgaaaataaattgccaccggttgaaatgcttataaataataactgcctcattgtactcggcaccgacagttatagcagtaactggcaattgagtattgcaaaagaaatggaatcgctattagcaatgccctatttcaaaaagatggaacaagaaccggctatggaaaccgtgttgcaatgggctactatcaacggcgcaaaaaaaatgcagtgggataatgtatccggcagttttgaaaaagggaaaaaaccaggagtgattttattagaaccctattttaaatcctcagttcgattgttgtga

SEQ ID NO: 4752 - protein, 166 aa, Unknown
  Obtained from environmental sample
  misc_feature (1)..(166): Xaa is any amino acid
MQSSPLPVSGKSSLQTYLPYFTQQQSILLVHNTFIQQEDISFAADYANKNKISLAYCLCPNANLYIENKLPPVEMLINNNCLIVLGTDSYSSNWQLSIAKEMESLLAMPYFKKMEQEPAMETVLQWATINGAKKMQWDNVSGSFEKGKKPGVILLEPYFKSSVRLL

SEQ ID NO: 4753 - DNA, 798 bp, Unknown
  Obtained from environmental sample
  misc_feature (1)..(798): n is a, c, g, or t
atgtgggaacagcgataccagtttttgaaaccccggagaagcgatacgaatatcaggtattattgttccgcagaactgaagctcctgttggatatagcgttgttgaacaaagcggggtacaggatctcacaaattaatagtttgtctgtacagcagatcaggacaaccgctggtacgatgacagatcaatccatcgtgcaggaaaataaagtgaatgagttgatcggtaccatggtggatcttgatatggagaaattcgagaatctcatttcatcgtatacggcaacaaaaggaattgaacgggcgatctcagatctcatatatcctttcctcgaaaaatccgggctactatggagtttcgggcacctggatccagcgggcgagcagctggtttcaaatatcatcaggcagaagctgatcgtagcgatcgaaaccacagcgcccaaagaagtgaagaaaaaaaccatactgttattccttcctgagaatgatcaccacgagatcgggttactctatatatattattcattaacgagtcgcggctacaatacaatttacctgggcgacaatgttcccctggatgaccttgaacatattgtgaaattgaaaaaaccagatctgatcctcacacacctgatcgaaacgacaccggcattcaaaaccgataaatatatccagcagttaagaaaaaaaataccgggtacgaaattgatcatatcgggtaagcctggtcatcccccgagggtgtggccggaaaatgtggtttggagtcagtcgatcgaggacattctaaaataa

SEQ ID NO: 4754 - protein, 265 aa, Unknown
  Obtained from environmental sample
  misc_feature (1)..(265): Xaa is any amino acid
MWEQRYQFLKPRRSDTNIRYYCSAELKLLLDIALLNKAGYRISQINSLSVQQIRTTAGTMTDQSIVQENKVNELIGTMVDLDMEKFENLISSYTATKGIERAISDLIYPFLEKSGLLWSFGHLDPAGEQLVSNIIRQKLIVAIETTAPKEVKKKTILLFLPENDHHEIGLLYIYYSLTSRGYNTIYLGDNVPLDDLEHIVKLKKPDLILTHLIETTPAFKTDKYIQQLRKKIPGTKLIISGKPGHPPRVWPENVVWSQSIEDILK

SEQ ID NO: 4755 - DNA, 1119 bp, Unknown
  Obtained from environmental sample
  misc_feature (1)..(1119): n is a, c, g, or t
ttgatacggggtgttttagttaagagtataaagaatcaaaaacggggagaagccaacggtacacttgtaacctttatccctgatgaaactgttttcaagaactttcattttgttcaggaatatctcgataaccagttctggaattattgttacctgaatgcggggctgatcatggtcctgaacggaaaaaagtatgtaagcaagaatggattgctggaccttttgcaacggaaaaccaatgaagatgagatacaataccccataatccatttatcaggagaagatattgagatcgccattacgcatgagcctgcatatggtgaagagtactatgcttttgtgaatggccagtttactacacaaggcggaacccacctggccgccttccgggagggttatgtaaaaacgatccgtgatttttataaaaaagattatgacgcttccgacatacggggaagcatatgcgccgcaatttctgtaagggtgcaggaacctgtatttgagagtcagaccaagacaaaacttggctctcaggtagtgtatgaaggcgggccaagcatgaaaaattttataggtgattttttgttgaaggaactcgacaattatcttcatcgtaaccctgcaaccgcagaagcgcttaagaaacgtattgaacaaaatgagcgtgagcggaaagaacttgcgggaatcaagaaactggcaaatgaaagggcaaagaaagccaaccttcacaataagaagctacgcgattgcaaattccattataatgatgagcccagtggaaaggacaaggatagtataattgaaaagcaaaaagagtctaccattttcattaccgaaggagacagcgcaagcggttccattancaaggcccgggatgtaaatacgcangccgttttcagtctcaggggaaagccgcttaatttgtttggactcactaggaaagttgtgtatgaaaatgaagaatttcaatctctacagcatgccctgaatatagaagaaaggtatgagggcttttgcgtatataatatcgttatcggcacaaatgccgatgtggaatgcatgcacatccggttattactgatgacttttttcctcaattttttccggactggntaa

SEQ ID NO: 4756 - protein, 372 aa, Unknown
  Obtained from environmental sample
  DOMAIN (70)...(233): DNA gyrase B
  misc_feature (1)..(372): Xaa is any amino acid
MIRGVLVKSIKNQKRGEANGTLVTFIPDETVFKNFHFVQEYLDNQFWNYCYLNAGLIMVLNGKKYVSKNGLLDLLQRKTNEDEIQYPIIHLSGEDIEIAITHEPAYGEEYYAFVNGQFTTQGGTHLAAFREGYVKTIRDFYKKDYDASDIRGSICAAISVRVQEPVFESQTKTKLGSQVVYEGGPSMKNFIGDFLLKELDNYLHRNPATAEALKKRIEQNERERKELAGIKKLANERAKKANLHNKKLRDCKFHYNDEPSGKDKDSIIEKQKESTIFITEGDSASGSIXKARDVNTXAVFSLRGKPLNLFGLTRKVVYENEEFQSLQHALNIEERYEGFCVYNIVIGTNADVECMHIRLLLMTFFLNFFRTG

SEQ ID NO: 4757 - DNA, 780 bp, Unknown
  Obtained from environmental sample
  misc_feature (1)..(780): n is a, c, g, or t
ttgatgtattctgcttttcgcccgntggttacaagtcatttagcactcaaactttcttcctctacgattaataccttcgaaatatctgaagaacatagaaggagttcttcaagcctgattttaaagtttgaactaaatagtttcgatgatttcaataatcttaaaaatgaattaggatcaaaacaagacaggaatccggatattcttatgtatctcaattcatggcaggaaggtgatgaaaatcttttaaagatctttaatcactccatagcgcttacaaaaggtagtttcaaattcgaaaaaacagcagacagccaattcatggttattaaatatccgtgtaaggttacccagaaattggttaattctccggcaaacaaaccggattacagtcttccgttaaagatcttaatagtagatgaccattttgtaaatagattatcaacaagaaaatcaatacaatcctggttccagaataccaatataaaagaagctgaaaatggtgaggaagctgtttcacttgcagcaacaatgttaccggatgttattcttatggatatccagatgcctgttatgaatggacttgaagcaacaaggatcattaaaaatcagcataaatccatgatcataattggaatgactgcttcccttgatcaaaattcagatatgctttcttctgaagcaggatttgatgactttattagaaaaccttttaagccggaagaattaaaagaaaagcttgaaaagcatttatcctccgttttcttttactttggataa

SEQ ID NO: 4758 - protein, 259 aa, Unknown
  Obtained from environmental sample
  DOMAIN (134)...(254): Response regulator receiver domain
  misc_feature (1)..(259): Xaa is any amino acid
MMYSAFRPXVTSHLALKLSSSTINTFEISEEHRRSSSSLILKFELNSFDDFNNLKNELGSKQDRNPDILMYLNSWQEGDENLLKIFNHSIALTKGSFKFEKTADSQFMVIKYPCKVTQKLVNSPANKPDYSLPLKILIVDDHFVNRLSTRKSIQSWFQNTNIKEAENGEEAVSLAATMLPDVILMDIQMPVMNGLEATRIIKNQHKSMIIIGMTASLDQNSDMLSSEAGFDDFIRKPFKPEELKEKLEKHLSSVFFYFG

SEQ ID NO: 4759 - DNA, 573 bp, Unknown
  Obtained from environmental sample
  misc_feature (1)..(573): n is a, c, g, or t
atgtatctcaattcatggcaggaaggtgatgaaaatcttttaaagatctttaatcactccatagcgcttacaaaaggtagtttcaaattcgaaaaaacagcagacagccaattcatggttattaaatatccgtgtaaggttacccagaaattggttaattctccggcaaacaaaccggattacagtcttccgttaaagatcttaatagtagatgaccattttgtaaatagattatcaacaagaaaatcaatacaatcctggttccagaataccaatataaaagaagctgaaaatggtgaggaagctgtttcacttgcagcaacaatgttaccggatgttattcttatggatatccagatgcctgttatgaatggacttgaagcaacaaggatcattaaaaatcagcataaatccatgatcataattggaatgactgcttcccttgatcaaaattcagatatgctttcttctgaagcaggatttgatgactttattagaaaaccttttaagccggaagaattaaaagaaaagcttgaaaagcatttatcctccgttttcttttactttggataa

SEQ ID NO: 4760 - protein, 190 aa, Unknown
  Obtained from environmental sample
  DOMAIN (65)...(185): Response regulator receiver domain
  misc_feature (1)..(190): Xaa is any amino acid
MYLNSWQEGDENLLKIFNHSIALTKGSFKFEKTADSQFMVIKYPCKVTQKLVNSPANKPDYSLPLKILIVDDHFVNRLSTRKSIQSWFQNTNIKEAENGEEAVSLAATMLPDVILMDIQMPVMNGLEATRIIKNQHKSMIIIGMTASLDQNSDMLSSEAGFDDFIRKPFKPEELKEKLEKHLSSVFFYFG

SEQ ID NO: 4761 - DNA, 717 bp, Unknown
  Obtained from environmental sample
  misc_feature (1)..(717): n is a, c, g, or t
atgaatcccgagctgccggcaatgcttaatataaaaactccccagaaaaaggagtctctgcaggctctttggaaactgctgaaaatattattggacaatttaaactttgatgatgtggtttataaagtcgtcaacagtattttgactgagctgggttatctaaacctgggttaccggatcattgttttatctttggtagatgagcaggccggcggcctgaggcgggttgctttatctcaaactaaggaagccgatctggcgaaatcggtttccacaataccatttgaaaaaatcgtcattcctctttctgccacaaataattattgtgtcagagttttaagacagcaggagcctttaaccaccagttactggccggatttactaagtccgcctttaactccggaagctgctttaaccaatcagcaggccgccggtataaaaaccagtatggtttacccggtttttgcccagggtaaaccgattggatccttaattttcagtatggttaaggattttaaggaagtgactgaagatgaanaagatctgctgctgggatttaccgatttggtgggacttgcagtccagaattcaatcctttttacttctctccaaaccaaacagaaagaattaaatgctgccaatgaaaagctgaaaatcatcgataagttaaaagacgattttgtttccatcgcctcacatgaactgagaactccaatg

SEQ ID NO: 4762 - protein, 239 aa, Unknown
  Obtained from environmental sample
  DOMAIN (39)...(194): GAF domain
  misc_feature (1)..(239): Xaa is any amino acid
MNPELPAMLNIKTPQKKESLQALWKLLKILLDNLNFDDVVYKVVNSILTELGYLNLGYRIIVLSLVDEQAGGLRRVALSQTKEADLAKSVSTIPFEKIVIPLSATNNYCVRVLRQQEPLTTSYWPDLLSPPLTPEAALTNQQAAGIKTSMVYPVFAQGKPIGSLIFSMVKDFKEVTEDEXDLLLGFTDLVGLAVQNSILFTSLQTKQKELNAANEKLKIIDKLKDDFVSIASHELRTPM

SEQ ID NO: 4763 - DNA, 753 bp, Unknown
  Obtained from environmental sample
  misc_feature (1)..(753): n is a, c, g, or t
atgggactaaaaaatattctgtataaagtagatggcggtgtggctgagatagtccttaaccgtcctgaaaagatgaattctcttgatgaagaacttattcatgacctgaccggaatgatgcgtgatttttcggctaatgatgaagttaaagttgtagtaattacgggagccggaggtaacttttgttcagggctttaccttgattacctccaaaaaataagcgagtttgatatattacagaacaaagaagattccagaaagttcaaaaacctgttactcagtatttacagttgtccaaagcctgtaattgcaaaggttagcggctactgccttgccggcggctgcggtattgcatcggcttgcgatataatagtagcggatgagactgccagatttagctatacagaagttaaaatagggtttattcctgcgattgtaatgatgttccttttaaaaagggtttctgagacccacgccaaagacctgcttttaactgcaagaatgatagaatcaagtgatgcgttaagaatgggactcataaatcattcggttccttcaaaagaaattgacttaaaagtacttgaaatagcagaggttctgaaaaaaaattcagaaagttctttaaagctgacaaaagaaatgtttacaaatatatcggggatggattttgaaaaagccctcgagtatgcatgtgacctgaatgcaattaccaggatgacccctgactgcaaagcaggagtatcaaaattttaa

SEQ ID NO: 4764 - protein, 250 aa, Unknown
  Obtained from environmental sample
  DOMAIN (15)...(185): Enoyl-CoA hydratase/isomerase family
  misc_feature (1)..(250): Xaa is any amino acid
MGLKNILYKVDGGVAEIVLNRPEKMNSLDEELIHDLTGMMRDFSANDEVKVVVITGAGGNFCSGLYLDYLQKISEFDILQNKEDSRKFKNLLLSIYSCPKPVIAKVSGYCLAGGCGIASACDIIVADETARFSYTEVKIGFIPAIVMMFLLKRVSETHAKDLLLTARMIESSDALRMGLINHSVPSKEIDLKVLEIAEVLKKNSESSLKLTKEMFTNISGMDFEKALEYACDLNAITRMTPDCKAGVSKF

SEQ ID NO: 4765 - DNA, 534 bp, Unknown
  Obtained from environmental sample
  misc_feature (1)..(534): n is a, c, g, or t
atgaaggcaatttttaacagatttaaaaattcagaatatgataaaatttacgtagataatttgataaatacttatttaaatatcgaaccatcttctcctttaggttatgatatgagcagcgttgaagcaagaaacttttttctgcagcatgtagctttggaatgtatttattattttggtgattcaagttactttaagtattatgataaattactaaaatttttgaattttgatttttatcatactcaaatatcagcaatcagagcattaagcagtataaatacagtagaatcaagatcatctatttttaattttctaaaaggtaaaggtgataatttttctaaagtaattgcaatatggtcacttgaaagaatgaatgctgttgaatataaaaataatttaattgaatattcaaataatgcatcaactgaagaagtttattttgatactgacataatggacccgagagttggaacttatttccctaaatcagtgaaagatgcagttcaaattttgttaaaaaagtggaagtaa

SEQ ID NO: 4766 - protein, 177 aa, Unknown
  Obtained from environmental sample
  misc_feature (1)..(177): Xaa is any amino acid
MKAIFNRFKNSEYDKIYVDNLINTYLNIEPSSPLGYDMSSVEARNFFLQHVALECIYYFGDSSYFKYYDKLLKFLNFDFYHTQISAIRALSSINTVESRSSIFNFLKGKGDNFSKVIAIWSLERMNAVEYKNNLIEYSNNASTEEVYFDTDIMDPRVGTYFPKSVKDAVQILLKKWK

SEQ ID NO: 4767 - DNA, 864 bp, Unknown
  Obtained from environmental sample
  misc_feature (1)..(864): n is a, c, g, or t
atgacgtcttcatttcaaatcaaaaagcgaagtgtctcttttttgcaggagcatgtacagcncattgctaaaatgcatccaggtgatgagaacaacacatccatcacctacaacaacaccttctttttaaaaatgtacaggaagattgatccatcgatcaatcctgatattgaattgagttattacctgtccgaagatgcgcacttcaatcacgtgcctgcttatttaggaacgattgatttaaacccggagaaggaagccattgcacttggaatgatacagaagctaatagaaaatcatggtgatggagaatcgtatatgaaggaaaggattggcaattacattgaaaggattatggcaagaaacagggaactgttggatccatacgacagaaagggaaccattacccaccccgttgagttccatgaattatcaaatgagttgcaaactttattagggagccgtactgccgaccaggcaagcttaatcggattacgaacaggcgaaatgcatttattattggcggatggaccaggcaaagattttaagcccgaggaatattcgctgcattatcagcgttcggttttttcttcgatgcaggcgctggtgagggagagcatgcaggcacttgaaaagaaattcaacatgctttctgtgcaaacaaaaaacgaggtgcaattcctggccgacaatcgaaataatattttaaatgcttcgcgaaaagtttaccagaaaaaatttgatatctggaaaacgagaacacatggttcttacagcctcaggaaattattgatatctggtaagggcatcgttatacaggactttggaggtaaatcatcgaaaagttacagcgcaaggagatga

SEQ ID NO: 4768 - protein, 287 aa, Unknown
  Obtained from environmental sample
  misc_feature (1)..(287): Xaa is any amino acid
MTSSFQIKKRSVSFLQEHVQXIAKMHPGDENNTSITYNNTFFLKMYRKIDPSINPDIELSYYLSEDAHFNHVPAYLGTIDLNPEKEAIALGMIQKLIENHGDGESYMKERIGNYIERIMARNRELLDPYDRKGTITHPVEFHELSNELQTLLGSRTADQASLIGLRTGEMHLLLADGPGKDFKPEEYSLHYQRSVFSSMQALVRESMQALEKKFNMLSVQTKNEVQFLADNRNNILNASRKVYQKKFDIWKTRTHGSYSLRKLLISGKGIVIQDFGGKSSKSYSARR

SEQ ID NO: 4769 - DNA, 477 bp, Unknown
  Obtained from environmental sample
  misc_feature (1)..(477): n is a, c, g, or t
atgcaagtgaaatacctgtatcactgcaaccacacaaaaagagattnctaccttttcaaaagaataaattcagacggagaaatagaagatagagcgctagcattcctcgttaaaataggaagccaatcatttttggacctgtatccgctggaaaccgataagtcagcgttagtcgatggcttttttaaatctaatcaatataagctgcaccaggtaacaaggattagactggcgggaggaaaactttactggcaggatttccaggataattacgttgaagaattgattaagaaaaagcaggtaaggataaaacatacacccctttatgaaatgtatagtgaagaaaacaaagatgacattctaataactgctggcacaaaagaattacaggctttcctgttgaaatatggaagcaaagatgaggcctttaattccattgataaatctaatacatacaataaaatacgtggattatga

SEQ ID NO: 4770 - protein, 158 aa, Unknown
  Obtained from environmental sample
  misc_feature (1)..(158): Xaa is any amino acid
MQVKYLYHCNHTKRDXYLFKRINSDGEIEDRALAFLVKIGSQSFLDLYPLETDKSALVDGFFKSNQYKLHQVTRIRLAGGKLYWQDFQDNYVEELIKKKQVRIKHTPLYEMYSEENKDDILITAGTKELQAFLLKYGSKDEAFNSIDKSNTYNKIRGL

SEQ ID NO: 4771 - DNA, 675 bp, Unknown
  Obtained from environmental sample
  misc_feature (1)..(675): n is a, c, g, or t
atgtccaaaatattcctggccgtattgacagtatttaccggcatcggggtacaagcacaacagcctaaatgggacagcacttttcggcccgcgaactatgcgcgtcaactggaaaattttcgcaactatcccaatgcgccttccgatatcattatgctgggcaatagcattacggattatgcggactggaacgaactactcggtatttgcgaagtgaaaaaccgcgggatttcgggcgatatcacttttggcattttggaaagactggacgaaataaccgaaggaaaacccgccaaagtttttatcctgatcggcatcaacgatatcgcgcgtaatatcccggatagtattatcctggataattataaacgcatcatacatcgtataagatctgcctcaccggccacgaagatctatttcaatacgctccttccggtaaataaaaccttcccggagaaaaatcatttcaacaaggatgtgaacattcttcatataaacgaggaactaaaaaaaattggaaaatcggaaggaatcgtggtcattgatactcatccccatttcctcgacacggaacaaatgcttaacaaatcgctcacctacgatggtctccatctcaatgctgccgggtacaaggtatgggcatcgatacttaaaccctatattaaaaacccatga

SEQ ID NO: 4772 - protein, 224 aa, Unknown
  Obtained from environmental sample
  SIGNAL (1)...(19)
  DOMAIN (50)...(217): GDSL-like Lipase/Acylhydrolase
  misc_feature (1)..(224): Xaa is any amino acid
MSKIFLAVLTVFTGIGVQAQQPKWDSTFRPANYARQLENFRNYPNAPSDIIMLGNSITDYADWNELLGICEVKNRGISGDITFGILERLDEITEGKPAKVFILIGINDIARNIPDSIILDNYKRIIHRIRSASPATKIYFNTLLPVNKTFPEKNHFNKDVNILHINEELKKIGKSEGIVVIDTHPHFLDTEQMLNKSLTYDGLHLNAAGYKVWASILKPYIKNP

SEQ ID NO: 4773 - DNA, 699 bp, Unknown
  Obtained from environmental sample
  misc_feature (1)..(699): n is a, c, g, or t
atgagttttgaaaaatttatcagtgaggccaatgaggcagtgaaattctcgcttaaaaaactggagatcaagaatgaaacatttaatctcacagagccgaccagagacgagtttggagacttgagttgtaatgttgctttcttgctgacaaagcaattacaaaaatccccacaagcgatagcatcaatgctggttgaacaatatcatcaattccgtaagacagattctaattcgcaatcgtacatttcatctgttgttgcacatgatagcggatacatcaattttcaagcaaatctagccctaataggcgaggaggtaatttctcatatattgaaaaatgaccatttaaggatggatataggtaaagggaaaaaagtgattattgagcatactagtgttaatccaaataaagcattgcatgtgggtcatttgagaaacgtagcgataggcgataccatatacagaatattgagagacaccaaccacgatgttagagttctaaactatgtagatgattctggaccacaagttgctgatattctggtcgggttcttattcctganatttccagtaacaccacctaacaataatatcaagtttgatacatattgcggtaacgagatctatgtgaaagtaaatgagttgtatgaaaaggatccagagttggttgaaaaaagaaagttattgctgaagaagtag

SEQ ID NO: 4774 - protein, 232 aa, Unknown
  Obtained from environmental sample
  DOMAIN (4)...(97): Arginyl tRNA synthetase N terminal domain
  misc_feature (1)..(232): Xaa is any amino acid
MSFEKFISEANEAVKFSLKKLEIKNETFNLTEPTRDEFGDLSCNVAFLLTKQLQKSPQAIASMLVEQYHQFRKTDSNSQSYISSVVAHDSGYINFQANLALIGEEVISHILKNDHLRMDIGKGKKVIIEHTSVNPNKALHVGHLRNVAIGDTIYRILRDTNHDVRVLNYVDDSGPQVADILVGFLFLXFPVTPPNNNIKFDTYCGNEIYVKVNELYEKDPELVEKRKLLLKK

SEQ ID NO: 4775 - DNA, 861 bp, Unknown
  Obtained from environmental sample
  misc_feature (1)..(861): n is a, c, g, or t
gtgttgataacgttacacattatacagattatcccgccttggccagaattatttctgaaaatgtatccaaatcctttgcgtttgaataatcgttatttcctgcttttattttgcacatgttgcatttttatttattcctgctctgataccgatgttgaaaaaacggccggagcagattcgcgtatagaactgagttatccatttggttttgacaccatgcggtttcccgatgacaaccgccttaccgctgcaagaattgaattaggaaaaaaaattttttttgacccacaattctctgccgataaaaaaatatcatgttcctcgtgccataaacccgaattcgcgtttgccgatacaataaaaacacataaaggatcgcacgacagcacaaataaccgcaattcgccttcgcttatcaatattggctatcatccctattttgactatgatggtggtgttcctacacttgaattacaagtattggttccttttgacggagagaacgaaatgcatggaaatctccttactgccgcaaaacaaatgcaaaaagataaaaaatacgttgcgcttgtaaaagaagcttataaacgtcaacccgatccgtatgtaaatacacgtgcattggccgcgtatcagcgaacgctgatttcaaccggatcaaatatgatctgtttaaagtacgggaggcaaaaaaggattgagttcggaagaaaaaaaggaatggaactgttttttttcactaaaacaaatgttcaaaatgtcaaaattggtccgttggttaccaaatttcgcgtttggaaaaattcggactacccaacaaccgtaaatgaacgggggcccgtaaccggggaaaaaccttga

SEQ ID NO: 4776 - protein, 286 aa, Unknown
  Obtained from environmental sample
  DOMAIN (61)...(223): Di-haem cytochrome c peroxidase
  misc_feature (1)..(286): Xaa is any amino acid
MLITLHIIQIIPPWPELFLKMYPNPLRLNNRYFLLLFCTCCIFIYSCSDTDVEKTAGADSRIELSYPFGFDTMRFPDDNRLTAARIELGKKIFFDPQFSADKKISCSSCHKPEFAFADTIKTHKGSHDSTNNRNSPSLINIGYHPYFDYDGGVPTLELQVLVPFDGENEMHGNLLTAAKQMQKDKKYVALVKEAYKRQPDPYVNTRALAAYQRTLISTGSNMICLKYGRQKRIEFGRKKGMELFFFTKTNVQNVKIGPLVTKFRVWKNSDYPTTVNERGPVTGEKP

SEQ ID NO: 4777 - DNA, 492 bp, Unknown
  Obtained from environmental sample
  misc_feature (1)..(492): n is a, c, g, or t
atgcgtatgccttctatccggaaatcgttattttacttttttatcctttgtgtattgccggtttttcaaggatgctcatgggtgaataatttttatgtttcaaacaccacaaatgaagaagtaaaagtagagatcctgcttaacgattcaccgggagactttcctattttttataacgaaaaaaatctccatgttgcttataagataaatagccataatggtcccgattaccccaatactgttccggtgcaaaaagagaaaaccggatcaacagatcatgtaataattatacttcagccaaaaaccaccttacaaatcggagcgctttccaatgataagtacacttcccataagcaaaatttcattaacggcagggttttcaatcttaagctcataaagatcagtcaaaaaaatattgagcgcagcattgatcccgatcaatttgacgcacagcttaaaaaagttaaaggagattttgtttacgctatttaa

SEQ ID NO: 4778 - protein, 163 aa, Unknown
  Obtained from environmental sample
  misc_feature (1)..(163): Xaa is any amino acid
MRMPSIRKSLFYFFILCVLPVFQGCSWVNNFYVSNTTNEEVKVEILLNDSPGDFPIFYNEKNLHVAYKINSHNGPDYPNTVPVQKEKTGSTDHVIIILQPKTTLQIGALSNDKYTSHKQNFINGRVFNLKLIKISQKNIERSIDPDQFDAQLKKVKGDFVYAI

SEQ ID NO: 4779 - DNA, 549 bp, Unknown
  Obtained from environmental sample
  misc_feature (1)..(549): n is a, c, g, or t
atgactacctactgcgattactgcaattctcaccccgaagacacgtacaaccgaatgtatcacgatacacaatatggctttcccctcaaagatgacagcctgttgtttgagcgcttcatccttgagatcaatcaggcaggtctttcctggatcacgatcctgaagaaagccgagaatttccataaagcctatcatggctttaacatcgataaagttgcgaaatacggagaaaaagaccgcgctcgtctgcttacggacccgggcatcatccgcaatcgtctgaaggtcaatgcggcgatcgtcaacgcacagaagatcaaagagttacagaaggaatacggttccttcaaagcctggctggacgcanatcggaacctctccaaagaggaatgggtcaagctgttcaaaaagacatttgtctttaccgggggtgagatcgtaaatgagtttctgatgtccacgggatatttgcccggcgcgcatgacgaaagctgtcctatttataaacgggtcgcctctttgcgccctgcatggatgcgccgcaagtag

SEQ ID NO: 4780 - protein, 182 aa, Unknown
  Obtained from environmental sample
  DOMAIN (7)...(170): Methyladenine glycosylase
  misc_feature (1)..(182): Xaa is any amino acid
MTTYCDYCNSHPEDTYNRMYHDTQYGFPLKDDSLLFERFILEINQAGLSWITILKKAENFHKAYHGFNIDKVAKYGEKDRARLLTDPGIIRNRLKVNAAIVNAQKIKELQKEYGSFKAWLDAXRNLSKEEWVKLFKKTFVFTGGEIVNEFLMSTGYLPGAHDESCPIYKRVASLRPAWMRRK

SEQ ID NO: 4781 - DNA, 300 bp, Unknown
  Obtained from environmental sample
  misc_feature (1)..(300): n is a, c, g, or t
atgcagcaacaaattattttacaacgaaatacttctacacaattaaaatcaaaatttaagccagttatccaaagctcattagacaaagtgggagccgccaggtactatacagaccttgtaaatacttacaataaaattccatttattgaaaaggtgaatcctgacttgaacgagtacgctacagaactagctatgaaaggattgttcacacaaatcgcaaaagaagaaaagactatccggcaggatccgatggcgcgaaccagtgatttattaaagagagtttttgccaatacaaaataa

SEQ ID NO: 4782 - protein, 99 aa, Unknown
  Obtained from environmental sample
  misc_feature (1)..(99): Xaa is any amino acid
MQQQIILQRNTSTQLKSKFKPVIQSSLDKVGAARYYTDLVNTYNKIPFIEKVNPDLNEYATELAMKGLFTQIAKEEKTIRQDPMARTSDLLKRVFANTK

SEQ ID NO: 4783 - DNA, 303 bp, Unknown
  Obtained from environmental sample
  misc_feature (1)..(303): n is a, c, g, or t
atggcagataaaatagatataaagactgttgacgagatagcacatttggctcgcttggagtttgatgcggaatcaaaaaaggaaatccttaatgacatgaaccgcatgttgtctttcgttgacaaattaaatgagctggatactgaaaatgtaaaacccctcatttacatgaccgacgaaaaaaatgttctcaggccggatgagccggaaataaccctcacccaaaaagaggcgctgaagaacgctccaaaaaaagacagtgattattttaaagcaccaaaggtgatagaacaaaacaggtag

SEQ ID NO: 4784 - protein, 100 aa, Unknown
  Obtained from environmental sample
  DOMAIN (21)...(92): Glu-tRNAGln amidotransferase C subunit
  misc_feature (1)..(100): Xaa is any amino acid
MADKIDIKTVDEIAHLARLEFDAESKKEILNDMNRMLSFVDKLNELDTENVKPLIYMTDEKNVLRPDEPEITLTQKEALKNAPKKDSDYFKAPKVIEQNR

SEQ ID NO: 4785 - DNA, 456 bp, Unknown
  Obtained from environmental sample
  misc_feature (1)..(456): n is a, c, g, or t
gtgaaacgaaacaagaacatatattgcctggaagggctttggaacgattacaacttaaaagataaatcatcggtaattcctttattggaatttttatcgaaatcaaacagctgcgattttatttatcatgactgcgccaccaaggatgagctttctttcttcctgaaaaaatgggcggtaaaatctctctcacataaattcccgatcttatatcttgcatgccatggagaacaggaaaggatctttttaaaccgtcacgattttgtaacgctgaatgagattgccgatattttagaagacaagtgttacgggcaagttttttatttcggatcctgctctactcttcagatcgaacaaagaaagatccagtcattcctgacaaaaacaaacgccattgctgccatcggttaccaggtgaatgtggactggatgaaatcaccggctgggaaccgctag

SEQ ID NO: 4786 - protein, 151 aa, Unknown
  Obtained from environmental sample
  misc_feature (1)..(151): Xaa is any amino acid
MKRNKNIYCLEGLWNDYNLKDKSSVIPLLEFLSKSNSCDFIYHDCATKDELSFFLKKWAVKSLSHKFPILYLACHGEQERIFLNRHDFVTLNEIADILEDKCYGQVFYFGSCSTLQIEQRKIQSFLTKTNAIAAIGYQVNVDWMKSPAGNR

SEQ ID NO: 4787 - DNA, 612 bp, Unknown
  Obtained from environmental sample
  misc_feature (1)..(612): n is a, c, g, or t
atgaatgcggtacaaaagttaatatcaacatatccggtattaatattcagcaaaacatattgtccttattgtcaaatggcaaaaaaagcattgagtgcagttggtgcaaagtttcatgctgtcgaacttgataccattcaagaaggtgctgtcatgcaatctgcattacaacaactcactggccgatctactgttccaaatgtctttattggtttgggttttgttgttgttgttttcttatttatcattttatcattttatcattttaccattttattttatttattacattttgatttcaaaacaaacaaaaattgcattccatttttggttgtttacgggtttttgcgcatttcaatcacatttcgatttggttgtggtggtttatttcaaataaaaataaaggcatttaaaacattggtatattttacatacaacaatgccaatagcctcaaaaaaatatggggggggccccaaacccaaacctttttacaggccgggcaacttaaaaaaattaaacaaactcattttcccaaaaaagaaacaaaaattttatctttcatcttaccattctttaaaaaaaaggaccccattaaaaaaaaatggatttga

SEQ ID NO: 4788 - protein, 203 aa, Unknown
  Obtained from environmental sample
  DOMAIN (12)...(79): Glutaredoxin
  misc_feature (1)..(203): Xaa is any amino acid
MNAVQKLISTYPVLIFSKTYCPYCQMAKKALSAVGAKFHAVELDTIQEGAVMQSALQQLTGRSTVPNVFIGLGFVVVVFLFIILSFYHFTILFYLLHFDFKTNKNCIPFLVVYGFLRISITFRFGCGGLFQIKIKAFKTLVYFTYNNANSLKKIWGGPQTQTFLQAGQLKKIKQTHFPKKETKILSFILPFFKKKDPIKKKWI

SEQ ID NO: 4789 - DNA, 519 bp, Unknown
  Obtained from environmental sample
  misc_feature (1)..(519): n is a, c, g, or t
atgccttgggatcaacttagtgtaagcattgatccatatgaggcagtcccatttgtaaataattataaatggtatgtaaatggagttttagtaaaagaaggtgaaggtgttatagattattgcacttgtgataatgaaggtccagatcaaagaatatgcggatataatacggttactttagaaggagaaaccgaatgtggcaccttccaacttggatatttagaatttgaacaagtctgctacggtgcaagagtaaaccttgaagcatatcctaatcccattaaagatttagttacaataaaattgagggatataaaaggcaatggcaaaacagtggtgaatgaaattaaggaattgaaagtattggataaactgggacaaataaagaaaacttataagtttggtaaaggtcaaaaagaagtccaaattaatatatcagatttaccgagtgatatttatatcattgaggtaaacgatggcacaaacagagctacaattcaagttattaaagtcaaataa

SEQ ID NO: 4790 - protein, 172 aa, Unknown
  Obtained from environmental sample
  misc_feature (1)..(172): Xaa is any amino acid
MPWDQLSVSIDPYEAVPFVNNYKWYVNGVLVKEGEGVIDYCTCDNEGPDQRICGYNTVTLEGETECGTFQLGYLEFEQVCYGARVNLEAYPNPIKDLVTIKLRDIKGNGKTVVNEIKELKVLDKLGQIKKTYKFGKGQKEVQINISDLPSDIYIIEVNDGTNRATIQVIKVK

SEQ ID NO: 4791 - DNA, 483 bp, Unknown
  Obtained from environmental sample
  misc_feature (1)..(483): n is a, c, g, or t
atgtattattcaattttatttacggggcatatgattgataaggaggaccggcttttgcgtcgttttccttcaagcaaagagggcgttgtcagaaagaaaataaaagaacagcttttaaaagtaaaacatgcagtaaaagaaaaattaaaaggcatagcaggtggtgcctgtggcggggacatcctctttcacgaattatgcctggaactaaatatcgcaagtgaaatttttcttgcattgcctgtaaatgattttaaaaaaagttctgtttcatttgccggtaaagattgggaagaccgttatgaatatttaataagaaagctgcctgttcatttcttgccgcaatcaaatgaaaataatacaatcaatgtatgggaacgtgcaaatctttggatgcttgaatcagcacttaagaacgggggacaaaacatgagcctgattgctttgtgggatggtaagccggtgatgctgggggcggactga

SEQ ID NO: 4792 - protein, 160 aa, Unknown
  Obtained from environmental sample
  misc_feature (1)..(160): Xaa is any amino acid
MYYSILFTGHMIDKEDRLLRRFPSSKEGVVRKKIKEQLLKVKHAVKEKLKGIAGGACGGDILFHELCLELNIASEIFLALPVNDFKKSSVSFAGKDWEDRYEYLIRKLPVHFLPQSNENNTINVWERANLWMLESALKNGGQNMSLIALWDGKPVMLGAD

SEQ ID NO: 4793 - DNA, 405 bp, Unknown
  Obtained from environmental sample
  misc_feature (1)..(405): n is a, c, g, or t
gtgatggtagataggaaagatgcggctcatagggcaaaaagtcttaaaaccctaaagtcaattctttccanacacatatctatatttatttgcccggaaggaacttttaacatgacaaatgcgccactcaaaaatttttatgatggtgcatttcgcatcgcgatagaaacaaaaactccaataaagcctattttgtttttggatacctacgacaggcttaattacaaaagtatcttctcactatcaccgggtatatcccgggctgtttatttgcaggaaacaataacatcgggatatactcttgctgacgtcacggaactcaaagaaaaaatttttaaacagttggtggagtgggttctcaggtataacgacaagctggataagcaggatagtgaactgacataa

SEQ ID NO: 4794 - protein, 134 aa, Unknown
  Obtained from environmental sample
  misc_feature (1)..(134): Xaa is any amino acid
MMVDRKDAAHRAKSLKTLKSILSXHISIFICPEGTFNMTNAPLKNFYDGAFRIAIETKTPIKPILFLDTYDRLNYKSIFSLSPGISRAVYLQETITSGYTLADVTELKEKIFKQLVEWVLRYNDKLDKQDSELT

SEQ ID NO: 4795 - DNA, 678 bp, Unknown; identical to SEQ ID NO: 2527
  Obtained from environmental sample
  misc_feature (1)..(678): n is a, c, g, or t

SEQ ID NO: 4796 - protein, 225 aa, Unknown; identical to SEQ ID NO: 2528
  Obtained from environmental sample
  DOMAIN (145)...(222): Transcriptional regulatory protein, C terminal
  misc_feature (1)..(225): Xaa is any amino acid

SEQ ID NO: 4797 - DNA, 594 bp, Unknown
  Obtained from environmental sample
  misc_feature (1)..(594): n is a, c, g, or t
ttggtaaacgcttcaacagagaatggatttcagaaatctggatttcaatttaacgatggaggccactatgcgatcattgggccgaatggttcagggaaatccactttattgcaggtcatttccggcttttctatttataatgaaggaagtgtgaattatttcgatggcaatcaatccatttcaactgaaaagatctttcaaaaagtttctttgtcagctccatatctcgatgtaattgaagagatgacgctgagcgaatttttttctttccatgaaaagatgaaaggctggttgccgcaaatgaatacaaaggaaattattcttttatcttctttggaaaatgctgctcagaagcaaatccggtattttagcagtggtatgaagcaaagagtaaaactggctcaggccgtttttagcaacacaccaatcgttctcctggatgaaccgctcaccaacctcgatgaagaaggcgtttctctttattacaatctgatcgaaaaatattgtaaaaaccgactggtaattgtgagcagtaatgataaaaaagaatatgctttttgtaatgaagtacttgatatcaaaaagtataaatga

SEQ ID NO: 4798 - protein, 197 aa, Unknown
  Obtained from environmental sample
  DOMAIN (20)...(196): ABC transporter
  misc_feature (1)..(197): Xaa is any amino acid
MVNASTENGFQKSGFQFNDGGHYAIIGPNGSGKSTLLQVISGFSIYNEGSVNYFDGNQSISTEKIFQKVSLSAPYLDVIEEMTLSEFFSFHEKMKGWLPQMNTKEIILLSSLENAAQKQIRYFSSGMKQRVKLAQAVFSNTPIVLLDEPLTNLDEEGVSLYYNLIEKYCKNRLVIVSSNDKKEYAFCNEVLDIKKYK

SEQ ID NO: 4799 - DNA, 324 bp, Unknown
  Obtained from environmental sample
  misc_feature (1)..(324): n is a, c, g, or t
ttgacaggcacacaaaattggattgatgtttcgcagtttctcaagttaaggaaaggcgaaatggacgaatttgattatgaagaaaaaaaaatcatgatattgaatctaaacggcgagttttgcgcctcagatcgcatttgtactcatgcgtatgttgacctcaccgggggtattttgaatgaatctgaaagaaccgtaacctgtccattacatttatcgtcttttgatctgaaaagtggtagcgctttgaacctgcctgcagaaaagccacttgaaatttatccgatgaaaaaggaaaagaacaagttgttgattttgatataa

SEQ ID NO: 4800 - protein, 107 aa, Unknown
  Obtained from environmental sample
  DOMAIN (6)...(101): Rieske [2Fe-2S] domain
  misc_feature (1)..(107): Xaa is any amino acid
MTGTQNWIDVSQFLKLRKGEMDEFDYEEKKIMILNLNGEFCASDRICTHAYVDLTGGILNESERTVTCPLHLSSFDLKSGSALNLPAEKPLEIYPMKKEKNKLLILI

SEQ ID NO: 4801 - DNA, 810 bp, Unknown
  Obtained from environmental sample
  misc_feature (1)..(810): n is a, c, g, or t
atgtatgatgaaatattacaaagacatgcatctaataaaccattttttgatgaaaaagcagtaactgaccctgaacaatatggtagagaatgggggcaattaacaggtcaaccattaactacatatggaattgctaaggcttctccaacagcaactaaattagctggttatcctactgaattaattggtagaactatggctaaacatacaccattatctactatgactggtgtgggtgttggtgcaagtatgggtggtattcctggtgctattgttggaactatgaaacctagtactagaattttaagggctatagaaagacctactggtagaatgattgaatctgttggtaagtcaatgaaaaatgtgggtaaatcaagtgtaggtaaagaattaactagtgatatattaaatgaagcagaattaactgagggtcaagatatcactccacctaagaaatttaaagtaatcaatcaagagaatgtaattaataaagttaagcctaaagttagacttaatgcagatggcacctttactgatatgaatactggtgaagtgttggatagtaaaggtcagccaattattgaatataatggtaagccaattagtaaggattctcctttttgcttgaagaatcgtcctaatacaactgaaatgaatttaagttcaaagggaactttacctaagcaagacttaccattatttgatgaacaaggtaaaattattagtggacgagaattactaaaccaagatatgaatctaaacgattaccaaaatgggacgcaaatggaaatccaaagattatggtaa

SEQ ID NO: 4802 - protein, 269 aa, Unknown
  Obtained from environmental sample
  misc_feature (1)..(269): Xaa is any amino acid
MYDEILQRHASNKPFFDEKAVTDPEQYGREWGQLTGQPLTTYGIAKASPTATKLAGYPTELIGRTMAKHTPLSTMTGVGVGASMGGIPGAIVGTMKPSTRILRAIERPTGRMIESVGKSMKNVGKSSVGKELTSDILNEAELTEGQDITPPKKFKVINQENVINKVKPKVRLNADGTFTDMNTGEVLDSKGQPIIEYNGKPISKDSPFCLKNRPNTTEMNLSSKGTLPKQDLPLFDEQGKIISGRELLNQDMNLNDYQNGTQMEIQRLW

SEQ ID NO: 4803 - DNA, 438 bp, Unknown
  Obtained from environmental sample
  misc_feature (1)..(438): n is a, c, g, or t
ttgccgggagatataaaatcgaaactgaatccttacatggagccgctgtatgataatttaaaattcatccaaagccagttcgatgaaaaaagtaaagaatttgcaaaagtggctgaaatgcttgcttctgagaaacttgtaattacacctctggcatatatccgcggccgcagtttaagcaatatattttttattgttgatgaagcgcaaaaccttactcctcatgaagttaaaacaataattacgcgcgccggcgaaggcaccaaaattgtttttacaggagatatttttcagattgatacaccttatttagatgcacaaagtaatggcttgtcttatttaattgataaagtacgagatcaaaaattatatgcacacattactttagaaaaaggcgaaagatctgaactggcaaaccttgccaacttgcttttgtaa

SEQ ID NO: 4804 - protein, 145 aa, Unknown
  Obtained from environmental sample
  DOMAIN (1)...(145): PhoH-like protein
  misc_feature (1)..(145): Xaa is any amino acid
MPGDIKSKLNPYMEPLYDNLKFIQSQFDEKSKEFAKVAEMLASEKLVITPLAYIRGRSLSNIFFIVDEAQNLTPHEVKTIITRAGEGTKIVFTGDIFQIDTPYLDAQSNGLSYLIDKVRDQKLYAHITLEKGERSELANLANLLL

SEQ ID NO: 4805 - DNA, 312 bp, Unknown
  Obtained from environmental sample
  misc_feature (1)..(312): n is a, c, g, or t
ttgcaaaaatcaaacatctcagacgacggtaaaagtattttgagagctgataatccaaatcccatcatgtctactgaagaaataaaagatctcgcttatcaatctttgaaagcagaaattcatttcaaacctattttgggcagagataatccaaacttttctttggatttggaattcaaagtggatagtgaagatacgaattcaagacaggtgtacataaaacaagctcgtccatacatcganttaatctcacaaatattttctagaccaacgactagatttctcaaattagctggatcaaagttagtttag

SEQ ID NO: 4806 - protein, 103 aa, Unknown
  Obtained from environmental sample
  misc_feature (1)..(103): Xaa is any amino acid
MQKSNISDDGKSILRADNPNPIMSTEEIKDLAYQSLKAEIHFKPILGRDNPNFSLDLEFKVDSEDTNSRQVYIKQARPYIXLISQIFSRPTTRFLKLAGSKLV

SEQ ID NO: 4807 - DNA, 318 bp, Unknown
  Obtained from environmental sample
  misc_feature (1)..(318): n is a, c, g, or t
ttgatcgcttcttttcctttgatcattttgtatgaatacttccatattcaatctttgtttattaataaatggtttttatatggtgttatcttaattgtaagctacctcatggtttctaaccgtacattcatggccattaaattcaccgatttttcatttaagaaaaatctttttaaatatattcttttaacacttgctctaatttccatagtgtttttaaagtggtttgcagtgcctgttatctttatcacctatttaattatttccggtttttcgaaacagcccggtatcatttctcaaaaaagcaacggaagttaa

SEQ ID NO: 4808 - protein, 105 aa, Unknown
  Obtained from environmental sample
  misc_feature (1)..(105): Xaa is any amino acid
MIASFPLIILYEYFHIQSLFINKWFLYGVILIVSYLMVSNRTFMAIKFTDFSFKKNLFKYILLTLALISIVFLKWFAVPVIFITYLIISGFSKQPGIISQKSNGS

SEQ ID NO: 4809 - DNA, 504 bp, Unknown
  Obtained from environmental sample
  misc_feature (1)..(504): n is a, c, g, or t
gtggattttggcgccagctatggcggttacaacgcagatctttcccgtacaattcccgtaaatggaaaattcacccgcaggcgcaccacggtcaataatacatgtttgcatttacacgactatgcaaaaagtttattgaagccaggcatttctattgttgattatacagaaaaagtaggtgaagaagccacgcagcaatttttgaaaattggattacttaaaaagaccgaggttaaaaatgaagatcctgataacagagcttatcgtaaatatttatatcacggcatttcgcatcatctaggtgttgatgtacacgacctgggtacaaaaacagaacctataaaggcaggaatgttatttactgtggaacccggaatttatattgagcaggaaggtatgggcatacgcattgaaaacaatgtatggataaccaaaaggggaaacattgatcttttnaaaggaattccaattactgttgaagagatagaagcggctatgaaataa

SEQ ID NO: 4810 - protein, 167 aa, Unknown
  Obtained from environmental sample
  DOMAIN (2)...(153): metallopeptidase family M24
  misc_feature (1)..(167): Xaa is any amino acid
MDFGASYGGYNADLSRTIPVNGKFTRRRTTVNNTCLHLHDYAKSLLKPGISIVDYTEKVGEEATQQFLKIGLLKKTEVKNEDPDNRAYRKYLYHGISHHLGVDVHDLGTKTEPIKAGMLFTVEPGIYIEQEGMGIRIENNVWITKRGNIDLXKGIPITVEEIEAAMK

SEQ ID NO: 4811 - DNA, 645 bp, Unknown
  Obtained from environmental sample
  misc_feature (1)..(645): n is a, c, g, or t
atgtatntgaacgcgctacatnacagggcaatagtgatggcaaaagaaaatactttttcatgtgatgagttttacaaacaaaaattgacaattaatatcgatttacaaaaattctttgaccaagaagggctacttcggttattacaaattaagtacaacatcctaatcacccaatacatccgtacaaattcgtgggcaataacctcattccatccgggcaaacagagtaattttatgaccttcgccacagcacgaaaaatcataaccatggagcaggtaaaagcaacaactatagacgggtatatctctctttttcctaaagatgttcaaacattgctaaaagaactgagaacaacgattaagaaagcagcgccgggttcctcggaatctatcaaatataacatggcgtgttttgtgctcaacggcaaccttgtttacttcgcaggttttaaaaatcatatcggcttctattctgccccgactgacattgaaacgttcagaaaagcgctatccccctacaaaactggcaaaggttccatccagtttccattggataaaccattgccgttggatctcatcaccaagatggtgaaattcagggtgcagcaaaatgcatcaaagacacgtaatcataaaacacggtag

SEQ ID NO: 4812 - protein, 214 aa, Unknown
  Obtained from environmental sample
  misc_feature (1)..(214): Xaa is any amino acid
MYXNALHXRAIVMAKENTFSCDEFYKQKLTINIDLQKFFDQEGLLRLLQIKYNILITQYIRTNSWAITSFHPGKQSNFMTFATARKIITMEQVKATTIDGYISLFPKDVQTLLKELRTTIKKAAPGSSESIKYNMACFVLNGNLVYFAGFKNHIGFYSAPTDIETFRKALSPYKTGKGSIQFPLDKPLPLDLITKMVKFRVQQNASKTRNHKTR

SEQ ID NO: 4813 - DNA, 693 bp, Unknown
  Obtained from environmental sample
  misc_feature (1)..(693): n is a, c, g, or t
atgcattccttagtcagttgtgcccaaaaaactgatgaaattttcaatgcaaaagaagtagaacgtatagaacgcacattggcatctgatgaaatgaagggaagagaagcaggaanacaaggtagcgaaaaagctgctcaatttattgcgggtgaattcaaaaaaactggcctggtaacatggaataaaagtgctgactatttgcaaccttttaaattggttcaccctaaacatttagaagtaaagggtgaaatgaatgataaagaacttgattcaaaaaatctattcgtgctcacaaccaaaccggagctggaagtaaatgaaaactctggttatgaatttaaaaccatacctgccggcgccaatatgatgcagttagcttataatattattaatgaagggaaaaaaacaattgttttcgtggatgagtcctatgctactaatttttcccgtctcaatcgttttgtacggccggtttttgaatctgaaagtagcactgtgtttattctttccaatataactgcgccgcaaaaatttaaaattaaggctaagcatacaattggcgaaatagctttgaacaatgtggtaggaatattgcccggaaaaacaaagccaggtgagtatgttattttttctgcgcactacgatcatttaggaatgggaaagccggaaaaacggggacagtatttataa

SEQ ID NO: 4814 - protein, 230 aa, Unknown
  Obtained from environmental sample
  misc_feature (1)..(230): Xaa is any amino acid
MHSLVSCAQKTDEIFNAKEVERIERTLASDEMKGREAGXQGSEKAAQFIAGEFKKTGLVTWNKSADYLQPFKLVHPKHLEVKGEMNDKELDSKNLFVLTTKPELEVNENSGYEFKTIPAGANMMQLAYNIINEGKKTIVFVDESYATNFSRLNRFVRPVFESESSTVFILSNITAPQKFKIKAKHTIGEIALNNVVGILPGKTKPGEYVIFSAHYDHLGMGKPEKRGQYL

SEQ ID NO: 4815 - DNA, 735 bp, Unknown
  Obtained from environmental sample
  misc_feature (1)..(735): n is a, c, g, or t
ttgactatccgaaaaaatggcttcactgggagaatcactgcaggcattgcacacgagatccagaaccctttaaacttcgtgaataatttttctgaagttaatgctgaattgcttgctgaactgaaacaagagatcagtaaaggaaacattcatgaagcaaaaaatattgccaatgatttaatcgataacgaacaaaagataaatcatcacggtaaacgtgcagacgccatagtaaaaggcatgttgcaacactcacgcattagcacaggacaaaaagaattaaccaatatcaatacccttgctgatgaatatttaagactggcttaccatggcatgagggctaaggacaatttctttaatgtagatatgaagactgattttgaccagggtattgaaaagattaagatcatcccacaggacataggaagagtgctcctcaatttaattaccaatgctttttatgcagtgaatgaaaaaaagaaacaacaacaagagggctatgaaccaacaataaccgtagctacgaaacgacttcaggacaaagtagaaatacgggttaaggacaatggcaatggcattcctcaaaaaatattggataaaatctttcaaccattctttactaccaaaccgacagggcagggaactggattgggtttgagtttaagctatgatattgtaaaagcacatggcagcgaaataaaagtgaagacgaaagaaaatgagggaacagagttn

SEQ ID NO: 4816 - protein, 245 aa, Unknown
  Obtained from environmental sample
  DOMAIN (136)...(245): Histidine kinase-, DNA gyrase B-, and HSP90-like ATPase
  misc_feature (1)..(245): Xaa is any amino acid
MTIRKNGFTGRITAGIAHEIQNPLNFVNNFSEVNAELLAELKQEISKGNIHEAKNIANDLIDNEQKINHHGKRADAIVKGMLQHSRISTGQKELTNINTLADEYLRLAYHGMRAKDNFFNVDMKTDFDQGIEKIKIIPQDIGRVLLNLITNAFYAVNEKKKQQQEGYEPTITVATKRLQDKVEIRVKDNGNGIPQKILDKIFQPFFTTKPTGQGTGLGLSLSYDIVKAHGSEIKVKTKENEGTEX

SEQ ID NO: 4817 - DNA, 687 bp, Unknown
  Obtained from environmental sample
  misc_feature (1)..(687): n is a, c, g, or t
gtgaataatttttctgaagttaatgctgatntgcttgctgaactgaaccaagagatcagtaaagganacattcatgaagcaaaaaatattgccaatgatttaatcgataacgaacaaaagataaatcatcacggtaaacgtgcagacgccatagtaaaaggcatgttgcaacactcacgcattagcacaggacaaaaagaattaaccaatatcaatacccttgctgatgaatatttaagactggcttaccatggcatgagggctaaggacaatttctttaatgtagatatgaagactgattttgaccagggtattgaaaagattaagatcatcccacaggacataggaagagtgctcctcaatttaattaccaatgctttttatgcagtgaatgaaaaaaagaaacaacaacaagagggctatgaaccaacaataaccgtagctacgaaacgacttcaggacaaagtagaaatacgggttaaggacaatggcaatggcattcctcaaaaaatattggataaaatctttcaaccattctttactaccaaaccgacagggcagggaactggattgggtttgagtttaagctatgatattgtaaaagcacatggcagcgaaataaaagtgaagacgaaagaaaatgagggaacagagtttattgttcaactgccaatagccacattatga

SEQ ID NO: 4818 - protein, 228 aa, Unknown
  Obtained from environmental sample
  DOMAIN (110)...(226): Histidine kinase-, DNA gyrase B-, and HSP90-like ATPase
  misc_feature (1)..(228): Xaa is any amino acid
MNNFSEVNADXLAELNQEISKGXIHEAKNIANDLIDNEQKINHHGKRADAIVKGMLQHSRISTGQKELTNINTLADEYLRLAYHGMRAKDNFFNVDMKTDFDQGIEKIKIIPQDIGRVLLNLITNAFYAVNEKKKQQQEGYEPTITVATKRLQDKVEIRVKDNGNGIPQKILDKIFQPFFTTKPTGQGTGLGLSLSYDIVKAHGSEIKVKTKENEGTEFIVQLPIATL

SEQ ID NO: 4819 - DNA, 531 bp, Unknown
  Obtained from environmental sample
  misc_feature (1)..(531): n is a, c, g, or t
atgggtcgcaatggtaaattcggtgtgaaaactagaagttatatcacatcactaacactcagcaaacttccttcggcttctcgtttgaaatacgaagagttcatcaaagaaaagagtctccatgttatggaggggacaattcttgatatgatggaagtttacgaagatttagatgatttcatcatacaacatgagtatgatgttagatgtttggggtttgacccctataatgctaaagaatttgttaatcggtgggaacaagaaaatggtgttttcggtatagaaaaggttattcagggtgctcgaactgagtcggttcctctaggagaactcaaaactcttagcgaagaacgtttattgatatttgatgaacaattgatggcctttgctatgggtaatgccatcacccttgaagatactaacggaaaccgaaagctatggaaaaaacgttacgaagaaaagattgataacgtagccgctttgatggatgcctgggtcgcatacaagatcaacaaggaggcgttcgaataa

SEQ ID NO: 4820 - protein, 176 aa, Unknown
  Obtained from environmental sample
  misc_feature (1)..(176): Xaa is any amino acid
MGRNGKFGVKTRSYITSLTLSKLPSASRLKYEEFIKEKSLHVMEGTILDMMEVYEDLDDFIIQHEYDVRCLGFDPYNAKEFVNRWEQENGVFGIEKVIQGARTESVPLGELKTLSEERLLIFDEQLMAFAMGNAITLEDTNGNRKLWKKRYEEKIDNVAALMDAWVAYKINKEAFE

SEQ ID NO: 4821 - DNA, 837 bp, Unknown
  Obtained from environmental sample
  misc_feature (1)..(837): n is a, c, g, or t
atgaataacaacaaacgcagctgggccgagccatataaaatgaaaatggtagagctgttgaaaatgacaactcctgcgcaacgcaaagtagcattgaaagaggcggggtacaatacatttttactcagatcggaggatgtatacattgatctgctgacagacagcggcacttccgccatgagtgacaggcagtgggccggaatgatgatgggcgatgaagcgtatgcaggcagcagaaatttttatcacctggaagaagtggttaaatccgtgtacggctataaatatctcataccgacacatcagggccgcggcgcagagaacatcctctccaggatccttatcaaaaaaggcgatatcattcccggcaatatgtatttcactaccacaagattacaccaggaattggcaggtggaaaatttgaagacatcatcatcgatgaagcgcatgatccagaaagcgaatttccgttcaaaggcaatgtcgacctggacaagcttcagaaacttattgacaaacatggcgccaaaaagattccttatgtcagcattgcaacgagtgtgaatatggcaggcggccagccgatcagcatgaaaaatcttaaagaacttagagcactcacgcggaaacatggcatccgcatcattcatgacatgacaagggttgctgaaaatgcttatttcattcaacaacgtgaaagcggatatcatgatcaagctatcaaggacatcgtaaaacaaatctgtaatctgacggatggagccactatgagcgcaaagaaagattcgttagtcaacattggtggtttcctgccatcaacgactgggatgttttga

SEQ ID NO: 4822 - protein, 278 aa, Unknown
  Obtained from environmental sample
  DOMAIN (6)...(278): Beta-eliminating lyase
  misc_feature (1)..(278): Xaa is any amino acid
MNNNKRSWAEPYKMKMVELLKMTTPAQRKVALKEAGYNTFLLRSEDVYIDLLTDSGTSAMSDRQWAGMMMGDEAYAGSRNFYHLEEVVKSVYGYKYLIPTHQGRGAENILSRILIKKGDIIPGNMYFTTTRLHQELAGGKFEDIIIDEAHDPESEFPFKGNVDLDKLQKLIDKHGAKKIPYVSIATSVNMAGGQPISMKNLKELRALTRKHGIRIIHDMTRVAENAYFIQQRESGYHDQAIKDIVKQICNLTDGATMSAKKDSLVNIGGFLPSTTGMF

SEQ ID NO: 4823 - DNA, 351 bp, Unknown
  Obtained from environmental sample
  misc_feature (1)..(351): n is a, c, g, or t
gtgaatatgatgcctgtagaattatcggncggcatgagaaaaaagattgctttgcccagaacactaatgctaagtcctgagattattttatatgatgaaccaacgacaggtctagatccaataacgggaaaagagataagtgagctggtgaatgagattaaagagaagtataacacttcatcattgattatatcacacgatatgagatgtatcaaattaactgccgacaggattgtggtattaattgatgggaaatgttatgcagaaggaacgtatcaggagctagaaagatcgggggatcaaaaagtgaaacaattttttgaatcatatggcaaagaaaactttaaatag

SEQ ID NO: 4824 - protein, 116 aa, Unknown
  Obtained from environmental sample
  misc_feature (1)..(116): Xaa is any amino acid
MNMMPVELSXGMRKKIALPRTLMLSPEIILYDEPTTGLDPITGKEISELVNEIKEKYNTSSLIISHDMRCIKLTADRIVVLIDGKCYAEGTYQELERSGDQKVKQFFESYGKENFK

SEQ ID NO: 4825 - DNA, 585 bp, Unknown
  Obtained from environmental sample
  misc_feature (1)..(585): n is a, c, g, or t
atgaagcaaccaggaaaaagcttccaaaaaggaattcattctggaaaaagcgggcacagatgtttctcgaaaaaggatttgccgcaaattcttatgcgggacctcgctgaaaccgttggcatcgaagccgccagtttgtataatcacattcgttccaaaaacgagatgcttgaaagcattgcgtttgatgtggccaaccggtttaccatgtacatggatgagatcgaatcgacgaaccagggttcaatcaaaaaaattgaaacgcttcttcgttttcatataaagcagatgatagagaactttgaagaagtgattgtttgcgaccgtgaatggaaacatcttgatgagccttacctttctaatttccataatcaacgccgcacttaccgaaagcggtttgccgctattattgaagaaggtatctcaaaaggcgatataaaaaaaattgacgctcctactgctgtactaataatgctgcattctgtaaacgggatcgaaagctggcatcgctctacggcaaaaattaccgcgaaagaactggaagacaatatggttttaataatgattgatggattgaggaaataa

SEQ ID NO: 4826 - protein, 194 aa, Unknown
  Obtained from environmental sample
  DOMAIN (16)...(60): Bacterial regulatory proteins, tetR family
  misc_feature (1)..(194): Xaa is any amino acid
MKQPGKSFQKGIHSGKSGHRCFSKKDLPQILMRDLAETVGIEAASLYNHIRSKNEMLESIAFDVANRFTMYMDEIESTNQGSIKKIETLLRFHIKQMIENFEEVIVCDREWKHLDEPYLSNFHNQRRTYRKRFAAIIEEGISKGDIKKIDAPTAVLIMLHSVNGIESWHRSTAKITAKELEDNMVLIMIDGLRK

SEQ ID NO: 4827 - DNA, 408 bp, Unknown
  Obtained from environmental sample
  misc_feature (1)..(408): n is a, c, g, or t
gtgtgcaacatcggccacttcgacaacgagatcgacgtcgcgtcgctgtcgaagtaccagtgggacgagatcaagccccaggtggatcacgtggttttcccggacggcaagcggatcatcatgctggccaagggacgcctggtgaacctgggctgcggcaccggccatccgagctacgtcatgagctcgagcttcgccaaccagaccatcgcgcagatcgagttgttcacgcaaacggcgaagtacccgatcggcgtctacgtgctgcccaagcacctcgacgagaaagtggcgcggctgcagctgaagaagctcaatgcccagctcaccgtgctgacggaccagcaggccaggtacatcggcgtgagcaaggacggcccgtacaaggccgaccactaccgctactga

SEQ ID NO: 4828 - protein, 135 aa, Unknown
  Obtained from environmental sample
  misc_feature (1)..(135): Xaa is any amino acid
MCNIGHFDNEIDVASLSKYQWDEIKPQVDHVVFPDGKRIIMLAKGRLVNLGCGTGHPSYVMSSSFANQTIAQIELFTQTAKYPIGVYVLPKHLDEKVARLQLKKLNAQLTVLTDQQARYIGVSKDGPYKADHYRY

SEQ ID NO: 4829 - DNA, 678 bp, Unknown
  Obtained from environmental sample
  misc_feature (1)..(678): n is a, c, g, or t
atggacatttttattgacgcatgcttatggggtttacccaaaaaagatgaacttgtttttaccggcatacagcacgtgaacagcgaagacgctgtaatggccacaaaaaaggacagcgttatcaagctggtggcacgggcaaaaaaattaaagaacgggaaagtggctgcctttgtattgcctcagtttgtgaaaaaagaagaccaactggcttttattaaagatgaatacaacggcgtgatcattgaaagctcatttgccgataaacaatttttttatggcaagggcgccggaagtttgccaaccgcttccgcagtattaagcgatatctccgccttgcggtacgaatataaatacgaatacaaaaagctgtatcaccatgcgcctaatgagcttaccaatgatttttatgtaaaaatctacctgggattcactgattgggagcatgtacgaaaagatgattttgaaagcatagaagaatggcattccaacgatcagatcaattacctgattggaattatacattttcaaaaattgcaggaaagcgactggtggaaaaagaatgaggtttcattgatccttaccgcagaccccatcattgaatcactggacgtagtgcgattgaaaaagagaagccttgagctggcgggcttttcagggagttatagtttatcgtaa

SEQ ID NO: 4830 - protein, 225 aa, Unknown
  Obtained from environmental sample
  misc_feature (1)..(225): Xaa is any amino acid
MDIFIDACLWGLPKKDELVFTGIQHVNSEDAVMATKKDSVIKLVARAKKLKNGKVAAFVLPQFVKKEDQLAFIKDEYNGVIIESSFADKQFFYGKGAGSLPTASAVLSDISALRYEYKYEYKKLYHHAPNELTNDFYVKIYLGFTDWEHVRKDDFESIEEWHSNDQINYLIGIIHFQKLQESDWWKKNEVSLILTADPIIESLDVVRLKKRSLELAGFSGSYSLS

SEQ ID NO: 4831 - DNA, 807 bp, Unknown
  Obtained from environmental sample
  misc_feature (1)..(807): n is a, c, g, or t
ttggagcaaccgcaacatgagctctggaacttattagaacctatattgtcgcatgacaaagaagatatagaatttccgtttgttgataaaacagcaaatagtaatgcggaaacaaaagacgttgtagttagaggttggccttcctgtatattttgttcagcaaaagatgagtcaaaatgggaaatatggaatgaaatcaaaagcagaatattaacaacctctcccaatatggttcctgaaaaatataaagaatcaaagaaattgatatcacaaaagaaaggtttacccaatttaattcaacaacaaattataatatctgatgagcgggttgaaaataccaaaaattgtgtcctactaatcaaagaaaagattaatcatttgaaatcaattaataatggaaaaatttctttgtggattccctataacgatttacttgatgaagaattaccagctaacaaaggaaccgatgtaagatatgaagatagagtattttcatttttaaatactatttctattgtaaaaaatgatttaaagatggttctgaatctggaaggtcaaagttcgattattgcagatttaaatgatttaagggaagtgctttcgataactcagagttttgatggattgcctgaattcaaggtgaaatttttcaatgacatagtcttagcatgttatgcaacaaagacaaaaaaagatgtaaaatacaatgataatggtgacaaaattataagagaagaagataaaattgcagttactacaagagactttgtgattatttcaacaagtaacaataacctatcacagtga

SEQ ID NO: 4832 - protein, 268 aa, Unknown
  Obtained from environmental sample
  misc_feature (1)..(268): Xaa is any amino acid
MEQPQHELWNLLEPILSHDKEDIEFPFVDKTANSNAETKDVVVRGWPSCIFCSAKDESKWEIWNEIKSRILTTSPNMVPEKYKESKKLISQKKGLPNLIQQQIIISDERVENTKNCVLLIKEKINHLKSINNGKISLWIPYNDLLDEELPANKGTDVRYEDRVFSFLNTISIVKNDLKMVLNLEGQSSIIADLNDLREVLSITQSFDGLPEFKVKFFNDIVLACYATKTKKDVKYNDNGDKIIREEDKIAVTTRDFVIISTSNNNLSQ

SEQ ID NO: 4833 - DNA, 711 bp, Unknown
  Obtained from environmental sample
  misc_feature (1)..(711): n is a, c, g, or t
ttgattcctgtgccttgggaagcgactgtttcttatggtgaaggtacatcaaagggacctaaggcaattttagatgcttctcaacaagttgatttatatgatttaatttatcctaatggatggaaagagggaattgctatgcaagatattccatctagtattttctacaataatcaatacaccaaagaaaaagttttgaaatatattgataaatacatggaaagagaaattgatttaaatctacaatcagaaatagataaagactgctcagatttaaatgattatgttagagaaacaactaaaaatttccttaatgataataaaatagttggattggttggaggtgatcacagtattccattgggctattttgaatcattatcttcaaaatatgaaaattttggggttttacacatagatgcccatgcagatctaagagacgcttatgaaggtttaacatattctcatgcttcaatattttttaatgctttaaaaattaaaaatattactaaattggtacaagtaggagtgagagatttttgtgaacaagaatataatctcgtaaaagaaaataaagatagaatattcttctacactgattctgaaataagaagagatctatttttaggaaaaactttaaaagaaaaatatagtgaaattatttctaatcttccagagaatgtttatatttctttgacattgatggtttaa

SEQ ID NO: 4834 - protein, 236 aa, Unknown
  Obtained from environmental sample
  DOMAIN (1)...(232): Arginase family
  misc_feature (1)..(236): Xaa is any amino acid
MIPVPWEATVSYGEGTSKGPKAILDASQQVDLYDLIYPNGWKEGIAMQDIPSSIFYNNQYTKEKVLKYIDKYMEREIDLNLQSEIDKDCSDLNDYVRETTKNFLNDNKIVGLVGGDHSIPLGYFESLSSKYENFGVLHIDAHADLRDAYEGLTYSHASIFFNALKIKNITKLVQVGVRDFCEQEYNLVKENKDRIFFYTDSEIRRDLFLGKTLKEKYSEIISNLPENVYISLTLMV

SEQ ID NO: 4835 - DNA, 732 bp, Unknown
  Obtained from environmental sample
  misc_feature (1)..(732): n is a, c, g, or t
ttgaaaatattacactatcatataggttcgcagattgaaaaactttcagatgtacttggtccaatcaaatatgctcttgatgttttctttaaattaaaagagaagaacccatcattggatactttagatataggaggggggatgccgataccatataaaagaacaaaggggtatccagttgataaattaatggaaaaaattcttgaattagtaaagaaggaatcagaaaagagagaacttcctcatccaaacttagtatgcgaatggggtcgttatattgttgcgcctgcccaaatttctgtttttaaagtaattaacacaaaaccaataaattacaagaaaagtctcgctaaaaaatggtatgtaattgatggaagttttatgaacgacttgctagatacttgggctataggtcaaaaatgggctatctcaccagttaataataaaagagatggaacgcttacagatatttggcttgctggttcatcttgtgattctgatgatatttataccggagttgatggggttataaattttccagattatgacataaatggtggtggtgaccctatgtatatagctgtccatgatactggtgcttatcagacatctctagcagcacaacactgcatgctttcatctcctatgacaatagtagtcgaaaatggacatgttgtagtggctcgtaaacatgaatctccagaagatattggtaaaaatgttggttggtag

SEQ ID NO: 4836 - protein, 243 aa, Unknown
  Obtained from environmental sample
  DOMAIN (104)...(221): Pyridoxal-dependent decarboxylase, C-terminal sheet domain
  misc_feature (1)..(243): Xaa is any amino acid
MKILHYHIGSQIEKLSDVLGPIKYALDVFFKLKEKNPSLDTLDIGGGMPIPYKRTKGYPVDKLMEKILELVKKESEKRELPHPNLVCEWGRYIVAPAQISVFKVINTKPINYKKSLAKKWYVIDGSFMNDLLDTWAIGQKWAISPVNNKRDGTLTDIWLAGSSCDSDDIYTGVDGVINFPDYDINGGGDPMYIAVHDTGAYQTSLAAQHCMLSSPMTIVVENGHVVVARKHESPEDIGKNVGW

SEQ ID NO: 4837 - DNA, 540 bp, Unknown; identical to SEQ ID NO: 2163
  Obtained from environmental sample
  misc_feature (1)..(540): n is a, c, g, or t

SEQ ID NO: 4838 - protein, 179 aa, Unknown; identical to SEQ ID NO: 2164
  Obtained from environmental sample
  DOMAIN (54)...(136): Bacterial membrane flanked domain
  misc_feature (1)..(179): Xaa is any amino acid

SEQ ID NO: 4839 - DNA, 540 bp, Unknown; identical to SEQ ID NO: 2163
  Obtained from environmental sample
  misc_feature (1)..(540): n is a, c, g, or t

SEQ ID NO: 4840 - protein, 179 aa, Unknown; identical to SEQ ID NO: 2164
  Obtained from environmental sample
  DOMAIN (54)...(136): Bacterial membrane flanked domain
  misc_feature (1)..(179): Xaa is any amino acid

SEQ ID NO: 4841 - DNA, 432 bp, Unknown
  Obtained from environmental sample
  misc_feature (1)..(432): n is a, c, g, or t
ttggccgtgataccgtcatcatttgaaggacttaatatcaatcattctccttttcagactgaaataacaaatttattaagaaaaagaggatacagcgtaaacaaaatagattacccagatcttttagtaggtgtcaaaaaagaaatacaatatgacaataaaaatatcttgggtctatatgttagatcgttaccagatattatagttactgatcctaatcaatctgactattcatttttgttagacataaaaacttcatttagtaaacatggtgcatttatcgaggctttcccttgggcgtgtaatatagaaagatctgtactctataatggactcaaaacaatatacatgtataatattctacaacagaagaaacaatccgaaaagcgttttttgcagactacagcaaatttatcattcttgatccactag

SEQ ID NO: 4842 - protein, 143 aa, Unknown
  Obtained from environmental sample
  misc_feature (1)..(143): Xaa is any amino acid
MAVIPSSFEGLNINHSPFQTEITNLLRKRGYSVNKIDYPDLLVGVKKEIQYDNKNILGLYVRSLPDIIVTDPNQSDYSFLLDIKTSFSKHGAFIEAFPWACNIERSVLYNGLKTIYMYNILQQKKQSEKRFLQTTANLSFLIH

SEQ ID NO: 4843 - DNA, 576 bp, Unknown
  Obtained from environmental sample
  misc_feature (1)..(576): n is a, c, g, or t
ttggataaaacaaaagtttatcaaatcgtaattgaaacattcgccgaaaatgaccaacctataataaacgagacttttacccgaataaataagtacgacattgacggaaattacgacaaatggttctatcataaaaacacttcaaacccgttagacactaccgaaattgtattcactactatttgtgttaatcccatccaatattctcaacctgtaataacatttttgcattcaaaaaatattgactcagcagatttcgtacacctggcagacaggtttaaactggacagcttaaataaatatatttcagataaaaggcttatatcctggaagaaagccccattatccaattctgctttgggaaacgtttttaagaaaagaaaggccacgggcttgagtaatatcttatttgaccaacaaaacaatattgcgttaattaaacttagagtgtactcaaagaataaatcacagaataagaatctttcaaaaattataatactcaaaaaagtgggaacagattgggaaactatagcttcacttgatgagaagaagcagccaacagcagttttgcaatag

SEQ ID NO: 4844 - protein, 191 aa, Unknown
  Obtained from environmental sample
  misc_feature (1)..(191): Xaa is any amino acid
MDKTKVYQIVIETFAENDQPIINETFTRINKYDIDGNYDKWFYHKNTSNPLDTTEIVFTTICVNPIQYSQPVITFLHSKNIDSADFVHLADRFKLDSLNKYISDKRLISWKKAPLSNSALGNVFKKRKATGLSNILFDQQNNIALIKLRVYSKNKSQNKNLSKIIILKKVGTDWETIASLDEKKQPTAVLQ

SEQ ID NO: 4845 - DNA, 705 bp, Unknown
  Obtained from environmental sample
  misc_feature (1)..(705): n is a, c, g, or t
ttggccaaaaaaatggaagaagctgaaaaaaatgctaaagaaaagattaaaaccctaattaaacagaacaaggtaaccaagctttttatagttaaacaatgttattctgttgataaacaagaaattttaaatcaggcaatttctgaactttctatccctggtcaatctaatttatttctagattgggaagatcatattatccatatcttgaattatggctgggttcataagggggttggactttatattgatccttacaagctttccaaagaagagaagagggaatatattaaaaaaaagtcagaattaattaaggattttattcagaaaaataaattggcctatctggattttagccataaagaattgactgatttagatatagaaatattaagagcagtctatatagacaagccttatggcttagtgatgccttcttgctcatctgttaccaagtttaatcatattaaaaaacagtttgaaaaaatagttgatcaattacaaaaaaaagaaatagcctcgataattgaaaaagaaaaaactgcctttctttttaaatcttactattttttagaaagtaacattatcccttttgatcatgatgagttgcaatcgctagagcaaataactaataatacacaagaattagttaaaatattgcgttcacactatcctaatttacagattattaacagtgaattttga

SEQ ID NO: 4846 - protein, 234 aa, Unknown
  Obtained from environmental sample
  misc_feature (1)..(234): Xaa is any amino acid
MAKKMEEAEKNAKEKIKTLIKQNKVTKLFIVKQCYSVDKQEILNQAISELSIPGQSNLFLDWEDHIIHILNYGWVHKGVGLYIDPYKLSKEEKREYIKKKSELIKDFIQKNKLAYLDFSHKELTDLDIEILRAVYIDKPYGLVMPSCSSVTKFNHIKKQFEKIVDQLQKKEIASIIEKEKTAFLFKSYYFLESNIIPFDHDELQSLEQITNNTQELVKILRSHYPNLQIINSEF

SEQ ID NO: 4847 - DNA, 504 bp, Unknown
  Obtained from environmental sample
  misc_feature (1)..(504): n is a, c, g, or t
ttgaaacggaaagttggtgacactatcaagggaaccggccggcaggaagcgcgaataaagcttgttttcaattatgcaattaacacacagaatgttagcgaaagactaaaaatcctaatttcagataagccagttgatttcaaagttttgccgtcaaacgacgaaagatcagttacgcttgctttaaatcctggtaaatccgacaattattctacacccgtttcaattcaaattgctaagggattaaaggctcaaaatactacgtacgctacgtcagacttacttactgccaatctcagcctgccgtctcccctacgtctcgaagtaactgacatcaaaacaggttttgaaaacaacacaggatttgcgagaattatcacaacccaggagcttaacccggaaagcatcgaaaaaggattcagcatcaatcctgcgttgactttcaaaacggaacccatcgaaaacggctttatattcgcngggatttctacgcaacagcactaa

SEQ ID NO: 4848 - protein, 167 aa, Unknown
  Obtained from environmental sample
  misc_feature (1)..(167): Xaa is any amino acid
MKRKVGDTIKGTGRQEARIKLVFNYAINTQNVSERLKILISDKPVDFKVLPSNDERSVTLALNPGKSDNYSTPVSIQIAKGLKAQNTTYATSDLLTANLSLPSPLRLEVTDIKTGFENNTGFARIITTQELNPESIEKGFSINPALTFKTEPIENGFIFAGISTQQH

SEQ ID NO: 4849 - DNA, 693 bp, Unknown
  Obtained from environmental sample
  misc_feature (1)..(693): n is a, c, g, or t
atggactcctttaccggactcgaaagcattccttgtgtgaccagccccgaaggcaaccgcaatgcagtagcagagcatactttaggattgatcctgaatctgcgcaataaaatttgttccagctttgaagagataaaggacagaaaatggattcgcgatcccaaccgcggaatggagctcgaaggaaagacagtgggaattattggctatggaaataccggttcttcggttgcaaaattattgtcttcttttggtgtaactgttttggcttacgataaatataaattcgattttggtggcggctacatcaaagaagctaaccgcgagcaggtatgtcgttattcggatgtgatcagtttgaatgttccattgacagaagaaacagaacatcttgccgacgatcatttttttaattctttggaaaggtcgccttattttatttcctgctgtaggggaaaagtaactaaaacggctgctctcatatcagcattaaaaaataaaaagatttccggagccggactggatgtactggaaaatgaaaagttagaaacttattcaaaggaagaaaatcatcagctaaactggctgatatctcagccgaatgtaatactgacaccgcatatagccggttattcgcacgaagctttattcaaaatggctaaagtgcttttggaaaaattaggcttgaaataa

SEQ ID NO: 4850 - protein, 230 aa, Unknown
  Obtained from environmental sample
  DOMAIN (23)...(207): D-isomer specific 2-hydroxyacid dehydrogenase, NAD binding domain
  misc_feature (1)..(230): Xaa is any amino acid
MDSFTGLESIPCVTSPEGNRNAVAEHTLGLILNLRNKICSSFEEIKDRKWIRDPNRGMELEGKTVGIIGYGNTGSSVAKLLSSFGVTVLAYDKYKFDFGGGYIKEANREQVCRYSDVISLNVPLTEETEHLADDHFFNSLERSPYFISCCRGKVTKTAALISALKNKKISGAGLDVLENEKLETYSKEENHQLNWLISQPNVILTPHIAGYSHEALFKMAKVLLEKLGLK

SEQ ID NO: 4851 - DNA, 606 bp, Unknown
  Obtained from environmental sample
  misc_feature (1)..(606): n is a, c, g, or t
gtgtttaccaaaaattctaccaccaaaactggtttcctgatttgtttctttttttctgtttgctttcgtcttcatgcgcaaagttttgaggcatctattgggaactttacacctgatgatttagccataaaagagtgtgcatttgataaaaatgctgatgcggtagttattcatgatatagctatatcaaatcatgacaacgaatatcatttggttacccagagaaaaataaaatttaaaatattaaaggagaaaggaatcgaaagggccaatattaaaataatgtattatagtaaccgggattttgaatttattagcaatatagaggctgtggttttaagtttaaacgatgatggagaaatggttaaacaaaaactttctaataagaacatctataaaaaacagttaaacagactttattccgaaatgagtttttcattacccaatgtaaaagtgggaagcattatcgagtattcttataccagtacaatgaaaagttatggagggttgcaggattggtattttcaaacagatatgcctgtaaggtttagcagttataaattgtttattattccgaatgctgaatttgcatatacggtnttataa

SEQ ID NO: 4852 - protein, 201 aa, Unknown
  Obtained from environmental sample
  misc_feature (1)..(201): Xaa is any amino acid
MFTKNSTTKTGFLICFFFSVCFRLHAQSFEASIGNFTPDDLAIKECAFDKNADAVVIHDIAISNHDNEYHLVTQRKIKFKILKEKGIERANIKIMYYSNRDFEFISNIEAVVLSLNDDGEMVKQKLSNKNIYKKQLNRLYSEMSFSLPNVKVGSIIEYSYTSTMKSYGGLQDWYFQTDMPVRFSSYKLFIIPNAEFAYTVL

SEQ ID NO: 4853 - DNA, 303 bp, Unknown
  Obtained from environmental sample
  misc_feature (1)..(303): n is a, c, g, or t
atgcaggcggttttaaaaagagcacatggacataaaggaacttcttttgtggaagtgtatcaaaactgtcctgtgtttaatgatggtgctttctttgctttctccgataaggaaacaaaaaaagaagaagccatttacctggagcatggcaagccattgatctttggagaaaatgagaaccagggaattcgtttggatgggttaacgcccattattgttgatgttataaaagatggagcgaatgatctttgggttcatgatgagagagacaaacaaaagcaaacctggttgcacggtctttga

SEQ ID NO: 4854 - protein, 100 aa, Unknown
  Obtained from environmental sample
  misc_feature (1)..(100): Xaa is any amino acid
MQAVLKRAHGHKGTSFVEVYQNCPVFNDGAFFAFSDKETKKEEAIYLEHGKPLIFGENENQGIRLDGLTPIIVDVIKDGANDLWVHDERDKQKQTWLHGL

SEQ ID NO: 4855 - DNA, 459 bp, Unknown
  Obtained from environmental sample
  misc_feature (1)..(459): n is a, c, g, or t
ttggaatatttaagtttggatgagaggaaacgaattgaagggtttataaaaacgccacctccttttttacgaaaagaggtaaatgataaacaattaagaccacttgaaaacctttatataaaaagtggaggacgtgttgtgctgggtgccgatgcatcggacagtggcattcttccggggtttcagaatcataatgtgatggtgagtatggtgaaggcaggctggactccgctggaagtaataaaaatagcaacgattgatggcgctaaatttttgaacgttgaaaaagaatcaggcagcatagaaattgggaaatccgctgacttaatgattgtatccggtaaaccggacctaagaatggaagatataaaaaatgttgagttagtttttaagaatggcattggttacgattccaaagccttacgtgaacggacaaaaggattggttggaagatattga

SEQ ID NO: 4856 - protein, 152 aa, Unknown
  Obtained from environmental sample
  misc_feature (1)..(152): Xaa is any amino acid
MEYLSLDERKRIEGFIKTPPPFLRKEVNDKQLRPLENLYIKSGGRVVLGADASDSGILPGFQNHNVMVSMVKAGWTPLEVIKIATIDGAKFLNVEKESGSIEIGKSADLMIVSGKPDLRMEDIKNVELVFKNGIGYDSKALRERTKGLVGRY

SEQ ID NO: 4857 - DNA, 417 bp, Unknown
  Obtained from environmental sample
  misc_feature (1)..(417): n is a, c, g, or t
gtggtggtatttgcaaatcttaaacgagccagcacctataaaatttcaaccaggatattacatatatatcaaccggaattaagcattgccagtttaaaaacaataaaggatacagagcctggtatcacaaaaatggtaaacgagtttatcaataatatgactgaaaaaaaattgcgtgctgatcagttcacgacaacattagcaaaggagttgatggatagcacaatgcaggcaagaggttcggattatttcttatcaaaaggtaaatttttaaaatcggagttgctttccaggaaggaattgggtaatgataccagggagtatcgttacaggctcttgtttagtaaagagatattagggttaatgatacagttcaataaagaaaacaaaatagttgatttgcaaacaagtgaataa

SEQ ID NO: 4858 - protein, 138 aa, Unknown
  Obtained from environmental sample
  misc_feature (1)..(138): Xaa is any amino acid
MVVFANLKRASTYKISTRILHIYQPELSIASLKTIKDTEPGITKMVNEFINNMTEKKLRADQFTTTLAKELMDSTMQARGSDYFLSKGKFLKSELLSRKELGNDTREYRYRLLFSKEILGLMIQFNKENKIVDLQTSE

SEQ ID NO: 4859 - DNA, 504 bp, Unknown
  Obtained from environmental sample
  misc_feature (1)..(504): n is a, c, g, or t
atggaaattaagtttttctcttcccttgccaaagaatcagcaaatggcatgtttgttatagacaaacatggaaggacgatattgtttccgtggggcgcaaaaagacaaggttatcttgtgaaagataaaaaccttgtgtcaacattcaagaaattttattcttacactttttccatttacttcattgcattagtaattttgacagccttgtttcacagtttctggtcaattgttgaggtgcttcttgtctgctccatcagcgcatggttcatttactatgtttacacaaacaggattacaaagtctctaacaacagttcaggctagttacaaagaaattgtccttgagaaaattgaatatgaagcatctcaggatatatcttatgaaatacctgcatctaattggagaatctccaatattgaaaataagcaagaatctttattgagtctaaaaaggttttggtcttatcttccacctggacgattggcgatactgtctttttaa

SEQ ID NO: 4860 - protein, 167 aa, Unknown
  Obtained from environmental sample
  misc_feature (1)..(167): Xaa is any amino acid
MEIKFFSSLAKESANGMFVIDKHGRTILFPWGAKRQGYLVKDKNLVSTFKKFYSYTFSIYFIALVILTALFHSFWSIVEVLLVCSISAWFIYYVYTNRITKSLTTVQASYKEIVLEKIEYEASQDISYEIPASNWRISNIENKQESLLSLKRFWSYLPPGRLAILSF

SEQ ID NO: 4861 - DNA, 597 bp, Unknown
  Obtained from environmental sample
  misc_feature (1)..(597): n is a, c, g, or t
ttgattctttggatagccgtaagaaggagcaggnacattgtcaataagctcgatgtcctcgatgccatcgcagtcctgggcacacctgaagaactgaaggacatggatttttcagaaaactttaaaaaagtaaaccgtacctcattccaattgaagacaggcaaacgccttttcagggatccgaacgataaaatcttaggcggtgtgtgttccggactggctgcttacttcggtattcatgacacggtgtgggtgcgcattgcattcttcctcttcaccatgcttggtggttccggcgtattgatctacatcgtgctctgggctatcatcccgccagcaaagactgtctctgacagacttgaaatgatgggagaacccacgaacgtaaataacatcgcccggctggtgaaagaagaactcgaacagttcagcgataagatgcacgagaagtttggcaagaaaaacaaatcttacaagcggccagaagccggagatgacgatcctgaacaagtagttacttccggtttgtcgctcggttcccggtttggaagacatgacaaaatgaaagctccgtacaacacaaaagatttcgtctga

SEQ ID NO: 4862 - protein, 198 aa, Unknown
  Obtained from environmental sample
  DOMAIN (54)...(115): PspC domain
  misc_feature (1)..(198): Xaa is any amino acid
MILWIAVRRSRXIVNKLDVLDAIAVLGTPEELKDMDFSENFKKVNRTSFQLKTGKRLFRDPNDKILGGVCSGLAAYFGIHDTVWVRIAFFLFTMLGGSGVLIYIVLWAIIPPAKTVSDRLEMMGEPTNVNNIARLVKEELEQFSDKMHEKFGKKNKSYKRPEAGDDDPEQVVTSGLSLGSRFGRHDKMKAPYNTKDFV

SEQ ID NO: 4863 - DNA, 747 bp, Unknown
  Obtained from environmental sample
  misc_feature (1)..(747): n is a, c, g, or t
atgagccgcttttataaaattcaattttatttattcttattaatcgctgtttctttttcggcatgtaaaaacggaaaaagtgatgatactgcaaaaaaagaaacgaccgacagcctgggtattgcaaaatcggatacttctattgagatcaatctcgaaaatcctgttgcggatcaaaaagttttgttgcgttttcaaccgccaacctccacaacctattatttcaacaatacttcatcttatacggcgattcgcagaatggacacacttgaaatgaaagcattgtcatcaaaatatgcgaaaatgaaaatgaatgtggttggagttgataaaggaaatatcaaaatagatttttctctgatcgatgtgaagaaaacaattaaagatgacagcgcaactattgattatcaatacggcaaaacaatgacagatccgggacaggatattgatcgtcagcttgaagattgtctcgtgaattctcctattacaattttcatgaatgaaaaaggggaagcggtagacatgcagggatatgaagccattattgcaaaaatgaaaaccattttggaaaaggcaaccggcaaatccgtacccgacgaatatattgcgcagcaaatgagtttgccgacagaaaatatcgataatttatttattgtctttcctgatacggctgtgagcatgggtgaatcttcgcaatacgtggcaaattccgcacttcagggaatgcctattatcatcacacgctaa

SEQ ID NO: 4864 - protein, 248 aa, Unknown
  Obtained from environmental sample
  misc_feature (1)..(248): Xaa is any amino acid
MSRFYKIQFYLFLLIAVSFSACKNGKSDDTAKKETTDSLGIAKSDTSIEINLENPVADQKVLLRFQPPTSTTYYFNNTSSYTAIRRMDTLEMKALSSKYAKMKMNVVGVDKGNIKIDFSLIDVKKTIKDDSATIDYQYGKTMTDPGQDIDRQLEDCLVNSPITIFMNEKGEAVDMQGYEAIIAKMKTILEKATGKSVPDEYIAQQMSLPTENIDNLFIVFPDTAVSMGESSQYVANSALQGMPIIITR

SEQ ID NO: 4865 - DNA, 663 bp, Unknown
  Obtained from environmental sample
  misc_feature (1)..(663): n is a, c, g, or t
atgcttgatatcgattggttactaataattaaaataagtatcaaccgatactccttaatgtttaaaagttttatagctttatttcctttaatttatatgcaaacaagtgagaaggaaaattcacaacaaaaattagagagctacagagacgatgcctataaaatgctggatagtatgatacagaaagttgatgatctgatggttttatcagatattaaacaacattataaaataaaacttagtatgataaaggacgccataatatttaaccatgataaatcttggatagggatttttgaagattctgcaaaacataaaagatattttaaagtcatgtctattttgggcatgaatcttattaggctgaataacgaagtagttcaattttctaaaaatgactcttatgatataaggccacaagtcaacaaacttttgaatggtatttttgaagaaatgaataaaaagaagatgtttcccgaatttaaagaatggatctctgggaatatgataatttatgaaacaataattgatcttgtcgaaaacaaagcatatatctttgatgtccttataaatgatttactggctttattgactaaccaaatagaagaaatcgctttgctgctcaaagtagaattcggagataatgaacatcctgatttgtga

SEQ ID NO: 4866 - protein, 220 aa, Unknown
  Obtained from environmental sample
  misc_feature (1)..(220): Xaa is any amino acid
MLDIDWLLIIKISINRYSLMFKSFIALFPLIYMQTSEKENSQQKLESYRDDAYKMLDSMIQKVDDLMVLSDIKQHYKIKLSMIKDAIIFNHDKSWIGIFEDSAKHKRYFKVMSILGMNLIRLNNEVVQFSKNDSYDIRPQVNKLLNGIFEEMNKKKMFPEFKEWISGNMIIYETIIDLVENKAYIFDVLINDLLALLTNQIEEIALLLKVEFGDNEHPDL

SEQ ID NO: 4867 - DNA, 606 bp, Unknown
  Obtained from environmental sample
  misc_feature (1)..(606): n is a, c, g, or t
atgtttaaaagttttatagctttatttcctttaatttatatgcaaacaagtgagaaggaaaattcacaacgaaaattagagagctacagagacgatgcctataaaatgctggatagtatgatacagaaagttgatgatctgatggttttatcagatattaaacaacattataaaataaaacttagtatgataaaggacgccataatatttaaccatgataaatcttggatagggatttttgaagattctgcaaaacataaaagatattttaaagtcatgtctattttgggcatgaatcttattaggctgaataacgaagtagttcaattttctaaaaatgactcttatgatataaggccacaagtcaacaaacttttgaatggtatttttgaagaaatgaataaaaagaagatgtttcccgaatttaaagaatggatctctgggaatatgataatttatgaaacaataattgatcttgtcgaaaacaaagcatatatctttgatgtccttataaatgatttactggctttattgactaaccaaatagaagaaatcgctttgctgctcaaagtagaattcggagataatgaacatcctgatttgtga

SEQ ID NO: 4868 - protein, 201 aa, Unknown
  Obtained from environmental sample
  misc_feature (1)..(201): Xaa is any amino acid
MFKSFIALFPLIYMQTSEKENSQRKLESYRDDAYKMLDSMIQKVDDLMVLSDIKQHYKIKLSMIKDAIIFNHDKSWIGIFEDSAKHKRYFKVMSILGMNLIRLNNEVVQFSKNDSYDIRPQVNKLLNGIFEEMNKKKMFPEFKEWISGNMIIYETIIDLVENKAYIFDVLINDLLALLTNQIEEIALLLKVEFGDNEHPDL

SEQ ID NO: 4869 - DNA, 774 bp, Unknown
  Obtained from environmental sample
  misc_feature (1)..(774): n is a, c, g, or t
ttgagagagattaaaatagtgtattataccttaataataattttaacagtgtcttgccgagacaatgaacagccaagcaaaattgttttggacaaagtcatttacggtgatgaagaaacaggaaaatacgtatacaaaaatggtcaactaatcaggtacgagtactactcaatagataagctaatacagtacgacctttataattatacggacgacttgctgacatcaaaaaagtattactcattaaataatgacggacaatttgagaaattttccgaagccacaatcacatatgatttagacaacaatttaagtgaagtatcaatagagcaaattgacagacagataacctacaaggccacgtggacaaataattacataacaaagattgagcgtatagaagacaacatatcaaccaacacagaattagaatacaatgacaaagggaacatcatcaaatttattgacttttcaagtgacggctctattaactacattttagaatgtgaatatgatagtaatcctaatcctaaatataaattaaatgacccgacagacattgttttcctcgattttacaaatagctcaccgaataatgcgacttcgataatacaaaaaatagattttgacagcgaggtatacgcgacaacagaaataacatacacttacaatgacaagggattaccaaatgaaagacagtaccaagttactgccttaggagaaacacgagtgactttagcaaagttttcttataaaagcataaagacaaattga

SEQ ID NO: 4870 - protein, 257 aa, Unknown
  Obtained from environmental sample
  misc_feature (1)..(257): Xaa is any amino acid
MREIKIVYYTLIIILTVSCRDNEQPSKIVLDKVIYGDEETGKYVYKNGQLIRYEYYSIDKLIQYDLYNYTDDLLTSKKYYSLNNDGQFEKFSEATITYDLDNNLSEVSIEQIDRQITYKATWTNNYITKIERIEDNISTNTELEYNDKGNIIKFIDFSSDGSINYILECEYDSNPNPKYKLNDPTDIVFLDFTNSSPNNATSIIQKIDFDSEVYATTEITYTYNDKGLPNERQYQVTALGETRVTLAKFSYKSIKTN

SEQ ID NO: 4871 - DNA, 435 bp, Unknown
  Obtained from environmental sample
  misc_feature (1)..(435): n is a, c, g, or t
gtgggcaattacatttggacagtgacgaccatgaataaattattcggtgttatgcttcttttgacatttacctcctgtgtcgttgactactatgacgggagattaaaaattgtgaatcaatcggacaaagtaatctgttttgaccatgaagttgacacaattctagacgtgccttcaattaacaaaaaggaattctttattaacgaaagaatagaacctggggacacagccaatgttgttctatctgggagttcgacaaaatggattatgaaggtcagcagcggtaaggacagcacgttaagtatttttgtgtttgactataaccaagttttaactaatgactggaacactttgagaatgaataagaaatacaaacgtcttgactataaattggacgacttaaatagaaacaactggacggtgattgtagaataa

SEQ ID NO: 4872 - protein, 144 aa, Unknown
  Obtained from environmental sample
  misc_feature (1)..(144): Xaa is any amino acid
MGNYIWTVTTMNKLFGVMLLLTFTSCVVDYYDGRLKIVNQSDKVICFDHEVDTILDVPSINKKEFFINERIEPGDTANVVLSGSSTKWIMKVSSGKDSTLSIFVFDYNQVLTNDWNTLRMNKKYKRLDYKLDDLNRNNWTVIVE

SEQ ID NO: 4873 - DNA, 471 bp, Unknown
  Obtained from environmental sample
  misc_feature (1)..(471): n is a, c, g, or t
ttggtaaatattacggcaggtaacttcatttgtaactggctgaaaccgttcatcattttctacgaattgtttcgttttttgtcaatagttttaatgggttgcagcaattatttttattcaagccttaaaattattgttatgcgattggttttagttctgtcaataatcatcccgtttctctccgatgcacaaattaaccgctctgctaccgaattggcatgcgaaaggatcaaagagtatatagaaacaaagctgtttaaagatcagccttacaaagcaatttcttacggagatttaaagcctgtttcacaacatgattcgaaagtggcatggaccattgaacataaatttgaaattgagacacccgtattcacggataagaaaatggctgtccggacgccacatcatttttcattttatcttgataaaaagctcaaaatacttttggctgaaagttttacgaagcaatga

SEQ ID NO: 4874 - protein, 156 aa, Unknown
  Obtained from environmental sample
  misc_feature (1)..(156): Xaa is any amino acid
MVNITAGNFICNWLKPFIIFYELFRFLSIVLMGCSNYFYSSLKIIVMRLVLVLSIIIPFLSDAQINRSATELACERIKEYIETKLFKDQPYKAISYGDLKPVSQHDSKVAWTIEHKFEIETPVFTDKKMAVRTPHHFSFYLDKKLKILLAESFTKQ

SEQ ID NO: 4875 - DNA, 468 bp, Unknown
  Obtained from environmental sample
  misc_feature (1)..(468): n is a, c, g, or t
ttggccaaagctatacctgaactgattaatggcggggatatccaaaaattccaaagcatttataacagtatgccacagagctctgacgtatttgaggatgccattatcctctctaatcatgatatgaatcgcatacgttcaactttgcacggagatatagcgaaagcgaaactcgcggcttccatcttacttacgctacctggcacaccttatatatactacggagaagaaattggcatgttgggtgtaaagccggatcggcaaatccgggaacctttcatatggggcgatgataattttcagaaaatatgctggaccacattaataaattcagtagcgcctgatgtggtgccactctccgcacaaatggatgatgaacactccatttacaatcattataaaaaatggataaaactcaggaaagaacatcctgcacttttcaaatggagaattaaaattcacggatga

SEQ ID NO: 4876 - protein, 155 aa, Unknown
  Obtained from environmental sample
  misc_feature (1)..(155): Xaa is any amino acid
MAKAIPELINGGDIQKFQSIYNSMPQSSDVFEDAIILSNHDMNRIRSTLHGDIAKAKLAASILLTLPGTPYIYYGEEIGMLGVKPDRQIREPFIWGDDNFQKICWTTLINSVAPDVVPLSAQMDDEHSIYNHYKKWIKLRKEHPALFKWRIKIHG

SEQ ID NO: 4877 - DNA, 516 bp, Unknown
  Obtained from environmental sample
  misc_feature (1)..(516): n is a, c, g, or t
atggactcagaaacaaaaacagactctcttataattcatgatgagtttaaagatgtgagttctcttaggcaaaaatatgaactagagataaaaaaagcggtccagaccggagatctaactttggtaaatacactacaccaagagattcaaactagagtagctgaaattagggtcaaaatagatccctatcaatacgaactgagatctaattttgccaaagaatacggttatgaatatgtgggcaagtttaatgaagaaaaagttgccatagcaaaagaccgttatcgacagtatcttttagtagatattaacaataaccaattaacagatccaaaatatagtataagcaaatttaaggaaggatttgctcagtatagtaatttcagcttaactttagggtttttaaatagccacggcgaagatttaatcctaaaaaaggatgcaaagatagctccaggtagcaatgacttttctgaaggtttagccgccatcaaggatggtaatgggttatggtnn

SEQ ID NO: 4878 - protein, 172 aa, Unknown
  Obtained from environmental sample
  misc_feature (1)..(172): Xaa is any amino acid
MDSETKTDSLIIHDEFKDVSSLRQKYELEIKKAVQTGDLTLVNTLHQEIQTRVAEIRVKIDPYQYELRSNFAKEYGYEYVGKFNEEKVAIAKDRYRQYLLVDINNNQLTDPKYSISKFKEGFAQYSNFSLTLGFLNSHGEDLILKKDAKIAPGSNDFSEGLAAIKDGNGLWX

SEQ ID NO: 4879 - DNA, 840 bp, Unknown
  Obtained from environmental sample
  misc_feature (1)..(840): n is a, c, g, or t
atgcatagagatcgtgacgcctggaaaaagcatatgcacacgatttcacctctcgtgggaaaagaagatttgtggagcgttcttggtgccggtaccggctttctcggttcagataattttccgccttttttggactttttagttgagcattcgggtggtcgttaccaaaaagtagaagtgcctgacgcccagccgggtacaaagcctcaatttaaagttattgaaaatccaaattgggcgcctggcgatctctatgacaccgttcctgaaaaagccgttctctacttagacgaatttcataagtggtcaaaagacgtaaaagatctttttattaagaaggctcttgagtcagacggtaccttccgtatttataacccgaacggtggcttagataaaattagtgtgccattaacaattttgattggttcaaatgatggtgtttcgctcttagccgcgcgtgagaaaaacggtcaacgttttggcaacccgctcacctatgagcagatgcttgaaaaacatcagcggattgctcacgacgaaaatgcaatcgcaggagccatcctggctggcaattcaactgaagaaggcgggcagatcgctaagggcacttcagaagagctcctcaatcgcgtgaaaaccgttgtggtgatgagaccactttctcctgaaaacttgaaagcaatcgccgagagcaagctgaaggtaatgatagaaaaactggcgaatagccacggtggcttttcaggaattaaaattgagtacactcctgccgtgattgattttattcagagttaccattacgtcgccgacacaacgcccgcccaattcttgatccactag

SEQ ID NO: 4880 - protein, 279 aa, Unknown
  Obtained from environmental sample
  misc_feature (1)..(279): Xaa is any amino acid
MHRDRDAWKKHMHTISPLVGKEDLWSVLGAGTGFLGSDNFPPFLDFLVEHSGGRYQKVEVPDAQPGTKPQFKVIENPNWAPGDLYDTVPEKAVLYLDEFHKWSKDVKDLFIKKALESDGTFRIYNPNGGLDKISVPLTILIGSNDGVSLLAAREKNGQRFGNPLTYEQMLEKHQRIAHDENAIAGAILAGNSTEEGGQIAKGTSEELLNRVKTVVVMRPLSPENLKAIAESKLKVMIEKLANSHGGFSGIKIEYTPAVIDFIQSYHYVADTTPAQFLIH

SEQ ID NO: 4881 - DNA, 834 bp, Unknown
  Obtained from environmental sample
  misc_feature (1)..(834): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcttggagtaccgaatggagagaattatataatgctattgccagttataaaaatgacacagcacttcaacttttagaagtaccattcacacagacaaaacatgaaaacataaggcagtatcatatagactttattttcggagcagtacaagaattctatacaccaatttatgacgaacttttttgggtaatgtgggagaacgagaaaaaaataaacgctcaagtattcaacttactttttctaaaaaattcagaaagagcttttcagctaataaaaaagacaattcaaaatgctgatgattattattacctcaacacaggaggtattactgaagacgactcaacacctgtaaatctattagacgtaatgcttgacacaattttagtccgggatagaccgtatgctattgagttaatcaacaaaaatataagagagattaatgttcatcagtttccaactttcgcagacaaggtattaaaaataaaagacatttcttttgtaacatcactttttgacagacttaagtcagaagataatccgcacatatatttaaaagtgacagaagtattgattgccttgaaagacaaggaaattaataaccgtatagtagaggtagccaagacaaatccagccttgaaaaaggattggggaggcaaagagttcacgaaattattaaaggataatggcatcaagtga

SEQ ID NO: 4882 - protein, 277 aa, Unknown
  Obtained from environmental sample
  misc_feature (1)..(277): Xaa is any amino acid
MXXXXXXXXXXXXXXXXXXXXXXXXXXXXXXXXXXXXXXXXXXXXXAWSTEWRELYNAIASYKNDTALQLLEVPFTQTKHENIRQYHIDFIFGAVQEFYTPIYDELFWVMWENEKKINAQVFNLLFLKNSERAFQLIKKTIQNADDYYYLNTGGITEDDSTPVNLLDVMLDTILVRDRPYAIELINKNIREINVHQFPTFADKVLKIKDISFVTSLFDRLKSEDNPHIYLKVTEVLIALKDKEINNRIVEVAKTNPALKKDWGGKEFTKLLKDNGIK

SEQ ID NO: 4883 - DNA, 507 bp, Unknown
  Obtained from environmental sample
  misc_feature (1)..(507): n is a, c, g, or t
atgtgggagaacgagaaaaaaataaacgctcaagtattcaacttactttttctaaaaaattcagaaagagcttttcagctaataaaaaagacaattcaaaatgctgatgattattattacctcaacacaggaggtattactgaagacgactcaacacctgtaaatctattagacgtaatgcttgacacaattttagtccgggatagaccgtatgctattgagttaatcaacaaaaatataagagagattaatgttcatcagtttccaactttcgcagacaaggtattaaaaataaaagacatttcttttgtaacatcactttttgacagacttaagtcagaagataatccgcacatatatttaaaagtgacagaagtattgattgccttgaaagacaaggaaattaataaccgtatagtagaggtagccaagacaaatccagccttgaaaaaggattggggaggcaaagagttcacgaaattattaaaggataatggcatcaagtga

SEQ ID NO: 4884 - protein, 168 aa, Unknown
  Obtained from environmental sample
  misc_feature (1)..(168): Xaa is any amino acid
MWENEKKINAQVFNLLFLKNSERAFQLIKKTIQNADDYYYLNTGGITEDDSTPVNLLDVMLDTILVRDRPYAIELINKNIREINVHQFPTFADKVLKIKDISFVTSLFDRLKSEDNPHIYLKVTEVLIALKDKEINNRIVEVAKTNPALKKDWGGKEFTKLLKDNGIK

SEQ ID NO: 4885 - DNA, 570 bp, Unknown
  Obtained from environmental sample
  misc_feature (1)..(570): n is a, c, g, or t
atgtngcgcanngggcncgggtctgtccgagcactagtggatcaagattgggtatctttgttgggaggtaagatccctgaactgaatgtcagaaaagaagtcatgaaaaaaagtgccggaattttgctatatcgttataaaaacagtggtcccgaagttctgctggttcatcccggcggtccgttttatgtaaataaggatgaacatacatggacaattccaaagggagaaataaacgataatgaggatgtgtttaaagctgccctcagagaattcgaagaggaaaccgggattcagcccgatggaaattttattgagctccgcactgtaaaacagaacgggggcaaacaggtgttcagttgggctgttgaacaagatttaaatgcagataaaatcgaaagcaataccttttccatggaatggcctccaaaatcgggaaaaatgaaagatttccctgaaattgacaaggctgaatggtttgattatgaaaatgcagtaaagaaaattctgaaaggtcagattcccatactcgaagatcttttcgagaagataaatccgaagatcaaataa

SEQ ID NO: 4886 - protein, 189 aa, Unknown
  Obtained from environmental sample
  DOMAIN (35)...(183): NUDIX domain
  misc_feature (1)..(189): Xaa is any amino acid
MXRXGXGSVRALVDQDWVSLLGGKIPELNVRKEVMKKSAGILLYRYKNSGPEVLLVHPGGPFYVNKDEHTWTIPKGEINDNEDVFKAALREFEEETGIQPDGNFIELRTVKQNGGKQVFSWAVEQDLNADKIESNTFSMEWPPKSGKMKDFPEIDKAEWFDYENAVKKILKGQIPILEDLFEKINPKIK

SEQ ID NO: 4887 - DNA, 600 bp, Unknown
  Obtained from environmental sample
  misc_feature (1)..(600): n is a, c, g, or t
atgaatttagatatcaatttacttaaaggcgaacatgtttatctagagtttcttttgccggaacatatcgaagcattaaggttattggcaaaggatgaccgcatttgggagtttacaaaaactttgttgattgatgaacaatacgatcaacggtttgatgattatataaccctggcattggaccgcaatgcgttggaaaaacaaattgcattcatcatacgcaggaaaacggatgatgcaataattggcatgacccgttattatggtattgatgaaaaacaaaaaaggctaaatattggctatacctggtacataccttctgtatggggtaaggtttataataaagaatgtaaactgattttattgggctatgcatttgagcaatcaggtttcaatcgggtggggtttgaagtagctcatcaaaaccttcgttcgcaaaaagctgtgatgaaaattggtgcaataaaagaaggagaattgagaaaacatgcaataagacccgatggggttttccggaatacggttatcttcagcatcatcaatgatgaatggccccagaagaaaaagcacctgattcaattagttgatcctgaaaaataa

SEQ ID NO: 4888 - protein, 199 aa, Unknown
  Obtained from environmental sample
  misc_feature (1)..(199): Xaa is any amino acid
MNLDINLLKGEHVYLEFLLPEHIEALRLLAKDDRIWEFTKTLLIDEQYDQRFDDYITLALDRNALEKQIAFIIRRKTDDAIIGMTRYYGIDEKQKRLNIGYTWYIPSVWGKVYNKECKLILLGYAFEQSGFNRVGFEVAHQNLRSQKAVMKIGAIKEGELRKHAIRPDGVFRNTVIFSIINDEWPQKKKHLIQLVDPEK

SEQ ID NO: 4889 - DNA, 408 bp, Unknown
  Obtained from environmental sample
  misc_feature (1)..(408): n is a, c, g, or t
atgatccacctcggcaagaacaccaagtcgaccatcatctccaaaggcatatctgccggccgctcgaacaattcgtaccgcggcctcgtaaaagtgatgccgaaagccaccggcgcacgcaactacacgcagtgtgattcgatgctgatcggcggcaagtccgaggcgaacacgttcccgtacatcgaggtgatgaacaacaccgccaaggtcgaacacgaagccacgacctcaaagatcagcgaagagcagttgttctacctccaacagcggggcatctcgcaggaagacgccgtgtcgctcatcatcaacggcttttgcaaggaagtgtttcgcgagctgccgatggaatacgcggtcgaggcgacgaaattgttgggattgaagttggaaggaagtgtagggtga

SEQ ID NO: 4890 - protein, 135 aa, Unknown
  Obtained from environmental sample
  DOMAIN (1)...(106): Uncharacterized protein family (UPF0051)
  misc_feature (1)..(135): Xaa is any amino acid
MIHLGKNTKSTIISKGISAGRSNNSYRGLVKVMPKATGARNYTQCDSMLIGGKSEANTFPYIEVMNNTAKVEHEATTSKISEEQLFYLQQRGISQEDAVSLIINGFCKEVFRELPMEYAVEATKLLGLKLEGSVG

SEQ ID NO: 4891 - DNA, 417 bp, Unknown
  Obtained from environmental sample
  misc_feature (1)..(417): n is a, c, g, or t
gtggatcaagaatgcatcacatgggataccaaactaaacaatcatgaatacatagaagtaaatgaatttttattggtggaagtgccggaaagccgtaattatagaattggatggagtagcgaaataaatatccaagccattaaagtaaagttcgacatagcaaagccagaatttgaacaaaagcttccacccggcaactactcaatagtaggtcttgcaaaagatttaaccgaagatcagtggaaggagattgtggatgagaagcaagttgtttgtcctgaatatggacaaaaacacatgatgccagtaaattatgaatcgaaaaaaatggcagcgagttatacaaaatccggcgcatccctattaaaatctcattcacttgaaccagcgactactttaatcttaaaaaaactttga

SEQ ID NO: 4892 - protein, 138 aa, Unknown
  Obtained from environmental sample
  misc_feature (1)..(138): Xaa is any amino acid
MDQECITWDTKLNNHEYIEVNEFLLVEVPESRNYRIGWSSEINIQAIKVKFDIAKPEFEQKLPPGNYSIVGLAKDLTEDQWKEIVDEKQVVCPEYGQKHMMPVNYESKKMAASYTKSGASLLKSHSLEPATTLILKKL

SEQ ID NO: 4893 - DNA, 381 bp, Unknown
  Obtained from environmental sample
  misc_feature (1)..(381): n is a, c, g, or t
atgtatatagagcattttgaaaaagatgttgataaggaaaacaatcagtacaacaaacgccttgcaatgataacggtaatatcaaagtgggatgaacgagaggctgaagattttattagaagtcttgggcggcttattgatttccaaaaagacaatcaggacaaatgggcatttccaaaacgccaagaaccatgtactttgttacacaggttttggcaaagcaaatcagatgcgtgtcccgttgatgccactattcaagaaaaacaagaggaagatttttctgactgggtgtgcgaacaatatgaacagttatcaataattattactaagccgaatagaattgtaggcgtacaggtgagtgacacaacagaatctcaatag

SEQ ID NO: 4894 - protein, 126 aa, Unknown
  Obtained from environmental sample
  misc_feature (1)..(126): Xaa is any amino acid
MYIEHFEKDVDKENNQYNKRLAMITVISKWDEREAEDFIRSLGRLIDFQKDNQDKWAFPKRQEPCTLLHRFWQSKSDACPVDATIQEKQEEDFSDWVCEQYEQLSIIITKPNRIVGVQVSDTTESQ

SEQ ID NO: 4895 - DNA, 402 bp, Unknown
  Obtained from environmental sample
  misc_feature (1)..(402): n is a, c, g, or t
gtgctttcatcacttgatcaattaatgagactgaacaatgttggatttaattttagaaatgattggagtgaaacaataaatgaatcatctaagcagttattcaataattataatttgcctttgtggcttttacttgccggtgaacatggcgagtttgaattaattttttcgattcctaaagatagagaagctgattttttaactgaagctaagcaagttaacctgatgccgatttatcttgctgatataacggaggaatcagaaattaaaataaacatttacgaaaaggagcagattatagattctgaaagaattagaaacctggcatttgaaaaagattttagtccgacgaaatatctgcaaaagttgatggagattgatgaagagctaaaaaaacaataa

SEQ ID NO: 4896 - protein, 133 aa, Unknown
  Obtained from environmental sample
  misc_feature (1)..(133): Xaa is any amino acid
MLSSLDQLMRLNNVGFNFRNDWSETINESSKQLFNNYNLPLWLLLAGEHGEFELIFSIPKDREADFLTEAKQVNLMPIYLADITEESEIKINIYEKEQIIDSERIRNLAFEKDFSPTKYLQKLMEIDEELKKQ

SEQ ID NO: 4897 - DNA, 348 bp, Unknown
  Obtained from environmental sample
  misc_feature (1)..(348): n is a, c, g, or t
atgttaaccttcaaagaagggatggagaatgaacttgcaaaatattataaaaaagacgatgcaaatccgcagctaaggtcaggacttaaaattaaaactgaagataaaacattaacttatgaaagttgtgtaggatcggtttataccgtaaatcccagatgcacgattaaatccattgattatgcggaaggcacattagtattgtatgttgctgatgttgaaaagaaacagattatatggcagtctgtgctcaatgggatcattgatcaggatgccattcggaataataagaatatcaggaaaacaattcagatgatgtttaaacaattcccttacagcaaagattaa

SEQ ID NO: 4898 - protein, 115 aa, Unknown
  Obtained from environmental sample
  misc_feature (1)..(115): Xaa is any amino acid
MLTFKEGMENELAKYYKKDDANPQLRSGLKIKTEDKTLTYESCVGSVYTVNPRCTIKSIDYAEGTLVLYVADVEKKQIIWQSVLNGIIDQDAIRNNKNIRKTIQMMFKQFPYSKD

SEQ ID NO: 4899 - DNA, 489 bp, Unknown
  Obtained from environmental sample
  misc_feature (1)..(489): n is a, c, g, or t
ttggtggattattacagtttgataagattaaaatgtatatcaaagcaatttaatacaatagctaaacaagatattaaattatgtcaaaagttttattattggaaatcagttgatataattaaagcagggaaaatgaatgatagtgaaatttattttttattctttaatggcaatgaaataggttcattaaatttttggagctcgcaaaatgtttcttgttatttatatttagaagaaacattatgggataaaaatacaaaacaaattttaaattggattaaatataataaaaaaataatacaaaaattaggattaaaatttggtcatgttggtttatctaaaaataatggtttaatatttgaaatagacaaatgtaaaagatttcaagaagctataaatttaattttatattttcattacatggctttgacatataaaatagataatagttttaaaaaaaataaaaaaaaatcatgtatcatcatataa

SEQ ID NO: 4900 - protein, 162 aa, Unknown
  Obtained from environmental sample
  misc_feature (1)..(162): Xaa is any amino acid
MVDYYSLIRLKCISKQFNTIAKQDIKLCQKFYYWKSVDIIKAGKMNDSEIYFLFFNGNEIGSLNFWSSQNVSCYLYLEETLWDKNTKQILNWIKYNKKIIQKLGLKFGHVGLSKNNGLIFEIDKCKRFQEAINLILYFHYMALTYKIDNSFKKNKKKSCIII

SEQ ID NO: 4901 - DNA, 357 bp, Unknown; identical to SEQ ID NO: 2711
  Obtained from environmental sample
  misc_feature (1)..(357): n is a, c, g, or t

SEQ ID NO: 4902 - protein, 118 aa, Unknown; identical to SEQ ID NO: 2712
  Obtained from environmental sample
  misc_feature (1)..(118): Xaa is any amino acid

SEQ ID NO: 4903 - DNA, 330 bp, Unknown
  Obtained from environmental sample
  misc_feature (1)..(330): n is a, c, g, or t
atgtttcgattcatcattgtttcagttttcgcgatatccgtgagctttgcagctgaaaaagtggagaaaaaagatccaagctcaaatgagcgttacgagaacttaagtctttttcaaaaagttctcttctttgtcgaacaaaactacgttgaagaagtaaaaaacaaggatctgatctacggcgcgattaagggaatggtcgaaacgctagatccccattccaactttttaccgcctgagatttttagagacatgaaaatcgacacctccggaaaagtttggcgaagttggtctggagattggtgtaaaaaattctatccttactggtag

SEQ ID NO: 4904 - protein, 109 aa, Unknown
  Obtained from environmental sample
  SIGNAL (1)...(17)
  misc_feature (1)..(109): Xaa is any amino acid
MFRFIIVSVFAISVSFAAEKVEKKDPSSNERYENLSLFQKVLFFVEQNYVEEVKNKDLIYGAIKGMVETLDPHSNFLPPEIFRDMKIDTSGKVWRSWSGDWCKKFYPYW

SEQ ID NO: 4905 - DNA, 1080 bp, Unknown
  Obtained from environmental sample
  misc_feature (1)..(1080): n is a, c, g, or t
atgggtgaatttgaagactacgaaaaacgagtcaatggaacatatcgcgttggtattcgcgtagctgccgatgaagaaccaaagttcgaattctatacttcgcgacttggaatccgctatagcgacatcaccaacttctacagagaaaatatcgagaagagtgaaaaggcatcattgaagatgctccacttctttatcaatacaggtatcaaagacaccgcatactactggagtgaactgagccgcttcatttttaaatactgcgaactcaaaaagatctgccctacactcgactcaatcgacatcgggggcggatttcctatcaagacttcactcacattccattatgattacaaatacatgatcgagcagatcgtggaaaacatcaagtggatctgtgataagaataacgttcctgttccaaacatcttcacagaattcggaagctataccgttggtgaaagtggagctgtgctttataatgtgatcgatcagaaacttcagaacgacaaagagctctggtatatgatcgatggttcattcatcactcatctcccagacgcgtggggattgaatcaaaaatatgtattgcttgctctcaacaaatgggatgatccatatcacaaagtgaacatgggtggtctcacatgtgatagcatggactattacaactccgaggcgcacaccggcgaagtgttcttgccgatgatcaatgatgaagagccgctgtacatcggattctttcatacaggtgcataccaggaatctctcggaggttacggcggtattcaacattgccttgtgcctgcacctaaacatgttctcatcgaacgcaatgaagacggcgagatcgttaccaaatttttgctgaacacagtcggcggagatatgtggaaagtctccggtattatcgattcgcattcggtctctggtcacaggtctctggttcagaagtcttcgtcgacatttctagcggcttcgaaattcgctctatgtgaccgcaataaattgcaattgatgctacgtgaaaaaaaaccattgcctaacgggaagtgttctcaaattgccactttatcttag

SEQ ID NO: 4906 - protein, 359 aa, Unknown
  Obtained from environmental sample
  DOMAIN (157)...(277): Pyridoxal-dependent decarboxylase, C-terminal sheet domain
  misc_feature (1)..(359): Xaa is any amino acid
MGEFEDYEKRVNGTYRVGIRVAADEEPKFEFYTSRLGIRYSDITNFYRENIEKSEKASLKMLHFFINTGIKDTAYYWSELSRFIFKYCELKKICPTLDSIDIGGGFPIKTSLTFHYDYKYMIEQIVENIKWICDKNNVPVPNIFTEFGSYTVGESGAVLYNVIDQKLQNDKELWYMIDGSFITHLPDAWGLNQKYVLLALNKWDDPYHKVNMGGLTCDSMDYYNSEAHTGEVFLPMINDEEPLYIGFFHTGAYQESLGGYGGIQHCLVPAPKHVLIERNEDGEIVTKFLLNTVGGDMWKVSGIIDSHSVSGHRSLVQKSSSTFLAASKFALCDRNKLQLMLREKKPLPNGKCSQIATLS

SEQ ID NO: 4907 - DNA, 357 bp, Unknown; identical to SEQ ID NO: 2887
  Obtained from environmental sample
  misc_feature (1)..(357): n is a, c, g, or t

SEQ ID NO: 4908 - protein, 118 aa, Unknown; identical to SEQ ID NO: 2888
  Obtained from environmental sample
  misc_feature (1)..(118): Xaa is any amino acid

SEQ ID NO: 4909 - DNA, 318 bp, Unknown
  Obtained from environmental sample
  misc_feature (1)..(318): n is a, c, g, or t
ttgtcaaaaagtacatttcacttcaataatcatgataacttcagaatagctatgaattttattctcctcttccttctcctcggcctcctcttcggttccttcgccaacgttgtcatctttcgcctcaaaacgaagaaaaagggcatgtttcgcggaagatcggaatgtccgcattgccatcaccgcctcggagttcttgacctcattccggttatttcctggatcgcgctcggcggaaaatgtcgctattgccggaaaaaaatcgcggtggagtatcctctggtggaaatcggcatggtgccctctggggaattttag

SEQ ID NO: 4910 - protein, 105 aa, Unknown
  Obtained from environmental sample
  DOMAIN (26)...(102): Bacterial Peptidase A24 N-terminal domain
  misc_feature (1)..(105): Xaa is any amino acid
MSKSTFHFNNHDNFRIAMNFILLFLLLGLLFGSFANVVIFRLKTKKKGMFRGRSECPHCHHRLGVLDLIPVISWIALGGKCRYCRKKIAVEYPLVEIGMVPSGEF

SEQ ID NO: 4911 - DNA, 825 bp, Unknown
  Obtained from environmental sample
  misc_feature (1)..(825): n is a, c, g, or t
ttggaagaaactccctgggtgctcgaagcaaaaagtgaagagcagcaaaagaaaaacatagcgctgctgtttgatatggtccgcatgagcggagaactcgaatcttcgcttagcaaattaaaagatatgcagtcacctaatggtggctttgtttggttcaaaggaggtccggatgatcggtatatcacccaatatattctaaccggtattggtcatctgaaaaaactaaacgcaatcacaaaagaccaggatcaaaaattattatcaatcgtaaatactgcatttccttacttagacagaaagttgaaagaagattatgacaacttaaaaaaacataaatcagatcagaaagtaaacaatacaggcacaatagccatccagtatctatatatgcgaagtttttttcccgaacacggcattgcaaaacaatcccaggctgcttataactattatatcgggcaggcaaaaaaattctggctttcgcacggtaagtttatgcaggcaatgacagcgttgtttttgtaccgaagcggtgatagaataactccgcaggcaatcatgcgttccctaaaagaaaattcagtaaataacgaagaacttgggatgtactggaaggaatggaacatccatggatactggtggtaccaggcgcttatagaatcggagggtatgatgatagaagcttttagtgaaataaggaacgatcaaacagtaataatgatcttaaaactggttgttaaaaataacgaattaatactggatatactagggcacagcgatgcatgcatgcgtatatcacggaaatatcgaagcgaatgttgttag

SEQ ID NO: 4912 - protein, 274 aa, Unknown
  Obtained from environmental sample
  misc_feature (1)..(274): Xaa is any amino acid
MEETPWVLEAKSEEQQKKNIALLFDMVRMSGELESSLSKLKDMQSPNGGFVWFKGGPDDRYITQYILTGIGHLKKLNAITKDQDQKLLSIVNTAFPYLDRKLKEDYDNLKKHKSDQKVNNTGTIAIQYLYMRSFFPEHGIAKQSQAAYNYYIGQAKKFWLSHGKFMQAMTALFLYRSGDRITPQAIMRSLKENSVNNEELGMYWKEWNIHGYWWYQALIESEGMMIEAFSEIRNDQTVIMILKLVVKNNELILDILGHSDACMRISRKYRSECC

SEQ ID NO: 4913 - DNA, 375 bp, Unknown
  Obtained from environmental sample
  misc_feature (1)..(375): n is a, c, g, or t
atgatgagaaatacgttgcttcatattgatgaaattgatgtccgaaatatccttattattccagtacctgatataaatattcatgcattatggactcataatcttgacttattagttccatcctatgatgttatttttacaaatgatccattcacaatagctttatttcaggaaagacaaaaaaaaattgttaaacctttattaattgaaagacaaaaattttcaggaaccagaatcagagaaaatataattaaaaaagcaaattggaaagatttagttcattttgaaactgcaaaagtaatagaagaaataaatggtatagagagattaaatcttctatggaaaaaatataatgacagcatcaataatcaataa

SEQ ID NO: 4914 - protein, 124 aa, Unknown
  Obtained from environmental sample
  misc_feature (1)..(124): Xaa is any amino acid
MMRNTLLHIDEIDVRNILIIPVPDINIHALWTHNLDLLVPSYDVIFTNDPFTIALFQERQKKIVKPLLIERQKFSGTRIRENIIKKANWKDLVHFETAKVIEEINGIERLNLLWKKYNDSINNQ

SEQ ID NO: 4915 - DNA, 546 bp, Unknown
  Obtained from environmental sample
  misc_feature (1)..(546): n is a, c, g, or t
ttgatgattcatggtgtaagttgtaacagaggggaatggattaggcacaaatggaaagtaaaaagaggttatctcaaaatacatatagcagttgacataacaaagaagagaattttatctttgcaagtaaccagtgaacaagtacatgatggaaaaatattacccgaattagtggatgatataactataaaacagaacaaagtagttgaaactgccattatggatggtgcctatgatagtaacaataattttcaatttctatcatttaaaggaattcaaccagcaattaaggtaagaaagaatgccaagtatagaaagacaaaccattatttgagaaacaagaacgtacaatcacagaaaaccaatctacaaaaatggaaagatagcgtaggctatggacaaagatggattgtagaaactgtcttctcctgtatcaagaggatgtttggagaatatgttactgctataagatttgagaacatgataaaggagataatactgaaagcatctttgtataactggtttcaaagtataactgttacataa

SEQ ID NO: 4916 - protein, 181 aa, Unknown
  Obtained from environmental sample
  DOMAIN (6)...(174): Transposase DDE domain
  misc_feature (1)..(181): Xaa is any amino acid
MMIHGVSCNRGEWIRHKWKVKRGYLKIHIAVDITKKRILSLQVTSEQVHDGKILPELVDDITIKQNKVVETAIMDGAYDSNNNFQFLSFKGIQPAIKVRKNAKYRKTNHYLRNKNVQSQKTNLQKWKDSVGYGQRWIVETVFSCIKRMFGEYVTAIRFENMIKEIILKASLYNWFQSITVT

SEQ ID NO: 4917 - DNA, 417 bp, Unknown
  Obtained from environmental sample
  misc_feature (1)..(417): n is a, c, g, or t
atggaaggagatttaatgataataatagctacacatgcggtttttatgaacggtaaagacatttatggtccgccgcatgctgtttcactcttcctcaataagcaaaaagacgctcatatttttataaaacacaatttgtatgctaatggtccttcgaaagttgaatattatcgtaacggaaaacttgaaaaagaagattctataaaagaatcgcctataaaatttcctttcttcctgtacttgtatgaaatgtatacaacactaaaaattgtacttgcagaacaagaaaaagttaccctctttataggggttgatccactgaatgcattagctggtgaaatcttaaaaaactgggtaaagcaaaaaaaaatgtttactttagcgctgattttgccttatcgcgctttccaaacgtaa

SEQ ID NO: 4918 - protein, 138 aa, Unknown
  Obtained from environmental sample
  misc_feature (1)..(138): Xaa is any amino acid
MEGDLMIIIATHAVFMNGKDIYGPPHAVSLFLNKQKDAHIFIKHNLYANGPSKVEYYRNGKLEKEDSIKESPIKFPFFLYLYEMYTTLKIVLAEQEKVTLFIGVDPLNALAGEILKNWVKQKKMFTLALILPYRAFQT

SEQ ID NO: 4919 - DNA, 384 bp, Unknown
  Obtained from environmental sample
  misc_feature (1)..(384): n is a, c, g, or t
atggaaggagatttaatgataataatagctacacatgcggtttttatgaacggtaaagacatttatggtccgccgcatgctgtttcactcttcctcaataagcaaaaagacgctcatatttttataaaacacaatttgtatgctaatggtccttcgaaagttgaatattatcgtaacggaaaacttgaaaaagaagattctataaaagaatcgcctataaaatttcctttcttcctgtacttgtatgaaatgtatacaacactaaaaattgtacttgcagaacaagaaaaagttaccctctttataggggttgatccactgaatgcattagctggtgaaatcttaaaaaaactgggtaaaggcaaaaaaaatgtttacttttag

SEQ ID NO: 4920 - protein, 127 aa, Unknown
  Obtained from environmental sample
  misc_feature (1)..(127): Xaa is any amino acid
MEGDLMIIIATHAVFMNGKDIYGPPHAVSLFLNKQKDAHIFIKHNLYANGPSKVEYYRNGKLEKEDSIKESPIKFPFFLYLYEMYTTLKIVLAEQEKVTLFIGVDPLNALAGEILKKLGKGKKNVYF

SEQ ID NO: 4921 - DNA, 747 bp, Unknown
  Obtained from environmental sample
  misc_feature (1)..(747): n is a, c, g, or t
ttgttctctactaatccacccattgttattttttcaccttcgagacgggttcgtgataatacaaccaaacatagcctgcagaatcttctggaagtacccgaggtggtaatcaatattgttacctatgatatggtgcaacaaacttcattagcaagttgtgaatatccaaaaggagcggatgaatttataaaagccggatttacaaaagaaaaagcagtattggtgaagccaccaatggtgaaagaaagtaaggccaacttggagtgtaaggttattgagataaaagaattgggaaaagaaggaggcgccggcaatttagttatctgcgaagttttatacctgcatatagatgatagcattttaaaggcaggtaaaatagaccaggcgaaattagaattggtagcgcggctgggcggcaattggtattgcaaggttggcgcagaaaatctttttgaagttaccaaaccgagcactcaattaggtatcggaattgatgcgctgccggaaggtatcaggaagagcaaatttttaactggaaataatttaggccagcttgcaaatattcatgaaatgccagcggtggacccctcttttgatgacgaacatttaaaaaatatttttcagtactactccattagcccggctgagatggaaaaagaaattcacctgtatgcagcaaaacttttaaatgaaaacaaagtacatgaggcgtggcaggtactattggcatcagaaaatattgtttaa

SEQ ID NO: 4922 - protein, 248 aa, Unknown
  Obtained from environmental sample
  misc_feature (1)..(248): Xaa is any amino acid
MFSTNPPIVIFSPSRRVRDNTTKHSLQNLLEVPEVVINIVTYDMVQQTSLASCEYPKGADEFIKAGFTKEKAVLVKPPMVKESKANLECKVIEIKELGKEGGAGNLVICEVLYLHIDDSILKAGKIDQAKLELVARLGGNWYCKVGAENLFEVTKPSTQLGIGIDALPEGIRKSKFLTGNNLGQLANIHEMPAVDPSFDDEHLKNIFQYYSISPAEMEKEIHLYAAKLLNENKVHEAWQVLLASENIV

SEQ ID NO: 4923 - DNA, 825 bp, Unknown
  Obtained from environmental sample
  misc_feature (1)..(825): n is a, c, g, or t
ttgctgcgcaagtcgcatccgtggattagagctttagccgctcaaactctctttaaacttgaccgtgaacgaagcgtcccttttctgatagcgttgctctccgatgaaggaaagcttgattatatgaacgatgtgtcgaattacaccgtttctaatcacgcctttaggattattaatgaaataatttacggaacattgcttttcaaaaaatcagttggcgataaagacaatccctttgcggaagttaaaagtgttcaaggttattactggtttcatcttccttattgcgattggcaggatgagccacagaaaatttgttttatcaatttccataaaattttcgccgatcttgaaaacgccaaattcccatttgcgtcagccaaaaatgattacaaaggaatcaattatgttttgataaatgaaagcatgacaaaaaccgctttcaaatttagcgagccggttgagatcagtttgatttttgttcatttcggcaatcgcattataaatattaggtgggacgctcgtgatttaactgttcacaaattcaagctgattgcgccaaacggcgaagagctaaaattaaagcccgaaggcttgcccgcgttccctgaacaaattccgatattgcaacctcaatggagtcgttcatcattagacaaaactttgaatttggcaaaaatgtatgatctcaaacagtgtggcaaatataagttttactacaagtatcaaccgccgaaagagattgacaaagacgaaccaaaatcgcctttgcatctttggtattggaatggaaaggaatacgataattatttcgaattcttatag

SEQ ID NO: 4924 - protein, 274 aa, Unknown
  Obtained from environmental sample
  misc_feature (1)..(274): Xaa is any amino acid
MLRKSHPWIRALAAQTLFKLDRERSVPFLIALLSDEGKLDYMNDVSNYTVSNHAFRIINEIIYGTLLFKKSVGDKDNPFAEVKSVQGYYWFHLPYCDWQDEPQKICFINFHKIFADLENAKFPFASAKNDYKGINYVLINESMTKTAFKFSEPVEISLIFVHFGNRIINIRWDARDLTVHKFKLIAPNGEELKLKPEGLPAFPEQIPILQPQWSRSSLDKTLNLAKMYDLKQCGKYKFYYKYQPPKEIDKDEPKSPLHLWYWNGKEYDNYFEFL

SEQ ID NO: 4925 - DNA, 342 bp, Unknown
  Obtained from environmental sample
  misc_feature (1)..(342): n is a, c, g, or t
ttgacctctatgaatatcagtaaagtaactattccctacgagcagactggttatttcagccacatagctattgattatctcgcaggcaaagattcaattaaacctttctacaaatatccttttgaaataaaatcatttgaacaggcaatcactgacaagcaaaagcaggatgttgaccgtgcgctgctgcataaagtattgctggagcaatatgcatcttactcgatttcggaaaatgagggagctataaagaatattgaatctttaaggagtgataacacatttgtagttgtaacaagcccacagcccaattatttctcggtccgtttatcttctctataa

SEQ ID NO: 4926 - protein, 113 aa, Unknown
  Obtained from environmental sample
  misc_feature (1)..(113): Xaa is any amino acid
MTSMNISKVTIPYEQTGYFSHIAIDYLAGKDSIKPFYKYPFEIKSFEQAITDKQKQDVDRALLHKVLLEQYASYSISENEGAIKNIESLRSDNTFVVVTSPQPNYFSVRLSSL

SEQ ID NO: 4927 - DNA, 390 bp, Unknown
  Obtained from environmental sample
  misc_feature (1)..(390): n is a, c, g, or t
ttgatttttttgtacaatattttcatcttcctgtttaaaattggtgtcagcataacgggtatttggagtactaaggccaaacaatggcttcagggaagaaaaaacatatggcaggaattagaacataaaatttcaaaaactgacctcattatctggatacatagttcgtccgtaggcgattttgaacaggccacacccttgattganncattaaaagaagaatacccagnctataaaatattggncagctttttctcgcctttcggatatcatntgctcaaaaattataagtatgccgatcatattgttaacctgcctgttgatactgcccggaatgccaggcgttttatacaaattgtaaatcataactggttgtattggtacgtataa

SEQ ID NO: 4928 - protein, 129 aa, Unknown
  Obtained from environmental sample
  misc_feature (1)..(129): Xaa is any amino acid
MIFLYNIFIFLFKIGVSITGIWSTKAKQWLQGRKNIWQELEHKISKTDLIIWIHSSSVGDFEQATPLIXXLKEEYPXYKILXSFFSPFGYHXLKNYKYADHIVNLPVDTARNARRFIQIVNHNWLYWYV

SEQ ID NO: 4929 - DNA, 438 bp, Unknown
  Obtained from environmental sample
  misc_feature (1)..(438): n is a, c, g, or t
ttggatttctcaatatattctgaactactgctgatattttctgcggacatctcgatttcgtattataggataaaatttatactctttcaagctaagcgtctatattgtgcaggtgcaaattatgttcgatttgtattaagattgatttgcctacttatgaaacaaatctccaagattttagaagaaaccaaaaacctgaagcgtccaaaaaacttaagccaggagtttcaatactacggagtattcctggccgaaacactggaggatacaaagcactactcgctttatattaagcttgccaaagaagttaaccggaatgttttagaggaggctctaagttacacaaaaggctttaccacagccaaatctaaaccccgggtatttatgtggcggctaaagcagctcagacaagaacaaaaggaaaaactcagccaataa

SEQ ID NO: 4930 - protein, 145 aa, Unknown
  Obtained from environmental sample
  misc_feature (1)..(145): Xaa is any amino acid
MDFSIYSELLLIFSADISISYYRIKFILFQAKRLYCAGANYVRFVLRLICLLMKQISKILEETKNLKRPKNLSQEFQYYGVFLAETLEDTKHYSLYIKLAKEVNRNVLEEALSYTKGFTTAKSKPRVFMWRLKQLRQEQKEKLSQ

SEQ ID NO: 4931 - DNA, 387 bp, Unknown
  Obtained from environmental sample
  misc_feature (1)..(387): n is a, c, g, or t
atggcaaaaacaagtaaactttctaatgtagtacaggtagaagattatattaaaaatcttgatcatcccctgcgcgatgttgtagcttcattgcggaaaataattttaagcatcgataaaaaaatcgccgaacaaataaaatggaactctcccgctttttactatacaggcgaaatgaaggcttttgatccaaaagaatataaaagagatatcgtagtttttaaccttcacaaaaaagatcttgtactgcttatttttccaacaggtgcgagaatcaatgatcaatcggnccttctggcaggcaaattcacagatgggaggaagacagccagcttcaaatcgctggaagatgtaacaaagaaagaaaaagacttcggattgctataa

SEQ ID NO: 4932 - protein, 128 aa, Unknown
  Obtained from environmental sample
  misc_feature (1)..(128): Xaa is any amino acid
MAKTSKLSNVVQVEDYIKNLDHPLRDVVASLRKIILSIDKKIAEQIKWNSPAFYYTGEMKAFDPKEYKRDIVVFNLHKKDLVLLIFPTGARINDQSXLLAGKFTDGRKTASFKSLEDVTKKEKDFGLL

SEQ ID NO: 4933 - DNA, 303 bp, Unknown
  Obtained from environmental sample
  misc_feature (1)..(303): n is a, c, g, or t
atgaatataatgaaccctaaggttgactggtactttgaaaaagactctcagttggcaaaagaatttgaaaaattaagaacaataattcttaacaccgggcttatggaagaattgaaatgcggttgcccctgttatatttttgagaatccgtacatcgttttaatccattgcattcaaaaattacttgtgcgctgctgttttttaaaaggcgcttcgttacaggatgccgaaaaggccggtgaattctcattcacaacaaaaatttcagccgccggcaattacgtcacgatttacgaattctga

SEQ ID NO: 4934 - protein, 100 aa, Unknown
  Obtained from environmental sample
  misc_feature (1)..(100): Xaa is any amino acid
MNIMNPKVDWYFEKDSQLAKEFEKLRTIILNTGLMEELKCGCPCYIFENPYIVLIHCIQKLLVRCCFLKGASLQDAEKAGEFSFTTKISAAGNYVTIYEF

SEQ ID NO: 4935 - DNA, 312 bp, Unknown
  Obtained from environmental sample
  misc_feature (1)..(312): n is a, c, g, or t
ttgacaaagaacgctacgaatattggctttcaaaaggtgccaaaccaagtcccacggtggcaaaactcatggaataatatgaaacaagcacttacacttattgtttcttcaatcgttgaccatgctgatgaactcactataactgagtctgaatcagacggagttgttacctttgtaatccatgcacatccggaagatatgggaaaacttatcggaaaaaatggaaaagttattcgaagtatccggaacgtaatgaaagtacccgccatcaaacaaagtaaacggatcgatatatcaatagcagagaattaa

SEQ ID NO: 4936 - protein, 103 aa, Unknown
  Obtained from environmental sample
  misc_feature (1)..(103): Xaa is any amino acid
MTKNATNIGFQKVPNQVPRWQNSWNNMKQALTLIVSSIVDHADELTITESESDGVVTFVIHAHPEDMGKLIGKNGKVIRSIRNVMKVPAIKQSKRIDISIAEN

SEQ ID NO: 4937 - DNA, 471 bp, Unknown
  Obtained from environmental sample
  misc_feature (1)..(471): n is a, c, g, or t
ttgacaattatgaaatataaacttataacgttatttctgctgtttcaaactctggcggcctccgtttcgggtcaattaaaaaaagcaggcaattaccagtacacagtagacttaactcgtgtagtcgacgacaaggtacatgtagaactgctggctccgaaaatatcttcttccgagattaccttttacctgcccaagattgtccctggaacatatgccatagccgactatggaagattcgtctccgactttaaagctgtcgacaagaaagggaaaaatctggcttacgaacgtgttgatgataatacgtggatcatcaaaaatgcttcccgacttgaaaaaatttcctactgggtgagcgattcatacgatacagatctatccggtccctccatatttcaacccgctggtactaacatcgaagaaaataaaaactacctccttaataccagtggttcttcggctatttga

SEQ ID NO: 4938 - protein, 156 aa, Unknown
  Obtained from environmental sample
  SIGNAL (1)...(19)
  misc_feature (1)..(156): Xaa is any amino acid
MTIMKYKLITLFLLFQTLAASVSGQLKKAGNYQYTVDLTRVVDDKVHVELLAPKISSSEITFYLPKIVPGTYAIADYGRFVSDFKAVDKKGKNLAYERVDDNTWIIKNASRLEKISYWVSDSYDTDLSGPSIFQPAGTNIEENKNYLLNTSGSSAI

SEQ ID NO: 4939 - DNA, 363 bp, Unknown
  Obtained from environmental sample
  misc_feature (1)..(363): n is a, c, g, or t
atgaaaacgaccgtccgaattttgtgtgtttgtattctggtttgctcctccgtctcgattatcgcccaaaaaaatgatattgaagctatcaaaacactgatcgaaaaagaaactacagcattttttgaaatcgattatgacacgtgggcatccaagtgggtccaagctccttatgcattttggtctttcgcaaaacaactgaagtcaactcatttccgggtgggaaaaaattgggagggatcaaaaatacttcggaactcaagccttcaaaacaaaattgaaggcatggatggatttagtcttggcaagaacctatgccaattccgaaagttagggaaaattggcgttccccttaataaatag

SEQ ID NO: 4940 - protein, 120 aa, Unknown
  Obtained from environmental sample
  SIGNAL (1)...(19)
  misc_feature (1)..(120): Xaa is any amino acid
MKTTVRILCVCILVCSSVSIIAQKNDIEAIKTLIEKETTAFFEIDYDTWASKWVQAPYAFWSFAKQLKSTHFRVGKNWEGSKILRNSSLQNKIEGMDGFSLGKNLCQFRKLGKIGVPLNK

SEQ ID NO: 4941 - DNA, 870 bp, Unknown
  Obtained from environmental sample
  misc_feature (1)..(870): n is a, c, g, or t
ttgactcccgaccaaaaagaagcatnttatgaatatatggtagtggatccgggaaatcctgacaatgattatgcaaaaattgacttgcagtacaagcaggataaaaggtatcccattttctcctacagcaccggcaacattgatggacagaaagccgacaccaatacttttcgactgttccaacactattacctcagtgctttgcgagatagtacccgcgatttgttaagtaaccgaaacaatatactaggcaaggttattaagaggcttgttgatagaaaggactctgaagaggaaatcaaggatattatcaaagaggctaacacaaaactactggcaagagaggaagtgacttcgactcgccaaagtataaacgataatcttgataatatttataagaaggtcaatcagagtcaaattgggctacagattgaacagtctcggatagactacattgtgaatgcgattaaaccctacttaccacatgattggaagaatcactccgcagaaggctttaacctttggcaaaacagtcttgggttcaataatctgatttacatcgcaactgtactcggcgatattaaagaaagggtcaaggatgatgctatcccacatttttcgttgctgatcgaagagccggaagcgcatattcatcctcagctacagttgagcctctacagttttttaaaggaagctaacagtgctgccaacagccaactttttattactacccactctccgacacttacctctaaggtgcctttcgataatttgatattgctcgaaaagaatgcgtatatcgtcagtgattcttttgtcgaccgggctactgaaaacattattcaggatactaaaaaggccgtgccttga

SEQ ID NO: 4942 - protein, 289 aa, Unknown
  Obtained from environmental sample
  misc_feature (1)..(289): Xaa is any amino acid
MTPDQKEAXYEYMVVDPGNPDNDYAKIDLQYKQDKRYPIFSYSTGNIDGQKADTNTFRLFQHYYLSALRDSTRDLLSNRNNILGKVIKRLVDRKDSEEEIKDIIKEANTKLLAREEVTSTRQSINDNLDNIYKKVNQSQIGLQIEQSRIDYIVNAIKPYLPHDWKNHSAEGFNLWQNSLGFNNLIYIATVLGDIKERVKDDAIPHFSLLIEEPEAHIHPQLQLSLYSFLKEANSAANSQLFITTHSPTLTSKVPFDNLILLEKNAYIVSDSFVDRATENIIQDTKKAVP

SEQ ID NO: 4943 - DNA, 636 bp, Unknown
  Obtained from environmental sample
  misc_feature (1)..(636): n is a, c, g, or t
gtgcggtgtatttggtgccatacccatancagcagtattgttagaggggcagcaaatgtggatgctggtgccagaactaaatnatcgtcgtttacacatgggatttttcttttgcttaccgttttattaattccttttcttctaaacaaaattccttacgcagcacttgccgctattttattgataacgggttacaacttaaccaagccaaaactttatcgcaatatgtggagcctgggatggaggcaatttgttccattcatgatcactattgttgtaatactgcttaccgatttgctcattggtgttagcattgggctattgatctcaacttattttattatcaggaataattttaaagcagaatataaaattcaaaaaacaaaacaacatgaaacagaagtatttttcatcaagctcaatacaaacgttacttttctaaataaggtaaaactgaaagatgctttagatcaaatacccgaatactccatacttaccattgatggcagtgaatgcaattttattgactacgacattcttgagatcatttccgagtacagcaacaaagcacacgataaacatattgaattgcatttgaaaggaattgaaaaagtgaatgtaacagctatacattaa

SEQ ID NO: 4944 - protein, 211 aa, Unknown
  Obtained from environmental sample
  misc_feature (1)..(211): Xaa is any amino acid
MRCIWCHTHXSSIVRGAANVDAGARTKXSSFTHGIFLLLTVLLIPFLLNKIPYAALAAILLITGYNLTKPKLYRNMWSLGWRQFVPFMITIVVILLTDLLIGVSIGLLISTYFIIRNNFKAEYKIQKTKQHETEVFFIKLNTNVTFLNKVKLKDALDQIPEYSILTIDGSECNFIDYDILEIISEYSNKAHDKHIELHLKGIEKVNVTAIH

SEQ ID NO: 4945 - DNA, 873 bp, Unknown
  Obtained from environmental sample
  misc_feature (1)..(873): n is a, c, g, or t
gtggaaaagtcagctaaaaacagcactgggtttgggttattcatattgattttcctgtggatgttnaagccttttggcctggggtcttttcccatgggccggttagctttcatcagtattatgtatgggcttattacactcggttgcatctttttaatgttgataacgctgccggtttttttcncactcttttttaaagaagacacatggacaacaggcaaacagatcatacatacaacggcagtaattgtattggtaggtttggtgaattatcttatttcgcctttcctggttgatacaacttattcgttgcgggacatgttatggttccagggaattacattggctatagctcttctgcctgtttctgtttttactttatggaagcaaaacagtttattaaaaaaatttgaactgcaggctgcggtacttgaaaaaaagttaaaagaaaaactggaacctggcaaacaacaggatacgccctctttaccatctgaaaaaaaaaatgaaactccattcattgaactgaccggcgactaccagggtgaaaaaatatccttgcccccggaagacctttattttattgccgccgccaataactatataaaagtctactttaataaaaaagaaaagatatcctattccattatacggatgacaatgaaaaaagcggaggaagcactggaagcatggcctggttttttccgctgccacagggcttatattattaatttagacaaaatagagcatgtggaaggtaatgcacagggatataaaatacgccttgctaatacagaagaatccattcctgtatcccgcaacctgaacagcgagttttccgataaactatggcgatacgaatatagatcctaa

SEQ ID NO: 4946 - protein, 290 aa, Unknown
  Obtained from environmental sample
  DOMAIN (182)...(284): LytTr DNA-binding domain
  misc_feature (1)..(290): Xaa is any amino acid
MEKSAKNSTGFGLFILIFLWMXKPFGLGSFPMGRLAFISIMYGLITLGCIFLMLITLPVFFXLFFKEDTWTTGKQIIHTTAVIVLVGLVNYLISPFLVDTTYSLRDMLWFQGITLAIALLPVSVFTLWKQNSLLKKFELQAAVLEKKLKEKLEPGKQQDTPSLPSEKKNETPFIELTGDYQGEKISLPPEDLYFIAAANNYIKVYFNKKEKISYSIIRMTMKKAEEALEAWPGFFRCHRAYIINLDKIEHVEGNAQGYKIRLANTEESIPVSRNLNSEFSDKLWRYEYRS

SEQ ID NO: 4947 - DNA, 393 bp, Unknown
  Obtained from environmental sample
  misc_feature (1)..(393): n is a, c, g, or t
gtgancactgctttagtaaggggtgtgtggcatatcatatatgacacagcgagctttttctgttatttcacagcacagctgctaatatccaactttgtaatgcatcatagcgctcatcaggtatgcagtttcatcactattaaaggggtttgggtctgcgttaatgttaaagcttggtaccaaaatgtggggttgcaatccaccgctgcagggttgatcctccgcaaccaagaaactcttaaaaaaccaggattgcgccccaaatattaccacgaaaaatggcttcatgcccttcaagggccagtttgtttaaaaaaattaaaaaatcccgtttttaaacgggcaattaaacccagagaaaatattttgtatacaaaaacaatttttcttttt

SEQ ID NO: 4948 - protein, 131 aa, Unknown
  Obtained from environmental sample
  misc_feature (1)..(131): Xaa is any amino acid
MXTALVRGVWHIIYDTASFFCYFTAQLLISNFVMHHSAHQVCSFITIKGVWVCVNVKAWYQNVGLQSTAAGLILRNQETLKKPGLRPKYYHEKWLHALQGPVCLKKLKNPVFKRAIKPRENILYTKTIFLF

SEQ ID NO: 4949 - DNA, 936 bp, Unknown
  Obtained from environmental sample
  misc_feature (1)..(936): n is a, c, g, or t
ttggaagaaactccctgggtgctcgaagcaaaaagtgaagagcagcaaaagaaaaacatagcgctgctgtttgatatggtccgcatgagcggagaactcgaatcttcgcttagcaaattaaaagatatgcagtcacctaatggtggctttgtttggttcaaaggaggtccggatgatcggtatatcacccaatatattctaaccggtattggtcatctgaaaaaactaaacgcaatcacaaaagaccaggatcaaaaattattatcaatcgtaaatactgcatttccttacttagacagaaagttgaaagaagattatgacaacttaaaaaaacataaatcagatcagaaagtaaacaatacaggcacaatagccatccagtatctatatatgcgaagtttttttcccgaacacggcattgcaaaacaatcccaggctgcttataactattatatcgggcaggcaaaaaaattctggctttcgcaaggtaagtttatgcaggcaatgacagcgttgtttttgtaccgaagcggtgatagaataactccgcaggcaatcatgcgttccctaaaagaaaattcaataaataacgaagaacttgggatgtactggaaggaatggaacatccatggatactggtggtaccaggcgcctatagaatcgcaggctatgatgatagaagcttttagtgaaataaggaacgatncaacagtaataaatgatcttaaaaccctggtgctaaaaaataaacaaactaataactggaatactactaaagccacagccgatgcatgctatgcgttattaatacagggaaatgatccgacgccgatcgggtggttaagcgaacaaaaaatgttgttatcagttaggaaaacaactatgatagtaaagaacagagcaggaggaaggccacgatatttaaacataaattga

SEQ ID NO: 4950 - protein, 311 aa, Unknown
  Obtained from environmental sample
  misc_feature (1)..(311): Xaa is any amino acid
MEETPWVLEAKSEEQQKKNIALLFDMVRMSGELESSLSKLKDMQSPNGGFVWFKGGPDDRYITQYILTGIGHLKKLNAITKDQDQKLLSIVNTAFPYLDRKLKEDYDNLKKHKSDQKVNNTGTIAIQYLYMRSFFPEHGIAKQSQAAYNYYIGQAKKFWLSQGKFMQAMTALFLYRSGDRITPQAIMRSLKENSINNEELGMYWKEWNIHGYWWYQAPIESQAMMIEAFSEIRNDXTVINDLKTLVLKNKQTNNWNTTKATADACYALLIQGNDPTPIGWLSEQKMLLSVRKTTMIVKNRAGGRPRYLNIN

SEQ ID NO: 4951 - DNA, 381 bp, Unknown
  Obtained from environmental sample
  misc_feature (1)..(381): n is a, c, g, or t
atgatatttataaaaagaacagcaaatagaagctggcctgggagccaaaatggaagcagcattaaaaaagtatttaataacggccacgaacacgtgcttattatcggaagcgactgttacgatcttacagcttcaattattaaagaagcctttgttgttttaaaatcaaatgatgtggtgctagggcccgcaaaagatgggggatattatttgcttgggcaaaataaattaaatccagatttattttctattaaaaaatggagcacttcatttgttttagcacaaactattgaagcttgcgaaagctgcggactcagctacaaaaaattaaatttgcttagcgatgtggatgaagccgaagacatcaactttaattattaa

SEQ ID NO: 4952 - protein, 126 aa, Unknown
  Obtained from environmental sample
  misc_feature (1)..(126): Xaa is any amino acid
MIFIKRTANRSWPGSQNGSSIKKVFNNGHEHVLIIGSDCYDLTASIIKEAFVVLKSNDVVLGPAKDGGYYLLGQNKLNPDLFSIKKWSTSFVLAQTIEACESCGLSYKKLNLLSDVDEAEDINFNY

SEQ ID NO: 4953 - DNA, 666 bp, Unknown
  Obtained from environmental sample
  misc_feature (1)..(666): n is a, c, g, or t
atgagcgccggcacccgtttgcatgaagtagtagatttgtcaggcattaatgtaatcattgatggagatgattatccgctggtgattaaagtagcttctttaccaaatgcaagattgcaaatttactttctggataacgaggattattttaaacggaaatctttgtttcatgatgaaaatgaaaaatggtttgaggacaatgcgttaagaacggtattgttttgcaaaggtgctttggaaacagtaaaaaaatttggttggcctccggatgtaattcattgtagcggatggatgacaggcttaatccccatgtatattaaaacagcctataagaacgaacctgtgtttagtaattgtaaagtgatttatagtataggtcaaaacacgcataaagaaaaattgggccaggaatttgtaaaattagctgcgatcaattcgaatgtaaaagaaaaagacatggagccatttaaggacggttctaatatctcgatgtttaggggcggtgcacattttgccgatgctatcacttttggagtgcaaagtgtagataaaaaattggaggaagagttttctaaggtcaaggggaagaaggttttgcattttaatgcagaatcagatttaacagactatttacaattgtataacgaccttgcgacgattaaataa

SEQ ID NO: 4954 - protein, 221 aa, Unknown
  Obtained from environmental sample
  misc_feature (1)..(221): Xaa is any amino acid
MSAGTRLHEVVDLSGINVIIDGDDYPLVIKVASLPNARLQIYFLDNEDYFKRKSLFHDENEKWFEDNALRTVLFCKGALETVKKFGWPPDVIHCSGWMTGLIPMYIKTAYKNEPVFSNCKVIYSIGQNTHKEKLGQEFVKLAAINSNVKEKDMEPFKDGSNISMFRGGAHFADAITFGVQSVDKKLEEEFSKVKGKKVLHFNAESDLTDYLQLYNDLATIK

SEQ ID NO: 4955 - DNA, 411 bp, Unknown
  Obtained from environmental sample
  misc_feature (1)..(411): n is a, c, g, or t
ttgatttggatccattcgttgtttcaaaaaatctttgaacattcaggtaaactgatgggccagataatttgtcagaaggaaaaacctttcaaagataatcctaaattagtggcgttagaatttagaatcgatactttcgatcaaatttcaattactacaatttccggtaaatggaattttgattctggaatcgagcagacaagtcagacaggaatgctatttgctttggagaaagataaagagttcggattagcagttatcggacaatcatatttaccagcccaagtgtatgtttccgcacagaatctacaaaaacctggtttattccaaggcgaactcaagcgcatggattcggaactcaatcctgacactcaaagtatttcctgctcttataaagtttataacaattaa

SEQ ID NO: 4956 - protein, 136 aa, Unknown
  Obtained from environmental sample
  misc_feature (1)..(136): Xaa is any amino acid
MIWIHSLFQKIFEHSGKLMGQIICQKEKPFKDNPKLVALEFRIDTFDQISITTISGKWNFDSGIEQTSQTGMLFALEKDKEFGLAVIGQSYLPAQVYVSAQNLQKPGLFQGELKRMDSELNPDTQSISCSYKVYNN

SEQ ID NO: 4957 - DNA, 822 bp, Unknown
  Obtained from environmental sample
  misc_feature (1)..(822): n is a, c, g, or t
ttgactactggtaaaaggatagttttaactgctgaccgaagtctaatgactaattatcgaggaaatttcctttatggttttatagcttgtggaccttatgaattagtaccagagtttgtttttgataaacttttttgtccgagtgtagaaacggataaacattcaggagaagtgaaagtagcacaatgtggattgagaagaatagaaggtgcattacttcaagagtataatcaaaatgaaatttttctagcacatcctgaaatgctaaacaaatgtattggaccggaaaccaaagtggtaggaattaatgtaatggatccattaggaatggctccggttacaacgacgatgtctcctgaaaaattatcttacgtagctatgaaatttaagaaaatgtgtgcttccattatacagttaaagaaaaaatacaatttcaaagttgtagtcggagggaatggtgcttgggaacttgccaaacctgatagaatgaggattcacggaattgatactgttgtgatcggagaagcagacgaattagctttggatttatttcatgacttagaacaaggtgatgctccagagcttttacatacatttgttcgaaatattgaaaatatccctccgataaaaggtcctaccataaattctttaattgaagcgatgcgaggttgtggacgtggatgtgatttttgtgacgtcnataaaagatcanaaaaagatatacctctttcaagattnaaggaaagagctaaaattaccctcagtacgggtttgattcgatatggctacaatctgatgaaatgtattgtacggatgcgataa

SEQ ID NO: 4958 - protein, 273 aa, Unknown
  Obtained from environmental sample
  misc_feature (1)..(273): Xaa is any amino acid
MTTGKRIVLTADRSLMTNYRGNFLYGFIACGPYELVPEFVFDKLFCPSVETDKHSGEVKVAQCGLRRIEGALLQEYNQNEIFLAHPEMLNKCIGPETKVVGINVMDPLGMAPVTTTMSPEKLSYVAMKFKKMCASIIQLKKKYNFKVVVGGNGAWELAKPDRMRIHGIDTVVIGEADELALDLFHDLEQGDAPELLHTFVRNIENIPPIKGPTINSLIEAMRGCGRGCDFCDVXKRSXKDIPLSRXKERAKITLSTGLIRYGYNLMKCIVRMR

SEQ ID NO: 4959 - DNA, 897 bp, Unknown
  Obtained from environmental sample
  misc_feature (1)..(897): n is a, c, g, or t
atgatatattttattttaaatgaactacaaaaaataaaaatttcggttctaatagtaacatctaatattataataacatatataaggactaaggagagattatttccggtattacctatggttgtggaaaataaaggaattatttcttatattagagttttaaaagaagatctcgagataatacgcatagtaccaagtgagggtacagtacctgatttcaaggctggtcaatttgttacattatctctaatgaatcctgatgaaggaaaattagtcaggagagcttattccatagcctcacctccagagaaaaaaaaatattttgaattactgattagatgggttaagaaacctctacctgggagattaactacacagatttttaaccgtaatgagggggacgagattggttggttaaagccaacagggatatttacaattaatgaaaaaatgcatgatgggacccaggataataggcgtcttgtgttaattggaggtgggactggactggctccttttatagcatatagtttacatcttaaatctattggtagtaaaagggaaatagttgttttacatggagcaagttatgtagacgagctcagttatagagaattattaactgagttggaagaagaaagtgaggataaaggtaaagacaactggaattttaaatatagggcaagtataagtagaccgcatgaaccttttaacagatcctggggaggacagaaaggtagagttgaatcattcttgagacctgaaccaggaggtaatacatcccctttggaagaccttgtaggagagaaatcacacctcaaatacatcattctatgtatgtggttggcaaggaactgtggatggtgtgttagatttcttgagcctaaagatttgtga

SEQ ID NO: 4960 - protein, 298 aa, Unknown
  Obtained from environmental sample
  DOMAIN (158)...(269): Oxidoreductase NAD-binding domain
  misc_feature (1)..(298): Xaa is any amino acid
MIYFILNELQKIKISVLIVTSNIIITYIRTKERLFPVLPMVVENKGIISYIRVLKEDLEIIRIVPSEGTVPDFKAGQFVTLSLMNPDEGKLVRRAYSIASPPEKKKYFELLIRWVKKPLPGRLTTQIFNRNEGDEIGWLKPTGIFTINEKMHDGTQDNRRLVLIGGGTGLAPFIAYSLHLKSIGSKREIVVLHGASYVDELSYRELLTELEEESEDKGKDNWNFKYRASISRPHEPFNRSWGGQKGRVESFLRPEPGGNTSPLEDLVGEKSHLKYIILCMWLARNCGWCVRFLEPKDL

SEQ ID NO: 4961 - DNA, 312 bp, Unknown; identical to SEQ ID NO: 2389
  Obtained from environmental sample
  misc_feature (1)..(312): n is a, c, g, or t

SEQ ID NO: 4962 - protein, 103 aa, Unknown; identical to SEQ ID NO: 2390
  Obtained from environmental sample
  misc_feature (1)..(103): Xaa is any amino acid

SEQ ID NO: 4963 - DNA, 609 bp, Unknown
  Obtained from environmental sample
  misc_feature (1)..(609): n is a, c, g, or t
ttgtccgtcataaccggcttcatcctataccgcaaagctatctggaaagccattcgattcaaaacagtctcccggtatcggggaaaagctgctttttattcttcgctgcatcgcaatgttggtgtctggacactattattcaacctgctgattatcgcgtctggtcttgtcttgagtataaccatcgcaaaaaatgcaatcaaaacatccggttcaaaatcaccagctattacccaggtggactttcctttggattcaatagttgaaaaagtaacccgttcaaatccggaattcgagatacacctggtgcgcattccggcttatagccatactattaagatcagtggacgctataaaaacgatccggcggtttacggagattatgccagttattttttaataaacgggctatcacaaaaaacagagaaaaaacaggtaatgtcggatcttcccttttcagaaaagctgttgttaatggcggcgcccttacattttggcaattttggaggcatcttcctgaaaattatctattgcttttttgggatcatgccggcaattttatccatcaccggatttctgatctggaaaaagagaaggagaataaaataa

SEQ ID NO: 4964 - protein, 202 aa, Unknown
  Obtained from environmental sample
  misc_feature (1)..(202): Xaa is any amino acid
MSVITGFILYRKAIWKAIRFKTVSRYRGKAAFYSSLHRNVGVWTLLFNLLIIASGLVLSITIAKNAIKTSGSKSPAITQVDFPLDSIVEKVTRSNPEFEIHLVRIPAYSHTIKISGRYKNDPAVYGDYASYFLINGLSQKTEKKQVMSDLPFSEKLLLMAAPLHFGNFGGIFLKIIYCFFGIMPAILSITGFLIWKKRRRIK

SEQ ID NO: 4965 - DNA, 402 bp, Unknown
  Obtained from environmental sample
  misc_feature (1)..(402): n is a, c, g, or t
ttggacgaaagggtaagttcgtatcgaacgagcctcgggataataaaacaactcaacaatttacttttcccccttaaaaaaatttcaaaacaactaaccaattcaatgaatttattccaaaaaaaatttatttttaatatcaaatctaaaactttcaattatgaaaagtacatcccgcaatattgtaatggctttagctcttttagctacttgttcattgaaaccggtgcccaaaaggttttgttcaaaaggtcccaacttgggcagctttcacttttattccaaaagaaatttttgacccgccaaagctttcggggcaaaaaaagcaaccccttgtttgcggggagatccctcttttggaattttgggaaaaatatcgggggcggagcaagttataaacaa

SEQ ID NO: 4966 - protein, 134 aa, Unknown
  Obtained from environmental sample
  misc_feature (1)..(134): Xaa is any amino acid
MDERVSSYRTSLGIIKQLNNLLFPLKKISKQLTNSMNLFQKKFIFNIKSKTFNYEKYIPQYCNGFSSFSYLFIETGAQKVLFKRSQLGQLSLLFQKKFLTRQSFRGKKSNPLFAGRSLFWNFGKNIGGGASYKQ

SEQ ID NO: 4967 - DNA, 522 bp, Unknown
  Obtained from environmental sample
  misc_feature (1)..(522): n is a, c, g, or t
gtgtattttcgcgcaaaatttaacggaatgatactcaccgaagattttaccagaaagatcatcacgaccaacgaaaagctgaacagcctcctggagaaatggagtgaccagcacgataagatcgtgtttacgaatggctgtttcgatatcgtgcataaaggccatattgattatctctacaaagcctctttgctgggaacaaaattgatgatcggggtaaattcggatagctctgtccaggccatcaaagggccttcccgcccggtccaggatgaaagttcgcggatgtatgtcctggcctccctggaatttgtcaatgctgtggtactctttaatgaccccacgccgctgaatctcattaaaaaagttcgtccggatgtgcttgtaaaaggagctgattataaacccgaagagatcgtgggctaccatgaagtaacctcctggggaggagagatccacaccatcgaattcctggaaggctattcgaccagtaagattatccggaaaatcctggaaggctaa

SEQ ID NO: 4968 - protein, 173 aa, Unknown
  Obtained from environmental sample
  DOMAIN (43)...(169): Cytidylyltransferase
  misc_feature (1)..(173): Xaa is any amino acid
MYFRAKFNGMILTEDFTRKIITTNEKLNSLLEKWSDQHDKIVFTNGCFDIVHKGHIDYLYKASLLGTKLMIGVNSDSSVQAIKGPSRPVQDESSRMYVLASLEFVNAVVLFNDPTPLNLIKKVRPDVLVKGADYKPEEIVGYHEVTSWGGEIHTIEFLEGYSTSKIIRKILEG

SEQ ID NO: 4969 - DNA, 708 bp, Unknown
  Obtained from environmental sample
  misc_feature (1)..(708): n is a, c, g, or t
ttggccaaaaaaatggaagaagctgaaaaaaatgctaaagaaaagattaaaaccctaattaaacagaacaaggtaaccaagctttttatagttaaacaatgttattctgttgataaacaagaaattttaaatcaggcaatttctgaactttctatccctggtcaatctaatttatttctagattgggaagatcatattatccatatcttgaattatggctgggttcataagggggttggactttatattgatccttacaagctttccaaagaagagaagagggaatatattaaaaaaaagtcagaattaattaaggattttattcagaaaaataaattggcctatctggattttagccataaagaattgactgatttagatatagaaatattaagagcagtctatatagacaagccttatggcttagtgatgccttcttgctcatctgttaccaagtttaatcatattaaaaaacagtttgaaaaaatagttgatcaattacaaaaaaaagaaatagcctcgataattgaaaaagaaaaaactgcctttctttttaaatcttactattttttagaaagtaacattatcccttttgatcatgatgagttgcaatcgctagagncaataactaataatacacaagaattagttaaaatattgcgttcacactatcctaatttacagattattaaaagtgaatttgaatag

SEQ ID NO: 4970 - protein, 235 aa, Unknown
  Obtained from environmental sample
  misc_feature (1)..(235): Xaa is any amino acid
MAKKMEEAEKNAKEKIKTLIKQNKVTKLFIVKQCYSVDKQEILNQAISELSIPGQSNLFLDWEDHIIHILNYGWVHKGVGLYIDPYKLSKEEKREYIKKKSELIKDFIQKNKLAYLDFSHKELTDLDIEILRAVYIDKPYGLVMPSCSSVTKFNHIKKQFEKIVDQLQKKEIASIIEKEKTAFLFKSYYFLESNIIPFDHDELQSLEXITNNTQELVKILRSHYPNLQIIKSEFE

SEQ ID NO: 4971 - DNA, 927 bp, Unknown
  Obtained from environmental sample
  misc_feature (1)..(927): n is a, c, g, or t
atggggaaggatcatattatcccatatcttgaattattggcggggtccataagggggttggaactttatattgatccttacaagctttccaaagagagaaagagggaatatattaaaaaaaagtcagaattaattagggattttattcagaaaaataaattggcctatctggattttagccataaagaattgactgatttagatatagaaatattaagagcagtctatatagacaagccttatggcttagtgatgccttcttgctcatctgttaccaagtttaatcatattaaaaaacagtttgaaaaaatagttgatcaattacaaaaaaaagaaatagcctcgataattgaaaaagaaaaaactgcctttctttttaaatcttactattttttagaaagtaacattatcccttttgatcatgatgagttgcaatcgctagagcaaataactaataatacacaagaattagttaaaatattgcgttcacactatcctaatttacagattattaaaagtgaatttgataagtttattactaataaacctagatattttgatttcagtcatagtaatttaacttttgtagaaagaggaattttgcataacgccctcttgccatatagtgaagaggaagcaatctttctcttgcccattactatagaggataagattatccatcttttacgttgctccttaaataaggaggaaaaaacaaccaaaattacttccttacttactgagaatagggtaattgagttatgttttgaagaaagcctggataatgaagagaaggagtttttatctcgatttactattgaggaaaatagaataaaaatacttaatttagaagataaaattctggctattttacgctcttcagaaacggaggaacaaaaaatccaagctgtaaatcttgcaatctga

SEQ ID NO: 4972 - protein, 308 aa, Unknown
  Obtained from environmental sample
  misc_feature (1)..(308): Xaa is any amino acid
MGKDHIIPYLELLAGSIRGLELYIDPYKLSKERKREYIKKKSELIRDFIQKNKLAYLDFSHKELTDLDIEILRAVYIDKPYGLVMPSCSSVTKFNHIKKQFEKIVDQLQKKEIASIIEKEKTAFLFKSYYFLESNIIPFDHDELQSLEQITNNTQELVKILRSHYPNLQIIKSEFDKFITNKPRYFDFSHSNLTFVERGILHNALLPYSEEEAIFLLPITIEDKIIHLLRCSLNKEEKTTKITSLLTENRVIELCFEESLDNEEKEFLSRFTIEENRIKILNLEDKILAILRSSETEEQKIQAVNLAI

SEQ ID NO: 4973 - DNA, 552 bp, Unknown
  Obtained from environmental sample
  misc_feature (1)..(552): n is a, c, g, or t
atgatgctaaagcagaaggatgatgactatatcaaacgtaagttagttcacttgggatttagaatagacgagaatgttcttgagggtataaagaaatcggctaagaggactgaaaccacggtaagtaatcaaatcaataccatcctcagaaattgggtcacacgagacacgctttttcaggaattaggctttatccctatgagtaaggacgtcctgagagcctggataaataaaattgagccaagcgaacttctaattcaggctagagaatttggacagtctacatctgaaatcatagcctacttctacggagaaattaacgtaagtaatatgatgaaattcctagaaatacttttgagtagattcccgtcttatgatcaccgaattgagaacaacactcattcatttcatataaatcatgatatatgtatgaaatattcaattttttttggtgagttattaaagtcattaatagagccaatttatcagagttcagtanaattaaagaaatctacacagaannacgatattatttcatttgatatcttgtag

SEQ ID NO: 4974 - protein, 183 aa, Unknown
  Obtained from environmental sample
  misc_feature (1)..(183): Xaa is any amino acid
MMLKQKDDDYIKRKLVHLGFRIDENVLEGIKKSAKRTETTVSNQINTILRNWVTRDTLFQELGFIPMSKDVLRAWINKIEPSELLIQAREFGQSTSEIIAYFYGEINVSNMMKFLEILLSRFPSYDHRIENNTHSFHINHDICMKYSIFFGELLKSLIEPIYQSSVXLKKSTQXXDIISFDIL

SEQ ID NO: 4975 - DNA, 552 bp, Unknown
  Obtained from environmental sample
  misc_feature (1)..(552): n is a, c, g, or t
atgatgctaaagcagaaggatgatgactatatcaaacgtaagttagttcacttgggatttagaatagacgagaatgttcttgagggtataaagaaatcggctaagaggactgaaaccacggtaagtaatcaaatcaataccatcctcagaaattgggtcacacgagacacgctttttcaggaattaggctttatccctatgagtaaggacgtcctgagagcctggataaataaaattgagccaagcgaacttctaattcaggctagagaatttggacagtctacatctgaaatcatagcctacttctacggagaaattaacgtaagtaatatgatgaaattcctagaaatacttttgagtagattcccgtcttatgatcaccgaattgagaacaacactcattcatttcatataaatcatgatatatgtatgaaatattcaattttttttggtgagttattaaagtcattaatagagccaattatcaagagttcagtaaaattaaagaatctaacacagaaaacgataattatttcatttgatatcttgtag

SEQ ID NO: 4976 - protein, 183 aa, Unknown
  Obtained from environmental sample
  misc_feature (1)..(183): Xaa is any amino acid
MMLKQKDDDYIKRKLVHLGFRIDENVLEGIKKSAKRTETTVSNQINTILRNWVTRDTLFQELGFIPMSKDVLRAWINKIEPSELLIQAREFGQSTSEIIAYFYGEINVSNMMKFLEILLSRFPSYDHRIENNTHSFHINHDICMKYSIFFGELLKSLIEPIIKSSVKLKNLTQKTIIISFDIL

SEQ ID NO: 4977 - DNA, 693 bp, Unknown
  Obtained from environmental sample
  misc_feature (1)..(693): n is a, c, g, or t
ttgaaaataaaaaaactaaacgctcttttttatttagtcatttcctgttcaaaggactttaaacaaaaaacaccctttaaaccatttaagcaaattttcattcaggcaggaaaggtaagagaacttcatctggaagaagcaatgctcaggaaaactctttcggataacttacttatatcatacaggaaaaacttgaaacaaaatcggctgaatgagcagaaacagttttttggaatgctaaacaaaaactttatcagccgattgaaaagaaagcacaaagtgattcttccatttctttccgaaatcgattctaaaaaagcaaataaatatattgataaaagtaaaaataacattaaaaagctgcttaaccagggaaccataaaaaagcgccagcttcatgaacttcgcaagcgattgaaaattcttgattataatataaagagtcttacatcaggaaataagaaaagccttgcaaagaaaagtgttctgcctgttctgttaggcaaatggcacgataaccaggtcatgcttgctcatcttaacaaggaaataaagtcacggaaaattaatctaaaagagatccattatcttgaaaaagtaagaatgaaaatatcttccggcaatgaggtgttattgaataaaataaattatgctatacgcacttcagaatatttgcagaaattaaatcagtga

SEQ ID NO: 4978 - protein, 230 aa, Unknown
  Obtained from environmental sample
  misc_feature (1)..(230): Xaa is any amino acid
MKIKKLNALFYLVISCSKDFKQKTPFKPFKQIFIQAGKVRELHLEEAMLRKTLSDNLLISYRKNLKQNRLNEQKQFFGMLNKNFISRLKRKHKVILPFLSEIDSKKANKYIDKSKNNIKKLLNQGTIKKRQLHELRKRLKILDYNIKSLTSGNKKSLAKKSVLPVLLGKWHDNQVMLAHLNKEIKSRKINLKEIHYLEKVRMKISSGNEVLLNKINYAIRTSEYLQKLNQ

SEQ ID NO: 4979 - DNA, 552 bp, Unknown
  Obtained from environmental sample
  misc_feature (1)..(552): n is a, c, g, or t
atgtattattcaattttatttacggggcatatgattgataaggaggaccggcttntgcgtcgttttccttcaagcaaagagggcgttgtcagaaagaaaataaaagaacagcttttaaaagtaaaacatgcagtaaaagaaaaattaaaaggcatagcaggtggtgcctgtggcggggacatcctctttcacgaattatgcctggaactaaatatcgcaagtgaaatttttcttgcattgcctgtaaatgattttaaaaaaagttctgtttcatttgccggtaaagattgggaagaccgttatgaatatttaataagaaagctgcctgttcatttcttgccgcaatcaaatgaaaataatacaatcaatgtatgggaacgtgcaaatctttggatgcttgaatcagcacttaagaacgggggacaaaacatgagcctgattgctttgtgggatggtaaagccggtgatgctgggggcggtactgaacacatgataagggttgccaaacaaaatggagcaagaacaaaaatcatagacattaaaaaaatataa

SEQ ID NO: 4980 - protein, 183 aa, Unknown
  Obtained from environmental sample
  misc_feature (1)..(183): Xaa is any amino acid
MYYSILFTGHMIDKEDRLXRRFPSSKEGVVRKKIKEQLLKVKHAVKEKLKGIAGGACGGDILFHELCLELNIASEIFLALPVNDFKKSSVSFAGKDWEDRYEYLIRKLPVHFLPQSNENNTINVWERANLWMLESALKNGGQNMSLIALWDGKAGDAGGGTEHMIRVAKQNGARTKIIDIKKI

SEQ ID NO: 4981 - DNA, 309 bp, Unknown
  Obtained from environmental sample
  misc_feature (1)..(309): n is a, c, g, or t
atggaaataacagtaaaggagataaaaatactttttgatcttttgattcaaaaacttcaagatgaacatccggatgcaattccgctaattgaagattattatgtaaaaatactctcctccgagcagtatcaattagaatcgacagtggaacctgcaatcggttctctgtacgatgatctcagagcgctaaaaaaagtgctaagcggagaaagtccattcacttatttagatatggacagaatttctagtattttaatctatataagtgagcatataacgccgacaagtaaatttagcaaagtcacttaa

SEQ ID NO: 4982 - protein, 102 aa, Unknown
  Obtained from environmental sample
  misc_feature (1)..(102): Xaa is any amino acid
MEITVKEIKILFDLLIQKLQDEHPDAIPLIEDYYVKILSSEQYQLESTVEPAIGSLYDDLRALKKVLSGESPFTYLDMDRISSILIYISEHITPTSKFSKVT

SEQ ID NO: 4983 - DNA, 705 bp, Unknown
  Obtained from environmental sample
  misc_feature (1)..(705): n is a, c, g, or t
atgattttcttaaaaaagtttttcaaaaataaaatattgatgatccagcgatcctttgaatcaattatgaagaaatttttatttactatatcagtaagtcttttagcattattagtgcacgctcaaacttcatacgtttcaaaagtttgggtagcagataatggcgacggctcttataaaaatcctgtgatcaatgctgattattcagatcctgatgcaataagagtgggggatgatttttatttggtttcgtccagttttgaagatgttccgggtttgccaattttacattccaaggatttgattaactggacaattattggtcatgggctggaacgattaattcctaaaaaacatttttcaatttcccgacatggcgatggagtgtgggctcctgcgattcgttttcataatggagaattttacatctattatcccgatccggattatggaatttatttgatcaaatcaaaaaatcctgctggcaagtggagcaaacctcttctggttcaggaaggaaaaggattaatagatccatgccctttatgggatgatgatggaaatgtttatttagttcacgcatttgcaggaagccgtgctggaatcaaaagtattttggtggtaaataaattaaatgcagaaggaacgaaagtgattgatgcgggaaaaattgttacgacgggcngaaaaagatccaacatctga

SEQ ID NO: 4984 - protein, 234 aa, Unknown
  Obtained from environmental sample
  misc_feature (1)..(234): Xaa is any amino acid
MIFLKKFFKNKILMIQRSFESIMKKFLFTISVSLLALLVHAQTSYVSKVWVADNGDGSYKNPVINADYSDPDAIRVGDDFYLVSSSFEDVPGLPILHSKDLINWTIIGHGLERLIPKKHFSISRHGDGVWAPAIRFHNGEFYIYYPDPDYGIYLIKSKNPAGKWSKPLLVQEGKGLIDPCPLWDDDGNVYLVHAFAGSRAGIKSILVVNKLNAEGTKVIDAGKIVTTGXKRSNI

SEQ ID NO: 4985 - DNA, 597 bp, Unknown
  Obtained from environmental sample
  misc_feature (1)..(597): n is a, c, g, or t
ttggaaggggaattccgccgaagtattgtttttgtaaataaatttgatccccaaaacaaggtgacgtttgaggttcccgtgataccgagaaataaaccgagtctttctgcagcacagtttttgtattactttcccgactatgaaggtttacctcaaaagtcttttagaagcaatggcttgtggncctgtcccggtatgctaaaaatgagtagtggcatacctgagttaattgagaataatgaaaccgcctatttagtttcagatagaaacgatgactttatagaagcaatcaaaaaattaaagaataataaaagcctgtttaatgagctaagtaaaaacgcaaaacaaaaaattattgatttctattcctctgatgcctgtacaaataagtggaacagtttattgaacgaactatattattctaattgcagttcgtacaaaaaaattgatatcccagacaaaattgaattacctaaaagacatccgcaattaagtatagaagattttagaataccgactgccttcgatttgttattggaaaaaatacgaacaaccaaagcctttcgatattttaaaaaatttattttaaaaagataa

SEQ ID NO: 4986 - protein, 198 aa, Unknown
  Obtained from environmental sample
  misc_feature (1)..(198): Xaa is any amino acid
MEGEFRRSIVFVNKFDPQNKVTFEVPVIPRNKPSLSAAQFLYYFPDYEGLPQKSFRSNGLWXCPGMLKMSSGIPELIENNETAYLVSDRNDDFIEAIKKLKNNKSLFNELSKNAKQKIIDFYSSDACTNKWNSLLNELYYSNCSSYKKIDIPDKIELPKRHPQLSIEDFRIPTAFDLLLEKIRTTKAFRYFKKFILKR

SEQ ID NO: 4987 - DNA, 948 bp, Unknown
  Obtained from environmental sample
  misc_feature (1)..(948): n is a, c, g, or t
atggcaggtagagggactgacatagtgctagggggcaatgtagctgcgttgttaaaagagaaactagcaagtaacaattattctgaaaaagagcgtaaagcgctagaagaagaaataaaaaaacacgtggatgaagatagaaaaaaagttttatctttaggcggacttttagttataggaactgaacgccatgaatcaagaagaatagataatcagctacgaggaagatcaggcaggcagggtgatcatgggcggactaaattttatctttctttagaagatgatcttatgagaattttcggctcagataaaattaaaggtttgctttctaaattaggtttaaaagagggagaagcgataatacacccatggattagtaggtctttggaaaaagcgcagcaaaaagtagaagctcgtaactatgataccagaaagacattgcttaaatttgacgatgttatgaatgagcaaagaaaggttatatataatcagcgtaaatatttcatgaatgcggataaccttgaagaatatatggaagagtctgcgatggagatattacatagtttggttgagaattatattccagctaagtcgatggttgaagaatgggatgtattaggattatcaaaagaactattccgggttttcgctattaagccagagtttatagctatcatagatgcagatacggatttaacgaaagaagaaattttggataaactaaaaaatactatcttagacagtataaaagataagatagacaaatatggagcgaaattaataagtctcgcaataagacaactattaatattaacactagatcaactttggaaagagcatctacatgtattagatcatttaaggatgggtataggtttaagggcatatggacaaaaagatcctcttaatgaatataaaatggaagcgtttaatttatttacaagntga

SEQ ID NO: 4988 - protein, 315 aa, Unknown
  Obtained from environmental sample
  DOMAIN (119)...(315): SecA Wing and Scaffold domain
  misc_feature (1)..(315): Xaa is any amino acid
MAGRGTDIVLGGNVAALLKEKLASNNYSEKERKALEEEIKKHVDEDRKKVLSLGGLLVIGTERHESRRIDNQLRGRSGRQGDHGRTKFYLSLEDDLMRIFGSDKIKGLLSKLGLKEGEAIIHPWISRSLEKAQQKVEARNYDTRKTLLKFDDVMNEQRKVIYNQRKYFMNADNLEEYMEESAMEILHSLVENYIPAKSMVEEWDVLGLSKELFRVFAIKPEFIAIIDADTDLTKEEILDKLKNTILDSIKDKIDKYGAKLISLAIRQLLILTLDQLWKEHLHVLDHLRMGIGLRAYGQKDPLNEYKMEAFNLFTX

SEQ ID NO: 4989 - DNA, 750 bp, Unknown
  Obtained from environmental sample
  misc_feature (1)..(750): n is a, c, g, or t
atgaatgcggataaccctgaaggatatatggaagagtttgcgatggagatattacatagtttggttgagaattatatcccagctaagtcgatggttgaagaatgggatgtattaggattatcaaaagaactattccgggttttcgctattaagccagagtttatagctatcatagatgcagatacggatttaacgaaagaagaaattttggataaactaaaaaatactatcttagacagtataaaagataagatagacaaatatggagcgaaattaataagtctcgcaataagacaactattaatattaacactagatcaactttggaaagagcatctacatgtattagatcatttaaggatgggtataggtttaagggcatatggacaaaaagatcctcttaatgaatataaaatggaagcgtttaatttatttaccaagttgatgctagattttaatgagctctcggtgcagagattccttcatctagaaattgctcatgaggttaatgagcatatttcagaagctaaggcggataaaatgaagatgtttgaaacaaggaacgatcctgcttttcgtaagaatgaagactactcaatgcaaaatgctaaaattagaaaagctagatcttatgttaatcctgaggacagggataaaaatgatactaacacatggggtaaagtttcaagaaatgaggaatgcccttgtggatcaggtaaaaaatataaatattgccatggcgctatgtga

SEQ ID NO: 4990 - protein, 249 aa, Unknown
  Obtained from environmental sample
  DOMAIN (230)...(249): SEC-C motif
  misc_feature (1)..(249): Xaa is any amino acid
MNADNPEGYMEEFAMEILHSLVENYIPAKSMVEEWDVLGLSKELFRVFAIKPEFIAIIDADTDLTKEEILDKLKNTILDSIKDKIDKYGAKLISLAIRQLLILTLDQLWKEHLHVLDHLRMGIGLRAYGQKDPLNEYKMEAFNLFTKLMLDFNELSVQRFLHLEIAHEVNEHISEAKADKMKMFETRNDPAFRKNEDYSMQNAKIRKARSYVNPEDRDKNDTNTWGKVSRNEECPCGSGKKYKYCHGAM

SEQ ID NO: 4991 - DNA, 477 bp, Unknown
  Obtained from environmental sample
  misc_feature (1)..(477): n is a, c, g, or t
ttgatcctggagatcggaacatataccggttatagtgccatttgccttgctgaaggactcaccaacaatggcattcttcacacgatcgatattaacgatgaactaaaaccgatggtggataagtatgttcgcctttcaggcctgcagaataaaatattcacccattacggaaatgcactccagctgctaaacaattttcccggaccgtttgacatcgtttttattgatgcagacaaggaaaattacagcaggtattatgaattggtcttcgataaaataaatcccggtggatatattattgctgacaatgttttatggagcggaaaggtattgaagaataaatcggaacaggataaggatacgcttgcaataaccgaattcaatactaagatccgggaagatgaccgtattgaaaaagtaatgctgcctgttagagacggcttattaataataagaaagaaacaggcaattctgtga

SEQ ID NO: 4992 - protein, 158 aa, Unknown
  Obtained from environmental sample
  DOMAIN (2)...(154): O-methyltransferase
  misc_feature (1)..(158): Xaa is any amino acid
MILEIGTYTGYSAICLAEGLTNNGILHTIDINDELKPMVDKYVRLSGLQNKIFTHYGNALQLLNNFPGPFDIVFIDADKENYSRYYELVFDKINPGGYIIADNVLWSGKVLKNKSEQDKDTLAITEFNTKIREDDRIEKVMLPVRDGLLIIRKKQAIL

SEQ ID NO: 4993 - DNA, 738 bp, Unknown
  Obtained from environmental sample
  misc_feature (1)..(738): n is a, c, g, or t
atgaccccaaggttaagaaatacactttggaatactttagacgatcatgtatggaatccattagacttacaaggttttcaattagtttttatcncacgaataaagttttgtcagaaactttggaaagattttttttatttacccgcggatgatattaataatgaatatgatataataagagaaaaatattttaattttaaatggtatgaagtttatgattttgtagaatttatattaactgagttaccattaaaagggctacaacatacaattaataaagttttagaagagaatttatcagcttatagatatgtaaacttcatttgtacagctataactgattcaaacgaaattaaaatacttgaagatgcattgtcagacaatactttcaaagctgtaaatgaacacttaacgcaagctattagattatttagcgataagagtaaacccgatttcaggaattcaattaaagaaagtatctctgccgttgaaagtttatgtcaaataattgctggaaaaccaaatgcaactttagcgaatgtcttaaaagtattagaaaaagactgtaagatacaccctgctttaagtcagggatttattaaattttatggatatacttcagaggcagatggtatccgccacgcattacaggatgaatctagtttaaacgcaaatgatgcgaaattcttcctaatatcctgctcttcatttattaattatttgaaaactaaaatataa

SEQ ID NO: 4994 - protein, 245 aa, Unknown
  Obtained from environmental sample
  misc_feature (1)..(245): Xaa is any amino acid
MTPRLRNTLWNTLDDHVWNPLDLQGFQLVFIXRIKFCQKLWKDFFYLPADDINNEYDIIREKYFNFKWYEVYDFVEFILTELPLKGLQHTINKVLEENLSAYRYVNFICTAITDSNEIKILEDALSDNTFKAVNEHLTQAIRLFSDKSKPDFRNSIKESISAVESLCQIIAGKPNATLANVLKVLEKDCKIHPALSQGFIKFYGYTSEADGIRHALQDESSLNANDAKFFLISCSSFINYLKTKI

SEQ ID NO: 4995 - DNA, 549 bp, Unknown
  Obtained from environmental sample
  misc_feature (1)..(549): n is a, c, g, or t
atgaccaatattgaaaggtatgcccaatatgccccggtatttacaaaaaacaattatgaagtgtggatgatagattatcctggctatggtaaaacaactgggaagcgcagcgaacaaaccatgtatgacgatgctttatttttataccaattagcaataaaagaaaatgaagtggaaaatattattctttatggaaaatctttaggcaccggtgtagcgtcctacctggcatatgtaaaatcgtgcaaacaacttatactggaaacgccttattatagtatggtgtcaatgacacgacattatgtacctatttatcctgcaaagttgttgcgttattcctttgcaagttttcaatatttaaaaaaagttaaagcacctgttactattttccatggcacttcagatgaagttattccttacagccaatcgataaaattaaaaaaggaattacctggtataaatttgataaaagtatcaaacggaaaacataacaacctataccgttatcctctggtcattcaaaaacttgactcattgcttgcaggataa

SEQ ID NO: 4996 - protein, 182 aa, Unknown
  Obtained from environmental sample
  misc_feature (1)..(182): Xaa is any amino acid
MTNIERYAQYAPVFTKNNYEVWMIDYPGYGKTTGKRSEQTMYDDALFLYQLAIKENEVENIILYGKSLGTGVASYLAYVKSCKQLILETPYYSMVSMTRHYVPIYPAKLLRYSFASFQYLKKVKAPVTIFHGTSDEVIPYSQSIKLKKELPGINLIKVSNGKHNNLYRYPLVIQKLDSLLAG

SEQ ID NO: 4997 - DNA, 762 bp, Unknown
  Obtained from environmental sample
  misc_feature (1)..(762): n is a, c, g, or t
atgattcctccttccgattcacttttaaaaaagtataaaatcatcacggcaaattacattgcagaaaaggattctcttactaagcacgacaccaaaattgactcataccaattattttatttcgatcccaatgttttgcctgacaccggatggagaaaattaggattttcagcaaaccagataaaagtcatacgcaattatatttcaaaaggagggcaattccgaaaaaaggaagacctcgccaggatatattgcatctcacctgaacagtttaatttgatttcatcttacatccagataaaagaacctgaaaaaaaacaattcaaagcttttgaaaaatttaaaacaacgtataaggaaaaaaagatcaagacgattaaggttatcgaattaaacacagccgatacatcagctttaatgtctttaccgctgataggcgctggaagagcaaaaacaattatcaaataccgtgaatctcttggcggatttgtatctgaaagtcagttgaaagaggttttcggaatagattcttcagtatttaaagtgatcgaaccttatttatcagtttcaaaagaaaatatccgtttccttgatctaaactccgatagcctgaagcatccttacctttcaaaacataacttaagaattattcgggcctggagaaaagaacatggcgattttaaaaattcttccgacctgaaacaggtaggcacaataaccgaggaaatctaccagaaacttttaccttatctgccagagtaa

SEQ ID NO: 4998 - protein, 253 aa, Unknown
  Obtained from environmental sample
  misc_feature (1)..(253): Xaa is any amino acid
MIPPSDSLLKKYKIITANYIAEKDSLTKHDTKIDSYQLFYFDPNVLPDTGWRKLGFSANQIKVIRNYISKGGQFRKKEDLARIYCISPEQFNLISSYIQIKEPEKKQFKAFEKFKTTYKEKKIKTIKVIELNTADTSALMSLPLIGAGRAKTIIKYRESLGGFVSESQLKEVFGIDSSVFKVIEPYLSVSKENIRFLDLNSDSLKHPYLSKHNLRIIRAWRKEHGDFKNSSDLKQVGTITEEIYQKLLPYLPE

SEQ ID NO: 4999 - DNA, 399 bp, Unknown
  Obtained from environmental sample
  misc_feature (1)..(399): n is a, c, g, or t
atgattaaaaaactaaccggggaaatatggaagcccatgcaatttattggaagtaaagctttacgtaaccgttatgcgctttcatcttatggaagaattgccagttacaaggaagacatcattaaagatggaaaattgctgaatggctcgttaacaaccggctatagaacactaaaccttcaccggcctggtaaccagggaactttatatatacatcgtgaaattgccaagctgtttttaaaacgtcctttcacaaaacataaatatgttattcataaaaaccacaacaagctggaccaatacattaaaaatttaaaatgggctacacttgacgaaatgatagaacacaagcaaagcagcccagcaaaaaattgcctacaaaaaacgccaggcaaataa

SEQ ID NO: 5000 - protein, 132 aa, Unknown
  Obtained from environmental sample
  misc_feature (1)..(132): Xaa is any amino acid
MIKKLTGEIWKPMQFIGSKALRNRYALSSYGRIASYKEDIIKDGKLLNGSLTTGYRTLNLHRPGNQGTLYIHREIAKLFLKRPFTKHKYVIHKNHNKLDQYIKNLKWATLDEMIEHKQSSPAKNCLQKTPGK

SEQ ID NO: 5001 - DNA, 819 bp, Unknown
  Obtained from environmental sample
  misc_feature (1)..(819): n is a, c, g, or t
atgatagatattgttgataatatgaatataaaaataagaacaccaaaattggaagtaaaaacaattcaaataagtgatatattagatattagttcattttatttatattataaagaatatttttatgatgacttctttattaaagaattatataataatatatatcttacagatgccctttttcaaaagttgaataaatttaacactaatttatcatttatattagcacaatacaataatatatctgtagtatgtttcaaaagaggtgaaaatgtcgatatttatgattattcttctaatattattgaattaaatataccaaaagataatatcaaccaaatcactgaaataactcaacgtatcgttcaatttccagtagaatataaaaaattaatagataatgaaaaaaaattaagagaaaatataaatgaacactatgaaaatgataattctaatttatatggcacggtaaattattctgacataactcttgatttagtccaaacgcgtcaaatacctgggaaaatagagttattgaaaatgaaaaaaaaagaatatagtttcatattctttataatacataaatataaagataatgatataatttatgtccttactgatctaataataagagatgatgaaataatagcatataaagcatataattcactttataaagaggaagaanatattaaaaatataaaaatttataattatggtgaattaaaaacatttggtactaaaatgagtaataattctggtagtattcgattcaaaacatggnatttattttcattcatattggcagaagttcaataa

SEQ ID NO: 5002 - protein, 272 aa, Unknown
  Obtained from environmental sample
  misc_feature (1)..(272): Xaa is any amino acid
MIDIVDNMNIKIRTPKLEVKTIQISDILDISSFYLYYKEYFYDDFFIKELYNNIYLTDALFQKLNKFNTNLSFILAQYNNISVVCFKRGENVDIYDYSSNIIELNIPKDNINQITEITQRIVQFPVEYKKLIDNEKKLRENINEHYENDNSNLYGTVNYSDITLDLVQTRQIPGKIELLKMKKKEYSFIFFIIHKYKDNDIIYVLTDLIIRDDEIIAYKAYNSLYKEEEXIKNIKIYNYGELKTFGTKMSNNSGSIRFKTWXLFSFILAEVQ

SEQ ID NO: 5003 - DNA, 711 bp, Unknown
  Obtained from environmental sample
  misc_feature (1)..(711): n is a, c, g, or t
atggaatggataaaatttatacttttattatctcatgaaagtttagatagttttaagcatttattatcaaatcagaaaatacttataaactttcctatagatcgttataaaattgaatatttaaaagaagatcataaaaataaaattaaaattaaaaatttgataataccaatgttgccttataaaaaaaaattactagaacataataatagaataattatacaggaaaaccaaaaattacaaaactcaaaacttaagatggttgtgattactgtaccaaacaataaccctgttttacaacagtatgaaataaaagattatacttcaaattttatatatacctggaaggttgatggcaacacaacaatatcatcagtttattatcataatagaaagaataaacaagaacaagttaaatatttaactagggataaaataacaaataatttattaccatatccacctaacggtgaggtttatataagtctattaattgatgatcaagaagtaataacacctaaaccgataattttgagagataatccatatgtatctaaccttgattttacccctagtcttgaccccggcaaccccaatccagacgaacatatgagtaattttttaattgattggtcaagaatcactaattctaatggaactttttattggattaataaaatatcaattatagaatttgatgatgacatgtaa

SEQ ID NO: 5004 - protein, 236 aa, Unknown
  Obtained from environmental sample
  misc_feature (1)..(236): Xaa is any amino acid
MEWIKFILLLSHESLDSFKHLLSNQKILINFPIDRYKIEYLKEDHKNKIKIKNLIIPMLPYKKKLLEHNNRIIIQENQKLQNSKLKMVVITVPNNNPVLQQYEIKDYTSNFIYTWKVDGNTTISSVYYHNRKNKQEQVKYLTRDKITNNLLPYPPNGEVYISLLIDDQEVITPKPIILRDNPYVSNLDFTPSLDPGNPNPDEHMSNFLIDWSRITNSNGTFYWINKISIIEFDDDM

SEQ ID NO: 5005 - DNA, 816 bp, Unknown
  Obtained from environmental sample
  misc_feature (1)..(816): n is a, c, g, or t
atgaatgaagggaaaaaagaactggataacttcattgatccagaatctaaataccctgtgattgccactaccagcaagctaatgacaactggtgtggatgcaaaaacctgtaagctgatcgttttagatcagcgtattcaatcaatgacggaatttaagcagatcattggccgtggcacacgtattgacgacgattacaacaaacattggtttacaattttagatttcaaaaaagcaaccgaattatttgcagatcccaaatttgatggcgatcctgtgcaggtttatagcccaaccccagaagatgccaccgtaccacccgatgaaattccagaagatgatattgccactaatgaaggtgattttgcttactcatccgatgaagataatgaagataccggcggtggcataagtgagaaagttaagaaatatactgtcagtgaggtgagtgtaaaagttattgatgagcgcacacaatacctcgatagcaacggtaagctaatcactgagtcgctgactgattacactcgtctctgtgtcactaaaaaatttgcaaccctcaatgaatttctacgcaaatggagtgatgccgaacaaaagaaagcgattattgaagaattaacagctcaaggtgttttgtggaatgacctgcaagcggatgtgagtaaaaagcttggttatgaattagatgctttcgatttaatcactcacattgttttcggccagccaccactgtctcgtcaagagcgcgctaacaatgtgaaaaagcgccaattacttcatcaaataccaaggcgcagccaaacaagtacttga

SEQ ID NO: 5006 - protein, 271 aa, Unknown
  Obtained from environmental sample
  misc_feature (1)..(271): Xaa is any amino acid
MNEGKKELDNFIDPESKYPVIATTSKLMTTGVDAKTCKLIVLDQRIQSMTEFKQIIGRGTRIDDDYNKHWFTILDFKKATELFADPKFDGDPVQVYSPTPEDATVPPDEIPEDDIATNEGDFAYSSDEDNEDTGGGISEKVKKYTVSEVSVKVIDERTQYLDSNGKLITESLTDYTRLCVTKKFATLNEFLRKWSDAEQKKAIIEELTAQGVLWNDLQADVSKKLGYELDAFDLITHIVFGQPPLSRQERANNVKKRQLLHQIPRRSQTST

SEQ ID NO: 5007 - DNA, 858 bp, Unknown
  Obtained from environmental sample
  misc_feature (1)..(858): n is a, c, g, or t
ttgatatggctganaatcnctgcacactaccagggtgcagttgtgatagtttcgcacgacaggtattttttggacagaatggtaacaaaaattgttgagctctatcagcaggaattacatttttattcaggaaattattcttattaccagcaggaaaaaatgcagcgtatagagttacaaaaaagagcttatgaaaaccaacaggattttatcaggcaacaagaaagatttgtggaacgctttaaagcaaaagcctcaaaggcagcgcaggcccaaagcataatgaaacgcctggataaaatcgaaagaattgagaacactgaccttgagagacctaacatccgtatcaatttcgccattgataaaactcccggacgcacattgtgcactttgaaaaatgtaagtaaaaaatttggtgacataaagatcattgagcatgctgatgcagaaattaaccgcggagataaaatcggtttgataggtgcaaacggaaaaggtaaatcaactcttttgcgtattgttgcaggcacagaaacttttgaaggcgaaagagtatgggggcataatgttgacgattcattttttgcccagcaccagttagatgctttgaatataaacaatacagttctggaagaaatgcaacgatgcggcagtggaaaaactgaacttgagctacgaacattgttaggatgttttttgttcagcggcgatgatgttgagaaaaaaataaaagtgttaagcggtggcgaaaaagcccgtgttgctttagctaaaacaatcgttagtaaagcaaattttttattacttgatgaacctaccaaccatctcgacatacattctgttgacctgctgnnatga

SEQ ID NO: 5008 - protein, 285 aa, Unknown
  Obtained from environmental sample
  DOMAIN (154)...(285): ABC transporter
  misc_feature (1)..(285): Xaa is any amino acid
MIWLXIXAHYQGAVVIVSHDRYFLDRMVTKIVELYQQELHFYSGNYSYYQQEKMQRIELQKRAYENQQDFIRQQERFVERFKAKASKAAQAQSIMKRLDKIERIENTDLERPNIRINFAIDKTPGRTLCTLKNVSKKFGDIKIIEHADAEINRGDKIGLIGANGKGKSTLLRIVAGTETFEGERVWGHNVDDSFFAQHQLDALNINNTVLEEMQRCGSGKTELELRTLLGCFLFSGDDVEKKIKVLSGGEKARVALAKTIVSKANFLLLDEPTNHLDIHSVDLLX

SEQ ID NO: 5009 - DNA, 684 bp, Unknown
  Obtained from environmental sample
  misc_feature (1)..(684): n is a, c, g, or t
atgatcttttttcaaggctgtcaaagcctgaagcaatcttccaaatatggttttaatgaagggtattataaaagccgattgttccataaaaaactaaaatccgtttatatagttccaggcgatgattcaataaaagtttacacaacaaaaagccttcaaaaagattccattgacacggttaaatctttgaaaatagcctttccacttaatcacaagcccgcaggttttaataactatttttttaaacaaaatacatttgatgttgacatactaagcatattgatcaaataccgttcttcggtttccgggttccctaatcaattcaatacttctatattaaacggagctgtttattttgggtaccgctccgatttttatcatttgcattacaacaaaacaccactaggtatttataaaagaaaaatcagccattatggacttagctatggactatttgccggtttgggagcctcaagagtagatccatatgttactttaaatgcgcttgatatagaatatgacggacttgtacaagtatctggaatagcagccatcattgccgtaaataaattgagttgtggtttaaactttggtgtagatcatcttttagataagaaccgaanattttggatttaccagggtaaaccatggataggattaagcatcgggttaaatttgaattag

SEQ ID NO: 5010 - protein, 227 aa, Unknown
  Obtained from environmental sample
  misc_feature (1)..(227): Xaa is any amino acid
MIFFQGCQSLKQSSKYGFNEGYYKSRLFHKKLKSVYIVPGDDSIKVYTTKSLQKDSIDTVKSLKIAFPLNHKPAGFNNYFFKQNTFDVDILSILIKYRSSVSGFPNQFNTSILNGAVYFGYRSDFYHLHYNKTPLGIYKRKISHYGLSYGLFAGLGASRVDPYVTLNALDIEYDGLVQVSGIAAIIAVNKLSCGLNFGVDHLLDKNRXFWIYQGKPWIGLSIGLNLN

SEQ ID NO: 5011 - DNA, 300 bp, Unknown; identical to SEQ ID NO: 915
  Obtained from environmental sample
  misc_feature (1)..(300): n is a, c, g, or t

SEQ ID NO: 5012 - protein, 99 aa, Unknown; identical to SEQ ID NO: 916
  Obtained from environmental sample
  misc_feature (1)..(99): Xaa is any amino acid

SEQ ID NO: 5013 - DNA, 456 bp, Unknown
  Obtained from environmental sample
  misc_feature (1)..(456): n is a, c, g, or t
ttgccaacgctaatgatctataatttctcatccatgaaaaaaatattagttcttacttttctttctgcttttcttttttcctgtaaaccccatgatggagagatagtagaaaattcacagcatgcggactccttattaaaagtgatcaattctccggaattagcggcggtaaacaaaaaaatcctggaagcaccggacgatgcgaatttgtataatgaacgtgccaggatctatatgcaattcaagcaatttgaagatgccatcaatgattctaaacgttctttaagaatggacagcaccaatgccgctttttatttacgggagccgacatttttttcccggcaacgaaaccagaaatgcaaaagatgtattggaaaaagtggggaaaaaatccctgaaaaaaccgaagggttatttgaaattggggaactccttttatttttaaaaacaaaatga

SEQ ID NO: 5014 - protein, 151 aa, Unknown
  Obtained from environmental sample
  DOMAIN (68)...(101): TPR Domain
  misc_feature (1)..(151): Xaa is any amino acid
MPTLMIYNFSSMKKILVLTFLSAFLFSCKPHDGEIVENSQHADSLLKVINSPELAAVNKKILEAPDDANLYNERARIYMQFKQFEDAINDSKRSLRMDSTNAAFYLREPTFFSRQRNQKCKRCIGKSGEKIPEKTEGLFEIGELLLFLKTK

SEQ ID NO: 5015 - DNA, 990 bp, Unknown
  Obtained from environmental sample
  misc_feature (1)..(990): n is a, c, g, or t
ttgaaaaggatacgcattttctcgggtgagaccggatcttttgatgaagagtcaaaagcattgtatggagtggaagcgccagtatatagtgaacagcattttcagtcgctcgtgaaaaaactggatagcttattgccggggcagggtactatacaggcaagatttcaaaaactcgccagtcgttttatcattccaaaaaacaagcttgacacggtatttaaaaaagctatcgccgaatgccgtaagcggaccatgcagtattatacactgcctgccaccgaaagttttacattggaatatgtgaaagataaaccctggagcggttataattggtacaagggcaattacaggagtgtgatacagatcaataccgatctcgacattttaattgaccgggcgatcgatgtaggcagtcatgaaagttatcccggtcatcatgtctacaatatgttattggagaaaaacctgtaccgtgataagggatgggtcgaaatttctttctatccattattcagcccgcagtctctgatcgccgaaggcagcgccaattatggtatcgccctggcgtttccgggtgaagagaaagtgaaattcgccaaagagcagttgctgccactggcagaattggatacgaccggcatcaccgcttatttcaatacgctcgacataaaagacgaactaaactatgcccgcaacgaagtgggcaggggtttgctgaatggtacaatgactgaaccggaagctattcgttggttaaaggaatatgggatgatgactgagcagagcgcagcaaaatccatcagctttatccgcaggaaccgcagctatgtcatcaactacaactatggcaaggnacctggtaaaaaaatatatccagtcaaaagggaagtgatgccgcccgccgaacgcacatggaagacgttttggctggttattgagcaacgaggtcagtacacaagacctggtcgcacaaaagcattagtggattaa

SEQ ID NO: 5016 - protein, 329 aa, Unknown
  Obtained from environmental sample
  misc_feature (1)..(329): Xaa is any amino acid
MKRIRIFSGETGSFDEESKALYGVEAPVYSEQHFQSLVKKLDSLLPGQGTIQARFQKLASRFIIPKNKLDTVFKKAIAECRKRTMQYYTLPATESFTLEYVKDKPWSGYNWYKGNYRSVIQINTDLDILIDRAIDVGSHESYPGHHVYNMLLEKNLYRDKGWVEISFYPLFSPQSLIAEGSANYGIALAFPGEEKVKFAKEQLLPLAELDTTGITAYFNTLDIKDELNYARNEVGRGLLNGTMTEPEAIRWLKEYGMMTEQSAAKSISFIRRNRSYVINYNYGKXPGKKIYPVKREVMPPAERTWKTFWLVIEQRGQYTRPGRTKALVD

SEQ ID NO: 5017 - DNA, 600 bp, Unknown
  Obtained from environmental sample
  misc_feature (1)..(600): n is a, c, g, or t
atgacaggccggcggcaggatgaatcctggaatggagacaaaaaagaaattaatttcttctacctgaaatctttcgttgaaaatattctgaaacaatctggtattgacttctcgaagattaaggaagaacctgcatcagccgaatatggttacggcgtgagctggaagttgaatgagaaaccgctcgtatcttttggtacagtttctaaaaaacaattgaaatcttttggcattgatgaagcattctatgcagactttaactggaagaccgtctttaaaaattcttcttccgatatccagtacacagaattgccaaagttccctcaggtaaaaagagacctgagcatgattatcggcagcgatgtcacctatgcacagatccgcgacattgcattccggactgaaaaaaatctattgaaagatattcgactgttcgacgtgtatgctggcgataaaatcgaagaaggaaaaaaatcctatgcggtttcttttatccttcaggatgaacgacagacgctcacggataagactatcgataaaacaatgaatcgtttgatggaggcgttggagaaggaagttggcgcggtaattaggaagtag

SEQ ID NO: 5018 - protein, 199 aa, Unknown
  Obtained from environmental sample
  DOMAIN (105)...(198): Ferredoxin-fold anticodon binding domain
  misc_feature (1)..(199): Xaa is any amino acid
MTGRRQDESWNGDKKEINFFYLKSFVENILKQSGIDFSKIKEEPASAEYGYGVSWKLNEKPLVSFGTVSKKQLKSFGIDEAFYADFNWKTVFKNSSSDIQYTELPKFPQVKRDLSMIIGSDVTYAQIRDIAFRTEKNLLKDIRLFDVYAGDKIEEGKKSYAVSFILQDERQTLTDKTIDKTMNRLMEALEKEVGAVIRK

SEQ ID NO: 5019 - DNA, 408 bp, Unknown
  Obtained from environmental sample
  misc_feature (1)..(408): n is a, c, g, or t
atgaaaaccaaacaaacagaatctgataaagtaacggagtacatttccaaactggattccgcgctttccaaatccattcaatatttgagaaagctgatcctggatatcagcccggaaataaaggaacagatcaaatggaattcccccagcttttattatgccggtgaaatgaaggagtttgatcccaaagaatacaaaagagatattgcagtaaccaatcttcaccggggaaatattatgctcgtgtttccaacaggcgccaggattgacaaccccggcaagttattggaaggcaattatcccgatggccggaaaatagtcaagttcagggacctgcaggatctaaagaacaaagagaaattgctgaagtctgcaattattgattggttgagtaaagtagagaagtga

SEQ ID NO: 5020 - protein, 135 aa, Unknown
  Obtained from environmental sample
  misc_feature (1)..(135): Xaa is any amino acid
MKTKQTESDKVTEYISKLDSALSKSIQYLRKLILDISPEIKEQIKWNSPSFYYAGEMKEFDPKEYKRDIAVTNLHRGNIMLVFPTGARIDNPGKLLEGNYPDGRKIVKFRDLQDLKNKEKLLKSAIIDWLSKVEK

SEQ ID NO: 5021 - DNA, 402 bp, Unknown
  Obtained from environmental sample
  misc_feature (1)..(402): n is a, c, g, or t
atgaaaatacaacaggacgtattattggagagcttaaaaaaagatgttgaagttttattggaatgtgcagatttttttcggaatgaaatagatgctttattaatacccccgttaccgggcaagtggagcattgcccaaatactggaacatcttaatggatatggtcgtgtttacctgccattgattaacaaagccgtttctatcagtcaatcaaaaagagcagcttggtttaattcaggccttttgggaaattattttaccaatatgatgaagccgaaagatgtttttgaaataaaaaataaaatgaaaacactaaaggcgcatatgccggatagtaatttaaaccctggaaaagtattggatgaatttatagaacagcaacacnncagttttgcaatctga

SEQ ID NO: 5022 - protein, 133 aa, Unknown
  Obtained from environmental sample
  misc_feature (1)..(133): Xaa is any amino acid
MKIQQDVLLESLKKDVEVLLECADFFRNEIDALLIPPLPGKWSIAQILEHLNGYGRVYLPLINKAVSISQSKRAAWFNSGLLGNYFTNMMKPKDVFEIKNKMKTLKAHMPDSNLNPGKVLDEFIEQQHXSFAI

SEQ ID NO: 5023 - DNA, 585 bp, Unknown
  Obtained from environmental sample
  misc_feature (1)..(585): n is a, c, g, or t
atgatagtaaatagtatccctaaaccgtctctggcttattttgtagattcctcccgaaaaataaaatatcttaatgattactttgtggaaatttgcaatcttaaaagctctaatgaaataatcgggttttctccttccgatattatagaaagcagtacactggtacatggtaataataaaactaaggcccttgctgaaaaggtgctcgaaactggagaagctatttataaccttgaaggggcgcttaaatttagaggcgcaaataagaccctttccgtaatatgttccgctgttccggtaagagatgattccgaggttatagttggcagccttacaatcataactgatatgacagaaatcagagaaaaagaaaaacaggtccaggaccttttaacttatactgaaatctgtctaaaaaaccttgggcagggtatccgaaaagtaggtgaaggagacctggacactcgccttgaaaagatcaagatgacgagttttggtaaaacctttgacggnttaaataacctttgtaagaacctgaagtcggttgtcggacaaactctagatgaaatggacttgaccctttga

SEQ ID NO: 5024 - protein, 194 aa, Unknown
  Obtained from environmental sample
  misc_feature (1)..(194): Xaa is any amino acid
MIVNSIPKPSLAYFVDSSRKIKYLNDYFVEICNLKSSNEIIGFSPSDIIESSTLVHGNNKTKALAEKVLETGEAIYNLEGALKFRGANKTLSVICSAVPVRDDSEVIVGSLTIITDMTEIREKEKQVQDLLTYTEICLKNLGQGIRKVGEGDLDTRLEKIKMTSFGKTFDGLNNLCKNLKSVVGQTLDEMDLTL

SEQ ID NO: 5025 - DNA, 300 bp, Unknown
  Obtained from environmental sample
  misc_feature (1)..(300): n is a, c, g, or t
ttgaagggggtggcgttggagtgcctttacaagatcctgctctccgtcctcgctcgcaaagacacgaaaggctttgggaccgaatgtgagcaggtcgtggagcagctctttggcgcctctggcaaaaagaaggaccagcacatcatctcttcaggaganactcaatcgaaatcatcgtggacctcatccacctcatatctgtcgcccgacttgatctggcttcacaaatattgtcttcgacctttcttaagacaagccatcgtccgaataaccaaaccacatccactaatggcgtggtga

SEQ ID NO: 5026 - protein, 99 aa, Unknown
  Obtained from environmental sample
  misc_feature (1)..(99): Xaa is any amino acid
MKGVALECLYKILLSVLARKDTKGFGTECEQVVEQLFGASGKKKDQHIISSGXTQSKSSWTSSTSYLSPDLIWLHKYCLRPFLRQAIVRITKPHPLMAW

SEQ ID NO: 5027 - DNA, 330 bp, Unknown
  Obtained from environmental sample
  misc_feature (1)..(330): n is a, c, g, or t
atgcatgaaaaaaaacaggaaaaagattttcatgattatagaaaagatattgatatcgcaaagaaatcaatgctagattacagtcaagaatgccaggagaatgcagaaaaagagacagaacctttcaaaaaggaagtcttaatgacatttagccgcatgggtgtccaaatggaagacctttatagtaatattgaagttttattggttgccaatcatatcacaactaagagattcgaagatctagttgagtttattttgggcttaaaagaagttaaaaataatcatgaattacgcaaacatatctcagaaattttatctaaggactattga

SEQ ID NO: 5028 - protein, 109 aa, Unknown
  Obtained from environmental sample
  misc_feature (1)..(109): Xaa is any amino acid
MHEKKQEKDFHDYRKDIDIAKKSMLDYSQECQENAEKETEPFKKEVLMTFSRMGVQMEDLYSNIEVLLVANHITTKRFEDLVEFILGLKEVKNNHELRKHISEILSKDY

SEQ ID NO: 5029 - DNA, 630 bp, Unknown
  Obtained from environmental sample
  misc_feature (1)..(630): n is a, c, g, or t
ttgccagaactgaagatgcagatgattaacaggataatatttgcagcaggcggaacaggcggacatatttacccggcaatagcagtggcagatgagctgaaaaaaatgaatgagaaaatagagatcagatttatcggcgcaaaagggaagatagaagagaagatagttccgatgaacggttataagcttgaaacaattgagatcagcggattcaaaaggagcatgagcctgaaaaatttttcagcagcgttaaaattaatgaaagcattgaaagattcaaaaaaaatactgaaagattttaaacctgagctggttttcggcacaggcggctatgtatcangcccggttttaaggacagccggcaagcttgggattcccacagttatagaagaaagcaatttttatcccggtgttactgtaaagctttgtgccccgaaagccgataagggtaattgtgaaattttgaaggaacaaaaaatttcctcaaaagacagaatacgttacaactatctcttatctgtcagggcaagtatgaaccggacaaaaagatcaaaaccggctaaaatggacggctttgaccctcaaaaaaaatactggttctatttggcgaaacccgggcccaaaacttaa

SEQ ID NO: 5030 - protein, 209 aa, Unknown
  Obtained from environmental sample
  DOMAIN (12)...(152): Glycosyltransferase family 28 N-terminal domain
  misc_feature (1)..(209): Xaa is any amino acid
MPELKMQMINRIIFAAGGTGGHIYPAIAVADELKKMNEKIEIRFIGAKGKIEEKIVPMNGYKLETIEISGFKRSMSLKNFSAALKLMKALKDSKKILKDFKPELVFGTGGYVSXPVLRTAGKLGIPTVIEESNFYPGVTVKLCAPKADKGNCEILKEQKISSKDRIRYNYLLSVRASMNRTKRSKPAKMDGFDPQKKYWFYLAKPGPKT

SEQ ID NO: 5031 - DNA, 309 bp, Unknown
  Obtained from environmental sample
  misc_feature (1)..(309): n is a, c, g, or t
atgaaaaagagtttaaccatgacgctatttgcaggattgtttctgataaatagttgcacagataaggcattgtctaaatcaatagtaggagacgaaaaatatttacactgcgttcaacaagaaaacaattacatgattcaatattcatgggaagcgcccagtgaaaatggatgttgtggaaaaggagctattaaaggcgtaaaggaaatatggaaacaggatgaaggacaaacccgcatgctggtcagctcggaaccaataaatgcgaaagaaatacagaaaaaattttgtgctaaaactacaaggtaa

SEQ ID NO: 5032 - protein, 102 aa, Unknown
  Obtained from environmental sample
  SIGNAL (1)...(18)
  misc_feature (1)..(102): Xaa is any amino acid
MKKSLTMTLFAGLFLINSCTDKALSKSIVGDEKYLHCVQQENNYMIQYSWEAPSENGCCGKGAIKGVKEIWKQDEGQTRMLVSSEPINAKEIQKKFCAKTTR

SEQ ID NO: 5033 - DNA, 399 bp, Unknown
  Obtained from environmental sample
  misc_feature (1)..(399): n is a, c, g, or t
ttgatgaagaagaaaatgagcaacgccgaaaaacgcgaatcagcttctgtgctgttgctcatcattgtgatcttatctctgctaaaaccggtttctccctatatcagcgacgggctggcacatcatctgtggaatgaaaaacaccacctgaaaatgcaccaggatggagtggaacatatagattccgatcttcaaaaaatgaataattacggggataatgaaaacgaaaaacctgtagatgcaatttcaatcacagccccctctctttttttttcagagtcttttgctgaataccaatattattcaaaatcaataatcctggacatgatccggttaaattgcataattatacaaagaactctctctccctctattcaaccacctgattacaccggttga

SEQ ID NO: 5034 - protein, 132 aa, Unknown
  Obtained from environmental sample
  misc_feature (1)..(132): Xaa is any amino acid
MMKKKMSNAEKRESASVLLLIIVILSLLKPVSPYISDGLAHHLWNEKHHLKMHQDGVEHIDSDLQKMNNYGDNENEKPVDAISITAPSLFFSESFAEYQYYSKSIILDMIRLNCIIIQRTLSPSIQPPDYTG

SEQ ID NO: 5035 - DNA, 612 bp, Unknown
  Obtained from environmental sample
  misc_feature (1)..(612): n is a, c, g, or t
atgaataaaatcacccaactttttaatataaaataccctattattcagggaggaatgatctggaacagtggatataaactggcaagcgcagtgagtaatgccggaggactaggcttaattggagccggatctatgtatcctgatgttttacgtgaacatatccagaaatgtaaaaaagcaacggacaaaccttttggagttaatgtgccaatgttgtatcccaacgttgaagaaatcatgaaaattcttgttgaagaagaggtgaaaattgtttttacttcggcaggtaatccgaaaacatggaccaattatttaaaagaacacggaattactgttgttcatgtagtaagtagttctaaatttgcactaaaatcgcaggaagcaggtgtagatgccgtagtagccgaaggttttgaagccggaggacacaacggcagggaggaaacaactacacttaccttaatcccgatggtaaaggaaaagcttaccattcctttattgcagccggaggattgctactgnaagagaaatgtggcggctatggttttaggagcagatggggtgcagaatggaaagccgttttgcagcttctgtagaaagttcggctcatga

SEQ ID NO: 5036 - protein, 203 aa, Unknown
  Obtained from environmental sample
  DOMAIN (1)...(203): 2-nitropropane dioxygenase
  misc_feature (1)..(203): Xaa is any amino acid
MNKITQLFNIKYPIIQGGMIWNSGYKLASAVSNAGGLGLIGAGSMYPDVLREHIQKCKKATDKPFGVNVPMLYPNVEEIMKILVEEEVKIVFTSAGNPKTWTNYLKEHGITVVHVVSSSKFALKSQEAGVDAVVAEGFEAGGHNGREETTTLTLIPMVKEKLTIPLLQPEDCYXKRNVAAMVLGADGVQNGKPFCSFCRKFGS

SEQ ID NO: 5037 - DNA, 405 bp, Unknown; identical to SEQ ID NO: 4273
  Obtained from environmental sample
  misc_feature (1)..(405): n is a, c, g, or t

SEQ ID NO: 5038 - protein, 134 aa, Unknown; identical to SEQ ID NO: 4274
  Obtained from environmental sample
  SIGNAL (1)...(19)
  misc_feature (1)..(134): Xaa is any amino acid

SEQ ID NO: 5039 - DNA, 507 bp, Unknown
  Obtained from environmental sample
  misc_feature (1)..(507): n is a, c, g, or t
atgataaaatacctgatctttttaatgtgtgtcaccgtcctgggcgtttcgtgccttaagtcgggtgaaagaacctgtgcgtatccgcagaacacaatcatagctccgcaggctgagcaggactccataaaagcatatctcgattcgaatcacattcaggctgagcatcatcccgctggcttttactataagattattaatcctggtaccggtagcgacacgatgttgttatgttcagaaatacttatcgactataaagggcagctcaaaaacggtagtgaatttgataaagggaacgacgtatattttgtgctgggcgcattgattgagggctggaagaaaggacttccattaatcaagaaaggcggagaaataatgctgtacctgccaccgtctctcggatatggttctacggattacgtaaactccgataatgttgttgtgatccccaaaaactccatgcttatattcgacatcaaactcaaagactatacgcagggatattaa

SEQ ID NO: 5040 - protein, 168 aa, Unknown
  Obtained from environmental sample
  DOMAIN (69)...(162): FKBP-type peptidyl-prolyl cis-trans isomerase
  misc_feature (1)..(168): Xaa is any amino acid
MIKYLIFLMCVTVLGVSCLKSGERTCAYPQNTIIAPQAEQDSIKAYLDSNHIQAEHHPAGFYYKIINPGTGSDTMLLCSEILIDYKGQLKNGSEFDKGNDVYFVLGALIEGWKKGLPLIKKGGEIMLYLPPSLGYGSTDYVNSDNVVVIPKNSMLIFDIKLKDYTQGY

SEQ ID NO: 5041 - DNA, 333 bp, Unknown
  Obtained from environmental sample
  misc_feature (1)..(333): n is a, c, g, or t
atgactttcactttccctgatggctctattggagttgtagactatctcgccaacggcgataagtcctttcccaaggaacgcgtggaagtgttctgcggtgggcaaattgccgtgttggatgattttgtatccttacaaactgtgaatgacggcagaaagaacgaaataaaaggcgcacaggacaaaggttgggtgaacgagtggaaagccttcaccaaagccattcgcgagggcggtgaaccgcctattccgtatgagcaattgatcggtgtgaccaagtccacattcgcggcggtggagtcgattaggacttccaaattggttttgatatag

SEQ ID NO: 5042 - protein, 110 aa, Unknown
  Obtained from environmental sample
  misc_feature (1)..(110): Xaa is any amino acid
MTFTFPDGSIGVVDYLANGDKSFPKERVEVFCGGQIAVLDDFVSLQTVNDGRKNEIKGAQDKGWVNEWKAFTKAIREGGEPPIPYEQLIGVTKSTFAAVESIRTSKLVLI

SEQ ID NO: 5043 - DNA, 420 bp, Unknown
  Obtained from environmental sample
  misc_feature (1)..(420): n is a, c, g, or t
atgacaactacccagattttagagaaaattccagaaaagatttcacatgacgaggtcttacaagtaatggtcaaggaaaggatatactctcgctatttgaaattatttaaagtacttactgtattgagtgatgaagcgatatccgacaatttaaatatgaatgttaagacatttagaaaatacagagatacaaaggctcatccgactaatcctcttcttcaagagcaaataatcctattaacatcacttttcaaacacgctcttgatatttttggttcgaaagaagagctaactgaatggtttagtaaacctaatttctttttcggaaaaaaaactccattatcttacctaaaaacaattagtggaattaaattcgttgatgatagattaacatcaatggaatacggagataatgcctaa

SEQ ID NO: 5044 - protein, 139 aa, Unknown
  Obtained from environmental sample
  misc_feature (1)..(139): Xaa is any amino acid
MTTTQILEKIPEKISHDEVLQVMVKERIYSRYLKLFKVLTVLSDEAISDNLNMNVKTFRKYRDTKAHPTNPLLQEQIILLTSLFKHALDIFGSKEELTEWFSKPNFFFGKKTPLSYLKTISGIKFVDDRLTSMEYGDNA

SEQ ID NO: 5045 - DNA, 1071 bp, Unknown
  Obtained from environmental sample
  misc_feature (1)..(1071): n is a, c, g, or t
atgaacaggatacaggagaccagggcaaagcttcttggctgccagaacaagatagagcagataaactatcttaaaacgcagaccaataacactatcataagctacaacaaagagaacgacgagcttactctctctaataaagagctttcaggtaaaatggacctggttatacttgaaaccgaatccgctgaaaacacaaaataccagcgcgaaaaagagcttgaacactttacaactgagcttgaaaacttagctgatgagcttaccgcaaaacgtgaagagtataattcatacaacatagaaattacaaagctaaacgctgagctatccaaccttgataacgaacacttcaggacggtggagagcattaaaaccaggcgcagcaacatagaagcgcgcactatggaatgctcagagtatgaaaccgagataaagaagcttaattcggaaattgagtcatactatgcagacggtactgttgccggtttccggccaaggcttaaagtacttgagactgaaagagccggcatagagtccgatttcagcctgatacgcagcgagtacgaggtgaagcgctcactggttgataaggttgagcatgaacagaaggatctaaggacatcacgcgatgagataatagattacatccacaagaacgagatgcagctcaccaaagaccgccttgagattaaagagcataaagataaggtactggaagaatatgagcttgaaatagagtatactgcttttgaggataatactacttatgaattcataaggaccaaggctgaaattgacaggcttaagaacaagctaaggcagcttggcggctcagggcagatggagcttggtatttacgagcaggaaaagcaggaccttgagaagcttggttcaaaaaaggaagaccttgccagggctgaaaaggaattgaccagcttattggaggacctgaacaaaacagcccaaaataagttcccccgaacctttgagcggatcaggcaaaacttcatggtcatctttccaagaacttgtcctgggaaggggaagaaaccgaacctgggcctggtataa

SEQ ID NO: 5046 - protein, 356 aa, Unknown
  Obtained from environmental sample
  misc_feature (1)..(356): Xaa is any amino acid
MNRIQETRAKLLGCQNKIEQINYLKTQTNNTIISYNKENDELTLSNKELSGKMDLVILETESAENTKYQREKELEHFTTELENLADELTAKREEYNSYNIEITKLNAELSNLDNEHFRTVESIKTRRSNIEARTMECSEYETEIKKLNSEIESYYADGTVAGFRPRLKVLETERAGIESDFSLIRSEYEVKRSLVDKVEHEQKDLRTSRDEIIDYIHKNEMQLTKDRLEIKEHKDKVLEEYELEIEYTAFEDNTTYEFIRTKAEIDRLKNKLRQLGGSGQMELGIYEQEKQDLEKLGSKKEDLARAEKELTSLLEDLNKTAQNKFPRTFERIRQNFMVIFPRTCPGKGKKPNLGLV

SEQ ID NO: 5047 - DNA, 375 bp, Unknown
  Obtained from environmental sample
  misc_feature (1)..(375): n is a, c, g, or t
atgagacacactgtgttttttttcattttctggcatatcaatctactttcttttgcacaatcttccagtcaagatccggctacaatcaaattaatcgatgataccaaccgaaaaattgatcgtgctgtggtttcaaaggatatcaatgtgttggaacagttttacggggaagattttgtattcacacatgccacgggattagtcgattcanaaaaaagttggatcgaatccgtaaagaanaataaaggatatgcagcccgcgagcatgactcaaccactgttgagttgcataaagatttggctattatctctggcaaacttacggtaacacgtttagaacctgcaaaagatggtacaacaaaatacagcccttag

SEQ ID NO: 5048 - protein, 124 aa, Unknown
  Obtained from environmental sample
  misc_feature (1)..(124): Xaa is any amino acid
MRHTVFFFIFWHINLLSFAQSSSQDPATIKLIDDTNRKIDRAVVSKDINVLEQFYGEDFVFTHATGLVDSXKSWIESVKXNKGYAAREHDSTTVELHKDLAIISGKLTVTRLEPAKDGTTKYSP

SEQ ID NO: 5049 - DNA, 369 bp, Unknown
  Obtained from environmental sample
  misc_feature (1)..(369): n is a, c, g, or t
atgatgaatcgacttcgacaaaaacagtcgcaacgacaatcaaaagattgggatagcatctgtacttacttagaatcagaaagcagttggttaagcgtgagaatttgtcattcatgtggatttgcaaaaatatttagccatagtaacgtgattcataaggttactcgctttcagtcattaaaagaagtccagaaaatagtagaatctataaaagaattatatgaaaaatcaactaccaatggaaataaagatgagtattgcaagttgatgcaaagggaaattggtttagaagttgtttatgatgaagtgaaattactaaacagcagaacaagaaaggattataaaataataattcctgcaaaaaaatga

SEQ ID NO: 5050 - protein, 122 aa, Unknown
  Obtained from environmental sample
  misc_feature (1)..(122): Xaa is any amino acid
MMNRLRQKQSQRQSKDWDSICTYLESESSWLSVRICHSCGFAKIFSHSNVIHKVTRFQSLKEVQKIVESIKELYEKSTTNGNKDEYCKLMQREIGLEVVYDEVKLLNSRTRKDYKIIIPAKK

SEQ ID NO: 5051 - DNA, 450 bp, Unknown
  Obtained from environmental sample
  misc_feature (1)..(450): n is a, c, g, or t
atgaattatttctttaagcaatccattgtacccttagttgttgcagctttgtctttttctactgttgcagctcanacttctactaaagaacaattacctaaagactggcacttaaaagacaaacaaaaagatggcatttacggtatcagtcttggcaaagcatatgaatatgtaaaaacaaaaaanagtaaaactgttatagtggctgtaattgattctggtattgatacgacacatgaagattttaaaccggtactttggacaaatgagaaagaaattgcaggcnatggaatagatgatgataagaatgggtatgtcgatgatattcatggatggaattttattggtgggaaagatggcagaaatgttcaggaagattcatatgaagcatcgagggttnatcaccaatttaaggacgttttcaaacatgacagatacgacatcccttag

SEQ ID NO: 5052 - protein, 149 aa, Unknown
  Obtained from environmental sample
  misc_feature (1)..(149): Xaa is any amino acid
MNYFFKQSIVPLVVAALSFSTVAAXTSTKEQLPKDWHLKDKQKDGIYGISLGKAYEYVKTKXSKTVIVAVIDSGIDTTHEDFKPVLWTNEKEIAGXGIDDDKNGYVDDIHGWNFIGGKDGRNVQEDSYEASRVXHQFKDVFKHDRYDIP

SEQ ID NO: 5053 - DNA, 744 bp, Unknown
  Obtained from environmental sample
  misc_feature (1)..(744): n is a, c, g, or t
ttgatgccgtgtgagtcattaattaatataccacagcgtaaattgtacgatgccctagaacagacaattcgtaattgtgccgtttgttctggaaaacaagagatgcgtatcgaccaaggtctttgcgcccaatgccgagttttgaacaaggtacttcaccgttacgctgaaagtaatattcctgtcaagtattggccgttagaaatggaccatcatttctatggagatgaaacgctcaagaccaagtatcttgaaattacctctgacttagctcaatcatatcgagttggagtaagcatgtgtttcgcgggctcacacggacttggcaaaacgatggcatcttgcaacatcctaaagcgcgccgttgagaaaggttattcggctctttacgtaaacctaaatgacatcatcaacgtcattcttggtaaggagacggacgacaaggccgtagctcgaaaagagttgatggtcgtagacttcttggttatcgatgagttcgatcctcgattcatgcccagcgataaggcggcagatctattcggaaaggtgcttgaggaaatcttccgagcacgacaccagaatggtttaccaatttttatgtgcaccaactcgcctaacgtcgttgaaagtttcaccggcaacatcaaagctagcattaccagcctaatgaatactgtaactattgttccattgcttggtcaagattttcgtaagaaattagcacagaagggtacgactaaatga

SEQ ID NO: 5054 - protein, 247 aa, Unknown
  Obtained from environmental sample
  misc_feature (1)..(247): Xaa is any amino acid
MMPCESLINIPQRKLYDALEQTIRNCAVCSGKQEMRIDQGLCAQCRVLNKVLHRYAESNIPVKYWPLEMDHHFYGDETLKTKYLEITSDLAQSYRVGVSMCFAGSHGLGKTMASCNILKRAVEKGYSALYVNLNDIINVILGKETDDKAVARKELMVVDFLVIDEFDPRFMPSDKAADLFGKVLEEIFRARHQNGLPIFMCTNSPNVVESFTGNIKASITSLMNTVTIVPLLGQDFRKKLAQKGTTK

SEQ ID NO: 5055 - DNA, 537 bp, Unknown
  Obtained from environmental sample
  misc_feature (1)..(537): n is a, c, g, or t
atgcgaaagataattgcaggttntgcaacaagcattgatggctttatccaggggccgaatggcgagatcgactggatcatttatgataatgagcaattcaaagagctggaggagtcatggaagaatatcgatgccatgttccatggacgtaaaacttatgagacatcattgaaaatgaaaggagaagtaactgaggaaatgatcaatccctttgcacatatgaagcattatgttttttcgaatacattaaaagaggttgaggcaggatatattctcgtaaatggcgatctgaaaattgaggcggataaaataagaaatcaaccgggaaaagatattgcagtttttggcggcgctgaattattgagttcattattgaactatgagatggtggatgagctttctttagcaatatgtccttccataatcgggaaaggaaaaagttttttccagcaaattgaaaaacgaagtgattggaatgttaaagaagtaaagacatataaatccgggcttatttcgatcacctaccagcggaaataa

SEQ ID NO: 5056 - protein, 178 aa, Unknown
  Obtained from environmental sample
  DOMAIN (2)...(172): RibD C-terminal domain
  misc_feature (1)..(178): Xaa is any amino acid
MRKIIAGXATSIDGFIQGPNGEIDWIIYDNEQFKELEESWKNIDAMFHGRKTYETSLKMKGEVTEEMINPFAHMKHYVFSNTLKEVEAGYILVNGDLKIEADKIRNQPGKDIAVFGGAELLSSLLNYEMVDELSLAICPSIIGKGKSFFQQIEKRSDWNVKEVKTYKSGLISITYQRK

SEQ ID NO: 5057 - DNA, 534 bp, Unknown
  Obtained from environmental sample
  misc_feature (1)..(534): n is a, c, g, or t
atgagaaattacatactgacaattttgacttttttcttttcaataacactttttgcagagaacaaacttgccattatcaatgaccctgatggttttacatatgttcgtaacggtcaaggcatgaactttaaagtggttgatacactttttaaagacgacttcttttacttccagtttgtagacaattctgaatgggcgaaagtaactgcgtggaagggcaggcaagtagaggggtttattcataaaagcagaattcaggaaattcagaaacttgacagtaaaaaacaaaaggtgcttatcacaaatacccttgaaagacatagaattttggcggataattttcagaatgcatgcaattcaaaggatagcctggcttacaggaaaactatccgggaattggaatttcacagcgacacaaagtatgaccctgtattatacattttgcctaaattcttctgttcgacaaatgacactaaagttctgcaacttttcttttcgacaatgtgggcagacaaaggttctgcgaacgagtga

SEQ ID NO: 5058 - protein, 177 aa, Unknown
  Obtained from environmental sample
  SIGNAL (1)...(19)
  misc_feature (1)..(177): Xaa is any amino acid
MRNYILTILTFFFSITLFAENKLAIINDPDGFTYVRNGQGMNFKVVDTLFKDDFFYFQFVDNSEWAKVTAWKGRQVEGFIHKSRIQEIQKLDSKKQKVLITNTLERHRILADNFQNACNSKDSLAYRKTIRELEFHSDTKYDPVLYILPKFFCSTNDTKVLQLFFSTMWADKGSANE

SEQ ID NO: 5059 - DNA, 909 bp, Unknown
  Obtained from environmental sample
  misc_feature (1)..(909): n is a, c, g, or t
ttgaaaaaagatattgattatgcagcctgccagcccaagatcctcacatttaaaaacaaaaacttttttgaatatgccggtggagcaggagggtggcttgatgcttatggttatccttttgcaaggggccgtgtttttgatatttgtgaagaagacaagggccaatacaatgataccgcagaagtattttgggctagcggcgccgccttgatcatacgaagtgaagtatttaataaaatgaaaggttttgatgaatatttttttgcccaccaggaagaaattgacctttgctggcgaatgcaatcttcaggatacaaaattttttgttgtcctcagtcggtagtttatcatgtaggaggtggcactttgccaaggggaaattcaaaaaaaacttttttaaacttccgaaataatcagatcatgctggcaaaaaatttaccggcaggtgaaaaatggtggaagataccttaccggatgatgttagatacaatttctgcagttaaaggtctgatttccggggatgctggttatttcgtggctatttttactgcacaccttgcctttttatattggctattttttaaaagacgtacgactaaagctggtaaaaagaaattggtgcatttaaaaggtttatacaaaggcaatatagcctggcagcattttataaaaaagaaaaacttttttccgagattgttgtatcagaatagtttttttcatgatttttttctttcatccataatttttgcaccacaaacacaattatggatcatcagcaagagtaccagcaggagtttgaaaaaattccagaacggggatttactcataactgggtgtcctcatcacgctttctttttttactggctgttttttgaatggggcctttacccttggggggtgtatacataa

SEQ ID NO: 5060 - protein, 302 aa, Unknown
  Obtained from environmental sample
  misc_feature (1)..(302): Xaa is any amino acid
MKKDIDYAACQPKILTFKNKNFFEYAGGAGGWLDAYGYPFARGRVFDICEEDKGQYNDTAEVFWASGAALIIRSEVFNKMKGFDEYFFAHQEEIDLCWRMQSSGYKIFCCPQSVVYHVGGGTLPRGNSKKTFLNFRNNQIMLAKNLPAGEKWWKIPYRMMLDTISAVKGLISGDAGYFVAIFTAHLAFLYWLFFKRRTTKAGKKKLVHLKGLYKGNIAWQHFIKKKNFFPRLLYQNSFFHDFFLSSIIFAPQTQLWIISKSTSRSLKKFQNGDLLITGCPHHAFFFYWLFFEWGLYPWGVYT

SEQ ID NO: 5061 - DNA, 318 bp, Unknown
  Obtained from environmental sample
  misc_feature (1)..(318): n is a, c, g, or t
atgtctccgatgaactttaaaaaatctattactgggggtaagggtttgattattacggcggaagaagattttggaatgaccgcgattgaggcaaatgcctgcggaaaaggggtgatttgttatgggaaaggcggatcgcttgaaactgttaagaacaatgaaacaggagtatattttgaaaaacaaaccgaggagagtttgaatgatgcaatagagaaatttgaaagtataaagtttgatccggaaaaatctgtaaataatgcgaaaaggttttcaaaagaaaagtttaaggagagattattggagttggtgaaatag

SEQ ID NO: 5062 - protein, 105 aa, Unknown
  Obtained from environmental sample
  misc_feature (1)..(105): Xaa is any amino acid
MSPMNFKKSITGGKGLIITAEEDFGMTAIEANACGKGVICYGKGGSLETVKNNETGVYFEKQTEESLNDAIEKFESIKFDPEKSVNNAKRFSKEKFKERLLELVK

SEQ ID NO: 5063 - DNA, 555 bp, Unknown; identical to SEQ ID NO: 2209
  Obtained from environmental sample
  misc_feature (1)..(555): n is a, c, g, or t

SEQ ID NO: 5064 - protein, 184 aa, Unknown; identical to SEQ ID NO: 2210
  Obtained from environmental sample
  DOMAIN (2)...(160): Polypeptide deformylase
  misc_feature (1)..(184): Xaa is any amino acid

SEQ ID NO: 5065 - DNA, 615 bp, Unknown
  Obtained from environmental sample
  misc_feature (1)..(615): n is a, c, g, or t
ttggaaatgtatgatcaaatgcaattcaaaaaattttttggtccctctttagctcttatttttattatcttttctacaatcccaataacagcttattcttatgatggattttcagtcacaaaaaatgatacaactcatgatgcctccaactcctccaaagttttagtcaatataacttttgattccctttttattaacaatgataagaatctattcggaaaaggtttatggaatttttcagttgatataaatgataaatcaatagatctacttgttaacgaaaaggtagacgagggacaaacagtcaggtttaacggaaaaaatatctcattagtaatgccaatatcagataccctttatttgttttctcagccttattatgttcaaaaaacaggaaaaataggtattcttgattggatatctgaaaagtataatcaaactaataattttggaaatggaagtcatattgcaattaccgatgatggtaaagaggatactgttaatattaatttggtgatttacaaatacactgcaattataaacaaagatcctgattatgttttaaaatatcacataaaagcaacccctataagcaaaaacaacatgacatactaa

SEQ ID NO: 5066 - protein, 204 aa, Unknown
  Obtained from environmental sample
  misc_feature (1)..(204): Xaa is any amino acid
MEMYDQMQFKKFFGPSLALIFIIFSTIPITAYSYDGFSVTKNDTTHDASNSSKVLVNITFDSLFINNDKNLFGKGLWNFSVDINDKSIDLLVNEKVDEGQTVRFNGKNISLVMPISDTLYLFSQPYYVQKTGKIGILDWISEKYNQTNNFGNGSHIAITDDGKEDTVNINLVIYKYTAIINKDPDYVLKYHIKATPISKNNMTY

SEQ ID NO: 5067 - DNA, 549 bp, Unknown
  Obtained from environmental sample
  misc_feature (1)..(549): n is a, c, g, or t
ttggatgcagccatctgggaaaaggctgtaaaagagtttaaaaataaattgactgatgatgttattgaaagagctgtaaaaaaattgcctggagaagtgtatgatataaatggagcgatgcttgaatcacgacttaaaagccggcgtaatactttattggaaggtgttatgaaatattaccggtttattgctggcaccgttgatatttccggaacagaagaggaggagctttttgaaataaaaaataatggcgagctattaagtataagtgtataccgtttaaaagaaaataacgaaaaagataagaaaatatatgagcggtcttttgatccggaggatacacggcgcattaatttgacaggccttggaggaaatgatcaatttcttgttgaaaaaaatatttcatcagaaattaaattaaagatcagtggtggggaggggaaagatgtttacgaactaaatggaaaaataaaaaccgttgtttatgattctttatcggataaaaatgaaattatcaataagtcaaaagcaaaaattattcttaattga

SEQ ID NO: 5068 - protein, 182 aa, Unknown
  Obtained from environmental sample
  misc_feature (1)..(182): Xaa is any amino acid
MDAAIWEKAVKEFKNKLTDDVIERAVKKLPGEVYDINGAMLESRLKSRRNTLLEGVMKYYRFIAGTVDISGTEEEELFEIKNNGELLSISVYRLKENNEKDKKIYERSFDPEDTRRINLTGLGGNDQFLVEKNISSEIKLKISGGEGKDVYELNGKIKTVVYDSLSDKNEIINKSKAKIILN

SEQ ID NO: 5069 - DNA, 450 bp, Unknown
  Obtained from environmental sample
  misc_feature (1)..(450): n is a, c, g, or t
ttgccaatgagtctatcaaaaaagctggctgaatacaaactggtccgtaaattggtttatgcagtggtaggaattttttcctaccctggtattgctatcattaacaaattaaagatcaacggcaccgaacacattgaaaatcttccgaagaagaatgtgctctttgtcagcaatcatcaaacttactttgcagatgtgattacctttcttcatattttttgtgcggtaaaatggagaaagaaaaaccgcttgggcattccttattatttattgaacccgtttacgagtgtttactacgttgctgctgaagagacgatgaanagcagttggatcagtcgcctgtttacattagccggtgcactcacagtaaaaagaacatggaagaaagatggggctgaagttcgccgcggcttagacccaagcggatacagaaaaatgaaagagcattga

SEQ ID NO: 5070 - protein, 149 aa, Unknown
  Obtained from environmental sample
  misc_feature (1)..(149): Xaa is any amino acid
MPMSLSKKLAEYKLVRKLVYAVVGIFSYPGIAIINKLKINGTEHIENLPKKNVLFVSNHQTYFADVITFLHIFCAVKWRKKNRLGIPYYLLNPFTSVYYVAAEETMXSSWISRLFTLAGALTVKRTWKKDGAEVRRGLDPSGYRKMKEH

SEQ ID NO: 5071 - DNA, 975 bp, Unknown
  Obtained from environmental sample
  misc_feature (1)..(975): n is a, c, g, or t
atgatcttggtctttgtacccccatatgttcgtcatcaccatataagtgggcaaaaggaacggttacaggcagaggctcttagggctgctaatatgagattatcaggtttggcaggcttatactgttatttcatcgcattgtctcaccgctggatgaagttaaacggcattgcgggatggcttattcccagtgagtttatggatgtaaattatggccaagctatcaaagattatttacttacagaagtaacgcttctacagattcaccgttttgatccgcttgatgttcagtttgatgatgctttagtttcttcagctattgtttggtttcagaacaagaaaccaaatgcgaaccataaagtaaagtttacttatggcgggactatcgaccagccagtgaacgaaaaagacgtaaactcaaaagtattaaagaatgaaaaaaaatggactcggtttccgttgaataatgagcgtggaatttcgacaactcccagtttaggtgactttttctcagtgaaacgaggaatagcaacgggtgacaataaattttttgttttaactgaaagtgagattgaaaaaaaagagcttccattatctcaatttaggccgatattacccagtcctcgatttctcgaagaaacagaagtaaaggctgataaattagattatccggctattcagaacaggctgtttgttcttgactgtaaattaccgattgatgaagtcgagcgtctttatcctacattgtataaatacatccaggaaggaatcaaaagtggagtttctgaacgcttcttatgtaaaaatcgtaaaatttggtatgcacaagaaaaccgtcttgaaagtaatttctactgtacatacattggccgatcagataaagaggcaaaaaacattccgatttatctaaatcattcaaaagcatcgttactattcatattgattcttatcccaagcaaaatggcatcgatatag

SEQ ID NO: 5072 - protein, 324 aa, Unknown
  Obtained from environmental sample
  misc_feature (1)..(324): Xaa is any amino acid
MILVFVPPYVRHHHISGQKERLQAEALRAANMRLSGLAGLYCYFIALSHRWMKLNGIAGWLIPSEFMDVNYGQAIKDYLLTEVTLLQIHRFDPLDVQFDDALVSSAIVWFQNKKPNANHKVKFTYGGTIDQPVNEKDVNSKVLKNEKKWTRFPLNNERGISTTPSLGDFFSVKRGIATGDNKFFVLTESEIEKKELPLSQFRPILPSPRFLEETEVKADKLDYPAIQNRLFVLDCKLPIDEVERLYPTLYKYIQEGIKSGVSERFLCKNRKIWYAQENRLESNFYCTYIGRSDKEAKNIPIYLNHSKASLLFILILIPSKMASI

SEQ ID NO: 5073 - DNA, 471 bp, Unknown
  Obtained from environmental sample
  misc_feature (1)..(471): n is a, c, g, or t
ttgtataaatacatccaggaagggatcaaagtgggagtttctgaacgcttcttatgtaaaaatcgtaaaatntggtatgcacaagaaaaccgtcttgaaagtaatttctactgtacatacattggccgatcagataaagaaggcaaaaaaccattccgatttattctaaatcattcaaaagccatcgttactaattcatatttgattctttatcncaagccaaaattggcatcgatcatagcgcacaatccagaaatggctaaaacagttctcgaagctttaaataatactgctgagaaggctatgcttgacgaaggtagagtttatggtgggggcatgcacaagttagaacctaaagagcttgccaatgtcccagcaccagaaatattaaggtttaccaatagcatagattattctaaaaaaatgcttgatcggactcagaataagaatacttccgtttatgctaactag

SEQ ID NO: 5074 - protein, 156 aa, Unknown
  Obtained from environmental sample
  misc_feature (1)..(156): Xaa is any amino acid
MYKYIQEGIKVGVSERFLCKNRKXWYAQENRLESNFYCTYIGRSDKEGKKPFRFILNHSKAIVTNSYLILYXKPKLASIIAHNPEMAKTVLEALNNTAEKAMLDEGRVYGGGMHKLEPKELANVPAPEILRFTNSIDYSKKMLDRTQNKNTSVYAN

SEQ ID NO: 5075 - DNA, 1113 bp, Unknown
  Obtained from environmental sample
  misc_feature (1)..(1113): n is a, c, g, or t
atgctgcaacacngttttgaaaaaaacattgacatctccaatacggttaatgttatgaaacgtgccgccctgatgatcaaagaacttggcggcggtcaaattgcatctgatattgttgatgtgtatcctgatccgccacaaaaaactgaggtcggccttaaatatcattatttaaaaaagttaagcggcaagaattatcatccggataaggtaaaaaatattttgggcagtcttggttttgaaattgtaaaagatggtattgatgagataagagtatctgttcctttcagcaaaccggatatttccttgcctgcagatatcgtagaagaaattttaaggatcgatggtctggataatattgaaattccaactgcgatcaccatcactccttcggttgaagaaaattatcttggacatactttaaaggaaaaagtagcgaattattttgtggggcttggttttcatgaaatgatgaccaattcaattaccaacgctgcttattttaccgaagaagaaagaatcccaatggtgaaaatgatgaacagccttagtgctgagctgaatattcttcgtccatcattactcgaaacaagtttggaagttgttgcccgcaacctgaatcataaaaacagcaacctgagactttttgaatttggtaaaggctatttcaccagtggacctggtaagtatcatgatatggaacaagtatgcatggtgattgcgggaaatacaatgatcaaagctggaaaggaaaatcacttcatcagatttcttttatacaaaaggtgtagtttcgtcagtttgcaactactcggtattaaacctgattcattgaaacccttccagtaccaaattgccggaccatatataaataaagcaaatggtgaattggttgccggtgcaggaaaattaaatcaaaaagttttatctccatttgccataaaacaacccgggttttttgccatccttaattggaaaactggccttaaacttacaaataaaaaaaactctcaattaaaaattgcccaaaatcccacccgggaagccggaatatttccgggggttccccaaaaccttgcaaaacccaaactggaaaaaccgggaaaaatttaa

SEQ ID NO: 5076 - protein, 370 aa, Unknown
  Obtained from environmental sample
  DOMAIN (48)...(117): tRNA synthetase B5 domain
  misc_feature (1)..(370): Xaa is any amino acid
MLQHXFEKNIDISNTVNVMKRAALMIKELGGGQIASDIVDVYPDPPQKTEVGLKYHYLKKLSGKNYHPDKVKNILGSLGFEIVKDGIDEIRVSVPFSKPDISLPADIVEEILRIDGLDNIEIPTAITITPSVEENYLGHTLKEKVANYFVGLGFHEMMTNSITNAAYFTEEERIPMVKMMNSLSAELNILRPSLLETSLEVVARNLNHKNSNLRLFEFGKGYFTSGPGKYHDMEQVCMVIAGNTMIKAGKENHFIRFLLYKRCSFVSLQLLGIKPDSLKPFQYQIAGPYINKANGELVAGAGKLNQKVLSPFAIKQPGFFAILNWKTGLKLTNKKNSQLKIAQNPTREAGIFPGVPQNLAKPKLEKPGKI

SEQ ID NO: 5077 - DNA, 324 bp, Unknown
  Obtained from environmental sample
  misc_feature (1)..(324): n is a, c, g, or t
ttgcagccttttgccgagaatgccattgttcacggatttaaaggaattgactatacaggaaaaatccgcgttcgtgtttacgatgataaaaaccaattaaaaattgaaatctccgataacggaatcggagtcgctcaaaacaatgagagcaacgaacttgaattaccggccgaacgaaacagcgccattaaaataacaactcaacgacttgatttatataaccataaaaaaggtaattggttaacaattcaaaaaaacgctgataaaaccatgcctgatggcaggcaaacaggattagttgttactttagcactattaaattaa

SEQ ID NO: 5078 - protein, 107 aa, Unknown
  Obtained from environmental sample
  misc_feature (1)..(107): Xaa is any amino acid
MQPFAENAIVHGFKGIDYTGKIRVRVYDDKNQLKIEISDNGIGVAQNNESNELELPAERNSAIKITTQRLDLYNHKKGNWLTIQKNADKTMPDGRQTGLVVTLALLN

SEQ ID NO: 5079 - DNA, 576 bp, Unknown
  Obtained from environmental sample
  misc_feature (1)..(576): n is a, c, g, or t
gtgcaacaaaccgttaaaatatcgaataaaaaggcttttttcaattatgccataaaggacacttatcttgccggcattgtattatcaggaaccgaagtaaagtcgttaagggccggtaaaggaagtatagccgaggcttattgcgttttacaaaatggcgaagtctatttacgcaatgcaaatatcaacgaatttgctgcgggaagttataataatcacattcctgtaagagaccgaaaattgttgttaaacaaaaaagagatcgaaaaactggaaaaggctaccaaaacaaaaggatttacgttagtgcctattgagttatttctaaatgaaaaaggactgtttaaaataaaaatagggaccgcggtgggaaaaaaacaatatgataagcgacaggatctgaaattaaaagacgataagcgcgaaatggaccggatgaagaaaaatagatacaccttcatcgatgggattacaaggttggcggtaattttcaaccacttttatcctcttcacacaatatctgttaataattcaacccngggtaaacgaaacacactcattgaaaaatcaccataa

SEQ ID NO: 5080 - protein, 191 aa, Unknown
  Obtained from environmental sample
  DOMAIN (3)...(71): SmpB protein
  misc_feature (1)..(191): Xaa is any amino acid
MQQTVKISNKKAFFNYAIKDTYLAGIVLSGTEVKSLRAGKGSIAEAYCVLQNGEVYLRNANINEFAAGSYNNHIPVRDRKLLLNKKEIEKLEKATKTKGFTLVPIELFLNEKGLFKIKIGTAVGKKQYDKRQDLKLKDDKREMDRMKKNRYTFIDGITRLAVIFNHFYPLHTISVNNSTXGKRNTLIEKSP

SEQ ID NO: 5081 - DNA, 483 bp, Unknown
  Obtained from environmental sample
  misc_feature (1)..(483): n is a, c, g, or t
gtgggttatctgaattttaatcaagatttatcaagtcacagggcgtcacccagagctcgcgaggcgaacacggacgacgaactatcatnaagggatgtttttggtgcgatacattttaaaaatcnaggagtctttatcgctgcaggtacagggatcacgcttttcatcgccatctttcgcgacctgcataagagaaaaaaactgcgtggaaataaacttatctattcgaataagacgatggctgacgtgatcatgaaaaaggaacttgtaaagatgttcgacaccgattttattaatgtcatcacccgcgagcacatcatcggctttgtgggaaagcgtatcgatcgggctttcctgatagaaaagatacaggacttcagccagtatttctatgtatgcggacctgatgatttcgttaccagcgtcaccgggcatctcaaagacctcggcgcagaatctgactggatcataattgaacagtaa

SEQ ID NO: 5082 - protein, 160 aa, Unknown
  Obtained from environmental sample
  DOMAIN (40)...(141): Oxidoreductase NAD-binding domain
  misc_feature (1)..(160): Xaa is any amino acid
MGYLNFNQDLSSHRASPRAREANTDDELSXRDVFGAIHFKNXGVFIAAGTGITLFIAIFRDLHKRKKLRGNKLIYSNKTMADVIMKKELVKMFDTDFINVITREHIIGFVGKRIDRAFLIEKIQDFSQYFYVCGPDDFVTSVTGHLKDLGAESDWIIIEQ

SEQ ID NO: 5083 - DNA, 1008 bp, Unknown
  Obtained from environmental sample
  misc_feature (1)..(1008): n is a, c, g, or t
ttgacgccncttctcaaaaaaaataatacaatcacaaaacatacaatcatgaaacgattattcaattatgtcttttcggttttcgtactgattttccttgcgcagtgcagtgggaaaaaagaaaatgagaatagcacaatgtccgacaaacctttgcttcaaaagtggaccgggccctacaacggcgtgcctccttttgataaaattaaaacttctgatttcagatctgcactgcagacagccatgacagaaaacagggaggagatcaacaggatcatagaaaataaagaagcaccgacatttaaaaatacgattgaagaactggagaagacgggtttcacattgagaagggtgatttcagcatatggaatctggaaaagtaatctcggctcgcctgagatggattctatccaggaagaaatggaaccgcgccttactgcattcagcgattcgataattcagaatactgaactttttaaaaagatcgaaacggtttacaacgatccggctaaaagtcagctgaaccccgagcagcaacggcttctcgagcgttattataaaaactttgtactggctggagcaaagctggatgctgatgcaaaagcaaaagttgccgacatcaataaaaaacttgccggattgtttacaaagttcaaccagcatcagttatcagatgaaggcgataaatatctggagctgacaagtgaaaaagatcttgacggattaccggaagatctganagcagctgccgcatcatcaggagaagcaaaaaataaaaaaggttcatgggtgatttccaacacacgatcttccgtgcagccattcctgacgtacagcaacaggagagacctgcgtgaaaaagcctggagaaatgttgtgaaccgcggcgnnacacgagatgcaaacgataaacaatgcatcatcacaaaaatcttcaactgcgtgcgcaacgtgcgctgctgctccggtatctacgcatgccattggcgtctgctgataaatggctaa

SEQ ID NO: 5084 - protein, 335 aa, Unknown
  Obtained from environmental sample
  misc_feature (1)..(335): Xaa is any amino acid
MTPLLKKNNTITKHTIMKRLFNYVFSVFVLIFLAQCSGKKENENSTMSDKPLLQKWTGPYNGVPPFDKIKTSDFRSALQTAMTENREEINRIIENKEAPTFKNTIEELEKTGFTLRRVISAYGIWKSNLGSPEMDSIQEEMEPRLTAFSDSIIQNTELFKKIETVYNDPAKSQLNPEQQRLLERYYKNFVLAGAKLDADAKAKVADINKKLAGLFTKFNQHQLSDEGDKYLELTSEKDLDGLPEDLXAAAASSGEAKNKKGSWVISNTRSSVQPFLTYSNRRDLREKAWRNVVNRGXTRDANDKQCIITKIFNCVRNVRCCSGIYACHWRLLING

SEQ ID NO: 5085 - DNA, 480 bp, Unknown
  Obtained from environmental sample
  misc_feature (1)..(480): n is a, c, g, or t
gtgggagccaaagactccagcggccatcccttggctctgacaggcatacttttagaagacaataattttttagattctgtcagaactaccacttcaggaatgggagcttttacaattaaaccaaaaacaggaaagagctatgccgtaagactatttcaaaaaggacgtaaagacactatctatttccttccttcagctatttcagaaggccctgtaatcagttttctaaaagccatggtagaagataccttaaagctcacaataaacaacaaaaaacaaaacacctactttttattgctgcataattttaatcgaattaataaagtattcaccctgcagacaatctttttcaactttcctgtcagtaccattgacggaatttccccggggcttgaatactcttactattttagattctttttatcatcctgtagcagagcgcttattctttgctcataccaaaaaaaagccggtcattaa

SEQ ID NO: 5086 - protein, 159 aa, Unknown
  Obtained from environmental sample
  misc_feature (1)..(159): Xaa is any amino acid
MGAKDSSGHPLALTGILLEDNNFLDSVRTTTSGMGAFTIKPKTGKSYAVRLFQKGRKDTIYFLPSAISEGPVISFLKAMVEDTLKLTINNKKQNTYFLLLHNFNRINKVFTLQTIFFNFPVSTIDGISPGLEYSYYFRFFLSSCSRALILCSYQKKAGH

SEQ ID NO: 5087 - DNA, 339 bp, Unknown
  Obtained from environmental sample
  misc_feature (1)..(339): n is a, c, g, or t
atgaactttttactttcaaaaatagctaataaaatagacacatattcaaattttatggagttcaaaagattagaaggtatggaaaatcttaatatagaaataataagcaagcttaatcaaaaaatcgggaaaatttattcaaaattgtactcattgctaaagcttattctgatctcaaagaataatgagaaaactgaccacctagaaatagataacaaaataagcgagcttagcaagattattgaaaaatatcttaacaaagtagacgatgtaaatgaatcacaagaattagatgtaataaatatgtcccaaaccttctcaacagaaaacaggagatag

SEQ ID NO: 5088 - protein, 112 aa, Unknown
  Obtained from environmental sample
  misc_feature (1)..(112): Xaa is any amino acid
MNFLLSKIANKIDTYSNFMEFKRLEGMENLNIEIISKLNQKIGKIYSKLYSLLKLILISKNNEKTDHLEIDNKISELSKIIEKYLNKVDDVNESQELDVINMSQTFSTENRR

SEQ ID NO: 5089 - DNA, 369 bp, Unknown
  Obtained from environmental sample
  misc_feature (1)..(369): n is a, c, g, or t
atggaagaattattgcaatcggcaacgcatcttccatcacaatcagaaagaatagttgtgaagactgcagggaaaattaagatcatccctattcctgagattctatacttagaagctgcggacgattatgtaaagattcacaccaaggatggtgcttttctcaaaaacaaaacgatgggcttttttgaaaactcattgccacaagaacaatttgttcgtacgcatcgctcctatattttgaatgtgcaggagatcacaagaattgatccctacgaaaaagaaaatcatttagccatacttcgttcgggtgcaagaattccggtgagcaaaaatgggtatgggaagttgaaagaagtgttgggtttataa

SEQ ID NO: 5090 - protein, 122 aa, Unknown
  Obtained from environmental sample
  DOMAIN (24)...(121): LytTr DNA-binding domain
  misc_feature (1)..(122): Xaa is any amino acid
MEELLQSATHLPSQSERIVVKTAGKIKIIPIPEILYLEAADDYVKIHTKDGAFLKNKTMGFFENSLPQEQFVRTHRSYILNVQEITRIDPYEKENHLAILRSGARIPVSKNGYGKLKEVLGL

SEQ ID NO: 5091 - DNA, 1035 bp, Unknown
  Obtained from environmental sample
  misc_feature (1)..(1035): n is a, c, g, or t
atgatggtatttggcgatgttgatggtacatttaaagaattacactcgtttaataacactgccataatccttgatatgaccctagaaaaccagcatacattagagcaatattatagaaaaataaaaaaggtaaatgagaatactgctgtgatatttttagctggagacaaactctatccaccactttgttatttatcttatatccaattcaaaagtacatggattgttaaaaagccgattaataaagaagatcttgctattaaggtaaaaactgcaatagaattctcattgaatagtaaaagccgtgaaaacgttgcgcttagttctgcctcaaaacagacgaatattgtcaatcatgaagatatggttctatccgaattatctgccctctttgacaattcaggtaagatgatggataacactaatgataatgcagatactaatgatttccctaaaaaagaaaagagtataaacagtcaatctaaattagtagtaggtacatttcataaacagtatttaaaattccgcgaggtaatttcactagtaattgatataaataaatttgaaaatatgaatacttatactcctaccggatttttattatatggtcatcaatacatcgacaagagagaactaatcaaatccatttcacttgaactgaatgccanatttttttatatcgatggagcggaactcttgacccanaagcgatatggngaaccggaagaattagtaaggaaagcatttagcgaagcaaaaattaacgcacctgttgtaatatatttggaccggcttgatcagctcttagacaatagtgactatgataattatcatattagtagaaacatctttcaaatacatactctattagataatattgtatctcatgataggataatagtaattgaatctgcaaagttcaggcgccctgatcccatcttcttttcgggagaatggccaattccgaccttgaattcctttttggaattcccgacaaaaatggaagacctgaatctgttgttttcatttccctaa

SEQ ID NO: 5092 - protein, 344 aa, Unknown
  Obtained from environmental sample
  misc_feature (1)..(344): Xaa is any amino acid
MMVFGDVDGTFKELHSFNNTAIILDMTLENQHTLEQYYRKIKKVNENTAVIFLAGDKLYPPLCYLSYIQFKSTWIVKKPINKEDLAIKVKTAIEFSLNSKSRENVALSSASKQTNIVNHEDMVLSELSALFDNSGKMMDNTNDNADTNDFPKKEKSINSQSKLVVGTFHKQYLKFREVISLVIDINKFENMNTYTPTGFLLYGHQYIDKRELIKSISLELNAXFFYIDGAELLTXKRYGEPEELVRKAFSEAKINAPVVIYLDRLDQLLDNSDYDNYHISRNIFQIHTLLDNIVSHDRIIVIESAKFRRPDPIFFSGEWPIPTLNSFLEFPTKMEDLNLLFSFP

SEQ ID NO: 5093 - DNA, 966 bp, Unknown
  Obtained from environmental sample
  misc_feature (1)..(966): n is a, c, g, or t
atgcgcatttacaaaaactcaaatgtgagtgaggctgaacaaaaagaaaagatggagaacagtctgctggaacttgaatctttttttgatgctgcacgatcttattcaaaaaaaaccgaagtgcctgtgcaggttaaccagcattttgaagctatgaaaggattgtttaatggaagcaggaaattatatattagaaccaacgatataaaagaaattgtttctgccatacgctttagtaataagtttaatgttaaaatggtgctcgttgatggcgctgacagctggcgtgttgcatccatgttgaaggaaaataatgttcctgtagtcatcgtgcgtacgcattctcttccatttcataatgatgatgatatcgatatccaattcaggttgccggcattattatataaagcaggtgttaaattctgtataaccgatgacggatactggctgcagaggaatattccttaccaggcagggagtgcagttgcatacgggctgccctatgaagaggctgtaaaagcaatcacactttcgcccgctgaaatacttggaataaatggccataccggatcacttgaagataataaagatgcgacattcataattgcatcaggtgatatgcttgacatgaaaacaagtaaagtggaggaagcctatatcaatggaagaaagatcagccttgataatattcaaagtcagctggttcacaagtacatgaaaaaatacaaattggagttaaataaaaaaggctgcctaaaaaagggcagcccttttttattaaaaaaaaatattaaaaaattaaccaagataagcccttcagcagtttggttttctgaaattccgccctccggggccttaaatggcttttttccttttaaacgggggaaaaccccttttccctttggacaaaaccaaattttccccctccgaatttctttcccccggggaaaaatccccggtttgtga

SEQ ID NO: 5094 - protein, 321 aa, Unknown
  Obtained from environmental sample
  misc_feature (1)..(321): Xaa is any amino acid
MRIYKNSNVSEAEQKEKMENSLLELESFFDAARSYSKKTEVPVQVNQHFEAMKGLFNGSRKLYIRTNDIKEIVSAIRFSNKFNVKMVLVDGADSWRVASMLKENNVPVVIVRTHSLPFHNDDDIDIQFRLPALLYKAGVKFCITDDGYWLQRNIPYQAGSAVAYGLPYEEAVKAITLSPAEILGINGHTGSLEDNKDATFIIASGDMLDMKTSKVEEAYINGRKISLDNIQSQLVHKYMKKYKLELNKKGCLKKGSPFLLKKNIKKLTKISPSAVWFSEIPPSGALNGFFPFKRGKTPFPFGQNQIFPLRISFPRGKIPGL

SEQ ID NO: 5095 - DNA, 339 bp, Unknown; identical to SEQ ID NO: 4547
  Obtained from environmental sample
  misc_feature (1)..(339): n is a, c, g, or t

SEQ ID NO: 5096 - protein, 112 aa, Unknown; identical to SEQ ID NO: 4548
  Obtained from environmental sample
  DOMAIN (32)...(110): Bacterial regulatory protein, arsR family
  misc_feature (1)..(112): Xaa is any amino acid

SEQ ID NO: 5097 - DNA, 396 bp, Unknown
  Obtained from environmental sample
  misc_feature (1)..(396): n is a, c, g, or t
atgaagtttcgagaagatgaaagaaccataaacagagtttcgaaatatctcgaaaaccaaaacaggcaaaaagttgtccaattcgaatctgttttacattatatcaatgagaagaaagtatgcaaaagcaagttgattctgggctattttggagaaaaatccgaaacagattgcggaatttgctcgtattgcatttccaaaaaaaacaaatccaatgacgcttccttgatttcaaaaaaaattatggaattattaaaatctcaaaacttgaattcgagagaaattcaaaaactaataaaaaacagtgcagacgatgttatctttgccttgcaaaacttattggaaaacaatgaaattgccatacaacccaacaataaatacactttaaaattataa

SEQ ID NO: 5098 - protein, 131 aa, Unknown
  Obtained from environmental sample
  misc_feature (1)..(131): Xaa is any amino acid
MKFREDERTINRVSKYLENQNRQKVVQFESVLHYINEKKVCKSKLILGYFGEKSETDCGICSYCISKKNKSNDASLISKKIMELLKSQNLNSREIQKLIKNSADDVIFALQNLLENNEIAIQPNNKYTLKL

SEQ ID NO: 5099 - DNA, 378 bp, Unknown
  Obtained from environmental sample
  misc_feature (1)..(378): n is a, c, g, or t
atgagaaagataacacaaattaaggaaacaaacaaacgtgggatctcagatgtaatcaacaatcagattcacaatatttccgtaaaaatagatccaaatgttactattgatatacatagaatatttcgactcgctggaacgataaatagtaagagtgggctggttaaatctcgtgtcaacaatttaactacttttgatccttttaaggaatcttgcatcagagaagatgcgttggtcaaattaaatgcatttattgataccaaagtgaatatcaatggaacatcatacaaaattaagactgggataaataacatacccgaattcgttgcagtttatatcatatcaaaggggataggagatatatctattgaaaactaa

SEQ ID NO: 5100 - protein, 125 aa, Unknown
  Obtained from environmental sample
  misc_feature (1)..(125): Xaa is any amino acid
MRKITQIKETNKRGISDVINNQIHNISVKIDPNVTIDIHRIFRLAGTINSKSGLVKSRVNNLTTFDPFKESCIREDALVKLNAFIDTKVNINGTSYKIKTGINNIPEFVAVYIISKGIGDISIEN

SEQ ID NO: 5101 - DNA, 642 bp, Unknown
  Obtained from environmental sample
  misc_feature (1)..(642): n is a, c, g, or t
ttgtcacagtttagcaaaaatgcaatggatactatattaagtaaacaattagccataaaaatagcaaaaaagtacaatatgcaatttcgagtctacgggaaaggccatggaattgtaggcgcactatcggctataggatgtgttttagactcagatcatacttttgaaacgctagcctacaggagagaagaaaatataggaaaaagcagaaaaacaaacgattttaaagtaaaaagactaagcgaagaatcctatccatatacttataataactatgatcaaaaaaactcgagggttctgattacaccccatggtcctgatccagtattttgtggtattagaggcgaagatccattattgactttgtattttttaaaaaatttgtgtatagaagaagtgctggatggctacatgatatttagatccaatcagggaacaaatcttcatcttacaaaagagaaacgaagagtagacatgaaaccttatacggcaggatacattaattgtgaagtcacaacaatgccctatacaattaatggcggacatgtaatcttcaaggtaaaagataggtacgactatgtgttaccagttgcagtatatcaaccgacaggtctaactaaagtgcaagagggtagcatctga

SEQ ID NO: 5102 - protein, 213 aa, Unknown
  Obtained from environmental sample
  misc_feature (1)..(213): Xaa is any amino acid
MSQFSKNAMDTILSKQLAIKIAKKYNMQFRVYGKGHGIVGALSAIGCVLDSDHTFETLAYRREENIGKSRKTNDFKVKRLSEESYPYTYNNYDQKNSRVLITPHGPDPVFCGIRGEDPLLTLYFLKNLCIEEVLDGYMIFRSNQGTNLHLTKEKRRVDMKPYTAGYINCEVTTMPYTINGGHVIFKVKDRYDYVLPVAVYQPTGLTKVQEGSI

SEQ ID NO: 5103 - DNA, 441 bp, Unknown
  Obtained from environmental sample
  misc_feature (1)..(441): n is a, c, g, or t
atgaaaaaaattcttctgcagggaattgcctgttttctttggattaccatccagggacaaatggatacattaggttcaactagcaagacacaaaaatggtcaactcatcccgcgaaagggacaaaaaaagggatgggtcgtctgaacctggggtttcccgcgggagtacattggagtgtcgatatttatacaaacaaaaataaatttatcataaacaggagtttggagggaaagcataaatcgtacgatatgccgcctggcttctataatctaaaacttaataccgtcctaattgaaaaagtatcaatagaatcgggaaaagaaacgaacatccgatatggaattcttgatattagctctgctgactgggaactaagaagtgaagacaataaaaaattcctaacgtcaggtaacaaatcaaaaaaaatgatttacctgtga

SEQ ID NO: 5104 - protein, 146 aa, Unknown
  Obtained from environmental sample
  misc_feature (1)..(146): Xaa is any amino acid
MKKILLQGIACFLWITIQGQMDTLGSTSKTQKWSTHPAKGTKKGMGRLNLGFPAGVHWSVDIYTNKNKFIINRSLEGKHKSYDMPPGFYNLKLNTVLIEKVSIESGKETNIRYGILDISSADWELRSEDNKKFLTSGNKSKKMIYL

SEQ ID NO: 5105 - DNA, 648 bp, Unknown
  Obtained from environmental sample
  misc_feature (1)..(648): n is a, c, g, or t
ttgtcgacactcatgagttataattatcttccgctagataggaaccctattaattttcaacaagtaaaaaacttattgacatataaccagttggtatcaattacatttgatgcacattttcgcattactgcctgtagggaatacttagataaaaaactaaataacagtgatcaatttttttatggcattaatactggctttggctatttacaaaatgtaaaaattgatactgatcaactgcaagaattacaaagcaacttaattaaatcgcatgcttgtggcctaggagaagaagtaccaaaagagatagtaaaattaatgatgatgttaaaaatcaaatcattaagttatgggcattcgggtgtacaaattgatacggtaaagcgattgatggatatgtataataatgatgtacttcctgtaatttatacgcaaggttctttaggagcatcaggagatttagcaccattgagccatttaagcttaccattgttaggtttaggcgaagtctgtcacgaaggaaaaaaaatgcaatcagccgatgcattgaaaaaatttgattggaaacctatacaattacaaagtaagggaggactggctttaattaatggcactcagtttatgagtgcctatggattatatatttaa

SEQ ID NO: 5106 - protein, 215 aa, Unknown
  Obtained from environmental sample
  DOMAIN (9)...(215): Phenylalanine and histidine ammonia-lyase
  misc_feature (1)..(215): Xaa is any amino acid
MSTLMSYNYLPLDRNPINFQQVKNLLTYNQLVSITFDAHFRITACREYLDKKLNNSDQFFYGINTGFGYLQNVKIDTDQLQELQSNLIKSHACGLGEEVPKEIVKLMMMLKIKSLSYGHSGVQIDTVKRLMDMYNNDVLPVIYTQGSLGASGDLAPLSHLSLPLLGLGEVCHEGKKMQSADALKKFDWKPIQLQSKGGLALINGTQFMSAYGLYI

SEQ ID NO: 5107 - DNA, 705 bp, Unknown
  Obtained from environmental sample
  misc_feature (1)..(705): n is a, c, g, or t
atgatgatgttaaaaatcaaatcattaagttatgggcattcgggtgtacaaattgatacggtaaagcgattgatggatatgtataataatgatgtacttcctgtaatttatacgcaaggttctttaggagcatcaggagatttagcaccattgagccatttaagcttaccattgttaggtttaggcgaagtctgtcacgaaggaaaaaaaatgcaatcagccgatgcattgaaaaaatttgattggaaacctatacaattacaaagtaaggaaggactggctttaattaatggcactcagtttatgagtgcatatggattatataatttaatgcaggcagatcgattattaaaatgggcagatattattgctgccatttcatttgatgcatttaattgtactattgaaccactgcatgaaaaaatacattcgataaggtctcacaaagggcaggtacataccgcagcaagattaagggaattattaaaagatagcaaaattgctgctcaaaaaaaatcacaggtacaagacccttattcatttagatgtataccccaggtgcatggtgctacaaaagatacatttaattatgtattaagtgtttttatgaaagaagtaaattcggtaaccgataatcctaatgtttttcctgaggaagacctaattgtaagtggagggaattttcacgggcaaccattagcgtaa

SEQ ID NO: 5108 - protein, 234 aa, Unknown
  Obtained from environmental sample
  DOMAIN (1)...(234): Phenylalanine and histidine ammonia-lyase
  misc_feature (1)..(234): Xaa is any amino acid
MMMLKIKSLSYGHSGVQIDTVKRLMDMYNNDVLPVIYTQGSLGASGDLAPLSHLSLPLLGLGEVCHEGKKMQSADALKKFDWKPIQLQSKEGLALINGTQFMSAYGLYNLMQADRLLKWADIIAAISFDAFNCTIEPLHEKIHSIRSHKGQVHTAARLRELLKDSKIAAQKKSQVQDPYSFRCIPQVHGATKDTFNYVLSVFMKEVNSVTDNPNVFPEEDLIVSGGNFHGQPLA

SEQ ID NO: 5109 - DNA, 471 bp, Unknown
  Obtained from environmental sample
  misc_feature (1)..(471): n is a, c, g, or t
gtgatgcatgtattacttcaccaatttcaactgaacaaagttcaatttcgaaaaatcatctttgagacgtactatccgttgaatcatattgaaaatttgataagaaaggaaattaaggctgaagttgatttacaatatttagaagaatttgctcatgtaaagcacatgttaagtgttgaggggattgccattttgcaccattctattgggaacaaaattacttcagccaattgtactccaattgttcgtttttttggttttgagtcggggaaaagccttctaaatgattatgttaagtggcttgttcctataacacgattgcaagaacttgatagcagtgtgaagattagaaataaaattaaactaatcgaaggagtagcttgcattttggaaagaaattaccctcaagaacatgaaaaattatgcaattattgtgaaatcctaaaagagaaattggccgatgaattttaa

SEQ ID NO: 5110 - protein, 156 aa, Unknown
  Obtained from environmental sample
  misc_feature (1)..(156): Xaa is any amino acid
MMHVLLHQFQLNKVQFRKIIFETYYPLNHIENLIRKEIKAEVDLQYLEEFAHVKHMLSVEGIAILHHSIGNKITSANCTPIVRFFGFESGKSLLNDYVKWLVPITRLQELDSSVKIRNKIKLIEGVACILERNYPQEHEKLCNYCEILKEKLADEF

SEQ ID NO: 5111 - DNA, 861 bp, Unknown
  Obtained from environmental sample
  misc_feature (1)..(861): n is a, c, g, or t
ttgatgtattttgtagttgctaccccaaatgttacccatcatgatggggcaacaaaagccttaatggctggtaaacatgttattgttgataagccgtttactgttacagcacaggaagctacagagttaatagaactggcaaaaaataaaaataaattattgaccgtatatcaaaacagaaggtgggatagtgattttcaaactgtaaaaaaagtaattgattctaatttgcttggcaaccttgtagaatatgaagcgcactatgaccgttttcgcaatactattcgccctgatacatggaaggaagatggtattttgggaacaggtttggtttacgatcttggttcacatcttatagaccaggcgctagtgttatttggattaccaaaaaccataactgccgatttaagaacacaaagacaaaacgccacaatcattgataattttgaaatgatcctggattacggaaaattgaaggtgacattaaaaggcggtatgctaataaaagaacaacttccccattttattttactcggtaacaacggtgcattcataaagtatggaatggacgtacaggaagaagcgttgattgccggtttggcacccaacaaatcgcttaactggggtgaagaaactgaaagtctttggggtaccatcaatacagaatttaacggaatagaattccgtggaaaagtaaaaagtgaaaaaggaaattatgttggcttttatgaaaacgtttataaagcaatacttggggaagaagaattagccgtnaaaccaggggaggcaagaaacactattcgtgttattgaattagctatgcaaagtaaccaggagaagcgaacaattacgtacagttga

SEQ ID NO: 5112 - protein, 286 aa, Unknown
  Obtained from environmental sample
  DOMAIN (70)...(178): Oxidoreductase family, C-terminal alpha/beta domain
  misc_feature (1)..(286): Xaa is any amino acid
MMYFVVATPNVTHHDGATKALMAGKHVIVDKPFTVTAQEATELIELAKNKNKLLTVYQNRRWDSDFQTVKKVIDSNLLGNLVEYEAHYDRFRNTIRPDTWKEDGILGTGLVYDLGSHLIDQALVLFGLPKTITADLRTQRQNATIIDNFEMILDYGKLKVTLKGGMLIKEQLPHFILLGNNGAFIKYGMDVQEEALIAGLAPNKSLNWGEETESLWGTINTEFNGIEFRGKVKSEKGNYVGFYENVYKAILGEEELAVKPGEARNTIRVIELAMQSNQEKRTITYS

SEQ ID NO: 5113 - DNA, 330 bp, Unknown
  Obtained from environmental sample
  misc_feature (1)..(330): n is a, c, g, or t
atggcggccatccattttttttcaagaaaaacctttcccaaaaaagtcattcgggaaaaatacgatgtgttcccatttgtcaaaccagattttagtaagccatgtttctttgggaatgcagaacccggcaggcaaagtaaaatggttcatagcaggaaccagcagaatgctaaaatgaaaaaggtcctggcagatttcaatgtaaatattttagatgcaattatacagaaaatatatggcgggatgaggaatcaaacctggcaagcaaacctgtttttcaatttaataatgcagggcttattaaaaagatcactgcttgtttgtaaataa

SEQ ID NO: 5114 - protein, 109 aa, Unknown
  Obtained from environmental sample
  misc_feature (1)..(109): Xaa is any amino acid
MAAIHFFSRKTFPKKVIREKYDVFPFVKPDFSKPCFFGNAEPGRQSKMVHSRNQQNAKMKKVLADFNVNILDAIIQKIYGGMRNQTWQANLFFNLIMQGLLKRSLLVCK

SEQ ID NO: 5115 - DNA, 501 bp, Unknown; identical to SEQ ID NO: 4751
  Obtained from environmental sample
  misc_feature (1)..(501): n is a, c, g, or t

SEQ ID NO: 5116 - protein, 166 aa, Unknown; identical to SEQ ID NO: 4752
  Obtained from environmental sample
  misc_feature (1)..(166): Xaa is any amino acid

SEQ ID NO: 5117 - DNA, 600 bp, Unknown
  Obtained from environmental sample
  misc_feature (1)..(600): n is a, c, g, or t
gtggaaagaattacagcatttaccctttatcgggaagctgtacagaaaaaaggtcagcctttaaacccttcaattccatcaatacagctttacaaaggggttgttcattttctcaaatcccaccgtggtcaccggtccatgcccggaataaactttggtttcatccggcagggtgaagatctgggtctgtatactattgacaagggtcttgaaatcgcccccgggaaggtcggtccggcctatgctgccgttgaaaagtacatcacccccgatcaggaatcctcctttttcatggtaaaaggagacacttccgggggaatgtcccggggtaaaccggatctccagttcatcctcacctattttaataatttctccttccttcaaataaaccagggggccatcgtaggggtcaaagggcagtccccattgttgcccggaaaggggagcaaaatcgagtaccggtttttccttttcatgaatatgaagcggaagtttccaggtatcatatatgaatttattaccaaagacatggtccaggtgacagtgcgtattaagcagcaaaaccggcaccccgcctgtcttttcaatgcccgttcttaa

SEQ ID NO: 5118 - protein, 199 aa, Unknown
  Obtained from environmental sample
  misc_feature (1)..(199): Xaa is any amino acid
MERITAFTLYREAVQKKGQPLNPSIPSIQLYKGVVHFLKSHRGHRSMPGINFGFIRQGEDLGLYTIDKGLEIAPGKVGPAYAAVEKYITPDQESSFFMVKGDTSGGMSRGKPDLQFILTYFNNFSFLQINQGAIVGVKGQSPLLPGKGSKIEYRFFLFMNMKRKFPGIIYEFITKDMVQVTVRIKQQNRHPACLFNARS

SEQ ID NO: 5119 - DNA, 573 bp, Unknown
  Obtained from environmental sample
  misc_feature (1)..(573): n is a, c, g, or t
atgaataaaccattttatattttcatcagtactcttttaattctttcctgcaaaaaccaaaaaacaaagccacaagccgaatcaagttttttccctgttctgtcctttattaaaagccaggtcgcccatgtagacacatctgtatatcggattataaaagttataaaaacagacagcgtttccgataccacttatttaaaaagagaagagtttagagacgtagccaaagactttttatccataccagatataagctccgaggaattaaaagacgattatacagaaacaaaattatttatccaggatatcgaccaggttgcattaaactatatgcctaaaaaaccagataaagaaataaccaggcaagaagtaatgataaaacctggcactgatggagataaggttcaatcaatatttatcaatcgaattaacaatagtaaagagggatcgatacaaaagatattattttgggaagtagataaacaattcaaaattgtgactttaactcaatttcccgatcaacctgaaaaaacacaaactatagaggtgatatggaataactttccatcataa

SEQ ID NO: 5120 - protein, 190 aa, Unknown
  Obtained from environmental sample
  misc_feature (1)..(190): Xaa is any amino acid
MNKPFYIFISTLLILSCKNQKTKPQAESSFFPVLSFIKSQVAHVDTSVYRIIKVIKTDSVSDTTYLKREEFRDVAKDFLSIPDISSEELKDDYTETKLFIQDIDQVALNYMPKKPDKEITRQEVMIKPGTDGDKVQSIFINRINNSKEGSIQKILFWEVDKQFKIVTLTQFPDQPEKTQTIEVIWNNFPS

SEQ ID NO: 5121 - DNA, 315 bp, Unknown
  Obtained from environmental sample
  misc_feature (1)..(315): n is a, c, g, or t
atgacgcagtcggaatttcaaaagatatcgtctggattacctgttcttcctggcatttataaatattatgatgccggaagcatgctattatatgtaggcaaagccaaaaatataagaaaaagaatcagctcatattttaataaaaccctggatagctataaaacgcatgaacttgtaaaacgtatcaaccgcatagagtttaacattggtaattcaaaacaggatgcctttttaatggaaaattcgctgataaaacagttccaacccttctcaaaattaatcttaaagacgacaaacttatccttacccgggtaa

SEQ ID NO: 5122 - protein, 104 aa, Unknown
  Obtained from environmental sample
  DOMAIN (16)...(98): GIY-YIG catalytic domain
  misc_feature (1)..(104): Xaa is any amino acid
MTQSEFQKISSGLPVLPGIYKYYDAGSMLLYVGKAKNIRKRISSYFNKTLDSYKTHELVKRINRIEFNIGNSKQDAFLMENSLIKQFQPFSKLILKTTNLSLPG

SEQ ID NO: 5123 - DNA, 924 bp, Unknown
  Obtained from environmental sample
  misc_feature (1)..(924): n is a, c, g, or t
atggtgggcattgatcagcaatacggcacacttgaggccgataaaaaagctagcttcatgatttactcagctgaccggttgcttggcgacgcttccgtgcttgaatctggggttttgggtgaacgccgcattttatcttctccccaatccgttgatttgcgcggaaaatttaatctggttgtcgacaatgaatacttaacgcttgaattatccggcagtaaggaaagtccgtcggctaaactgaaaaagaaaaacatttcggcagctgcagagcctgagaaaaaaccacgtggacgcaaaaagaaggaacaacccgttgtaaaggattctaccgaaatcagctgttctgtcagtgtacacgaaaatgatatcaccatccaattcagttcaaaagaagtgaaatggaaaggcagcaccagtttgcacggaaaatacaacgccaaattcggtctttttgaaggtgatgccttacttgcagacggcagatgggtgcgctggagcggtatcaaatccgaaaacaaagaaaaatccgatgaaaaagagaaaaaaagtaccgctgcaagccgcgacttttctttgtggtatcccaatatggcctttggtttcaaggaaaaacccaagcaacagaatatcattatcgaaaacgccaccatctggaccaacgaaaaagacggcatcatccaaaacggttccattctgattgaaaacggcaaaatttcctttgtcagcaagggagaatatgccttttcggtaaatgctcaggtatacgatggcaagggtaaacacttaacgagtggtatcattgacgaacattcgcatattgccatcagtcgcggcgtaaacgaagacggacaggccgtttcagctgaggtgagcatcgaagatgtggtaaatccggaagacattgatatttaccgccagtga

SEQ ID NO: 5124 - protein, 307 aa, Unknown
  Obtained from environmental sample
  misc_feature (1)..(307): Xaa is any amino acid
MVGIDQQYGTLEADKKASFMIYSADRLLGDASVLESGVLGERRILSSPQSVDLRGKFNLVVDNEYLTLELSGSKESPSAKLKKKNISAAAEPEKKPRGRKKKEQPVVKDSTEISCSVSVHENDITIQFSSKEVKWKGSTSLHGKYNAKFGLFEGDALLADGRWVRWSGIKSENKEKSDEKEKKSTAASRDFSLWYPNMAFGFKEKPKQQNIIIENATIWTNEKDGIIQNGSILIENGKISFVSKGEYAFSVNAQVYDGKGKHLTSGIIDEHSHIAISRGVNEDGQAVSAEVSIEDVVNPEDIDIYRQ

SEQ ID NO: 5125 - DNA, 1077 bp, Unknown
  Obtained from environmental sample
  misc_feature (1)..(1077): n is a, c, g, or t
gtgaaacctattgagaaggtgatgagaggacttttttttactttctacagaatgggatatgcgcaaccattttccggttatggggggctggccaatgcctcggacagatcaggggtgccgctcatatcaatgaagagatacttgcaaattataagcttacaagatttatacaacaacaacttcatgatcgtcgaaaaaaggataaaagagcttaagaaaaaagggaccagtaaaactaccgacccgatcctgaaactaaagatctggattctttatcccttcctcgaaactgaagatcccaacctccaatactattacgatttttcccaaagccacgaagagtatagcaaagtcttttcgggattaggcgccgactgggcctggcagccggtaaccatgaagaattacaaagaggttatcggcagaattaaaaaggaatcgggaaggaaaattccgctcgtattaaacctgtgcgatggggatgaaatcaatggaacgccgggtgtttcggttatacatgagctggaaaaaaacagactgatctataccggctctgacgatcatttttataatatcactacctccaagatacccatgaaaaaggcatttgatgaggccggggtgtctacagccaaatgggaggtcgtcgatgggtcagaagagtcgataaagggaatttgtaaaagactgggggcacccctgattataaaaccagccgtatcgggtggcagtatgggcgtatcggtaaaaaatgtggtctacacagaccaggaattgctcgacagggttaaggagattagcgatggataccggggctggaacttattggcaggtggattattcgttgaacagtttattactgggccggaatacacctcatttattgtaggttcatataacagtcctgaatcctgttatatttatccacccgttgaaaggatatttcatgcgtctttacctgatgaagagaagttcttgtcatttgaccggctctgggaaatatatgaagatgaaaaacctatgcccggtgatgagaatttttacaattatcaccgcccggatcgtcttgaaacataa

SEQ ID NO: 5126 - protein, 358 aa, Unknown
  Obtained from environmental sample
  misc_feature (1)..(358): Xaa is any amino acid
MKPIEKVMRGLFFTFYRMGYAQPFSGYGGLANASDRSGVPLISMKRYLQIISLQDLYNNNFMIVEKRIKELKKKGTSKTTDPILKLKIWILYPFLETEDPNLQYYYDFSQSHEEYSKVFSGLGADWAWQPVTMKNYKEVIGRIKKESGRKIPLVLNLCDGDEINGTPGVSVIHELEKNRLIYTGSDDHFYNITTSKIPMKKAFDEAGVSTAKWEVVDGSEESIKGICKRLGAPLIIKPAVSGGSMGVSVKNVVYTDQELLDRVKEISDGYRGWNLLAGGLFVEQFITGPEYTSFIVGSYNSPESCYIYPPVERIFHASLPDEEKFLSFDRLWEIYEDEKPMPGDENFYNYHRPDRLET

SEQ ID NO: 5127 - DNA, 309 bp, Unknown
  Obtained from environmental sample
  misc_feature (1)..(309): n is a, c, g, or t
atgacagaacaaaattacgatagtagtgaggaccccaatagcaaactgaagtctctgcttgtagacattgatgcagggataaataagttagacgaaaagacttggcaggattcgattctcgcaagaacaaagaaagtccgtccatcgatacctataacattttatagaaacgatagggaagttttaggtaagataaatttggagttagaaaaaaagtggggtcatttaagtagcactcaggatgaaaagtcgtacctagatttaattcagatattcgataagttgattgagtggataataactggttga

SEQ ID NO: 5128 - protein, 102 aa, Unknown
  Obtained from environmental sample
  misc_feature (1)..(102): Xaa is any amino acid
MTEQNYDSSEDPNSKLKSLLVDIDAGINKLDEKTWQDSILARTKKVRPSIPITFYRNDREVLGKINLELEKKWGHLSSTQDEKSYLDLIQIFDKLIEWIITG

SEQ ID NO: 5129 - DNA, 462 bp, Unknown
  Obtained from environmental sample
  misc_feature (1)..(462): n is a, c, g, or t
ttgatagaaatttttctgccatcactgaaggataatcttatggttaaccacatttctgtttatccattggaaaaattatctaaacatactgaaataaagccaggatttgcatttaggagtgaagaattcttagaaaacaccagcgaaatcccacttgtaaagggtgagaatctccaacaaggttatattgactggagcgcagcaaagtattggtcaagcgataagacacgtggagttgaggattattttctagtagaaaatgacattgtagtggctatggaccgtccctgggtaacttcagggctaaagtggtcttatataagaaaaggtgatccgaaatcgttgcttgttcagcgtgtagcaaggttgcgagctaagggaaaactgaatcaatattttctaaggtatcttattggaagtgagatttctctagatcatataaaccattctgtgatccactag

SEQ ID NO: 5130 - protein, 153 aa, Unknown
  Obtained from environmental sample
  misc_feature (1)..(153): Xaa is any amino acid
MIEIFLPSLKDNLMVNHISVYPLEKLSKHTEIKPGFAFRSEEFLENTSEIPLVKGENLQQGYIDWSAAKYWSSDKTRGVEDYFLVENDIVVAMDRPWVTSGLKWSYIRKGDPKSLLVQRVARLRAKGKLNQYFLRYLIGSEISLDHINHSVIH

SEQ ID NO: 5131 - DNA, 654 bp, Unknown
  Obtained from environmental sample
  misc_feature (1)..(654): n is a, c, g, or t
ttgacctcaagccaaggtaatctgattcggtttaacaagaggggaattattaatatcagtacctcacttaccaatcctgttaaaaaaagatttgttttggcacatgaattgggtcactggtttatgcataaggataaagtaatgtttgcttgtactgaagacaatatgaatgattggaccttaaataatccaattattgaagttgagtcaaatgcatttgccggagaacttattttacctgaaaatatattaaaatcatattttataaatagaattccagatgcagatatttttagagagatttcccattcatacaagatttccttatccgctctgtccattaaatatgtgaaatccgggattacacccgtgtgcattatgttctgtagaaacaaccaggttgaatggcacgccacttcccataagtttccgtttgggttgtttgggaacaaaactattcccgacaaatccctgacagcagaaagtttaaaaaaaaagatgacacaatcctctactcgtgtcaatgaggccaaaatgtggtttcccactgattataaagttgggcaggataattatataaacgagatgatttttccaatgcctaaaatgaaagcctgtctgacttttgtgtgggaatataaaattattttataa

SEQ ID NO: 5132 - protein, 217 aa, Unknown
  Obtained from environmental sample
  DOMAIN (2)...(117): Domain of unknown function (DUF955)
  misc_feature (1)..(217): Xaa is any amino acid
MTSSQGNLIRFNKRGIINISTSLTNPVKKRFVLAHELGHWFMHKDKVMFACTEDNMNDWTLNNPIIEVESNAFAGELILPENILKSYFINRIPDADIFREISHSYKISLSALSIKYVKSGITPVCIMFCRNNQVEWHATSHKFPFGLFGNKTIPDKSLTAESLKKKMTQSSTRVNEAKMWFPTDYKVGQDNYINEMIFPMPKMKACLTFVWEYKIIL

SEQ ID NO: 5133 - DNA, 303 bp, Unknown
  Obtained from environmental sample
  misc_feature (1)..(303): n is a, c, g, or t
atgggtacgggagccaaaagcaatgttttgcaaaacaaagaaactttgttcgcttttatgatggcgacagcaaataaagaaagaatttataccggcgaatttgactattcaaaaattgatgccctcgaaaaatataccggcacccatccggaagtgatgcaatcaaaaattgctaatattaactggcagtttgaatatgatctttcttataataatcttagtataaaggaacgttcaaaaaaccttttggaaaaaattaccggcaaacgcccttttgattttaataactataaaatcatttag

SEQ ID NO: 5134 - protein, 100 aa, Unknown
  Obtained from environmental sample
  misc_feature (1)..(100): Xaa is any amino acid
MGTGAKSNVLQNKETLFAFMMATANKERIYTGEFDYSKIDALEKYTGTHPEVMQSKIANINWQFEYDLSYNNLSIKERSKNLLEKITGKRPFDFNNYKII

SEQ ID NO: 5135 - DNA, 468 bp, Unknown
  Obtained from environmental sample
  misc_feature (1)..(468): n is a, c, g, or t
atgactacctactgcgattactgcaattctcaccccgaagacacgtacaaccgaatgtatcacgatacacaatatggctttcccctcaaagatgacagcctgttgtttgagcgcttcatccttgagatcaatcaggcaggtctttcctggatcacgatcctgaagaaagccgagaatttccataaagcctatcatggctttaacatcgataaagttgcgaaatacggagaaaaagaccgcgctcgtctgcttacggacccgggcatcatccgcaatcgtctgaaggtcaatgcggcgatcgtcaacgcacagaagatcaaagagttacagaaggaatacggttccttcaaagcctggctggacgcaaatcggaacctctccaaagaggaatgggtcaagctgttcaaaaagacatttgtctttaccgggggtgagatcgtaaatgagtttctgatgtccacgggattn

SEQ ID NO: 5136 - protein, 156 aa, Unknown
  Obtained from environmental sample
  DOMAIN (7)...(155): Methyladenine glycosylase
  misc_feature (1)..(156): Xaa is any amino acid
MTTYCDYCNSHPEDTYNRMYHDTQYGFPLKDDSLLFERFILEINQAGLSWITILKKAENFHKAYHGFNIDKVAKYGEKDRARLLTDPGIIRNRLKVNAAIVNAQKIKELQKEYGSFKAWLDANRNLSKEEWVKLFKKTFVFTGGEIVNEFLMSTGX

SEQ ID NO: 5137 - DNA, 483 bp, Unknown
  Obtained from environmental sample
  misc_feature (1)..(483): n is a, c, g, or t
atgtctggttttctatcaacatatttcggaaatatatacagggcccttcgttccctcggaaaaggaatgaagataaccggctattatttcactcaccataaggaaattcttacacaagaatatcctgacaaccgcgacacgctcacattcggcgagcgtttcaggggagaagtggtaatgccgcacgatgaaaacaacgagcatcgctgcacaggatgcagtgcttgcgagattgcttgtccgaacggaaccatcaagattttaacgaagcaggagattactgaggacggcaaaaagaaaaaagccatcgataagtttgtttatcatttaggcatgtgcacgttttgcaacctctgtatcattgcctgtccgaccgatgcgatcaagatgagccacgactttgagcacagcgtgtacgacaggaaacaacttaccaaggtgttgaataaaccgggatctaaacttgcaaaaggagtagaataa

SEQ ID NO: 5138 - protein, 160 aa, Unknown
  Obtained from environmental sample
  DOMAIN (63)...(86): 4Fe-4S binding domain
  misc_feature (1)..(160): Xaa is any amino acid
MSGFLSTYFGNIYRALRSLGKGMKITGYYFTHHKEILTQEYPDNRDTLTFGERFRGEVVMPHDENNEHRCTGCSACEIACPNGTIKILTKQEITEDGKKKKAIDKFVYHLGMCTFCNLCIIACPTDAIKMSHDFEHSVYDRKQLTKVLNKPGSKLAKGVE

SEQ ID NO: 5139 - DNA, 315 bp, Unknown
  Obtained from environmental sample
  misc_feature (1)..(315): n is a, c, g, or t
ttgattggggatacgatccacgtgtgttcatttccgccgggtaccagcaagtggaacaagatcgagcaccgaatgttctgccacatcacgcagaactggcgtggccagccattgattagccatgaggtcatcgtcaagctgattgcaaacacgaccactcgctcaggcctgaaaattcgcgccgagttggacagcgctcgataccccgccggcataaaggtcactgaggatgagcttgctgcagtgaacatcaagcgcgccgactttcatggtgagtggaactacacgctgaagcctacatacaagagaaagtag

SEQ ID NO: 5140 - protein, 104 aa, Unknown
  Obtained from environmental sample
  misc_feature (1)..(104): Xaa is any amino acid
MIGDTIHVCSFPPGTSKWNKIEHRMFCHITQNWRGQPLISHEVIVKLIANTTTRSGLKIRAELDSARYPAGIKVTEDELAAVNIKRADFHGEWNYTLKPTYKRK

SEQ ID NO: 5141 - DNA, 519 bp, Unknown
  Obtained from environmental sample
  misc_feature (1)..(519): n is a, c, g, or t
ttggtattagttggggctggagatgagcttggatatttaaagaagataattgctggcttaggaatggaaaaaaatgtctattttactggttttcaaaagaatccatacaaatttttagtaaagtcggatctgttcgtcctgtcgtcagcatgggaaggtttcccgaatgttcttatagaggctatggcgtgcggtttgcctgttatttcggtagattgtaaatcagggccgcgtgaaatattggccccaaaaatgagtgagcaagaagaggttaaatcaatttattttgctgagtttggagtgttgattcctgaactcgatggtgaatataagagcgttgatgagccgttaagcatacaggaagtaataatgtcagaagcaattatgaaagtgcttcagtctgatttaatcaaagatgactatattgaaaaaggtaaacaaagagtcctagacttttcgatgcagagttttactgataattggcttaacgttataaattcagtcgttgataataagtaa

SEQ ID NO: 5142 - protein, 172 aa, Unknown
  Obtained from environmental sample
  DOMAIN (1)...(148): Glycosyl transferases group 1
  misc_feature (1)..(172): Xaa is any amino acid
MVLVGAGDELGYLKKIIAGLGMEKNVYFTGFQKNPYKFLVKSDLFVLSSAWEGFPNVLIEAMACGLPVISVDCKSGPREILAPKMSEQEEVKSIYFAEFGVLIPELDGEYKSVDEPLSIQEVIMSEAIMKVLQSDLIKDDYIEKGKQRVLDFSMQSFTDNWLNVINSVVDNK

SEQ ID NO: 5143 - DNA, 666 bp, Unknown
  Obtained from environmental sample
  misc_feature (1)..(666): n is a, c, g, or t
atgattcttgataattttgaaacagtggttaatgctctggaaaatgaagaactaaaagatgtaactgaacttttaaaatttgcttcagattatccaaacatagttatcacctctagagaaaagcttagttcttcagatgattttgaagatgtctattcacttactcctttaataacagacgacgctttaatattattcgaaaaacattatggcacagctataactaatacagcagaaataaaaattctccgacaagaaattttagaagatttattgaacaataatccattagctataaaattagttactaattctagaacaagttcaaaaaatatggctgagttgcgaaatcagttacaaaaacatttttttgaatctataaatgaagattactctttagtttttaaaaataatgcagatttaaatattgaaagaacaaaatctatatatcaatcaattaattattcttatacaacattaaattcaaaggaaaagatagcatttgaattattaagtctttttcctgatggaataagcttaaataattttaaaaaatgctttaccaaaaattcttcttcaaataacataactgacaaagaatttataatactcaggaacaaatctttaatagaagactataatggactctccaactacaacctataa

SEQ ID NO: 5144 - protein, 221 aa, Unknown
  Obtained from environmental sample
  misc_feature (1)..(221): Xaa is any amino acid
MILDNFETVVNALENEELKDVTELLKFASDYPNIVITSREKLSSSDDFEDVYSLTPLITDDALILFEKHYGTAITNTAEIKILRQEILEDLLNNNPLAIKLVTNSRTSSKNMAELRNQLQKHFFESINEDYSLVFKNNADLNIERTKSIYQSINYSYTTLNSKEKIAFELLSLFPDGISLNNFKKCFTKNSSSNNITDKEFIILRNKSLIEDYNGLSNYNL

SEQ ID NO: 5145 - DNA, 570 bp, Unknown
  Obtained from environmental sample
  misc_feature (1)..(570): n is a, c, g, or t
gtgcgtgccccgctggccaatataagggggttttgcgatacgcttgactacagggaactggacgataacgaacgggtagaggttttggcaggcatttctgcatcagccaaaagacttgacgatgtaattaccgacctgaacttcattttgcagatgaaacaaggggtgagcgaaaacaaagaacctgtgttttttgccaaccttgttgaggatataaaatttagtatagccaacctggtaaataatgaaaaagtggtgattattactgatttcaacgaagtagataagaaaattactatcagaagctacctgtacagtattttctataatctcatcataaacagcatcaaatatcgaaggccggatgttgcacccgtaattgaaattacaagtcgcaaacaggagaacaagttagtactgctgtttaaagacaacgggttgggtattgaccttgaaaaaagagggaactatgtattcggcctatataaacggttccacccgcaaatagaaggaaagggaatgggcctgtttatgaccaaaacgcaggttgaaatgctgggaggtaaataa

SEQ ID NO: 5146 - protein, 189 aa, Unknown
  Obtained from environmental sample
  DOMAIN (99)...(189): Histidine kinase-, DNA gyrase B-, and HSP90-like ATPase
  misc_feature (1)..(189): Xaa is any amino acid
MRAPLANIRGFCDTLDYRELDDNERVEVLAGISASAKRLDDVITDLNFILQMKQGVSENKEPVFFANLVEDIKFSIANLVNNEKVVIITDFNEVDKKITIRSYLYSIFYNLIINSIKYRRPDVAPVIEITSRKQENKLVLLFKDNGLGIDLEKRGNYVFGLYKRFHPQIEGKGMGLFMTKTQVEMLGGK

SEQ ID NO: 5147 - DNA, 543 bp, Unknown
  Obtained from environmental sample
  misc_feature (1)..(543): n is a, c, g, or t
gtgcttttatatgatgaccagaaatatgcctttcggataatagctaggtattttttaaatggtctcaccaatggtgaatcatgtattttctttacttcagataatcccgatgaaattgaaaaaagactaaataaggaaggtatcgatgtaagattttataaaaataataacttgttgcgtatctataccatcgaaagatcagatgagaacaaacatgaaactttgaacacgcttagacatataagaaaagatgctactgtaggaatgaagcctccatttagatttgcaggaagaacgataacgaatacagaaacaatggaaggaatgaaactaggaattgttttggaagaagttgggcataaaaactttgatagttttgataattcacaattatgtttttatgatatctctaaaatagaaaaatcgatgagaccaaaatggatacaaaatcttttaaaagctcatcattgcgttatctatgcatccgaacctaataaagcagtagcatttgataccaacttacttgaggatcaagaagtatga

SEQ ID NO: 5148 - protein, 180 aa, Unknown
  Obtained from environmental sample
  misc_feature (1)..(180): Xaa is any amino acid
MLLYDDQKYAFRIIARYFLNGLTNGESCIFFTSDNPDEIEKRLNKEGIDVRFYKNNNLLRIYTIERSDENKHETLNTLRHIRKDATVGMKPPFRFAGRTITNTETMEGMKLGIVLEEVGHKNFDSFDNSQLCFYDISKIEKSMRPKWIQNLLKAHHCVIYASEPNKAVAFDTNLLEDQEV

SEQ ID NO: 5149 - DNA, 507 bp, Unknown
  Obtained from environmental sample
  misc_feature (1)..(507): n is a, c, g, or t
atggatgatgagtggaaggaggacttgcaagattataaatcaaccccagatgggatgaagcgcaggatatacattgagtccgattttttgcacgcatctgaactgcggagagcgcagaatgaggttgagtttatttgtgaagaaaaaggcgataagtgtgtaaggcgagtgttttcagaagttcttgaacttgcctggcataatttggaaagaacttgggaggcggtacagcgggcagacgaaatatattctgactcatcattgatgcctcttgtcggcgggtcttatatgggagcgccggttatatttaacggtatgtgcgaaagggcggtgaaagaaaatattacagggaaggatgtttacattctgaacaacctgaaagatatatactggggaatgatagatattccgatgatgaagcgggcattcaaaaagaacaacctttttatgtataacagcgaaagagaattggtcaaggtggacgcatccaagataaaaaagaagtga

SEQ ID NO: 5150 - protein, 168 aa, Unknown
  Obtained from environmental sample
  misc_feature (1)..(168): Xaa is any amino acid
MDDEWKEDLQDYKSTPDGMKRRIYIESDFLHASELRRAQNEVEFICEEKGDKCVRRVFSEVLELAWHNLERTWEAVQRADEIYSDSSLMPLVGGSYMGAPVIFNGMCERAVKENITGKDVYILNNLKDIYWGMIDIPMMKRAFKKNNLFMYNSERELVKVDASKIKKK

SEQ ID NO: 5151 - DNA, 657 bp, Unknown
  Obtained from environmental sample
  misc_feature (1)..(657): n is a, c, g, or t
atgataaggtctctaatgagtaatggaaataccacaggcagtactgttattatggatggtggctaccgaaattacgatcagtttaatgtgtggacgattgaaaatattcgttgggtaacaaagattcatcctctaaccacttaccaggtaagtaaatcgaacagtgtttctaaacgagagactaaggctggagtttgtttagatcaggagatagttatgggagcagattatccaaaaatttccaaagtgtcatgcagacttattcattttacctgccctactactagtaagtcctttcaattcatcactaatgattttaaatcaactgctgcatatattggaagaatgtataaaaagaggtggaagattgaactactgttcaaaagactgaagcaaaatatgcccctccaatattttttaggtgataatcagaacgcaatacaaatacaagtttggtgcgctttgattgctgatttgcttgttaacattgtaagacagcaagtaaaaagaaaatgggccttctctaacattgtaagtgttgttagactgcatcttttcaactacttgaatttgttctcctttcttgaaaatccagataagtgcgtaatcgcatcatcgactgaagatattcaactcaaactgtctttgtcgggatga

SEQ ID NO: 5152 - protein, 218 aa, Unknown
  Obtained from environmental sample
  misc_feature (1)..(218): Xaa is any amino acid
MIRSLMSNGNTTGSTVIMDGGYRNYDQFNVWTIENIRWVTKIHPLTTYQVSKSNSVSKRETKAGVCLDQEIVMGADYPKISKVSCRLIHFTCPTTSKSFQFITNDFKSTAAYIGRMYKKRWKIELLFKRLKQNMPLQYFLGDNQNAIQIQVWCALIADLLVNIVRQQVKRKWAFSNIVSVVRLHLFNYLNLFSFLENPDKCVIASSTEDIQLKLSLSG

SEQ ID NO: 5153 - DNA, 864 bp, Unknown
  Obtained from environmental sample
  misc_feature (1)..(864): n is a, c, g, or t
ttgggncnncccatcggtcagattgtaggaatgcggcgcgaaaatcaggtcgacccgttcagcacggcggaagttctctgcaataattgcggaacttttaacctcgtgcgtccaaagctttgcccgaactgcggcgaaccggtcgggttaaaacataaacacgatcaacaggaatgccaggagcgcggcgtttcatacagcgttcctttgaaggtcaagattcgtctgaccgtttttgaaaaagacgccgacacgggcgtttcgaccatccgcgacattaaggaagaagaagttttcttcggcgaaattcctttgatgaccgaaaacggaacttttgttattaacggaaccgagcgcgttatcgtttcgcagcttcatcgctcgcccggcgttttctttaagggcgaacgcgataattttttggcgaaaataattccctatcgcggctcgtgggtcgaatttgaatacgaccaaaaaggtcttttgtattcgcggctcggcaagcggaaaattctggcgacaatttttcttcgcgctttgggtttgtggctcaaaccgcagattgatatgaagacgatttccgaccagattttggaagaagtcgtcaaaaacgccgaatttacaaacagcgacattttgcgtcttttctatacttccgatgaagttagcgtcgaaaaaggtcggatttacgtccgagtcaaagaagaaggcgaaacacacctcgtcggaatgcgcgccgaggaggacatcaaggacaaaggtgaagatgtcgttaaaataggtaagaaaattaccaaatcagctttgcgcgagttgaaaaatctcagcatcgaaaaagtcgaagtttcggcaaacgaattttga

SEQ ID NO: 5154 - protein, 287 aa, Unknown
  Obtained from environmental sample
  misc_feature (1)..(287): Xaa is any amino acid
MGXPIGQIVGMRRENQVDPFSTAEVLCNNCGTFNLVRPKLCPNCGEPVGLKHKHDQQECQERGVSYSVPLKVKIRLTVFEKDADTGVSTIRDIKEEEVFFGEIPLMTENGTFVINGTERVIVSQLHRSPGVFFKGERDNFLAKIIPYRGSWVEFEYDQKGLLYSRLGKRKILATIFLRALGLWLKPQIDMKTISDQILEEVVKNAEFTNSDILRLFYTSDEVSVEKGRIYVRVKEEGETHLVGMRAEEDIKDKGEDVVKIGKKITKSALRELKNLSIEKVEVSANEF

SEQ ID NO: 5155 - DNA, 687 bp, Unknown
  Obtained from environmental sample
  misc_feature (1)..(687): n is a, c, g, or t
gtgtcaagcccttttttcaggttttttcaaggtttgaattaccattttataaataaatatgacgaatgctgggtacctgattttagcgaaccaccttttcttgccggagttttgtcgcatccaaaaaaaatgccggatagcccggtaagatatattggttggctatcgcgttttggaattacggaaaaaaaagaaggggaatatatattgatactactttcaggtcccgaaccgcaaaggagcattttagaaaaaataatgctggatcaattagaaaattattttgaaccagttttaatagtaagaggtttacccggcagtaacagtttgctttctgtcaaaaacaatacaaggtatctaaatcatttacctgcaaaacaaatggaagaagcaattttaaatgcatcatttattatcgcacgaaccgggtacagtactataatggatttattaaaattaaaaaagaaggcgatactaattcctactccgggacagacagaacaagaatacctggccaatcatcttttgcaaaacaaaatggctttttgcacagtgcaacaaggatttaatttacctgaaactttgaaagcagcttgcgtttttaattatactttttacgatagggatacaatttttcaagaagcactcttgtttgaaaaatattacaaaagcaaagcctccaaataa

SEQ ID NO: 5156 - protein, 228 aa, Unknown
  Obtained from environmental sample
  DOMAIN (70)...(221): Glycosyltransferase family 28 C-terminal domain
  misc_feature (1)..(228): Xaa is any amino acid
MSSPFFRFFQGLNYHFINKYDECWVPDFSEPPFLAGVLSHPKKMPDSPVRYIGWLSRFGITEKKEGEYILILLSGPEPQRSILEKIMLDQLENYFEPVLIVRGLPGSNSLLSVKNNTRYLNHLPAKQMEEAILNASFIIARTGYSTIMDLLKLKKKAILIPTPGQTEQEYLANHLLQNKMAFCTVQQGFNLPETLKAACVFNYTFYDRDTIFQEALLFEKYYKSKASK

SEQ ID NO: 5157 - DNA, 435 bp, Unknown
  Obtained from environmental sample
  misc_feature (1)..(435): n is a, c, g, or t
ttgtgggcagatctacacgatcagtggatgatggaacgtgggtatctggatgtaaaaactttcaaggatttggttagcgcccgtaacacccaaaagaaactcgtgaccattgaaccgaagcacacggtagctgaagcagtagagttaatgaagaaatacgacattgaacatattccggtggtaaatgggaacggacccatcggctcgatcagtgaaaacgggttgtttcagaaagtattttccaatcccgacattcgtaatgaatcagtagaaagcgtgatggaacatccctttccgattgttgattttgataccccggttgaaagactcagcacgcttataaataaagaaaatggcgccgtgctaagcaaagacgaggcaggcaattttcacatcgttactaagtatgatgtcatacaggcccttggaagttga

SEQ ID NO: 5158 - protein, 144 aa, Unknown
  Obtained from environmental sample
  DOMAIN (28)...(80): CBS domain
  misc_feature (1)..(144): Xaa is any amino acid
MWADLHDQWMMERGYLDVKTFKDLVSARNTQKKLVTIEPKHTVAEAVELMKKYDIEHIPVVNGNGPIGSISENGLFQKVFSNPDIRNESVESVMEHPFPIVDFDTPVERLSTLINKENGAVLSKDEAGNFHIVTKYDVIQALGS

SEQ ID NO: 5159 - DNA, 468 bp, Unknown; identical to SEQ ID NO: 2239
  Obtained from environmental sample
  misc_feature (1)..(468): n is a, c, g, or t

SEQ ID NO: 5160 - protein, 155 aa, Unknown; identical to SEQ ID NO: 2240
  Obtained from environmental sample
  misc_feature (1)..(155): Xaa is any amino acid

SEQ ID NO: 5161 - DNA, 765 bp, Unknown
  Obtained from environmental sample
  misc_feature (1)..(765): n is a, c, g, or t
atggatgacgttgatttaatcaagcaaaagatagatattgcagatctaattgcaagctacatcccgacaaaaagagcaggaaggaatttcaaggcaaattgcccattccataacgaaaaatctccctcattcgtaatttcccccgaaagacaaatttggcactgctttggatgccaaaaaggtggagacattttcactttcgttgaggaatatgagcgcgtagacttctcagaagccctaaagctactagctgaaaaggcaaatgtgaagcttaagaaaaatgtcttccgtacccaacaggatgagcgtaagaacaggatttatgaaataaatcaccttgcttcccagttctatcattatttattaacaaaacataagtcgggtaaagacgcccttaagtacgtgactgatacaagaggccttacgaatgccctcataaatacctatctcttagggtttgctcctcaccaaagctacgctcttactgattatctaatgaaaaagaaaggctataaaagagacgagctcctagaagccggtgtttcaacagaaagaggaggaagaatatatgacttctttcaaaataggattattttccctatccaagatgcacggggaaatatcattgctttttcaggtaggggacttacaccgnnagctatgcctaaatatataaatacaaaggaaacacctgtttatatcaagggagacacggtattgggcctatttcaagcaaaagaatccattaagaggaaagccaagtga

SEQ ID NO: 5162 - protein, 254 aa, Unknown
  Obtained from environmental sample
  DOMAIN (2)...(96): CHC2 zinc finger
  misc_feature (1)..(254): Xaa is any amino acid
MDDVDLIKQKIDIADLIASYIPTKRAGRNFKANCPFHNEKSPSFVISPERQIWHCFGCQKGGDIFTFVEEYERVDFSEALKLLAEKANVKLKKNVFRTQQDERKNRIYEINHLASQFYHYLLTKHKSGKDALKYVTDTRGLTNALINTYLLGFAPHQSYALTDYLMKKKGYKRDELLEAGVSTERGGRIYDFFQNRIIFPIQDARGNIIAFSGRGLTPXAMPKYINTKETPVYIKGDTVLGLFQAKESIKRKAK

SEQ ID NO: 5163 - DNA, 627 bp, Unknown
  Obtained from environmental sample
  misc_feature (1)..(627): n is a, c, g, or t
atggccagatggtggtgtagatatatttttaatctgggtaatgattgttacacagacaacggcacttttgtaatgaagtctgaaaaagctattttggtaggcactatgacaaagtataaagaaacagagatggataacatnccnaattgttggagtaggttaagggcaggcgctgtgtctgcttttttcaaatttgtttcattaagtgaaattgctaatcaaactattgaattaggaaagttatgttttgatttgagaaagttaataaaatccccctttgaagtattgaatcagaaattagtaaagaacttgaataaacccaatcattctctattaacccaaattgagacaataaagaaattaaaaggtcagattaaaatagaagaattagcgtctctacattttactactgtgcgacaattagaacgaaactttaaagaacatcttggtataacgccaaaagagtttgtcaatcttgttcgatatcaaaatgcaatgaaggcaatagaacaacgtaagcccaatgaatccattctgtctattgcttttgattttggttattatgaccattcacatttaactaacgacttcaagcaatatattggttgtgccccaacatttatttaa

SEQ ID NO: 5164 - protein, 208 aa, Unknown
  Obtained from environmental sample
  DOMAIN (116)...(158): Bacterial regulatory helix-turn-helix proteins, AraC family
  misc_feature (1)..(208): Xaa is any amino acid
MARWWCRYIFNLGNDCYTDNGTFVMKSEKAILVGTMTKYKETEMDNXPNCWSRLRAGAVSAFFKFVSLSEIANQTIELGKLCFDLRKLIKSPFEVLNQKLVKNLNKPNHSLLTQIETIKKLKGQIKIEELASLHFTTVRQLERNFKEHLGITPKEFVNLVRYQNAMKAIEQRKPNESILSIAFDFGYYDHSHLTNDFKQYIGCAPTFI

SEQ ID NO: 5165 - DNA, 372 bp, Unknown; identical to SEQ ID NO: 105
  Obtained from environmental sample
  misc_feature (1)..(372): n is a, c, g, or t

SEQ ID NO: 5166 - protein, 123 aa, Unknown; identical to SEQ ID NO: 106
  Obtained from environmental sample
  DOMAIN (1)...(118): Penicillinase repressor
  misc_feature (1)..(123): Xaa is any amino acid

SEQ ID NO: 5167 - DNA, 681 bp, Unknown
  Obtained from environmental sample
  misc_feature (1)..(681): n is a, c, g, or t
atgtccaaatcaaaatttaataccgtaaaccccgatgatctggttgtaaaatacggcgccgatacattccgaatgtatgaaatgtttcttggccctatagaaatgagtaagccgtgggatccaaaaggtattgaaggtgttcaccggtttcttaagaaactctggcgtttattctttgatgaacaaaaaggtttaatcatttcgaatgatgctgctacaaatgcagaactaaaaatacttcataaaaccataaaaaagatagaagaagatacagagcgattttcttacaatactgcagtcagtgcttttatggtttgtgtaaatgagttgatggatctgaaatgtcacaaacgtgaaattttgcagccattaattattctacttactccttatgcgccacatatatcggaagaattgtggcatgtgttgggaaactttgataccatattagatgcaccttttccaaagcttgaagaaaaatacctggttgaaactacaaaggaatacccggtttctatcaatggcaaactgcgtacgcaactggttatggatttaaataccgatcaaaagcaagtggaagaaattattttgcaaaatcctgtggtgcaaaaatggcttgaaggaagaccaccaaagaaaattatttatgtaaaaggtaagatggtaaatgtggtaatttga

SEQ ID NO: 5168 - protein, 226 aa, Unknown
  Obtained from environmental sample
  misc_feature (1)..(226): Xaa is any amino acid
MSKSKFNTVNPDDLVVKYGADTFRMYEMFLGPIEMSKPWDPKGIEGVHRFLKKLWRLFFDEQKGLIISNDAATNAELKILHKTIKKIEEDTERFSYNTAVSAFMVCVNELMDLKCHKREILQPLIILLTPYAPHISEELWHVLGNFDTILDAPFPKLEEKYLVETTKEYPVSINGKLRTQLVMDLNTDQKQVEEIILQNPVVQKWLEGRPPKKIIYVKGKMVNVVI

SEQ ID NO: 5169 - DNA, 567 bp, Unknown
  Obtained from environmental sample
  misc_feature (1)..(567): n is a, c, g, or t
gtgccacggaggatggattgtattgattgtcataatcggcctgctcatatttatagagcgccttcacgtttggtcaatcttgaaatgagtaccagacgaattaaagcttctcttcctttcattaaaaagaacgctgtacaggttcttacaacggaatataaaactactccggaagcgatgaagaaaattgaatcttcaatgcttgaaatgtacaaagacttcggcgataaaaaattacttcaagatacgattaagcagattcaatggatttattctcaaaatattttcccggaaatgaaagtgtcatggaaatcatatccaaacaatattggccatacactgttccccggttgttatcggtgtcatgatggtcagcatgttagcgacgatgggaaggtgatctcgcatgattgtagcgcgtgtcatacaattatcgctcagggaagtggcgaacaagtgaaaacaatagcgccgacaggccttgagtttcaacatcctgttgatattggtgatatctggaaggaaatgaactgtgcagaatgtcacaccggcggtccaatggaatga

SEQ ID NO: 5170 - protein, 188 aa, Unknown
  Obtained from environmental sample
  misc_feature (1)..(188): Xaa is any amino acid
MPRRMDCIDCHNRPAHIYRAPSRLVNLEMSTRRIKASLPFIKKNAVQVLTTEYKTTPEAMKKIESSMLEMYKDFGDKKLLQDTIKQIQWIYSQNIFPEMKVSWKSYPNNIGHTLFPGCYRCHDGQHVSDDGKVISHDCSACHTIIAQGSGEQVKTIAPTGLEFQHPVDIGDIWKEMNCAECHTGGPME

SEQ ID NO: 5171 - DNA, 339 bp, Unknown
  Obtained from environmental sample
  misc_feature (1)..(339): n is a, c, g, or t
atgcctttttttatgagtctcaccctacgaacatctcttggttgcacagaagccgttattgacgatgacggcggattaaaaagattctatcaaatagccggaattttatctgacgattttgaagtaaattttaccaacaaagaagatgatttcgatgccatcaactggagttttttacttggtaactataagttaacattgcactatagtatctataatggtatttctattttccctacaaaaacgaaggatgcccgcaagaaagaaaatcatgcagtgattgaactggctaatgtgcttgaaggaaagttgatgaatattgacctcagaaaaatatag

SEQ ID NO: 5172 - protein, 112 aa, Unknown
  Obtained from environmental sample
  misc_feature (1)..(112): Xaa is any amino acid
MPFFMSLTLRTSLGCTEAVIDDDGGLKRFYQIAGILSDDFEVNFTNKEDDFDAINWSFLLGNYKLTLHYSIYNGISIFPTKTKDARKKENHAVIELANVLEGKLMNIDLRKI

SEQ ID NO: 5173 - DNA, 360 bp, Unknown
  Obtained from environmental sample
  misc_feature (1)..(360): n is a, c, g, or t
atgtatcagatgagtgtaaacatgctgattccggcatcgtcaaatgtagcaaatactgatttctttatcttccagtcgttccgtgataattcgagtcggtattgggcgaggaaacgcaatgtgtcatctacagacatgccaaaagcaattccgaaaactaaaatagtagaaggttttaagggaatgttcagaaagcccattaatccggcagtcatcaataacggcaatagattagggataattgaaaccagtaccattttgaaagaacggaacatgatggctaccaatcctgctgttaacccgaaagccatcagcaaagaggaaagcaaattgtccagtaggtattgtgttcctttatga

SEQ ID NO: 5174 - protein, 119 aa, Unknown
  Obtained from environmental sample
  misc_feature (1)..(119): Xaa is any amino acid
MYQMSVNMLIPASSNVANTDFFIFQSFRDNSSRYWARKRNVSSTDMPKAIPKTKIVEGFKGMFRKPINPAVINNGNRLGIIETSTILKERNMMATNPAVNPKAISKEESKLSSRYCVPL

SEQ ID NO: 5175 - DNA, 972 bp, Unknown
  Obtained from environmental sample
  misc_feature (1)..(972): n is a, c, g, or t
atggattgtcaattccgtaaagtacaccggcgtaagtgtttatatggtagccctttccttattgattataggaatgataggattccccgaatgagaatctcaggcagtattattgaggacatgcctaagaaaaccgactttttcagtgatatccgctttttcgagaaagaatttgacggcgttatgccactggaaatcatgattgacaccaaacgtaaaaaaggagtcatgaaactggccactntaaaacgcatggaagaactggaagagaccattctggaaatccccgaactgtccaaaccgctttcggtagtaaatctggttaaatattcaaaacaggcttattacaacaacaatcctgatttttatgaattgccaaccgcacaggaacagtcattcattttatcatatgccaaaaacgccacccagaactccaaagaaaacctaatgaagagttatgtggactccaccggtcaatatgcccggatcaccactttcatcaaagatgaaaacggagaaaaaatggaagccattgaagcacggatccgcgcaaaagccagcaaggtattcccttctccgcgttatgaagtgactattaccggaaaaccttccgtatttcataaaggaacacaatacctactggacaatttgctttcctctttgctgatggctttcgggttaacagcaggattggtagccatcatgttccgttctttcaaaatggtactggtttcaattatccctaatctattgccgttattgatgactgccggattaatgggctttctgaacattcccttaaaaccttctactattttagttttcggaattgcttttggcatgtctgtagatgacacattgcgtttcctcgcccaataccgactcgaattatcacggaacgactggaagataaagaaatcagtatttgctacatttgacgatgccggaatcagcatgtttacactcatctga

SEQ ID NO: 5176 - protein, 323 aa, Unknown
  Obtained from environmental sample
  misc_feature (1)..(323): Xaa is any amino acid
MDCQFRKVHRRKCLYGSPFLIDYRNDRIPRMRISGSIIEDMPKKTDFFSDIRFFEKEFDGVMPLEIMIDTKRKKGVMKLATXKRMEELEETILEIPELSKPLSVVNLVKYSKQAYYNNNPDFYELPTAQEQSFILSYAKNATQNSKENLMKSYVDSTGQYARITTFIKDENGEKMEAIEARIRAKASKVFPSPRYEVTITGKPSVFHKGTQYLLDNLLSSLLMAFGLTAGLVAIMFRSFKMVLVSIIPNLLPLLMTAGLMGFLNIPLKPSTILVFGIAFGMSVDDTLRFLAQYRLELSRNDWKIKKSVFATFDDAGISMFTLI

SEQ ID NO: 5177 - DNA, 981 bp, Unknown
  Obtained from environmental sample
  misc_feature (1)..(981): n is a, c, g, or t
atgagatcgggtcgtcgatggcttttaattggtgaacaaccccaaaattttagcctgaaagatagagggataacaattatccaggaaaaagataatgattcactcgatgacctcgatgggattatttttgcagagaattttaattcaatacagactgaggatattgattctcatattgatctacaaaagaatactttgaaaaaaatattggttttgattaaatccttaaaggatagagccattaaaccaaggcttatcttcctaacgaccaacaacataacagaacatagcaaagacactatgaatcttgatagtggtcctttaaaaggattctgcaaaaccctatgtttagagctacctcaatatcaaaccatcctcattgatgtggatacaaataatgaagataatatagcagaacaagtcattgatgaaatgaactataatcatggtcaatactacgaacatatcgtttcatatcgtgagggaaagcgactggtttcgcgtttaaaaaaggccctcttacctaagaaaaaagaattacttcatgccgaaggacgttatcttataacgggtggttgtggtggtctaggtttagtcacttcggaagccttactatcagctggtgcaagagagttagttcttgtctcacgaactgttgatgaaccttcaatcatagtcaatatcaagaaattacaatcgaattaccctgatcggattattcgtctggttagtttggatgtttctgataaagtcgccctgcacaagctcttattagagatcaatgaggatggtttattaaagggtattattcatgctgccggcgcanacattaataaaccattacttcaacatcaagatcaagacattgaccatttattttctgctaaagtaaagggcggttggtatttacatgaactgacccaggattacgatctggatttttttgtcgtttactcttccatttccttcagtatttggtaa

SEQ ID NO: 5178 - protein, 326 aa, Unknown
  Obtained from environmental sample
  misc_feature (1)..(326): Xaa is any amino acid
MRSGRRWLLIGEQPQNFSLKDRGITIIQEKDNDSLDDLDGIIFAENFNSIQTEDIDSHIDLQKNTLKKILVLIKSLKDRAIKPRLIFLTTNNITEHSKDTMNLDSGPLKGFCKTLCLELPQYQTILIDVDTNNEDNIAEQVIDEMNYNHGQYYEHIVSYREGKRLVSRLKKALLPKKKELLHAEGRYLITGGCGGLGLVTSEALLSAGARELVLVSRTVDEPSIIVNIKKLQSNYPDRIIRLVSLDVSDKVALHKLLLEINEDGLLKGIIHAAGAXINKPLLQHQDQDIDHLFSAKVKGGWYLHELTQDYDLDFFVVYSSISFSIW

SEQ ID NO: 5179 - DNA, 342 bp, Unknown
  Obtained from environmental sample
  misc_feature (1)..(342): n is a, c, g, or t
gtgatctacacgagtagagaattgaaagttggaacagatactgaaagcagtttgaggattcatagtgtggtttcgacatttctagtagaaattgttaatggcattaaaataagaccctcctttatcatcgccaagggtggtattacatccagcgacttggcctccaagggactttcatcaaaatcagcgttgatactcggacaagcgattgcgggtgtgccgatctggaagctggacttggaaagcaaatttccggaaatggtctatatagtctttcccggaaacgttggcgatgaggctgcgctctggaatgtttggaataaattcaaatctcctgcataa

SEQ ID NO: 5180 - protein, 113 aa, Unknown
  Obtained from environmental sample
  misc_feature (1)..(113): Xaa is any amino acid
MIYTSRELKVGTDTESSLRIHSVVSTFLVEIVNGIKIRPSFIIAKGGITSSDLASKGLSSKSALILGQAIAGVPIWKLDLESKFPEMVYIVFPGNVGDEAALWNVWNKFKSPA

SEQ ID NO: 5181 - DNA, 702 bp, Unknown
  Obtained from environmental sample
  misc_feature (1)..(702): n is a, c, g, or t
atggaattgctgggccaatatgtgggagagtatgccaagatttttcagatggtggatgagctaaaacagagcgtggccgacggaaatttgcctagaacaaaggccataattaaggccattgaagaatttgaaaaagagatccaattaagccaggtggtcaaagacacggataatttattaaagcacaatcaaaaagggatcgagcgtatccagaaaatcgtcatggatttgcggacatttgcacgggaagataatgaagtgatcgaattggtaaaggtcgaagaggtcattgacagtattttaagcattgtccataacgaagtgaaatataaggctgaattaaaaaaatactatgggaagacccccttgattagatgcaatccgcaacgattggggcaagtttttatcaatctgcttgtgaatgccacccatgccattgaggaaaaaggcattattgaaataaagacctatcaatacggggactatctgtgcattgatattagagatacgggaaaaggcattccgcctgaaaatttaaaaaagatattcgatgcttttttcacaaccaaaccgattggtcaggggacagggttagggttaagcgtcagttacgagattgttaagaaacgcgggggagatattaaggtgaaatcaaagctgggggaaggaacgaccttcacggtgatgttgcctgtagtttaa

SEQ ID NO: 5182 - protein, 233 aa, Unknown
  Obtained from environmental sample
  DOMAIN (126)...(233): Histidine kinase-, DNA gyrase B-, and HSP90-like ATPase
  misc_feature (1)..(233): Xaa is any amino acid
MELLGQYVGEYAKIFQMVDELKQSVADGNLPRTKAIIKAIEEFEKEIQLSQVVKDTDNLLKHNQKGIERIQKIVMDLRTFAREDNEVIELVKVEEVIDSILSIVHNEVKYKAELKKYYGKTPLIRCNPQRLGQVFINLLVNATHAIEEKGIIEIKTYQYGDYLCIDIRDTGKGIPPENLKKIFDAFFTTKPIGQGTGLGLSVSYEIVKKRGGDIKVKSKLGEGTTFTVMLPVV

SEQ ID NO: 5183 - DNA, 489 bp, Unknown
  Obtained from environmental sample
  misc_feature (1)..(489): n is a, c, g, or t
ttggttgcttctgcatttatccctaacccgaataatctgcctatggttaaccactgtgacggaaatccaggcaataacattttatctaatcttgaatggtgtacaagttcagaaaacgagtaccataaaattcatacgcttaacaagaagccagccgttcaaaactttaaatacgttaagcatacggacgaagtattgagatttaacgataaaaatattttcggcgaaaaactacagtcattattaaaaaggtttttatcaggtgaaaggatttgcggcaatcaatttcctcctgaagaaatacaatctttttactctaccgtttctgaattaagaaatcgttttggagttccaattttatcagtaagaagaaaggggttgcctagttacaaagattactacatagaccttaaagattttcacggaatagaaattaagacagaaaaacaaaaaggcggctttaaaacttactttatttctaatgactga

SEQ ID NO: 5184 - protein, 162 aa, Unknown
  Obtained from environmental sample
  misc_feature (1)..(162): Xaa is any amino acid
MVASAFIPNPNNLPMVNHCDGNPGNNILSNLEWCTSSENEYHKIHTLNKKPAVQNFKYVKHTDEVLRFNDKNIFGEKLQSLLKRFLSGERICGNQFPPEEIQSFYSTVSELRNRFGVPILSVRRKGLPSYKDYYIDLKDFHGIEIKTEKQKGGFKTYFISND

SEQ ID NO: 5185 - DNA, 1032 bp, Unknown
  Obtained from environmental sample
  misc_feature (1)..(1032): n is a, c, g, or t
ttgcagactttacaggatcttgccaactatcacagaaaaacatttaccattccttttttaggaataaccgggagcaacgggaaaacaacaagtaaagagcttatcaatgcagtgctctccaaaaaattcaatacgcttgcaacggaaggaaacctcaacaatcatattggtgttccacttactttacttaagatcacaaacgaacatgagtttgccataatcgaaatgggggcaaatcatcagggggaaattgatatgctttgtaaaattgcagagcctgactatggggtgatcacaaacattggaaaagctcacctggaaggatttggaggaattgaaggagtaaaaaaagggaaaagcgaactatataaatacattgcatcaaaatcgggtaagatctttttacatggtgatgatgagatacttcaggacctgagtgtggggaatgacaaaataacttacggaacgaaaaaattatacgatgtggttggaaagatcaacgcttcctccgaacaggttgaatttgcatggaaaacccgatacacggctcctgatctcgcaaaaactccttttattaaaacgcacctgataggagtttacaattatcataatcttttatgcgctgcatgcattggaaattatttcaaaatcgccgaagaagcaattaatgatgcgctcgcaaattacaagcctaccaacaacagatcacagcttgaacataccgctaacaacaagttgatcctggattattacaacgctaatccaacaagcatgcgggcagccatcgagaacttgccaacatcgaagcccgtaacaaaatgctcattctgggtgatatgctggagcttggtgaggacgcaaaaaaagacatcagcagattgtggaactgcctcacgaaaaaaaactggatcattattttctggttggaccaaatcctcagtagtggtacctatggataaacatttcaaaaaattcagaagatgcagctctttttctttgcggggaaaaagtaaaaaaagaaaaccatcctaa

SEQ ID NO: 5186 - protein, 343 aa, Unknown
  Obtained from environmental sample
  DOMAIN (1)...(223): Mur ligase family, catalytic domain
  misc_feature (1)..(343): Xaa is any amino acid
MQTLQDLANYHRKTFTIPFLGITGSNGKTTSKELINAVLSKKFNTLATEGNLNNHIGVPLTLLKITNEHEFAIIEMGANHQGEIDMLCKIAEPDYGVITNIGKAHLEGFGGIEGVKKGKSELYKYIASKSGKIFLHGDDEILQDLSVGNDKITYGTKKLYDVVGKINASSEQVEFAWKTRYTAPDLAKTPFIKTHLIGVYNYHNLLCAACIGNYFKIAEEAINDALANYKPTNNRSQLEHTANNKLILDYYNANPTSMRAAIENLPTSKPVTKCSFWVICWSLVRTQKKTSADCGTASRKKTGSLFSGWTKSSVVVPMDKHFKKFRRCSSFSLRGKSKKRKPS

SEQ ID NO: 5187 - DNA, 372 bp, Unknown
  Obtained from environmental sample
  misc_feature (1)..(372): n is a, c, g, or t
ttcaaaggggggatcttttttgttagccataagcttatcaaaagcccccaaagaagttcggctgttaactttcttcatgtcctgaccgaccttctcaagaccatcttcattaacaccataattcttacggggataattagctgtgatgtctggaagatcgtcatcgtatcacgcttcggatcccagcccatattaaggcctttagggtccctcagttttaaagtaattcacgtattcaaaaaagcggttcgcaaacattgtataataattaactgtgttgttagctcctttgaccataatgaagctaatgttcgggaaataagaagcacgattgccttcacctttaacgatttctttgctcatgaaaagtga

SEQ ID NO: 5188 - protein, 123 aa, Unknown
  Obtained from environmental sample
  misc_feature (1)..(123): Xaa is any amino acid
MKGGIFFVSHKLIKSPQRSSAVNFLHVLTDLLKTIFINTIILTGIISCDVWKIVIVSRFGSQPILRPLGSLSFKVIHVFKKAVRKHCIIINCVVSSFDHNEANVREIRSTIAFTFNDFFAHEK

SEQ ID NO: 5189 - DNA, 636 bp, Unknown
  Obtained from environmental sample
  misc_feature (1)..(636): n is a, c, g, or t
ttggnnccccatgtacagatgatgaaggaaatacgtgaaatgataaactatgccactcttgcaatacccatcatggcagtattggctattggcggagtaattagtttttttgttgcatattccttctatcccgaaaaacatgaaaatataaaaattgacggcaaatgctacgaattggtggatgcggctcatgagaaaattacggccctaaatgcagaaatgaaaataaaaaaaatgttgcttcagataagtaaagtggaacccccaaatgcaagaataccaataattttcaatggaaaagattctgaagttaacaatttcaaaaatacttataatctaacggtaacttcaaatcaaaaagtaatgtattttcccaaaattaacggaagtgttgttactgcagatattaccaaaccagatttgctaaaaattgttgaacacttaagtctgtttgatgtctttccatcatcaaaatccgtagttggaagcataggcattcaaccaaataaatatacatctccttctgaggagaagaatgtttctctagaactggacaaactcatgaaaaataagttgagacaaatcattgatacatcagagggtgtagaatcagcagaatgtagaaacgatacatag

SEQ ID NO: 5190 - protein, 211 aa, Unknown
  Obtained from environmental sample
  misc_feature (1)..(211): Xaa is any amino acid
MXPHVQMMKEIREMINYATLAIPIMAVLAIGGVISFFVAYSFYPEKHENIKIDGKCYELVDAAHEKITALNAEMKIKKMLLQISKVEPPNARIPIIFNGKDSEVNNFKNTYNLTVTSNQKVMYFPKINGSVVTADITKPDLLKIVEHLSLFDVFPSSKSVVGSIGIQPNKYTSPSEEKNVSLELDKLMKNKLRQIIDTSEGVESAECRNDT

SEQ ID NO: 5191 - DNA, 690 bp, Unknown
  Obtained from environmental sample
  misc_feature (1)..(690): n is a, c, g, or t
atggccgtattgaattacccctccatacaaccctttctcaattttctgaagtttgaaaaaagatattccccgcatacgctgacatcttacgaaactgatttggtttcattcattgattacctggaaatacaatacggggagacgcagctttctgaaatttcacatatttatataaggagctggctcgccttactaaaagaaaaaggccttacagccaaatcgcttaaccggaagatctccacgctcaaatcttttttcaaatttgaattgaaggaaggcaggatacaatcaagcccgatgctacaggtgattagtcccaaatcaggtaaacgcttacccttatttattaaagaagaagaaacgagggagatggtagatatgctgaatgtagccgcagaggactggaacatgctgaatgctaaaatgctcgtcaccattttttatgcaacaggaatgcggttaagtgagttgataggattaaaggaaaaacaggtggacctcgcggggtcgagaatcaggatccttggtaaaggaaataaagagagaatagtacctgtcagtgcggaggtggtatccctgatcagggattattgccattttaagaaaaaagaaattggtgcggagggcgagaaactgctggtaacggggaaggggaaaaaattatatccaaataccccaatttgctggtaa

SEQ ID NO: 5192 - protein, 229 aa, Unknown
  Obtained from environmental sample
  DOMAIN (9)...(94): Phage integrase, N-terminal SAM-like domain
  misc_feature (1)..(229): Xaa is any amino acid
MAVLNYPSIQPFLNFLKFEKRYSPHTLTSYETDLVSFIDYLEIQYGETQLSEISHIYIRSWLALLKEKGLTAKSLNRKISTLKSFFKFELKEGRIQSSPMLQVISPKSGKRLPLFIKEEETREMVDMLNVAAEDWNMLNAKMLVTIFYATGMRLSELIGLKEKQVDLAGSRIRILGKGNKERIVPVSAEVVSLIRDYCHFKKKEIGAEGEKLLVTGKGKKLYPNTPICW

SEQ ID NO: 5193 - DNA, 351 bp, Unknown
  Obtained from environmental sample
  misc_feature (1)..(351): n is a, c, g, or t
ttgaataagcaagcctgctctcttcactgcattttgctgaagaaaagcaggagaaaagttctttatttattgtttcacttaaataagatcactatgaacgtaaaaattcaatcagttcatttcgatgctgacagtaagttgatcgagtatgttaccaaaaaactggagaagctggaagtttttaacggccgcattgtccaggtgagtgtttttttaaaactcgataacgtagttcatactattaaagacaaaatcgccgagataagggtacatatcccccggcacaatttttttgtaaaatcaaccagtaaatcatttgaagaatcttttgacgatgcgtggaaacaatga

SEQ ID NO: 5194 - protein, 116 aa, Unknown
  Obtained from environmental sample
  misc_feature (1)..(116): Xaa is any amino acid
MNKQACSLHCILLKKSRRKVLYLLFHLNKITMNVKIQSVHFDADSKLIEYVTKKLEKLEVFNGRIVQVSVFLKLDNVVHTIKDKIAEIRVHIPRHNFFVKSTSKSFEESFDDAWKQ

SEQ ID NO: 5195 - DNA, 975 bp, Unknown
  Obtained from environmental sample
  misc_feature (1)..(975): n is a, c, g, or t
atgagaataggtatagaagctcaacgaattttacgaccaaaaaaacatggaatggatgtggtggcattggaattgatcaagaagctccagcaaattgacgaagaaaacaaatattatgtttttgccagaaaagatgaggatgaatatgctattaatgagacaagtaattttaaagtcgaaaaattttcatccttatcttattttgactgggagcaaattaagcttagaaaagcagtaaggaatcagaatatagaacttttgcattgtaccgcgaatacagcaccgctgtcaatgcatatccctcttattgtcaccatacacgatataatctatcttgagaatcttgattttaagggaaccacctatcaaaatttggggaatttatacaggagattcttagtgccgagaattgcaaaaaaggctgatttagttttaacagtatcaaactatgaaagagaaaatattatagagcgtttaaagcttgcggaaaataaggtacaggttttatacaatggcgtgagtgaaaagtttagtgtaaagtttagcttggaagaactaaataaatttcgagaaaaacataatctaccgggaaagtatatcatgtttttgggaaatactgcgcctaaaaagaataccgtaaatgttataaaagcatatgtagactattgtctgtcggaaaacgatgctgtaccaatagtattgttagactataaaaaagagctggttgcaaaactcttaaaagagttaggacacgagcatttgattaataagtttgtttttcctggctatgtggcacacaatgagatccctttaatatatagttcctcgtgcctttttttatatccatctttaagagaaaagcttgngttgccnattttagnagcgatggcgtgtggcacaccagtcattacatctaatacatcatctatgcctgaaatagctggtgatgcagctattcagatcgatcccttttaa

SEQ ID NO: 5196 - protein, 324 aa, Unknown
  Obtained from environmental sample
  DOMAIN (184)...(324): Glycosyl transferases group 1
  misc_feature (1)..(324): Xaa is any amino acid
MRIGIEAQRILRPKKHGMDVVALELIKKLQQIDEENKYYVFARKDEDEYAINETSNFKVEKFSSLSYFDWEQIKLRKAVRNQNIELLHCTANTAPLSMHIPLIVTIHDIIYLENLDFKGTTYQNLGNLYRRFLVPRIAKKADLVLTVSNYERENIIERLKLAENKVQVLYNGVSEKFSVKFSLEELNKFREKHNLPGKYIMFLGNTAPKKNTVNVIKAYVDYCLSENDAVPIVLLDYKKELVAKLLKELGHEHLINKFVFPGYVAHNEIPLIYSSSCLFLYPSLREKLXLPILXAMACGTPVITSNTSSMPEIAGDAAIQIDPF

SEQ ID NO: 5197 - DNA, 543 bp, Unknown
  Obtained from environmental sample
  misc_feature (1)..(543): n is a, c, g, or t
ttgcaaaaattgacaaccatgaatcccgattttcaaaaagttttcgatatgctggaacgccagcgcttagctattctccatgatgttcaacatgtttcgatagaaaaatataatcatgctcctgtggccggaaaatggtctcttggtcagattttgacgcacattcttactgctgaaaaattatcgatcgcttacatgaaaaaaaaatacctgggtgccgaccaagttggtaattcaggagttattacatccttacgcttaggtctgctcattatttcgcaacgaattcctgcattaaaatttaatgcacccaaagtagtggtagaaaatactccacccgttctttccttacaagaattatcagaaaaatggaatgcgcagcgagcagatctaaaattattcttagagggaatggatgaaaaaaattataaaaaattaatctacaagcatcctattgccggcagactggatgctagacaggcaatggtattttttggagagcacatcattcatcacatgccgcaaatcaaacggctattatag

SEQ ID NO: 5198 - protein, 180 aa, Unknown
  Obtained from environmental sample
  misc_feature (1)..(180): Xaa is any amino acid
MQKLTTMNPDFQKVFDMLERQRLAILHDVQHVSIEKYNHAPVAGKWSLGQILTHILTAEKLSIAYMKKKYLGADQVGNSGVITSLRLGLLIISQRIPALKFNAPKVVVENTPPVLSLQELSEKWNAQRADLKLFLEGMDEKNYKKLIYKHPIAGRLDARQAMVFFGEHIIHHMPQIKRLL

SEQ ID NO: 5199 - DNA, 375 bp, Unknown
  Obtained from environmental sample
  misc_feature (1)..(375): n is a, c, g, or t
ttgaaatggaataatcctgcagtgatctacgagatcatcaaagcgtatgaattcacggaaagacaggtggaggaattattcaaactcgctgccagtgattcaggaaagtatatcacttcgcccggaaacaaataccggatcatcaggcatcgccatttgttcattattaccccggtgtctggtgcaggtacagaaacaatcatcatcgaaaaaaacgaccgtgaagtttcatttggagaatattcgttgctattagaaacaaaaaaaaatagcggtaccattattcccggtgttgatacagttgcttgtcttgatagcagtgctattaagtatccattgctcttacgtaaatggaagacttccgattatttctaa

SEQ ID NO: 5200 - protein, 124 aa, Unknown
  Obtained from environmental sample
  misc_feature (1)..(124): Xaa is any amino acid
MKWNNPAVIYEIIKAYEFTERQVEELFKLAASDSGKYITSPGNKYRIIRHRHLFIITPVSGAGTETIIIEKNDREVSFGEYSLLLETKKNSGTIIPGVDTVACLDSSAIKYPLLLRKWKTSDYF

SEQ ID NO: 5201 - DNA, 417 bp, Unknown
  Obtained from environmental sample
  misc_feature (1)..(417): n is a, c, g, or t
ttgcaaaaatctgatattcaggggatctggtcgatgggcaatggttcaataaagatcggaattattgccgatggaaataaccgctataaaggagttgttctgaagcaaacctcccttcttgatgttggtcatatcttacttgaattgcagaggaaaagcgataatttattcgaatgtgtctttcatgcaggccttctcggatttaatttcaaagatgtctacacaacttcagaaatacggaatgggcgttttcctgaattcggtttgtcaaaaaaaggagaggtgacaggttatgatgaaaaaccatataagttcaccgaacttgacagtgtgacaaattatatccgtttaaaatcattcgacaggagcctgagcggtcaatataacgtattctatgattcattcttgatccactag

SEQ ID NO: 5202 - protein, 138 aa, Unknown
  Obtained from environmental sample
  misc_feature (1)..(138): Xaa is any amino acid
MQKSDIQGIWSMGNGSIKIGIIADGNNRYKGVVLKQTSLLDVGHILLELQRKSDNLFECVFHAGLLGFNFKDVYTTSEIRNGRFPEFGLSKKGEVTGYDEKPYKFTELDSVTNYIRLKSFDRSLSGQYNVFYDSFLIH

SEQ ID NO: 5203 - DNA, 423 bp, Unknown; identical to SEQ ID NO: 2425
  Obtained from environmental sample
  misc_feature (1)..(423): n is a, c, g, or t

SEQ ID NO: 5204 - protein, 140 aa, Unknown; identical to SEQ ID NO: 2426
  Obtained from environmental sample
  misc_feature (1)..(140): Xaa is any amino acid

SEQ ID NO: 5205 - DNA, 612 bp, Unknown
  Obtained from environmental sample
  misc_feature (1)..(612): n is a, c, g, or t
atgagcacaaacaattttcagcaacacactcattgcctcatcagcggttctggtaaattaaaaccgcttaaaggatacgaaaataaattcttggtgaaaagccctgttggctttgtcttttgctcccgtatccccacggaagatgaattaactcatcattataatacaatctatccgcgaaacgattacctgtcacccatcactgttaaacgatataatgaattgctgaatgattttgaaccttacagaaaaaccggcaggttgctggatgtcgggtgtggcgttggttattttttgattgaagcaaaaaaaagaggttgggacgtgtacggcactgaataccctgatgacgccatccgcatatgtgaaaaaagcggcatcaaaaccaaaaaaggcacattagatgttgcatggtatgaaaacgaaaggtttgatatcgttacttcctttgaattgattgaacctatctataatccccgggggaagtgccactataaaccagtactgacaaagaggttatctatttactaccccaatttatgccatgaagatctttcacgccgatatctgtgtcaaacggacttgtctatatcaaaaacctctattttcngg

SEQ ID NO: 5206 - protein, 204 aa, Unknown
  Obtained from environmental sample
  misc_feature (1)..(204): Xaa is any amino acid
MSTNNFQQHTHCLISGSGKLKPLKGYENKFLVKSPVGFVFCSRIPTEDELTHHYNTIYPRNDYLSPITVKRYNELLNDFEPYRKTGRLLDVGCGVGYFLIEAKKRGWDVYGTEYPDDAIRICEKSGIKTKKGTLDVAWYENERFDIVTSFELIEPIYNPRGKCHYKPVLTKRLSIYYPNLCHEDLSRRYLCQTDLSISKTSIFX

SEQ ID NO: 5207 - DNA, 462 bp, Unknown
  Obtained from environmental sample
  misc_feature (1)..(462): n is a, c, g, or t
atgctgcttgctgaaaaagcagacgcctttaattaccgtttacttgaaatacccaaatacattctgcaggaagttgccgtcagctcaacccaaataaggaatgctttattgaaaagcgacattgatacggccggaaaattattaggctatgatttcttttttgagggccttgtaattggaggcgacaagctgggaagaaaactgggctatccaacggcaaatctcgaatacactgatgctgataaaattcatttgggacatggtgtatatgcggcttatgcagaagtgaacagaaccaaatacaaaggcctgttgagcattggcaacaggccaacacttaaaaattcagatgaccgggttgaagtaaccattgtgaatttgataaggagattatggagaaaccatcaaagtgacggtaaaaaaatatttacgcggccaggaaagatttcctcggtagattng

SEQ ID NO: 5208 - protein, 154 aa, Unknown
  Obtained from environmental sample
  DOMAIN (47)...(144): Riboflavin kinase / FAD synthetase
  misc_feature (1)..(154): Xaa is any amino acid
MLLAEKADAFNYRLLEIPKYILQEVAVSSTQIRNALLKSDIDTAGKLLGYDFFFEGLVIGGDKLGRKLGYPTANLEYTDADKIHLGHGVYAAYAEVNRTKYKGLLSIGNRPTLKNSDDRVEVTIVNLIRRLWRNHQSDGKKIFTRPGKISSVDX

SEQ ID NO: 5209 - DNA, 957 bp, Unknown
  Obtained from environmental sample
  misc_feature (1)..(957): n is a, c, g, or t
atgcaggaaagtgaagaacgtttccgcaatctttacagaagtgctaaagttggactttacagaactacaccttccggaaaaattcttatggcaaataatgaattggttaaaatgctgggttatgcttcgtttgagcaccttgctgaacgaaatattgagcaacagggttttggtccttcatatcccagaaaagaatttattgagaaaattgatcgagatggtgaaataaataattttgaatctacctggattcgtctggatggtactgctttctttgttcgtgaaaatgcacatacaattcgtgatgcgaatagtgatgttttgtattatgatggtgtggtagaagacattaccgaacgtaagctggctgaagagaaaataagaaaattatatactggtattgagcatagtcccgcttcggttgtaataacagatattaaaggtcacattgaatatgttaacgccaaattctgtgatattacaggttatgattacaacgaaattattggaaagaacccgaatattttgcaatcaggtgaaatgcctaaatcagaatacgaggaaatgtggaatataattctttccggtaatgactggcagggtgaattccataataaaaagaaaaatggagaactctactgggaatctgcatctatttctcctattaaaaacgaaaatggaatagtcactcatttcatcggaattaaggaggacattacagaaaagaaaaatatgattaacgaattgatccaggctaaagaaaaagcagaagagatgaatcgcttaagatctaactttcttgcaaatatgagttacgaattaagaacaccattagttggaatattaggatatgccgagataattcgtaacgaaaagggatcttctgaaattaaagtgatgggagaaattatttacaaaagcggtaatagatcatcggaaaccttaaacttaatttag

SEQ ID NO: 5210 - protein, 318 aa, Unknown
  Obtained from environmental sample
  DOMAIN (262)...(318): His Kinase A (phosphoacceptor) domain
  misc_feature (1)..(318): Xaa is any amino acid
MQESEERFRNLYRSAKVGLYRTTPSGKILMANNELVKMLGYASFEHLAERNIEQQGFGPSYPRKEFIEKIDRDGEINNFESTWIRLDGTAFFVRENAHTIRDANSDVLYYDGVVEDITERKLAEEKIRKLYTGIEHSPASVVITDIKGHIEYVNAKFCDITGYDYNEIIGKNPNILQSGEMPKSEYEEMWNIILSGNDWQGEFHNKKKNGELYWESASISPIKNENGIVTHFIGIKEDITEKKNMINELIQAKEKAEEMNRLRSNFLANMSYELRTPLVGILGYAEIIRNEKGSSEIKVMGEIIYKSGNRSSETLNLI

SEQ ID NO: 5211 - DNA, 594 bp, Unknown
  Obtained from environmental sample
  misc_feature (1)..(594): n is a, c, g, or t
atgaaaggaaatttcaggacatttccggaccgtcaatatactatacggaataccattgagtggagcttcgatctactcgatccgaaagaacaaaacttattgcttcaaatcagtctgtaccatgcgggtgcattgttgaaaacgcttgaggcgtttgcagatcttggtgatgaactctatgagaccctcgatggattgatcaacaaaagcctgctcattaaacaggacgaagaattcaatgtgcgctttcaaatgctggaaactgtccgtgagttttcttttgaaaaaatcacctcgcagggtaatatggagcaaatgaggcaaatacaagctgattactatcatgcttcactcaaagacatgcgtcttcagaaaaataagatcgatcaggttgaacttttaaaatgccttgaaatagagcacaccaacatccggcttgcgctggatttcctgatgcataaaaaagagcttagaaaggtaaccgatatcgcgtggagcctctggttgttctggtgggtgaatgcacacaccaaagaagttacacctggctcaaaaagcctgggaagtgtaccacaacgaaaagcaattatttga

SEQ ID NO: 5212 - protein, 197 aa, Unknown
  Obtained from environmental sample
  misc_feature (1)..(197): Xaa is any amino acid
MKGNFRTFPDRQYTIRNTIEWSFDLLDPKEQNLLLQISLYHAGALLKTLEAFADLGDELYETLDGLINKSLLIKQDEEFNVRFQMLETVREFSFEKITSQGNMEQMRQIQADYYHASLKDMRLQKNKIDQVELLKCLEIEHTNIRLALDFLMHKKELRKVTDIAWSLWLFWWVNAHTKEVTPGSKSLGSVPQRKAII

SEQ ID NO: 5213 - DNA, 309 bp, Unknown
  Obtained from environmental sample
  misc_feature (1)..(309): n is a, c, g, or t
atgaaattggctatcgaaaattttgctaagaaaccagtcgaaaacaagatcatgctgcttggcgcgatggccgagttaggggtggaaagcctgcacgaacaccaggaaataattgatcttatcaacaactattcctggaaggaagttattcttgttggtggcgatttcctgaaactctcccaccctttcctttcatttgaaaattctttgaaagcaaaagaatggtttgctcaacaggatttccaaaacagttatatacttgtaaaaggaagtcgtagtacgcagatggaaaaggttttagaatcttaa

SEQ ID NO: 5214 - protein, 102 aa, Unknown
  Obtained from environmental sample
  misc_feature (1)..(102): Xaa is any amino acid
MKLAIENFAKKPVENKIMLLGAMAELGVESLHEHQEIIDLINNYSWKEVILVGGDFLKLSHPFLSFENSLKAKEWFAQQDFQNSYILVKGSRSTQMEKVLES

SEQ ID NO: 5215 - DNA, 333 bp, Unknown
  Obtained from environmental sample
  misc_feature (1)..(333): n is a, c, g, or t
ttgcaccatattcgaaaggcctgcataaaattgccgcaggcgccaaaatgtattatcaacaatgaatggtatctggtgtttctgggcgatttctgccagcctttcaaaatcaggaatgctgaaacccggattaccaatggtctctacataaatagctcttgtacggtcgttgatcttcgcttcgaaatctgccgggttatcaagatcggcgaacctcacttcgaagccaagccttttgaatgttactttaaagctggttatatgttcctccatacaggtacgatgaagacacaatattatctccagtttgtaaaatattctgtaaggctataa

SEQ ID NO: 5216 - protein, 110 aa, Unknown
  Obtained from environmental sample
  misc_feature (1)..(110): Xaa is any amino acid
MHHIRKACIKLPQAPKCIINNEWYLVFLGDFCQPFKIRNAETRITNGLYINSSCTVVDLRFEICRVIKIGEPHFEAKPFECYFKAGYMFLHTGTMKTQYYLQFVKYSVRL

SEQ ID NO: 5217 - DNA, 621 bp, Unknown
  Obtained from environmental sample
  misc_feature (1)..(621): n is a, c, g, or t
ttgagcggaattctgatcggcgatgctacccagtacaatcttttccaccagatggtggtgaataacatcccattgccggaacaaccagaatctcttatcgtaggcagttcctcaaaaaacgatactgagggcgccggaatcaaaaacctgcccgacgctgcgcaaatttgctcgtgcgaaaatgtattaaagggtgacctcgtttgccaaataaaagaccacggagctaagacagtcgacgaccttaaaaagaaaacgaaggcgtgcacgggttgcggcggttgtaccccaatggtaaacgatattctaaaactcacactggagtcgctgggacacagtattaagaaaacactttgtgaacactttgaattttcgcggcaggaattgttcgacatcattaaagttaaaggaataaaaacctatgatgcgcttttggatagtgttggcaagggcgacggatgtgaaatttgcaagccggcgatagcatcccttcttgcaagcatctggaacgagctcattgcagaacaagacactatccaggacaccaacgatcggtatcttgccaacatccaacgaggtggcacctactctgtcgtacacgcattgccggaggagaaataa

SEQ ID NO: 5218 - protein, 206 aa, Unknown
  Obtained from environmental sample
  DOMAIN (54)...(107): BFD-like [2Fe-2S] binding domain
  misc_feature (1)..(206): Xaa is any amino acid
MSGILIGDATQYNLFHQMVVNNIPLPEQPESLIVGSSSKNDTEGAGIKNLPDAAQICSCENVLKGDLVCQIKDHGAKTVDDLKKKTKACTGCGGCTPMVNDILKLTLESLGHSIKKTLCEHFEFSRQELFDIIKVKGIKTYDALLDSVGKGDGCEICKPAIASLLASIWNELIAEQDTIQDTNDRYLANIQRGGTYSVVHALPEEK

SEQ ID NO: 5219 - DNA, 954 bp, Unknown
  Obtained from environmental sample
  misc_feature (1)..(954): n is a, c, g, or t
ttgatgctgcgcttgagattgcctccgaatgaccctcgcagtcaacagatacgtgtactcaagaagctgctgaaaaaagcacgctttacagaattcggacagaaataccgctttgatgaatcgctattaagtaaacttcctgcaaagagcttccaggaaaacgtcccggttcatgattataacaagatatatggcgaatggtgggtaaagacactggaaggtgtacccgacgtgacctggcctgggaaaattaaatattacgcgctgagctcgggtacttcggaagcagcaagtaagtatatacccgtcacaaaagacatgctgcggagtaatacagtgaattatctccgtcaattattaagcctgctggcttatgaagaagcaaataagaaggcgatgacaaaaggcttcctcatgcttggaggcgccacagatcttaagaaaggtaaagcaggatggtacgcgggtgacctgagtgggattctggccaaaaaaagacctttctggttccagacattttataaacccggtggaagaatcgccgccattgctgactggaatcaaaaattgactgagatcgttgaacacgcaaaagaatgggacatcggttatattgtaggagttcccgcatggtgccagatgtgtatggaaatggtcatcgatcattacaaactaaagaacatccatgagatctggcctaatttcagcttcttcgttcacgggggcgttgcattcgaaccgtacaaaaaagggtttgaaaaattattaggtaaacccattgtgtatattgaaaattacctttccagtgaagggtttatcgggtacaaaacacgcgaacatgcacgcggcatgcagcttatcttaaataancatatcttttttgaattcatccctttcgatgataaaaattttgacagcgaaggaaatgtagttgaaaatcccgagcctgnatga

SEQ ID NO: 5220 - protein, 317 aa, Unknown
  Obtained from environmental sample
  misc_feature (1)..(317): Xaa is any amino acid
MMLRLRLPPNDPRSQQIRVLKKLLKKARFTEFGQKYRFDESLLSKLPAKSFQENVPVHDYNKIYGEWWVKTLEGVPDVTWPGKIKYYALSSGTSEAASKYIPVTKDMLRSNTVNYLRQLLSLLAYEEANKKAMTKGFLMLGGATDLKKGKAGWYAGDLSGILAKKRPFWFQTFYKPGGRIAAIADWNQKLTEIVEHAKEWDIGYIVGVPAWCQMCMEMVIDHYKLKNIHEIWPNFSFFVHGGVAFEPYKKGFEKLLGKPIVYIENYLSSEGFIGYKTREHARGMQLILNXHIFFEFIPFDDKNFDSEGNVVENPEPX

SEQ ID NO: 5221 - DNA, 765 bp, Unknown
  Obtained from environmental sample
  misc_feature (1)..(765): n is a, c, g, or t
ttgggtttgaatttcccgaaggtgggattcgttccttttattactagcaagcgaaaaaagcaagaccggctgcaggatttgaaaatgaataaggaattggtacggatcttttcattgcgcaggtcatttttatgttttactgaaatggatctacccttcccttaccatgacacagtttgtaagctgggtgagtggtcatggaatgaaacgggattatgtaaagggatcatccatttctccaacgcaaaacttgcggtgatcgccggtgaagaccagttgttccccgaccattcgggatttgactggaaaagcatcaaaaaagcgatgaattataataagaaaaaaccgggaagggtaagaggtgcaagtacgatcagccagcaggtcgcaaagaatgtatttctatggcaggggcgcagttttatcaggaaggggctcgaagtttattttacatttatgattgaaaaaatttggggtaaaaaacgcatcctggagatgtacatgaatgttgctgaaatgggtgagggcatatttgggatagagatggcgtcaaaaaaatatttcaacaagagtgcccatcaactaaaccggcaggagtccgccctgatcgcagcctgccttcctaatcccaaacgttataccgtaaaacctccatcgcgttatgtttcctttcgttcaaggaccattcagcgacagatgaataacctgcaatcggatcctgatatacgcaaacttgtttggagcgaggagaaaaaagctatttga

SEQ ID NO: 5222 - protein, 254 aa, Unknown
  Obtained from environmental sample
  DOMAIN (75)...(217): Transglycosylase
  misc_feature (1)..(254): Xaa is any amino acid
MGLNFPKVGFVPFITSKRKKQDRLQDLKMNKELVRIFSLRRSFLCFTEMDLPFPYHDTVCKLGEWSWNETGLCKGIIHFSNAKLAVIAGEDQLFPDHSGFDWKSIKKAMNYNKKKPGRVRGASTISQQVAKNVFLWQGRSFIRKGLEVYFTFMIEKIWGKKRILEMYMNVAEMGEGIFGIEMASKKYFNKSAHQLNRQESALIAACLPNPKRYTVKPPSRYVSFRSRTIQRQMNNLQSDPDIRKLVWSEEKKAI

SEQ ID NO: 5223 - DNA, 888 bp, Unknown
  Obtained from environmental sample
  misc_feature (1)..(888): n is a, c, g, or t
ttgattttcacttcatttatgtcaaaagaagccagcgctcgtatcaaaataaacaaactgctcgaagaaagcggctggcgtttctttgataatcaccagggcaaagccaacattgttttggaaagtaataccaagctttctcaatcccagttaaatgaattcggtgataattttgagaagactaaaaatggattccttgattatttattgcttgatgaaaaagggtttccattaattgtattggaagcgaagaaagaagaaattgagcctttatatgcaaaagaaaaatccaggcaatacgcccgctcacagaattgcagatttgttattctttcgaatgggaacctgcattacttttgggatcttgaaagaggaaaccccgttgtaatcacaacattcccaactccggaatctattcaaccctataaagcgctgaagcccaatcccgctcagctaattaacgaggacattgattcagattacattgtccggacgcaaaaccccaactattccaaggatcctcgctggaacgacttggcttctcgttctgaagtaatcaaacaaaatcagttaaaatttcttcggccatatcagataaaggcggttcaatcgattcaaaatgcagtagcgaatggaaatgagcgttttctttttgaaatggcaaccggcaccggaaaaacactaattgccggtgctgtcattcgtttatttctccggacaggaaatgcaaagcgtgttttatttttagttgacaggcttgaattggaagatcaggcttggaanaacttttgtaaatacctcaagaacgattttaaaatcgttatctatnaggaaagtaagaatgactggcgcccagcagaaatgttgttactaccgntcaatcgctaa

SEQ ID NO: 5224 - protein, 295 aa, Unknown
  Obtained from environmental sample
  DOMAIN (192)...(294): Type III restriction enzyme, res subunit
  misc_feature (1)..(295): Xaa is any amino acid
MIFTSFMSKEASARIKINKLLEESGWRFFDNHQGKANIVLESNTKLSQSQLNEFGDNFEKTKNGFLDYLLLDEKGFPLIVLEAKKEEIEPLYAKEKSRQYARSQNCRFVILSNGNLHYFWDLERGNPVVITTFPTPESIQPYKALKPNPAQLINEDIDSDYIVRTQNPNYSKDPRWNDLASRSEVIKQNQLKFLRPYQIKAVQSIQNAVANGNERFLFEMATGTGKTLIAGAVIRLFLRTGNAKRVLFLVDRLELEDQAWXNFCKYLKNDFKIVIYXESKNDWRPAEMLLLPXNR

SEQ ID NO: 5225 - DNA, 534 bp, Unknown
  Obtained from environmental sample
  misc_feature (1)..(534): n is a, c, g, or t
ttgancgagcaagcgatggattgggaaggaatgaaaatagacaggatgttttatgacaggtttgaagaaacagtgaagcaggatgaatttgcaaagcaacaatatgaagccgggaatattgaagttgtagaagaacacgtgcgaaaagaattattcgaaaagccagaagaatatttcaatatggataaattgcgcaaagctgttggcatcgaccggagaatttcattgcgggaaatcattgaaaaaatatttggtgggatatcctattttaaaagcaaagatgaattgctggaagaagaatttgaaaaatttgtttcaatttataagccggatggcaaatacatcgttccgattaagaatttcctgaaagcctacattaccgatccggaagtacgagatattgttgattcaggaaagtatcccttatttgcaacaaagccaatcaaggaagattttaaggcactcaataaccaatggcgccagatcatcccggaatatgtcaaggattatgttcctttaaacaagtttggctaa

SEQ ID NO: 5226 - protein, 177 aa, Unknown
  Obtained from environmental sample
  misc_feature (1)..(177): Xaa is any amino acid
MXEQAMDWEGMKIDRMFYDRFEETVKQDEFAKQQYEAGNIEVVEEHVRKELFEKPEEYFNMDKLRKAVGIDRRISLREIIEKIFGGISYFKSKDELLEEEFEKFVSIYKPDGKYIVPIKNFLKAYITDPEVRDIVDSGKYPLFATKPIKEDFKALNNQWRQIIPEYVKDYVPLNKFG

SEQ ID NO: 5227 - DNA, 681 bp, Unknown
  Obtained from environmental sample
  misc_feature (1)..(681): n is a, c, g, or t
atgagcaaacaacctacttacaagaaaattctggagcacccagataaagatgaaatcatttctaaactagttattggagtatcagcaagcgatatcaatgattggttaaaagcaaagtatactaatgtaagtgaggctaagtttgttctttctgagaagattatcaagtcatttcaagataattacctagatttctataatgatatgacgcaggacttagctaacgttaagactgctatgacagccaacactcaagatcagcttgatctagcagttaaaagtaatcctgcctataaggatgctttagttaaaattgcagaaaacgaattagatattgatttgattatggcaagaatggccatcaatattgaaacgcgtattagtcaaatttttgatatggttcaggaagatcctagaaatatcaatactaaaattgatcgattgctaaacgattatgctgagactttaggtaatttattggataagtatcataagtggaaggaagctcgcactcctgaccaaaatatccagcataacgtgactttacaggttgtagatcagcatattttcgtatttcatgatgtaatcaaaagagttttgtctcaaatggatttggagacctccatgtacttcatggaagtctttaatgaaaagatgtcccagctaaaaactacctgctga

SEQ ID NO: 5228 - protein, 226 aa, Unknown
  Obtained from environmental sample
  misc_feature (1)..(226): Xaa is any amino acid
MSKQPTYKKILEHPDKDEIISKLVIGVSASDINDWLKAKYTNVSEAKFVLSEKIIKSFQDNYLDFYNDMTQDLANVKTAMTANTQDQLDLAVKSNPAYKDALVKIAENELDIDLIMARMAINIETRISQIFDMVQEDPRNINTKIDRLLNDYAETLGNLLDKYHKWKEARTPDQNIQHNVTLQVVDQHIFVFHDVIKRVLSQMDLETSMYFMEVFNEKMSQLKTTC

SEQ ID NO: 5229 - DNA, 495 bp, Unknown
  Obtained from environmental sample
  misc_feature (1)..(495): n is a, c, g, or t
atgtcagaacagccaagaaacgataataagaaatccggaagtaattttcagaagccgcgaacgcccaaattcagttttaacttttactggatttatgcgctcgtgctttttgtaattattgcaatcagtctttttgatgacggcaaccgtccacaggaaactacatggagtaaattctcaacatgggttaaagaaggcgatattgataaggttgtagttgtgaatcgtgagattgtacatgtttacatcaaacgttcgagccttaacgaagaagatttcaaagcggtttcgcgaaagactttcggcaatggtgttaacgaaggcccgcattactcatttactatcggagatgtaggttcattcaagaaagatctggatgacgttcagaaagatctgcccgaaacaagccgtgtaaatatcatttataagaataacgagaattcttactgggatctcttatggacatggatgttcccgttctgctcgtattgttga

SEQ ID NO: 5230 - protein, 164 aa, Unknown
  Obtained from environmental sample
  misc_feature (1)..(164): Xaa is any amino acid
MSEQPRNDNKKSGSNFQKPRTPKFSFNFYWIYALVLFVIIAISLFDDGNRPQETTWSKFSTWVKEGDIDKVVVVNREIVHVYIKRSSLNEEDFKAVSRKTFGNGVNEGPHYSFTIGDVGSFKKDLDDVQKDLPETSRVNIIYKNNENSYWDLLWTWMFPFCSYC

SEQ ID NO: 5231 - DNA, 474 bp, Unknown
  Obtained from environmental sample
  misc_feature (1)..(474): n is a, c, g, or t
ttgagtgaggatctcactataagacaagctattgcggaagaggtgtcacaaaataaattggctgaatacgattgtattataattggaagttctgtttatttaggcaaattgttgataagcaaatggctggaaaaaaataaacccattttagtgaataaaaaactattcctgtttatagtatgtggaactaatcctgaagagaagcaaaagttaagaagcatagtacatgctggcgttcctgctgaaataagaaaccagtgtgagttgtattttttgcgtggaagaatagatgtcaagaaattgtcctggcttgataggttcataattggccttggttcaaaacttgctaaaacacaggaagaaaaagccatgttctccaattttgattttgtggataaaagtaatacagaaccattgttaagggctattcagaaatatcaaatccacgatagtaaatcttctttaatgcattaa

SEQ ID NO: 5232 - protein, 157 aa, Unknown
  Obtained from environmental sample
  misc_feature (1)..(157): Xaa is any amino acid
MSEDLTIRQAIAEEVSQNKLAEYDCIIIGSSVYLGKLLISKWLEKNKPILVNKKLFLFIVCGTNPEEKQKLRSIVHAGVPAEIRNQCELYFLRGRIDVKKLSWLDRFIIGLGSKLAKTQEEKAMFSNFDFVDKSNTEPLLRAIQKYQIHDSKSSLMH

SEQ ID NO: 5233 - DNA, 681 bp, Unknown
  Obtained from environmental sample
  misc_feature (1)..(681): n is a, c, g, or t
atggaaaagataatattggcattaaacagtaaccaactaaattattcagttgttgaatttgcttactatacagccaaacttactggttcaaaactgacaggtattttcatggaagctcctgtttatgagcctgtaacagaaagtgaggaaatacaggataactcgggtaaacttaataagcctgttttaattaaagcaaaacaagtgactctggatacagaaaaaggtatgcactactttaaggaagcttgtaccaaagaaaaagttcgttatgaagttttccaaagtgaaggctcctctgctgaagatgtcatttttgaaagccgttttgccgacctgctgatcattgatgtcgaaactgctgtaggtaacaataacgaaagttctcaatttgcaaaagagatacttgccagggcagagtgcccggtcatccttcctccaatatcatttaaaggaattgatgaaattattttttgctatgatggaagccggtcttcagtgtttgcaatgaagcaatttacttatctatttcctcaatatgaagataaaaaagtaactgttctcgaagtgaatgaagaaggagtttcatctatttatgaaaaagataaagttcgcgacttgttgaaaggtcattattctcaaattggcttttatgtagcaaatggtgatcctaccatttga

SEQ ID NO: 5234 - protein, 226 aa, Unknown
  Obtained from environmental sample
  misc_feature (1)..(226): Xaa is any amino acid
MEKIILALNSNQLNYSVVEFAYYTAKLTGSKLTGIFMEAPVYEPVTESEEIQDNSGKLNKPVLIKAKQVTLDTEKGMHYFKEACTKEKVRYEVFQSEGSSAEDVIFESRFADLLIIDVETAVGNNNESSQFAKEILARAECPVILPPISFKGIDEIIFCYDGSRSSVFAMKQFTYLFPQYEDKKVTVLEVNEEGVSSIYEKDKVRDLLKGHYSQIGFYVANGDPTI

SEQ ID NO: 5235 - DNA, 735 bp, Unknown
  Obtained from environmental sample
  misc_feature (1)..(735): n is a, c, g, or t
atgcagggctcttctctcgtacctgtaatcatcgcccttctgacaactaaagaggtacacgattcctataattcaaaattcataaaaggattcgtcggcgcctgcacggcagtttggtttatcctgatactccctttccaattcatgccgtccagattcatgtacgaaactgataagagtaaattaaattacaaagagctgattgatgtacaatttgcccgatatgcaataggcgatcagaatgaaaatggcgtgctgaaacaatttttctctccgactcaactcaatataattaaaacactgaacagggataaagaagcaagagttttgaatgtatcaaccttcctgaattattttattgaaaataatgatagaagggtttttaaggataaccagctgggaatattcaacgatatttatttccatgcgaataacgaccggaaacaatttgctaaagaattaaaaaagaataaaattaaatatatattggtcagtctgaagacggcttcgatagaccgtactccggataaatctctcaccaggaagttcgacaacctgatgagggccatggtgaataatccggaagttcaactcttgtatactaacagaattgttgaaagacctgacggagacatgcaattaacgaaagatggtcttacagtaactgctaaatatgatgttgtaggaaaacgagtgctggatccgggtacggatgcattatttgaaatattataa

SEQ ID NO: 5236 - protein, 244 aa, Unknown
  Obtained from environmental sample
  misc_feature (1)..(244): Xaa is any amino acid
MQGSSLVPVIIALLTTKEVHDSYNSKFIKGFVGACTAVWFILILPFQFMPSRFMYETDKSKLNYKELIDVQFARYAIGDQNENGVLKQFFSPTQLNIIKTLNRDKEARVLNVSTFLNYFIENNDRRVFKDNQLGIFNDIYFHANNDRKQFAKELKKNKIKYILVSLKTASIDRTPDKSLTRKFDNLMRAMVNNPEVQLLYTNRIVERPDGDMQLTKDGLTVTAKYDVVGKRVLDPGTDALFEIL

SEQ ID NO: 5237 - DNA, 666 bp, Unknown
  Obtained from environmental sample
  misc_feature (1)..(666): n is a, c, g, or t
ttgaaaaatatttggggtaaaaaaccgaaaagaaaatttaaagttgttcgtaaaaagccaaatcacaaagccattcggttggcgattgaaaagccatcggaacaattgcatttgctgatgggattgccggtgaccagctttcgagacactcagagatttgaggcctttattgtgaacgctcttttggggggcggaatgacttcaaaactgtaccaaagtgtccgcgaaaaaagaggattggtgtattcgatttattccagtctgaatacatttatggattatggaatgattaatgtttatgcctcatgtgaaaagaaaaacatgaaatcggtttataataatataatggccgaactacaaaaaattcgaaaaaagaaaatttctgagcatgatttggaaatgtataaaacccaggtcaaaggcgctattttgttgggcgctgacgatatcgacaaccgaatgacgtctattggcgttaatgaaatggttttcgaaaaatacaagcccgtcgaagccattatcgaagaaattgatgcggtcagtgccaaatcagtgaatgaatacgtgcaaaaatattttgatttgaatcacttgggtgcagtattgataggtggcggggccaaagaactcgagccttggtttttatcagagacggggaagaaatga

SEQ ID NO: 5238 - protein, 221 aa, Unknown
  Obtained from environmental sample
  DOMAIN (3)...(139): Peptidase M16 inactive domain
  misc_feature (1)..(221): Xaa is any amino acid
MKNIWGKKPKRKFKVVRKKPNHKAIRLAIEKPSEQLHLLMGLPVTSFRDTQRFEAFIVNALLGGGMTSKLYQSVREKRGLVYSIYSSLNTFMDYGMINVYASCEKKNMKSVYNNIMAELQKIRKKKISEHDLEMYKTQVKGAILLGADDIDNRMTSIGVNEMVFEKYKPVEAIIEEIDAVSAKSVNEYVQKYFDLNHLGAVLIGGGAKELEPWFLSETGKK

SEQ ID NO: 5239 - DNA, 321 bp, Unknown
  Obtained from environmental sample
  misc_feature (1)..(321): n is a, c, g, or t
atgatgatgccaaacataataaaatcgagagattgtgtttctattttattactatacttatcacaacaatttgataccgaagtggtaaatttttgcaacggtcttggtgatagagacatttttcttattgatcaatattggttattgctataccaactatttttggacggaaaaattaaaaatccatacgatattgatgagaacgcatatggaaaatatttacaaagcaaaaaagagaaattatcggttgccaaaaatcgcgagattcgggtttttgaagttttgaagaaagagggtgtcaattttattattgctccttaa

SEQ ID NO: 5240 - protein, 106 aa, Unknown
  Obtained from environmental sample
  misc_feature (1)..(106): Xaa is any amino acid
MMMPNIIKSRDCVSILLLYLSQQFDTEVVNFCNGLGDRDIFLIDQYWLLLYQLFLDGKIKNPYDIDENAYGKYLQSKKEKLSVAKNREIRVFEVLKKEGVNFIIAP

SEQ ID NO: 5241 - DNA, 309 bp, Unknown
  Obtained from environmental sample
  misc_feature (1)..(309): n is a, c, g, or t
atggcgacaaaaacaaccttgcacgaaatatcatctcgtctcgacagagtattcgaatcatcacgtggaattaatgatgatgagatcaaatctcactatgctcgatatttatgtgttttaacttcaggatacatcgaagagtcgatcaaaacaataataaataactatgttatcaaccggtcttccccaacaatttctaattacattaattcctctacaaataaattgacaaatttgaacacggaaaagatttgtgttctcctgaatacttttgatagtaaatggaaagaacagttgaaaataaattaa

SEQ ID NO: 5242 - protein, 102 aa, Unknown
  Obtained from environmental sample
  misc_feature (1)..(102): Xaa is any amino acid
MATKTTLHEISSRLDRVFESSRGINDDEIKSHYARYLCVLTSGYIEESIKTIINNYVINRSSPTISNYINSSTNKLTNLNTEKICVLLNTFDSKWKEQLKIN

SEQ ID NO: 5243 - DNA, 495 bp, Unknown
  Obtained from environmental sample
  misc_feature (1)..(495): n is a, c, g, or t
ttgaacttccttaaaaaagaaatatttatgaaaaacctgattccatttctgatcatattcatggcttgcaattcaaggcaaacagaacctgtcaaccaggcactcatagatctaagcaaaaccgcaagtgaagaaatcaggaataccgatatagctatgagtgatcaggctcagagagatggatttagtaaaacacttctcgagtttgctgatgacagcatcatcaaacctaaggaaggtgaattccctgtgattggtaaaaaggctttagaagattattggaaaggtaataagggaacaaaaggaatttcatggaagcccttcagagttgaggcagctaaatctggagaaatgggttatactgtaggaaattggaatttgaatacacctgattcaacttatcacggcaactatatcacgatctggaaaaaacaacaggatggtcaatggaaatgggttgtagatggtggcaatgcaactccggcgcctaaataa

SEQ ID NO: 5244 - protein, 164 aa, Unknown
  Obtained from environmental sample
  misc_feature (1)..(164): Xaa is any amino acid
MNFLKKEIFMKNLIPFLIIFMACNSRQTEPVNQALIDLSKTASEEIRNTDIAMSDQAQRDGFSKTLLEFADDSIIKPKEGEFPVIGKKALEDYWKGNKGTKGISWKPFRVEAAKSGEMGYTVGNWNLNTPDSTYHGNYITIWKKQQDGQWKWVVDGGNATPAPK

SEQ ID NO: 5245 - DNA, 459 bp, Unknown
  Obtained from environmental sample
  misc_feature (1)..(459): n is a, c, g, or t
atggatgacaggaaaattttaattgttgaagatgaaaagaaaatcgccgacctgcttaagttcggacttagtgaatgtggatttcatgtgcaggttgcctacgatggtacgttagggtatcatttatttcaagcgcaggactttgatcttgttatcctcgatattaaccttccgggaatgaacgggtatgaattatgcaaagctatccggttaaaaaaccaacacgtaccagtcctaatgcttacgtcaatgatagcattgacggataagatagcgggttataattcaggggctgatgactatatggttaaaccctttgaatttaaagaactgcttttaaaaatcagggcattgcttaaacgtaccatgatgcaaagtttaccggttggcaatcttttaaaggcagctgacctggaaatgaatcttgatagtaaagaagtaaggcgggatgataaataa

SEQ ID NO: 5246 - protein, 152 aa, Unknown
  Obtained from environmental sample
  DOMAIN (4)...(123): Response regulator receiver domain
  misc_feature (1)..(152): Xaa is any amino acid
MDDRKILIVEDEKKIADLLKFGLSECGFHVQVAYDGTLGYHLFQAQDFDLVILDINLPGMNGYELCKAIRLKNQHVPVLMLTSMIALTDKIAGYNSGADDYMVKPFEFKELLLKIRALLKRTMMQSLPVGNLLKAADLEMNLDSKEVRRDDK

SEQ ID NO: 5247 - DNA, 945 bp, Unknown
  Obtained from environmental sample
  misc_feature (1)..(945): n is a, c, g, or t
ttgatgtgttttggacagtacattagagaaacagattcaccgaagcaggacgatgcaaaacaagagttgaaagtggtgagagatattgaaacatcagcgggtggcacggagacacctggtgaagaagaaaaaaaagggaaggtggttaagaaggcggggaagaggataggatataattatattattttgaaaagtttaaaggagagtcagaagaatgatgtggtgaaatgtttatatataaagagtttgtttaagtggggaatttgcgtgattaaggaggggacgtatggagactcgaaggatcggtgggggagagacataaaagacaaactaatctggcaaaaaaaacttcatgaacaacttcaaaataaggtaagagtacccaagtatctagacaattttgaagaaaatggaaattattatctggtaattgaatatataaaaggaaaatctctttataaagctataaaagaaaaaaaagagttaagagacagtttaattaaaggcgacaaattaggtcggacttttattacttatataatacagttaatagctttgctggatagactacatcagaataatattattcatagggatgtatcttcaaataactttatagttacatcatcaggaaaagtggccgtaattgatatggagctcagctattgcttcgaaaataatctgccatctccaccttttcaactaggtacatatggatttatgtcgccccagcaagaaaacatgaagactccagtagttaaagatgacattttctctattggatcaatactttttcaactatggacaggaatttcaccaaataagctaattggtacatcagaagaagatcttaccaaaaaatacatttctttattccagataaaagcatttcagaaacagttattaattgcttacataatgaccccgataaaaggccacaattaa

SEQ ID NO: 5248 - protein, 314 aa, Unknown
  Obtained from environmental sample
  DOMAIN (40)...(310): Protein kinase domain
  misc_feature (1)..(314): Xaa is any amino acid
MMCFGQYIRETDSPKQDDAKQELKVVRDIETSAGGTETPGEEEKKGKVVKKAGKRIGYNYIILKSLKESQKNDVVKCLYIKSLFKWGICVIKEGTYGDSKDRWGRDIKDKLIWQKKLHEQLQNKVRVPKYLDNFEENGNYYLVIEYIKGKSLYKAIKEKKELRDSLIKGDKLGRTFITYIIQLIALLDRLHQNNIIHRDVSSNNFIVTSSGKVAVIDMELSYCFENNLPSPPFQLGTYGFMSPQQENMKTPVVKDDIFSIGSILFQLWTGISPNKLIGTSEEDLTKKYISLFQIKAFQKQLLIAYIMTPIKGHN

SEQ ID NO: 5249 - DNA, 546 bp, Unknown
  Obtained from environmental sample
  misc_feature (1)..(546): n is a, c, g, or t
ttgctacaatattctttgaaatacaaagataattatgctttagaaagtgccgaacgagggttaaattggctgaaaaaagttgctatttatcacaaagataaaatagactggaaatcgactaataataaaaagattgatccctggtggtgcgaaggtgcccctggtatctctttaacattcatgaaagcatatagcatattcaaaacggatcagtataaaaaaattgcatatggtgctctattaaataatccagataaaattgtaaataataatcttagccaatacgacggtttatgtgggttaggcgagctttatttagaggctttcaaaatatttaaagaagaaatctggataaatcgtgctgaatggataatgcaagttgtaatgcaaatgaaaaaggaacacaacttatatggaccttactggctagtaaagaatgaacgtcaacctgtaatagattttatgactggaagtagcgggttaattcactttttattaagatactgctttcaagatagaatatcatttcctttattagggcaataa

SEQ ID NO: 5250 - protein, 181 aa, Unknown
  Obtained from environmental sample
  misc_feature (1)..(181): Xaa is any amino acid
MLQYSLKYKDNYALESAERGLNWLKKVAIYHKDKIDWKSTNNKKIDPWWCEGAPGISLTFMKAYSIFKTDQYKKIAYGALLNNPDKIVNNNLSQYDGLCGLGELYLEAFKIFKEEIWINRAEWIMQVVMQMKKEHNLYGPYWLVKNERQPVIDFMTGSSGLIHFLLRYCFQDRISFPLLGQ

SEQ ID NO: 5251 - DNA, 876 bp, Unknown
  Obtained from environmental sample
  misc_feature (1)..(876): n is a, c, g, or t
ttgctgctccgcaaaaatactcaaataaagatcgcacttctcgggaaccctaacgcggggaaaacgagtttgtttaatggcttaacaggtcttaaacaaaaaacaggtaattacgccggagttactgtcgacaggcatgaaggcagaactgaatttaccgcaggtccagaccggttcatgctttccatcatcgaccttcccggggtttacagcctttttccaaaatccaacgacgaagagatcgcgtgccgtactttattggacgaaaacgagcatatcgatgttgttgttgtggttgttgatgccacgagccttaaacggaatttattactggcgacccaggttattgacctgaaatttaaaacggttgtggcgctcaacatgatggatgaggccgaaaaacaaaatattaagatcgatatcaagggattatccaaaacactgggtgttcctgtggtggcagttgattcaaggcatgaggtcggttttcctgaactgaagcaggccatcacaaatgccgcggtaagtgaaagctttttttacgacttaaacgctcctttttcaaaacagtttaaggattaccgcgaatttattaaaagttatgtttaccgttctgaatcaaccaatagcgattcgccggagaacaccgataaagtttacaggtacaataccatcaattatttactggctaaatatgtgaagagtcccgccgagctctcgcaaaaagaattaacctcgcgcatcgacaggatagccacgcacaggatctttgggtatgtgatcttcatagcggaatgttccctggtttccagtttatcttttacttttccgaaaacccgatgttctggatcgaaagttgttccttcaccttggtga

SEQ ID NO: 5252 - protein, 291 aa, Unknown
  Obtained from environmental sample
  DOMAIN (6)...(178): Elongation factor Tu GTP binding domain
  misc_feature (1)..(291): Xaa is any amino acid
MLLRKNTQIKIALLGNPNAGKTSLFNGLTGLKQKTGNYAGVTVDRHEGRTEFTAGPDRFMLSIIDLPGVYSLFPKSNDEEIACRTLLDENEHIDVVVVVVDATSLKRNLLLATQVIDLKFKTVVALNMMDEAEKQNIKIDIKGLSKTLGVPVVAVDSRHEVGFPELKQAITNAAVSESFFYDLNAPFSKQFKDYREFIKSYVYRSESTNSDSPENTDKVYRYNTINYLLAKYVKSPAELSQKELTSRIDRIATHRIFGYVIFIAECSLVSSLSFTFPKTRCSGSKVVPSPW

SEQ ID NO: 5253 - DNA, 561 bp, Unknown
  Obtained from environmental sample
  misc_feature (1)..(561): n is a, c, g, or t
atgtttattgaaccacatattaaaggtgaatgtggcggatggatcgaagtggtttgcggttccatgttctcaggaaaaacagaagaattgattcgtaggcttaaaagagccaaaatagccaacctcaaggtagagattttcaaacctgctatggatacaaggtatgatgctgaaaaaatcgtttctcatgatgaaaaccgtatccaatccacgcctgttgataattcccaaaagatcctcctcttagctcagggtgtggatgtaatcggaattgatgaagcccagttcttcgatgatgggctcccggatgtttgtgaacaactagcctgcaggggtatcagggtaatagttgcaggtcttgacatggattacctgggcaaaccttttggacagattccttttctgcttgcaaaggcagattatatcaccaagcttcatgctatatgtatgaagtgtggcaacattgccaactattcttacaggaagatccctaatgaagataggatcatgcttggtgaaaaagacgtttacgaaccaagatgccgcaggtgtataacctga

SEQ ID NO: 5254 - protein, 186 aa, Unknown
  Obtained from environmental sample
  DOMAIN (13)...(185): Thymidine kinase
  misc_feature (1)..(186): Xaa is any amino acid
MFIEPHIKGECGGWIEVVCGSMFSGKTEELIRRLKRAKIANLKVEIFKPAMDTRYDAEKIVSHDENRIQSTPVDNSQKILLLAQGVDVIGIDEAQFFDDGLPDVCEQLACRGIRVIVAGLDMDYLGKPFGQIPFLLAKADYITKLHAICMKCGNIANYSYRKIPNEDRIMLGEKDVYEPRCRRCIT

SEQ ID NO: 5255 - DNA, 339 bp, Unknown
  Obtained from environmental sample
  misc_feature (1)..(339): n is a, c, g, or t
atgacattcgataagaataaaaatattcagggagaccagttgaatcttgccggaaaaatattggaacaaattcctgttggggtaatctccttttctgctgattggcaggttgaatttgtaaatgaaaattttataaaatttggtgtattatattattatgatttcaattccttgcccggcagcaacattttaaccagtgaacttttccccggaatcaatttaaaggaagaactgcttcaattagaagaaggctactcttttgaaagagaaattaaaagtatctgttatcctgacaaaagaaaaatttctcttgttataaaagcttcctccggtttttga

SEQ ID NO: 5256 - protein, 112 aa, Unknown
  Obtained from environmental sample
  misc_feature (1)..(112): Xaa is any amino acid
MTFDKNKNIQGDQLNLAGKILEQIPVGVISFSADWQVEFVNENFIKFGVLYYYDFNSLPGSNILTSELFPGINLKEELLQLEEGYSFEREIKSICYPDKRKISLVIKASSGF

SEQ ID NO: 5257 - DNA, 402 bp, Unknown
  Obtained from environmental sample
  misc_feature (1)..(402): n is a, c, g, or t
ttgatggttatgtgcctccccagaatttacatatctggtaaaccagataaactagaagaaattacagccaatgaagaaaaaaaaattcagattgttgcatcttctaatatagacttaaatgcaaatgtagatctattcgcagaaatggagtctctagaagaatctaatatctttaaaataaagttaaaagacaataaatcaaatgtcataccaaaatatggtaaatataaaactgatctaggattaaaattgttaaaagatacagaaggatctacctcattaactattaaatcaattttctctttggacaatcatacatttaaaggtcatcttaaaatactagataaagaatattttccagtctctgtaatcccaagaaagaaagagttgaattgccaataa

SEQ ID NO: 5258 - protein, 133 aa, Unknown
  Obtained from environmental sample
  misc_feature (1)..(133): Xaa is any amino acid
MMVMCLPRIYISGKPDKLEEITANEEKKIQIVASSNIDLNANVDLFAEMESLEESNIFKIKLKDNKSNVIPKYGKYKTDLGLKLLKDTEGSTSLTIKSIFSLDNHTFKGHLKILDKEYFPVSVIPRKKELNCQ

SEQ ID NO: 5259 - DNA, 984 bp, Unknown
  Obtained from environmental sample
  misc_feature (1)..(984): n is a, c, g, or t
ttggaatgcaattcccaaaattcacagcatgatgttgatgatgataataatactactttaataaagaaaaaaaataatgctcataaagacgacggaaacccctcaatagtcactncattacaatctgaaaaagttagaataataatcaaatcaccaactttaaaagataaagaatccataaaatccaaagtagaagaggtatttgaatcagttaaagagaatacaagtaatattattaacaaagcaataaaagtagaagaacaagatattaattccttcaaaatattatcagaaaaagtttctcaaactctacaacaacaaaaagaatctcttgaagaggaatttgttattcctgtgatagcagaagattattcactttctaaaaaaaatctttctgaagagataaacattgaaaaaagatgggtagaacaagaagaaattaaggtacccgttagatatgaaaaagtttttgtaaatgataaagaaattgatgtctattcaaagcaaggagttatttctcaaatcaaagaaaagatatcagatttgattcagtctaataaggaagaaaatgaaactcagaacgacgaaaaaatagatacgaaaaatcaaaatgacaataaagaatttgaaaagaaaaaaaatgaaggagaaaaaggagtagaagaaggagaaaaagaagtacagttaaagggtgaaattgtaccactttttgataatcaggagaacgaaaacaataatatccaattaactcaaaacaacaataataatagtaataataaagagttaacaaaaaaagaactttatacagtgattcctctatatgcagaggaaataactatttcaaagaaaattgtaaaagttggggaaattgtgttaagcaagagaagagttatagaggaggaaaattttaacatagatacaataaaagaacgaataaaccttgaacatccagatggtagaaaagaaaagcttatcggttattga

SEQ ID NO: 5260 - protein, 327 aa, Unknown
  Obtained from environmental sample
  misc_feature (1)..(327): Xaa is any amino acid
MECNSQNSQHDVDDDNNTTLIKKKNNAHKDDGNPSIVTXLQSEKVRIIIKSPTLKDKESIKSKVEEVFESVKENTSNIINKAIKVEEQDINSFKILSEKVSQTLQQQKESLEEEFVIPVIAEDYSLSKKNLSEEINIEKRWVEQEEIKVPVRYEKVFVNDKEIDVYSKQGVISQIKEKISDLIQSNKEENETQNDEKIDTKNQNDNKEFEKKKNEGEKGVEEGEKEVQLKGEIVPLFDNQENENNNIQLTQNNNNNSNNKELTKKELYTVIPLYAEEITISKKIVKVGEIVLSKRRVIEEENFNIDTIKERINLEHPDGRKEKLIGY

SEQ ID NO: 5261 - DNA, 822 bp, Unknown
  Obtained from environmental sample
  misc_feature (1)..(822): n is a, c, g, or t
gtgaaagttcttctatcaacagcactccccatagctttatgctgcctgctgttacaacccgcaacaaataaaattccggcagaaaataaaatttatacagcccccccgatcagggaaactggaaatgatctttttgacagcgaagaaatcctgaatataaaattgtcgggaaagatccgtcaactatttgcagaccgctccgatgatggagcctatcatccactggtgcttacttataaaggcgctgatggtaacgacgtaaccattaatttaagaggcaaaacaagaggaaattttcgccgtaaaaaagaaaattgtacttacccgcccattctgctgaattttacaaggaaagaacaccagccctcactctttgatcaacaggataaattaaaactggttactccatgcgcaggtgataactatgttatccgcgaataccttgtttataaattatacaacttggttactcccaaaagctacagggccagattggtgaaagtaacttttgacgatatagaaaagaaaaaagaaacctcattttacagcatgttactggaagaagatgagcagatggccctacgcaacaaatcgaagttaatggctataaaaaacctgaatggagaaaatacagaaactgaaacatttttgaagatggccgtctttcaatacatgatcggcaatacagattggtcggttcctttcggccacaatatcaggatactttcttttgaccccgcgacggtaccatctgttgtgccttacgattttgaccatgcaggaattgtagatgcaccttatgcttaccaccagaacatctga

SEQ ID NO: 5262 - protein, 273 aa, Unknown
  Obtained from environmental sample
  SIGNAL (1)...(18)
  misc_feature (1)..(273): Xaa is any amino acid
MKVLLSTALPIALCCLLLQPATNKIPAENKIYTAPPIRETGNDLFDSEEILNIKLSGKIRQLFADRSDDGAYHPLVLTYKGADGNDVTINLRGKTRGNFRRKKENCTYPPILLNFTRKEHQPSLFDQQDKLKLVTPCAGDNYVIREYLVYKLYNLVTPKSYRARLVKVTFDDIEKKKETSFYSMLLEEDEQMALRNKSKLMAIKNLNGENTETETFLKMAVFQYMIGNTDWSVPFGHNIRILSFDPATVPSVVPYDFDHAGIVDAPYAYHQNI

SEQ ID NO: 5263 - DNA, 900 bp, Unknown
  Obtained from environmental sample
  misc_feature (1)..(900): n is a, c, g, or t
gtgaagattataatcgaccaggcatacaaatccgagatgcttcggcgactcatagagaataagtattattctgcgatcgattccatgaaattcgtgatcgatccaatcacgcttgcctcaacggtaatagatggtgaactacaatacttctatattgatcccttgggtgaaaaaattgaacgacttggcacttggattcatgcgacagcattccgaagcgacagccttgccaatgtgcaaagcgaagaagggtacctcacaatcgacaacaaaggaagccaatggccaaaatccatggatggtttcaataaggatgacagatcagtagattgcagtttcgacaatcttgacaatttgccacgtaaaatgtatgtagctactgaacttaatttattgattgccaatggaaacaacattcgacgaatccagcccaagatcaaagcattgaccaatcttgtgtatgtcaatttgaatgacaatgaacttaagaaatttaaagcacttacacgaaatcctagcttgattaagctcagtgtacagggaaactatatcagcaaaatccacagaagaatttcgcaattggactcacttgagagccttgatttgagtcgtaacttaatcaaaaagatatctaatgtactctttggaattaaggttctaaaggagctggatcttcaatacaatcgcattccaaaattgaaaaatggcattggcaaacttgcaaatttagaaatgcttgatctcagcttcaatcaaatcacggaacttccagagggattaatcaaactacaaaaaatgaaatatttggggcttnactggaacaaaattgaagacattagcgatgagaagttttttcattatctngaagagataaaagcctcagagtgtgcgcttgggtag

SEQ ID NO: 5264 - protein, 299 aa, Unknown
  Obtained from environmental sample
  DOMAIN (242)...(264): Leucine Rich Repeat
  misc_feature (1)..(299): Xaa is any amino acid
MKIIIDQAYKSEMLRRLIENKYYSAIDSMKFVIDPITLASTVIDGELQYFYIDPLGEKIERLGTWIHATAFRSDSLANVQSEEGYLTIDNKGSQWPKSMDGFNKDDRSVDCSFDNLDNLPRKMYVATELNLLIANGNNIRRIQPKIKALTNLVYVNLNDNELKKFKALTRNPSLIKLSVQGNYISKIHRRISQLDSLESLDLSRNLIKKISNVLFGIKVLKELDLQYNRIPKLKNGIGKLANLEMLDLSFNQITELPEGLIKLQKMKYLGLXWNKIEDISDEKFFHYLEEIKASECALG

SEQ ID NO: 5265 - DNA, 612 bp, Unknown
  Obtained from environmental sample
  misc_feature (1)..(612): n is a, c, g, or t
gtgaattacaataatggaaataatgtggcagaccaatcgctggttgacaaagtcttacgtggcgacacgaatgcatttaaggttattataaaaaacacagaaggactggtagctcaaattgttttcaaaatgataccaggtgctgaagacaggaaagacattgcgcaggatatctatttgaagacatttcaaaaactagggggctttaaattccaatcaaagctttctacatggataggacagattgcctataacacttgcataaaccatcttaggaaaaagaaaatattgcttattgataatagtatttcggacaataaatccgaggatgatacattagaaataatgaataaaacaattaattggcccgataatgacactgaaaagatcattttcaaaaaagagctttcggggattttaaaaaaagaaatagataaactttccccgctttaccgaacattgataacactctatcacaacgaagaattaaactacttagaaatagcggaaataacggaactgccggaagggacgattaaaaactatttattccgtgcaaggaaaaccttgcggaataatttattgctcacttataaaaaggaagctttatga

SEQ ID NO: 5266 - protein, 203 aa, Unknown
  Obtained from environmental sample
  DOMAIN (29)...(96): Sigma-70 region 2
  misc_feature (1)..(203): Xaa is any amino acid
MNYNNGNNVADQSLVDKVLRGDTNAFKVIIKNTEGLVAQIVFKMIPGAEDRKDIAQDIYLKTFQKLGGFKFQSKLSTWIGQIAYNTCINHLRKKKILLIDNSISDNKSEDDTLEIMNKTINWPDNDTEKIIFKKELSGILKKEIDKLSPLYRTLITLYHNEELNYLEIAEITELPEGTIKNYLFRARKTLRNNLLLTYKKEAL

SEQ ID NO: 5267 - DNA, 669 bp, Unknown
  Obtained from environmental sample
  misc_feature (1)..(669): n is a, c, g, or t
atgtttaaattcctatcaaaaatattcccttcaaaacacgagaaggatgtaaaaacgcttctgcctttggtggaagaagtgaatgtattttatgaagagtacaaaaatctgactgatgatgagcttcgtgcaaaaactgccgaattcagggaaataatcaggaagaatactcaggaacatgaagataagatagtggagcttcgttccaggctgactaatgatattacacatgatgagcgcaaagatatctatgatgagcttgaagctactgaaaatgaacttgacgggataattgaagatactcttaatgaactgcttccgcaggcatttgcggttattaaggatacaagcagaaggctttgcggaacggagtggtctgttgccgggcagaaatctaagtgggatatggtgccttttgatgttcagctaatcggcggtatggtgctgcaccagggtaagatagcagaaatggcaaccggcgaaggtaaaacgctggtaggtactcttcctgtttatctgaatgcacttcccggaaaaggtgttcacattataactgttaacgattaccttgcaaaaagggatagtgagtggatgggcgagcttttcaagtttcacggcttaaccgtaggagttatccttaacgatatggataatgataaaagngcgtga

SEQ ID NO: 5268 - protein, 222 aa, Unknown
  Obtained from environmental sample
  DOMAIN (1)...(222): SecA DEAD-like domain
  misc_feature (1)..(222): Xaa is any amino acid
MFKFLSKIFPSKHEKDVKTLLPLVEEVNVFYEEYKNLTDDELRAKTAEFREIIRKNTQEHEDKIVELRSRLTNDITHDERKDIYDELEATENELDGIIEDTLNELLPQAFAVIKDTSRRLCGTEWSVAGQKSKWDMVPFDVQLIGGMVLHQGKIAEMATGEGKTLVGTLPVYLNALPGKGVHIITVNDYLAKRDSEWMGELFKFHGLTVGVILNDMDNDKXA

SEQ ID NO: 5269 - DNA, 408 bp, Unknown
  Obtained from environmental sample
  misc_feature (1)..(408): n is a, c, g, or t
ttgatatggccgctgagtttcgctcctcactcgatcaggttgaaactaaaaaaatatccgccaaggaaaaagctcacactgggcattattggacacgttcatgtgatggcaaaggatctaacagcatcggcggtgtttatgaacgaacacaggcatttaagccagccttacttacgcgacttcctatttttgagaatcaattatatcaaccgcttcaaaaaaattattgaagaaggagttcaggcaggcgagttcaagaagaacattgatacaaaacttgccgtaatgacccttttctcttcccttaactggatgccgctttggtacagtccttcaggatccatcgaacccaaggaattaggccagcaacttgccgatatgttggtaaacgggctgaaacaaaactga

SEQ ID NO: 5270 - protein, 135 aa, Unknown
  Obtained from environmental sample
  misc_feature (1)..(135): Xaa is any amino acid
MIWPLSFAPHSIRLKLKKYPPRKKLTLGIIGHVHVMAKDLTASAVFMNEHRHLSQPYLRDFLFLRINYINRFKKIIEEGVQAGEFKKNIDTKLAVMTLFSSLNWMPLWYSPSGSIEPKELGQQLADMLVNGLKQN

SEQ ID NO: 5271 - DNA, 819 bp, Unknown
  Obtained from environmental sample
  misc_feature (1)..(819): n is a, c, g, or t
gtgactataaaaaatcctaatggattcaacaccataaaatctgccagatacaaaagcttgactatactcaaggcatccgagaattcagcttttaagctaagattgatctgcgcattgctaaaatatcgctcacgccaactcaggacttcctggctcctctggaaacgccattcgcgcggggttatgttcatctgcatgttgatgttcggttttttgtgcgctgcagaaatcacagtaaacaagcttgaaaacaccatgcaaaaacgctttggtgctaaaggtgtgagcaagctacaggcgtgggaaaagctactggaaaataataaaaccaaatcgatagcagaaaaaaataaagcggttaatgatttttttaataaaaacacccgctttgaagacgatatcattcactggaaaatcagcgactattgggcgacgccgctcgaaacattaggcagtgaagcaggtgattgtgaagactacacaatcgcaaaatattttacgctcctgcgtctgggaattccctccgagcagttacgtctcatctacgtaaaagcgcaaattgggggtgcttcaagtaaagtatttcaggcgcacatggtgcttggatactatgaccaacctaattcaattccactgattttggatagcctgattcccaatattgaaactgctgataaacgtaccgatttacatcccgtgtttagttttaatagcgaaggtttgtgggttggtaatcaggcccaaccacaaattgatccaactgcacgtttatcgcgctggcgtgacgtgcttgaacgaatgaagcaagaagggttttaa

SEQ ID NO: 5272 - protein, 272 aa, Unknown
  Obtained from environmental sample
  misc_feature (1)..(272): Xaa is any amino acid
MTIKNPNGFNTIKSARYKSLTILKASENSAFKLRLICALLKYRSRQLRTSWLLWKRHSRGVMFICMLMFGFLCAAEITVNKLENTMQKRFGAKGVSKLQAWEKLLENNKTKSIAEKNKAVNDFFNKNTRFEDDIIHWKISDYWATPLETLGSEAGDCEDYTIAKYFTLLRLGIPSEQLRLIYVKAQIGGASSKVFQAHMVLGYYDQPNSIPLILDSLIPNIETADKRTDLHPVFSFNSEGLWVGNQAQPQIDPTARLSRWRDVLERMKQEGF

SEQ ID NO: 5273 - DNA, 378 bp, Unknown
  Obtained from environmental sample
  misc_feature (1)..(378): n is a, c, g, or t
ttggtcgtgaaagatctcgctttcaaacgggtaaaagatagtgtgaaatcggcggtgaaatttatcaacgacttcgaaaaaactgctgccgacattgcgattgaaaaccgatatgactacgttatttgtggtcatatccatcaaccggaaatcaagaaaataacaacagaaaagggtgaagtattttatttaaattcgggcgactgggtggagaacctcacggcattggagttcgacgggcataattggagcatttatcgttatgctgacgataagaaggcgcaaaccgtaagacttccgaagcgatttaatgagaaacttgataatgatgagctcttccgtgacctggtgaacgaatttttaacggtaaaaaagtga

SEQ ID NO: 5274 - protein, 125 aa, Unknown
  Obtained from environmental sample
  misc_feature (1)..(125): Xaa is any amino acid
MVVKDLAFKRVKDSVKSAVKFINDFEKTAADIAIENRYDYVICGHIHQPEIKKITTEKGEVFYLNSGDWVENLTALEFDGHNWSIYRYADDKKAQTVRLPKRFNEKLDNDELFRDLVNEFLTVKK

SEQ ID NO: 5275 - DNA, 372 bp, Unknown
  Obtained from environmental sample
  misc_feature (1)..(372): n is a, c, g, or t
gtggtatacgacctcgggtccggcgacgggcggatccccatacgggcgcccagaaaatacggcgccgcgcccattggcatcgacatcaacccggagcggatcaaggaagcgaacgagaatctcgcgaaggccaatgtcggcagcaaggtcaagttcctcaaccaggacctgtttgaaaccgatatcagcgaggcgacggtcgtgacgctttacctcctgccgagcctgaacatcaagctgatgccgactttgaaggcactcaagaaaggcacgcggatcgtctcgcacagcttcaacatgggcgatgagtggccgccggagaagacccaggacgtgaacggccgcacgatttactactggacaatcaagtag

SEQ ID NO: 5276 - protein, 123 aa, Unknown
  Obtained from environmental sample
  misc_feature (1)..(123): Xaa is any amino acid
MVYDLGSGDGRIPIRAPRKYGAAPIGIDINPERIKEANENLAKANVGSKVKFLNQDLFETDISEATVVTLYLLPSLNIKLMPTLKALKKGTRIVSHSFNMGDEWPPEKTQDVNGRTIYYWTIK

SEQ ID NO: 5277 - DNA, 603 bp, Unknown
  Obtained from environmental sample
  misc_feature (1)..(603): n is a, c, g, or t
ttgagcaagcttcgatgtggaaggaaaccattcatggcaacatctatattagaggtcaacaacctggtaaaaaaatacggtgacttcaccgccgtcaaaggaatttccttcgatatcaaggatggggaaatcttcagcctgctgggccccaacggcgcggggaagacgacgaccatctccatgctgtccaccttatacacgcccaccacgggggatgcgaccatctgcgggcattccatcacaaagaatccaatggccgtcaaacaggtgatcggggtggtcccccaggagatcgcattgtatgaagatctgactgcaaaagagaacctcatcttctggggacagatgtatgatctcagcggcaagtcactcacgagccgggtggacgaagtgctggaccagatcggcctgacggacaaagcccggtaccggggtcagacctattcgggtggcatgaagcgccgggtcaacatcggcgtgggactactgcataagccgcgcctgctgttcatggacgagccgaacgtcggcatcgacccgcagtcccgccgcgccattctcgacacggtcaaggactccaccggcagggatgacggtctgtaa

SEQ ID NO: 5278 - protein, 200 aa, Unknown
  Obtained from environmental sample
  DOMAIN (42)...(199): ABC transporter
  misc_feature (1)..(200): Xaa is any amino acid
MSKLRCGRKPFMATSILEVNNLVKKYGDFTAVKGISFDIKDGEIFSLLGPNGAGKTTTISMLSTLYTPTTGDATICGHSITKNPMAVKQVIGVVPQEIALYEDLTAKENLIFWGQMYDLSGKSLTSRVDEVLDQIGLTDKARYRGQTYSGGMKRRVNIGVGLLHKPRLLFMDEPNVGIDPQSRRAILDTVKDSTGRDDGL

SEQ ID NO: 5279 - DNA, 549 bp, Unknown
  Obtained from environmental sample
  misc_feature (1)..(549): n is a, c, g, or t
ttgatggatccaagaggatggtcagacaacccaacttgcatcattgaagctatcaatgagcaccttgatgacactgagaattcctccaccaatatcaagttcaggtgtggtatcaatgatgatgcttatgaagatatcctgacatacaaccaaatcatggaccacctatcaaagggtgatgatgatgacattatttggaagttcaaggacatcattgggcatcaaggcccactcagcaagaatcacaaggactacaagggatcaccatacaacctgacagtcctatgggagaatggggagaccagcatcaaacctctcttggttattgcagttgatgaccctgtgtcgtgcgccaagtataccaagcagaacaacctactcgatcaacctggatggaaacggttcaagcccctagcaaaaaggcacaaaaggatgctcagggagatcaatcttgctattgaaccgagaataccacttaccttgaccgggcaaagagctcggcgcttcatcgctctgatggctgatgaatttttgtggtatttaagctaa

SEQ ID NO: 5280 - protein, 182 aa, Unknown
  Obtained from environmental sample
  misc_feature (1)..(182): Xaa is any amino acid
MMDPRGWSDNPTCIIEAINEHLDDTENSSTNIKFRCGINDDAYEDILTYNQIMDHLSKGDDDDIIWKFKDIIGHQGPLSKNHKDYKGSPYNLTVLWENGETSIKPLLVIAVDDPVSCAKYTKQNNLLDQPGWKRFKPLAKRHKRMLREINLAIEPRIPLTLTGQRARRFIALMADEFLWYLS

SEQ ID NO: 5281 - DNA, 768 bp, Unknown
  Obtained from environmental sample
  misc_feature (1)..(768): n is a, c, g, or t
atgtcaacatataaaactatagcagaatcaaataacttcattgtcctagacaaatttaccaaatattcagaggtgaatgagacgcccgttgcctatcaaacagaatctgctcttgaacgggaatttatccaagatctgatcaaccaaggttatgagtacccatcaaacctaaatacacccgaagccctattgggaaatgcaagggtgcaactgcaatcgctcaacaatgtggtattttcggatgctgagtggattcgttttgtagaggagtatttagatatgccaagtgataaccttgttgaaaaatcaaggaaaatacatgacaaccatatttacgattttgtttttgatgatggccatatccaaaacgtctacctgttagataaaaagaatgttgcacgtaataacgtgcaggtgatcaaacaatttgaacaaaaaggcacacatgccaatcgttatgatataaccatattagttaatggattgcctttggttcaggtcgaactaaaaaagcgtgnggttgccattcgagaagcgtttaatcaagttcatagatactcaaaggaaagttttaatagtaaaaactctctctataaatacattcagatttttatcatttcanatggcactgacagccgatattttgccaacaccgtaaaacgagataaaaacangtttgactttaccatgaattgnngcaagtctgancatacgttaatcaaagaccttaagatttactgctacctttttcagaagaacacgctttaa

SEQ ID NO: 5282 - protein, 255 aa, Unknown
  Obtained from environmental sample
  DOMAIN (32)...(223): Type I restriction enzyme R protein N terminus (HSDR_N)
  misc_feature (1)..(255): Xaa is any amino acid
MSTYKTIAESNNFIVLDKFTKYSEVNETPVAYQTESALEREFIQDLINQGYEYPSNLNTPEALLGNARVQLQSLNNVVFSDAEWIRFVEEYLDMPSDNLVEKSRKIHDNHIYDFVFDDGHIQNVYLLDKKNVARNNVQVIKQFEQKGTHANRYDITILVNGLPLVQVELKKRXVAIREAFNQVHRYSKESFNSKNSLYKYIQIFIISXGTDSRYFANTVKRDKNXFDFTMNXXKSXHTLIKDLKIYCYLFQKNTL

SEQ ID NO: 5283 - DNA, 672 bp, Unknown
  Obtained from environmental sample
  misc_feature (1)..(672): n is a, c, g, or t
gtgaaagtcggattgaattacaggtacttccaggataacctgctctggctttacaatcagcggaacctgattcaaacagcaggtttatccatacaatataaaattacaaagaaccttacttcagccatcctggtaagtccggcggtgataaacagaaaaactgagaagagcgcagttgctaaccccggactctttaaggataatagcctgatcttgagcggtatgataaaatatatacgcaagaagcatcaacttgatattaatgataatttctataagctcaattacgatactacggagacgaattataaccaggccggcatatcacaaatcgtaaaaatcaataagtcgtttcaattacagaatgagatcttgcacttcactacttctaaaaaggataccacggttaaaacctgtttcatctttcaaagcgggtttaaggcttcacttaagaagctttctgcgcaggttaccatcagggcttcttacagtaatagttcagggtcagattatggctatgaccttaagcttcaataccccgttacaaaacagatcgtggctgaacttgcaacaagcaaatacgtggggggcaatttcctgttgggttataacgattcattactaaaaaaatatccgtatcanacaataataaaactgatgtataaatggtag

SEQ ID NO: 5284 - protein, 223 aa, Unknown
  Obtained from environmental sample
  misc_feature (1)..(223): Xaa is any amino acid
MKVGLNYRYFQDNLLWLYNQRNLIQTAGLSIQYKITKNLTSAILVSPAVINRKTEKSAVANPGLFKDNSLILSGMIKYIRKKHQLDINDNFYKLNYDTTETNYNQAGISQIVKINKSFQLQNEILHFTTSKKDTTVKTCFIFQSGFKASLKKLSAQVTIRASYSNSSGSDYGYDLKLQYPVTKQIVAELATSKYVGGNFLLGYNDSLLKKYPYXTIIKLMYKW

SEQ ID NO: 5285 - DNA, 744 bp, Unknown
  Obtained from environmental sample
  misc_feature (1)..(744): n is a, c, g, or t
ttgctgcattctgttttttttatttcggaagcgcaaaagccggcatctccaaaaaattcttcatcctccagcgaggtcattctattagtaactccatttgataaggattcattggatgaactgaatcctgtatttcaatgggtcaccagcggggccgccactatccatatcagcgacggtgccccgattcaaattcaatataagtttaccctggtaaagatcaatccgggccaggcacccaatgaagcaatacaaaaaaaccagccgttacatatagtttttccattgcagggaaatatgctgcaataccccgtaacatcacccgcattggaaaagggaggtcattatgcctggaaggtggagaaattccttaacggagcattgtataatcaaagtgaaacctgggagtttcggattaaagttaaacccaagaaagttgtttatgacctggagaccatgagtggaaccggaggtatagcaatggttacagatgacttgtttattggatttacagttacgaataaccctgacctagtttcaataatgatcaaaagcgaccggaataaggatataacatcatcagtttctatcgaaaatacatcttcattggacgaattaaaactttacaagcctggtgccaatacaattaaaatagattgcagtacattaatgaagggtaattacaaattggaactgagcaacgccaacgcaacaaaacagactttattttttcagaaggattaa

SEQ ID NO: 5286 - protein, 247 aa, Unknown
  Obtained from environmental sample
  misc_feature (1)..(247): Xaa is any amino acid
MLHSVFFISEAQKPASPKNSSSSSEVILLVTPFDKDSLDELNPVFQWVTSGAATIHISDGAPIQIQYKFTLVKINPGQAPNEAIQKNQPLHIVFPLQGNMLQYPVTSPALEKGGHYAWKVEKFLNGALYNQSETWEFRIKVKPKKVVYDLETMSGTGGIAMVTDDLFIGFTVTNNPDLVSIMIKSDRNKDITSSVSIENTSSLDELKLYKPGANTIKIDCSTLMKGNYKLELSNANATKQTLFFQKD

SEQ ID NO: 5287 - DNA, 558 bp, Unknown
  Obtained from environmental sample
  misc_feature (1)..(558): n is a, c, g, or t
ttgccgaagcagagatggcatgcagttaatgacctcttcaaacacatcaagccagacgtcgtattattagatattcatatgcncattatgacgggctatactactttgcccgagataaagaaattataccctgagatcaaggtaattatgctatccatgaataatgatccctcgattattacaaagatgatggaagtaggagccaactcctatcttaccaaggaatccgattcagaaactatttaccaggctatcagaacctgttatgaacaggaattctttttcaacgatcttaccaataaagcgcttctgaacggcctccgtatgaaaaagccgcaggaagctccagttcaggaagttcatctgacagataaagaaatcacaatattaaaactgatgtgtgaagaaaaaagcacaaaagaaattgctgacatcgttgacctcagcccccgtacagtagaagctatcagggataaactgaagacaaaaacaggtgtaaaatcaatggctggtttagttatgtatgcggtaaaagcaggcattgttgaacaagcataa

SEQ ID NO: 5288 - protein, 185 aa, Unknown
  Obtained from environmental sample
  DOMAIN (1)...(92): Response regulator receiver domain
  misc_feature (1)..(185): Xaa is any amino acid
MPKQRWHAVNDLFKHIKPDVVLLDIHMXIMTGYTTLPEIKKLYPEIKVIMLSMNNDPSIITKMMEVGANSYLTKESDSETIYQAIRTCYEQEFFFNDLTNKALLNGLRMKKPQEAPVQEVHLTDKEITILKLMCEEKSTKEIADIVDLSPRTVEAIRDKLKTKTGVKSMAGLVMYAVKAGIVEQA

SEQ ID NO: 5289 - DNA, 417 bp, Unknown
  Obtained from environmental sample
  misc_feature (1)..(417): n is a, c, g, or t
atggctaataaatacctgctctgccttttattccttgtttcagcctgtagtcagcaggaaaaggaaaaatcaaaccccatcgttggtaaatgggaatatgaaagaatagaaaagcataatggcgagccgattgatattcgggattcagcttataacaagcttcatcagcaacacatcggactgacattttccttttcaaaggggtatgtttttaaggtcacccaaaagagaaaaggtaataccgaagaatttatagcagaacaggaatacgaatttgccggaggaaaaaaagtacttcgctttgaagacacgggccgcccggatgataaatttgacatcattgatctatcagatttccttttaaaaataaatgtatttcaaagccccatagggtattgggttttccggaagaaatag

SEQ ID NO: 5290 - protein, 138 aa, Unknown
  Obtained from environmental sample
  SIGNAL (1)...(15)
  misc_feature (1)..(138): Xaa is any amino acid
MANKYLLCLLFLVSACSQQEKEKSNPIVGKWEYERIEKHNGEPIDIRDSAYNKLHQQHIGLTFSFSKGYVFKVTQKRKGNTEEFIAEQEYEFAGGKKVLRFEDTGRPDDKFDIIDLSDFLLKINVFQSPIGYWVFRKK

SEQ ID NO: 5291 - DNA, 324 bp, Unknown
  Obtained from environmental sample
  misc_feature (1)..(324): n is a, c, g, or t
atgagcaactacaaagcagacatcaacaccactgttacacgcgacattactgatttcgaaaaagaaacaaagaacgtttacgaatcagtggtgatcatggcaaaacgtgcgaaccagatcagcaatgagatcaaggaagagctgaatggaaagctctctgagttcaatacgagtgccgacacgcttgatgaaatttttgagaaccgcgagcagatcgagatttcaaaatattatgagcgccttccaaagccaacgttgattgcagcgcaggaatttcttgagaacaaaatttatcacagaaatccagttaaggaaaccaactaa

SEQ ID NO: 5292 - protein, 107 aa, Unknown
  Obtained from environmental sample
  misc_feature (1)..(107): Xaa is any amino acid
MSNYKADINTTVTRDITDFEKETKNVYESVVIMAKRANQISNEIKEELNGKLSEFNTSADTLDEIFENREQIEISKYYERLPKPTLIAAQEFLENKIYHRNPVKETN

SEQ ID NO: 5293 - DNA, 1056 bp, Unknown
  Obtained from environmental sample
  misc_feature (1)..(1056): n is a, c, g, or t
ttgcattggacaaaggcaattgggttcttcagagttttttcccgccttgggggtagaatgccccccgattttccaataatggcgggattaagggagaggggtttcccttgggatatggctccccggattccaaaggaccgaaaaaaaaattccctttttttttccttgaaattatggaacgctacccagcaggagcggtttcagggggtaatgaacccgaattttttgcgaaacatgctgcagtggataaatggcaacagattttataacgataatgatgctccattccctttttttagcgaaatagggcaattagccggcgtagctgcaacagactggagctggagtgtattgcttgcagatttcaataacgatggttggaaagacatgcatataacaaatggtataggaagagattttattaatgcagattttatagagttcagccatgagacgtttactaccattgccgataaaaaagaacaacaaaaagcgctcaaaaaaaagttatccagcctcagtcatataaacctcggtaattatttatacatcaacaaccatgattattcatttaaagacaggtctcaagaatcgggaattgaggaaccttccatgtctaatggagcagcttatgccgatcttgataatgatggggatttggatcttgttgttaacaacatcgataaacaggcttttgtttttataaataataccatccagaaaaccaagcctggtcatgctcattttttaaaaatgattttgaaaggagatggtagcaataagcacgcctttggtgcaaaggtttgcttatacagcaatggaagaatacagatggaagaacagaaccctgtaagaggctattattcctcggttgaccatgacctggttttcggtcttggcgccaattcaaaaattgattccctggttatcatttggccaaatgggaaaaaggaaataaagaaaaatattttgccagatacttcattagttctttttgaaaaagatngcttcgctgatgcatcagcctgcaaactccgattcatcgttgctttttaa

SEQ ID NO: 5294 - protein, 351 aa, Unknown
  Obtained from environmental sample
  DOMAIN (262)...(333): ASPIC and UnbV
  misc_feature (1)..(351): Xaa is any amino acid
MHWTKAIGFFRVFSRLGGRMPPDFPIMAGLRERGFPWDMAPRIPKDRKKNSLFFSLKLWNATQQERFQGVMNPNFLRNMLQWINGNRFYNDNDAPFPFFSEIGQLAGVAATDWSWSVLLADFNNDGWKDMHITNGIGRDFINADFIEFSHETFTTIADKKEQQKALKKKLSSLSHINLGNYLYINNHDYSFKDRSQESGIEEPSMSNGAAYADLDNDGDLDLVVNNIDKQAFVFINNTIQKTKPGHAHFLKMILKGDGSNKHAFGAKVCLYSNGRIQMEEQNPVRGYYSSVDHDLVFGLGANSKIDSLVIIWPNGKKEIKKNILPDTSLVLFEKDXFADASACKLRFIVAF

SEQ ID NO: 5295 - DNA, 399 bp, Unknown
  Obtained from environmental sample
  misc_feature (1)..(399): n is a, c, g, or t
atgcttcgaaactactttgtgatcgcattgcgaaatcttgtaaagtcacccggactttctggtattaaaataattggtctgtgtgtgggggtgtgtggctgtattatcgtctttctcctcgtaaagctggagctgagcttcgacaagcatcatacgaaaggggagaacgtgtaccgcccttacactgctttcaagggtgtttgggagggaactaattatggcattgcgcttccgtttccctcagcttttcgggagcgtgccgttggcgtgaaatctgtaagccaaatgatcaccgccaacgaagacgtcgtgnttaacgatggtggctcggagaaaaagtttaccaagcccaacaagatagctttttgtcgacagcaattactttcatgtatttcctga

SEQ ID NO: 5296 - protein, 132 aa, Unknown
  Obtained from environmental sample
  misc_feature (1)..(132): Xaa is any amino acid
MLRNYFVIALRNLVKSPGLSGIKIIGLCVGVCGCIIVFLLVKLELSFDKHHTKGENVYRPYTAFKGVWEGTNYGIALPFPSAFRERAVGVKSVSQMITANEDVVXNDGGSEKKFTKPNKIAFCRQQLLSCIS

SEQ ID NO: 5297 - DNA, 570 bp, Unknown
  Obtained from environmental sample
  misc_feature (1)..(570): n is a, c, g, or t
ttgttcgcccagggcgtacggcccacatatcgaagagggtgctctatgaacttaaatctaacagcagaggaaaaaaggttagttgaatattcgcaggaagccattgcaaaatataacaagatccgccacgtaaatggcgggatcgataccctgtacgcctttgttctttcggagaaagagaacatctacgatggagccagctatgagccgaacatcgtccacgcaagtgtttgcggtgagcggtgtgcgatcgccaatatggtcctgcaggagtcgtataaagcgaaaatcaaaagcattgtcgtggcagacccggtcccggaagtgcaggaatatgggacaccgccctgtgggacctgccggcatctgatctggtcgcatgggaaaccggaaacgactgtgattctcatgcagtacatccagggcaaagaaagctggacgttcccgaagctgcagaaatatacgatcaaagacttctatcccctccatatgagccgaaagaagactttgggacactggcagcccgggtattcatcaaagcagggcctcccgtcccgctgccagccgtag

SEQ ID NO: 5298 - protein, 189 aa, Unknown
  Obtained from environmental sample
  misc_feature (1)..(189): Xaa is any amino acid
MFAQGVRPTYRRGCSMNLNLTAEEKRLVEYSQEAIAKYNKIRHVNGGIDTLYAFVLSEKENIYDGASYEPNIVHASVCGERCAIANMVLQESYKAKIKSIVVADPVPEVQEYGTPPCGTCRHLIWSHGKPETTVILMQYIQGKESWTFPKLQKYTIKDFYPLHMSRKKTLGHWQPGYSSKQGLPSRCQP

SEQ ID NO: 5299 - DNA, 378 bp, Unknown
  Obtained from environmental sample
  misc_feature (1)..(378): n is a, c, g, or t
atgtcaattacaagaaaagataatctgcaaagtgatttgaatagtgttttactttctgtagaagggaaagttgatcctgctgtgattaaaaagatccagcgcgcgatggataacttgttggagcaagataataaatttaatcgagaaatattaacccattctgtcgatgagttactcatccttggcgactctaaagaattacacaaggaagaaattaaaaaaatcttaaaatttttagagtccttaaaagattttttgacaaaaggcttaaagaatttatatgaatacgataacatgctcaaagaagaacaacgcaaagtaaacactaaaattgcggatatacaagaaaaacaaggattccgcattggcagaagataa

SEQ ID NO: 5300 - protein, 125 aa, Unknown
  Obtained from environmental sample
  misc_feature (1)..(125): Xaa is any amino acid
MSITRKDNLQSDLNSVLLSVEGKVDPAVIKKIQRAMDNLLEQDNKFNREILTHSVDELLILGDSKELHKEEIKKILKFLESLKDFLTKGLKNLYEYDNMLKEEQRKVNTKIADIQEKQGFRIGRR

SEQ ID NO: 5301 - DNA, 375 bp, Unknown
  Obtained from environmental sample
  misc_feature (1)..(375): n is a, c, g, or t
atgggtcaaaaagttcatccgaaaggattacgattaggaactctcataacatgggattcccgctggatgttttcgaataaaaaactatatcgagagaatatcatatcagacgtaatcattcgtacttccatattaaagaaatttaaatttgccgttgtaactaaggtagaaattgaaagagcaattaatagagtaactgttatcatccattcagctaaacctggaatgataattggtagaggtggaaaaggtctagaagaggtaaaatatttcctttcttctacaataggagcagaaaaaattaaaaagaaaaaatcaaaattgatatacgaattgaaccagttaaaaagccctatcttgatgcttattatgtag

SEQ ID NO: 5302 - protein, 124 aa, Unknown
  Obtained from environmental sample
  DOMAIN (64)...(110): KH domain
  misc_feature (1)..(124): Xaa is any amino acid
MGQKVHPKGLRLGTLITWDSRWMFSNKKLYRENIISDVIIRTSILKKFKFAVVTKVEIERAINRVTVIIHSAKPGMIIGRGGKGLEEVKYFLSSTIGAEKIKKKKSKLIYELNQLKSPILMLIM

SEQ ID NO: 5303 - DNA, 333 bp, Unknown
  Obtained from environmental sample
  misc_feature (1)..(333): n is a, c, g, or t
ttgagaagaaaaaacatgcacctatcaggcatttgctcaggctatgtccgtggatgcagcaaatatgctgatgtaaacagccgcgcgcaacagttaaaaagcttcggccgatctaataaatttatcgaaaaccgaggtaaacttgtcgtgatcggaaaagtgatgcagaaaatctaccctaccctcaaccttggggataagaaaacccaaacccccctcatcgattggaaaaatatcccggataagaggttccctttgctaaaaaacttgccatttaaaagtttttgcttgccctatcttccaaaaaaaaaaaagctggccaaaaaaatttga

SEQ ID NO: 5304 - protein, 110 aa, Unknown
  Obtained from environmental sample
  misc_feature (1)..(110): Xaa is any amino acid
MRRKNMHLSGICSGYVRGCSKYADVNSRAQQLKSFGRSNKFIENRGKLVVIGKVMQKIYPTLNLGDKKTQTPLIDWKNIPDKRFPLLKNLPFKSFCLPYLPKKKKLAKKI

SEQ ID NO: 5305 - DNA, 357 bp, Unknown
  Obtained from environmental sample
  misc_feature (1)..(357): n is a, c, g, or t
gtgcccgggttatacttttacaacaatgatgttgtggagattgccaaaaacatcaagccaggcccccggggtgaatacgagatcaccgacattaaccggtattacctggaacgtaaaaatttaaaggtcgctgtgctcgatcgtggatttgcctggctggatacgggaacttttgattcccttcacgacgcaagtgagtatgtaagggtgatcgaaaaaagacagggtttaaagatcgggtgccctgaagagatagcttaccgcatgggatttattgataaagaacaacttgccaaattagccgaaggtcttaaaaaaagcgggtatggcgaatacctgcaacgaatgattaaataa

SEQ ID NO: 5306 - protein, 118 aa, Unknown
  Obtained from environmental sample
  misc_feature (1)..(118): Xaa is any amino acid
MPGLYFYNNDVVEIAKNIKPGPRGEYEITDINRYYLERKNLKVAVLDRGFAWLDTGTFDSLHDASEYVRVIEKRQGLKIGCPEEIAYRMGFIDKEQLAKLAEGLKKSGYGEYLQRMIK

SEQ ID NO: 5307 - DNA, 327 bp, Unknown
  Obtained from environmental sample
  misc_feature (1)..(327): n is a, c, g, or t
atgtatgaggcaaaagaacgtgtgacaaatattgaaatgcaatttgccaataaacaaatccgtactatcgaatttaccatccctgatggttatgaaattaaaaatttgaaagaccttaatattaatcaaacgtataaggagaacaacgaacaactaatgggttttgtttctacctacgagcagaaaggaaatattctaaaaatttttattgacgaagaatacaacaggtatttttacccaacagaaaaatatgaggtattcaaaaaaataattaactcctccgctgattttaataaagtagtgctggtgctggataagaaatcataa

SEQ ID NO: 5308 - protein, 108 aa, Unknown
  Obtained from environmental sample
  misc_feature (1)..(108): Xaa is any amino acid
MYEAKERVTNIEMQFANKQIRTIEFTIPDGYEIKNLKDLNINQTYKENNEQLMGFVSTYEQKGNILKIFIDEEYNRYFYPTEKYEVFKKIINSSADFNKVVLVLDKKS

SEQ ID NO: 5309 - DNA, 351 bp, Unknown
  Obtained from environmental sample
  misc_feature (1)..(351): n is a, c, g, or t
atgcatatgctaaagatttatttcaaaccaaattgttcgacctgccgcacggcgctctcgctgataaaggacaataccgatgaagattatgaactcatcgaatatctcgtggacacaccatccgaaaaggaaatacgcgagatccttaaaatgcttaacatgaaggccgaggatctggttaggaaaaaagaacccttattcaaggaaaaatttgacggcaaaaagatcagcaatgcgcaatggataaagattctgcatgagaatccggtcctgatcgaaagacccatcgttattaaagacggcaaagcaataatcggaagacccgttgagaaaattttgaatatcctgtaa

SEQ ID NO: 5310 - protein, 116 aa, Unknown
  Obtained from environmental sample
  DOMAIN (7)...(116): ArsC family
  misc_feature (1)..(116): Xaa is any amino acid
MHMLKIYFKPNCSTCRTALSLIKDNTDEDYELIEYLVDTPSEKEIREILKMLNMKAEDLVRKKEPLFKEKFDGKKISNAQWIKILHENPVLIERPIVIKDGKAIIGRPVEKILNIL

SEQ ID NO: 5311 - DNA, 717 bp, Unknown
  Obtained from environmental sample
  misc_feature (1)..(717): n is a, c, g, or t
atganatgccatgagcgacttcaggaatttacctttatatcgagtcatgatctgcaggaaccgctgcgtaaaattcaaatttttaccaatttcctttctaccccggccgctcaactcaacgagtatgctaaaaagtattcggataagatcaattcctctgccttcagaatgtctgcgttgataaaagaccttcttagcttctcaattctaagggatgataagatagaaatggaaaaagttgatctgaatgccgttatgagaaatattataaatgattttgaagttctcattgaagagagaaaggcgactgtcaacgtttcgttgcttcccgtcgtttgtggtgagccggttcagatgaatcagctcttctacaacctgatcagcaatgcgctaaaatttagcagggaaaatccggtcattaatatcagcgcaggcgaagcgagcgctaatgattttttaatttacccggaattagtgaaagacacgtactacgttttcatcagtgtaaaggataacggtattggatttgatcaaaaataccaggataagatcttcacactttttcaacggcttaacgataaaaaagacgtgcctggcacgggagtagggttagcgatctgcaaaaaaattgttgacaatcacaaaggattcatttttgtaaatagtacaaaaaacataggaactaccttcgaagtgtttcttccgggcaaagtataa

SEQ ID NO: 5312 - protein, 238 aa, Unknown
  Obtained from environmental sample
  DOMAIN (6)...(73): His Kinase A (phosphoacceptor) domain
  misc_feature (1)..(238): Xaa is any amino acid
MXCHERLQEFTFISSHDLQEPLRKIQIFTNFLSTPAAQLNEYAKKYSDKINSSAFRMSALIKDLLSFSILRDDKIEMEKVDLNAVMRNIINDFEVLIEERKATVNVSLLPVVCGEPVQMNQLFYNLISNALKFSRENPVINISAGEASANDFLIYPELVKDTYYVFISVKDNGIGFDQKYQDKIFTLFQRLNDKKDVPGTGVGLAICKKIVDNHKGFIFVNSTKNIGTTFEVFLPGKV

SEQ ID NO: 5313 - DNA, 474 bp, Unknown
  Obtained from environmental sample
  misc_feature (1)..(474): n is a, c, g, or t
ttgttggctactacctggaactggcagggaaaagcatcgttcaatgaccactgcacaatttcagcatccgtggggtcgtcttcaagcattaaaattttcaatggcgacgtcatggtatgttttttttggcctggttctaaaaatgccctgttaacaggcaatactaacttaaaattaaagatcatttgccaatacaagcccaaaactaaaacagcatcatcattgaacaaattgcattggcacaaatttttagatatctcatcgtataccctgcctatgccttcaagcgtcatatcgcaataccactactatgccgatacgcttactttgcgtatagtgttcttatcgggccgcatctacgactacaaaaatgtgccggaaaaaacctatcaacaattgaaatcatcaaaatcaaaaggcagtttcctcaatcaaaaaatcaaaccacattacgattatgtgaaaattaattaa

SEQ ID NO: 5314 - protein, 157 aa, Unknown
  Obtained from environmental sample
  misc_feature (1)..(157): Xaa is any amino acid
MLATTWNWQGKASFNDHCTISASVGSSSSIKIFNGDVMVCFFWPGSKNALLTGNTNLKLKIICQYKPKTKTASSLNKLHWHKFLDISSYTLPMPSSVISQYHYYADTLTLRIVFLSGRIYDYKNVPEKTYQQLKSSKSKGSFLNQKIKPHYDYVKIN

SEQ ID NO: 5315 - DNA, 540 bp, Unknown
  Obtained from environmental sample
  misc_feature (1)..(540): n is a, c, g, or t
atggcagacccaatccgactaagcgatgttctggctgagatctccagattgtacgggacggtgaagcattcgctcgacagaaagagccttgaggcgctgggaaagcggctcatctttcttagaagaactattaatgacgatattctcaaggtactcaatattgtgaatgccgcaggtgaattgtcgtccgacaaattcgatcagtggcaggcccaaccaccaggctggaggttggacgttctgaaaaagctcgaggagaggatcgttcttgaagattctgtggagctctctgagttttttgcgaatgtttcaaccgcggtgattaatgcgcaaaaaaacctcaatactttctccggacagtatgttgacgaactggagaagaagaattccagaattccgcccacctattttgctattccgaatataaaggccgagatgaagcttggcttcagcgaaatgacgtcaaagggtgtcaacgtgattctcttcaagaatgaagaacagaagaagcaatatgtcgagagtacggtgactttttga

SEQ ID NO: 5316 - protein, 179 aa, Unknown
  Obtained from environmental sample
  misc_feature (1)..(179): Xaa is any amino acid
MADPIRLSDVLAEISRLYGTVKHSLDRKSLEALGKRLIFLRRTINDDILKVLNIVNAAGELSSDKFDQWQAQPPGWRLDVLKKLEERIVLEDSVELSEFFANVSTAVINAQKNLNTFSGQYVDELEKKNSRIPPTYFAIPNIKAEMKLGFSEMTSKGVNVILFKNEEQKKQYVESTVTF

SEQ ID NO: 5317 - DNA, 354 bp, Unknown
  Obtained from environmental sample
  misc_feature (1)..(354): n is a, c, g, or t
atgtacgaagccggcagtgtgtttacttatgaggataaatccgcaggctctaaaaagatcctcgaaacagggaataagataatgatcaatgccgggaatgcggatctgatttttcacggtgaaaagggcagggaatttgatgtatttgatatgaagggtgagcttgaaatgctgtttggaaaattcaatattgaaattaacaaattaaatgattattattatagcgattattttgattgcaggatagaatactttaataaaaacgttctaattgcttcaattgttaagttttctaaaggcttcctgaagaagtttgatattgaaagaagtgtgattacatgcgagatctgttaa

SEQ ID NO: 5318 - protein, 117 aa, Unknown
  Obtained from environmental sample
  misc_feature (1)..(117): Xaa is any amino acid
MYEAGSVFTYEDKSAGSKKILETGNKIMINAGNADLIFHGEKGREFDVFDMKGELEMLFGKFNIEINKLNDYYYSDYFDCRIEYFNKNVLIASIVKFSKGFLKKFDIERSVITCEIC

SEQ ID NO: 5319 - DNA, 342 bp, Unknown
  Obtained from environmental sample
  misc_feature (1)..(342): n is a, c, g, or t
atggaagattggttatccttcaactttatcgcatacgaagtattgaaaattgggaaaactgacacgcttacacaattagctccgcctcacctattagagattaacgatgtaaaaacctactcaacaaagtctatccaacaacgcaaaccctacataaatttaatcatcatcaaggccacacaatcgtctcgcgcaatcacacaatcacaagttgcggcaaacaaaaaactaaactacttattcaaaaaaaggaaagaaaatccaaatcccactcatcaaagaaaacgaagagggacctttgatttgtgcggtagtgactcagtgctgaaggacagaacgtga

SEQ ID NO: 5320 - protein, 113 aa, Unknown
  Obtained from environmental sample
  misc_feature (1)..(113): Xaa is any amino acid
MEDWLSFNFIAYEVLKIGKTDTLTQLAPPHLLEINDVKTYSTKSIQQRKPYINLIIIKATQSSRAITQSQVAANKKLNYLFKKRKENPNPTHQRKRRGTFDLCGSDSVLKDRT

SEQ ID NO: 5321 - DNA, 627 bp, Unknown
  Obtained from environmental sample
  misc_feature (1)..(627): n is a, c, g, or t
gtgcacccgcattttttgtttaacaccctgaacaatatatattctttttcgatggcgaattctcccaaaacgcccgaacttattttgaagttgtcgtcgttgctcagttatattttgcatgattgcaaaacagacgaggtccgtttggaaaaagaaatcgagatcatgaaaaattatatagacctggaaaaagagcgatatggcaataaaatagagatagcgtggaatgtagagggagaaataagcgacaagtgcattgccccattattaatactcccttttcttgaaaacgcgtttaagcatggagcttcggaacaaatcgaaaaatcctggctcagcgtggacatatcagtacaaaaaaaggttctcagatgcaaaattgccaatagtaaaaatgaatttgtgccttatagcgaaaggggtatcggtattgctaatgtaaaaaaacggcttgaatttatttatccgggcaatcatgaattgaaattaattgatgaaggttgcttttatgtggttgctatgctcgttaatgtaagttgcaaaactgaaatgtctgatttacacctggccaaaccacatatctcacaggggggaaatagagttacaccaatacctgcttacaaataa

SEQ ID NO: 5322 - protein, 208 aa, Unknown
  Obtained from environmental sample
  DOMAIN (1)...(76): Histidine kinase
  misc_feature (1)..(208): Xaa is any amino acid
MHPHFLFNTLNNIYSFSMANSPKTPELILKLSSLLSYILHDCKTDEVRLEKEIEIMKNYIDLEKERYGNKIEIAWNVEGEISDKCIAPLLILPFLENAFKHGASEQIEKSWLSVDISVQKKVLRCKIANSKNEFVPYSERGIGIANVKKRLEFIYPGNHELKLIDEGCFYVVAMLVNVSCKTEMSDLHLAKPHISQGGNRVTPIPAYK

SEQ ID NO: 5323 - DNA, 300 bp, Unknown; identical to SEQ ID NO: 73
  Obtained from environmental sample
  misc_feature (1)..(300): n is a, c, g, or t

SEQ ID NO: 5324 - protein, 99 aa, Unknown; identical to SEQ ID NO: 74
  Obtained from environmental sample
  misc_feature (1)..(99): Xaa is any amino acid

SEQ ID NO: 5325 - DNA, 474 bp, Unknown
  Obtained from environmental sample
  misc_feature (1)..(474): n is a, c, g, or t
atgacgttagggggccgtgcttcagagtctattttctttggcaaggtatctaccggtgcgagtaatgatctgcaacaaataaccaagatggcttattcaatggttaccgtatatggtatgaatccaaaggttgggaatgtgagttattatgacccagcgcaggaaaatgcattccaaaaaccttttagtgaggagacaggaaaaatgattgatgaagaagtgcgcaaattaatagagatggcatttgagagaaccaaagctctgttaacagaaaagaaaaatgaggtggagatcatcgcaaaggaattattaaagagagaagttctttttcaaagcgatgtagaagccttaattggtaaaaggccttatgaagataaaaaggcattggattttgtagataatcctaaagaagcagtcattgattccccaatacatgtagtggataccaatgatacaacctgtcaaataaaataa

SEQ ID NO: 5326 - protein, 157 aa, Unknown
  Obtained from environmental sample
  DOMAIN (1)...(117): Peptidase family M41
  misc_feature (1)..(157): Xaa is any amino acid
MTLGGRASESIFFGKVSTGASNDLQQITKMAYSMVTVYGMNPKVGNVSYYDPAQENAFQKPFSEETGKMIDEEVRKLIEMAFERTKALLTEKKNEVEIIAKELLKREVLFQSDVEALIGKRPYEDKKALDFVDNPKEAVIDSPIHVVDTNDTTCQIK

SEQ ID NO: 5327 - DNA, 582 bp, Unknown
  Obtained from environmental sample
  misc_feature (1)..(582): n is a, c, g, or t
ttgaaagtaacaatcgttcctagaggaactgctgcattgggctatgctcaatatactcctaaggaacaatacctttataatacagatcagttattagatcaaatttgtatgacgttagggggccgtgcttcagagtctattttctttggcaaggtatctaccggtgcgagtaatgatctgcaacaaataaccaagatggcttattcaatggttaccgtatatggtatgaatccaaaggttgggaatgtgagttattatgacccagcgcaggaaaatgcattccaaaaaccttttagtgaggagacaggaaaaatgattgatgaagaagtgcgcaaattaatagagatggcatttgagagaaccaaagctctgttaacagaaaagaaaaatgaggtggagatcatcgcaaaggaattattaaagagagaagttctttttcaaagcgatgtagaagccttaattggtaaaaggccttatgaagataaaaaggcattggattttgtagataatcctaaagaagcagtcattgattccccaatacatgtagtggataccaatgatacaacctgtcaaataaaataa

SEQ ID NO: 5328 - protein, 193 aa, Unknown
  Obtained from environmental sample
  DOMAIN (1)...(153): Peptidase family M41
  misc_feature (1)..(193): Xaa is any amino acid
MKVTIVPRGTAALGYAQYTPKEQYLYNTDQLLDQICMTLGGRASESIFFGKVSTGASNDLQQITKMAYSMVTVYGMNPKVGNVSYYDPAQENAFQKPFSEETGKMIDEEVRKLIEMAFERTKALLTEKKNEVEIIAKELLKREVLFQSDVEALIGKRPYEDKKALDFVDNPKEAVIDSPIHVVDTNDTTCQIK

SEQ ID NO: 5329 - DNA, 390 bp, Unknown
  Obtained from environmental sample
  misc_feature (1)..(390): n is a, c, g, or t
atgcaacgtgtagattttgtgtacatcaatggctcccgaaacaatgcttttggatcgtacaaagaaaagaatggacagtggctggagcaatttgccaatgctattgacagtattggcggttatgaacatttgaaagtgcttgacctctatcacaaaaacggaatggagctcaataacctggtaaaatttaaacgcttaaaagatccgcaaacaggtgcgtacaaaaattatccctaccccgaatttataaatgttccttttaaccctgatacggatgaacatccttatccgacggaatccatcaacataacctacgatggattgcatccttccgataaaggttatgaaatgattacaaaaatgctggtgaagattatgaagaagtattga

SEQ ID NO: 5330 - protein, 129 aa, Unknown
  Obtained from environmental sample
  misc_feature (1)..(129): Xaa is any amino acid
MQRVDFVYINGSRNNAFGSYKEKNGQWLEQFANAIDSIGGYEHLKVLDLYHKNGMELNNLVKFKRLKDPQTGAYKNYPYPEFINVPFNPDTDEHPYPTESINITYDGLHPSDKGYEMITKMLVKIMKKY

SEQ ID NO: 5331 - DNA, 390 bp, Unknown; identical to SEQ ID NO: 5329
  Obtained from environmental sample
  misc_feature (1)..(390): n is a, c, g, or t

SEQ ID NO: 5332 - protein, 129 aa, Unknown; identical to SEQ ID NO: 5330
  Obtained from environmental sample
  misc_feature (1)..(129): Xaa is any amino acid

SEQ ID NO: 5333 - DNA, 507 bp, Unknown
  Obtained from environmental sample
  misc_feature (1)..(507): n is a, c, g, or t
atgccgatgagaacagttgcaaaggtggcaaatgaacttggtttagcaggcatttcggaacaaacagctcttaatgctaccaacaaggccgtgatgcgtcagtgccttaagcaacacaatgttcctattcctgagttctataaggctaatacaaaagaagagtatctagatacaataggtaagtttaagactacgtgcattgttaagccagcggataactctggcagcagaggcgtcgttctgctttctgatctaacaaatattgaagcaatcaataaggcatttgaatacagcaagaataattcccgcagcggtgacattgttgtagaagaatatttggaggggccggaagtcagcgttgagactctaagtttagacggtgtctgtcatgtaattcagatcactgataagctgactacagggtctcctttcttcgtagaaatggggcataatgagccctctatgcttcccaaagatataaaacgaaaatgncaaagtcgcaaatga

SEQ ID NO: 5334 - protein, 168 aa, Unknown
  Obtained from environmental sample
  misc_feature (1)..(168): Xaa is any amino acid
MPMRTVAKVANELGLAGISEQTALNATNKAVMRQCLKQHNVPIPEFYKANTKEEYLDTIGKFKTTCIVKPADNSGSRGVVLLSDLTNIEAINKAFEYSKNNSRSGDIVVEEYLEGPEVSVETLSLDGVCHVIQITDKLTTGSPFFVEMGHNEPSMLPKDIKRKXQSRK

SEQ ID NO: 5335 - DNA, 795 bp, Unknown
  Obtained from environmental sample
  misc_feature (1)..(795): n is a, c, g, or t
atgtggctgtttcgcgacaaaaactggacaacagcgccatacaaaattgaagaagaaaaaatacaggtgaaagagaaaagctttttaatcagttatactgcttttcacgagctcggtgaaattctttataaatcgtttgtagagataaaaggagaggaggatggtacaatatcattttcttttaaaggtgaagccctatcttcttttgaaagaaatcgcattggcctgtgtgtattacatcctatgaaggaatgtgccggtaataaagccaccataatttgtccggatggctcatcttatgaaggcttgtttccaaaaccagttagcccgcatcaaccttttaaaaatatccggcaattaaaatggaaagttggcgaacagattgaagcaaatgttttttttgaaggcgatatttttgaaacagaagaccaacgaaactggtcggataattcttataaaacttacagcacacctcttgaaattccgtatcctgctttagtaaaaaaaggtgacagggtagaacaaaaggtaattttacaaatttcagaagaagcaggtgagcaaaaccaggctccaaaaatttttgaagaaaataaaattccttttccaaaaattggctatgcccgttctgaggagccattgacacatgccgaaataaacctgcttagaaaaattccttttgatcattaccgcgttacattaagtttgtgtaaagaggattggaaagaaggctggctcttagctgttgaagaaacgaaaaaattggctaccgaaatcgaactgttgtttttttaa

SEQ ID NO: 5336 - protein, 264 aa, Unknown
  Obtained from environmental sample
  misc_feature (1)..(264): Xaa is any amino acid
MWLFRDKNWTTAPYKIEEEKIQVKEKSFLISYTAFHELGEILYKSFVEIKGEEDGTISFSFKGEALSSFERNRIGLCVLHPMKECAGNKATIICPDGSSYEGLFPKPVSPHQPFKNIRQLKWKVGEQIEANVFFEGDIFETEDQRNWSDNSYKTYSTPLEIPYPALVKKGDRVEQKVILQISEEAGEQNQAPKIFEENKIPFPKIGYARSEEPLTHAEINLLRKIPFDHYRVTLSLCKEDWKEGWLLAVEETKKLATEIELLFF

SEQ ID NO: 5337 - DNA, 660 bp, Unknown
  Obtained from environmental sample
  misc_feature (1)..(660): n is a, c, g, or t
atgagcaagctatttacacccattcttattcccgcaggtattgaaaaaaaaggaactgaaggtcatgccttgtttacactttggtttcaactaaacgctaaccatgacgctttttcaaaaacatggaccgggcccatccctgaaaatgtcttcaattccataaaaaaattacctggccttgtaaataaccttaaaaacaagagagttgccattgtgcattctaacggctcaaaaaaattggatgcttatccgtcttatgatggacccgttatcgttacaccggaaggtgttgaatttcattcaaactattttgataccgttacaactttctcaaaaattcggcaattaatagcacagnaaactanattctttaattcccctcaaacaaccaatacagccattcgaagtatacttcacggtaaaggtcctatcgggccgctcgatattgatacgccaattgaagacagactcgaagtgtataacgatgctgttgattcatttcatacattgaaggaacaaatagaacttatccgaaacgccaaaaaggaaatctgtaagcacgcggcactgatggcacaggtaaaaccttatgagtacaccggaaatcctctaaaaatgatgaacgacagtcaatccgtggccttccaggcgaaagcttaa

SEQ ID NO: 5338 - protein, 219 aa, Unknown
  Obtained from environmental sample
  misc_feature (1)..(219): Xaa is any amino acid
MSKLFTPILIPAGIEKKGTEGHALFTLWFQLNANHDAFSKTWTGPIPENVFNSIKKLPGLVNNLKNKRVAIVHSNGSKKLDAYPSYDGPVIVTPEGVEFHSNYFDTVTTFSKIRQLIAQXTXFFNSPQTTNTAIRSILHGKGPIGPLDIDTPIEDRLEVYNDAVDSFHTLKEQIELIRNAKKEICKHAALMAQVKPYEYTGNPLKMMNDSQSVAFQAKA

SEQ ID NO: 5339 - DNA, 897 bp, Unknown
  Obtained from environmental sample
  misc_feature (1)..(897): n is a, c, g, or t
ttgagtcgcgatttagtcaaagatcgaaaaaccgttgttgattccgtaagagaccgcgtggacagttcagactataaacggtaccgatacaatttttccaaagatgcgctcgaaaatattcacacaaaagctaaacgcctgatcggcgatatcaacaaaagacatcaaaaaataggtcgggagatactcggaagtaaaaactggacaagtgttgtcggcaatttgtggaaggcaacaaagaatcagaaggactcttcggttgttgtggacaaaacccaattcgagtacactacacaagaactagatacactcttggatctatttcaaaaatcccagccaatatatggggaatatttgacggttgcagaccaggcatttattaacccgaagaagcttcatggtgaaaacccctacataatcgagcaagcatttgatgattcatttaagttttattctaatcaactccagcaagttaatctggttctggaagcaaatagagaagagtatttcaaactgagaaaatctgaactggataaccaaatcaaaaagatcaacagcctgattgatgaactgttggctcaggaagctgtcttaaataacctttgcaaaactgaatgtgacctctatttagagtcacgacaaaaagagtttgcaggtcaatgtaagtccataaacgaagtaaatgaagctattggaaatatattcaacacaaataaggagaatcaagatttattcaatgaatcaaaaacagcgtcgttcacgtataagctcggttccttattctcaaggaagaaaaaacaaacgattaaagatcagcgtatcttgagagtacttttggacattttcaagagttgtaaacacttcaaagatttccccttatcagttatggattgctag

SEQ ID NO: 5340 - protein, 298 aa, Unknown
  Obtained from environmental sample
  misc_feature (1)..(298): Xaa is any amino acid
MSRDLVKDRKTVVDSVRDRVDSSDYKRYRYNFSKDALENIHTKAKRLIGDINKRHQKIGREILGSKNWTSVVGNLWKATKNQKDSSVVVDKTQFEYTTQELDTLLDLFQKSQPIYGEYLTVADQAFINPKKLHGENPYIIEQAFDDSFKFYSNQLQQVNLVLEANREEYFKLRKSELDNQIKKINSLIDELLAQEAVLNNLCKTECDLYLESRQKEFAGQCKSINEVNEAIGNIFNTNKENQDLFNESKTASFTYKLGSLFSRKKKQTIKDQRILRVLLDIFKSCKHFKDFPLSVMDC

SEQ ID NO: 5341 - DNA, 732 bp, Unknown
  Obtained from environmental sample
  misc_feature (1)..(732): n is a, c, g, or t
atggttctatcaataatcgaaaagaatatccatagattaccaaatggaaaatatccgagcgttggtgttgctacatttaatatagcccagcgaaacctgattaagagtaaaatcctagaccgtcagcggttcgcaaaaaatgcagcttttaatgaaaaaattcaagaattggaggaagaaggtttgtttattaaaaaccttgaaaatattcaaggtgatgaaagagatataataattctctcaactacctatggtgtcgggaaagacagaaagtttgtccaaaggttcggtcccatcatacattcaaaaggatataagttgttgaatgtaataataacacgggctaaatataaaatctatgtctgttcctctgtacctgaacaagtcttcttaaattttaaagaacacctgattactgaaggttcaaacaatagaaaggctgtattttatgcatacctcgcttattgtaaggccaccagtgagcaaaaccaagagttcagaatgtcagttctgacaagcctagcagaaaatactacccgtagcgcaagtttcgaatcattcaaagtgggagaattggagtcaccgtttgaagaagaagtatatcaaactttagctgatcactttggtaccgaaaaaattgctgcacaggtccaatttgccggattcaggatagacattgtatatgatccaagactgcctgacattccgaaaatcgcattcttgatccactag

SEQ ID NO: 5342 - protein, 243 aa, Unknown
  Obtained from environmental sample
  misc_feature (1)..(243): Xaa is any amino acid
MVLSIIEKNIHRLPNGKYPSVGVATFNIAQRNLIKSKILDRQRFAKNAAFNEKIQELEEEGLFIKNLENIQGDERDIIILSTTYGVGKDRKFVQRFGPIIHSKGYKLLNVIITRAKYKIYVCSSVPEQVFLNFKEHLITEGSNNRKAVFYAYLAYCKATSEQNQEFRMSVLTSLAENTTRSASFESFKVGELESPFEEEVYQTLADHFGTEKIAAQVQFAGFRIDIVYDPRLPDIPKIAFLIH

SEQ ID NO: 5343 - DNA, 747 bp, Unknown
  Obtained from environmental sample
  misc_feature (1)..(747): n is a, c, g, or t
atgatgctggcctcacagacgaatatcatcaggcgccagacacacctttatttccagggcggcaatattctgcaggccggcgattatgtcattatcggactggattacctgaaggaaaactgtggcagaatgttcctggagaccatgcccaaggttaagaagcagttcgaaaatttgctgggtaagccggtcataacggtcggccacagagatattattgagcacaaacaccgtcagtatcttgggggcggaattttccagcccattttccacattgatatgtatgtcactccaaccggaaaaaccggtaaaacgggaaaagagattgttcttgtcggcagcccaaggctggcgcgcaggatcctaggagagaaagacctggataacgactataatgaatattttgatgaaactgcagaacagttgctgcaatattttgaagttcagcgattgcctttgcttcccactaaatacaaatcaaaggagcaggaaatgcccaggcattattatcttacttataataacgcattaattgaaaactattcggaaaatggtaaagatcaaagctgtgtgtatgttgccacttacagagaagatgtgcaaaaattcaaatcagagacctttattcttgaattattaccggtgacgaaaaaaaatacaggaaacttgatgaggccgccagcaagatctggcgcaacctgggcttcaaaactttcagtatggatggtttggaggacctggctatga

SEQ ID NO: 5344 - protein, 248 aa, Unknown
  Obtained from environmental sample
  misc_feature (1)..(248): Xaa is any amino acid
MMLASQTNIIRRQTHLYFQGGNILQAGDYVIIGLDYLKENCGRMFLETMPKVKKQFENLLGKPVITVGHRDIIEHKHRQYLGGGIFQPIFHIDMYVTPTGKTGKTGKEIVLVGSPRLARRILGEKDLDNDYNEYFDETAEQLLQYFEVQRLPLLPTKYKSKEQEMPRHYYLTYNNALIENYSENGKDQSCVYVATYREDVQKFKSETFILELLPVTKKNTGNLMRPPARSGATWASKLSVWMVWRTWL

SEQ ID NO: 5345 - DNA, 603 bp, Unknown
  Obtained from environmental sample
  misc_feature (1)..(603): n is a, c, g, or t
gtgctttcaaaagaaatggcaaataagttttttggaaattggaagactgctttaggcaaaagcttcagttttgatgataaggtgaattatacagttagtggtgtaattgatgatgttgctgaaaattattcggtaccggtaaaaattatgcttgcttacaaatctttcaaaagcaatagtttaacgaattggggttcagttagttctagttctgaaagctactttaaactaaaatcaaatgttaacatagaaacacttaacggaccgctaacatcattcattaaaaaatattatgtagaaaaagcacccggtaaagaaggacatctatttcagccattggcagatattcattacaatgaaaaatttggcaatttttcaggtcgcattatgcccaaaaaacaactttacggattagttataattggcttttttctgatgattacagcctctatcaattttattaatctggcaactgcacaggcggtaagtcgttctaaagaggttggagttaggaaagtaatgggtagcccaagaagccagttaatcattcaatttttaacagaaactttaaccatagtattcatttcattgttaattggaagn

SEQ ID NO: 5346 - protein, 201 aa, Unknown
  Obtained from environmental sample
  misc_feature (1)..(201): Xaa is any amino acid
MLSKEMANKFFGNWKTALGKSFSFDDKVNYTVSGVIDDVAENYSVPVKIMLAYKSFKSNSLTNWGSVSSSSESYFKLKSNVNIETLNGPLTSFIKKYYVEKAPGKEGHLFQPLADIHYNEKFGNFSGRIMPKKQLYGLVIIGFFLMITASINFINLATAQAVSRSKEVGVRKVMGSPRSQLIIQFLTETLTIVFISLLIGX

SEQ ID NO: 5347 - DNA, 726 bp, Unknown
  Obtained from environmental sample
  misc_feature (1)..(726): n is a, c, g, or t
gtgatcaatggcctgcgtaagctggaatatcgcggctatgattccagcggcctgggcattatctgcggcgacgaaattcaggtcagaaaagccccgggcaagatcggcaaactgcaggaactaatgaaaaccgacgtcatgtccttgggcacggtcggcatttcacatacccgatgggcgacccacggcgcgccgaatcaagttaattcccatcctcattttgactgctcaaaaaaaattctcattgttcataacggcattatcgaaaattacgaagaattaaggaccgctctagaaaagagaggccataaatttttgtctgaaacagacacggaagtcgttgcgcatttaattgaagaaaacttaaacggggattttttaacggcagtacgcaaatctttccgtcagctcacgggcgcgtttgctttagggattatttgtacggatcatccggatactttaatcgccgcccggatcggatcgccgctcattatcggcctcggtgaaaaagaaaattatatcgcttccgacgttcccgccattttggatttaaccaagaaaattatttatctcaaagacggcgaaatggccgttattacgaaagacaatgtcgctgtttccgatttcaacggaaaaaaagttacgccgaaagtcgatacggtcaagttcagtgcggaagcggtccaaaagcagggttcgatcactttatgctcaaagaaatgttga

SEQ ID NO: 5348 - protein, 241 aa, Unknown
  Obtained from environmental sample
  DOMAIN (1)...(120): Glutamine amidotransferases class-II
  misc_feature (1)..(241): Xaa is any amino acid
MINGLRKLEYRGYDSSGLGIICGDEIQVRKAPGKIGKLQELMKTDVMSLGTVGISHTRWATHGAPNQVNSHPHFDCSKKILIVHNGIIENYEELRTALEKRGHKFLSETDTEVVAHLIEENLNGDFLTAVRKSFRQLTGAFALGIICTDHPDTLIAARIGSPLIIGLGEKENYIASDVPAILDLTKKIIYLKDGEMAVITKDNVAVSDFNGKKVTPKVDTVKFSAEAVQKQGSITLCSKKC

SEQ ID NO: 5349 - DNA, 804 bp, Unknown
  Obtained from environmental sample
  misc_feature (1)..(804): n is a, c, g, or t
atgtcatatccttaccaggttcaatcattagaagaatataaagaagcttacaaaaaaagtatagaggaacccgagtcattctggagtgatatagcccaacatttcttgtggaaaaaaaagtgggataaagttttagaatggaatttcaaggaacccgatactaaatggtttatcaatggcaaattgaatattacagaaaactgtattgacaggcacctggcaacaatgggtgagaagccagctattatctgggaacccaacaacccggaagaccgcgtacgtatagttacctataatcgtttacataaaagggtttgccagtttgcacaagtgcttattaacaatggcgtaaaaaaaggtgaccgtgtttgtatttatatgggtatggttcccgaactggtatatgccgtattgggttgtgcaagagttggtgccattcatagtgtaatctttggtggcttttctgcacaaagtattgcggacaggctggaagatgcaggggctgaatatattgtaacctgcgatggtgcctaccgtggcgaaaaaattattccgttaaaagacgtaattgatgatgcattgatcgggaatcaaacagttaaacgagttattgtatacacacgtacccggacacccgtatccatgatcaaaggcagagatgtttggtgggaagatgaaatggaacatgccgaaaaccaggtggaaaaagataatgttgtctcaatgccggacaacgaaaccgaagccgaaagatccgtagtatatttaatacactccggagtagtaacgggaaaaccaaaaann

SEQ ID NO: 5350 - protein, 268 aa, Unknown
  Obtained from environmental sample
  misc_feature (1)..(268): Xaa is any amino acid
MSYPYQVQSLEEYKEAYKKSIEEPESFWSDIAQHFLWKKKWDKVLEWNFKEPDTKWFINGKLNITENCIDRHLATMGEKPAIIWEPNNPEDRVRIVTYNRLHKRVCQFAQVLINNGVKKGDRVCIYMGMVPELVYAVLGCARVGAIHSVIFGGFSAQSIADRLEDAGAEYIVTCDGAYRGEKIIPLKDVIDDALIGNQTVKRVIVYTRTRTPVSMIKGRDVWWEDEMEHAENQVEKDNVVSMPDNETEAERSVVYLIHSGVVTGKPKX

SEQ ID NO: 5351 - DNA, 486 bp, Unknown
  Obtained from environmental sample
  misc_feature (1)..(486): n is a, c, g, or t
atgaaatttttattagcccttttaattattacctgttctgatatttgtacagcgcaggaaaagatcacggtacattttaattttgataaagctgatttgacagctgctggtaaattttctcttgacagtcttatcaccacgattaaagtttcatcgacccagattcaattaaaaatctcagggcataccgatgctataggttcaaatgaatataatgaccttctttctgcgaggcgtattgaaactgtcagcgcctatttaataaataatggaattttaaaagaaaatattaccggggaaaacgcactcggtgaaacgcaacccgttgtggaaaattcaagcgcgtcaaaccgtgctttgaaccgaagggttgaaattttaatcttaaaagaaatcccttcgcccaataataaccttacactgaaaggaaaagatcgncgattcatcgacgacggttggatccaacatcgttttaaaaaatattaa

SEQ ID NO: 5352 - protein, 161 aa, Unknown
  Obtained from environmental sample
  SIGNAL (1)...(18)
  DOMAIN (25)...(122): OmpA family
  misc_feature (1)..(161): Xaa is any amino acid
MKFLLALLIITCSDICTAQEKITVHFNFDKADLTAAGKFSLDSLITTIKVSSTQIQLKISGHTDAIGSNEYNDLLSARRIETVSAYLINNGILKENITGENALGETQPVVENSSASNRALNRRVEILILKEIPSPNNNLTLKGKDRRFIDDGWIQHRFKKY

SEQ ID NO: 5353 - DNA, 441 bp, Unknown
  Obtained from environmental sample
  misc_feature (1)..(441): n is a, c, g, or t
atgaaaaccgatattgaaaaatcttcgttgcccggcaactcttcttcaaaaaaagcgacgtcgagccattcatttctgcacgctttgtctggtagtgtatccgatgctgtcatcctcacggataagaaattaattatcgcgtattggaataaagaagccggccggctattcgggcttgacgaatcagaagccgttggcaaacatatttcagctattttgtttcataatttcaataactcttttttcgatgaaattattcggcggctgtccgaaaatgaaaaatgtaaagagcaaatatttacgaataaaacaaaaatagattgcacttttttacttacttccccatatgaggatgacagtagcgggttactcgttcttggtaaagaacattattccggcagacgatttactaaatggaaaaaaacagttacccttcaatga

SEQ ID NO: 5354 - protein, 146 aa, Unknown
  Obtained from environmental sample
  DOMAIN (24)...(87): PAS domain
  misc_feature (1)..(146): Xaa is any amino acid
MKTDIEKSSLPGNSSSKKATSSHSFLHALSGSVSDAVILTDKKLIIAYWNKEAGRLFGLDESEAVGKHISAILFHNFNNSFFDEIIRRLSENEKCKEQIFTNKTKIDCTFLLTSPYEDDSSGLLVLGKEHYSGRRFTKWKKTVTLQ

SEQ ID NO: 5355 - DNA, 582 bp, Unknown
  Obtained from environmental sample
  misc_feature (1)..(582): n is a, c, g, or t
ttgttgtatcactatcctaaccaccacattttagcaaaagttgcaggagctataggagtccctattattgaaattaaatgtgaaaaaaatgataaagaatcagaagttgataacctatacaacggtatataccaagctattacccagttccaggttaaaggactatgtcatggatgtattcatagtgaatttcaaatgaatatttttaggaaagcagtggaaaaattcaatttgaaattgctatcacctctctggaaaatagacacagaaatttattataataccctttttaaagataattttgaaattattttaactcgagttgcagcgaatggacttgataaaacatggcttggaaaaactatcactcccattacgttgagggatttaagaaatttaagtaacaaatttggatttaatttagactttgaaggcggagaagctgaaactctggtattaagttgtcctttatataagaagaggatagttactaaggcttcaaaaagtcagtgggatggaattaggggaatctttgaaatatcagatgttgaattaatagaaattaagagatccaatgcttga

SEQ ID NO: 5356 - protein, 193 aa, Unknown
  Obtained from environmental sample
  DOMAIN (1)...(185): ATP-binding region
  misc_feature (1)..(193): Xaa is any amino acid
MLYHYPNHHILAKVAGAIGVPIIEIKCEKNDKESEVDNLYNGIYQAITQFQVKGLCHGCIHSEFQMNIFRKAVEKFNLKLLSPLWKIDTEIYYNTLFKDNFEIILTRVAANGLDKTWLGKTITPITLRDLRNLSNKFGFNLDFEGGEAETLVLSCPLYKKRIVTKASKSQWDGIRGIFEISDVELIEIKRSNA

SEQ ID NO: 5357 - DNA, 768 bp, Unknown
  Obtained from environmental sample
  misc_feature (1)..(768): n is a, c, g, or t
ttgttacaggaacaaccagcattattaccaatggttataaactatgttgaatggctatctggtattttgctgaaatttggtgatatggaaatagacctgaaagatttaaccacggcagaaaaacaatattatctacaacatcttgtggcgccacgacctatttgttttgcttctactattgatcaatcaggatcagtcaacctgagccctttcagctttttcaatttgttctctactaatccacccattgttattttttcaccttcgagacgggttcgtgataatacaaccaaacatagcctgcagaatcttctggaagtacccgaggtggtaatcaatattgttacctatgatatggtgcaacaaacttcattagcaagttgtgaatatccaaaaggagcggatgaatttataaaagccggatttacaaaagaaaaagcagtattggtgaagccaccaatggtgaaagaaagtaaggccaacttggagtgtaaggttattgagataaaagaattgggaaaagaaggaggcgccggcaatttagttatctgcgaagttttatacctgcatatagatgatagcattttaaaggcaggtaaaatagaccaggcgaaattagaattggtagcgcggctgggcggcaattggtattgcaaggttggcgcagaaaatctttttgaagttaccaaaccgagcactcaattaggtatcggaatggatgcgtgccggaaggtatcaggagaagcaatttttaactggaaatattaa

SEQ ID NO: 5358 - protein, 255 aa, Unknown
  Obtained from environmental sample
  misc_feature (1)..(255): Xaa is any amino acid
MLQEQPALLPMVINYVEWLSGILLKFGDMEIDLKDLTTAEKQYYLQHLVAPRPICFASTIDQSGSVNLSPFSFFNLFSTNPPIVIFSPSRRVRDNTTKHSLQNLLEVPEVVINIVTYDMVQQTSLASCEYPKGADEFIKAGFTKEKAVLVKPPMVKESKANLECKVIEIKELGKEGGAGNLVICEVLYLHIDDSILKAGKIDQAKLELVARLGGNWYCKVGAENLFEVTKPSTQLGIGMDACRKVSGEAIFNWKY

SEQ ID NO: 5359 - DNA, 459 bp, Unknown
  Obtained from environmental sample
  misc_feature (1)..(459): n is a, c, g, or t
atgaaatctgttgcgatagtaataccttgcaggaacgaagaaaaatacattggaaaatgtatggattcttttttggcacaggactatccgaaagagttacttcatttgtacgtgtgcgatggtaaaagcaccgataaaacggtagatgtgatcaatgagtacagtaaaagaaacccaaccattcatttgctgatcaatgaaaagcaaacgactccctttgctcttaatttaggaataaaaagtagtcatgcagatgtcctgatcattttaggagcacattctgaattgtaccctgattatgtttctaattgtattaaggcgtttgaagtagatgaacacattggctgtaccggtggtattattgaaaatgtttatgagaatgaaaccagcagaagttatcggaaaagcgatgtcatccggttttggagttggaaatgctcattttcgtacaggcaataa

SEQ ID NO: 5360 - protein, 152 aa, Unknown
  Obtained from environmental sample
  DOMAIN (5)...(148): Glycosyl transferase
  misc_feature (1)..(152): Xaa is any amino acid
MKSVAIVIPCRNEEKYIGKCMDSFLAQDYPKELLHLYVCDGKSTDKTVDVINEYSKRNPTIHLLINEKQTTPFALNLGIKSSHADVLIILGAHSELYPDYVSNCIKAFEVDEHIGCTGGIIENVYENETSRSYRKSDVIRFWSWKCSFSYRQ

SEQ ID NO: 5361 - DNA, 588 bp, Unknown
  Obtained from environmental sample
  misc_feature (1)..(588): n is a, c, g, or t
atgattttacaaaagtatttcattccagtttatactaaatggtaccaatcaaacctttgtgaattgtgttttcctcaaaatattacaggtgaaaaatgtttagttgagacaagttttgcttcgattacaccaagattaatttttggctttccaaaagtaaaaagaactaagaacttaaataatattttaaatctaagtagctccctattatatggaaatctaaaaaagggaaataataagtacttatactatacaagggtcggagatattatcaataaaaaggtaaacggagaagaaataaataaaaagaatataataaaatggttaagagatttgagagtcaacttattcgataaaccacaattcaaaagtaataagattgttctaattactccctcaaatggtactaaatcaaatttcattgatttagttaatgaatatgtattcgactacaccgcaaattgtttaagcatttctctatatgatgaatatattgaaaatacggaatcattgtatgccgatgggctatataaagcagatgttgcaatttatgttgatgatgttttatcaaccgctaatcttttttag

SEQ ID NO: 5362 - protein, 195 aa, Unknown
  Obtained from environmental sample
  misc_feature (1)..(195): Xaa is any amino acid
MILQKYFIPVYTKWYQSNLCELCFPQNITGEKCLVETSFASITPRLIFGFPKVKRTKNLNNILNLSSSLLYGNLKKGNNKYLYYTRVGDIINKKVNGEEINKKNIIKWLRDLRVNLFDKPQFKSNKIVLITPSNGTKSNFIDLVNEYVFDYTANCLSISLYDEYIENTESLYADGLYKADVAIYVDDVLSTANLF

SEQ ID NO: 5363 - DNA, 903 bp, Unknown
  Obtained from environmental sample
  misc_feature (1)..(903): n is a, c, g, or t
ttgaagacccgaatagtattttccccaatagacaaggaagctataagatatgtgaacttaatggaacagcattcgattgacagtattcgcaatttattttacaggaaggcggataaagtaaaacctatcgatttatctcataagattgacaggataacaataaataaaattgatgatacaatagaattccaaaataaaaaattgtttcaattatttgttttagatacattttataagctctttgaatataacaacttaagtaaaagctacattcatcaggatttacttgatagcatttttaatgaaaataaggttttagacaagctaattactttccatctattgcgaagcaaaatagaagatattttatttgacttaaagaatccaatatatgagcagcacagcgagctactaaatagatatcgacataatattgaatatgttatcttaaaaataatctgtagtactccaataatttactataaaagcataagagagtcatcatttgattgggttattgctatgcttgaacacgtaagaaccggaggaaataatgaattagcttattgtattaacaatcttaattctgaaaatataatcaactttttcgtagtgaatgcagaaaattactattcagaactacaaaaattaaaatttcttttaaaaagaacggtccaattaaaaagtaactacataatacacccaacttttttcaaatcaataaaaattttaataaatactttattcacaaactatgacagatgtgaaaaaattaaaaatgattcggattccttgtttctagaaaaagtgattaaacttttcaaattaaagtatccgcacttaagaagtcaagcgttcaattatattaaagaattagaaatacgtcaatgtttccattcttga

SEQ ID NO: 5364 - protein, 300 aa, Unknown
  Obtained from environmental sample
  misc_feature (1)..(300): Xaa is any amino acid
MKTRIVFSPIDKEAIRYVNLMEQHSIDSIRNLFYRKADKVKPIDLSHKIDRITINKIDDTIEFQNKKLFQLFVLDTFYKLFEYNNLSKSYIHQDLLDSIFNENKVLDKLITFHLLRSKIEDILFDLKNPIYEQHSELLNRYRHNIEYVILKIICSTPIIYYKSIRESSFDWVIAMLEHVRTGGNNELAYCINNLNSENIINFFVVNAENYYSELQKLKFLLKRTVQLKSNYIIHPTFFKSIKILINTLFTNYDRCEKIKNDSDSLFLEKVIKLFKLKYPHLRSQAFNYIKELEIRQCFHS

SEQ ID NO: 5365 - DNA, 693 bp, Unknown
  Obtained from environmental sample
  misc_feature (1)..(693): n is a, c, g, or t
atgacagacaaattaaaaattttaacaatgggagatcatcccttcgtaccatcaggtgtaggtagtcagtgtagatatttgttcgaaggtcttttaaagacaggaaattattcaattagaagtcttggtggcgctatgaagcatccagattatcgtccaatgaaaacaaaagaatgggaagatgactggattgtattcccagttgacggctacggcaatgaagaaattatcagaaaaattttagaccacgaaaagattgacgcgattcattttacaactgaccctagattttacggttggttattcaatatgtcagatgaaattagagacagaggaattcctcttctttattggcacgtttgggatgacgaaccaacgccacaattcaatagaggattttacaaatcttgtgattatgtaggttgcatttcaaaactaactcacaagattttagtagatttaggatttgatggaagttctggatacattcctcacgcatcaaatgcagcaatttttaaacctttctcaaaagaagaaattcttaagaaaagaaaagaactgttgaaatcagattcagataagatcgttgtattttacaattcaagaaacgcgagaagacagaaaacttctgacgttttaaagacttttaagcaactgtgttatccagtgggacacgataatgcttctcgttaa

SEQ ID NO: 5366 - protein, 230 aa, Unknown
  Obtained from environmental sample
  misc_feature (1)..(230): Xaa is any amino acid
MTDKLKILTMGDHPFVPSGVGSQCRYLFEGLLKTGNYSIRSLGGAMKHPDYRPMKTKEWEDDWIVFPVDGYGNEEIIRKILDHEKIDAIHFTTDPRFYGWLFNMSDEIRDRGIPLLYWHVWDDEPTPQFNRGFYKSCDYVGCISKLTHKILVDLGFDGSSGYIPHASNAAIFKPFSKEEILKKRKELLKSDSDKIVVFYNSRNARRQKTSDVLKTFKQLCYPVGHDNASR

SEQ ID NO: 5367 - DNA, 813 bp, Unknown
  Obtained from environmental sample
  misc_feature (1)..(813): n is a, c, g, or t
gtgttaaaaacaaatatgtctagaaattcagaaatggattttgaaacaattaaagccagattagaaaatttaaaacaagctattggtattccacaagctgaatgtcctccagtttatttggttcacgccaatttaacaagcgaagaaatgtctgagttgtataggcacccaaagattaaggctttcataactttgactcacggcgaaggattcggaataccagttttggaagctgccgcttcaggcttgccaatattggctacaaattggtctggacaccttgatattttgaaagatggtaaattcatttcctttgagcacgacctaagagaaattccagaatcagttgtgtgggatccaattctcatcaagggttctaggtgggcagaagttagagaagaagacgttaagagaaaaatggacaaaattgttaaggctccctctaagccaagagaatgggcacaagaattagtctctaaagttgttgataagttcgatatcgacaagaccaatgagttcttcttacagacagttaagcaagcgttgttgggcaatgtaatgcaagaagttaatccagtagaaagtttatcttctttcgtagacactccagacgacttcaatgtaatttacactatgccaatgtctactggtgatgtgtttatttcaacagcagtaattgacggtttaatgaaacaacttccagaaggagcaaaagtttattttgcgacacaaccaaaatactttgatgttttgaaaggaaataagaacatttataaatgtattcccttactacagaatatgcatcattcttga

SEQ ID NO: 5368 - protein, 270 aa, Unknown
  Obtained from environmental sample
  misc_feature (1)..(270): Xaa is any amino acid
MLKTNMSRNSEMDFETIKARLENLKQAIGIPQAECPPVYLVHANLTSEEMSELYRHPKIKAFITLTHGEGFGIPVLEAAASGLPILATNWSGHLDILKDGKFISFEHDLREIPESVVWDPILIKGSRWAEVREEDVKRKMDKIVKAPSKPREWAQELVSKVVDKFDIDKTNEFFLQTVKQALLGNVMQEVNPVESLSSFVDTPDDFNVIYTMPMSTGDVFISTAVIDGLMKQLPEGAKVYFATQPKYFDVLKGNKNIYKCIPLLQNMHHS

SEQ ID NO: 5369 - DNA, 804 bp, Unknown
  Obtained from environmental sample
  misc_feature (1)..(804): n is a, c, g, or t
gtgattgagatgaaacaaacaggaatcaagcctgatctactcacctacggttgtatgattaaagcgtgtaatatctgtggagattccatctgggctaaagaagttttgaaagagatgaaaacttcgggaattaagcccgatgttttgatttttggcgccatgattcatttaacgggacagcaaagtttagatgaggctttttattactttaatctgatgaaggaattcaacctaccccccaatgaaagaatttgtagcactctgattaggctctgccactctaatccaaagcgtggaattgctctcttgcaagaaatcccttttgaaccgactcgagaaatttatgagagcttaattcatgcccttacattatcaccagagccatttttagttgttgaatggatcgctaccatgaaagaaaaaggattgaaaccctcactcctgacctgtcgtgccctggttaaaattttcaaaaaaataaaagatggaaaacaagccttaaagttactccaagacttcgaaaaacatgaagtcgccatcatcgaaatgtataaccgcgtgatttacatttatgcaaaaaatcaggacctggttggtgctgaagagacttttcaacagctgttaaaaacagatctcagaccgactctctatacctgtaatgcccttttacttgcctacgcggaagtcaacgagatagacaaggggatactatttatgaatcaggagttcaataaatggaatttgactccagacactgtctctttcaatactctcaggattggttatatacgtgccgttctttga

SEQ ID NO: 5370 - protein, 267 aa, Unknown
  Obtained from environmental sample
  DOMAIN (14)...(48): PPR repeat
  misc_feature (1)..(267): Xaa is any amino acid
MIEMKQTGIKPDLLTYGCMIKACNICGDSIWAKEVLKEMKTSGIKPDVLIFGAMIHLTGQQSLDEAFYYFNLMKEFNLPPNERICSTLIRLCHSNPKRGIALLQEIPFEPTREIYESLIHALTLSPEPFLVVEWIATMKEKGLKPSLLTCRALVKIFKKIKDGKQALKLLQDFEKHEVAIIEMYNRVIYIYAKNQDLVGAEETFQQLLKTDLRPTLYTCNALLLAYAEVNEIDKGILFMNQEFNKWNLTPDTVSFNTLRIGYIRAVL

SEQ ID NO: 5371 - DNA, 372 bp, Unknown
  Obtained from environmental sample
  misc_feature (1)..(372): n is a, c, g, or t
atgaaaaagctgatcctcctgccttttctcgcattactgcttggttttattttaccaggtaagaaaaaaataaaaatattcatggccggcgactcaactatggccatcaaggaaaccaaagcctatcccgaaatgggttggggtatgccttttgtatatttctgggattcttctgttacagttatcaaccgtgccaaaaatggcagaagttcaaaaacattcataagtgaaggactttggcaatctatttacaccgaagcaggagaaggagattatgttataatacagttcgggcataacgatgaagctgtggagaaaaagaaaggtttccaccccggatactttcaaaatgaaccttacccgcttcattaa

SEQ ID NO: 5372 - protein, 123 aa, Unknown
  Obtained from environmental sample
  SIGNAL (1)...(20)
  misc_feature (1)..(123): Xaa is any amino acid
MKKLILLPFLALLLGFILPGKKKIKIFMAGDSTMAIKETKAYPEMGWGMPFVYFWDSSVTVINRAKNGRSSKTFISEGLWQSIYTEAGEGDYVIIQFGHNDEAVEKKKGFHPGYFQNEPYPLH

SEQ ID NO: 5373 - DNA, 429 bp, Unknown
  Obtained from environmental sample
  misc_feature (1)..(429): n is a, c, g, or t
atgattttaccgatagttgcttacggtcatcccattttacgtaaggtggcaaaagatatagatgaaaattatcctgatttaaaaaagctggtagaggatatgtgggaaaccatgtacgccagcaatggtgttggtttggctgcgccgcaggtaaataaagaaatcaggctgtttgtaattgacagtgcacagatttttgccaatatggatgaagaggaaagaaaggaacatgaatatcccgatgatcccggggtaaaacaaacttttatcaatgctcatgtagttgaagagcatggcgatgactgggcctataatgaaggatgtntgagtattccaaaaataagagacgatataaagaggggagaagagcttaccattgaatttcttgatgaaaattttattaagcataaaaaacattttcgggcataa

SEQ ID NO: 5374 - protein, 142 aa, Unknown
  Obtained from environmental sample
  DOMAIN (2)...(140): Polypeptide deformylase
  misc_feature (1)..(142): Xaa is any amino acid
MILPIVAYGHPILRKVAKDIDENYPDLKKLVEDMWETMYASNGVGLAAPQVNKEIRLFVIDSAQIFANMDEEERKEHEYPDDPGVKQTFINAHVVEEHGDDWAYNEGCXSIPKIRDDIKRGEELTIEFLDENFIKHKKHFRA

SEQ ID NO: 5375 - DNA, 783 bp, Unknown
  Obtained from environmental sample
  misc_feature (1)..(783): n is a, c, g, or t
ttgcctttanacaggatcacccaaaagttttgcaaggagtttacagattatctgcttaccaaggtcagcaacaataccgccatgtgttatatcattattctttatggcgggttgcaggaagccgaaaggataaacattatccaaaaaaatcctttgcggttaatggaaaaaaaagatcgcattaaaaagcaggatatttttagaagttcctttaccattgagcaactacaaaaactggtagaaacacctctaaaaattccacaacagtacaaacaatcctttttgtttagttgctttagtggtttaagatggtcagacaccaatcctcttaaatggtctgaaataattgagaaggaaatagaaggcaaagaaaagtggtttatttactttgagcaggaaaaaacagaagcggttgaatatttacccttgtcacaacaagcggtggctattatcaagcaaaggatggaagcaagaaaacatgaatctgaaagtgaatatgtatttccactggttaaggagatcaatgaaaaatctcaaattacttaccaaagggtaaaaagggctattaaaacatggggtaaaaaagcagggtttaatcccgacctaatgcactttcatgcaggaaggcatacctttgctaccaatgtacttgagcatagccctgatggggatttatacactgtttcaaaactgcttggtcataagaatatcaattcaacacaggtgtatgccaaggtaagggacaaaagaagagctgctgcggtggattcatgccagtgctaa

SEQ ID NO: 5376 - protein, 260 aa, Unknown
  Obtained from environmental sample
  DOMAIN (71)...(253): Phage integrase family
  misc_feature (1)..(260): Xaa is any amino acid
MPLXRITQKFCKEFTDYLLTKVSNNTAMCYIIILYGGLQEAERINIIQKNPLRLMEKKDRIKKQDIFRSSFTIEQLQKLVETPLKIPQQYKQSFLFSCFSGLRWSDTNPLKWSEIIEKEIEGKEKWFIYFEQEKTEAVEYLPLSQQAVAIIKQRMEARKHESESEYVFPLVKEINEKSQITYQRVKRAIKTWGKKAGFNPDLMHFHAGRHTFATNVLEHSPDGDLYTVSKLLGHKNINSTQVYAKVRDKRRAAAVDSCQC

SEQ ID NO: 5377 - DNA, 474 bp, Unknown
  Obtained from environmental sample
  misc_feature (1)..(474): n is a, c, g, or t
ttgttacttgtntatggtggccattttatgcccgcagggatgacattgcagaatgataaagtagatgccttttgtcagaagtttgaagaggtagtgcgggcgtctattcacccggaattgttgataccagaaattgtgattgatgcggaaatttcgttgatggaaattaagcaatcgttttacgatatcatatgccagatggaaccgtttggacctgataatttaaggcctgtttttgttgccaaaaaggtttataatacaggctggagcaaagtggtgaaagaaaaccatatccgctttgttttacagcaaggtaccgcaaagattacaggcattggatttaatatggctgagaaaatgcccctgcttgaagcaggtaaggcagtggatgttgtttttaaactggatgaaaacgaatggaacggtgaaaaaagccttcagctaaaggtgattgatgtaaggatcaccgaataa

SEQ ID NO: 5378 - protein, 157 aa, Unknown
  Obtained from environmental sample
  misc_feature (1)..(157): Xaa is any amino acid
MLLVYGGHFMPAGMTLQNDKVDAFCQKFEEVVRASIHPELLIPEIVIDAEISLMEIKQSFYDIICQMEPFGPDNLRPVFVAKKVYNTGWSKVVKENHIRFVLQQGTAKITGIGFNMAEKMPLLEAGKAVDVVFKLDENEWNGEKSLQLKVIDVRITE

SEQ ID NO: 5379 - DNA, 333 bp, Unknown
  Obtained from environmental sample
  misc_feature (1)..(333): n is a, c, g, or t
gtgtatgccaataaaggcttagaggcaaatgtggtgatagagattgcagcagtaattgtaatgagtgcgcaagacagaaaactacttgaccagactttattgcacgattatatttttgaatggggaatacaaaaaaaacagtgttgcatggcacttgggtatgtttctttatacaatcattcttatgattctaattgcacttacgatatggactttaaaaaaaatactattactatcaccacaaccaggaaaatcaaaaaaggagaagagttgtttatcaactataatggagagccggataaaaaaacacccgtctggtttgatgcaaaatga

SEQ ID NO: 5380 - protein, 110 aa, Unknown
  Obtained from environmental sample
  misc_feature (1)..(110): Xaa is any amino acid
MYANKGLEANVVIEIAAVIVMSAQDRKLLDQTLLHDYIFEWGIQKKQCCMALGYVSLYNHSYDSNCTYDMDFKKNTITITTTRKIKKGEELFINYNGEPDKKTPVWFDAK

SEQ ID NO: 5381 - DNA, 312 bp, Unknown
  Obtained from environmental sample
  misc_feature (1)..(312): n is a, c, g, or t
gtgcgcaagacagaaaactacttgaccagactttattgcacgattatatttttgaatggggaatacaaaaaaaacagtgttgcatggcacttgggtatgtttctttatacaatcattcttatgattctaattgcacttacgatatggactttaaaaaaaatactattactatcaccacaaccaggaaaatcaaaaaaggagaagagttgtttatcaactataatggagagccggataaaaaaacacccgtctggtttgatgcaaaatgaaatttgttttttgcagctattgattgctatgggagtttcgtaa

SEQ ID NO: 5382 - protein, 103 aa, Unknown; identical to SEQ ID NO: 618
  Obtained from environmental sample
  misc_feature (1)..(103): Xaa is any amino acid

SEQ ID NO: 5383 - DNA, 663 bp, Unknown
  Obtained from environmental sample
  misc_feature (1)..(663): n is a, c, g, or t
ttgaacaagcccaatacgcttgtcatcacaaaaggtatggcgaagaaatatttcgggagtaaaggtccgataggccaaacattgttattcgacaataaaaaagagcttacagtagctgctgtaatggaaaatgttccctcgaactctcatttcagttttgattttctaacttctctttacagtattaaaggcacagacagcctggaaacgcaggtggtttggaacaaccctaattacagcacctatcttttattaaagcccggaacgaacattcatgttctttcaaaaaaaattgataattgggttaatcctccggatgaaggcaatcattcagcttcgcaaaattcacttcacttaaaactggagccgcttaaggatgttcattttaatacagaggtatttaattacaaaaattattttgctataactgattttaaatacgtccacatctttatcacgattgctattcttgttttgctaattgcctgcgccaattacattaatctttccacagcaaaagcaacgtcccgtgcaaaggaagttggcattcgtaaaactgccggtgccagttttttacagctttttacacaattcctttcagaatcgtttttatttacttcacttgccgctgttgtttcaattgcattggaaccaatggattga

SEQ ID NO: 5384 - protein, 220 aa, Unknown
  Obtained from environmental sample
  misc_feature (1)..(220): Xaa is any amino acid
MNKPNTLVITKGMAKKYFGSKGPIGQTLLFDNKKELTVAAVMENVPSNSHFSFDFLTSLYSIKGTDSLETQVVWNNPNYSTYLLLKPGTNIHVLSKKIDNWVNPPDEGNHSASQNSLHLKLEPLKDVHFNTEVFNYKNYFAITDFKYVHIFITIAILVLLIACANYINLSTAKATSRAKEVGIRKTAGASFLQLFTQFLSESFLFTSLAAVVSIALEPMD

SEQ ID NO: 5385 - DNA, 738 bp, Unknown
  Obtained from environmental sample
  misc_feature (1)..(738): n is a, c, g, or t
atgaggtatgtggatatagtcaacctattccattcctatactaatgacccgttttttaataatttggactacgcgggagaaagaatactacttaccattcgtgagatacgtaagatgtcggacggtaaattatcagaagcagactttttcaatatagctaaactttacgctgacaaagaaggtaacacctcatggctttacggcggagaatataatgttaacggaaactaccaaggaagaccatacaactacgatgattaccgtatcccttgtttagactttgtgttctataccaccgatgtttacaagtgggagagcagggtcgataaatacggtaaccaaaaggtaaacagaaaacctttcgattacaacaagacctacgaagaaagtaagtacgagcgtgaattaatacgcaaagatttagagatggagtacgaggggctgtgggttattggatcagaatacatggtcaattatggtagaagcaaaaacataacaagaccaaaggtacaaggcaagatgactgcttcgtgcttaaaaaaatatatcatcgttcaacccgcattacgttatggatttagtaagtcgttggtagagattgctcgaccaaatgttgactcaatacaggtagcggtgttgagaaaaagacacttcatggctgaggctatgcccccaggtcttgctattgactgggattcgttggtagagatttctaccgcaatgaaattaaaccactag

SEQ ID NO: 5386 - protein, 245 aa, Unknown
  Obtained from environmental sample
  misc_feature (1)..(245): Xaa is any amino acid
MRYVDIVNLFHSYTNDPFFNNLDYAGERILLTIREIRKMSDGKLSEADFFNIAKLYADKEGNTSWLYGGEYNVNGNYQGRPYNYDDYRIPCLDFVFYTTDVYKWESRVDKYGNQKVNRKPFDYNKTYEESKYERELIRKDLEMEYEGLWVIGSEYMVNYGRSKNITRPKVQGKMTASCLKKYIIVQPALRYGFSKSLVEIARPNVDSIQVAVLRKRHFMAEAMPPGLAIDWDSLVEISTAMKLNH

SEQ ID NO: 5387 - DNA, 435 bp, Unknown
  Obtained from environmental sample
  misc_feature (1)..(435): n is a, c, g, or t
ttggagaaagtatcggatagcagagtactctttatcgctctggcgggggaactgaaaccggatcatttcctggccggactgatcgtaaataatcagatcatttcctgcagaattacatttaaagaaaccataaagtacccgcggttccaggtatcgtttgttcaggacttcctttttaatttcaaggaagcgaggttggaattcttgtgcaagaacccgatcccaatcggcatcgtgctgtgtctttccaccccaggacatacggaaaagggaacgtgtatcgatatagcgaaacacagtttgaaggggaatttcctcaagctcccggaagcccaaaaatggcggctcgggaattggaacatcggtttttacggaagatcttactgttggcccgccattcgttgcggcgggggcaacctcgcgcttcttaactag

SEQ ID NO: 5388 - protein, 144 aa, Unknown
  Obtained from environmental sample
  misc_feature (1)..(144): Xaa is any amino acid
MEKVSDSRVLFIALAGELKPDHFLAGLIVNNQIISCRITFKETIKYPRFQVSFVQDFLFNFKEARLEFLCKNPIPIGIVLCLSTPGHTEKGTCIDIAKHSLKGNFLKLPEAQKWRLGNWNIGFYGRSYCWPAIRCGGGNLALLN

SEQ ID NO: 5389 - DNA, 546 bp, Unknown
  Obtained from environmental sample
  misc_feature (1)..(546): n is a, c, g, or t
ttgattggtaatttgccggcaatgaagattattgttcgtttaccgaattggctgggtgatatggtaatgtccgttgcttttttacatgaattatacaaacaatatcctggtgcagaagtgagtgtgattgctaagaaaggtttgcatgaactattggcgtttttcccgccgataaaacatgggtttatttttagtaaagaagaatttaaaggagtaaaagggttgatggattttggaaaaaagatccgcaagacggacaattttgacctgttcttttgtttgccggactctttttcttctgctttgatggcatcggcctctggtgcaaaagcaacggtgggatataaaaaggaactgaggggttttttgctgacaaactcataccaaaaaccaaaggacctgcatagagttgatgaatatttaaacctcctgcaactttacacagaaaaagaaacaggtattcctactgtacacattcaacatcaatttcaaaagaaagactatatcgttgtgaacataaattgtgaagcttcatcgcgacggtaa

SEQ ID NO: 5390 - protein, 181 aa, Unknown
  Obtained from environmental sample
  misc_feature (1)..(181): Xaa is any amino acid
MIGNLPAMKIIVRLPNWLGDMVMSVAFLHELYKQYPGAEVSVIAKKGLHELLAFFPPIKHGFIFSKEEFKGVKGLMDFGKKIRKTDNFDLFFCLPDSFSSALMASASGAKATVGYKKELRGFLLTNSYQKPKDLHRVDEYLNLLQLYTEKETGIPTVHIQHQFQKKDYIVVNINCEASSRR

SEQ ID NO: 5391 - DNA, 750 bp, Unknown
  Obtained from environmental sample
  misc_feature (1)..(750): n is a, c, g, or t
gtgttaaattttataaatttgctttttaattttgagtggcaagatgcggtagaaatattaaagattagattaagtaaaaatataaaatttaatttagcgaatatcttaatagacaaaatccagtttttggatgaaattgctggtttattgatagtttctaaacttaaagacagttatataaaatattctttgtttttattaattgaaaatagaattcaaaatataaattctttaggccgttttaattttctaagtatttttctacaaaaattaacacgtcaatctttggtaaagatactcatagacttatctaataccccgtgtttttctgaagctttcccctttaaagtggaagaatctttattagagcgattaaaatggcaaaaactatcctcagggttatttataaataactcaaatttagtgttagaattcttagctccatttacagacttgaatgagcaaaagcaccgcgctgaactcttgatagagaaaggatacggatttaattgggaatcagttgtggcgattttaaaaatattttctgatgaagaaaaacgtcttgaattagcaagaaaaataattcacaaaatttatagtgtggaaagttttgaactatttttagctttttgtacttttgacgtacaatatgaaagtttaacaggctttagtctcgattctaaaatgagtttaacacttttacttatcaaaaatgtccatcaatttcttaaagcagaaattgggagataa

SEQ ID NO: 5392 - protein, 249 aa, Unknown
  Obtained from environmental sample
  misc_feature (1)..(249): Xaa is any amino acid
MLNFINLLFNFEWQDAVEILKIRLSKNIKFNLANILIDKIQFLDEIAGLLIVSKLKDSYIKYSLFLLIENRIQNINSLGRFNFLSIFLQKLTRQSLVKILIDLSNTPCFSEAFPFKVEESLLERLKWQKLSSGLFINNSNLVLEFLAPFTDLNEQKHRAELLIEKGYGFNWESVVAILKIFSDEEKRLELARKIIHKIYSVESFELFLAFCTFDVQYESLTGFSLDSKMSLTLLLIKNVHQFLKAEIGR

SEQ ID NO: 5393 - DNA, 354 bp, Unknown
  Obtained from environmental sample
  misc_feature (1)..(354): n is a, c, g, or t
ttgattaaagcctccttgcttgcccggaaaattaccccaccggtactcttcgatcttctccgggttttcaaaccggagaataaaaagaataaggcgaatccggatgagatggtccggattgcttccatgccaaggtatatggaaggaattacctcgcttccgggcttaggaaataattttaagttcagtgacagcgcttcattcctttcaacttacaaaagcatatttgccgatgaaatataccggttccagagcgattcaaaaagtcctttcatcattgatgccggggccaatatcggcttgagtgtattatatcttaaaaaacttttcctggtgcagagatctggcgtttga

SEQ ID NO: 5394 - protein, 117 aa, Unknown
  Obtained from environmental sample
  misc_feature (1)..(117): Xaa is any amino acid
MIKASLLARKITPPVLFDLLRVFKPENKKNKANPDEMVRIASMPRYMEGITSLPGLGNNFKFSDSASFLSTYKSIFADEIYRFQSDSKSPFIIDAGANIGLSVLYLKKLFLVQRSGV

SEQ ID NO: 5395 - DNA, 930 bp, Unknown
  Obtained from environmental sample
  misc_feature (1)..(930): n is a, c, g, or t
atgattccagtgatcagaaatctctatgggtcttctgaatatcgtgtacaagaccagattgattttcagggtcgaatcatctgtgctaaattggaacaggcagtaaagcatggaagaccatttagaaaacaagcaactaacagaaacattgactctaatataacttacaggccgattatttctggcgagcgaaagcaacttggagaatcagttatccatgagatcgaagccataatgggattggattattccaaattacagattgctggcataatcccgcaaggtgaaataagcaagataatagattcccagccaaaggagttcaaagaattgttaaatagtatgatcggattggatcgattagatgcatctttccataatatgcatggagtaattgaagaatttcgaagaatgttaagagaaaaaacttcggggtatgatgataatcagatagacattttggtaacaagaattaaaaataatgaaacaaaattatcaaaaaccaaagaactgttaggcgacatcttgttacaagttgctagcaagacggatgcaatgatcaagcttgagaggcaaatcgaaattttagaacctaagataatcaaattatcggaactcaaatcacttgaaaacaccctattgaaatatttcaaagaacgatcaaactcattaagaaaggagatagacaatttaaatcgtgtaataaaagatgttaagaagtcacttaatattttgaaggacaaagaaagaacatttattactattcagatggttaaatctgagaaagacgatctaaatgataggataaacaaaatagttggagagataggcaaactagaagggcttacagaatgtgcacaaaaaattcagattatagatggaaaatgtccagtgtgtaactcaaagatcgtatccataatcatatgttaa

SEQ ID NO: 5396 - protein, 309 aa, Unknown
  Obtained from environmental sample
  misc_feature (1)..(309): Xaa is any amino acid
MIPVIRNLYGSSEYRVQDQIDFQGRIICAKLEQAVKHGRPFRKQATNRNIDSNITYRPIISGERKQLGESVIHEIEAIMGLDYSKLQIAGIIPQGEISKIIDSQPKEFKELLNSMIGLDRLDASFHNMHGVIEEFRRMLREKTSGYDDNQIDILVTRIKNNETKLSKTKELLGDILLQVASKTDAMIKLERQIEILEPKIIKLSELKSLENTLLKYFKERSNSLRKEIDNLNRVIKDVKKSLNILKDKERTFITIQMVKSEKDDLNDRINKIVGEIGKLEGLTECAQKIQIIDGKCPVCNSKIVSIIIC

SEQ ID NO: 5397 - DNA, 456 bp, Unknown
  Obtained from environmental sample
  misc_feature (1)..(456): n is a, c, g, or t
ttgaattctataattaaggaaacctcgggttattccaaaaaaccagtagtcgatcttcagatagtcggctcgaatataaatcagaaaattctagccaggcagctaatatcgttagaaaatacaacgctacattacaattggagtattgcagatgcccagcattccgatatgaccggatattcttatgataaagacaaaggatttgatatggataaagagatgtcgacattgatacaaaaatcattggggtcaatgcctcttacagacctttctttggatctaatccagtcattcaacgataatcatgaatccccttataacgatggactggataagaagaagagagagcagattgctaaatttctatggaaattttatgaatctagtagatcctcatatgagaatccaaaagtagatatcaataacacaccatcagaagagtcggaagagaagtag

SEQ ID NO: 5398 - protein, 151 aa, Unknown
  Obtained from environmental sample
  misc_feature (1)..(151): Xaa is any amino acid
MNSIIKETSGYSKKPVVDLQIVGSNINQKILARQLISLENTTLHYNWSIADAQHSDMTGYSYDKDKGFDMDKEMSTLIQKSLGSMPLTDLSLDLIQSFNDNHESPYNDGLDKKKREQIAKFLWKFYESSRSSYENPKVDINNTPSEESEEK

SEQ ID NO: 5399 - DNA, 486 bp, Unknown
  Obtained from environmental sample
  misc_feature (1)..(486): n is a, c, g, or t
atgaattgcaagttcttgataccttcatttaaaattttgtatatgctcaggaagattctaataggccttttgattgttcttattattgcacaatttatccagccatcaaagaatagtggatccccaattactgcaaatgacatcacacattcggtacaagtaccagattccgtaatgagtttattgaaaattgcctgttatgattgtcactctaattacacaagatatccttggtatagcagaatcacaccggtaaactggtggttgcataatcatattaatgaaggcaagcacgaattgaatttttctgaattcaccggcagttatagaaggaaaatgagaaagcttgaagagtcagcagagcagacggaaaaacatgaaatgccaatcagctcctatttgtggattcataaagatgcgagattgagtgatgcacaacgaaaacagatcatggattgggcgaacaatgcacgtaagcattcttag

SEQ ID NO: 5400 - protein, 161 aa, Unknown
  Obtained from environmental sample
  misc_feature (1)..(161): Xaa is any amino acid
MNCKFLIPSFKILYMLRKILIGLLIVLIIAQFIQPSKNSGSPITANDITHSVQVPDSVMSLLKIACYDCHSNYTRYPWYSRITPVNWWLHNHINEGKHELNFSEFTGSYRRKMRKLEESAEQTEKHEMPISSYLWIHKDARLSDAQRKQIMDWANNARKHS

SEQ ID NO: 5401 - DNA, 498 bp, Unknown
  Obtained from environmental sample
  misc_feature (1)..(498): n is a, c, g, or t
atgaaaaatataaaatcaaaagctaagaaaatccaaaattctgaactcttaattcataactctgaattcaagaagggagtggattatattggagtgacttgtgttttcttttgtcatgatgggaatggaaagttacttttacataaaaggagtaatagctgtaaggatgaaaaaggtatgtgggatccaggtggtggatcacttgaagttggtgaagaatttgaagaaggggttagaagagaagttaaggaagaatattgtacagatattttaaaactagattttgtgggtgcaaataatgttttgcgggtgaatgatggtaagcgaactcattggatagctttggtttttgtctgtcatgtcgatccaaatcaagtgaagattggagaaccagaaaaaatggacgatattggatggtttaaaatagatgatttacccagtcctttacattcacaattcgatcgttttttagaagaagtcaaaaagtatattcactaa

SEQ ID NO: 5402 - protein, 165 aa, Unknown
  Obtained from environmental sample
  DOMAIN (28)...(163): NUDIX domain
  misc_feature (1)..(165): Xaa is any amino acid
MKNIKSKAKKIQNSELLIHNSEFKKGVDYIGVTCVFFCHDGNGKLLLHKRSNSCKDEKGMWDPGGGSLEVGEEFEEGVRREVKEEYCTDILKLDFVGANNVLRVNDGKRTHWIALVFVCHVDPNQVKIGEPEKMDDIGWFKIDDLPSPLHSQFDRFLEEVKKYIH

SEQ ID NO: 5403 - DNA, 705 bp, Unknown
  Obtained from environmental sample
  misc_feature (1)..(705): n is a, c, g, or t
atgaatatttttttattaaaaaaagaatctaaagagttacaacagttttctcacatcatcgaatttgcttttaaaaaaagcacaaccatacaatttgattcattaaaaaaagaaacatcaaaatacctaaggatttattatgtggttgatggaaaatttgaatggatcattgacgaacagcattatattttatatcccggcgacctggctgtggtattacctggaaaaattttcggaggagaaaagggcttttttgatattggtactgtatcctggttgcacatacgtctggaacaactggagccgagcgggaaaatgaccttaggaaaatggagcagcatatcggccaatgaaagcagaactattggaaaaattttgatgttgaataacagccctgtcctttctaaattaaaagaagcaggcactatcctgcagatgatgcagcaggaaatacaaaaccaggaaattggttatataacacgattcaatcaattgacggatgaattggttattcttattgcgcggcagttaacaaaacaaaatagttcaaggagagatttcccccaggcatttacgaagcttgaagaaacattacgggataatctctcacaccaatggacagtagaagaaatggccgcattggtagggttaggcactactgcattctcagaaaaagtaaacagtacaccggtttctctccactaa

SEQ ID NO: 5404 - protein, 234 aa, Unknown
  Obtained from environmental sample
  misc_feature (1)..(234): Xaa is any amino acid
MNIFLLKKESKELQQFSHIIEFAFKKSTTIQFDSLKKETSKYLRIYYVVDGKFEWIIDEQHYILYPGDLAVVLPGKIFGGEKGFFDIGTVSWLHIRLEQLEPSGKMTLGKWSSISANESRTIGKILMLNNSPVLSKLKEAGTILQMMQQEIQNQEIGYITRFNQLTDELVILIARQLTKQNSSRRDFPQAFTKLEETLRDNLSHQWTVEEMAALVGLGTTAFSEKVNSTPVSLH

SEQ ID NO: 5405 - DNA, 468 bp, Unknown
  Obtained from environmental sample
  misc_feature (1)..(468): n is a, c, g, or t
ttgaataagactatggcaataaataaagacgcatatcaacagatcatatcggaactgcaacccaaatacataacgttggttgcggtctccaaaactaaaccggttgaggacatacgtaaactatatgcactcgggcatcgtgattttggtgagaactacgtgcaggaacttgtcgataaagaatctcagttgccaaaagacatccgctggcattttattggtcatttgcaaagcaataaggtaaagtatatagcacccttcgtacacctggtccatggcgttgatagtttgaaactgcttactgaaataaataagcaggcggcaaaaaataaaagagttaagctcgggcgcctgcaggttcatattgcgcaggaagagacgaagtttggactggatgaagcagagctgagtttgataattaaggagtttgaaatttggaatttaccaacctgcgaatttgcgggttaa

SEQ ID NO: 5406 - protein, 155 aa, Unknown
  Obtained from environmental sample
  misc_feature (1)..(155): Xaa is any amino acid
MNKTMAINKDAYQQIISELQPKYITLVAVSKTKPVEDIRKLYALGHRDFGENYVQELVDKESQLPKDIRWHFIGHLQSNKVKYIAPFVHLVHGVDSLKLLTEINKQAAKNKRVKLGRLQVHIAQEETKFGLDEAELSLIIKEFEIWNLPTCEFAG

SEQ ID NO: 5407 - DNA, 300 bp, Unknown
  Obtained from environmental sample
  misc_feature (1)..(300): n is a, c, g, or t
atgaagtcaatgtccataatagttctcatgcagaacatatttaattcctcatttcatcatttcaacattgtcattcaggattacatgaaaaaggcaaggctggcaaaagccaaacatggaataaacaagatattcatcgcttctgatgatcaatccatcatcaatcaaacaagagagtattcccacgaatttgatttcctcttgttgaaaggtgatacttacttctcttttgtatttcattttcttattgtttccttgtcgaagaaagtattcaataaagttgttatcgtattgacttga

SEQ ID NO: 5408 - protein, 99 aa, Unknown
  Obtained from environmental sample
  misc_feature (1)..(99): Xaa is any amino acid
MKSMSIIVLMQNIFNSSFHHFNIVIQDYMKKARLAKAKHGINKIFIASDDQSIINQTREYSHEFDFLLLKGDTYFSFVFHFLIVSLSKKVFNKVVIVLT

SEQ ID NO: 5409 - DNA, 300 bp, Unknown; identical to SEQ ID NO: 2663
  Obtained from environmental sample
  misc_feature (1)..(300): n is a, c, g, or t

SEQ ID NO: 5410 - protein, 99 aa, Unknown; identical to SEQ ID NO: 2664
  Obtained from environmental sample
  misc_feature (1)..(99): Xaa is any amino acid

SEQ ID NO: 5411 - DNA, 315 bp, Unknown
  Obtained from environmental sample
  misc_feature (1)..(315): n is a, c, g, or t
ttgataatagaatatggagtttatataccattatttattatactatattaccttgaaaataagaacaaatatttacacaatttaaccaataaaagaaattatactttaatcaaaaaagatattataaaattgttaactgctttctccatatcagaggtagtcttttcaatatcaaaaatagcaattcattaccaattacttcagatatcagttgaaccatacaaggcgtctatgctaggttcaatatgtgcgtggattatattttttgtagtaataaattatagtataaaaacagttaaactttttaaaaaataa

SEQ ID NO: 5412 - protein, 104 aa, Unknown
  Obtained from environmental sample
  misc_feature (1)..(104): Xaa is any amino acid
MIIEYGVYIPLFIILYYLENKNKYLHNLTNKRNYTLIKKDIIKLLTAFSISEVVFSISKIAIHYQLLQISVEPYKASMLGSICAWIIFFVVINYSIKTVKLFKK

SEQ ID NO: 5413 - DNA, 453 bp, Unknown
  Obtained from environmental sample
  misc_feature (1)..(453): n is a, c, g, or t
ttgaaatccagagtacaagtaaatgaaagaaactctcctaaagagtattgtagttggcaagaagtagaatcgttaacaaggattcttgcaaataaaataatatcatgcagaaaaaaatacgattctattctgagtataacaaatggtggaataattccagctcgattaattgcgcgagagcttgatattaattatatacaattcatacaaataagaaacaaaaaattattcaaagaggagatgcctttattgaatgaggaaaaaaaatatcttgtaattgatgaaatatacgatactggcaatatattttcccaagttcatgatgctgtaaaatcgtttaattgtgattttgcatttcttataagcagatacaaagagattaatagtgatcgattaatatatgttggaaaaatactgaatcacaacaagtggattgtatttccatgggaatga

SEQ ID NO: 5414 - protein, 150 aa, Unknown
  Obtained from environmental sample
  DOMAIN (11)...(137): Phosphoribosyl transferase domain
  misc_feature (1)..(150): Xaa is any amino acid
MKSRVQVNERNSPKEYCSWQEVESLTRILANKIISCRKKYDSILSITNGGIIPARLIARELDINYIQFIQIRNKKLFKEEMPLLNEEKKYLVIDEIYDTGNIFSQVHDAVKSFNCDFAFLISRYKEINSDRLIYVGKILNHNKWIVFPWE

SEQ ID NO: 5415 - DNA, 432 bp, Unknown
  Obtained from environmental sample
  misc_feature (1)..(432): n is a, c, g, or t
atgaaaataacaggaaatgatatcgacatccatgtcaacggcgtgacactttgttatgatgacctgggagacggcgctgttcccatccttttcattcatggattcccttttgacaaatcgtcgtggcaaccgcaggtaaaattcctgaaaagcaaacgccgtgtgatcgcgtatgatatccgtggctatggcaaatcaaccgaaggaaatgaaaaagttagcatggatctcttcgctgacgacctggtaaattttatggatgccttgaggattgagaaggctgttgtatgcggcttgtctatgggcgggtatatcttattgactgccatcaccgatacccgcaacggttcaaagccaatgtattacgtgatacacaatgcatcggtgattctccggaaggaaaagaaacacgttcaaagacgatcgggctaa

SEQ ID NO: 5416 - protein, 143 aa, Unknown
  Obtained from environmental sample
  misc_feature (1)..(143): Xaa is any amino acid
MKITGNDIDIHVNGVTLCYDDLGDGAVPILFIHGFPFDKSSWQPQVKFLKSKRRVIAYDIRGYGKSTEGNEKVSMDLFADDLVNFMDALRIEKAVVCGLSMGGYILLTAITDTRNGSKPMYYVIHNASVILRKEKKHVQRRSG

SEQ ID NO: 5417 - DNA, 504 bp, Unknown
  Obtained from environmental sample
  misc_feature (1)..(504): n is a, c, g, or t
atgaacccagtatttaaaattttcattttacctattattgccgccgaattaagtagttgttcgagtttcggcaaaggcgttatcgaagctgtcatggaaaaacagcaagccgttgatactcgcctatgtgaagtatgggggaaatcctttagtggaatcatgccatttctggatcatcagaaaggcaaaatgaaagtactcatggtacatggagtgggggaccatttacccggatactcgacacaatttatagagaagctggctaaagaactggagttaccggtcatgtcggcacagtacaaaaacattactctgacggatccgcttgatgccaccaaaaatctcggcaacttaagaatcaaccgattgctaagcagggatagaagcaaggagttaatgttttatgaattaacctggtctgttattacagccaagcaaaaagaagtgctggcgtatgataattcaggagatattcctttcgccgagcggaaatcaatgatttga

SEQ ID NO: 5418 - protein, 167 aa, Unknown
  Obtained from environmental sample
  misc_feature (1)..(167): Xaa is any amino acid
MNPVFKIFILPIIAAELSSCSSFGKGVIEAVMEKQQAVDTRLCEVWGKSFSGIMPFLDHQKGKMKVLMVHGVGDHLPGYSTQFIEKLAKELELPVMSAQYKNITLTDPLDATKNLGNLRINRLLSRDRSKELMFYELTWSVITAKQKEVLAYDNSGDIPFAERKSMI

SEQ ID NO: 5419 - DNA, 354 bp, Unknown
  Obtained from environmental sample
  misc_feature (1)..(354): n is a, c, g, or t
gtgatttgtgacgggcagttgcttggtaaaccggtaaatgatgatgatgcacttaggatgctaaaaatgctctccggcaacaggcacgaagtaattaccggtgtaaatatttatactccgaacaaggaaatttcatttgcagatacaaccgttgttgaatttaacgaccttaaggaggaggaactacgacactatatcgctgcctataaaccattcgataaagctggcgcctatgccatacaggagtggatcggagttgtgggaatcaaaaagatcacaggtgatttttacaatgttatgggtcttccggttaacagggttgtaaaggctttaagagaatggtataaccattaa

SEQ ID NO: 5420 - protein, 117 aa, Unknown
  Obtained from environmental sample
  DOMAIN (1)...(114): Maf-like protein
  misc_feature (1)..(117): Xaa is any amino acid
MICDGQLLGKPVNDDDALRMLKMLSGNRHEVITGVNIYTPNKEISFADTTVVEFNDLKEEELRHYIAAYKPFDKAGAYAIQEWIGVVGIKKITGDFYNVMGLPVNRVVKALREWYNH

SEQ ID NO: 5421 - DNA, 678 bp, Unknown
  Obtained from environmental sample
  misc_feature (1)..(678): n is a, c, g, or t
atgcttaaaatattattagctgttacagtggccttttctttcctccctgctttttcccaggaaactaaaaggaataagaaagaagagagaaggcaaaggatagatgctatatcacgccaggaagaggagggcgtaataaaatatacccgtcacaccattttcggcgggaaactaacatctgatggttacggtggttttatggaaatcggcagggcgcgttcagtgcgcaaggggcttttgttccaactggagatcactgaaagaaaacatcctaaggaggaaaagcagcaggtgaattttgcagctacaacgccctttatttatggtaaaatgaatttcttttatccaataaaactcggagtacaacaacaggtacttcttggtaataaaagtaataagaatggagttagcataacaggcaactggggtggggggctgataatgggtcttctgcggccatatatgattgatgtggatcttaatggtgaacgcaagtcggtgagttattacagcgacagtacatcatttaaaaacaaaagcctttatttgcgcggccccggttttgggaaaggatggagtaacctgaaagttgtacctggcatttatgcaaaaccagctttacgatttgattatggtaagtacaatgaaatggtgaatgccatcgaggttgtcttatag

SEQ ID NO: 5422 - protein, 225 aa, Unknown
  Obtained from environmental sample
  SIGNAL (1)...(19)
  misc_feature (1)..(225): Xaa is any amino acid
MLKILLAVTVAFSFLPAFSQETKRNKKEERRQRIDAISRQEEEGVIKYTRHTIFGGKLTSDGYGGFMEIGRARSVRKGLLFQLEITERKHPKEEKQQVNFAATTPFIYGKMNFFYPIKLGVQQQVLLGNKSNKNGVSITGNWGGGLIMGLLRPYMIDVDLNGERKSVSYYSDSTSFKNKSLYLRGPGFGKGWSNLKVVPGIYAKPALRFDYGKYNEMVNAIEVVL

SEQ ID NO: 5423 - DNA, 324 bp, Unknown
  Obtained from environmental sample
  misc_feature (1)..(324): n is a, c, g, or t
ttgaacgctgtagttatgctaaatgaaatcaaaacagtaattgacgaaatcaaagtgaataagcaaaacggcaaatttgcagtttataaaccgctattgctacttataatatttagatccattctcaatggaagcgataattcttttaagttcaaaagcttttataaaaatttggaacgcttaatggaaaaatacggctggggtacaatttcaaagaagaaggctgagtatccatttttctttttagcatcatctgaaatatgggaaataaatgtttccaaatctgatctgaacatcctaatgttccaaacaaatccgcaatga

SEQ ID NO: 5424 - protein, 107 aa, Unknown
  Obtained from environmental sample
  misc_feature (1)..(107): Xaa is any amino acid
MNAVVMLNEIKTVIDEIKVNKQNGKFAVYKPLLLLIIFRSILNGSDNSFKFKSFYKNLERLMEKYGWGTISKKKAEYPFFFLASSEIWEINVSKSDLNILMFQTNPQ

SEQ ID NO: 5425 - DNA, 633 bp, Unknown
  Obtained from environmental sample
  misc_feature (1)..(633): n is a, c, g, or t
ttgcagcagttatttcccaaaataaaaaataatctcaaaagggagcagcaaaacatcattgatttatcagtaaataaaatctttgacctgccttattttagaaaaccggtaattcagcagggaagtttttccagagttttaaatgaagcatattctgatattggttttataagaaaaatgaatggcttatcacagaaaccaccagcagatgaagtgactgtgctatgtgtgttatgtgatattaaagataaaaataatcaagttactgatagcaatagatctttactggcgagattggctcatacaggaattgatttgaataaagaaatttttgaaaaatctttaggttttgaaaaaggcataagcattaaccaaatgctggcatcttttcctaaagatattgaaaaggatttaagaggagaaattaacaagggtcgaaaggaaagtttattaaggaagtattttgcagaggaaattgataagttgccgcagcatcatattctttgcttaattaaggagttggaaaatacgaaatctgattcgtatttatctgaattatcacaatataaagctgttgatctggattttctgattcatgcgcctggtactggtgaattccaggagcgccagtaa

SEQ ID NO: 5426 - protein, 210 aa, Unknown
  Obtained from environmental sample
  misc_feature (1)..(210): Xaa is any amino acid
MQQLFPKIKNNLKREQQNIIDLSVNKIFDLPYFRKPVIQQGSFSRVLNEAYSDIGFIRKMNGLSQKPPADEVTVLCVLCDIKDKNNQVTDSNRSLLARLAHTGIDLNKEIFEKSLGFEKGISINQMLASFPKDIEKDLRGEINKGRKESLLRKYFAEEIDKLPQHHILCLIKELENTKSDSYLSELSQYKAVDLDFLIHAPGTGEFQERQ

SEQ ID NO: 5427 - DNA, 714 bp, Unknown
  Obtained from environmental sample
  misc_feature (1)..(714): n is a, c, g, or t
atgaggattacaaaagaatactgcaaagatggtttaagaggacagttccattgtttcaacggttcgttatcagatgcaaaagatattattagaatgaaattcttcatctcattcaccggtaatataacttttaaaaaagcggattcacttcgcgagactttatcaaatataagattgcagcatctgctgcttgagactgattcgccctttatgactcccgtgcctttccggggaaaaagaaatgaaccttcttacattaagcttgttgctgaaaaagcagcagaactccataatatttctgtggaagatgttgcaaaaataacttccataaatgcttttcgtttatttggaattggaagtccgcctgatacagccttcacatataagcttggtaaaagtttgtatgttaatattacaaacaggtgcaatgctgattgtgttttctgcagaagaaaagaagatgctgtaattgaaggttataatttaaatatgtccttagatgaagaaccgccggcagaaaagtatattgaagaaatcggtgatcctaaaatttataatgaaatagttttttgtggttatggagagccaactataagatggaatgttgtaaaagtaattgcaaaatatattaaggagaatggaggaagaacaagactcgatacaaacgggcatggtaattttatcaataaaaaagatataacaccggaaatttaa

SEQ ID NO: 5428 - protein, 237 aa, Unknown
  Obtained from environmental sample
  DOMAIN (1)...(117): TatD related DNase
  misc_feature (1)..(237): Xaa is any amino acid
MRITKEYCKDGLRGQFHCFNGSLSDAKDIIRMKFFISFTGNITFKKADSLRETLSNIRLQHLLLETDSPFMTPVPFRGKRNEPSYIKLVAEKAAELHNISVEDVAKITSINAFRLFGIGSPPDTAFTYKLGKSLYVNITNRCNADCVFCRRKEDAVIEGYNLNMSLDEEPPAEKYIEEIGDPKIYNEIVFCGYGEPTIRWNVVKVIAKYIKENGGRTRLDTNGHGNFINKKDITPEI

SEQ ID NO: 5429 - DNA, 492 bp, Unknown
  Obtained from environmental sample
  misc_feature (1)..(492): n is a, c, g, or t
ttgatatccgaatacgcaaggtgcacaaattattggtataatttaaaaacaagttctactagattagatctaggattaataatgcgctattcgttcgaaaaaaaaacagatatgactgaacgatggaatcaaaacataacgactcagttgacgatttcaaaaaatagagcgacaccatggccatgggataaaacaaccggaactcaacaaatgatcgacggaatattaatccattctgacagcgtcaatcatgctcaaagcaacaaattaggatttgcaatcagtcttcgctatgaatgggaattgctttcaaagtcaaagaaaaagaatgtgcttaatttttttattgggtaccgacaaggcttaaccgtgactaaccgatcctactattcaatttggcattcaaatggaatgtctgttgatattacctcattgtcaaaatcatccgcattcttttttggtatttcaaaacctataaatattattaaataa

SEQ ID NO: 5430 - protein, 163 aa, Unknown
  Obtained from environmental sample
  misc_feature (1)..(163): Xaa is any amino acid
MISEYARCTNYWYNLKTSSTRLDLGLIMRYSFEKKTDMTERWNQNITTQLTISKNRATPWPWDKTTGTQQMIDGILIHSDSVNHAQSNKLGFAISLRYEWELLSKSKKKNVLNFFIGYRQGLTVTNRSYYSIWHSNGMSVDITSLSKSSAFFFGISKPINIIK

SEQ ID NO: 5431 - DNA, 411 bp, Unknown
  Obtained from environmental sample
  misc_feature (1)..(411): n is a, c, g, or t
atgcgctattcgttcgaaaaaaaaacagatatgactgaacgatggaatcaaaacataacgactcagttgacgatttcaaaaaatagagcgacaccatggccatgggataaaacaaccggaactcaacaaatgatcgacggaatattaatccattctgacagcgtcaatcatgctcaaagcaacaaattaggatttgcaatcagtcttcgctatgaatgggaattgctttcaaagtcaaagaaaaagaatgtgcttaatttttttattgggtaccgacaaggcttaaccgtgactaaccgatcctactattcaatttggcattcaaatggaatgtctgttgatattacctcattgtcaaaatcatccgcattcttttttggtatttcaaaacctataaatattattaaataa

SEQ ID NO: 5432 - protein, 136 aa, Unknown
  Obtained from environmental sample
  misc_feature (1)..(136): Xaa is any amino acid
MRYSFEKKTDMTERWNQNITTQLTISKNRATPWPWDKTTGTQQMIDGILIHSDSVNHAQSNKLGFAISLRYEWELLSKSKKKNVLNFFIGYRQGLTVTNRSYYSIWHSNGMSVDITSLSKSSAFFFGISKPINIIK

SEQ ID NO: 5433 - DNA, 723 bp, Unknown
  Obtained from environmental sample
  misc_feature (1)..(723): n is a, c, g, or t
gtgctggggttaactgagaaagaattagctggatcacttcctaaaccaccaacagacattaatgacctattctcatgtttactggaaaaaggctgggataggtctgatgctttaggaacaattcagaagcagttaacatccaaaaccatcatgctctcaacccgtcattctgagattttaggccaattaattaataaaatatcagaggtccatttcagggaattagcaaaccttccggataatgaaaagcttaaaaacaggcatattcaagttatcgttattgatcaaattttagaattggccaaagataataattggggtatttgcaaacaatatgactttatttatctttttaatggcgagtattgggggctgctcgaaaccgaagagttgaaaaccttcttaggcgatgcagctgagaagatgggaatttgcaatgtcgatgctcaacacttcaattttaaagatcaactttacaaacagtttatggcagcagctaatttaccaaagccagaacagcctataaatgtaataaatatcaacctaaagaatggaacttttgaagtcactcctgaaggaaataaattaaatccatttaatcgcagtgactttatgacgtatcaattaccatttgaatatgatccagaagccaaagccttattattttcaacctatcttaataaggtgttacctgaaaaaaaacttacaagatatcctggctga

SEQ ID NO: 5434 - protein, 240 aa, Unknown
  Obtained from environmental sample
  misc_feature (1)..(240): Xaa is any amino acid
MLGLTEKELAGSLPKPPTDINDLFSCLLEKGWDRSDALGTIQKQLTSKTIMLSTRHSEILGQLINKISEVHFRELANLPDNEKLKNRHIQVIVIDQILELAKDNNWGICKQYDFIYLFNGEYWGLLETEELKTFLGDAAEKMGICNVDAQHFNFKDQLYKQFMAAANLPKPEQPINVININLKNGTFEVTPEGNKLNPFNRSDFMTYQLPFEYDPEAKALLFSTYLNKVLPEKKLTRYPG

SEQ ID NO: 5435 - DNA, 324 bp, Unknown
  Obtained from environmental sample
  misc_feature (1)..(324): n is a, c, g, or t
ttgaatatgatccagaagccaaagccttattattttcaacctatcttaataaggtgttacctgaaaaaaaacttacaagatatcctggctgaatacttgggatacatctttatccacacaagtacgtcgaacttagaaaaaaccatcctgctctatggtacaggtgccaatggtaaatcctgtttttacgagattgtcaaagtctttaggaaaacaaatacctctgatttcctgtcaagcctacaaatgacatggtttaccgacatggttgccataatagtcattatgcatgaattcatgaaacttatctcattttaccattag

SEQ ID NO: 5436 - protein, 107 aa, Unknown
  Obtained from environmental sample
  misc_feature (1)..(107): Xaa is any amino acid
MNMIQKPKPYYFQPILIRCYLKKNLQDILAEYLGYIFIHTSTSNLEKTILLYGTGANGKSCFYEIVKVFRKTNTSDFLSSLQMTWFTDMVAIIVIMHEFMKLISFYH

SEQ ID NO: 5437 - DNA, 930 bp, Unknown
  Obtained from environmental sample
  misc_feature (1)..(930): n is a, c, g, or t
ttggattttttaattttgacgcggaataaaagaatttccataacccatcatcgcgtcatttcgtattttaattcccccaggttgaattcatcgaatcaaatatacttttacaacaacctcaggagtcccttagccgtattgtatttaaccacagttctgttattgctgtctatttttttaaatgcaaaatctcctgtttctcttcctgccggcaaacctattgtattttttttgaccgacagtttaaaaaccaaaccatttaatccgggtaaaggctcagccaacattcttcgcagcgataccctgcctgtcccgcagacaaacatcctccccaacgattcaagcatcactattatttccgacactataagcaataacgacactattgagtttgcacaacaagacgacattaaagatatcatcaattataaagccgaagattccattgtgtacgatatcagcacaaaaaaaatgtacttgtataatgctgccgatgttcattaccagaaaattcagctgaattcaaattccattgatttcgattggaatgtgtttacgctcaccgcccgcggaacgctcgacagcaacgcgcaaatgtcgggcactccggtattcaccgatgacgganaagaataccgcgctgattcgatgaaatataatttcaaaaccaagaaaggaattgtctatcatgtggtcaccaaagaaggtgatgcttacattcacagtgaaaaagtgaagaaaaatgaatatgatgaatggtatggtgagaaatcgaaatacaccacttgcgacttagaccatccgcatttctacttcaaagcccaggaagtgaagatagtaccgaaacaagtgctggtgacaggtcctgcaaatctttgggtgggcgatgtgccgaccccgctgtattggcttttcggattttttccgtga

SEQ ID NO: 5438 - protein, 309 aa, Unknown
  Obtained from environmental sample
  misc_feature (1)..(309): Xaa is any amino acid
MDFLILTRNKRISITHHRVISYFNSPRLNSSNQIYFYNNLRSPLAVLYLTTVLLLLSIFLNAKSPVSLPAGKPIVFFLTDSLKTKPFNPGKGSANILRSDTLPVPQTNILPNDSSITIISDTISNNDTIEFAQQDDIKDIINYKAEDSIVYDISTKKMYLYNAADVHYQKIQLNSNSIDFDWNVFTLTARGTLDSNAQMSGTPVFTDDGXEYRADSMKYNFKTKKGIVYHVVTKEGDAYIHSEKVKKNEYDEWYGEKSKYTTCDLDHPHFYFKAQEVKIVPKQVLVTGPANLWVGDVPTPLYWLFGFFP

SEQ ID NO: 5439 - DNA, 834 bp, Unknown
  Obtained from environmental sample
  misc_feature (1)..(834): n is a, c, g, or t
atgctatcattaaggaaatgtgttaacgaacttggttttgaacaagctaatatagacagtgtaggaaatattattgccaccaaaggtgaagggtatccaagaatattactttgtggtcatatggatacagttccaaataaagttccagtaaggatagagaatggcttcatgtatggtagaggtgcatcagatgctaaagctccattaatatccatgcttttagcagcctctgaattccctaaacaaaatggtactataatatttgctggtgtagtcgatgaggaaggaaatgcaacaggtagtaagcatcttgtaaaaaataatttggaaatagattatgccatatttggtgaacccagtggtatagaaaatattacagtttcctataagggaagattagctcttaaattaatatgtgatgttttagacagtgcacatgcaagtgctccatggttagcaaaaaactctattgaagaaatctataatttttggaatgagattaaaaatgctttaaataagaattatgagaaagaaaaaagaagtaactctgtcagttgttgtcttacagaaattttaggtggatccagtcacaatgtcactcctcaaaaatgtaaaataacaatggatattagaatcccaaatgggactacttgccaacaagtttttgattctataaaaagtctcattgcaaaaacttcaaaagaaaatgggataaaaacaaattttataattgaagattttactgagccattcgaaactgatttttcctctccattagtgaggtctcttgttctctcaattcttgacatttgtaaaaaaagacctgcattataa

SEQ ID NO: 5440 - protein, 277 aa, Unknown
  Obtained from environmental sample
  DOMAIN (127)...(237): Peptidase dimerisation domain
  misc_feature (1)..(277): Xaa is any amino acid
MLSLRKCVNELGFEQANIDSVGNIIATKGEGYPRILLCGHMDTVPNKVPVRIENGFMYGRGASDAKAPLISMLLAASEFPKQNGTIIFAGVVDEEGNATGSKHLVKNNLEIDYAIFGEPSGIENITVSYKGRLALKLICDVLDSAHASAPWLAKNSIEEIYNFWNEIKNALNKNYEKEKRSNSVSCCLTEILGGSSHNVTPQKCKITMDIRIPNGTTCQQVFDSIKSLIAKTSKENGIKTNFIIEDFTEPFETDFSSPLVRSLVLSILDICKKRPAL

SEQ ID NO: 5441 - DNA, 348 bp, Unknown
  Obtained from environmental sample
  misc_feature (1)..(348): n is a, c, g, or t
atgaataaaaattacgatatttcttttaaaataccagacgatctgttacaatttttaaataatgaaacttattcattgttgattaaaggtgagccaggctcaggaaaaaccgctctatgtttgacaattcttaaagcattaaacataaagaataatttcttttatatttctacaagagtatcgcctaataaattattttattactttaagtggataaataaataccttaaaattaaatattcaaataatcataaaaaaacttctaaaaatataaatagtttagaaccattttttgaagatgcacgtttagatgaaccagaatccctttcgaacgaaacaatcatctga

SEQ ID NO: 5442 - protein, 115 aa, Unknown
  Obtained from environmental sample
  misc_feature (1)..(115): Xaa is any amino acid
MNKNYDISFKIPDDLLQFLNNETYSLLIKGEPGSGKTALCLTILKALNIKNNFFYISTRVSPNKLFYYFKWINKYLKIKYSNNHKKTSKNINSLEPFFEDARLDEPESLSNETII

SEQ ID NO: 5443 - DNA, 438 bp, Unknown; identical to SEQ ID NO: 4803
  Obtained from environmental sample
  misc_feature (1)..(438): n is a, c, g, or t

SEQ ID NO: 5444 - protein, 145 aa, Unknown; identical to SEQ ID NO: 4804
  Obtained from environmental sample
  DOMAIN (1)...(145): PhoH-like protein
  misc_feature (1)..(145): Xaa is any amino acid

SEQ ID NO: 5445 - DNA, 483 bp, Unknown
  Obtained from environmental sample
  misc_feature (1)..(483): n is a, c, g, or t
atgaaaaaactgataaaactttgcgctcttttctattgcttcagcttaatatcttgtggtggaaatgaagaaaaaaagacagaaaacgcagatgaaaagcaaattgatagcattgaaactcanagagctgtaattcctgatgcgccaaataataagtttgatgataccctaatttacatttcaacttttgaagatttatataaaaacataggttcgcacagaactnntggtttnaaaaatgacattatattttcagataaagtaaagggcgcaaaaaatataaatgcagagctgaagttttcgatgaggatcaccggaataagtatttnngaaaattgtagcgataagataaactctatacttttatttcaccgaacccnntgctacaagtattggcattttaatgctgcgaaatattcatattcaaattgtaaagcaaggcacgaactaaaaaaggttctgcagcgcaagtgtatcagataa

SEQ ID NO: 5446 - protein, 160 aa, Unknown
  Obtained from environmental sample
  misc_feature (1)..(160): Xaa is any amino acid
MKKLIKLCALFYCFSLISCGGNEEKKTENADEKQIDSIETXRAVIPDAPNNKFDDTLIYISTFEDLYKNIGSHRTXGXKNDIIFSDKVKGAKNINAELKFSMRITGISIXENCSDKINSILLFHRTXCYKYWHFNAAKYSYSNCKARHELKKVLQRKCIR

SEQ ID NO: 5447 - DNA, 945 bp, Unknown
  Obtained from environmental sample
  misc_feature (1)..(945): n is a, c, g, or t
atgaaaaaactgttaaactttgggtttttttttatggcttcaggttatttttttgggggaaatggagaaaaaaaggccgaaaacgccggtgaaaagcaaattgatagcattgaaattaaaagagctgtaattcctgatgcgccaaataataagtttgatgataccctaattacattttcaacttttgaagatttatataaaaacataggttcgcacagaactttggttttaaaaaatgacattatattttcagataaagtaaagggcgcaaaaaatataaatgcagagctgagtttcggattgaggatcaccggaataagtaatttgaaaattgttagcgataaagataaactctatactttaattcaaccgaaccctgcttacaaagtattggcattttatggctgcgaaaatattcatattcaaaatgttaaagcagggcacgaacccaaaaaaggttcttgcagcgcaagtgttatcagtatagataaatcacagaacttttttattaccgattctgatctttacggcagtggttatgaaggtattacggcttacgaagtaacaggtttatatgtaaaaaatactaaaatacatgaatgttctttcagcatgatgacattgtctttatctgagaatctttattttatggattgcagttttgttgataataatgagcctagcggtgcaggaaaattctattttgctaaatctgagaatattatatttgaaaacggtgaaattgcaagaaatgcacgttttattggccagccaacacaagatgccatgtttgaacttgatgactgcggcgatattattttaaataacctacatattcatgataatagcgccggcaggttttctacagacgataaaatgctaaaaatcaacaacgtaaagtttgaaaataatacctgggatgtaaaaccaacagcatctaaataa

SEQ ID NO: 5448 - protein, 314 aa, Unknown
  Obtained from environmental sample
  misc_feature (1)..(314): Xaa is any amino acid
MKKLLNFGFFFMASGYFFGGNGEKKAENAGEKQIDSIEIKRAVIPDAPNNKFDDTLITFSTFEDLYKNIGSHRTLVLKNDIIFSDKVKGAKNINAELSFGLRITGISNLKIVSDKDKLYTLIQPNPAYKVLAFYGCENIHIQNVKAGHEPKKGSCSASVISIDKSQNFFITDSDLYGSGYEGITAYEVTGLYVKNTKIHECSFSMMTLSLSENLYFMDCSFVDNNEPSGAGKFYFAKSENIIFENGEIARNARFIGQPTQDAMFELDDCGDIILNNLHIHDNSAGRFSTDDKMLKINNVKFENNTWDVKPTASK

SEQ ID NO: 5449 - DNA, 378 bp, Unknown
  Obtained from environmental sample
  misc_feature (1)..(378): n is a, c, g, or t
atggacaaagcaattacaaaaaaaagactggcgctcggggcgatagcggtaacactgtttacagttattgcatggatgtacccggaaggttatttccagctcgcgatggaaaatgatttcatcaaatcggtgaaagaaaaaatgacggcatataataagcaaatgcccgaagaccgattgtatgtacaaatggataagcccatgtattctccgggagaaacgatgtggctttctgtttttgtgcgcaacggacagacgttaaagccttcgaaaaaaagcgatatcgtccatgttgagctgatcaatccgaaaggcacggttgaaaaaacaatcaatctcatcgcgaccaacggtgggcggcaggagattcaattctga

SEQ ID NO: 5450 - protein, 125 aa, Unknown
  Obtained from environmental sample
  misc_feature (1)..(125): Xaa is any amino acid
MDKAITKKRLALGAIAVTLFTVIAWMYPEGYFQLAMENDFIKSVKEKMTAYNKQMPEDRLYVQMDKPMYSPGETMWLSVFVRNGQTLKPSKKSDIVHVELINPKGTVEKTINLIATNGGRQEIQF

SEQ ID NO: 5451 - DNA, 612 bp, Unknown
  Obtained from environmental sample
  misc_feature (1)..(612): n is a, c, g, or t
atgatagcaattcgacaatacacatactttctttctttctttctttttgccgcggttacttcttttgcccaaaaggatcagaccctgaaacccgaacgtaccagggaattatttcatgattatgtagatagcgagcaaagaaaggccctgcagagtgatggcaaagacgacaagatctttaccccttatgcaaatgaagaaataaatattcagatcacgagtgccctggttggtaaagtaaatgaccttcagaagaaaattgagaaagattctacggtgggagggcaagccaaagtgctttatctccgtggacttgaaagactgctgcgcgatcttaacgctaattggaaatatggtcgttttgtagttacctatctgccagaaatattgtccggctatgaaaccagcgttgatctggataagaagaaagaaagcattgaaaattttataaggggtcttgattataacgttgcccgtgcattgcttgactgcactgcctttgaaaaaaacgcangttataagtcatccaggaattatttaataaaaaatattgtgaactgcatccggagcaaacttttggcatgctgcggactacgctggccagaatcctga

SEQ ID NO: 5452 - protein, 203 aa, Unknown
  Obtained from environmental sample
  misc_feature (1)..(203): Xaa is any amino acid
MIAIRQYTYFLSFFLFAAVTSFAQKDQTLKPERTRELFHDYVDSEQRKALQSDGKDDKIFTPYANEEINIQITSALVGKVNDLQKKIEKDSTVGGQAKVLYLRGLERLLRDLNANWKYGRFVVTYLPEILSGYETSVDLDKKKESIENFIRGLDYNVARALLDCTAFEKNAXYKSSRNYLIKNIVNCIRSKLLACCGLRWPES

SEQ ID NO: 5453 - DNA, 903 bp, Unknown
  Obtained from environmental sample
  misc_feature (1)..(903): n is a, c, g, or t
gtgttgtgcggcgacgggccgcgtacagaaaaggaaggcgaaaaggaacgttgcgaccaggcaaggaaaattgcaactgccgtggattgggattgcgaagtaaaaactttattccgcgatgaaaacataggctgcggccgcggccctgccgaagcaattagctggttttttgaacatgtggagcagggaattattttagaagatgattgcttgccagcacagagttttttttcttttagtgaagaacttttggagaaatataaatacaataatagaatctggcatatttgcggaaattctttttttcaaaatcaaagtcaaacatcttattatttttctagctatggccatatatggggctgggcgtcctggagaagagcttggaagcactatgattttaatttaaaaaatattgatcgttctattttaatcttgagattaaatgacacttttatttctaaggaagaaaaacttttttggttaaatcactatgatcacgttcataagttgaaatataaagatttctgggactatcaatggtctttaatattatggtataataaagctctttcaataacgcctacaaaaaatttaattagaaacataggttttggtgattatgcaacacacacaactgataaaaattcctggctttctgaattaaagacttttgaaatttcaaacgttgttcataataatagtatcattcaaaataagatagcagatcgttatacttcaaaaaaaatatttggtattcaatccaaaaatgaattaatactaaaacgaattaaacatatcgttaagaaattagtaaataaanaaggtgcttacaaacgctatttaaaatatctaattttcatttatatacataagtatgcagacagaaccgcttctttggaatga

SEQ ID NO: 5454 - protein, 300 aa, Unknown
  Obtained from environmental sample
  misc_feature (1)..(300): Xaa is any amino acid
MLCGDGPRTEKEGEKERCDQARKIATAVDWDCEVKTLFRDENIGCGRGPAEAISWFFEHVEQGIILEDDCLPAQSFFSFSEELLEKYKYNNRIWHICGNSFFQNQSQTSYYFSSYGHIWGWASWRRAWKHYDFNLKNIDRSILILRLNDTFISKEEKLFWLNHYDHVHKLKYKDFWDYQWSLILWYNKALSITPTKNLIRNIGFGDYATHTTDKNSWLSELKTFEISNVVHNNSIIQNKIADRYTSKKIFGIQSKNELILKRIKHIVKKLVNKXGAYKRYLKYLIFIYIHKYADRTASLE

SEQ ID NO: 5455 - DNA, 816 bp, Unknown
  Obtained from environmental sample
  misc_feature (1)..(816): n is a, c, g, or t
atgtgtggaatcataggctttaccggaccgaagaatttggagactttgctaaatatgaatttaattcaacatcatagaggacctgatgaagacggaacttatattgatgagtcaggaatggtgaatttagcaatgaaacgactaagcattgtagatatacttgaagggcatcaacctatgtgcaatgacgacgaacaaatatggattgttttcaatggtgaaatttttaatgcaccagaattaagaaagaggctaattaaaaaaggatataaattcaggacagaccattcagatacagaagttctaatttatatgtatctagaatatgagagtgcaatgctcgatcaattaaacggaatgtttgcttttgtgatttatgataagaaaaagaacaagctatttggctcaagagatcgttttggaataaaacctttttattattctttaaccggtaatcgtttttcttttgcttcggaaatgaaatcacttataatttgtccgtggattagcagtgaaatagatatacaggctacatatgacttttttacttttcaagtcactcctgcgccccattcaatatttaaatctataaaaaaactaccctctggtaattattttgactatgatttagggttaaaaaaatttacaaccggtgtttattggaaaccatctttttctaatgtagttgtaaaacgtagtgaattaactgattttaaaagttcaattaaaaaaacttttttggaagcagtcggtagatggtcccaaagtgatgttgaagttgggtgttcttatcggaggtatgactctctcatctga

SEQ ID NO: 5456 - protein, 271 aa, Unknown
  Obtained from environmental sample
  DOMAIN (2)...(108): Glutamine amidotransferases class-II
  misc_feature (1)..(271): Xaa is any amino acid
MCGIIGFTGPKNLETLLNMNLIQHHRGPDEDGTYIDESGMVNLAMKRLSIVDILEGHQPMCNDDEQIWIVFNGEIFNAPELRKRLIKKGYKFRTDHSDTEVLIYMYLEYESAMLDQLNGMFAFVIYDKKKNKLFGSRDRFGIKPFYYSLTGNRFSFASEMKSLIICPWISSEIDIQATYDFFTFQVTPAPHSIFKSIKKLPSGNYFDYDLGLKKFTTGVYWKPSFSNVVVKRSELTDFKSSIKKTFLEAVGRWSQSDVEVGCSYRRYDSLI

SEQ ID NO: 5457 - DNA, 717 bp, Unknown
  Obtained from environmental sample
  misc_feature (1)..(717): n is a, c, g, or t
atgaaatgccatgagcgacttcaggaatttacctttatatcgagtcatgatctgcaggaaccgctgcgtaaaattcaaatttttaccaatttcctttctaccccggccgctcaactcaacgagtatgctaaaaagtattcggataagatcaattcctctgccttcagaatgtctgcgttgataaaagaccttcttagcttctcaattctaagggatgataagatagaaatggaaaaagttgatctgaatgccgttatgagaaatattataaatgattttgaagttctcattgaagagagaaaggcgactgtcaacgtttcgttgcttcccgtcgtttgtggtgagccggttcagatgaatcagctcttctacaacctgatcagcaatgcgctaaaatttagcagggaaaatccggtcattaatatcagcgcaggcgaagcgagcgctaatgattttttaatttacccggaattagtgaaagacacgtactacgttttcatcagtgtaaaggataacggtattggatttgatcaaaaataccaggataagatcttcacactttttcaacggcttaacgataaaaaagacgtgcctggcacgggagtagggttagcgatctgcaaaaaaattgttgacaatcacaaaggattcatttttgtaaatagtacaaaaaacataggaactaccttcgaagtgtttcttccgggcaaagtataa

SEQ ID NO: 5458 - protein, 238 aa, Unknown
  Obtained from environmental sample
  DOMAIN (6)...(73): His Kinase A (phosphoacceptor) domain
  misc_feature (1)..(238): Xaa is any amino acid
MKCHERLQEFTFISSHDLQEPLRKIQIFTNFLSTPAAQLNEYAKKYSDKINSSAFRMSALIKDLLSFSILRDDKIEMEKVDLNAVMRNIINDFEVLIEERKATVNVSLLPVVCGEPVQMNQLFYNLISNALKFSRENPVINISAGEASANDFLIYPELVKDTYYVFISVKDNGIGFDQKYQDKIFTLFQRLNDKKDVPGTGVGLAICKKIVDNHKGFIFVNSTKNIGTTFEVFLPGKV

SEQ ID NO: 5459 - DNA, 663 bp, Unknown
  Obtained from environmental sample
  misc_feature (1)..(663): n is a, c, g, or t
ttgttctatccatttagcataagtatagaaatggatttagctttgttatacatctttcaatatgtgccaaataaccctgttagactagaattatctactgtacagaaaaaggaattattttcattcatgaagagtactaaggataaagaggaatacagaagagcatctgccataaaacaaaagatggaaggagtaccttatagaacaatagccaaaaaccttggtgtcaattaccgtaatgtgtatgactggattaacaattacagaaaatatagtctggatggaataagaaacaatagaatgaatgcaggtagaaagccagtgatatctactgacaagaacaaggagatggtaaaagacatagtactgaacaaatcaccccatacatttggctatctcaaaaatacatggagtattaggctgttggccacatatctttcctcactactggaaatgaatgtcagtccaatgcagacatggagaataattcatgatatgggcatagtatacaaacagccaaaacttgaactagaaaaaggcatagattatgaggaaaagaaaggaaagatagacagatacaagaagatatcggcngctctttttaaaaaagattctactgggattttgaagatgaaacatggttacatcctgcaccctacataa

SEQ ID NO: 5460 - protein, 220 aa, Unknown
  Obtained from environmental sample
  misc_feature (1)..(220): Xaa is any amino acid
MFYPFSISIEMDLALLYIFQYVPNNPVRLELSTVQKKELFSFMKSTKDKEEYRRASAIKQKMEGVPYRTIAKNLGVNYRNVYDWINNYRKYSLDGIRNNRMNAGRKPVISTDKNKEMVKDIVLNKSPHTFGYLKNTWSIRLLATYLSSLLEMNVSPMQTWRIIHDMGIVYKQPKLELEKGIDYEEKKGKIDRYKKISAALFKKDSTGILKMKHGYILHPT

SEQ ID NO: 5461 - DNA, 759 bp, Unknown
  Obtained from environmental sample
  misc_feature (1)..(759): n is a, c, g, or t
ttgaactttgattgcataagtttttctttgtctaaaattttgaatatgaaggatcttattgaaaaggcctgggaagaccggacgttgctgacggataaaaatgttctggatgcaattgaaagagtagtcgggcaacttgataaaggacagattcgcgtggcagaaccttccggagaagggtggaaagtaaacgactggattaaaaaagcggtgatcttatatttcccgacacgaaaaatggaaacattacatgccggtccgatggaattccatgataagattcaattaaaacacaactatagtgatcttggcgtaagagtcgttccgcatggcatcgcacgttacggaagctttcttgctaaaggagtgattatgatgccttcttatgtaaacataggtgcgtatgtcgatgaaaggacaatggntgatacatgggcaacggtaggcagttgcgcgcaaattggaaagtctgtacatctttcaggcnggtgtagaatgggcggattgcttgaaacggttcaggcagcacctgtgattattgaagatcactgcttcattggatcacgcagcattgtggtccaaagtgtgaagttgggaaaaaaagcgtgctgggaccaatgtcgttcttaccatgtcgacaagatatcgacgtcctccgaccgaaccgaaggatacaccggaaatttcctccgaaaccggttgaattccggccccaccgaaaaatttccggcagggaaatgggtttcctgcgccctctaa

SEQ ID NO: 5462 - protein, 252 aa, Unknown
  Obtained from environmental sample
  misc_feature (1)..(252): Xaa is any amino acid
MNFDCISFSLSKILNMKDLIEKAWEDRTLLTDKNVLDAIERVVGQLDKGQIRVAEPSGEGWKVNDWIKKAVILYFPTRKMETLHAGPMEFHDKIQLKHNYSDLGVRVVPHGIARYGSFLAKGVIMMPSYVNIGAYVDERTMXDTWATVGSCAQIGKSVHLSGXCRMGGLLETVQAAPVIIEDHCFIGSRSIVVQSVKLGKKACWDQCRSYHVDKISTSSDRTEGYTGNFLRNRLNSGPTEKFPAGKWVSCAL

SEQ ID NO: 5463 - DNA, 483 bp, Unknown
  Obtained from environmental sample
  misc_feature (1)..(483): n is a, c, g, or t
atgaatttcctggcacatgcatacttatcttttggcaataaagaagtgctggtaggtaatatgatttccgattttgtaaaaggcaaagcgcaatttgattttattgaaaatatacggaaggggatttcattgcaccggcgaattgatgcttatacggatacacataatgaaatcaaaaaagcaaaagaatattttcggccttcctaccgtttatacagcggaccaatcattgatattttgatggatcattttttagcaaatgacccgtttcagtttaaagcaggtgaactaaaacgttttacgcaatcagtttatcaaacgctcaaatcatattcttcacacttacccatgcgttttatcccagcttttacttacatgcaatcagaggactggctatttattaccnnatacangagggatttcaaaaagtatccgtgccttgtaagacgtgccagctttatagagacagtgcaactgcaataa

SEQ ID NO: 5464 - protein, 160 aa, Unknown
  Obtained from environmental sample
  DOMAIN (19)...(155): Protein of unknown function, DUF479
  misc_feature (1)..(160): Xaa is any amino acid
MNFLAHAYLSFGNKEVLVGNMISDFVKGKAQFDFIENIRKGISLHRRIDAYTDTHNEIKKAKEYFRPSYRLYSGPIIDILMDHFLANDPFQFKAGELKRFTQSVYQTLKSYSSHLPMRFIPAFTYMQSEDWLFITXYXRDFKKYPCLVRRASFIETVQLQ

SEQ ID NO: 5465 - DNA, 669 bp, Unknown
  Obtained from environmental sample
  misc_feature (1)..(669): n is a, c, g, or t
ttgggtaatggtagccaactcggatgtaagtttgagtacgccatacaggaaatgcctaacggtttggcacaggcatttgtaattggagcagattttataggtaccgataaagtagcattgatattgggcgataatattttttatggtaccgggcttgggagtcaattacagcaattaaacaatattgatggaggttatgtatttgcttacgaagtatccgacccggaaagatatggtgtggttgaatttgataaggattataacgtgctctccattgaagaaaaaccacagcaaccaaaatcaaacttcgcagttccgggtctttatttttatgataacgaagtggtcagtatctccaaaaatctaaagccatcacttcgtggtgagtacgaaataacggatgtgaataaagagtacttaaaaagaggcaggttgaaagtttctatccttgaccggggtactgcatggctggataccggcacatttgaatcattaaatgatgccagcgaatttgtaagagtaattgaaaaaaggcaaggcactaagatcgggtgtatagaagaagttgcctaccggatgaattttataaaaaaagatcaattattacaacaagccgaagctcttgcaaaaagtggttatggcatttacctcaaaaacctggttaagtaa

SEQ ID NO: 5466 - protein, 222 aa, Unknown
  Obtained from environmental sample
  DOMAIN (1)...(175): Nucleotidyl transferase
  misc_feature (1)..(222): Xaa is any amino acid
MGNGSQLGCKFEYAIQEMPNGLAQAFVIGADFIGTDKVALILGDNIFYGTGLGSQLQQLNNIDGGYVFAYEVSDPERYGVVEFDKDYNVLSIEEKPQQPKSNFAVPGLYFYDNEVVSISKNLKPSLRGEYEITDVNKEYLKRGRLKVSILDRGTAWLDTGTFESLNDASEFVRVIEKRQGTKIGCIEEVAYRMNFIKKDQLLQQAEALAKSGYGIYLKNLVK

SEQ ID NO: 5467 - DNA, 402 bp, Unknown; identical to SEQ ID NO: 3307
  Obtained from environmental sample
  misc_feature (1)..(402): n is a, c, g, or t

SEQ ID NO: 5468 - protein, 133 aa, Unknown; identical to SEQ ID NO: 3308
  Obtained from environmental sample
  DOMAIN (8)...(126): Glyoxalase/Bleomycin resistance protein/Dioxygenase superfamily
  misc_feature (1)..(133): Xaa is any amino acid

SEQ ID NO: 5469 - DNA, 744 bp, Unknown
  Obtained from environmental sample
  misc_feature (1)..(744): n is a, c, g, or t
ttgttgctggcttatttatatggattaccatatgggtttttgatgatagcaaccgtagtcatatttcttacgttttcaatcaaagctttaaattggtggcttatatctcaaagagaaagcaatgaaaaacactacaaatctcaaagtaacattgttgatagttttataaactttgccacaattaagctttttaataatcaaaaatatgaatttgataagtgtttaaatttgcttaatgagcgacaagaatctcaagtcaaagcattacttcatgggcgctatatttgcttaggccaagactttattatagggattacattaataatttttagtcttatgtgtgcttataaagttctttacgaagggtatggtgttagtgattttatattaattaattcatatgtattacagttctctattccacttagtagtttaggcttcattcttggtgattttcacaaacaacttacccagatggaaaaaatcatagaacttcttgggtacaaacctaggattaaagatgggagcaagcccattgtagtgaacgacaataaaatagttatatcatgtaaagatattcactttggatatgagtctaanagaccgatccttaaaggtgtgtcgtttactttactgccgggaaaaaaccttagcatttgtaggacccactggttctgggaagtcaactgctacaaatcnttttgtttacgttttacgagtacaaatctggagaaatacatataa

SEQ ID NO: 5470 - protein, 247 aa, Unknown
  Obtained from environmental sample
  misc_feature (1)..(247): Xaa is any amino acid
MLLAYLYGLPYGFLMIATVVIFLTFSIKALNWWLISQRESNEKHYKSQSNIVDSFINFATIKLFNNQKYEFDKCLNLLNERQESQVKALLHGRYICLGQDFIIGITLIIFSLMCAYKVLYEGYGVSDFILINSYVLQFSIPLSSLGFILGDFHKQLTQMEKIIELLGYKPRIKDGSKPIVVNDNKIVISCKDIHFGYESXRPILKGVSFTLLPGKNLSICRTHWFWEVNCYKSFCLRFTSTNLEKYI

SEQ ID NO: 5471 - DNA, 468 bp, Unknown
  Obtained from environmental sample
  misc_feature (1)..(468): n is a, c, g, or t
ttgatgatcgcattctttatcatgcaggcagattcatcatttatcaaagtatatgacaccagtggccggtacgagagtggcaagagcaaaagcgaccttacgcgaacggatagcctttcatggaaagagaagtcgtgggttgcaggtattaaaaccgggaatggttcgaaagcttacgactggaacgaactaaaagcaaagcgagtcattcatgacgacatccgcaaaacaccagtgctgttagtactggcgggagacgacaaaagtttctttgcattcgagcgaccttccatggatgcaattttttcacttaaactcgatacgctgatctctaacaatcatcattacaggattgacggtaaaggaatcgatacatcattttcattgaagcctttacctgtttaccaggaattctggcacagctggcgcacatttaatcccggaacagagagatatcctgaacggtaa

SEQ ID NO: 5472 - protein, 155 aa, Unknown
  Obtained from environmental sample
  misc_feature (1)..(155): Xaa is any amino acid
MMIAFFIMQADSSFIKVYDTSGRYESGKSKSDLTRTDSLSWKEKSWVAGIKTGNGSKAYDWNELKAKRVIHDDIRKTPVLLVLAGDDKSFFAFERPSMDAIFSLKLDTLISNNHHYRIDGKGIDTSFSLKPLPVYQEFWHSWRTFNPGTERYPER

SEQ ID NO: 5473 - DNA, 318 bp, Unknown
  Obtained from environmental sample
  misc_feature (1)..(318): n is a, c, g, or t
atgggactcaacaaatcagagaacgcagggatggtttatctatccgtagcgaatggaaaacttgtccagcagcacaaagaggcgaacgccaatacaacccaacgcgaaaacaaaatgggtaaaattgtgcatgaggaatttttcaaggaattggttggcgttattaccaagatcgatancaaggagaatgattatggtaagcagtggcaaatcgttttcaccgatggtgatgataagtatttggttcaatgccgtatagcggtcgttattcttctcatttttgaaagcatgccaaatgttacgcagggcaaacagtaa

SEQ ID NO: 5474 - protein, 105 aa, Unknown
  Obtained from environmental sample
  misc_feature (1)..(105): Xaa is any amino acid
MGLNKSENAGMVYLSVANGKLVQQHKEANANTTQRENKMGKIVHEEFFKELVGVITKIDXKENDYGKQWQIVFTDGDDKYLVQCRIAVVILLIFESMPNVTQGKQ

SEQ ID NO: 5475 - DNA, 678 bp, Unknown
  Obtained from environmental sample
  misc_feature (1)..(678): n is a, c, g, or t
ttggataaacatgaaaactggttaagaaaatatattatagaacaacatggttccgactggaagccaaatgtattgggacagtgcaaaagctggattgatagcggacttcagccaagagcagtgaccagagatcttgactggggtgtaaaagttccattgaaagaggcagaaggaaaagtattgtatgtatggtttgatgcgcctatcgggtacatatctgccaccaaacaatggtcattaaatacaggtaaggactggaaaccttactggatggacaaagaaaccaagcttgttcattttattggtaaggataatattgttttccattgtctcatatttcctgtaatgcttcacctgcatggttacattgtacctgataatgtacctgccaatgaattcatgaatcttgaaggagacaaaatgagcaccagcagaaactggaagcttgacatgcaggaatacattgatgattttatcaaaaaagaaaatggcggaccattgcttgcagatgcattacgctattatctgatcggcatattaccagaaacaaaggacagcgaatttacatggaagggtttccaggattcagtgaacaatgaactcgttgccatattcggaaattttgtgaacaggacttttgtgttgatgcacaaactcacaaaaggaaaaagttcctaa

SEQ ID NO: 5476 - protein, 225 aa, Unknown
  Obtained from environmental sample
  misc_feature (1)..(225): Xaa is any amino acid
MDKHENWLRKYIIEQHGSDWKPNVLGQCKSWIDSGLQPRAVTRDLDWGVKVPLKEAEGKVLYVWFDAPIGYISATKQWSLNTGKDWKPYWMDKETKLVHFIGKDNIVFHCLIFPVMLHLHGYIVPDNVPANEFMNLEGDKMSTSRNWKLDMQEYIDDFIKKENGGPLLADALRYYLIGILPETKDSEFTWKGFQDSVNNELVAIFGNFVNRTFVLMHKLTKGKSS

SEQ ID NO: 5477 - DNA, 633 bp, Unknown
  Obtained from environmental sample
  misc_feature (1)..(633): n is a, c, g, or t
ttgcgcgctccggaaatcacaggcggtcgcggctggcttaacactgacaaaccgctttccatcgccgccctcaagggaaaagtcgttctactcgatttctggacctatggctgcatcaactgcatccatatcattcccgatctgaagaaactcgaagcgaagtacgctaaccaactggtcgtgatcggagttcactccgtcaagtttcaaaacgaaaaagagacgcagaacatcaggcgcatcatcctgcgctacgaaatcgagcatcccgtttacaacgactcggaatacgcagtctggcaaagctacggcgtgcgcgcctggcccacgcaggttctaatcgatcctgccggttatatcgtcggcggcgcttccggcgaaggcaattacgatgttatcgatcaaaccgtagcgaagcctgttacagactttcgcagcaaaggcgaactcaacgaggaaccgctcaaactcgttctcgaacggaccaaagttgatgaactaccactcgcttttcctggaaagattctcgctgacgcgaatagcgatcgactcttcatcgccaactcaatcaaaacccgcatcgtcgttacgaaactcaaaggcacactcgtcgaaacaatcggcaaaggctaa

SEQ ID NO: 5478 - protein, 210 aa, Unknown
  Obtained from environmental sample
  misc_feature (1)..(210): Xaa is any amino acid
MRAPEITGGRGWLNTDKPLSIAALKGKVVLLDFWTYGCINCIHIIPDLKKLEAKYANQLVVIGVHSVKFQNEKETQNIRRIILRYEIEHPVYNDSEYAVWQSYGVRAWPTQVLIDPAGYIVGGASGEGNYDVIDQTVAKPVTDFRSKGELNEEPLKLVLERTKVDELPLAFPGKILADANSDRLFIANSIKTRIVVTKLKGTLVETIGKG

SEQ ID NO: 5479 - DNA, 372 bp, Unknown
  Obtained from environmental sample
  misc_feature (1)..(372): n is a, c, g, or t
ttgcacatgacaacatacaacccaaaaacaatgtttagaggccacatggtcgtagtatttatatttttatcgatactaacctcctacatactaagcgcacagcgtacccctccaatgagtaagcccgatatgaaagacaccctttattgtgttcagaatactgcgcaagagtggcaggtatggctatataaatttgaaaatattaaatttcaattaaagaaaagcgaccttccctcccgtgatgtaacctacttaatagactcattgattgtgccaatgcagtatgtgattagcagccaagtgaggccacaaattgagagaagagaaaaagcagactcagcaggtaaaccaaataataaacaaggaaaataa

SEQ ID NO: 5480 - protein, 123 aa, Unknown
  Obtained from environmental sample
  misc_feature (1)..(123): Xaa is any amino acid
MHMTTYNPKTMFRGHMVVVFIFLSILTSYILSAQRTPPMSKPDMKDTLYCVQNTAQEWQVWLYKFENIKFQLKKSDLPSRDVTYLIDSLIVPMQYVISSQVRPQIERREKADSAGKPNNKQGK

SEQ ID NO: 5481 - DNA, 489 bp, Unknown
  Obtained from environmental sample
  misc_feature (1)..(489): n is a, c, g, or t
ttgtatccagatgttgtactgatggatattaatcttccgggcatgagcggaattgattgtattaaatacgtcaaagaaaaatgtcncggtacgcaattcatgatgttcacagtttatgagaatgatgaaaaagtagttcaggcattgcgtgcaggagcaaccggttatttattgaagcgaacagaacccaaacgcattttggaaagcattaaggaactaaaccagggcggttcgcccatgagcagcaatattgcacgaaaactactaaccatttttgttcacgaaaaagcggtcactaaaaaagaagtgctctccgatagagaaaaccaggtgctgcaacttttggccgatggtttgttatacaaagaaatcgctgagcgccttttcatcggtcacggcactgttcgacagcacattcataacatttatgaaaaacttcacgttagcaaccgcaccgaagccgtgaataaatatttcgaaagaaactaa

SEQ ID NO: 5482 - protein, 162 aa, Unknown
  Obtained from environmental sample
  DOMAIN (1)...(78): Response regulator receiver domain
  misc_feature (1)..(162): Xaa is any amino acid
MYPDVVLMDINLPGMSGIDCIKYVKEKCXGTQFMMFTVYENDEKVVQALRAGATGYLLKRTEPKRILESIKELNQGGSPMSSNIARKLLTIFVHEKAVTKKEVLSDRENQVLQLLADGLLYKEIAERLFIGHGTVRQHIHNIYEKLHVSNRTEAVNKYFERN

SEQ ID NO: 5483 - DNA, 456 bp, Unknown
  Obtained from environmental sample
  misc_feature (1)..(456): n is a, c, g, or t
ttgcgcgaacatgaagaagcatatgaaggagaatttgtgtgtattttcaataaaacggtaaaactattcactacaataactgttggaatcattctgttctcttcacctgttatgggccaggatgcattttctgacaaggaagtatgtatggctgcactcactaaaatgaatcaatggtcaaagaatcctaaaggtgggcaaagtttgcaaggcagatatttaacttatgacaataataaatattattttaaatccaaaggcggtgaatggaaatgcaccatattgggagataaggtaatgtggggcttaaagtcagggcgttggagaaatactcctgatgacggtataattaattttgaaatagtaggtaataagctctcaattacagaaaaatattctgacaactcctctgatgttaaaatgttcactaaaaaagaagttcaacatttattttag

SEQ ID NO: 5484 - protein, 151 aa, Unknown
  Obtained from environmental sample
  misc_feature (1)..(151): Xaa is any amino acid
MREHEEAYEGEFVCIFNKTVKLFTTITVGIILFSSPVMGQDAFSDKEVCMAALTKMNQWSKNPKGGQSLQGRYLTYDNNKYYFKSKGGEWKCTILGDKVMWGLKSGRWRNTPDDGIINFEIVGNKLSITEKYSDNSSDVKMFTKKEVQHLF

SEQ ID NO: 5485 - DNA, 756 bp, Unknown
  Obtained from environmental sample
  misc_feature (1)..(756): n is a, c, g, or t
ttgttttctgatgcggtgttaaagctgttaagaaggaatagattgcagccatcttcagtcgacattatcggctcacacgggcagacatttcaccacctgcctgaaaaggataactaccttggattcagactaaaatcaaccctgcagatcggggatcctgcaataatcgcaaacctgactggaataacaacggtgggtgatttcaggatagctgattgtgctgtagatggcgatggtgcgccgcttgtaccgtatcttgaccatatccttttcacccacaaaagcaaaaaccgcgcgttacttaatatcggcggaatagcaaacattacggtactgaaaaagaatgcccgcaaacaggatgtttttgcttttgatacgggtccgggtaatatgataatagacggtttgatgtatcacctgtttaagaagaagtatgataagaacagtctgattgctaaaaaagggacgctgaatcccgaacttttcaattacctggtaatggatagcgcatacagggctgaaccgcccaaatcaaccgggcgtgagcattatggaatggaatttcagaagaaactccttaagaaattcaaaaaggtgaataagtttgatatgataagaacagttactgagtttaccgcttatacaatttggtataattacaaaaattacattgaatcaggttgcagaattgatgagctgatagtaaagcgcgggggagcccacaatccattacttatgcatacttttaaagactaa

SEQ ID NO: 5486 - protein, 251 aa, Unknown
  Obtained from environmental sample
  DOMAIN (1)...(251): Uncharacterised protein family (UPF0075)
  misc_feature (1)..(251): Xaa is any amino acid
MFSDAVLKLLRRNRLQPSSVDIIGSHGQTFHHLPEKDNYLGFRLKSTLQIGDPAIIANLTGITTVGDFRIADCAVDGDGAPLVPYLDHILFTHKSKNRALLNIGGIANITVLKKNARKQDVFAFDTGPGNMIIDGLMYHLFKKKYDKNSLIAKKGTLNPELFNYLVMDSAYRAEPPKSTGREHYGMEFQKKLLKKFKKVNKFDMIRTVTEFTAYTIWYNYKNYIESGCRIDELIVKRGGAHNPLLMHTFKD

SEQ ID NO: 5487 - DNA, 714 bp, Unknown
  Obtained from environmental sample
  misc_feature (1)..(714): n is a, c, g, or t
atgtcgtttaacgattcagagaatacaccgcaaggcgccaaccgaaaattaattcctgagtggggcggccagcgaaatggtggtacatggtcggatggaactatatattatgaagtggttcctaaagatgccttcgataaaatattatggattgactccgacaggcttggctttatgattaatacggttacaaaagaagcgcttgaagccgagaagcaagttgtgaaaaatgaaaaacgtgaacgggttgacaatgcaccctatggatacaccgaagaaatcattcgtacaaatctctatccgaaagaacatccatacaactggaccgtaattggttcactacccgatcttcaggctgctacgctggaagacgtgaaagaattttatgatatgtactatggcgctaacaatgctacgcttgtgatagcaggtgatattaacattcaagaaaccaaagaaaaagtacagcggtggtttggagaaatccgcaaaggcccggaagtacagatgctaaaaccaatgcctgtaaaattagatcagataaaatctttttcttttgaggataactttgctcgccttcctgaattacaaatgattttcccgacaatcgaaaattaccatgctgattcatatgctctgaacatcttgggggaactgttaagtggaagtcgcaagtcaccattgtataaaattattgttgaagagaaaaaatag

SEQ ID NO: 5488 - protein, 237 aa, Unknown
  Obtained from environmental sample
  DOMAIN (119)...(237): Peptidase M16 inactive domain
  misc_feature (1)..(237): Xaa is any amino acid
MSFNDSENTPQGANRKLIPEWGGQRNGGTWSDGTIYYEVVPKDAFDKILWIDSDRLGFMINTVTKEALEAEKQVVKNEKRERVDNAPYGYTEEIIRTNLYPKEHPYNWTVIGSLPDLQAATLEDVKEFYDMYYGANNATLVIAGDINIQETKEKVQRWFGEIRKGPEVQMLKPMPVKLDQIKSFSFEDNFARLPELQMIFPTIENYHADSYALNILGELLSGSRKSPLYKIIVEEKK

SEQ ID NO: 5489 - DNA, 414 bp, Unknown
  Obtained from environmental sample
  misc_feature (1)..(414): n is a, c, g, or t
ttgtgcaatcaaaaactttcgagtctaatttcgggaaaaattggtgaaggatgggtcacagatttatatcaactcaaaaaacttacgacctttgccgatgatcctctgtttaggaatcaatggcgggccgtaaagtcgtataacaaagaaactttggctggctacattgcaagcctcaccggcgtaaaagtaaatctggattccatatttgacattcacgtcaaacgtattcatgaatacaaacgccagttgttgaattgtttgcacgcgatccatctttacaatcaaatcaaacaaaatccgcagctttcattcgttcctatcactaagatttttgcaggtaaagcggcgccaggatacttccttgcaaagttaattattaaacgttatcaattcagtggcagatgtaattaa

SEQ ID NO: 5490 - protein, 137 aa, Unknown
  Obtained from environmental sample
  DOMAIN (3)...(135): Carbohydrate phosphorylase
  misc_feature (1)..(137): Xaa is any amino acid
MCNQKLSSLISGKIGEGWVTDLYQLKKLTTFADDPLFRNQWRAVKSYNKETLAGYIASLTGVKVNLDSIFDIHVKRIHEYKRQLLNCLHAIHLYNQIKQNPQLSFVPITKIFAGKAAPGYFLAKLIIKRYQFSGRCN

SEQ ID NO: 5491 - DNA, 300 bp, Unknown
  Obtained from environmental sample
  misc_feature (1)..(300): n is a, c, g, or t
atgtatgtagaattgcctggtccggtacaaaaaagtaagatcgagtatttcgtgatttttagaaattctatgggcatgatcaataacagggctgatacccgcctcattggcgaaatgagattatccggattgcccgttggagaatcctgtatccttgttgcattcaccaagaaagatggagtcttttatcacagcagaagtgaattttctgttgaaaagaacaaaagtgttaccacggatttcaaccaggtatcagaagaaaaattgaaagaaatgtttggagaaaatgtccggatctga

SEQ ID NO: 5492 - protein, 99 aa, Unknown
  Obtained from environmental sample
  misc_feature (1)..(99): Xaa is any amino acid
MYVELPGPVQKSKIEYFVIFRNSMGMINNRADTRLIGEMRLSGLPVGESCILVAFTKKDGVFYHSRSEFSVEKNKSVTTDFNQVSEEKLKEMFGENVRI

SEQ ID NO: 5493 - DNA, 399 bp, Unknown
  Obtained from environmental sample
  misc_feature (1)..(399): n is a, c, g, or t
atggatcaattcatgcggtccgacagggccaagcacgccgttttacccattacaaaattcggcctcatgcagatcacaaggcagcgcatgaagcctgaaatgaatatcaataccagcgagatctgcccaagctgcaacggaaccggtaagatctcgtcaacattgatacttgaagatgagatcgaaaagaacctaagttacctgattatgcaaaagcatacaggcttaaccatagaagtacaccccatcctctataccttcctcacttcagggttcatttccaaaagattcaaatggagctggaaatacaaacaaaagatcaaggtaaaggccaactcaaattatcaccttacagaatttcatttctttgatgatagtgatgaagagataaaattgtaa

SEQ ID NO: 5494 - protein, 132 aa, Unknown
  Obtained from environmental sample
  misc_feature (1)..(132): Xaa is any amino acid
MDQFMRSDRAKHAVLPITKFGLMQITRQRMKPEMNINTSEICPSCNGTGKISSTLILEDEIEKNLSYLIMQKHTGLTIEVHPILYTFLTSGFISKRFKWSWKYKQKIKVKANSNYHLTEFHFFDDSDEEIKL

SEQ ID NO: 5495 - DNA, 357 bp, Unknown
  Obtained from environmental sample
  misc_feature (1)..(357): n is a, c, g, or t
ttgatgtcttatatcatccctgaagccagaatatacagcatccaatgcgcgggtgaggctgtcattggtcattccatggttgctctcctcggggataaaccacagccattgatgaccagatattggttgaggctgattggcaagtttcacatatgggtcacgcacaaaggcaagagcgggaatgttttttgcgaagttaagccatcgctctcgcaactggttgaatccaatatggccaaagacaataccaaggtcagcttggttttctgccatcaattcgaaaatatctccctgcagaaattttggcatttcttattcctgatgttgaatatgtttatatttgtaaataaattatag

SEQ ID NO: 5496 - protein, 118 aa, Unknown
  Obtained from environmental sample
  misc_feature (1)..(118): Xaa is any amino acid
MMSYIIPEARIYSIQCAGEAVIGHSMVALLGDKPQPLMTRYWLRLIGKFHIWVTHKGKSGNVFCEVKPSLSQLVESNMAKDNTKVSLVFCHQFENISLQKFWHFLFLMLNMFIFVNKL

SEQ ID NO: 5497 - DNA, 411 bp, Unknown
  Obtained from environmental sample
  misc_feature (1)..(411): n is a, c, g, or t
atgtatgaggaatgcccaatttgtggaaaatcggattttcctgagaacaccttccgttgcaagaaatgcaagcgtcccttcatttgtttgcagcaccaggaccccaagacatttctttgcatcgagtgcgagaaaaaggcagaatccttatccatagattcacttcgttttgaagttagcagaaatccatcggataacaaaaagattcagttactttgtaaaactttatatgcccagtcaatagatgcactcaatctggaaagatggagtgttgccagaacagggttccaggaaatcatgcgatttatcccggattacatgcatagtcgcaagtttcttatagaaacctattcgaaagaagcagcacaaaagatcaagcagcgatatttgaacccgcctgngatgctatga

SEQ ID NO: 5498 - protein, 136 aa, Unknown
  Obtained from environmental sample
  misc_feature (1)..(136): Xaa is any amino acid
MYEECPICGKSDFPENTFRCKKCKRPFICLQHQDPKTFLCIECEKKAESLSIDSLRFEVSRNPSDNKKIQLLCKTLYAQSIDALNLERWSVARTGFQEIMRFIPDYMHSRKFLIETYSKEAAQKIKQRYLNPPXML

SEQ ID NO: 5499 - DNA, 720 bp, Unknown
  Obtained from environmental sample
  misc_feature (1)..(720): n is a, c, g, or t
ttgcagctattgttttttatgcagcatccacatccaatcatccagccgtttatagagtaccttaaattcgaaaaacgctattcgcagcataccatcatttcttatcaaacagatctcatttcttttttcgattacattatcgttcagtatggcgagaccccgttaaatcaggtttctcattcttatgtccgaagctggctggcttctttaaaagacgggggaaatacttccaagacgttaaaccgtaagatctctactttaaaatccttttttaaataccagattaaaacaggtgggctgaagcaaagccctatgactaaaattgtggcacctaaaaatgaaaaacgacttcccggctttgtaaaggagcaggatattgaaaaaatattggacgaaaagcagtttcctgataattgggaaggcagaaccgaccgtttgctgataacccttttatataatgcagggctccggcgcagtgaactaatcaatttaaaaagaagccagatcaattattctgcctttactttaaaagtattgggtaagggaaacaaagaaagagtgatacctgttagcccgcaacttattgggagcattaaaaaatatgtagaggacagaaaggccgaatttcccggtctggatacggatgtattacttgttgatgaaaaggggagggcattgaatccgcgaaaagtgtactcatctgtaaagcgcattgcatag

SEQ ID NO: 5500 - protein, 239 aa, Unknown
  Obtained from environmental sample
  DOMAIN (14)...(99): Phage integrase, N-terminal SAM-like domain
  misc_feature (1)..(239): Xaa is any amino acid
MQLLFFMQHPHPIIQPFIEYLKFEKRYSQHTIISYQTDLISFFDYIIVQYGETPLNQVSHSYVRSWLASLKDGGNTSKTLNRKISTLKSFFKYQIKTGGLKQSPMTKIVAPKNEKRLPGFVKEQDIEKILDEKQFPDNWEGRTDRLLITLLYNAGLRRSELINLKRSQINYSAFTLKVLGKGNKERVIPVSPQLIGSIKKYVEDRKAEFPGLDTDVLLVDEKGRALNPRKVYSSVKRIA

SEQ ID NO: 5501 - DNA, 309 bp, Unknown
  Obtained from environmental sample
  misc_feature (1)..(309): n is a, c, g, or t
atgttggttttcttttcaccgtactcccgttattggcacnttgaatattttaaagaaacagaggataaacattcattgataataacagacttgagaatgcctggtatatgtgggatagaccttgcaaagagtataagagagtttaacaccaaaataaaaattttcttgatgactgcttttgaaagtaaagatttagaggataacgaagactttataaatgcgagaatcgacctactaattcaaaaacctgttcggtttgctgatctccgagtaatggtaaacgatgcattgaaaaatctaatatgctaa

SEQ ID NO: 5502 - protein, 102 aa, Unknown
  Obtained from environmental sample
  DOMAIN (1)...(101): Response regulator receiver domain
  misc_feature (1)..(102): Xaa is any amino acid
MLVFFSPYSRYWHXEYFKETEDKHSLIITDLRMPGICGIDLAKSIREFNTKIKIFLMTAFESKDLEDNEDFINARIDLLIQKPVRFADLRVMVNDALKNLIC

SEQ ID NO: 5503 - DNA, 363 bp, Unknown
  Obtained from environmental sample
  misc_feature (1)..(363): n is a, c, g, or t
atgattctagtcatcggtaacaaacgtttttccagttggtctctgcgttcctggttactcatgaaacaattcggaatccctttcgaagaaaaactcattcctctcgatcaacctgcaacgacaacggagatcctgaaatactcaaaatcgggcagggtccccatcctcatagacagtgacacgacgatttgggattccctagccatcgccgaatatctcaacgagaattccctcaaaaacaaatgtggcctaaggatccgaagacacgcgcatgggcgcgttctatttccaatgaaatgcattctagtttcgaaacgatgcgttctcacatgtcacatgcttacaaacaattcttgtccntag

SEQ ID NO: 5504 - protein, 120 aa, Unknown
  Obtained from environmental sample
  DOMAIN (3)...(75): Glutathione S-transferase, N-terminal domain
  misc_feature (1)..(120): Xaa is any amino acid
MILVIGNKRFSSWSLRSWLLMKQFGIPFEEKLIPLDQPATTTEILKYSKSGRVPILIDSDTTIWDSLAIAEYLNENSLKNKCGLRIRRHAHGRVLFPMKCILVSKRCVLTCHMLTNNSCP

SEQ ID NO: 5505 - DNA, 423 bp, Unknown
  Obtained from environmental sample
  misc_feature (1)..(423): n is a, c, g, or t
ttgcaaatgaaaatcagctcaaaattttatttaaaaataactgcggtattagtagttattttacttgtggtcggatataccattgtttcatcaaaaaatagttccaaaattgaaaataacataaccgtcgaaaaactggatgcattgctgttggcagatctgcaacaccagcaaatagatattgaaccggcatcaaaagaaataatggattgcagtaatatttcagaatctgaaatcagacaattatttaattttaagaatattaattattccaaatgcgaacccggcaattgccatactactgcatacaccattgaaggaaacttacaaaacgggaatcctgtcagcttcaagcttgattgcgcagaagaaggtaatgtattaagagaatttaaaataaatggtaaggcagattgcatctaa

SEQ ID NO: 5506 - protein, 140 aa, Unknown
  Obtained from environmental sample
  misc_feature (1)..(140): Xaa is any amino acid
MQMKISSKFYLKITAVLVVILLVVGYTIVSSKNSSKIENNITVEKLDALLLADLQHQQIDIEPASKEIMDCSNISESEIRQLFNFKNINYSKCEPGNCHTTAYTIEGNLQNGNPVSFKLDCAEEGNVLREFKINGKADCI

SEQ ID NO: 5507 - DNA, 384 bp, Unknown
  Obtained from environmental sample
  misc_feature (1)..(384): n is a, c, g, or t
ttgcaaatgaaaatcagctcaaaattttatttaaaaataactgcggtattagtagttattttacttgtggtcggatataccattgtttcatcaaaaaatagttccaaaattgaaaataacataaccgtcgaaaaactggatgcattgctgttggcagatctgcaacaccagcaaatagatattgaaccggcatcaaaagaaataatggattgcagtaatatttcagaatctgaaatcagacaattatttaactttaagaatattaattattccaaatgcgaacccggcaattgccatactactgcatacaccattgaaggaaacttacaaaacgggaatcctgtcagcttcaagctgaattggcagaagaaggtactgacttaa

SEQ ID NO: 5508 - protein, 127 aa, Unknown
  Obtained from environmental sample
  misc_feature (1)..(127): Xaa is any amino acid
MQMKISSKFYLKITAVLVVILLVVGYTIVSSKNSSKIENNITVEKLDALLLADLQHQQIDIEPASKEIMDCSNISESEIRQLFNFKNINYSKCEPGNCHTTAYTIEGNLQNGNPVSFKLNWQKKVLT

SEQ ID NO: 5509 - DNA, 951 bp, Unknown
  Obtained from environmental sample
  misc_feature (1)..(951): n is a, c, g, or t
gtggatcaagatggtaagaatttcaggaaagctggaaaaagtgaattatccgatgaactgaaggatgagctaaaaagaatagggattgtcctgactgataagaagtcaactctaatcgcagaggaaaattcaaataaatggattgtcagacagggatcccaggatgcaatctacatccaaaataaggaagcaaaattatatgtttatattaaacccgatgtgtcggttaaaatatcggatgtagtattcggatacatcctgaatgattatggtaacgccaactacaattatttcagaagatacggggaccgtgaatttctaaatgtggcaatcaaggcctatacagattcgatcagcagtttccctgataatactgtttcaaaatataataaatcactggccattttggaacaggacattgatgcgtcgactaaattgctggatgatgttataaaaaataatccaaaatggtttgaggctttggcctcatcggtggaaatcaatctgacaaaaattaataaagaaataaggtcaatcgaaaaaaaactgaatgacctggaaaaggaaagagtgtcagaaaaggaaaacgcaaaanaagcatttctgtctgctgccattcagcctattaaaagcacgccaactgatgtaattgaatgcaaatgccaaaaatactgcttattcgccggcaaatcaccaggaaaaaaacattcccatgaaaaaattctttacttgtacggaaccatcttttttaggcataaatcaacccgaaaatttccatttaatgtcactagtaatgttgaatcacggaaattgaccaaaaaatactgtattcagagaagagtcaaccggacaaacgaaacaggaaacaggaatatggcccaggatcgaaattttttggacccaccagttgtttcctatttgacgggatgcattagagccctgacagtctaa

SEQ ID NO: 5510 - protein, 316 aa, Unknown
  Obtained from environmental sample
  misc_feature (1)..(316): Xaa is any amino acid
MDQDGKNFRKAGKSELSDELKDELKRIGIVLTDKKSTLIAEENSNKWIVRQGSQDAIYIQNKEAKLYVYIKPDVSVKISDVVFGYILNDYGNANYNYFRRYGDREFLNVAIKAYTDSISSFPDNTVSKYNKSLAILEQDIDASTKLLDDVIKNNPKWFEALASSVEINLTKINKEIRSIEKKLNDLEKERVSEKENAKXAFLSAAIQPIKSTPTDVIECKCQKYCLFAGKSPGKKHSHEKILYLYGTIFFRHKSTRKFPFNVTSNVESRKLTKKYCIQRRVNRTNETGNRNMAQDRNFLDPPVVSYLTGCIRALTV

SEQ ID NO: 5511 - DNA, 801 bp, Unknown
  Obtained from environmental sample
  misc_feature (1)..(801): n is a, c, g, or t
atggtccgttttaatgatgctgaatataccttcaagacttgtgtaaatggaatgttaacaatatctatgatgattgaggaaatgctcaatatcaaagatatgaagattctacaagcaaatactgatggtattacgatcatgttccccaggaaggatgaagaaagagtacagcagattataaaggagaatgagaaaataacaggtctcaatgtggagcaagcagaatactctataatggttattaacgatgttaacaactacatgagtatagatgttaacggcgatattaaacagaaaggttgttttcttacaagagatagtatgattaaaggaggcttttatgagaagaatcctagtcagaatatagttgctattgcccttaataagtactttagcgagaatattcctgttgaggatactattaacgaatgtaacgatatccatgagtttatgattggtgttaagagaactaagacttttaagtggttagttaatactgttaaggattcaggagttatttcttcagagttaatggttgatagggtaatccgttattatgtaggtggtacaagttctataagtaagatgtggttaaaaggagaagtagacaaggacggagagaaagattctagtggatttactcttcttagtgctcattatcccattaccttagcacaaattattagtaacaacgagattgtatccagcaaaggtgtaagaaaaggacagaatatctttcctaacttaaatagagaatattatattaatgaatgtaagaaaataattgaaaatatatgctag

SEQ ID NO: 5512 - protein, 266 aa, Unknown
  Obtained from environmental sample
  misc_feature (1)..(266): Xaa is any amino acid
MVRFNDAEYTFKTCVNGMLTISMMIEEMLNIKDMKILQANTDGITIMFPRKDEERVQQIIKENEKITGLNVEQAEYSIMVINDVNNYMSIDVNGDIKQKGCFLTRDSMIKGGFYEKNPSQNIVAIALNKYFSENIPVEDTINECNDIHEFMIGVKRTKTFKWLVNTVKDSGVISSELMVDRVIRYYVGGTSSISKMWLKGEVDKDGEKDSSGFTLLSAHYPITLAQIISNNEIVSSKGVRKGQNIFPNLNREYYINECKKIIENIC

SEQ ID NO: 5513 - DNA, 750 bp, Unknown
  Obtained from environmental sample
  misc_feature (1)..(750): n is a, c, g, or t
atgataaatgtaaaaaagtccaggaagaaaatagacaagaaacttggggaacctattgataacaatgtttggtttcacgatatcgaagtctttcctaattatagtctgtttgtctttgagaataaagataccttggatcaggtgactatagaaattcatgataaagatactggggatttagctcagtttttaagtttaaaagtgggtaataaagatataggattgataggttataattgcctaggatacgatggacaagttattgaatacattgtaaagaatccaggatgcactgtagctcaaattaaagagtttaatgacttagtcattaactctacctttcccccgtacagggttgagaagttgagttacaactacctagatctaatgttgattaataactatggaattcatagtgctaaaagtacaagtcttaagcagttgtcctttttctacagggttaaatcagttatggatagcccttgtgactttcagaaaccagttaaagagagtgataaagaaagtattattaaatattgtataaaggacgttagtgtaacaagggagacttatgagttaactattcctttgattaatcttagagttaatctgggaaaagtagagggactagaattcataaacgatcctgaacctaaactagctaaaaaatacttctggaatgtaattagtaaatttacaggagagagtattcaagttattcaggaacgaagacctacagagatacgataa

SEQ ID NO: 5514 - protein, 249 aa, Unknown
  Obtained from environmental sample
  misc_feature (1)..(249): Xaa is any amino acid
MINVKKSRKKIDKKLGEPIDNNVWFHDIEVFPNYSLFVFENKDTLDQVTIEIHDKDTGDLAQFLSLKVGNKDIGLIGYNCLGYDGQVIEYIVKNPGCTVAQIKEFNDLVINSTFPPYRVEKLSYNYLDLMLINNYGIHSAKSTSLKQLSFFYRVKSVMDSPCDFQKPVKESDKESIIKYCIKDVSVTRETYELTIPLINLRVNLGKVEGLEFINDPEPKLAKKYFWNVISKFTGESIQVIQERRPTEIR

SEQ ID NO: 5515 - DNA, 744 bp, Unknown
  Obtained from environmental sample
  misc_feature (1)..(744): n is a, c, g, or t
atgatcaacttcgtttatttaaaaacagcaaccaatcaacgatcacgaataatttgttcattggcaattcaaccttgcactacatctatggataattatgaaatagcagaccagttttcattgcttgcgaagttgatggatatacacggagagtactcgtttaaatcagaaacctatgcttccgctgcatttgctattgaaaagcttcctcagcagcttgcattgctgccgcatgaaaaaattttccaggtaaaaggtattggcgaaagtgtaggcagaaagattatagagattttagaaaagggtgaactgcccgttttaagcgaatacattgccaacacaccttccggtgttttacaaatgatgaatataaaagggcttggtccaaaaaagatcaacctgttatggaaagaactaaagattgacaacattgaagacttgcaaaaagcttgtgaacaaaacaggatcgcttccaaaaaaggctttggtgaaaaaacacagcagaacattttagactccatacaatttcaaaagcaaagtgccggcaaatacttgtataaaaaaattgaagtctttgcggaagcatttacatctaaactgaaagagaaatttccaggcaataaaacagaaattacaggtgagttcagaaggcagctcgagatcgttgaatccttagagtgggtaaccactgtttcaagcgatgacgtaaaaaattatttatacagcgaccagatacattcttga

SEQ ID NO: 5516 - protein, 247 aa, Unknown
  Obtained from environmental sample
  misc_feature (1)..(247): Xaa is any amino acid
MINFVYLKTATNQRSRIICSLAIQPCTTSMDNYEIADQFSLLAKLMDIHGEYSFKSETYASAAFAIEKLPQQLALLPHEKIFQVKGIGESVGRKIIEILEKGELPVLSEYIANTPSGVLQMMNIKGLGPKKINLLWKELKIDNIEDLQKACEQNRIASKKGFGEKTQQNILDSIQFQKQSAGKYLYKKIEVFAEAFTSKLKEKFPGNKTEITGEFRRQLEIVESLEWVTTVSSDDVKNYLYSDQIHS

SEQ ID NO: 5517 - DNA, 648 bp, Unknown
  Obtained from environmental sample
  misc_feature (1)..(648): n is a, c, g, or t
ttggagaaagcaaatcccaaccagatcaaagttgaattgctgaaaaccatcgagaccgctgtggtcatctctggcgaccgcaacgactccacggatgtcaagaagtatacgaacgaaacttatcacaaggatagtattcgccgcttcaaacttcccttcgatgcggaagaaactgaaggcgatggaactgtcaacgggaaagtgggaatcatcgtcgtcaacaacatgctgctgacaggcttcgatgccccgattgagcaggtgctgtatctcgaccgtgtcatcaccgaccataacctggtgcaagccatcgtgcgcgtcaaccgcgtcagcaacgacgataaagacaaaggctttgtggtcgattacgtgggcattggcaacgacctgaaaaaggcgcttgattcctacgccgaacgcgaacaacaggaaattattgatgccatgaacagcaagagtgaggacatcaacatccttgtccaggctcaccgcgagatcatggaattcctgaaacagtacggattgaacgacatcaccgactcagacgccttctttgacctgttctacgaaagaagagattcgcttcgaatatatcctgctcttccaaaccctgacccgggccttaaacaacatcatgccggcaaatga

SEQ ID NO: 5518 - protein, 215 aa, Unknown
  Obtained from environmental sample
  misc_feature (1)..(215): Xaa is any amino acid
MEKANPNQIKVELLKTIETAVVISGDRNDSTDVKKYTNETYHKDSIRRFKLPFDAEETEGDGTVNGKVGIIVVNNMLLTGFDAPIEQVLYLDRVITDHNLVQAIVRVNRVSNDDKDKGFVVDYVGIGNDLKKALDSYAEREQQEIIDAMNSKSEDINILVQAHREIMEFLKQYGLNDITDSDAFFDLFYERRDSLRIYPALPNPDPGLKQHHAGK

SEQ ID NO: 5519 - DNA, 516 bp, Unknown
  Obtained from environmental sample
  misc_feature (1)..(516): n is a, c, g, or t
atgcaaagtgttgatagcaacgaggatccttttataaaaattgcatcgctgataggtggagatgaatatcaccaagttgctaaagcattattaaagactgaagattcaactgacgaggaaatagctctagctaccggtcttcgaataaatattatacgaaaggttctgtacgatttatttggaaaagctttgataacaggcattagagtcaaagatgaaaaaaagggttggtttgtctacaggtggagagcaaaaagagaccatgtagataattttattgataaccaaaaaaagaaaatcttggaaaggttacaaaatagactcgaatatgaagaatcatccgaattttatcactgtggtaattctgcctgtgacagaattaaatttgattacgcgatagagttgttcttcaaatgtccaaattgcaaagaacctctcaatatggtagataatagcaaactaaaggatgcactccgatacaaaatagagcagttaagcacggactctgtaagataa

SEQ ID NO: 5520 - protein, 171 aa, Unknown
  Obtained from environmental sample
  DOMAIN (11)...(170): TFIIE alpha subunit
  misc_feature (1)..(171): Xaa is any amino acid
MQSVDSNEDPFIKIASLIGGDEYHQVAKALLKTEDSTDEEIALATGLRINIIRKVLYDLFGKALITGIRVKDEKKGWFVYRWRAKRDHVDNFIDNQKKKILERLQNRLEYEESSEFYHCGNSACDRIKFDYAIELFFKCPNCKEPLNMVDNSKLKDALRYKIEQLSTDSVR

SEQ ID NO: 5521 - DNA, 516 bp, Unknown; identical to SEQ ID NO: 5519
  Obtained from environmental sample
  misc_feature (1)..(516): n is a, c, g, or t

SEQ ID NO: 5522 - protein, 171 aa, Unknown; identical to SEQ ID NO: 5520
  Obtained from environmental sample
  DOMAIN (11)...(170): TFIIE alpha subunit
  misc_feature (1)..(171): Xaa is any amino acid

SEQ ID NO: 5523 - DNA, 588 bp, Unknown
  Obtained from environmental sample
  misc_feature (1)..(588): n is a, c, g, or t
atgcttaaagatacaatgataaattgtatgcacaacaacctcggctgtatagatccgaaacagacccacacaccgcgtaactttgtaacagaatattatacaaaaaccattgaaatatacaagtgttgttctgagcaaagtcaacccaggacaacaccacctgtcgagttggtgtatccaatcgaatttaataaaccatccaagcgatctttcggagaatcatgtgtgaagtttctcgaccagtcaagtgatctgtacaagtttctaattgatctgcgtactaatttgttgaatgctggttataagatgactgatattgtaggattacatgttaagattgtcgaattagaaactgaaacactcgatacatttctgtcacgagtatcgaaaatacaaggcagtatgataaatgtaactgatttgacaaattactatgtacttaataattctgttgtaattagagtcggatttttagaaggttatggtaaggaaacatgtatcattattgctacagttgaatcacacaaaaaacatgacgcattcatgtatattagtaattatattgaaacgcgtgccatgctaaagtag

SEQ ID NO: 5524 - protein, 195 aa, Unknown
  Obtained from environmental sample
  misc_feature (1)..(195): Xaa is any amino acid
MLKDTMINCMHNNLGCIDPKQTHTPRNFVTEYYTKTIEIYKCCSEQSQPRTTPPVELVYPIEFNKPSKRSFGESCVKFLDQSSDLYKFLIDLRTNLLNAGYKMTDIVGLHVKIVELETETLDTFLSRVSKIQGSMINVTDLTNYYVLNNSVVIRVGFLEGYGKETCIIIATVESHKKHDAFMYISNYIETRAMLK

SEQ ID NO: 5525 - DNA, 672 bp, Unknown
  Obtained from environmental sample
  misc_feature (1)..(672): n is a, c, g, or t
atgtctcatattgattttaacatgggtgtttattatcctcagggaggtatttataaagttgtcgaggctctggagagaatctgtctggaaaatggcgttagtattaaaacaaattcagaagttaaaagtataaaaattaatagaggactagctgttgcggtagttgttaatcaaaaaaaaatagaatctgatatagttatatcaaatgctgattatccgtatactgaagttaaattattacgaagacaacaccaaacttactctgaaaattattggaaaaaaagaactcttgcaccttcagcctttctcatttatttaggaataaagggcaaggttaaaaatctatctcaccatacactgtcttttgcaaataattgggaagcacattttgaagaaattttcaagaaacccctatggcctcaaaaaccttcttactacatatgctgtccatcaaaaaccgatcagacagttgcgccaaaagattgcgagaatttatttatactgattcctgtagcttcagacttaaaggatacagatgagatacgtaatcagtatgccaacaaaatactagaagatgtagaaaaccttataggagaaagaataaaagatcgcataattgtaaagcgtatattttctcaaaaagattttaaaacagtttataatttcatataa

SEQ ID NO: 5526 - protein, 223 aa, Unknown
  Obtained from environmental sample
  misc_feature (1)..(223): Xaa is any amino acid
MSHIDFNMGVYYPQGGIYKVVEALERICLENGVSIKTNSEVKSIKINRGLAVAVVVNQKKIESDIVISNADYPYTEVKLLRRQHQTYSENYWKKRTLAPSAFLIYLGIKGKVKNLSHHTLSFANNWEAHFEEIFKKPLWPQKPSYYICCPSKTDQTVAPKDCENLFILIPVASDLKDTDEIRNQYANKILEDVENLIGERIKDRIIVKRIFSQKDFKTVYNFI

SEQ ID NO: 5527 - DNA, 717 bp, Unknown
  Obtained from environmental sample
  misc_feature (1)..(717): n is a, c, g, or t
ttgccactatactattgggaaacaatcaaaccactaaaacgttttggaaccgaagcaaccgagcccggtgttaaccaaaatatttcatttaaaagcaaacgtttcagagtagaaacggagaaaacggattcaatttatttggatgaggcagagttaaaagagatctacaaactggatttatcaaatgaaccgaagttagatcgatcaagggacttattcttattaggcgcttggacaggattgaggttctcggacttctcaaacattaaagcggaaaacattaaaggtaattttatagaaatcacgccaaagaaaacaggtgtaccggttgttattccaatacacgaaacagttaaagcaattatttcaaagtataatggaaagaatgaaaactcgttaccaaaagctatttcaaacgtggcaataaacgaacatatcaaagagattgcagttaaaataaaggcgttccaagtgaaaacatcaacaggaattacaaaaggtggtgtaaatgtaactcgcaacgttagcaaattcgcattaattacgagccataccgcaagacgttcattcgctacaaatctatttttggacggtgtttcacctattactattatgggaataaccggccataagacagaaaagtcattcttaaaatatatcaaaatcaccccaagcgagaacgctaaaatattgcaattgcttttccatattcattag

SEQ ID NO: 5528 - protein, 238 aa, Unknown
  Obtained from environmental sample
  DOMAIN (47)...(229): Phage integrase family
  misc_feature (1)..(238): Xaa is any amino acid
MPLYYWETIKPLKRFGTEATEPGVNQNISFKSKRFRVETEKTDSIYLDEAELKEIYKLDLSNEPKLDRSRDLFLLGAWTGLRFSDFSNIKAENIKGNFIEITPKKTGVPVVIPIHETVKAIISKYNGKNENSLPKAISNVAINEHIKEIAVKIKAFQVKTSTGITKGGVNVTRNVSKFALITSHTARRSFATNLFLDGVSPITIMGITGHKTEKSFLKYIKITPSENAKILQLLFHIH

SEQ ID NO: 5529 - DNA, 378 bp, Unknown
  Obtained from environmental sample
  misc_feature (1)..(378): n is a, c, g, or t
atgatgaatatttttctgcgtgtattgtttgttatcaccattttgacagtggtgttgagtagctgtgatcgcgattaccttccaaaaccacttggttacaatcggcttgtattgccagaacctgcataccaaactttacccgacaccttgccgtatacattcgagtattcaaaacatgccaaattgttaagcgatacatcaagaataagtgagcggtattggattgagatttattaccctgctctcaaatcaaatattcacatcacctataaaaaagttaacaaaaacgataaattgttgaaagagtttttaaacgatgcatacacacttgtagccaagcaccaaaataaaagcatatgcaattctgtgatccactag

SEQ ID NO: 5530 - protein, 125 aa, Unknown
  Obtained from environmental sample
  misc_feature (1)..(125): Xaa is any amino acid
MMNIFLRVLFVITILTVVLSSCDRDYLPKPLGYNRLVLPEPAYQTLPDTLPYTFEYSKHAKLLSDTSRISERYWIEIYYPALKSNIHITYKKVNKNDKLLKEFLNDAYTLVAKHQNKSICNSVIH

SEQ ID NO: 5531 - DNA, 903 bp, Unknown
  Obtained from environmental sample
  misc_feature (1)..(903): n is a, c, g, or t
atgtatgatgagccctttggtgataattcaggcatccccacatacctggtttccagaatggctaaggagcatgtcaaagtttccttatcggcagatggtggtgacgaagtgtttggaggttatttgaaatattcacgcaaccacaattattaccataagttggcaaaaattcctgttccgatcaggagatcagcttcaggtttactgactgcattaggacacgaccgcacggtaaagattttcaaatcacttccatggacatccacgattggtaatctggagtggcgtgtgtcaaaaattctgaacgccatgaaggcaaaagatccgattgaattccaggatctgatctccagttatatctctgataaaacccttaacgaattagtaaactctaaatcgtcgccaaacggcaaagttgaaaaatggcctataaaagacaacctggtgtattccttactgggagccattgatataacaacttacctggaaggggacatccttgccaaagtagacagggctaccatgcagcatgcactcgaaggacgtgagcctttcctggaccaacacatcattgagtttgccatgcaattacctgacaatttcaaattgcgcaacggagaaaccaaatggatcctcaagcagatactcgacaaatatgttccgagggaattaatggaaagaccgaaacaaggatttgcggtcccgacaaaaaaatggctgcatactatcctgtttgatgaactggataatgtctaccaggataaaaattttgttgactgttttcaatttaatgtctcaaagttaaaagcgattattcagaattttaagaacaatgcaagtaagcaggagattcctacctcgtatggttctgtattgttgtatggtggaataacgcggtgttga

SEQ ID NO: 5532 - protein, 300 aa, Unknown
  Obtained from environmental sample
  DOMAIN (1)...(229): Asparagine synthase
  misc_feature (1)..(300): Xaa is any amino acid
MYDEPFGDNSGIPTYLVSRMAKEHVKVSLSADGGDEVFGGYLKYSRNHNYYHKLAKIPVPIRRSASGLLTALGHDRTVKIFKSLPWTSTIGNLEWRVSKILNAMKAKDPIEFQDLISSYISDKTLNELVNSKSSPNGKVEKWPIKDNLVYSLLGAIDITTYLEGDILAKVDRATMQHALEGREPFLDQHIIEFAMQLPDNFKLRNGETKWILKQILDKYVPRELMERPKQGFAVPTKKWLHTILFDELDNVYQDKNFVDCFQFNVSKLKAIIQNFKNNASKQEIPTSYGSVLLYGGITRC

SEQ ID NO: 5533 - DNA, 687 bp, Unknown
  Obtained from environmental sample
  misc_feature (1)..(687): n is a, c, g, or t
ttgacaaaacattcgaggtgtatgcaaaagcgtaatatgctggtgacaggcgcgtctggttttgtcggcacacatgccataccttatttcaatagaaaatataacactaccatcatttcatttaaagataaaaaggtcagtgaagttgatctgaattcttaccaggtgattttgcatctcgcaggaattgcacatcagacaaaagagttgccggacagttattatcatgatgtcaactatacgcttacagtggatctcgctaaaaaagcaagcaaggagggcgtatcccattttatttttttgagttccgtgaaagtatacggagagcatattgatcacccggtaaatgaacaatcaccatgtcatccgggagatgcatatgcaaagagcaaattcgaggcagaagctgaaatcctgaaactcaattcaacgtcattcactgtttctgtaataagaccggctttggtatatggaaaaaacgtgaagggcaatcttgataatctgatttcattgataaagaagtatcctgtgatacccctgggaaatattcacaataaaagaagcctggtttttgtgggcaacctattggctttaattgataccattgtggagaagaagcaaccgggtatatttatcgcgtgcgatatcaatgacatttcgacgagcagcttgtgcttcaattcttga

SEQ ID NO: 5534 - protein, 228 aa, Unknown
  Obtained from environmental sample
  DOMAIN (13)...(228): NAD dependent epimerase/dehydratase family
  misc_feature (1)..(228): Xaa is any amino acid
MTKHSRCMQKRNMLVTGASGFVGTHAIPYFNRKYNTTIISFKDKKVSEVDLNSYQVILHLAGIAHQTKELPDSYYHDVNYTLTVDLAKKASKEGVSHFIFLSSVKVYGEHIDHPVNEQSPCHPGDAYAKSKFEAEAEILKLNSTSFTVSVIRPALVYGKNVKGNLDNLISLIKKYPVIPLGNIHNKRSLVFVGNLLALIDTIVEKKQPGIFIACDINDISTSSLCFNS

SEQ ID NO: 5535 - DNA, 645 bp, Unknown
  Obtained from environmental sample
  misc_feature (1)..(645): n is a, c, g, or t
atggatgcgaagcttatgttatttccacagtcggaagtgtatggaactcatgcaaagaaaaaaatgtcagaggatattaatcctatcgtttcatcaagcgtaacgccgcgacttgaatatggcataggtaagcttgcgggcgaaattatgcttaagaatataagtgaagcaacaggacttaagtataattgcgtacggccgttcaatattattggtccaggtcaaaatgacaaaggaggatttgttattccacgtttcgttaggcttgcacttggaagcgaaccacttacagtatatggtgatggtagtcaagttcgaacatttacacatatcgaagatttcgtagaggcaattatagctattactgaatcggatgtttctggagaggtatttaatgttggaaatccggatgggacgcttacaattctcgagcttgcaaaacagatcaaggaaactcttaatagtgatagcgaaatcatacttattgatccggagaaacttcatggtcgtccttttcatgacgcttgggacaaaattccagatatatcaaaactgactaagagtgtaggttggaaaccgaaatggatgatggataaaataatggctgaaattggtgaattgcgcgaacgttatctcgtaaactaa

SEQ ID NO: 5536 - protein, 214 aa, Unknown
  Obtained from environmental sample
  DOMAIN (3)...(212): NAD dependent epimerase/dehydratase family
  misc_feature (1)..(214): Xaa is any amino acid
MDAKLMLFPQSEVYGTHAKKKMSEDINPIVSSSVTPRLEYGIGKLAGEIMLKNISEATGLKYNCVRPFNIIGPGQNDKGGFVIPRFVRLALGSEPLTVYGDGSQVRTFTHIEDFVEAIIAITESDVSGEVFNVGNPDGTLTILELAKQIKETLNSDSEIILIDPEKLHGRPFHDAWDKIPDISKLTKSVGWKPKWMMDKIMAEIGELRERYLVN

SEQ ID NO: 5537 - DNA, 444 bp, Unknown
  Obtained from environmental sample
  misc_feature (1)..(444): n is a, c, g, or t
atgggcggtccagactttaggaatgaatctgtgttaccacataggcttgcatcaggaattatcgagatgccgatgacgattctctataccgggttattgaaaaaagaaggtgtattcggaaaattctacgcgcagttaccaaaaggaatatttaaaagaacaataaaccttttatttcggcaaaaatggctgagaatttttcctacaacaacatatcgtgactttaaaaatattctcaatgctgcacgagtaaataatcttccggcccttgtatttatggttcattcaaccgaacttcactttggtacaagttcatacacgaaaaacgaagcggatgttgaatttatgtacaaaaagcttgaggaacttttttccttaatgaaaaaagaaggacttacaggtataacgctttctgattttgcgaaaagctggatgatatactaa

SEQ ID NO: 5538 - protein, 147 aa, Unknown
  Obtained from environmental sample
  misc_feature (1)..(147): Xaa is any amino acid
MGGPDFRNESVLPHRLASGIIEMPMTILYTGLLKKEGVFGKFYAQLPKGIFKRTINLLFRQKWLRIFPTTTYRDFKNILNAARVNNLPALVFMVHSTELHFGTSSYTKNEADVEFMYKKLEELFSLMKKEGLTGITLSDFAKSWMIY

SEQ ID NO: 5539 - DNA, 522 bp, Unknown
  Obtained from environmental sample
  misc_feature (1)..(522): n is a, c, g, or t
atgggaattggcgttgaatctgattctacttttgccggtattattaataatgaagagaatgttaatgttttaaatttatctatgatcggatattcgaataaagattatttaaatataataaagaaaataatagttgaggataggaataaactaaatatatctaaggtatcgctgttctggtgtttaaatgatgtttatgattattatcccggtgataccacacctgaggttaagcctgaaggaattttaggagcagccttaacttttttcaaacggaactttaaattgttttactttctaaaggatttttttaccgacaggcccaaatcatattatttgtacgacgtgaagttgtatagtgcagctaacgaattttttataaagtcattaaaaactctaacctcaattgctgaaatattaaaggaaaagcaaataccatttgagatatttctaatgccatacgaataccagttaagagctgaagagaaattcagaagtaaaccctcaaaaactattagctga

SEQ ID NO: 5540 - protein, 173 aa, Unknown
  Obtained from environmental sample
  misc_feature (1)..(173): Xaa is any amino acid
MGIGVESDSTFAGIINNEENVNVLNLSMIGYSNKDYLNIIKKIIVEDRNKLNISKVSLFWCLNDVYDYYPGDTTPEVKPEGILGAALTFFKRNFKLFYFLKDFFTDRPKSYYLYDVKLYSAANEFFIKSLKTLTSIAEILKEKQIPFEIFLMPYEYQLRAEEKFRSKPSKTIS

SEQ ID NO: 5541 - DNA, 351 bp, Unknown
  Obtained from environmental sample
  misc_feature (1)..(351): n is a, c, g, or t
atgcatatgctaaagatttatttcaaaccaaattgttcgacctgccgcacggcgctctcgctgataaaggacaataccgatgaagattatgaactcatcgaatatctcgtggacacaccatccgaaaaggaaatacgcgagatccttaaaatgcttaacatgaaggccgaggatctggttaggaaaaaagaacccttattcaaggaaaaatttgacggcaaaaagatcagcaatgcgcaatggataaagattctgcatgagaatccggtcctgatcgaaagacccatcgttattaaagacgggaaagcaataatcggaagacccgttgagaaaattttgaatatcctgtaa

SEQ ID NO: 5542 - protein, 116 aa, Unknown; identical to SEQ ID NO: 5310
  Obtained from environmental sample
  DOMAIN (7)...(116): ArsC family
  misc_feature (1)..(116): Xaa is any amino acid

SEQ ID NO: 5543 - DNA, 702 bp, Unknown
  Obtained from environmental sample
  misc_feature (1)..(702): n is a, c, g, or t
ttgcttcttgcaaccggcccttataatttaggagaaatatgccgggcacgaagctgctgcttacttgccctgcaggaaatgattgataaaggtttgttgcaggcagaagacgtagaatatgatcagcaacataccgttgcaaaaatgaaggctattgaaataaaaactttgcgactgttatcagatcctgaagtttttattgaagcagaaaaatatttgcagcaaaaaaagccgctgattgaaagcgcaaaggatgaagtagtaaaagccagggtgttgcttgatggcaaaaattactttgtaataatacgcagaaacgaggaacgaacttttgacaccagtagtaattatgaagacagggaacatcctctttgtttaccaaagctgattgtttttttacacttgttttataaacacggagcaaattattttgattcgatccgtaactgggataaggaaaagaataaattacttgaggcatatggttattcattaagtgatgatataaaaggaaaattcgagttcaattataaagatggcaaaccttacttacgggtgttggataattccatcaaacgcattgtagttcccgtttcgacttcttataaaaaaatagaggagccggttgaggttttagaaactgaggtcttgcaaaaggacccagttgtgattaatagcaggcttggtgtgtttttaatttga

SEQ ID NO: 5544 - protein, 233 aa, Unknown
  Obtained from environmental sample
  misc_feature (1)..(233): Xaa is any amino acid
MLLATGPYNLGEICRARSCCLLALQEMIDKGLLQAEDVEYDQQHTVAKMKAIEIKTLRLLSDPEVFIEAEKYLQQKKPLIESAKDEVVKARVLLDGKNYFVIIRRNEERTFDTSSNYEDREHPLCLPKLIVFLHLFYKHGANYFDSIRNWDKEKNKLLEAYGYSLSDDIKGKFEFNYKDGKPYLRVLDNSIKRIVVPVSTSYKKIEEPVEVLETEVLQKDPVVINSRLGVFLI

SEQ ID NO: 5545 - DNA, 393 bp, Unknown
  Obtained from environmental sample
  misc_feature (1)..(393): n is a, c, g, or t
ttgcagctaattacaattcttccccttatgaaaatcaatactgccgaattcatcatcagcaattccgatgtcagcaaatgccctaacgagccgctgccggagtatgcctttatcggcaggagtaatgtggggaagtcgtcactcatcaacatgctgacgggccgcaacagcctcgccaagacttccggcaggccgggcaagacccagctcatcaaccattttaagatcaatgagaactggtacctggtcgatcttcccggctacggctatgcccgcgtatcgaaatcgaccaaagagaccttccagaaattcatcactgattattttgagcgccgtgagcagctcgtatgcgccttcgtattaattgatatccgcctggaagcccagaagaag

SEQ ID NO: 5546 - protein, 131 aa, Unknown
  Obtained from environmental sample
  misc_feature (1)..(131): Xaa is any amino acid
MQLITILPLMKINTAEFIISNSDVSKCPNEPLPEYAFIGRSNVGKSSLINMLTGRNSLAKTSGRPGKTQLINHFKINENWYLVDLPGYGYARVSKSTKETFQKFITDYFERREQLVCAFVLIDIRLEAQKK

SEQ ID NO: 5547 - DNA, 657 bp, Unknown
  Obtained from environmental sample
  misc_feature (1)..(657): n is a, c, g, or t
atgattgatgaaaaaaagcgggttgacctgatggctattccggcttctaacttccaggtgacaacactgattgactttaattctcccatccttggttcccaacatgcctcattaaaaacaatcaatgattttaaaaaggagattgcaccctgccgtacattttgttttttgcatgaactggaaaccttgctggaacataatttaataaaaggtggcgacataaataatgccatcgtagtggtggataaacccatcagcgataaagaaaaaaacaggctggcgaaggctttcaacagggaacacattgaagtaaatgaaggctaccttgataacctggaactgcgtttccccaatgaacccgcccgtcataaattgctggatgttgtcggcgacctggcattgattggttacccgttaaaagcacatatcatcgccaaccgccccggccatagcagcaacgtggagttcgccaaaaaaattaaaaaatacataaaaaagaaaaagactaccaaatgtgcgccgctttataatccgcaggatacgccggtttacaaccagcaatacattgagcaaaagcttccgcaccgctatccttttttatttgttgataacataattgagcttgcagataatcatatattcggggtaaaaatgtaa

SEQ ID NO: 5548 - protein, 218 aa, Unknown
  Obtained from environmental sample
  DOMAIN (2)...(165): UDP-3-O-acyl N-acetylglycosamine deacetylase
  misc_feature (1)..(218): Xaa is any amino acid
MIDEKKRVDLMAIPASNFQVTTLIDFNSPILGSQHASLKTINDFKKEIAPCRTFCFLHELETLLEHNLIKGGDINNAIVVVDKPISDKEKNRLAKAFNREHIEVNEGYLDNLELRFPNEPARHKLLDVVGDLALIGYPLKAHIIANRPGHSSNVEFAKKIKKYIKKKKTTKCAPLYNPQDTPVYNQQYIEQKLPHRYPFLFVDNIIELADNHIFGVKM

SEQ ID NO: 5549 - DNA, 339 bp, Unknown
  Obtained from environmental sample
  misc_feature (1)..(339): n is a, c, g, or t
atggcatacgattatgaagaaaaaaagcgaaaacaaatcagctcaatgaagtccattatggactatggtatggggggattgtttttgttactcgggttgttttttttgtttcataattatttgaatatcgatttttcacgcttttcaaaaacgccgctgattgataatttgtctggtggtataagtaacgtttatggtgcgtggcggatttacagaggttataaaaaaaattttttaaatgaacgtaaaggctctgcttgcatttgtcttttctattacaagattggcatctatatgctgtttgtagcaagtatcataagctgcgccatgcaggcgtga

SEQ ID NO: 5550 - protein, 112 aa, Unknown
  Obtained from environmental sample
  misc_feature (1)..(112): Xaa is any amino acid
MAYDYEEKKRKQISSMKSIMDYGMGGLFLLLGLFFLFHNYLNIDFSRFSKTPLIDNLSGGISNVYGAWRIYRGYKKNFLNERKGSACICLFYYKIGIYMLFVASIISCAMQA

SEQ ID NO: 5551 - DNA, 453 bp, Unknown
  Obtained from environmental sample
  misc_feature (1)..(453): n is a, c, g, or t
ttgttaaactataaattttctaaatcgggaaatcggggagcacattgtctccccgatttctttttaagcaggtccattctgatatggatcgtattgatcagtttcacatttggttgcaagactaaagttgccccaccatacgagggtgtttcaaaaaaattttcaactgaggaattgcaacgtcgcacatttaattatttctgggaattagctgataaaaaaaattaccagatccctgaccgttaccctacacttacgttttcttccattgctgcaacagggtttggcctgagtgcctatattgtaggggccgagaaaaaatatatcacgcgtgatcaagcggcagaccggaccttaaaaactttaaaggtgctctggaatttaccgcaaggaccagagcaggatggcaactcaggatataaggtttcttttatcantccttacactggataa

SEQ ID NO: 5552 - protein, 150 aa, Unknown
  Obtained from environmental sample
  misc_feature (1)..(150): Xaa is any amino acid
MLNYKFSKSGNRGAHCLPDFFLSRSILIWIVLISFTFGCKTKVAPPYEGVSKKFSTEELQRRTFNYFWELADKKNYQIPDRYPTLTFSSIAATGFGLSAYIVGAEKKYITRDQAADRTLKTLKVLWNLPQGPEQDGNSGYKVSFIXPYTG

SEQ ID NO: 5553 - DNA, 453 bp, Unknown
  Obtained from environmental sample
  misc_feature (1)..(453): n is a, c, g, or t
gtgtatattccgaaagaagatgaaaagactggaatacgttatagcatacaagtgaaacagtatgcaattgataaagaagaatatgaatttttagtgcagatgaaaaaaaatactgagtcacttggttctatcttcgatccgcaaccctccgtaataagaggtaaccttcattccctctccaacgttgatgaattagttattggttatattggcgtaacaactatgaaaaagcaaagggttttcatttcatcaactgatttaaaaaataaaggctttcaaatgattgaccattgcagttcagactcaatagaggatggaaatattccgcctggttttttgccttacggcacctttcgaggtatgggaggcagggtaggcttgttagtttcagaaacaaaatgtgtggattgcagagccaggggaggcattaatattaaaccagatttttggtaa

SEQ ID NO: 5554 - protein, 150 aa, Unknown
  Obtained from environmental sample
  misc_feature (1)..(150): Xaa is any amino acid
MYIPKEDEKTGIRYSIQVKQYAIDKEEYEFLVQMKKNTESLGSIFDPQPSVIRGNLHSLSNVDELVIGYIGVTTMKKQRVFISSTDLKNKGFQMIDHCSSDSIEDGNIPPGFLPYGTFRGMGGRVGLLVSETKCVDCRARGGINIKPDFW

SEQ ID NO: 5555 - DNA, 393 bp, Unknown
  Obtained from environmental sample
  misc_feature (1)..(393): n is a, c, g, or t
ttgttgaaaaacacctttcataagcaagagcgtttaacgggtaaaaagtccattgacttgttatttgctaaaggaaagggtataagtaacggaccattaaaactcatcatcaaggcatctttaagtacgcagatctatccggccaaggccatgttcgttgtaccgaagaaaaaattcaaaagggcgcacgatcgcaatcttttaaagcgccgcatgcgcgaagcctatcgtatcaataaaaataccttttatactatgctcaatgataagggactcaaagtgagttgtgccttgctgtatatgagcggtaaaacagatacgtatgcggcaattgaaaaatcgctcattgatcttttgacgcaaagcgttaataaattaaaatcctcttcgtaa

SEQ ID NO: 5556 - protein, 130 aa, Unknown
  Obtained from environmental sample
  DOMAIN (6)...(123): Ribonuclease P
  misc_feature (1)..(130): Xaa is any amino acid
MLKNTFHKQERLTGKKSIDLLFAKGKGISNGPLKLIIKASLSTQIYPAKAMFVVPKKKFKRAHDRNLLKRRMREAYRINKNTFYTMLNDKGLKVSCALLYMSGKTDTYAAIEKSLIDLLTQSVNKLKSSS

SEQ ID NO: 5557 - DNA, 306 bp, Unknown; identical to SEQ ID NO: 1333
  Obtained from environmental sample
  misc_feature (1)..(306): n is a, c, g, or t

SEQ ID NO: 5558 - protein, 101 aa, Unknown; identical to SEQ ID NO: 1334
  Obtained from environmental sample
  misc_feature (1)..(101): Xaa is any amino acid

SEQ ID NO: 5559 - DNA, 432 bp, Unknown
  Obtained from environmental sample
  misc_feature (1)..(432): n is a, c, g, or t
atgtcggagccaaaaacaaaaattacagataaaaaccccatagattttctaagaaacgtagaacctgagcagaaaagaaaagatagcttcgtacttcttaagatatttgaaaaaatcacccaagagaaacctatgatgtggggggagagcatgataggatttgggaaatatcattataaatctgagaaaagcagtcaagaaggagattggtttaaggtgggcttctcaccaagaaagcagaatctaagtctttatatcatgtatggaagtaaaaataatccagattttcaaaaattaggtaaatataaggcgagcctcggctgtctttacatcaataagctatccgacataaaccaaaaaatattaggaaaattaatagagaagtcttataaatttatgaaagaagctacgtaccaagattcgacatcgtaa

SEQ ID NO: 5560 - protein, 143 aa, Unknown
  Obtained from environmental sample
  misc_feature (1)..(143): Xaa is any amino acid
MSEPKTKITDKNPIDFLRNVEPEQKRKDSFVLLKIFEKITQEKPMMWGESMIGFGKYHYKSEKSSQEGDWFKVGFSPRKQNLSLYIMYGSKNNPDFQKLGKYKASLGCLYINKLSDINQKILGKLIEKSYKFMKEATYQDSTS

SEQ ID NO: 5561 - DNA, 489 bp, Unknown
  Obtained from environmental sample
  misc_feature (1)..(489): n is a, c, g, or t
atgttctgttgcttcacaggcttggcatatgctgatgtagaaaaattaaagaggtcggaaatatctgtgggaattgataatgagctttggatttttacagatcgtctcaagactgatatcaaatcccgaatccctttacttcctgtttcattggaaataataaagagatatcagaatgatccggcctgcattaatgctaacaaagttttgccggttttaagcaatcagaaatacaatgcttacttaaaagaggtagctacaatttgcggcatcactaagaacctgacaacccatacggcgaggcatacatttggaacaacggtaacacttagcaacggcgtgcctattgagtctgtaagtaaaatgttgggccataaaaagatctcaactactcagcattatgcacgggttttggatattaaggttagcgaggacatgcagaggttaaaggataggttgaattcaccatcacatatttcagcaaaataa

SEQ ID NO: 5562 - protein, 162 aa, Unknown
  Obtained from environmental sample
  DOMAIN (8)...(144): Phage integrase family
  misc_feature (1)..(162): Xaa is any amino acid
MFCCFTGLAYADVEKLKRSEISVGIDNELWIFTDRLKTDIKSRIPLLPVSLEIIKRYQNDPACINANKVLPVLSNQKYNAYLKEVATICGITKNLTTHTARHTFGTTVTLSNGVPIESVSKMLGHKKISTTQHYARVLDIKVSEDMQRLKDRLNSPSHISAK

SEQ ID NO: 5563 - DNA, 462 bp, Unknown
  Obtained from environmental sample
  misc_feature (1)..(462): n is a, c, g, or t
atggctgatatcccgacgtttgaaagaatacggggtaatatcatcaatcaaaatccacaaaccgttgagtatgcgtctcaactaaaactggcagatgccgagaactgtattatcactaaatattcctctggaagcaaaccagtttacagttggcaggctctgatgtttacaactgaggattttgaagctgcttataaaaaatataaatgggtttttacccaactaagaggaatgaatatccattatgtaaaagaccagtatacattgaggggaaccctggaggaaccggatgagagtcgaaagtttaccaatagcatactgacaccagttgctcccccggatccactaaaaaaattaaaaattgacgttgccatcgaattcgaatttcctgaatggaaagtaaaactattagtatacgagaaagaaagagatgatgatgaacgaggggatatagaagaatag

SEQ ID NO: 5564 - protein, 153 aa, Unknown
  Obtained from environmental sample
  misc_feature (1)..(153): Xaa is any amino acid
MADIPTFERIRGNIINQNPQTVEYASQLKLADAENCIITKYSSGSKPVYSWQALMFTTEDFEAAYKKYKWVFTQLRGMNIHYVKDQYTLRGTLEEPDESRKFTNSILTPVAPPDPLKKLKIDVAIEFEFPEWKVKLLVYEKERDDDERGDIEE

SEQ ID NO: 5565 - DNA, 417 bp, Unknown; identical to SEQ ID NO: 751
  Obtained from environmental sample
  misc_feature (1)..(417): n is a, c, g, or t

SEQ ID NO: 5566 - protein, 138 aa, Unknown; identical to SEQ ID NO: 752
  Obtained from environmental sample
  misc_feature (1)..(138): Xaa is any amino acid

SEQ ID NO: 5567 - DNA, 357 bp, Unknown; identical to SEQ ID NO: 3121
  Obtained from environmental sample
  misc_feature (1)..(357): n is a, c, g, or t

SEQ ID NO: 5568 - protein, 118 aa, Unknown; identical to SEQ ID NO: 3122
  Obtained from environmental sample
  misc_feature (1)..(118): Xaa is any amino acid

SEQ ID NO: 5569 - DNA, 744 bp, Unknown
  Obtained from environmental sample
  misc_feature (1)..(744): n is a, c, g, or t
ttggaagaactccttcgtcggcagacaggaagtaccatatttggagggaaggcaggagatgatttggcacttgaatcaacattcgtttttaccaatggaaaaagtaaagattacggacttgtagcactcattattgatgaggataaaatagatgttaaaggtatagccacttgtggctggaaggctattggcacttccaaaacagttacaaaaagcgaaggtaatatagtgtataccatcgacgataaaccagcattggatatgttgatgaattaccttggcgttgagatcaagctggatgacaacaaggaaatcgtgacatttctaagctcctggtattaccccttgcaagtggaacgggaaaatgtagatcccgtaattcgtacagccatgtttgccaatcgggaagaacgttcacttatttgttctggccatgtgccgcaagggtcaaaaatcaagttttccctgccacccgattttgattccatggaaacagtcgttgcagaatgtaagggcattaaggataatgcacagcagcaagccgatgccttgatcatgttttcctgcgtgagcaggtatttatcgtttggaatggtaatgagagaggagatagagcaggtgcaaaatatctggggtgcgcccatggccggctttttatcctatggcgaatatggaaaatcaaaaaccggtaaatatgattatcacaatcatacatgctgcctggtggtatcacaagagaaataa

SEQ ID NO: 5570 - protein, 247 aa, Unknown
  Obtained from environmental sample
  misc_feature (1)..(247): Xaa is any amino acid
MEELLRRQTGSTIFGGKAGDDLALESTFVFTNGKSKDYGLVALIIDEDKIDVKGIATCGWKAIGTSKTVTKSEGNIVYTIDDKPALDMLMNYLGVEIKLDDNKEIVTFLSSWYYPLQVERENVDPVIRTAMFANREERSLICSGHVPQGSKIKFSLPPDFDSMETVVAECKGIKDNAQQQADALIMFSCVSRYLSFGMVMREEIEQVQNIWGAPMAGFLSYGEYGKSKTGKYDYHNHTCCLVVSQEK

SEQ ID NO: 5571 - DNA, 318 bp, Unknown
  Obtained from environmental sample
  misc_feature (1)..(318): n is a, c, g, or t
atgaagttaacagtaacagcgatttttttatgtgtggcgatccaggccatcagccagaagaacttatttgacactttgaaagttgacacccatacaaaaataattggacgatacccacattatgacaaatccagaacgtatgaaaaatataatttcatcattgaagattcggttaaaatagtggaattcataaataacctggaacttggtaaagaagttgagaattcaacggaagacccaagctttacattaagcatcgtaaaaaactatgaggaaattggttcatggactataaccctacgcttaaaagcgcaatga

SEQ ID NO: 5572 - protein, 105 aa, Unknown
  Obtained from environmental sample
  SIGNAL (1)...(18)
  misc_feature (1)..(105): Xaa is any amino acid
MKLTVTAIFLCVAIQAISQKNLFDTLKVDTHTKIIGRYPHYDKSRTYEKYNFIIEDSVKIVEFINNLELGKEVENSTEDPSFTLSIVKNYEEIGSWTITLRLKAQ

SEQ ID NO: 5573 - DNA, 519 bp, Unknown
  Obtained from environmental sample
  misc_feature (1)..(519): n is a, c, g, or t
atgaaaaagtattttggaattttattgattacttccctcatatgcttagttcaactacaagcacaaaccgataaaactccctttcttacaaagtctttgaccggatcaatcaaggctgtgaaggtgcaaacttcaggtggtagcataaccgttgaaggtatgacaggtggagaatcacgggtagagatgtacgttcagtctaatgacaggcacggaaacctaaccaaagaacagatacaaaaaaagctggatgaagattacactattgaaattactgcgactaaccagcaattaacagccatagcaaaacaaaagaacaaaatatcaaactggagaaatgcattaaatatttccttcaaggtttttgcgcctagaaatatttcttccgacctcaatacaagcggtggaagtattaatatctctaatgtatcaggagagcaggatttaaaacaagcggcggaacctgcttatagatcatgttaccgggaaattaacggtaaaattccggtggcgcattga

SEQ ID NO: 5574 - protein, 172 aa, Unknown
  Obtained from environmental sample
  SIGNAL (1)...(20)
  misc_feature (1)..(172): Xaa is any amino acid
MKKYFGILLITSLICLVQLQAQTDKTPFLTKSLTGSIKAVKVQTSGGSITVEGMTGGESRVEMYVQSNDRHGNLTKEQIQKKLDEDYTIEITATNQQLTAIAKQKNKISNWRNALNISFKVFAPRNISSDLNTSGGSINISNVSGEQDLKQAAEPAYRSCYREINGKIPVAH

SEQ ID NO: 5575 - DNA, 552 bp, Unknown
  Obtained from environmental sample
  misc_feature (1)..(552): n is a, c, g, or t
atgagaactaactgcatcctgctttctgtattattatttactttttcaacatcatcgtacacccaatcttcctaccaaaaaggatttgttgttgtaaatagcggggatactattcggggatggatagattatcgccagtgggataaaaaccctgatgcaataaaattcagaaacgatgtaatgacggataacacagtagtttacaagatcaacgatctttcctattttgaaataacgggatttgataagtatgaaagggcagtcgttagtaaggatatgcgtccggtcgaaaccagtaagttggagaaaaacgaaaaggatattttcgttgaggatactgtttttttacaaattcttataaaaggtaacataagtttgtatcaactggaggattctaaagcgcattactatataaaggaagaaggccaagattacgaagaactactatacaaagtctactggcaggaatataatgccagtctttcgaaaatgtctatattcagagaccagttgaaacagtggatacccgtttcaaaaacactccttcgttaa

SEQ ID NO: 5576 - protein, 183 aa, Unknown
  Obtained from environmental sample
  SIGNAL (1)...(19)
  misc_feature (1)..(183): Xaa is any amino acid
MRTNCILLSVLLFTFSTSSYTQSSYQKGFVVVNSGDTIRGWIDYRQWDKNPDAIKFRNDVMTDNTVVYKINDLSYFEITGFDKYERAVVSKDMRPVETSKLEKNEKDIFVEDTVFLQILIKGNISLYQLEDSKAHYYIKEEGQDYEELLYKVYWQEYNASLSKMSIFRDQLKQWIPVSKTLLR

SEQ ID NO: 5577 - DNA, 507 bp, Unknown
  Obtained from environmental sample
  misc_feature (1)..(507): n is a, c, g, or t
atgctcaagatcatggatatttccaaaaaactcggaaacaagtatgttctttttggttcccggcaggatattatgtttcccgccaacggagcggatgaagcaaccattcgcaaagcgttctcagcgatcggctttgattatgaattgggaagcgatcagtcactctatcaaaacatcgtaagctcttatatttccgtgaacgtttcggagaccaccaattgggtcaaagaagacacttaccatttcgtgatcgataattttgattataaaccaaagatcaagattaacatcgtagatcctgttcagagcattattcccttgtttacaggcgaactgaattttatcgcctccaaagaggaaaactactggtacctgtatatccggaacgcgagaaatggcaatgtggtagagtgttggcccaagcttatcttcacgcaagatatcgcgaagatctcaaaagtgctggaggaattgatgttgagtgcttctacgttcanccgtggatga

SEQ ID NO: 5578 - protein, 168 aa, Unknown
  Obtained from environmental sample
  misc_feature (1)..(168): Xaa is any amino acid
MLKIMDISKKLGNKYVLFGSRQDIMFPANGADEATIRKAFSAIGFDYELGSDQSLYQNIVSSYISVNVSETTNWVKEDTYHFVIDNFDYKPKIKINIVDPVQSIIPLFTGELNFIASKEENYWYLYIRNARNGNVVECWPKLIFTQDIAKISKVLEELMLSASTFXRG

SEQ ID NO: 5579 - DNA, 372 bp, Unknown
  Obtained from environmental sample
  misc_feature (1)..(372): n is a, c, g, or t
ttgcacatgacaacatacaacccaaaaacaatgtttagaggccacatggtcgtagtatttatatttttatcgatactaacctcctacatactaagcgcacagcgtacccctccaatgagtaagcccgatatgaaagacaccctttattgtgttcagaatactgcgcaagagtggcaggtatggctatataaatttgaaaatattaaatttcaattaaagaaaagcgaccttccctcccgtgatgtaacctacttaatagactcattgattgtgccaatgcagtatgtgattagcagccaagtgaggccacaaattgagagaagagaaaaagcagactcagcaggtataccaaataataaacaaggaaaataa

SEQ ID NO: 5580 - protein, 123 aa, Unknown
  Obtained from environmental sample
  misc_feature (1)..(123): Xaa is any amino acid
MHMTTYNPKTMFRGHMVVVFIFLSILTSYILSAQRTPPMSKPDMKDTLYCVQNTAQEWQVWLYKFENIKFQLKKSDLPSRDVTYLIDSLIVPMQYVISSQVRPQIERREKADSAGIPNNKQGK

SEQ ID NO: 5581 - DNA, 615 bp, Unknown
  Obtained from environmental sample
  misc_feature (1)..(615): n is a, c, g, or t
atgaagttgtttaatgcaatattttatcaatacagaaaaaacaaaacagtcaaagaaagtaagagaattcagaatcaggaactaaacacaataaaaaagtattttgaaaatggccagattccctggtcagaaggctatcaattacacaaagaaaaatcaattactgaaagtcttaataccgaaggaattctacagaaatttggagacaatgagattatttcaaagtttggatatcgtttagatgaaagaatagtagaatacccctggatttttaataaccttaaaaaagaaaattgtaaattattagatgcaggctctacctttaatttcaaatatattctggaacatgccctgatagaaaataaagatttaacgatttttaccttcgcgccagaaagtcctaatttcaatgagaaaagatttcttatgtatatggagatttacgggatttaccatttacagatggatattttgaccgtggtgatnccacaatctactattgagcacataggcatgaataattcttatttaatggctacgatagtgattaccataaaaaactgcgacctcaatcttatgaattctttatgcgataagggacatggaaggggttag

SEQ ID NO: 5582 - protein, 204 aa, Unknown
  Obtained from environmental sample
  misc_feature (1)..(204): Xaa is any amino acid
MKLFNAIFYQYRKNKTVKESKRIQNQELNTIKKYFENGQIPWSEGYQLHKEKSITESLNTEGILQKFGDNEIISKFGYRLDERIVEYPWIFNNLKKENCKLLDAGSTFNFKYILEHALIENKDLTIFTFAPESPNFNEKRFLMYMEIYGIYHLQMDILTVVXPQSTIEHIGMNNSYLMATIVITIKNCDLNLMNSLCDKGHGRG

SEQ ID NO: 5583 - DNA, 816 bp, Unknown
  Obtained from environmental sample
  misc_feature (1)..(816): n is a, c, g, or t
atgagagaacacagtgaaaagctgcaggaagctaaaaagataattgaacaacaaaataaggaaatcacgatcaagaatgacgagctggcaactgaagttgagcatcagacaaaattcctcagggaaaccaaccttgaactcatcgagcataacagcaggcttgaacaatttgcttttatcatttcacacaaccttcgggcacctgtcgcaaggcttgttggcctctcatcaatccttgagcatgccgctaatcccgaagaacaacaaaagattgtgaagatgatgatcaaatcaacaggcgaacttgatcaggtgatacaggatctgggattcattctgagaatacaaaaattaagtgcaaaggttctcagccaggttaaccttaatcatattgccgataaagtgatgaatattcttgaggcggacatcagagacacacaggctgaaataaagatagattttaacgatgttgttactgtttattcgttgccacagtatttcgagagtattatttacaaccttgtgagcaattcaattaaataccgtcatcccgagcggaggccgctgatcaaaatgttttcaaaatttgaggatgattttattaaaattgaaatctctgataatggtttaggaattgatcttgaccgcaataaaaacaatctttttaatctctataagagatttcattttcatgttgaacgaaaaggactcggcctttatctggtgaaaactcaaattgatgcgctgggaggaaagatcgaagtgaccagtaacgttgaagtggggactacattcaccctgtacttcaagaattaa

SEQ ID NO: 5584 - protein, 271 aa, Unknown
  Obtained from environmental sample
  DOMAIN (53)...(118): His Kinase A (phosphoacceptor) domain
  misc_feature (1)..(271): Xaa is any amino acid
MREHSEKLQEAKKIIEQQNKEITIKNDELATEVEHQTKFLRETNLELIEHNSRLEQFAFIISHNLRAPVARLVGLSSILEHAANPEEQQKIVKMMIKSTGELDQVIQDLGFILRIQKLSAKVLSQVNLNHIADKVMNILEADIRDTQAEIKIDFNDVVTVYSLPQYFESIIYNLVSNSIKYRHPERRPLIKMFSKFEDDFIKIEISDNGLGIDLDRNKNNLFNLYKRFHFHVERKGLGLYLVKTQIDALGGKIEVTSNVEVGTTFTLYFKN

SEQ ID NO: 5585 - DNA, 765 bp, Unknown
  Obtained from environmental sample
  misc_feature (1)..(765): n is a, c, g, or t
atgataagcccgaaggatataaaagatcaatgcctgaaatggtggaaggacgttttagtttcacacatagattccaggtcctttttcccaagagatattacccgaataggtaaggtaaattcaaaagacatcctgagcaatctatcggcatatgataaatccattcaattattaaaaagcgaagcgaaacctaataaaaaactgggctatacactaataactgaggaaagacggtttaataaaatcaaagaccaaacggtaccggtaaaaatcaccatcgatagtatcgatgattacttacaaattaccgggaagaaaagggaatatgagtcgttccagggcaattatgatttggtaattaagaatcatcccttacttaagggctggataaaggaaaatccaacgaagttgattgaacatgatacttgggaacatacattaaaaacatgttcgtatttccttcaaacacctaagcccaacttgtatattaggcaacttccgattgatattcacacgaaatatatttccgaaaatgaaggcttgttgcagtcacttttggaatatttaattccggaacatattgtcacaaacgaaaagaaatttgaaaggcgatttaacttgaaatattctgaaccattaattaggatacggttcttggataaaaccctttcaccaataccctctgcaacagacatttctttaccgctttcggagtttaataaatttaattccaattgtaaaaatatttttgtcaccgagacatga

SEQ ID NO: 5586 - protein, 254 aa, Unknown
  Obtained from environmental sample
  misc_feature (1)..(254): Xaa is any amino acid
MISPKDIKDQCLKWWKDVLVSHIDSRSFFPRDITRIGKVNSKDILSNLSAYDKSIQLLKSEAKPNKKLGYTLITEERRFNKIKDQTVPVKITIDSIDDYLQITGKKREYESFQGNYDLVIKNHPLLKGWIKENPTKLIEHDTWEHTLKTCSYFLQTPKPNLYIRQLPIDIHTKYISENEGLLQSLLEYLIPEHIVTNEKKFERRFNLKYSEPLIRIRFLDKTLSPIPSATDISLPLSEFNKFNSNCKNIFVTET

SEQ ID NO: 5587 - DNA, 477 bp, Unknown
  Obtained from environmental sample
  misc_feature (1)..(477): n is a, c, g, or t
atgcatcagcattatgagcgtatttcgcattctactttagtccagttccgcactggaccagttaaatggttacaagatcttcaagctggaactcctattggattataccatgataaagtaacaacaacggaatccggcgtatcgaagtattatacaatctcagatcccgaaatgttttcgataggcgatatcacgctcaagaaagtcggccttcaaactgtttctgataccgtgcgctatatcatgctcacgaccgacgacacaaacggcaagaatttatacctggcaatgtataagagatttggaattccaaatggtaaagctgaccatattaatagttcatatttgtggaaagggaataaactccacttatctattcaaaagaaaggcaacgagtggcaggctacctatattgatgtgccgttcgaaaagagagtggagaaagaaaaagagaaaaagaaactatcagatttttga

SEQ ID NO: 5588 - protein, 158 aa, Unknown
  Obtained from environmental sample
  misc_feature (1)..(158): Xaa is any amino acid
MHQHYERISHSTLVQFRTGPVKWLQDLQAGTPIGLYHDKVTTTESGVSKYYTISDPEMFSIGDITLKKVGLQTVSDTVRYIMLTTDDTNGKNLYLAMYKRFGIPNGKADHINSSYLWKGNKLHLSIQKKGNEWQATYIDVPFEKRVEKEKEKKKLSDF

SEQ ID NO: 5589 - DNA, 801 bp, Unknown
  Obtained from environmental sample
  misc_feature (1)..(801): n is a, c, g, or t
atggctgaagtcaaaccctcagcagcatcttccgcttctgccgtggtgccgttcgtgcatcttcacgttcacacgcacaacagctttctcgcgtccacgatcaagatcgccgatctggtgaaacgcgcgaaagaagagggcatgcctgcactcgcgatgacggatacgaacaatatcttcggtgcgatcgaattttatttcgcgtgtaaagatgccggtatcaaacccatcatcggttgcgatctcgtttattgtccggaaggtcgcgatcaagtttttcctgaaaaaggaatgcagggaaaacagatccattccctcgtagtgctttgtaaaaataaaaagggttacgagaatctgtgtaaacttctcacccaagcgttcatcaacggctccgcgaacaaaactccgctcagcgatttggttcgcggcgtggtggatcgcgagcttttggataaatacggcgatggattgatcgtgttgtcttcatccatccgaggcgagatcgggtacaaactcatgacttcgcaggatgaagaagcgaagaaagccgtggattggtttaaaaaacggttcaaagacgatttctatctcgaagtgatcgataacggattgccggaacagcaatcggtgaaccagcgcttggtcgaaatcggaaacagcaagggtgtggaacttgttcggcacgagcgaaagtttttacctcgatccgaaagtggccgaangccaagaaattctccatgtattcctcttccgcaggactcctcgattttggggcggtccgaagtccctcgtcccgcctga

SEQ ID NO: 5590 - protein, 266 aa, Unknown
  Obtained from environmental sample
  DOMAIN (102)...(232): PHP domain C-terminal region
  misc_feature (1)..(266): Xaa is any amino acid
MAEVKPSAASSASAVVPFVHLHVHTHNSFLASTIKIADLVKRAKEEGMPALAMTDTNNIFGAIEFYFACKDAGIKPIIGCDLVYCPEGRDQVFPEKGMQGKQIHSLVVLCKNKKGYENLCKLLTQAFINGSANKTPLSDLVRGVVDRELLDKYGDGLIVLSSSIRGEIGYKLMTSQDEEAKKAVDWFKKRFKDDFYLEVIDNGLPEQQSVNQRLVEIGNSKGVELVRHERKFLPRSESGRXPRNSPCIPLPQDSSILGRSEVPRPA

SEQ ID NO: 5591 - DNA, 660 bp, Unknown
  Obtained from environmental sample
  misc_feature (1)..(660): n is a, c, g, or t
gtggctgtttattttttaaggagttttatgaaaaaaatcggtttaattttagtgactttatttatcgccgcgggctgcctgatgagcgattccgtgccgcaggcggaacttaaaaacaagtccgtcctcgattttaagatgaaggacatcgacggcaacgaggttaaattaaagaaatacaagggcaatgtcctgctcgtcgtcaacacggcgagcaaatgcggctacacgccgcagtatgaaggcttgcaggcgactttcgataaatacaaggaccagggcttcgtcgtcctcggttttccggcaaacaatttcggcggtcaggaaccgggaacggaagccgagatcaaggaattctgcacgaccaaatataaagtctcgttcccgatgttcgctaaaatctcggtcaagggcgacgatcaggacccgctttataaattcctgacgagcaaagaaaccaaccctgctttcgcaggcgacattaaatggattttcaacaaattcctgatcgaccgcaaaggcaccgtcgtcgcccgcttcgattcgaaagaaaacccgacgggaagcatcacggcgggatcgaaatttttgaagagacaagtactcaagtatcaatgtacgcggatttggcggatggtgccgatttcgcggattatctaa

SEQ ID NO: 5592 - protein, 219 aa, Unknown
  Obtained from environmental sample
  DOMAIN (41)...(149): Glutathione peroxidase
  misc_feature (1)..(219): Xaa is any amino acid
MAVYFLRSFMKKIGLILVTLFIAAGCLMSDSVPQAELKNKSVLDFKMKDIDGNEVKLKKYKGNVLLVVNTASKCGYTPQYEGLQATFDKYKDQGFVVLGFPANNFGGQEPGTEAEIKEFCTTKYKVSFPMFAKISVKGDDQDPLYKFLTSKETNPAFAGDIKWIFNKFLIDRKGTVVARFDSKENPTGSITAGSKFLKRQVLKYQCTRIWRMVPISRII

SEQ ID NO: 5593 - DNA, 342 bp, Unknown
  Obtained from environmental sample
  misc_feature (1)..(342): n is a, c, g, or t
atgacaggcaacgtcaaagacgataaaaggctctctgaacaggaaaaacacaaactcgaaacgatattgaaagcgattgaattaaggcacgataccatcctggtcgatcctcaaatcagccaagcagtgctagccaggataataccctctgatcccaagataggactcagagttacagccgtgtatgatcttgtccgcttgatcttatgcaatgagatcaacaactgttatcatgccaagtccaaggtcagagaattaataggcctgctgggcctggtagccaaacatatggatcctatctaccatggtctggcaaggacaaagtacaaaccggctttgtag

SEQ ID NO: 5594 - protein, 113 aa, Unknown
  Obtained from environmental sample
  misc_feature (1)..(113): Xaa is any amino acid
MTGNVKDDKRLSEQEKHKLETILKAIELRHDTILVDPQISQAVLARIIPSDPKIGLRVTAVYDLVRLILCNEINNCYHAKSKVRELIGLLGLVAKHMDPIYHGLARTKYKPAL

SEQ ID NO: 5595 - DNA, 327 bp, Unknown
  Obtained from environmental sample
  misc_feature (1)..(327): n is a, c, g, or t
atgaatatttgctatttcattggctctacttctctattaaaagaatgtattttaatagcaaaaaattatgactttcaaataaataaagtttttactaacgatgtcagcatccaacaatggtgtcaatcaatttatctggattgtttccctttacaagatatagaaaaaataaaagaaagtgagtgtgattacctatttagtgtagttaacccaaaaattttatctaatcatattcttaaaaaaataaaaaaattatctattaattaccacgatggattattaccaaaatatgctggtattaatgcgactacttgggccatcatttaa

SEQ ID NO: 5596 - protein, 108 aa, Unknown
  Obtained from environmental sample
  misc_feature (1)..(108): Xaa is any amino acid
MNICYFIGSTSLLKECILIAKNYDFQINKVFTNDVSIQQWCQSIYLDCFPLQDIEKIKESECDYLFSVVNPKILSNHILKKIKKLSINYHDGLLPKYAGINATTWAII

SEQ ID NO: 5597 - DNA, 705 bp, Unknown
  Obtained from environmental sample
  misc_feature (1)..(705): n is a, c, g, or t
atgaatatttgctatttcattggctctacttctctattaaaagaatgtattttaatagcaaaaaattatgactttcaaataaataaagtttttactaacgatgtcagcatccaacaatggtgtcaatcaatttatctggattgtttccctttacaagatatagaaaaaataaaagaaagtgagtgtgattacctatttagtgtagttaacccaaaaattttatctaatcatattcttaaaaaaataaaaaaattatctattaattaccacgatggattattaccaaaatatgctggtattaatgcgactacttgggccatcattaataatgaaaaaacgcatggtattacttggcatttattaaaagaaggtatagatacaggcgatattctcagtcaaacgacagtatttatcgatgaaaatgaaactacattttcattaaatttaaaatgttacaatgaagctcttcaaacttttccacttattttagatcaattaattaagaataatctatcctcaaaaacacaagatttgcaattaagaacttactgctcacaatatgataggccgtttggtaatggttttattgattggcatgatactgccaaaaatatagcaagaatggtgcgggtattagattttgtatttataaataacccaattaccatggctaaaataattattaatgatgaatttatttgttag

SEQ ID NO: 5598 - protein, 234 aa, Unknown
  Obtained from environmental sample
  DOMAIN (1)...(163): Formyl transferase
  misc_feature (1)..(234): Xaa is any amino acid
MNICYFIGSTSLLKECILIAKNYDFQINKVFTNDVSIQQWCQSIYLDCFPLQDIEKIKESECDYLFSVVNPKILSNHILKKIKKLSINYHDGLLPKYAGINATTWAIINNEKTHGITWHLLKEGIDTGDILSQTTVFIDENETTFSLNLKCYNEALQTFPLILDQLIKNNLSSKTQDLQLRTYCSQYDRPFGNGFIDWHDTAKNIARMVRVLDFVFINNPITMAKIIINDEFIC

SEQ ID NO: 5599 - DNA, 576 bp, Unknown
  Obtained from environmental sample
  misc_feature (1)..(576): n is a, c, g, or t
atggcatccaggcttgatctatatattaatccgatatttgcacattcatacagaaattatgttcgaatttattgcaaagtatcaaaaagtaattatttagcgaataaaatatctgacaaattaggatatattcttcactgttttgaatgtggatatcgaggattgatgaaaaaaagtccatctgatataaaatgtccattgtgccaaaaaaggatgaggttgggtggtccattatgggtatctcacatgttcgataagaatgtgattttaaaaatattaactgaaatagttcagtcagaagcaaaaatgacaaatatagtaagaaatgttaaacaaaataaggatccgataaaaaagtttttcgagattgcatcaagagaattagatcatattccgtatcattacaatagtgatgaatttgggaaaattatgaaaaatagtacacatcccctttcaaaaattattgataaactaatcaatgatggatatgccaccagcccgaccattttttcatcaacaggatttaagactgatgcaaatatacaagaaatcaagtctagcctttctaaactctag

SEQ ID NO: 5600 - protein, 191 aa, Unknown
  Obtained from environmental sample
  misc_feature (1)..(191): Xaa is any amino acid
MASRLDLYINPIFAHSYRNYVRIYCKVSKSNYLANKISDKLGYILHCFECGYRGLMKKSPSDIKCPLCQKRMRLGGPLWVSHMFDKNVILKILTEIVQSEAKMTNIVRNVKQNKDPIKKFFEIASRELDHIPYHYNSDEFGKIMKNSTHPLSKIIDKLINDGYATSPTIFSSTGFKTDANIQEIKSSLSKL

SEQ ID NO: 5601 - DNA, 489 bp, Unknown
  Obtained from environmental sample
  misc_feature (1)..(489): n is a, c, g, or t
atgttgcaatacatggtgcagcaaactatcgccgattctctaaaatttaaagacacggtgaagcaagcagtattggtgccgataaaaaacgataggcagtttgacctcggtaaccgcatcgtggaagtgatccatgttccggggcataccccgggaagcatctgcctcctcgataacaaaagccggctgctgttttcaggcgaccatatcaagataccaacgtggttgcatatgcaggaatcgacgtctgtggaaatgtatttgtcgggcgttaagaaacttcgtacgaggtccaatgaattcgaccgcattcttccgggtcatggcaatgctttggacaccgccttcctgggtgagcagaccgtttgcgcggaaaatattctcgccagcaaatgcaaaggagaaaaatatgaatcggtagtaggcaacggtttattgtgtacgtataagcgtgcgcagatcgcctttgatccggcaaagatcaaatag

SEQ ID NO: 5602 - protein, 162 aa, Unknown
  Obtained from environmental sample
  misc_feature (1)..(162): Xaa is any amino acid
MLQYMVQQTIADSLKFKDTVKQAVLVPIKNDRQFDLGNRIVEVIHVPGHTPGSICLLDNKSRLLFSGDHIKIPTWLHMQESTSVEMYLSGVKKLRTRSNEFDRILPGHGNALDTAFLGEQTVCAENILASKCKGEKYESVVGNGLLCTYKRAQIAFDPAKIK

SEQ ID NO: 5603 - DNA, 747 bp, Unknown
  Obtained from environmental sample
  misc_feature (1)..(747): n is a, c, g, or t
atgaaactgggagtggagcatgaaaacagtattctcaaattcaacgacaggctggtgaaggttgatgttttcccgatcagcatagactaccagaaatttcatgatgcttacaacctgcccgaagtggtaagcaaaagaaaattttacctggaacaatttgaaggaaagaaaataatattttctgttgacaggcttgattacagtaaaaatgttcttggcaggctgaaaggatatgaaaagttcctgtcgcagtttcctgcttacaaagaaaaggtggtttttatacttgcgatagtgccatctcgcgataacattgccaactatgccgaccggaaaaaagagatcgatgaatttataggtggcttcaatgcaaaggttggcaacataatgtggaaacctgttatttatcagtacgaccacctgccatttcatgaaatgatcgccctgtattcgagttgcaacattgcccttatcactccgctgcgagatggtatgaacctggtttcgaaagagtttgtggcatcaaggcaagatcaaaaaggtgtacttgtattaagcgaaatggccggagccgcacgcgaactaaccgatgccgttttaataaatcctaatgatgtgaacggattggcagaaaaaatgcacctcgcacttgaaatgcctgaagcggaacagcatgaaaggataactagaatgcaacagcgcatatctgatattccgtacagctgggtgagattttctgatcactag

SEQ ID NO: 5604 - protein, 248 aa, Unknown
  Obtained from environmental sample
  DOMAIN (43)...(234): Glycosyl transferases group 1
  misc_feature (1)..(248): Xaa is any amino acid
MKLGVEHENSILKFNDRLVKVDVFPISIDYQKFHDAYNLPEVVSKRKFYLEQFEGKKIIFSVDRLDYSKNVLGRLKGYEKFLSQFPAYKEKVVFILAIVPSRDNIANYADRKKEIDEFIGGFNAKVGNIMWKPVIYQYDHLPFHEMIALYSSCNIALITPLRDGMNLVSKEFVASRQDQKGVLVLSEMAGAARELTDAVLINPNDVNGLAEKMHLALEMPEAEQHERITRMQQRISDIPYSWVRFSDH

SEQ ID NO: 5605 - DNA, 801 bp, Unknown
  Obtained from environmental sample
  misc_feature (1)..(801): n is a, c, g, or t
ttgctgattggtatccgcaaattaacctggattacagcctttcaacataactttaagttacctacaataaatattaacggcaatctcattcataccggattagtaaatacttcaaatgcagaattgggtgcaatgcaaaatatttttaacagagatgtattgcttgcttcacgtaccggaaaagatgttcgtcagcaagcaagccaaagtacaaaagagcaaaatatagccattactgtacaggtaagcaaggctttttatgatgttatacttaccatggagcaaatgaaggttactgaagaagatattttgcgcattgaccgcagcctcaaagatgcctattatcagtaccaaagcggtatcactgataaaacagattataaacgtgcaactatttccttaaacaatgccagggctcaaaaaaagagcattgaggaatcactaaaagtaaaatatacttatctaaaacagataatgaattatccggttgagagaaatctcgaattagtatatgactcatcacgaatggtaaatgaaatatttgttgatacgttgcaaaccgttaattattttaatcgcatagaagtaaagctgctggagacccaaaagaaattacagcaatacaatttgcaatattataagtggagttttttaccggacatttccgccttcggtaattataattttaattttcaaaacaatgcattttcgaaattatacaggcaaaattatcctacttcttatatcgggcttttgttgtctatcccgatattccagggagtaaaagactccagcaaataa

SEQ ID NO: 5606 - protein, 266 aa, Unknown
  Obtained from environmental sample
  misc_feature (1)..(266): Xaa is any amino acid
MLIGIRKLTWITAFQHNFKLPTININGNLIHTGLVNTSNAELGAMQNIFNRDVLLASRTGKDVRQQASQSTKEQNIAITVQVSKAFYDVILTMEQMKVTEEDILRIDRSLKDAYYQYQSGITDKTDYKRATISLNNARAQKKSIEESLKVKYTYLKQIMNYPVERNLELVYDSSRMVNEIFVDTLQTVNYFNRIEVKLLETQKKLQQYNLQYYKWSFLPDISAFGNYNFNFQNNAFSKLYRQNYPTSYIGLLLSIPIFQGVKDSSK

SEQ ID NO: 5607 - DNA, 414 bp, Unknown
  Obtained from environmental sample
  misc_feature (1)..(414): n is a, c, g, or t
atgccttcaataaaagaatatatatcaaaactcccggggcaagaaaaaaagatcgcggcaaagctgcatgatatcatttgctccatgctgcccggggcggctgaaaaatttacttatggagtgccccactactttggaaactcgaggatatgttttttgtggccgtcctccgtttccggcgggaagataaaggaaggcatagcccttgggttttgccagggttatctgatggcaaacgaggaaggtatacttaagcgtgaaggcaaaaccaatatttatgtgatattatatacatcagtaaaagatattgatgaaacagttttatgtgagcttcttgctgaggctataatgatagacgaacgcacggcaatgacggcatatttaaaaacaggaaataaaaaaaataaaaaataa

SEQ ID NO: 5608 - protein, 137 aa, Unknown
  Obtained from environmental sample
  misc_feature (1)..(137): Xaa is any amino acid
MPSIKEYISKLPGQEKKIAAKLHDIICSMLPGAAEKFTYGVPHYFGNSRICFLWPSSVSGGKIKEGIALGFCQGYLMANEEGILKREGKTNIYVILYTSVKDIDETVLCELLAEAIMIDERTAMTAYLKTGNKKNKK

SEQ ID NO: 5609 - DNA, 714 bp, Unknown
  Obtained from environmental sample
  misc_feature (1)..(714): n is a, c, g, or t
atggaagatcagaaaaatctgcctgaagaaggggatatagtttttgttaatgttaaacaagttactaatcatggagcatatgtttctttagaagaatatggtaatattactggattcttacatatttctgaaatagcgacaggttggataagaaatatcgaaagatatgttagacctaatcaaaaaattgttctaaaagttattagagttaataaaacacgatctgaagttgatttatcactaaaacaagtctccggtgaagaaaaaaaatcaaagataattgaagtaaagaaaaatgagaaggctaatgcgttcatggcgataataaaaagtaaagccagcctatcagacgaacaaataaaacagattgaagaaaaaattttaactaaatatgattatgtttatgatatttttgaggctacaacaaaaaaagggaaagatgtattattaccattagaattacccgaaaatgtaattcaaataattgaagatgaaagtaaaaaaatttccattccccatgtcgaaataagaggtatattggaaatttcgtcgcaaaaatccaatggtgttgaaattattaaatccattttaagtactgcagaaactacaaaaggtaattcaaagattatgatttcatatattgcagcaccaaaatatagaatagttgttgctgctgataactttaaatcgctgagaatctataacatactctag

SEQ ID NO: 5610 - protein, 237 aa, Unknown
  Obtained from environmental sample
  DOMAIN (118)...(228): Eukaryotic translation initiation factor 2 alpha subunit
  misc_feature (1)..(237): Xaa is any amino acid
MEDQKNLPEEGDIVFVNVKQVTNHGAYVSLEEYGNITGFLHISEIATGWIRNIERYVRPNQKIVLKVIRVNKTRSEVDLSLKQVSGEEKKSKIIEVKKNEKANAFMAIIKSKASLSDEQIKQIEEKILTKYDYVYDIFEATTKKGKDVLLPLELPENVIQIIEDESKKISIPHVEIRGILEISSQKSNGVEIIKSILSTAETTKGNSKIMISYIAAPKYRIVVAADNFKSLRIYNIL

SEQ ID NO: 5611 - DNA, 816 bp, Unknown
  Obtained from environmental sample
  misc_feature (1)..(816): n is a, c, g, or t
gtgctcgcgtttgcggaagctggtcttgcaaaaaagatacctgttataaatgtaaccatacctcatgatgggggttctgctgcaaatccttattttgttattctcaacccaacgctgcgtacacaatgcgaagggatttatcgatatgcgcaaaaatattactctatcaaccctgtcattgtatttagaaaaaaaggagagatagaagaccagataaaggattatttcgatcagttttcgaaagtaacaatgtcggttcctctcaagatcaagtacgtcgatctccccgacagttttactatcaatcatctcagttcgcatctcgatacggtcaggcggagtgtttgtattgccggcagtcttgatccgtcatttggaagaaggttagcgtctcaactggcatcacttaacagggattatccgagtgttgtagtgggtatgcctacgtgggatgccattcgtgatttcaataagcctgaatttaaaggtctggagatcatttacagcaatccattctacaacacgaaaacagatcatatcagccaggagataaataattacttcaacaatgtgatgtactcaagacccagtgacatggtctttcgggggtatgaagtaacatggaaattcgcgaagctgcttctccaatacggcaatgatctttcttcgaacctgggcaacaaacaaaacaaagtgtttactgatttcgatattcaacctgtcctcaacaggaaaagcatggcattggaatattttgaaaacaaaaaattgtacttcctgaaatggctcgacggatccatcaaggctgttaactga

SEQ ID NO: 5612 - protein, 271 aa, Unknown
  Obtained from environmental sample
  misc_feature (1)..(271): Xaa is any amino acid
MLAFAEAGLAKKIPVINVTIPHDGGSAANPYFVILNPTLRTQCEGIYRYAQKYYSINPVIVFRKKGEIEDQIKDYFDQFSKVTMSVPLKIKYVDLPDSFTINHLSSHLDTVRRSVCIAGSLDPSFGRRLASQLASLNRDYPSVVVGMPTWDAIRDFNKPEFKGLEIIYSNPFYNTKTDHISQEINNYFNNVMYSRPSDMVFRGYEVTWKFAKLLLQYGNDLSSNLGNKQNKVFTDFDIQPVLNRKSMALEYFENKKLYFLKWLDGSIKAVN

SEQ ID NO: 5613 - DNA, 579 bp, Unknown
  Obtained from environmental sample
  misc_feature (1)..(579): n is a, c, g, or t
atggccgaggtcctgtcttggacacatgcgatagaggccagtatctattattacaagtataaagatttcaaaatctcgctaaaaatggagcgacaatcgggaaatgattttgaccctgctggatttggaaatgctttccaacacagccacttactgggaaccgtattgcaggccccctcagatattatagatggccaaaacttgcttcggaaagaaaatcggaataaaaccgtgacattcgatgttgcatttcgaatcgaaaacgcagtagtccaagggaaagtaatagaagaatttagagtaaaaggaaaagcgtgtttagaagaaaggaaattggaaataccgactattttaacgtatggaccgccgagtataagcggtaaatttagagacgtctatatccaaaaatacaatctaggtaatactcaaattatccaccataaagactctatttcaatcctattggatatttcaaatatggaatccctccttactgccaattcagattcttttcagtcaattcaaaaacaatccgaaaccatgatccttcgaaataatgggtgcggaaaaatgagataa

SEQ ID NO: 5614 - protein, 192 aa, Unknown
  Obtained from environmental sample
  misc_feature (1)..(192): Xaa is any amino acid
MAEVLSWTHAIEASIYYYKYKDFKISLKMERQSGNDFDPAGFGNAFQHSHLLGTVLQAPSDIIDGQNLLRKENRNKTVTFDVAFRIENAVVQGKVIEEFRVKGKACLEERKLEIPTILTYGPPSISGKFRDVYIQKYNLGNTQIIHHKDSISILLDISNMESLLTANSDSFQSIQKQSETMILRNNGCGKMR

SEQ ID NO: 5615 - DNA, 912 bp, Unknown
  Obtained from environmental sample
  misc_feature (1)..(912): n is a, c, g, or t
atgcgcggtttacaaacctgttttttggtagtgacaaagggatattacggaagactattggagcatccgacttttataaccttggatttacaaagtgttttcatttcggctatcattgacagcggaaccggtgacttattagacgagttaaccgttttaatgaaagacgaaccggaagcgaatgaagaatcagatgtgccgaaattcgccatcatcgggcagcctaatgttggtaaatcttctttgttgaatgccctggtaggagaagagcgcaccattgtaagcgatattgccggtacaaccagggatacaattcatacacgctacaacctttttcaaaaggactttattttgatcgataccgctggcattcgccgtaaagcaaaagtccatgaggacctggagttctattctgttatcagggctatcaaggcgcttgatgaagcagatgtttgccttcttctgttagatgcagaaaaaggaatcactgcgcaggacctgacaatttacagtcttgctgcacgaaaaggaaagggcattgtactccttatcaataaatgggatttggtgtcgaaagaaaccaatactgcaagagactatgagaaaacattaaaacaacgccttgcccctttcaatgatgtaccgatcttatttatttctgtaaaggagaaaaccagaatatttaaagcaattgaagcgggcctggaagtttatgagaaccgcaaacgccgtataccgacttctgtgttaaacgaaaaattattaaaagccattgaagcgtaccatccgcctgttgttcgtggcaacccaattaaaataaaatacatcacgcagatacccactgttgttccttcttttgcttttttttgcaactacccggatgaggtaaaaccccctacaagattatcttga

SEQ ID NO: 5616 - protein, 303 aa, Unknown
  Obtained from environmental sample
  DOMAIN (26)...(164): Protein of unknown function, DUF258
  misc_feature (1)..(303): Xaa is any amino acid
MRGLQTCFLVVTKGYYGRLLEHPTFITLDLQSVFISAIIDSGTGDLLDELTVLMKDEPEANEESDVPKFAIIGQPNVGKSSLLNALVGEERTIVSDIAGTTRDTIHTRYNLFQKDFILIDTAGIRRKAKVHEDLEFYSVIRAIKALDEADVCLLLLDAEKGITAQDLTIYSLAARKGKGIVLLINKWDLVSKETNTARDYEKTLKQRLAPFNDVPILFISVKEKTRIFKAIEAGLEVYENRKRRIPTSVLNEKLLKAIEAYHPPVVRGNPIKIKYITQIPTVVPSFAFFCNYPDEVKPPTRLS

SEQ ID NO: 5617 - DNA, 492 bp, Unknown
  Obtained from environmental sample
  misc_feature (1)..(492): n is a, c, g, or t
atgaaaaataaaataattgcatttctgccattgttgatttgtgcaggggttattactacttcgtttactccggcaaaaaagaaaaagccagtgatcattggttatgttggcggctttcgtggattgatcaatacagactccattaatatacgtcggttatcgcatatcaattatgcctttgttgatgtaaaagataatcgtgcctggttgcataacgaagcaactgatactgtcaacctgagaaaactaagtgaactaaaacaaaaaaaaccaagcttaaacattttgatttctctaggtggctggagttggagtaagaatttttctgatgccgtgcttactgatagttctactagaaattttgctaatagttgtatcgatattgtggcaacatataatttggatggagtggatattgattgggaataccctggcatggaaagggataacaataagttcggccggaagaataagacatatacctgcttttaa

SEQ ID NO: 5618 - protein, 163 aa, Unknown
  Obtained from environmental sample
  SIGNAL (1)...(19)
  DOMAIN (30)...(159): Glycosyl hydrolases family 18
  misc_feature (1)..(163): Xaa is any amino acid
MKNKIIAFLPLLICAGVITTSFTPAKKKKPVIIGYVGGFRGLINTDSINIRRLSHINYAFVDVKDNRAWLHNEATDTVNLRKLSELKQKKPSLNILISLGGWSWSKNFSDAVLTDSSTRNFANSCIDIVATYNLDGVDIDWEYPGMERDNNKFGRKNKTYTCF

SEQ ID NO: 5619 - DNA, 897 bp, Unknown
  Obtained from environmental sample
  misc_feature (1)..(897): n is a, c, g, or t
ttgatatacttgacatatatgatgataacttatcgcgatacaattcaacctttaaaaaaaatacaaaattcaatattagaaacatttgaggatgtaagtagtcttaatgaaatttctaaattaaggattgaattaaatttgttgaaatcaataggcatggtcgagagcatttctccaaataagcgagcacccaaagacgttggattaacgctagaaagaatcctaggtgtgaaagttaataacttaaaaacaccagattatatgggaaaaattgaattgaaatcgttacgcgaaaaatctcaaaaagattctcttttttcaaaagtacctgacaaggatattagtaaatataaaaaagccaaagatattatatctaaatttggttattgggatgaaataaataaacgtattgcattgtataacaatataataacgaaacccaataaccagggactttatttggtagcaaacaatgaaaaactaatcctttcgcaaaactatgcattaaataatcaatttgatgaggtctgcgcatggcattatagtacattaaaaaaatcgcttgaaacaaagcaccctacaactttgtgggccgatgcgattgaaacaacagatgttgaaggaaagataaattttatttataaaaaatttgaattaacctcgaagccattattctcagaatttatctctttaattgagagagatttaattaattttgattggaagggtcatgtaaaaaatggcaaggaaagaaatcatggaccacgatttcgcattggaacaaaatataacggtctattatttaaaacacttacaaaagtgtcatatattgcatgcctagttatattatgtagtacatacattgacttctactttcaattatcattcagtaaataa

SEQ ID NO: 5620 - protein, 298 aa, Unknown
  Obtained from environmental sample
  misc_feature (1)..(298): Xaa is any amino acid
MIYLTYMMITYRDTIQPLKKIQNSILETFEDVSSLNEISKLRIELNLLKSIGMVESISPNKRAPKDVGLTLERILGVKVNNLKTPDYMGKIELKSLREKSQKDSLFSKVPDKDISKYKKAKDIISKFGYWDEINKRIALYNNIITKPNNQGLYLVANNEKLILSQNYALNNQFDEVCAWHYSTLKKSLETKHPTTLWADAIETTDVEGKINFIYKKFELTSKPLFSEFISLIERDLINFDWKGHVKNGKERNHGPRFRIGTKYNGLLFKTLTKVSYIACLVILCSTYIDFYFQLSFSK

SEQ ID NO: 5621 - DNA, 381 bp, Unknown
  Obtained from environmental sample
  misc_feature (1)..(381): n is a, c, g, or t
ttgaaacggaaatataaagtctttagtgttattagcccaagcgagtggggaaagtatttagaatgggctgatatttttgtttcccgctctggagcgaactttacataccagcttttagttattaaaaaacctgcagttttaattcctttaccctttactcatttggatgagcaagtaataaatgcagaatacgcagaagaatatggattggctgagataattaatcaggaaactgcaactgctgataagctgctttcaacactgtttcagatagaggataaatgggaagaaataacaagcttggtccaaaataagacttcgcctgatattaacgcctcagaaaaactggtagagttgatagaagagtacctaccaagataa

SEQ ID NO: 5622 - protein, 126 aa, Unknown
  Obtained from environmental sample
  misc_feature (1)..(126): Xaa is any amino acid
MKRKYKVFSVISPSEWGKYLEWADIFVSRSGANFTYQLLVIKKPAVLIPLPFTHLDEQVINAEYAEEYGLAEIINQETATADKLLSTLFQIEDKWEEITSLVQNKTSPDINASEKLVELIEEYLPR

SEQ ID NO: 5623 - DNA, 708 bp, Unknown
  Obtained from environmental sample
  misc_feature (1)..(708): n is a, c, g, or t
atgctgaattttttagccgcagattttaaaaatattttcctgtctgagatcttttcagaatttgaaaatgaagcgcaaaacaggtacataaaagacagtcttgtcaactccaatttttcaggttacgtaaacagatatgatacacggatatatacttttgatgcaaagggtaatccgttatataatgccgattcaacaacactcaacactttaaatacaattatagaaacccaggcgaaggaaataaacaaaaacggcttgtattattatgacgtatcgtacgaccggtttgattacttgattaaaaaagaaattactgatacaaatagtatcgttaaaggatatgtctttattctttctcatccaaaaaaatacaagcccgatgcactttaccctgagctattttcaaaaggaagcacaaattctatagaaaactcatcagtatatgcattcgctgtatataataaaaatgatttaagcaccagccataatgattacccgtttcccacaaaaatatccgagcctaaacttttgaacaatgaatttcaaattagaaaaagaagtggtaatgatgaactgtggtacagagccaacgaagataaagtaattgtgatagctaagcctgacagcttttctattgaatcaataaccttgttcgcttacctattttgtgcttttcttgcactaaccgncctctttctgctttaa

SEQ ID NO: 5624 - protein, 235 aa, Unknown
  Obtained from environmental sample
  misc_feature (1)..(235): Xaa is any amino acid
MLNFLAADFKNIFLSEIFSEFENEAQNRYIKDSLVNSNFSGYVNRYDTRIYTFDAKGNPLYNADSTTLNTLNTIIETQAKEINKNGLYYYDVSYDRFDYLIKKEITDTNSIVKGYVFILSHPKKYKPDALYPELFSKGSTNSIENSSVYAFAVYNKNDLSTSHNDYPFPTKISEPKLLNNEFQIRKRSGNDELWYRANEDKVIVIAKPDSFSIESITLFAYLFCAFLALTXLFLL

SEQ ID NO: 5625 - DNA, 342 bp, Unknown
  Obtained from environmental sample
  misc_feature (1)..(342): n is a, c, g, or t
atgagtaaggacaaagaagataacaaagcagaacttagatgtgatacaaccaacgacactaatcgttattatgttatagactataatttaggagtagaggtagaaatacacggcgctattcagtttaagactgttaataaagatggaaaggttgtttataagtcacacattacagtaattgatgtattcttaaaagagttagccgcttatcaaaaagataatatggataggttttttaaagaaatgggtgaatctataagcaaagcctacgaaaatgatactctatatacttttgacgaaaacggtaagtttataaaatggagtgagaaatataaaaaatga

SEQ ID NO: 5626 - protein, 113 aa, Unknown
  Obtained from environmental sample
  misc_feature (1)..(113): Xaa is any amino acid
MSKDKEDNKAELRCDTTNDTNRYYVIDYNLGVEVEIHGAIQFKTVNKDGKVVYKSHITVIDVFLKELAAYQKDNMDRFFKEMGESISKAYENDTLYTFDENGKFIKWSEKYKK

SEQ ID NO: 5627 - DNA, 900 bp, Unknown
  Obtained from environmental sample
  misc_feature (1)..(900): n is a, c, g, or t
ttggctaataaaactgcaattgaatttaacaaaaaggaaagagatactttgcttgcgaaaaatgcgaaggaattggaaacccgctaccgggttaaagaaaaagaagataagattgaatcattagcagccataaacaaagttgaaagcaaaataagtcaacagcgaaaaattatcaatatcggaatgggcgttgtactcctgttgaccattgctattgctatcctgttactgcgacgccgaaagatgcaaatacaaattcgagaggttcagttaacgcaacaattactgcgaagccagatggaacctcattttattttcaacacacttaatgttttaaaaagttttatttcgagcgaaaaacccgaactatctaatgcttttttagataagttttcaagtcttctaagaattaaccttgagaatgcgagagagaatttagtactcttaagaaaggaggtcgaggcattgaagaattatttagacctgcactcgatgggtttcgaaaatttatttacgtatcacctagaagtttatcctgaatacgaagaagataacatctttattccgccaatgctattgcagccgtttgtagagaacgccatctttcatggctttgctgaacctaacttgaaaggggaaatctcagttataattcaaagagactcgaacgtacttcattgcattatcgaggacaatggtgtaggacttaacggttcaacaaaatcgtacgcgaagagatcactttcaacggtcattacccaggaaaggctatccttattgacaaagcaaatgggaaagcccgcaaaaattgttatcactgacaaacaggagttgaatgagggaaaaggtgtaagagtagtacttgatattccaattattaaacaagatatacctcagtaa

SEQ ID NO: 5628 - protein, 299 aa, Unknown
  Obtained from environmental sample
  DOMAIN (94)...(176): Histidine kinase
  misc_feature (1)..(299): Xaa is any amino acid
MANKTAIEFNKKERDTLLAKNAKELETRYRVKEKEDKIESLAAINKVESKISQQRKIINIGMGVVLLLTIAIAILLLRRRKMQIQIREVQLTQQLLRSQMEPHFIFNTLNVLKSFISSEKPELSNAFLDKFSSLLRINLENARENLVLLRKEVEALKNYLDLHSMGFENLFTYHLEVYPEYEEDNIFIPPMLLQPFVENAIFHGFAEPNLKGEISVIIQRDSNVLHCIIEDNGVGLNGSTKSYAKRSLSTVITQERLSLLTKQMGKPAKIVITDKQELNEGKGVRVVLDIPIIKQDIPQ

SEQ ID NO: 5629 - DNA, 375 bp, Unknown; identical to SEQ ID NO: 3677
  Obtained from environmental sample
  misc_feature (1)..(375): n is a, c, g, or t

SEQ ID NO: 5630 - protein, 124 aa, Unknown; identical to SEQ ID NO: 3678
  Obtained from environmental sample
  misc_feature (1)..(124): Xaa is any amino acid

SEQ ID NO: 5631 - DNA, 540 bp, Unknown; identical to SEQ ID NO: 3681
  Obtained from environmental sample
  misc_feature (1)..(540): n is a, c, g, or t

SEQ ID NO: 5632 - protein, 179 aa, Unknown; identical to SEQ ID NO: 3682
  Obtained from environmental sample
  misc_feature (1)..(179): Xaa is any amino acid

SEQ ID NO: 5633 - DNA, 801 bp, Unknown
  Obtained from environmental sample
  misc_feature (1)..(801): n is a, c, g, or t
gtgtatggttacaacccggtgcccaaagagcttaatgccggacaggcaaaatatatcatgggttcacaggcaaacctgtggacggaatacataggcaacacacgcaaagtagagtacatgatctttccacgcatgagcgccttgagcgaagtattgtggaccgaacctgcaaataaaacctggagcgattttgaaaagcgcatgcaaacacaattcaaccggtacaggttgtggggagccaacttcagcaatgcatactatggtgttgatgctgccataacaccagcacccggcaacaaagggttgcaggtaaaattgcgatcaaaagacaagggtggaaaaattacctatgccatagcaggcaagcattttgcaaaaaattataccaaaccctttgttgtaactgaagatgcgcagctaacaacgctttatataaaaaacggaaacctgcttgattcgtttacgcttaatataaaaatgaacaaggccaccgggaaaaaaatatcattgtcgcagcctccctcttccacctatcctggtgaaggcgggtttactttggtaaatggaattgtaaatgaaatgggcctggcaagagcaaaagaatttatcgggtaccgtggaagcaatatgcaagcgatccttgacctaggcacaccgcaaaaaatatccagtgtggtagtaaatacaattaccaacaggtggaagccgggtatatgcaccagaatcagcggaggcaattattccttgatggaaacttataaacactgggaaaaactgcgaattaattcccaatgcgggtaa

SEQ ID NO: 5634 - protein, 266 aa, Unknown
  Obtained from environmental sample
  misc_feature (1)..(266): Xaa is any amino acid
MYGYNPVPKELNAGQAKYIMGSQANLWTEYIGNTRKVEYMIFPRMSALSEVLWTEPANKTWSDFEKRMQTQFNRYRLWGANFSNAYYGVDAAITPAPGNKGLQVKLRSKDKGGKITYAIAGKHFAKNYTKPFVVTEDAQLTTLYIKNGNLLDSFTLNIKMNKATGKKISLSQPPSSTYPGEGGFTLVNGIVNEMGLARAKEFIGYRGSNMQAILDLGTPQKISSVVVNTITNRWKPGICTRISGGNYSLMETYKHWEKLRINSQCG

SEQ ID NO: 5635 - DNA, 441 bp, Unknown
  Obtained from environmental sample
  misc_feature (1)..(441): n is a, c, g, or t
gtgctgatgctaaattacgttcagttcttgacaagttttcntattaaaaagcaaatcagcgattgtancancgannccggctcaatcatggggagagtttttcagcancggatncggtgggcaagcaaagccgatcgttatgatgataaccggatcttttgggtactgtattgggtttacctgctgaatattgcttcnctggttacagccatcgcttcgttctggaaaaatatctggcttttcttcttctgtattttattgctggctaaaattcttattgagttcccttttgtaaatgctgttgccgcttttttcggccgacagtcgctgatgaaatattttccttttcttcaacccctgcatattttatatactattattgcgggatggctgggtaagtttggacattataaatggaaggggagaaaaataaagaaatga

SEQ ID NO: 5636 - protein, 146 aa, Unknown
  Obtained from environmental sample
  misc_feature (1)..(146): Xaa is any amino acid
MLMLNYVQFLTSFXIKKQISDCXXXXGSIMGRVFQXRXRWASKADRYDDNRIFWVLYWVYLLNIASLVTAIASFWKNIWLFFFCILLLAKILIEFPFVNAVAAFFGRQSLMKYFPFLQPLHILYTIIAGWLGKFGHYKWKGRKIKK

SEQ ID NO: 5637 - DNA, 843 bp, Unknown
  Obtained from environmental sample
  misc_feature (1)..(843): n is a, c, g, or t
ttgcatccaagagatacgtttaatttaatccgggttttaaaagagcttcgtgaccttggcaacactgttgttgttgtggaacacgatgaaatgatgatgcgtgaagccgatcatattattgatatgggaccgctggcttcgcatttaggtggagaagtaattgctgagggcaactatgatgcaattatttctaaccccgaaagtcttacggggaaatatctaaagggtgaattaacaatcgatcctccaaaaaaattacgcaagttccaggaatccataattattgaaggcgcccgccagcataatttaaaagacatcacagttgaatttccgttgaatgtgctttgtgtggtaagtggtgttagcggaagcggaaaaacaacgttgatcaaacacattttgtatcctgctttaaaaaaattgcaaggtgaagctgcggataaagtgggcttccatcgtgctattaaaggcaatatagattctatcgcacatgtggaaatggtcgatcaaaatcccattggaaaatcgtcaagaagtaatccggttacgtacataaaagcctgggataatattcgtgacctgtatgcttcgcaacctttgagtaaaatgcgtggctttcagcccaagcatttttcgtttaatgtagatggaggaagatgtgacgcttgcaagggcgagggagagaaaattgtagaaatgcaatttttggccgacgttcatcttacgtgcgaagtctgncgaggaaaacggttcaaggaagaagtgctggaagtggagtacaaaggaaaaaatgtgtttgatgttctggaaatgagcgtagacgaaaccattgagtttttttaa

SEQ ID NO: 5638 - protein, 280 aa, Unknown
  Obtained from environmental sample
  misc_feature (1)..(280): Xaa is any amino acid
MHPRDTFNLIRVLKELRDLGNTVVVVEHDEMMMREADHIIDMGPLASHLGGEVIAEGNYDAIISNPESLTGKYLKGELTIDPPKKLRKFQESIIIEGARQHNLKDITVEFPLNVLCVVSGVSGSGKTTLIKHILYPALKKLQGEAADKVGFHRAIKGNIDSIAHVEMVDQNPIGKSSRSNPVTYIKAWDNIRDLYASQPLSKMRGFQPKHFSFNVDGGRCDACKGEGEKIVEMQFLADVHLTCEVXRGKRFKEEVLEVEYKGKNVFDVLEMSVDETIEFF

SEQ ID NO: 5639 - DNA, 579 bp, Unknown
  Obtained from environmental sample
  misc_feature (1)..(579): n is a, c, g, or t
atgcttcataacaaactcataggaaagaaaatcatacttgcttcaggttcgccccgacgccagcagttctttaaagatttggatctggattttgaaatacgcttaaaagaaatcgaagaaatttttccacctcatttacagtctttccatatcaccaattatttagcgcaactcaaagctgacgcatttacagatttaggcgaaaacgatctactaattacaagtgatactttagtttggctcggaaatgaagctttaggaaaacctatcgatgaaaatgatgctattaaaatgcttcagaagttgtccggaaaaacacacgaggtagttacttctgtttgttttaaaaccaaaaccaaaagcgatgttatccacgatataaccaaagttactttcgcagaattaaatttagaagccatcgaatattacattcaaaattataaacctttagacaaagccggaagctacggaatccaagactggataggtcttgtaggcatttcanagattgaaggttcctataccaatgtagtaggattgccaaccgaaaaggtataccaatatctgttaaaattgtaa

SEQ ID NO: 5640 - protein, 192 aa, Unknown
  Obtained from environmental sample
  DOMAIN (9)...(192): Maf-like protein
  misc_feature (1)..(192): Xaa is any amino acid
MLHNKLIGKKIILASGSPRRQQFFKDLDLDFEIRLKEIEEIFPPHLQSFHITNYLAQLKADAFTDLGENDLLITSDTLVWLGNEALGKPIDENDAIKMLQKLSGKTHEVVTSVCFKTKTKSDVIHDITKVTFAELNLEAIEYYIQNYKPLDKAGSYGIQDWIGLVGISXIEGSYTNVVGLPTEKVYQYLLKL

SEQ ID NO: 5641 - DNA, 381 bp, Unknown; identical to SEQ ID NO: 1795
  Obtained from environmental sample
  misc_feature (1)..(381): n is a, c, g, or t

SEQ ID NO: 5642 - protein, 126 aa, Unknown; identical to SEQ ID NO: 1796
  Obtained from environmental sample
  misc_feature (1)..(126): Xaa is any amino acid

SEQ ID NO: 5643 - DNA, 381 bp, Unknown
  Obtained from environmental sample
  misc_feature (1)..(381): n is a, c, g, or t
ttgaatntgggaaaacagaaaattcttttgaaaaccaaaaaaatcaaaatgccaacagtaagtatcgtatcatgtttctgtaccgtttctactggaattctaatgaatttgaatttagttacacacgaaaataaattgaaaaacactctggatctattgaaacagaataatcatcctgacgttgcatcaaagtgtgttgaagttctctcaagaatagtaaataacataatccttcatcccgatgatccaaaatacaccaagatttcctgtaatagcaaaacacttacagggaatgtattaaatacaaaatatggaatagatttccttcttaattgtggatttcaacgacaaggtgagtttgcgttgcatcacttggtctaa

SEQ ID NO: 5644 - protein, 126 aa, Unknown
  Obtained from environmental sample
  misc_feature (1)..(126): Xaa is any amino acid
MNXGKQKILLKTKKIKMPTVSIVSCFCTVSTGILMNLNLVTHENKLKNTLDLLKQNNHPDVASKCVEVLSRIVNNIILHPDDPKYTKISCNSKTLTGNVLNTKYGIDFLLNCGFQRQGEFALHHLV

SEQ ID NO: 5645 - DNA, 438 bp, Unknown
  Obtained from environmental sample
  misc_feature (1)..(438): n is a, c, g, or t
gtgaaaaaacttaaaaataaatctaaatatgtagccctatttaatataaagaagcgctacaataatttaattgttatagagttcagcgaatttgcaaatggagcacacctatgtgtgaagcaacctgttgaggaatttaatttaactacctataattcagtgcgaagtttgccatttaatcaactttgttattggtattcaaatcaggaggctgctaggataaagaatctatttcagcagtacgattctgggaggatattagagaatatacgatgcaaaggttgtctagatccagagatatggacacttgaaatatacaatcatggtaagtattcatcaatgacaaaggatgcatatggcgtttatgaaccttttatcgatagtttatttgctaaagttcatttgaataagtcaaataattttaagatcacttattag

SEQ ID NO: 5646 - protein, 145 aa, Unknown
  Obtained from environmental sample
  misc_feature (1)..(145): Xaa is any amino acid
MKKLKNKSKYVALFNIKKRYNNLIVIEFSEFANGAHLCVKQPVEEFNLTTYNSVRSLPFNQLCYWYSNQEAARIKNLFQQYDSGRILENIRCKGCLDPEIWTLEIYNHGKYSSMTKDAYGVYEPFIDSLFAKVHLNKSNNFKITY

SEQ ID NO: 5647 - DNA, 492 bp, Unknown
  Obtained from environmental sample
  misc_feature (1)..(492): n is a, c, g, or t
gtgagtttttctgatcccgatacttcagtgtcaggaattaagataggagatgcaaatagcacaacggccattattggggaaaatgaaaagtactatcaggatgaagtatatcattactattccaaaaacaaaaacgagatattgtctatggttacccaccccggtgatgttaattatagtatgagcatatttaatgttcggtcagctggcaaaaaaaaatatccgtataagacattgaacatagaacattttaaaaccgaaaaaggaataatgcttggcttaaataaagagcaaattatttccaaactcgggagctgttatgttgtaaaagacagtgcgaaaggatatatagagctttattatagcatagaagcaccaaatgatagcaaaacaaaattattagagagtcagaacatgcctatatattatgcttcttacattcttcgtaacgataaactccagaagtttgaatttgggtttgagtatccttaa

SEQ ID NO: 5648 - protein, 163 aa, Unknown
  Obtained from environmental sample
  misc_feature (1)..(163): Xaa is any amino acid
MSFSDPDTSVSGIKIGDANSTTAIIGENEKYYQDEVYHYYSKNKNEILSMVTHPGDVNYSMSIFNVRSAGKKKYPYKTLNIEHFKTEKGIMLGLNKEQIISKLGSCYVVKDSAKGYIELYYSIEAPNDSKTKLLESQNMPIYYASYILRNDKLQKFEFGFEYP

SEQ ID NO: 5649 - DNA, 525 bp, Unknown
  Obtained from environmental sample
  misc_feature (1)..(525): n is a, c, g, or t
atgaacaaattaatttttgctaccaataaccagcataaggtaaatgaaattaagcgtgtgattggcgacttattcaatatcatctctttaaaagaagcaggaattaccattgatattcctgaacctcatgataccctggagcaaaatgcaagtgaaaaatcacgtaccatttttgaacttaccaatgtaaactgctttagcgaagataccggactcgaaacggaggcattaaacggagcaccgggtgtaaaaagcgcaagatatgcaggagaagaaagcaattcctataataacgtcagaaaattgttggacgctttggaaggtgcaacanatcggaaggcgaggtttagaacggttatctctctgatcgatggtggtaaagaatatttatttgaaggaatatgtgaaggagcgattaaccacaaacctttgggcgataaagggttggatacgattctgtttttataccggcaggcagtaaccgtacttttgccgaaatggatgttgaagaaaaaaacattttag

SEQ ID NO: 5650 - protein, 174 aa, Unknown
  Obtained from environmental sample
  DOMAIN (4)...(167): Ham1 family
  misc_feature (1)..(174): Xaa is any amino acid
MNKLIFATNNQHKVNEIKRVIGDLFNIISLKEAGITIDIPEPHDTLEQNASEKSRTIFELTNVNCFSEDTGLETEALNGAPGVKSARYAGEESNSYNNVRKLLDALEGATXRKARFRTVISLIDGGKEYLFEGICEGAINHKPLGDKGLDTILFLYRQAVTVLLPKWMLKKKTF

SEQ ID NO: 5651 - DNA, 600 bp, Unknown
  Obtained from environmental sample
  misc_feature (1)..(600): n is a, c, g, or t
atgaaaaaactacacattctttacctggaagattcggaacatgacgcggaactcaccgccaggacccttaaaaaatcaggattagattttgatctcgaactggtggatacccaggaagaatatgtgcaggcgctcgaccagggaaaagccgaccttgtattggccgaccattccctggttcaatttaattcagtagaagccctccggatctttaaaaaatacgagtataagatcccttttattttggtaaccggtaccgtatcggaagagtttgcggtcgacatcctcaaagaaggtgcacacgactacctgttaaagaataacctcaccaggcttccaaatgcgatccttaactccctggagaaattccagattgaagaagaaaagcagcagtacctccaggatgtgatcactaacgaggcattgctccgggaggccgagcacctggcacatattggaagctgggcaatggacgttcagaccggtattacaaaatggtccgatgaaaatttcaggatattcgggtatgagccgggggagataaagccctgcctcgaccagtttaaaaagcatattcacccggagacaggcaagctatga

SEQ ID NO: 5652 - protein, 199 aa, Unknown
  Obtained from environmental sample
  DOMAIN (4)...(124): Response regulator receiver domain
  misc_feature (1)..(199): Xaa is any amino acid
MKKLHILYLEDSEHDAELTARTLKKSGLDFDLELVDTQEEYVQALDQGKADLVLADHSLVQFNSVEALRIFKKYEYKIPFILVTGTVSEEFAVDILKEGAHDYLLKNNLTRLPNAILNSLEKFQIEEEKQQYLQDVITNEALLREAEHLAHIGSWAMDVQTGITKWSDENFRIFGYEPGEIKPCLDQFKKHIHPETGKL

SEQ ID NO: 5653 - DNA, 432 bp, Unknown
  Obtained from environmental sample
  misc_feature (1)..(432): n is a, c, g, or t
atgattgttggtaaaaataaaatcgaacttgtgtggcacatatttttttattactccagggcaattcataaacgcagcatgaaaaaatcacaaatatggtccatacttaaccttttggctttaatgctgcacgtgaccttgtcttatcttacccaattcaaacttgttaatgaacaggatgtaggccaggtttccgatgcttacgaatccatttttacaccagccggtatcacgtttgctatatggggtgtcatctacacggcactgctcttttttagtatctaccatctccggatggcgttcaagaaagaggactcacatcacgccaacaaaaatattctcagttcgggtccatggttcatatcaaataatattggcgccgccacctggctgatgtacgacaaaaggatatccaaaataatcgnnnnntaa

SEQ ID NO: 5654 - protein, 143 aa, Unknown
  Obtained from environmental sample
  misc_feature (1)..(143): Xaa is any amino acid
MIVGKNKIELVWHIFFYYSRAIHKRSMKKSQIWSILNLLALMLHVTLSYLTQFKLVNEQDVGQVSDAYESIFTPAGITFAIWGVIYTALLFFSIYHLRMAFKKEDSHHANKNILSSGPWFISNNIGAATWLMYDKRISKIIXX

SEQ ID NO: 5655 - DNA, 690 bp, Unknown
  Obtained from environmental sample
  misc_feature (1)..(690): n is a, c, g, or t
gtggcttcgcatgatttgcaagagcctcttcgaaaaataagagcattcggagatcggctcgtgtcgcggtataaagagaaactcgacggtcccggggaagattatatcaaaagaatgcagtctgcttcctcgcgcatgcagacgttgatcgaagatttgctttcgttctcacgcgtatctcgaagcaacgaagtttttcagcacctggacatggatcaaattatggcggaaattcatgaggacctcgatatacaaattaagcgagaaaaagctgtgattaaaattggcagcttgccgtcggtaaccggcgaaaaaatgcagatcaaacgcttatttcaaaacttaattaataatgctgtcaaatttcataaaccgaatgaaattccagttgttgaagtatatgggaaacccataaaatggcaggagataaaaaaagagtttggtgtttccttaccggacaatgcttatgcgaggattacagttaaagataatggtattggattcgatgaaaaattcaatgacaagatttttaacattttccagcgcttgcatggcagaacggattatgaaggaacaggtattggtttagcgatttgcagaaaaattgttaccaaccataaaggatttattaccgccaagagtaaggaaaacataggctctgaatttatagttatattacctgcaggttaa

SEQ ID NO: 5656 - protein, 229 aa, Unknown
  Obtained from environmental sample
  DOMAIN (1)...(62): His Kinase A (phosphoacceptor) domain
  misc_feature (1)..(229): Xaa is any amino acid
MASHDLQEPLRKIRAFGDRLVSRYKEKLDGPGEDYIKRMQSASSRMQTLIEDLLSFSRVSRSNEVFQHLDMDQIMAEIHEDLDIQIKREKAVIKIGSLPSVTGEKMQIKRLFQNLINNAVKFHKPNEIPVVEVYGKPIKWQEIKKEFGVSLPDNAYARITVKDNGIGFDEKFNDKIFNIFQRLHGRTDYEGTGIGLAICRKIVTNHKGFITAKSKENIGSEFIVILPAG

SEQ ID NO: 5657 - DNA, 522 bp, Unknown
  Obtained from environmental sample
  misc_feature (1)..(522): n is a, c, g, or t
atgattacaattatttcaggtaccaatcgttcacacagtaacaccttaaaagtggcaagaatttattcgcaactaatggaaaaacagggtgttaagcctaaattactgtccctggaaaaggttcctgcagatattgcattcaatgaattattcaataaccgttctccggcctttcaacaaattttggatgaatacattatccctgcacaaaaattcgtgattatttcccccgaatacaatggtagttttccgggaattttaaaaacctttattgatgctattcatccggatgtcaaccggggcaaaaaagtagctttggtaggtgtttcaaccggccgtgcgggtaatttgagaggaatggatcacctgacaggaattttaaattacctcggttttcatgtgatgcctaataaattacctatttcaaccgttttaacattgctggatgaaaaaagtaacattaaagatgagaacaccgttatggtattggaaaaacatattgcagattttttaaagtattaa

SEQ ID NO: 5658 - protein, 173 aa, Unknown
  Obtained from environmental sample
  DOMAIN (2)...(165): NADPH-dependent FMN reductase
  misc_feature (1)..(173): Xaa is any amino acid
MITIISGTNRSHSNTLKVARIYSQLMEKQGVKPKLLSLEKVPADIAFNELFNNRSPAFQQILDEYIIPAQKFVIISPEYNGSFPGILKTFIDAIHPDVNRGKKVALVGVSTGRAGNLRGMDHLTGILNYLGFHVMPNKLPISTVLTLLDEKSNIKDENTVMVLEKHIADFLKY

SEQ ID NO: 5659 - DNA, 525 bp, Unknown
  Obtained from environmental sample
  misc_feature (1)..(525): n is a, c, g, or t
ttggctcaaatgcctgttgcagaacccgatgtagtgcttatggatttacgcatgcctttgaaagatggaatagaaacaacaaaagttttaagtaaacaatacccccatgtcaatgtaatcattttgagcatgtatgaagatgaaagatttgtttatcatcttatggaaaacggagctcatggttatttactaaaaaatgcagagccccaggaaattaggcgggcaataatggaggttcatgaaaaaggatattaccttaataattttgtaaatcgcatcctgctgaagcgaacgcacaagcaaaacgtggtgccttccatcagcagtgaaataactttaactgatagggaaaaagacgttttgaaatttatatgcatggaatttactgcccaggaaatagcacagaaaatggaaattagtccacgaacagtagaggctattaaagaccgcttaatggaacgttttggaagtaagaacacagcgggtctggtgttcttcgcagtaaaaaacaacctggttgattaa

SEQ ID NO: 5660 - protein, 174 aa, Unknown
  Obtained from environmental sample
  DOMAIN (2)...(84): Response regulator receiver domain
  misc_feature (1)..(174): Xaa is any amino acid
MAQMPVAEPDVVLMDLRMPLKDGIETTKVLSKQYPHVNVIILSMYEDERFVYHLMENGAHGYLLKNAEPQEIRRAIMEVHEKGYYLNNFVNRILLKRTHKQNVVPSISSEITLTDREKDVLKFICMEFTAQEIAQKMEISPRTVEAIKDRLMERFGSKNTAGLVFFAVKNNLVD

SEQ ID NO: 5661 - DNA, 453 bp, Unknown; identical to SEQ ID NO: 3531
  Obtained from environmental sample
  misc_feature (1)..(453): n is a, c, g, or t

SEQ ID NO: 5662 - protein, 150 aa, Unknown; identical to SEQ ID NO: 3532
  Obtained from environmental sample
  misc_feature (1)..(150): Xaa is any amino acid

SEQ ID NO: 5663 - DNA, 630 bp, Unknown
  Obtained from environmental sample
  misc_feature (1)..(630): n is a, c, g, or t
atgacgcaatatgttgtacagcaagcagatagcaatgtcagggttgctaatccggagtacagtaatctgtcttattatataaaaaaaacaaacgaaaaaataaacagaagaatagctgaattacataatttaacgaataaaaatattgaacacagtttggacacaacaaaaccatatttaaaaaagctggcaaaattaaatgaagaaattgagggtttgattactcaggttgaaaattataaaaagcagcggagtgaaacaccaagcagaatcaaaatcggcgaaatgcctgaaaatttcagatataacagacttgataccgaaagtaaacacttccagaacatcattaaaatgatttgttacagagccgaaacctcttgtgcaaatgtatttgccgatttttacggaaaatacgaaaatgaaaaaagagatttagttaaatgtattataaacacaagaggagatataatagccgactacaaaaacaatattctgaccgtcagtttatattcacttgcaaatccaagaatgaacagagctctcgaaatgttgtgtaatttaattaatgaagcggaggtcaaatatcccggtaccgaaatgtccctttttttcaaaactgcgaactcctga

SEQ ID NO: 5664 - protein, 209 aa, Unknown
  Obtained from environmental sample
  misc_feature (1)..(209): Xaa is any amino acid
MTQYVVQQADSNVRVANPEYSNLSYYIKKTNEKINRRIAELHNLTNKNIEHSLDTTKPYLKKLAKLNEEIEGLITQVENYKKQRSETPSRIKIGEMPENFRYNRLDTESKHFQNIIKMICYRAETSCANVFADFYGKYENEKRDLVKCIINTRGDIIADYKNNILTVSLYSLANPRMNRALEMLCNLINEAEVKYPGTEMSLFFKTANS

SEQ ID NO: 5665 - DNA, 831 bp, Unknown
  Obtained from environmental sample
  misc_feature (1)..(831): n is a, c, g, or t
atgaaacttgcagaaaaaaatacggaacttaaccgggtttctttgcgggaagtacgtaaattatctcaggacggacatcagacttcaattatcactacaaataaaaaaattgtattaactgaaattgcaacaaatatgttttcgcgatggacacaggaaaattactttaaatatttaagaagtaattacgactttgacagaatgacgcaatatgttgtacagcaagcagatagcaatgtcagggttgctaatccggagtacagtaatctgtcttattatataaaaaaaacaaacgaaaaaataaacagaagaatagctgaattacataatttaacgaataaaaatattgaacacagtttggacacaacaaaaccatatttaaaaaagctggcaaaattaaatgaagaaattgagggtttgattactcaggttgaaaattataaaaagcagcggagtgaaacaccaagcagaatcaaaatcggcgaaatgcctgaaaatttcagatataacagacttgataccgaaagtaaacacttccagaacatcattaaaatgatttgttacagagccgaaacctcttgtgcaaatgtatttgccgatttttacggaaaatacgaaaatgaaaaaagagatttagttaaatgtattataaacacaagaggagatataatagccgactacaaaaacaatattctgaccgtcagtttatattcacttgcaaatccaagaatgaacagagctctcgaaatgttgtgtaatttaattaatgaagcggaggtcaaatatcccggtaccgaaatgtccctttttttcaaaactgcgaactcctga

SEQ ID NO: 5666 - protein, 276 aa, Unknown
  Obtained from environmental sample
  misc_feature (1)..(276): Xaa is any amino acid
MKLAEKNTELNRVSLREVRKLSQDGHQTSIITTNKKIVLTEIATNMFSRWTQENYFKYLRSNYDFDRMTQYVVQQADSNVRVANPEYSNLSYYIKKTNEKINRRIAELHNLTNKNIEHSLDTTKPYLKKLAKLNEEIEGLITQVENYKKQRSETPSRIKIGEMPENFRYNRLDTESKHFQNIIKMICYRAETSCANVFADFYGKYENEKRDLVKCIINTRGDIIADYKNNILTVSLYSLANPRMNRALEMLCNLINEAEVKYPGTEMSLFFKTANS

SEQ ID NO: 5667 - DNA, 570 bp, Unknown
  Obtained from environmental sample
  misc_feature (1)..(570): n is a, c, g, or t
atgtctgttaaaggtttcgatcgctacaaacgactcttcaaaaatatttcaaactggcaggaatatgcttttcataagggagaaagaaaaaagcgatcactggaatttgttacacgtccgaacccgataaaatttgaggtgccggaaagtttgtaccaggttttcaaagaaatttttatggaagatttttatgaagccgatcaaatgataaaaaaacttccggccagtcctttagttatagatgtaggtgctaatgctggcttttttaatgtattgttgttttcgaaattaaaaaccgccagggtatttgcatacgaaccacttccttcaaacatcgggctttttaaaaagactattcaacaaaatgaatcattaaaaaacatacagcttgcgcaactagctattacaggcacatcaaatgacagcatagatttatttacagaaaacactgaagacaatacagtagtatcctcagtttttgcaggcttcaataagctcaatcagaaaaaattacggttccggccaagtctctcgctgccatcattgaacaaaataatctggagaaaatag

SEQ ID NO: 5668 - protein, 189 aa, Unknown
  Obtained from environmental sample
  misc_feature (1)..(189): Xaa is any amino acid
MSVKGFDRYKRLFKNISNWQEYAFHKGERKKRSLEFVTRPNPIKFEVPESLYQVFKEIFMEDFYEADQMIKKLPASPLVIDVGANAGFFNVLLFSKLKTARVFAYEPLPSNIGLFKKTIQQNESLKNIQLAQLAITGTSNDSIDLFTENTEDNTVVSSVFAGFNKLNQKKLRFRPSLSLPSLNKIIWRK

SEQ ID NO: 5669 - DNA, 726 bp, Unknown
  Obtained from environmental sample
  misc_feature (1)..(726): n is a, c, g, or t
gtgggaatagcttcccatgagttaaaaacgcccattacgagtataaaagcgtatacacaacttttacaatacagatgtagaaaagctcaggattccaaatcagtggaacttgttacaaaaatggatgtccaactagataaactcacctcattggtaagcgatctaatcgatattactaaaatagacggacgaagaatcaaatttaatgaagaaaattttgactttaatgagctggtaaatgaaatagttgaagagttgcaacgaacttcattacaacacgtactcattacaaaacttactgtctcaaaaaatatctatggagacagaaatagaattggacaggtactgacaaaccttattacaaacgcaattaaatattctccacgcgctaaaaaagtaataattaaaactaaggtagataaaaataatattttccttttcgttcaggattttggtattggtattgctgaaaaagctcaattaaaagtgtttgaacgatttttcagggttggtgataaaggacaagaaacatttcccggattggggttgggtctttacatttccgctgagataatcaaccggcataacggtaaaatcagggtagaaagtaaaaagggtaaaggatcaattttttggtttcaattaccaattaaacagaaaacgagtgataaaaaaactattattgattctcctatcaaaaaggggatgtttcatgaaggtcaataa

SEQ ID NO: 5670 - protein, 241 aa, Unknown
  Obtained from environmental sample
  DOMAIN (1)...(64): His Kinase A (phosphoacceptor) domain
  misc_feature (1)..(241): Xaa is any amino acid
MGIASHELKTPITSIKAYTQLLQYRCRKAQDSKSVELVTKMDVQLDKLTSLVSDLIDITKIDGRRIKFNEENFDFNELVNEIVEELQRTSLQHVLITKLTVSKNIYGDRNRIGQVLTNLITNAIKYSPRAKKVIIKTKVDKNNIFLFVQDFGIGIAEKAQLKVFERFFRVGDKGQETFPGLGLGLYISAEIINRHNGKIRVESKKGKGSIFWFQLPIKQKTSDKKTIIDSPIKKGMFHEGQ

SEQ ID NO: 5671 - DNA, 411 bp, Unknown
  Obtained from environmental sample
  misc_feature (1)..(411): n is a, c, g, or t
ttgatagccaccactattttctatattgttacccaaaaaaacaaacctctttcaccaaaatccttcagagaaatgattccaaaaggatttccaacggtgggaattgatgtttcccatcaccagggagaaatggattgggatgaattatttaataaaagtggttatgattctttgatacagtttgtttattgcaaagctacggaaggagacactcatattgatactcagtgggaacgcaatcgaaaacaattaaacaatttaggaattcccaatggagcctatcatttttttcgttccaaagaagattcaaaatcacaagtccagcattttttgaaacattggaagaaaagagatattgatttaccacctgttttagatgtcgaaacagaagtgtttctgacgaagacctga

SEQ ID NO: 5672 - protein, 136 aa, Unknown
  Obtained from environmental sample
  DOMAIN (35)...(136): Glycosyl hydrolases family 25
  misc_feature (1)..(136): Xaa is any amino acid
MIATTIFYIVTQKNKPLSPKSFREMIPKGFPTVGIDVSHHQGEMDWDELFNKSGYDSLIQFVYCKATEGDTHIDTQWERNRKQLNNLGIPNGAYHFFRSKEDSKSQVQHFLKHWKKRDIDLPPVLDVETEVFLTKT

SEQ ID NO: 5673 - DNA, 312 bp, Unknown
  Obtained from environmental sample
  misc_feature (1)..(312): n is a, c, g, or t
ttgttaattgcatttccttattacgcaaaaatattttatccaaagcctcaggaagcaaaagttattattgttgataaaagcaatatacagactgcagaatttaaaataaaaggtatgacctgcgaaggctgtacagaacatataaacagcgaactttcaaaaacatcgggagtgattgagttcaatacttcttatgaaaaaggcagcagccttgttaagtttgacaacagtaaaacttccgttgacagccttgtatccgtcattaataaaactggctataaagtaacttctcaatcagtaatcaacaactaa

SEQ ID NO: 5674 - protein, 103 aa, Unknown
  Obtained from environmental sample
  DOMAIN (33)...(97): Heavy-metal-associated domain
  misc_feature (1)..(103): Xaa is any amino acid
MLIAFPYYAKIFYPKPQEAKVIIVDKSNIQTAEFKIKGMTCEGCTEHINSELSKTSGVIEFNTSYEKGSSLVKFDNSKTSVDSLVSVINKTGYKVTSQSVINN

SEQ ID NO: 5675 - DNA, 459 bp, Unknown
  Obtained from environmental sample
  misc_feature (1)..(459): n is a, c, g, or t
atggatccaagaatgcagtttttgcatttgcactggtatcaaaaactcaaaccgcaaaaacaaattgactgcgactgtgaggcagacaataaaaaatcattttggcaatcaaaagcatttttagctatcgttacagtagttgcaggattgttaattgcatttccttattacgcaaaaatattttatccaaagcctcaggaagcaaaagttattattgttgataaaagcaatatacagactgcagaatttaaaataaaaggtatgacctgcgaaggctgtacagaacatataaacagcgaactttcaaaaacatcgggagtgattgagttcaatacttcttatgaaaaaggcagcagccttgttaagtttgacaacagtaaaacttccgttgacagccttgtatccgtcattaataaaactggctataaagtaacttctcaatcagtaatcaacaactaa

SEQ ID NO: 5676 - protein, 152 aa, Unknown
  Obtained from environmental sample
  DOMAIN (82)...(146): Heavy-metal-associated domain
  misc_feature (1)..(152): Xaa is any amino acid
MDPRMQFLHLHWYQKLKPQKQIDCDCEADNKKSFWQSKAFLAIVTVVAGLLIAFPYYAKIFYPKPQEAKVIIVDKSNIQTAEFKIKGMTCEGCTEHINSELSKTSGVIEFNTSYEKGSSLVKFDNSKTSVDSLVSVINKTGYKVTSQSVINN

SEQ ID NO: 5677 - DNA, 300 bp, Unknown; identical to SEQ ID NO: 2663
  Obtained from environmental sample
  misc_feature (1)..(300): n is a, c, g, or t

SEQ ID NO: 5678 - protein, 99 aa, Unknown; identical to SEQ ID NO: 2664
  Obtained from environmental sample
  misc_feature (1)..(99): Xaa is any amino acid

SEQ ID NO: 5679 - DNA, 561 bp, Unknown
  Obtained from environmental sample
  misc_feature (1)..(561): n is a, c, g, or t
ttgttagcaactcagattgattttttaaataacataccagtgatatattttgtcagacattcatgtggtggtcaatatctcgcatatagaaataacaccggtattgaagatgtgtcaatagttgaaaacatgcagaatccatcagtcttatattccccgataatttcagtcgagaaattcccgaccatcttttggcgaagacccaaaggagcaaagaatatgaattatgcaccaatcaagttgagcaattttcaaagcctcgtaaaaatagcatcttacaagatgatttatgaagaatcaccgctccccctttttgtgtttaaaagtacgaagaagtcgaattatattgtgggcacagctctgaacatggccgaatctgatggggtttcctacttttactatgctgctattccggagaatcctaactattctttcatcaaatattctagtctgaaatcagaggatcctacatttactaacaacattggggaacatgggtatatttacatcaaactaataaaattacttggctctcatccattagtgaaagttgatgaataa

SEQ ID NO: 5680 - protein, 186 aa, Unknown
  Obtained from environmental sample
  misc_feature (1)..(186): Xaa is any amino acid
MLATQIDFLNNIPVIYFVRHSCGGQYLAYRNNTGIEDVSIVENMQNPSVLYSPIISVEKFPTIFWRRPKGAKNMNYAPIKLSNFQSLVKIASYKMIYEESPLPLFVFKSTKKSNYIVGTALNMAESDGVSYFYYAAIPENPNYSFIKYSSLKSEDPTFTNNIGEHGYIYIKLIKLLGSHPLVKVDE

SEQ ID NO: 5681 - DNA, 459 bp, Unknown
  Obtained from environmental sample
  misc_feature (1)..(459): n is a, c, g, or t
atgaaagaaaaacaaacagttaagcctgaaattgtaacacaggcagagtttcagatattttcagaaacgtttaaggcatttccgacagcgtttgtcaaagatgtaaaaattacagaatatcctaactccatttcaattacattttatgatgatgttgaaggtaaagctagagcgtctatgggtgactttgttaatggatttagcaaagtagctcgaacattaaaattagaaaacattaaccaagaaggcaggatatatcgcacgtcaaaaatagaaggcgtgtgctatagtccagtattacaaaagccattgctcgaagaagagtatagtacaggtataacagatcaacatacgtttacttacaatttttgctttagcagaattgtaaaggcgaatatctattcgacaggcgatgatgctgcagaactatcttgggaacaagaagaggaaaatttatga

SEQ ID NO: 5682 - protein, 152 aa, Unknown
  Obtained from environmental sample
  misc_feature (1)..(152): Xaa is any amino acid
MKEKQTVKPEIVTQAEFQIFSETFKAFPTAFVKDVKITEYPNSISITFYDDVEGKARASMGDFVNGFSKVARTLKLENINQEGRIYRTSKIEGVCYSPVLQKPLLEEEYSTGITDQHTFTYNFCFSRIVKANIYSTGDDAAELSWEQEEENL

SEQ ID NO: 5683 - DNA, 777 bp, Unknown
  Obtained from environmental sample
  misc_feature (1)..(777): n is a, c, g, or t
gtgattagccctgaatccatttcagcagctaaaaagaacgggtttcatgttgcgatggttgatggcggtagctcacaagcctttcttgatacggtcaaacttagcggaatacaaattgaaaaacaaaaagaagaaggcggtcaaggaccggcacgtaggcaaggcattgaattggctcaaaacgtacccggaattaaggttatagctagtgtcgagccggaaaaagtatctctcatcgcggattgtattaagctggcatcagaacccattcttaaaggtgaggcagatatagttgtccctagaagaattgcaaaaagcatggagacctaccctgtccatcaagctaagcaagaagcaaaatcgaataaaatatataatgctattttaagatcaagaggtttactaaaaaaggaagatcctgatttggatttttggggcggaacaagaattttcgtaaacaaacctgaggttcgtgaactctttaacgtcaaaagaaaattcgaacctggaaaaacgaagttagatcagaaagtacggatggaaatgtactcaaacccgctctttcacccggttgttgatgctttatataaagggcttaaggttaagtccgttgatatcccatatatccatccggcaaaacaaacattctttgaagctggaaataaagaatttgatcaaaaaagagatacccagagaagaactattgtgaccgaattagtacatcttaattcgtcagaaaggagaaagacaaaaaacccaaaaagaaatcccaattag

SEQ ID NO: 5684 - protein, 258 aa, Unknown
  Obtained from environmental sample
  misc_feature (1)..(258): Xaa is any amino acid
MISPESISAAKKNGFHVAMVDGGSSQAFLDTVKLSGIQIEKQKEEGGQGPARRQGIELAQNVPGIKVIASVEPEKVSLIADCIKLASEPILKGEADIVVPRRIAKSMETYPVHQAKQEAKSNKIYNAILRSRGLLKKEDPDLDFWGGTRIFVNKPEVRELFNVKRKFEPGKTKLDQKVRMEMYSNPLFHPVVDALYKGLKVKSVDIPYIHPAKQTFFEAGNKEFDQKRDTQRRTIVTELVHLNSSERRKTKNPKRNPN

SEQ ID NO: 5685 - DNA, 351 bp, Unknown
  Obtained from environmental sample
  misc_feature (1)..(351): n is a, c, g, or t
atggaaagaaataaaatgagcataccatttcaagtaatagattggaataagattccagaagaagaacacaaaggagaaaccggaacatctttttggcaaacattacaatatgccggtttgcgtgttcgtatagttgagtacagtgcgggataccttgctgatcattggtgcaagaaaggacaccttgtgcactgccttgaaggagaagttttgaatgaacaggaaaatggcgagaaatatttgcttaaaaaaggtatgacttacattgtttctgacgatttaagcagtcatcgttcaatagcaaaagaaaaagtaaaactactgattattgatggtgattttttaaaataa

SEQ ID NO: 5686 - protein, 116 aa, Unknown
  Obtained from environmental sample
  misc_feature (1)..(116): Xaa is any amino acid
MERNKMSIPFQVIDWNKIPEEEHKGETGTSFWQTLQYAGLRVRIVEYSAGYLADHWCKKGHLVHCLEGEVLNEQENGEKYLLKKGMTYIVSDDLSSHRSIAKEKVKLLIIDGDFLK

SEQ ID NO: 5687 - DNA, 759 bp, Unknown
  Obtained from environmental sample
  misc_feature (1)..(759): n is a, c, g, or t
gtgttaaacctttttaacgggctagaaaggggaagaaatttctttatggacagggtaactgattatactgaacacaagattttgattgaaattgaaagaatctttaatctaactgttttttacggaagggatgcagaatggcctgatgtaataaagcgctgccggcgttacccaatgttttcggacaggcagttagtagtgctaaaagaagcccagtccatgcgaaatatagaaaagctggagtcgtacatagaaaagcctttgtcctctaccatccttgttgtggcttataaaaataaaaaggtggatggaagaacaaaactggcgaagctgctaaaggaaaagggcacaatactgagtacaaaaaagctgtatgataatgatttgcccgaatggacgcaacaattagtaaagtcaaaaggttattcaataaacaggaaagctctttttcttttaattgaccatattggtaacgaccttaaccggctaaataatgaaatagataaacttgcattgaaccttggaaacagggatacaattaccgaggatgatattgaaacttatgttggcataagcaaagagtttaatgtttttgaattgcaacatgccattgccagccgcgatctgtacaaagccgtacgcattattaactatttcgaagcaaaccctaaggctgctcccatgcagttgatactaccttctttgtataattttttcagtaaagtgcaaatgatttattcaatttcttnccagggatga

SEQ ID NO: 5688 - protein, 252 aa, Unknown
  Obtained from environmental sample
  misc_feature (1)..(252): Xaa is any amino acid
MLNLFNGLERGRNFFMDRVTDYTEHKILIEIERIFNLTVFYGRDAEWPDVIKRCRRYPMFSDRQLVVLKEAQSMRNIEKLESYIEKPLSSTILVVAYKNKKVDGRTKLAKLLKEKGTILSTKKLYDNDLPEWTQQLVKSKGYSINRKALFLLIDHIGNDLNRLNNEIDKLALNLGNRDTITEDDIETYVGISKEFNVFELQHAIASRDLYKAVRIINYFEANPKAAPMQLILPSLYNFFSKVQMIYSISXQG

SEQ ID NO: 5689 - DNA, 528 bp, Unknown
  Obtained from environmental sample
  misc_feature (1)..(528): n is a, c, g, or t
gtgacagtttacgacgaatctcacattggacacgcaagaactattattatatttgatgtcttacatagatatcttttatcgagacaccataaagtaacattcattcaaaattttaccgatattgatgacaaaataataaaaaaagctaactctcttaataaagactacaaagaaatatctcaaaaatatatcaaacaatatttggaggatgcatctaaattaaacgttttaaaaggagttcattatccaaaggctactgaccatatctcaaatatgatagaattaataaaatatttgcttgaaaaaaattatgcatatattaccttaaatggaatttattttgaagtaaaaaaattttctcagtatggaaaattatctaagaaaacttctgaaagtattaattctggggtaagagtagagattgatcctacaaaaaaagatccgcttgattttgccttgtggaaattttcatctgtctcgcctatatgggaaagtacttggggagcaggtcgtccaggaaccacatag

SEQ ID NO: 5690 - protein, 175 aa, Unknown
  Obtained from environmental sample
  DOMAIN (2)...(175): tRNA synthetases class I (C) catalytic domain
  misc_feature (1)..(175): Xaa is any amino acid
MTVYDESHIGHARTIIIFDVLHRYLLSRHHKVTFIQNFTDIDDKIIKKANSLNKDYKEISQKYIKQYLEDASKLNVLKGVHYPKATDHISNMIELIKYLLEKNYAYITLNGIYFEVKKFSQYGKLSKKTSESINSGVRVEIDPTKKDPLDFALWKFSSVSPIWESTWGAGRPGTT

SEQ ID NO: 5691 - DNA, 660 bp, Unknown
  Obtained from environmental sample
  misc_feature (1)..(660): n is a, c, g, or t
atgatgatggtggggaggaagttttctgctacaaataattacaggtttggatttaatgggaaagaacaagatggcgaagtaaagggaactggggagcaatatgattatggatttagaatttatgatcctaggatcggaaaattcttatctgttgatccattatataaaacatatccatattacaccccgtatcaatttgctggaaatatgccgatagcagccattgatttagatggcttagaagtaaaggtttcttttgattttgcaactgtaacaaaagaccggactgccattgaaataaaatcttctgtttctattaaagttcaaataattaatttatcagcaattccaaatacagatttagatttacaaaatattgccctcaatcttagttcagatttatccaataagcttggtggtaaatctacggcgattatgactcttccatttatatttaaaagtaaaggcaatcatgtaattggtgtagagacagtaaaagattcaaaggatagtaaagactattccgttactttcaatacttatgttaccacagatatttcggtagttaatgatatttctaaaatagataaggatgcgtgggtatttgcaatagtagataatgtaaatgaccagaaaaacctgacgcttctggactgctga

SEQ ID NO: 5692 - protein, 219 aa, Unknown
  Obtained from environmental sample
  misc_feature (1)..(219): Xaa is any amino acid
MMMVGRKFSATNNYRFGFNGKEQDGEVKGTGEQYDYGFRIYDPRIGKFLSVDPLYKTYPYYTPYQFAGNMPIAAIDLDGLEVKVSFDFATVTKDRTAIEIKSSVSIKVQIINLSAIPNTDLDLQNIALNLSSDLSNKLGGKSTAIMTLPFIFKSKGNHVIGVETVKDSKDSKDYSVTFNTYVTTDISVVNDISKIDKDAWVFAIVDNVNDQKNLTLLDC

SEQ ID NO: 5693 - DNA, 462 bp, Unknown
  Obtained from environmental sample
  misc_feature (1)..(462): n is a, c, g, or t
atgaaaatactaaccattgtttttttagttggatttttttgcttcgttcaagctgaatcatcgataactcttgatgaggtgatccgaaatcatgttaaagcgatcggagggaaagaagcgatcgaaaaagtgaaatcactccaatataaattggaaattactgagccgaagttcaccgtgaatggagtttatcgtgccgatcgcaatatgcatatgcggattgatatttccaaggatggaaaagtcgtttacatcgaggctttcaatggtaagagtggatgggaagcccggagtgaagatggtcctcgaaatgattcaacccctgaaggtactgcaggtctttggcatggcattgtcatgcctgacaaattattcggacttcatgaaatggaatcgattggaaaccaggtgagtttggaaggcagaaaagcggtggatgaccattcattattatttgattaa

SEQ ID NO: 5694 - protein, 153 aa, Unknown
  Obtained from environmental sample
  SIGNAL (1)...(18)
  misc_feature (1)..(153): Xaa is any amino acid
MKILTIVFLVGFFCFVQAESSITLDEVIRNHVKAIGGKEAIEKVKSLQYKLEITEPKFTVNGVYRADRNMHMRIDISKDGKVVYIEAFNGKSGWEARSEDGPRNDSTPEGTAGLWHGIVMPDKLFGLHEMESIGNQVSLEGRKAVDDHSLLFD

SEQ ID NO: 5695 - DNA, 402 bp, Unknown; identical to SEQ ID NO: 1711
  Obtained from environmental sample
  misc_feature (1)..(402): n is a, c, g, or t

SEQ ID NO: 5696 - protein, 133 aa, Unknown; identical to SEQ ID NO: 1712
  Obtained from environmental sample
  DOMAIN (1)...(129): Conserved hypothetical protein 95
  misc_feature (1)..(133): Xaa is any amino acid

SEQ ID NO: 5697 - DNA, 585 bp, Unknown
  Obtained from environmental sample
  misc_feature (1)..(585): n is a, c, g, or t
ttggttatcagtttttttatgttccttacctcccaacaatatatccggtctttcctggaatacctgaaatttcagaaaagatattcccagcacactattatatcttacgaaaatgacctgatatcttactttgattttcagcaattacagttcaatgaatcattggcagagaatacaaaggctgcctttgtcaggtcatggcttgcctcactcaaagagcaaggcatgacctcaaaatcgatcatcaggaaaatctcttcacttaaatccttctttaaatacctgttacggcaacaggtaatagaggtgagcccaatggttacgattataagccctaaaactaataagcgccttccgaagtatattgaaaaggaagatgtggatacattgtttacccatgtggagtttcctgatacgtgggaaggaagaacgcaaaaactcgccctcgaacttttgtataatacaggcattcgtcaggctgaactgattaacctcaaagagatccaggtcgacatggcaaaccaggctaccaagtatttggaaagcagtaaagagcgaacttcggtcagtatcctagatccgtag

SEQ ID NO: 5698 - protein, 194 aa, Unknown
  Obtained from environmental sample
  DOMAIN (15)...(100): Phage integrase, N-terminal SAM-like domain
  misc_feature (1)..(194): Xaa is any amino acid
MVISFFMFLTSQQYIRSFLEYLKFQKRYSQHTIISYENDLISYFDFQQLQFNESLAENTKAAFVRSWLASLKEQGMTSKSIIRKISSLKSFFKYLLRQQVIEVSPMVTIISPKTNKRLPKYIEKEDVDTLFTHVEFPDTWEGRTQKLALELLYNTGIRQAELINLKEIQVDMANQATKYLESSKERTSVSILDP

SEQ ID NO: 5699 - DNA, 327 bp, Unknown
  Obtained from environmental sample
  misc_feature (1)..(327): n is a, c, g, or t
ttgggtaagatacttgatcgaattcagaaagaccaggacacctctggcagcagtcatggagataactttgtaatgagaaaagttggagaaacaattacaattaggttaaatacattttggcaaactgattttaaaatatctaaaagtagagtggttttcccagaacctttagcaccacnaaagattccaacaaagggttcatcaccaagtctaacattagggaaaaaattgaaatccattttagtttttttttataatatgtacatatatgattcattttttttgggtaaaaacaagtcctaccaccactcctgcacttgtcactaa

SEQ ID NO: 5700 - protein, 108 aa, Unknown
  Obtained from environmental sample
  misc_feature (1)..(108): Xaa is any amino acid
MGKILDRIQKDQDTSGSSHGDNFVMRKVGETITIRLNTFWQTDFKISKSRVVFPEPLAPXKIPTKGSSPSLTLGKKLKSILVFFYNMYIYDSFFLGKNKSYHHSCTCH

SEQ ID NO: 5701 - DNA, 885 bp, Unknown
  Obtained from environmental sample
  misc_feature (1)..(885): n is a, c, g, or t
atgtatagctggaatttcagaaaatacgaccctaatgcatttgcagataatccatttgaaaacttactaaagattttcaaagaactgctcatgtttacctctggcaatgtgagcgaatctcttaattggctcacgcaactcgacaggcaatacaatcttaccactcctgaatatggaatggctgattttatcagagacctgaaggagaaagggtacataaaagatgatggtaagaataggcatatggtcccggccgccaaaatggaactcgagttgcgaagaaaagcacttgatgatgtctttgatgacctgaaaaaatcaaaacggggcgatcataagacaaatgccataggacttggtgatgaagtgacctctgagataaaaccctatgaatggggagattctcttgatcagatagcggtgtctgagacaattaaaaatgcgcacatcaatcatggcatcgaggagttcagtctgacccaggaagacatgcagatccatgagagcttttaccagtctcaaatgagcactgtgttgatgatcgatatctctcactcgatgatcctctatggcgaagaccgcatcacacccgcaaaaaaagtggccatggcactctccgaactaatcaccacaaaatatccaaaagacaccctcgatatcattgtcttcggtgatgatgcatggcagatcgaaataaaagatcttccttacctgaaagtaggaccttatcataccaatacggtatccggacttgagcttgcgaaggagcttttacgaaaaagacggaatcccaataagcagatcatgatgatcaccgattggaaaaccaaactgcatcaagatcggcaagaagtattatcaaaacagttttgggctcgacaataa

SEQ ID NO: 5702 - protein, 294 aa, Unknown
  Obtained from environmental sample
  misc_feature (1)..(294): Xaa is any amino acid
MYSWNFRKYDPNAFADNPFENLLKIFKELLMFTSGNVSESLNWLTQLDRQYNLTTPEYGMADFIRDLKEKGYIKDDGKNRHMVPAAKMELELRRKALDDVFDDLKKSKRGDHKTNAIGLGDEVTSEIKPYEWGDSLDQIAVSETIKNAHINHGIEEFSLTQEDMQIHESFYQSQMSTVLMIDISHSMILYGEDRITPAKKVAMALSELITTKYPKDTLDIIVFGDDAWQIEIKDLPYLKVGPYHTNTVSGLELAKELLRKRRNPNKQIMMITDWKTKLHQDRQEVLSKQFWARQ

SEQ ID NO: 5703 - DNA, 450 bp, Unknown
  Obtained from environmental sample
  misc_feature (1)..(450): n is a, c, g, or t
atgacgtgcatagttaaagtaatacataattcgggacagcctagacgttatacatttactggtggtgataaagccaagttaaatgtgcgtatacaacattttccagcagatctcgatgctatagcggccgaactcaaagaatgtcttgtatttaagcggcgttatgaagtgatattcgattttaaatcggtatcagatcaaattcgcaattattatagctttcgagatgccatgatacggctcttgtatcgaaaggatccggaacaagatctagatgcaatcattgaaatagtcaaatttcatatggccaagggtaaacaccctgattttactaaatatgctgaacctaaattcttcaaaaaaatatccaattacatcaattccatcaccggcacctctgttccagtaaccggcactatcgaaatatgcaaacgcctcatgctctactag

SEQ ID NO: 5704 - protein, 149 aa, Unknown
  Obtained from environmental sample
  misc_feature (1)..(149): Xaa is any amino acid
MTCIVKVIHNSGQPRRYTFTGGDKAKLNVRIQHFPADLDAIAAELKECLVFKRRYEVIFDFKSVSDQIRNYYSFRDAMIRLLYRKDPEQDLDAIIEIVKFHMAKGKHPDFTKYAEPKFFKKISNYINSITGTSVPVTGTIEICKRLMLY

SEQ ID NO: 5705 - DNA, 813 bp, Unknown
  Obtained from environmental sample
  misc_feature (1)..(813): n is a, c, g, or t
atggctaatgtagcgatcatcatagcgcgtggcggaagcaaacgtattccccggaaaaatataaaagattttttagggaaaccaattatcgcttattctattgaaaccgctttaagatcaaacctgtttgattatgttatggtttcaaccgatgatgatgaaattgccggggtagctacaaaatatggtgcacaagtaccatttatgagaagcaaaaaaacatcggacgatctttcgacgactgcagatgttataattgaagtattggatagtttaaagaatataaacaaacaatttgagaacgtttgttgcatttatccaacagcaccgttcattagtatcaaaaatctttcaacaagctataataaactaatagataataatttcgatacggtatttccggtttgcaaatacagctcagctatacaacgcgcattgacaattgatgagaacgaaaaactaaaaatgatcttgcctgagatgatgaatattcgctctcaggatctaacaccagcatattatgatgcgggacaattttattggttaaggacagataaattccaattaaataaaaaaatatattccgataattccggctcagtgatcttaaatgagatggaagtacaggatattgataatttgatggattgggaactggcacaattaaaatttaaacttattaataaaacaaagatgggttataaaacccgaacaggagaattttgggccggaaatttgggcaaagaatacatttcaaggaaacatagcgaagaattgctcccatcaaatttaaattcctttctagggctttag

SEQ ID NO: 5706 - protein, 270 aa, Unknown
  Obtained from environmental sample
  DOMAIN (4)...(232): Cytidylyltransferase
  misc_feature (1)..(270): Xaa is any amino acid
MANVAIIIARGGSKRIPRKNIKDFLGKPIIAYSIETALRSNLFDYVMVSTDDDEIAGVATKYGAQVPFMRSKKTSDDLSTTADVIIEVLDSLKNINKQFENVCCIYPTAPFISIKNLSTSYNKLIDNNFDTVFPVCKYSSAIQRALTIDENEKLKMILPEMMNIRSQDLTPAYYDAGQFYWLRTDKFQLNKKIYSDNSGSVILNEMEVQDIDNLMDWELAQLKFKLINKTKMGYKTRTGEFWAGNLGKEYISRKHSEELLPSNLNSFLGL

SEQ ID NO: 5707 - DNA, 924 bp, Unknown
  Obtained from environmental sample
  misc_feature (1)..(924): n is a, c, g, or t
ttgcaaagaggagagcaaaaagatcattcttgtttccaagacatcaacctccgtctcaaagcaaaggcacttggtttagcagccgaggattatacaaccggcaaggttcaaaatatatcttcgctatacacaggcaaaactatcatcgaagatgttgatgcaaacatgatcaaccttctttatgagaaaggatattgccaaccagaagaattattaggtgggaatgtgcctctaaaaaatcattactatattctaaagagtggaaagaaatctgccctggcatatttcaattcgctcaacggaatggttgagcacgtagagaaaaaatccgtttacggtgttaagccacgcaatgcagaacagacgtttgccattcacgcggtatcaaaacccgagattaaacttgtgtcgctctccggaattgccggaacaggaaaaacgcttattgcacttgccgctgccctggatcaaaagagagaattcaagcaaatctatctcgcccgccctattgtaccccttagcaataaggacattggatatcttccgggagatattaaatcgaaggtaaacccgtacatggagccgttatgggataaccttaagttcattcaaaaccaatacaacgaaaccgacaaagaatactcaaagatcaccgaaatggttactcaggaaaaactggtgatcacacccctggcttatatacgtggacggagtctctcaaacatctgctttatcgtagatgaagccctaaacctgactccccatgaggtgaaaactattattacacgggctggagaggggacaaaaatcatttttacaggagacattcaccagatcgatacaccttacctggattctcaaagtaatggactctccccacctatcgaccgtctaaagggaccacgagctttacgcccaccataa

SEQ ID NO: 5708 - protein, 307 aa, Unknown
  Obtained from environmental sample
  DOMAIN (113)...(305): PhoH-like protein
  misc_feature (1)..(307): Xaa is any amino acid
MQRGEQKDHSCFQDINLRLKAKALGLAAEDYTTGKVQNISSLYTGKTIIEDVDANMINLLYEKGYCQPEELLGGNVPLKNHYYILKSGKKSALAYFNSLNGMVEHVEKKSVYGVKPRNAEQTFAIHAVSKPEIKLVSLSGIAGTGKTLIALAAALDQKREFKQIYLARPIVPLSNKDIGYLPGDIKSKVNPYMEPLWDNLKFIQNQYNETDKEYSKITEMVTQEKLVITPLAYIRGRSLSNICFIVDEALNLTPHEVKTIITRAGEGTKIIFTGDIHQIDTPYLDSQSNGLSPPIDRLKGPRALRPP

SEQ ID NO: 5709 - DNA, 861 bp, Unknown
  Obtained from environmental sample
  misc_feature (1)..(861): n is a, c, g, or t
gtgctggggttaactgagaaagaattagctggatcacttcctaaaccaccaacagacattaatgacctattctcatgtttactggaaaaaggctgggataggtctgatgctttaggaacaattcagaagcagttaacatccaaaaccatcatgctctcaacccgtcattctgagattttaggccaattaattaataaaatatcagaggtccatttcagggaattagcaaaccttccggataatgaaaagcttaaaaacaggcatattcaagttatcgttattgatcaaattttagaattggccaaagataataattggggtatttgcaaacaatatgactttatttatctttttaatggcgagtattgggggctgctcgaaaccgaagagttgaaaaccttcttaggcgatgcagctgagaagatgggaatttgcaatgtcgatgctcaacacttcaattttaaagatcaactttacaaacagtttatggcagcagctaatttaccaaagccagaacagcctataaatgtaataaatatcaacctaaagaatggaacttttgaagtcactcctgaaggaaataaattaaatccatttaatcgcagtgactttatgacgtatcaattaccatttgaatatgatccagaagccaaagccttattattttcaacctatcttaataaggtgttacctgaaaaaaaactacaagatatcctggctgaatacttgggatacatctttatccacacaagtacgttgaaattagaaaaaaacatcctgctctatggtacaggtgcaaatggtaaatctgttttttacgagattgttagaaagtcttttaggagaacaaaatacctctga

SEQ ID NO: 5710 - protein, 286 aa, Unknown
  Obtained from environmental sample
  misc_feature (1)..(286): Xaa is any amino acid
MLGLTEKELAGSLPKPPTDINDLFSCLLEKGWDRSDALGTIQKQLTSKTIMLSTRHSEILGQLINKISEVHFRELANLPDNEKLKNRHIQVIVIDQILELAKDNNWGICKQYDFIYLFNGEYWGLLETEELKTFLGDAAEKMGICNVDAQHFNFKDQLYKQFMAAANLPKPEQPINVININLKNGTFEVTPEGNKLNPFNRSDFMTYQLPFEYDPEAKALLFSTYLNKVLPEKKLQDILAEYLGYIFIHTSTLKLEKNILLYGTGANGKSVFYEIVRKSFRRTKYL

SEQ ID NO: 5711 - DNA, 633 bp, Unknown
  Obtained from environmental sample
  misc_feature (1)..(633): n is a, c, g, or t
ttgcttgaaaaaaccggcatcgatcatctcgttattgttccctttaatcaacaatttgccggccaaacgcctgatgaatacatcgaaaatttcctgatagaaaaatttcacccacataccatcatcattggttacgatcatcattttgggaaaaacaggcagggaaattttatgctgcttgctgaaaaagcagacgcctttaattaccgtttacttgaaatacccaaatacattctgcaggaagttgccgtcagctcaacccaaataaggaatgctttattgaaaagcgacattgatacggccggaaaattattaggctatgatttcttttttgagggccttgtaattggaggcgacaagctgggaagaaaactgggctatccaacggcaaatctcgaatacactgatgctgataaaattcatttgggacatggtgtatatgcggcttatgcagaagtgaacagaacaaaatacaaaggcatgttgagcattggcaacaggccaacacttaaaaattcaaatgaccgggttgaagtaaacatttttgattttgataaagagatttatggcgaaaccatcaaagtgacggtaaaaaaatatttacgcggccaggaaagatttcttcgtagataa

SEQ ID NO: 5712 - protein, 210 aa, Unknown
  Obtained from environmental sample
  DOMAIN (1)...(88): Riboflavin kinase (Flavokinase)
  misc_feature (1)..(210): Xaa is any amino acid
MLEKTGIDHLVIVPFNQQFAGQTPDEYIENFLIEKFHPHTIIIGYDHHFGKNRQGNFMLLAEKADAFNYRLLEIPKYILQEVAVSSTQIRNALLKSDIDTAGKLLGYDFFFEGLVIGGDKLGRKLGYPTANLEYTDADKIHLGHGVYAAYAEVNRTKYKGMLSIGNRPTLKNSNDRVEVNIFDFDKEIYGETIKVTVKKYLRGQERFLRR

SEQ ID NO: 5713 - DNA, 444 bp, Unknown
  Obtained from environmental sample
  misc_feature (1)..(444): n is a, c, g, or t
ttgaacctaactatattgacaaaaacaatccaggaaacggaagcggagatagtcagtgagtttgcactttttgatgactggaccgaaaagtacgaatacatcattgagcttggacagaaactgccttccctggatttgaagtataaggtggatgaaaataaaattaagggatgccagagcagcgtatggctgaacagttactcaaaagacggaaaagtatatttcgaagcagatagcgattccacttttgtaaaaggagaaattgctttgcttatccgtgtattatcaggccaaattcctggtgacatcctgaaaacggaattaaaatttatcgacgacatcggcttgcgccagcatattgctgtgaccagggcaaatggccttgcatcgatgattaaacaaatgaaaacttttgcagtgggatttagcaataaaacggtttga

SEQ ID NO: 5714 - protein, 147 aa, Unknown
  Obtained from environmental sample
  DOMAIN (17)...(140): Fe-S metabolism associated domain
  misc_feature (1)..(147): Xaa is any amino acid
MNLTILTKTIQETEAEIVSEFALFDDWTEKYEYIIELGQKLPSLDLKYKVDENKIKGCQSSVWLNSYSKDGKVYFEADSDSTFVKGEIALLIRVLSGQIPGDILKTELKFIDDIGLRQHIAVTRANGLASMIKQMKTFAVGFSNKTV

SEQ ID NO: 5715 - DNA, 777 bp, Unknown
  Obtained from environmental sample
  misc_feature (1)..(777): n is a, c, g, or t
atgataaatgaaattcctgataattggtttgaatattttttccagggaataaactgcgaagtttgggaaaaagctattccgattgaggtcacaaaacaagaggttaactttttgctgaatgaattaaatctgcaaaaagggcagcatatacttgacgtaccttgtggtttcggccgacatgctatagaactttcaaaaaaaggatttaaggttacaggcattgacatctccgagacttttattaaaggactgactgaaaagataatttcagaaaaactgaatattaacgcaattcagtccgacattcttaccattcaactaaatgaaaagttttcaggcgctgtatgcctgggaaacagctttgggtacttcaatattgatagaatgaaattgtttgtcgaaaaggtttcttcaagtcttgaaagcgggtcaaaatttattattaattcgggtatgatagctgaaagcattttaccaaacttcctaaactactcaaaaaacaattcgtacaatgttggaaatataacaatggatattaccaatatttatcatgtagaggatagctacatgagaagccatcttctttataccaaagaaggtacgacagaggaacacgcttttaaacattatgtatttaccctgggagaagtaatacggcttttgaagttatatggattaaacactattgcaacatatagttcgacatcaaaagaccactacaagctcggggatcgacaagtttacattgtgactaaaaaggatagcgataaaagttga

SEQ ID NO: 5716 - protein, 258 aa, Unknown
  Obtained from environmental sample
  misc_feature (1)..(258): Xaa is any amino acid
MINEIPDNWFEYFFQGINCEVWEKAIPIEVTKQEVNFLLNELNLQKGQHILDVPCGFGRHAIELSKKGFKVTGIDISETFIKGLTEKIISEKLNINAIQSDILTIQLNEKFSGAVCLGNSFGYFNIDRMKLFVEKVSSSLESGSKFIINSGMIAESILPNFLNYSKNNSYNVGNITMDITNIYHVEDSYMRSHLLYTKEGTTEEHAFKHYVFTLGEVIRLLKLYGLNTIATYSSTSKDHYKLGDRQVYIVTKKDSDKS

SEQ ID NO: 5717 - DNA, 612 bp, Unknown
  Obtained from environmental sample
  misc_feature (1)..(612): n is a, c, g, or t
ttgacgtaccttgtgtttcggncgacatgctatagaactttcaaaaaaggatttaaggttacagcatttgacatctccgagacttttattaaaggactgactgaaaagataatttcagaaaaactgaatattaacgcaattcagtccgacattcttaccattcaactaaatgaaaagttttcaggcgctgtatgcctgggaaacagctttgggtacttcaatattgatagaatgaaattgtttgtcgaaaaggtttcttcaagtcttgaaagcgggtcaaaatttattattaattcgggtatgatagctgaaagcattttaccaaacttcctaaactactcaaaaaacaattcgtacaatgttggaaatataacaatggatattaccaatatttatcatgtagaggatagctacatgagaagccatcttctttataccaaagaaggtacgacagaggaacacgcttttaaacattatgtatttaccctgggagaagtaatacggcttttgaagttatatggattaaacactattgcaacatatagttcgacatcaaaggaccactacaagctcggggatcgacaagtttacattgtgactaaaaaggaatag

SEQ ID NO: 5718 - protein, 203 aa, Unknown
  Obtained from environmental sample
  misc_feature (1)..(203): Xaa is any amino acid
MTYLVFRXTCYRTFKKGFKVTAFDISETFIKGLTEKIISEKLNINAIQSDILTIQLNEKFSGAVCLGNSFGYFNIDRMKLFVEKVSSSLESGSKFIINSGMIAESILPNFLNYSKNNSYNVGNITMDITNIYHVEDSYMRSHLLYTKEGTTEEHAFKHYVFTLGEVIRLLKLYGLNTIATYSSTSKDHYKLGDRQVYIVTKKE

SEQ ID NO: 5719 - DNA, 546 bp, Unknown
  Obtained from environmental sample
  misc_feature (1)..(546): n is a, c, g, or t
ttgctggagcaggatggatttgttacaaaaagcttcactgatatcgccgatgtgtatgtcataaatacttgctcggtgacggaaaatgcagacaaagaatgcaggcaactcgtcagaagaatacaaagaaaggctcccgcggccatggtggttgttactggttgctatgctcaattaaaaccaaaagaaatagcagaaatatcaggtgtagacctggtgttgggcgctgcagaaaagtttaatatcgttagccacctgaaagaaatcagcaaaggtgatagtaccaaaatttgcagttgcgacacagaagagatccaaggatttaattcctcattttcattaaacacaaggacgcgttcattcttaaaagtgcaggatggctgcgactacaactgctcattttgcacaattccattggccaggggaaaaagcaggagtaattctatagaaaatgttttgcatgaaataaaacagatcgcaaagcaagatgtaaaagaaattgtttttacaggaattaatctcggcgattttggaaaaaatnggtga

SEQ ID NO: 5720 - protein, 181 aa, Unknown
  Obtained from environmental sample
  DOMAIN (2)...(75): Uncharacterized protein family UPF0004
  misc_feature (1)..(181): Xaa is any amino acid
MLEQDGFVTKSFTDIADVYVINTCSVTENADKECRQLVRRIQRKAPAAMVVVTGCYAQLKPKEIAEISGVDLVLGAAEKFNIVSHLKEISKGDSTKICSCDTEEIQGFNSSFSLNTRTRSFLKVQDGCDYNCSFCTIPLARGKSRSNSIENVLHEIKQIAKQDVKEIVFTGINLGDFGKNX

SEQ ID NO: 5721 - DNA, 417 bp, Unknown; identical to SEQ ID NO: 751
  Obtained from environmental sample
  misc_feature (1)..(417): n is a, c, g, or t

SEQ ID NO: 5722 - protein, 138 aa, Unknown; identical to SEQ ID NO: 752
  Obtained from environmental sample
  misc_feature (1)..(138): Xaa is any amino acid

SEQ ID NO: 5723 - DNA, 333 bp, Unknown
  Obtained from environmental sample
  misc_feature (1)..(333): n is a, c, g, or t
atgcgtaagttcttttcattccgaaaggtttttatgtataaaagagaggaattttatccatccactaacctttatcaaggtgaaatatcctgtttaagaatatattcaaggaaaatacaagtagtttctgaggtcttagtttcctggcctgatgctaaagtaaatatatatgttaaatttaatgggaaaagctctatattattaacgtattcgggatctttaaaccaattattaaataacccactgttcggactaattataaaagggcctgcagattttcgtacaaatataccaatttcctcatcactcatctcaaaggtgaaacgagtgtga

SEQ ID NO: 5724 - protein, 110 aa, Unknown
  Obtained from environmental sample
  misc_feature (1)..(110): Xaa is any amino acid
MRKFFSFRKVFMYKREEFYPSTNLYQGEISCLRIYSRKIQVVSEVLVSWPDAKVNIYVKFNGKSSILLTYSGSLNQLLNNPLFGLIIKGPADFRTNIPISSSLISKVKRV

SEQ ID NO: 5725 - DNA, 915 bp, Unknown
  Obtained from environmental sample
  misc_feature (1)..(915): n is a, c, g, or t
atgcattttacccgcaaccttgaatttggaaaccgggggactcgcgggaacgatgggcgtaggttccaacaggataaacaagtacaccattggaatggcaacacagggatacgcaaactattacaaaagagttttcccggccagcaaattaaagtagccattgcgcatgacagccgtaacaacagccgcttttttgccgaaaccacggcacatgtttttgccgccaatggcataaaagtttttttgttcgaggacctgcggcccacccctgaactttcttttgcaatcaggcaattaggttgtaagggtggtgtagtgtgcactgcttctcataatccaaaagaatataatggctacaaagcgtattgggatgatggcgggcaattagttccgccgcatgataaaaatgtaattgtagaagtagaaaagattgcaagtgttagtgatgtaaaatggaatgggaatgatgaaaacattatcatcatcggtaaaaagatggatgaggcttatataaaaatggtaaagggcctgagtgtttatcctgaggtgatacaaaaggaaaaagaccttaagattgtttatacacctattcatggtacaggaataaaactggtgccgcaggtattaaaagaatttggttttaccaatgtgcatattgtagaagaacaaaaaaccccggatggaaattttccaacggttgcttatccaaatcctgaagaaaaagaaaccatgagcattggtcttaagaaagcagaagaactggatgccgatattttgttaggcactgacccggatgcagaccgcgtaggcattggcgtaaaagacagcaatggaaaatggattttaatgaacggcaaccaaactgcggtgcttgcctttaattacatgatagaaagccgaaagaaaaaggcatag

SEQ ID NO: 5726 - protein, 304 aa, Unknown
  Obtained from environmental sample
  DOMAIN (168)...(280): Phosphoglucomutase/phosphomannomutase, alpha/beta/alpha domain II
  misc_feature (1)..(304): Xaa is any amino acid
MHFTRNLEFGNRGTRGNDGRRFQQDKQVHHWNGNTGIRKLLQKSFPGQQIKVAIAHDSRNNSRFFAETTAHVFAANGIKVFLFEDLRPTPELSFAIRQLGCKGGVVCTASHNPKEYNGYKAYWDDGGQLVPPHDKNVIVEVEKIASVSDVKWNGNDENIIIIGKKMDEAYIKMVKGLSVYPEVIQKEKDLKIVYTPIHGTGIKLVPQVLKEFGFTNVHIVEEQKTPDGNFPTVAYPNPEEKETMSIGLKKAEELDADILLGTDPDADRVGIGVKDSNGKWILMNGNQTAVLAFNYMIESRKKKA

SEQ ID NO: 5727 - DNA, 549 bp, Unknown; identical to SEQ ID NO: 4105
  Obtained from environmental sample
  misc_feature (1)..(549): n is a, c, g, or t

SEQ ID NO: 5728 - protein, 182 aa, Unknown; identical to SEQ ID NO: 4106
  Obtained from environmental sample
  misc_feature (1)..(182): Xaa is any amino acid

SEQ ID NO: 5729 - DNA, 489 bp, Unknown
  Obtained from environmental sample
  misc_feature (1)..(489): n is a, c, g, or t
ttgccacatcgtatggaacaactgctttttgaagaaaaacaatatgtgggttttaatacctattccattgcaaggcgcatggtgcttgccatattttgcttcgtggcatattattatacggaaaacagggaagaaaatgccgatctgctgttcctgctgggcatattaatattggtaatatctgtgctgttactgtttgtaaaatatatacatatcaaagttaagcctgaaacaatcagcattaaaggtctttggaaaaaccaggaggtaaccattgacctgaaaaagattgcaagtgcggaaaaaactatttacagcaaataccatcttaataacccggcttttaatgttcatactgataagactatcaagttttatgcagggggaaaggatgcaattaagctcactgcttacgatgggcttacctatctcattggaacaagcaaggccgatgaacttttacgctctgttaaaagcgttttgcaataa

SEQ ID NO: 5730 - protein, 162 aa, Unknown
  Obtained from environmental sample
  misc_feature (1)..(162): Xaa is any amino acid
MPHRMEQLLFEEKQYVGFNTYSIARRMVLAIFCFVAYYYTENREENADLLFLLGILILVISVLLLFVKYIHIKVKPETISIKGLWKNQEVTIDLKKIASAEKTIYSKYHLNNPAFNVHTDKTIKFYAGGKDAIKLTAYDGLTYLIGTSKADELLRSVKSVLQ

SEQ ID NO: 5731 - DNA, 966 bp, Unknown
  Obtained from environmental sample
  misc_feature (1)..(966): n is a, c, g, or t
ttgaaagccgagggaattgccggcttgggacttttgatgggcaactcgcaggaggacaatcgcgttttaccccgncaggttatgaagatctttgaaatggatcaaagttctaatttgccggaattcatggaatttgttcacccgagcgaccgtgaaaaacttcgtgagtccatagagggcgctttaaaaggtaatggagattatgattgtgagtaccggtaccgtagaaacggtaaagagaaagtgatatggtcaaaaggtgtagtgagttttaaagataacaagccattattaatgaaaggtacggtgatggatattaccgatcgtcactatatgttgcaaactttaaaacgcaacgaagagctatataaacaagctcaaaaactaactcacatcggtaactgggcctgggatcttgaaacaaatgaagtgaaattctcagatgaattgtatcgcatttatggtttggagatcggtacgtacatggatgccattcgctttttttcgttcgtacatgatgacgataaagagaagatccttacgttactgaaccattcgaaaagtactcatcaaccgcacaccgttgactatagactggtgcgcaaagacggaagtatacgtatcatgcgcagaaatgccgaagttcttttggatgaaaagaacaaaccatataagatcattggtacaggtcaggatataacgaaggaagtagaattgaacagagagattcgcgagcgtgaagagaatttcagccacttgatcaaaaacgcgccggatggcatcattgtaattgatgaaaatagtattattcgattatggaatgaaaaagcgaccgaaatatttggatggaagaacgaagatgttataggcaaagatctcacctcaaccataatgccgaatgcagatcctgatggcaccaaaaaagcaatgtcatcatttctaaacaccggccagggcagaacntaa

SEQ ID NO: 5732 - protein, 321 aa, Unknown
  Obtained from environmental sample
  DOMAIN (248)...(311): PAS domain
  misc_feature (1)..(321): Xaa is any amino acid
MKAEGIAGLGLLMGNSQEDNRVLPRQVMKIFEMDQSSNLPEFMEFVHPSDREKLRESIEGALKGNGDYDCEYRYRRNGKEKVIWSKGVVSFKDNKPLLMKGTVMDITDRHYMLQTLKRNEELYKQAQKLTHIGNWAWDLETNEVKFSDELYRIYGLEIGTYMDAIRFFSFVHDDDKEKILTLLNHSKSTHQPHTVDYRLVRKDGSIRIMRRNAEVLLDEKNKPYKIIGTGQDITKEVELNREIREREENFSHLIKNAPDGIIVIDENSIIRLWNEKATEIFGWKNEDVIGKDLTSTIMPNADPDGTKKAMSSFLNTGQGRT

SEQ ID NO: 5733 - DNA, 603 bp, Unknown
  Obtained from environmental sample
  misc_feature (1)..(603): n is a, c, g, or t
ttgcctcttcccttttatatcacagcaagctattacgatttccttgagcgggcattaatcaatgtaaaaaaggagcctattacgcaggtctgtaattggacaggtgatattagcgagatcaaacctgaacacagcccggatcgccagtaccaagctactgctcagaccccattggtctaccacttgtatgggttggaggattatcccgaaactatggttctcagtgaagatgattacatcaattttttgatcaaggttatctcgaatacaaacgctctgaatccaattgtgccgttgagtctgcagggaaaattgacagagtcccagctgctgctccttggttaccagctcaacgactgggatttccggatactattccgattcctcctaaaattccgaagaaaagaaagacaaatgttggaaaggggcctggttattcaattaaaagcattaaataagagagaaataggaaatgcagataaaaccttggattacctgagggactactatgaccaggaaaacttcgaagtgaagtggaaaaaggttcaaacatttatccgtgaactatggaaagaatggaattcagatgggcaggaaaagtaa

SEQ ID NO: 5734 - protein, 200 aa, Unknown
  Obtained from environmental sample
  misc_feature (1)..(200): Xaa is any amino acid
MPLPFYITASYYDFLERALINVKKEPITQVCNWTGDISEIKPEHSPDRQYQATAQTPLVYHLYGLEDYPETMVLSEDDYINFLIKVISNTNALNPIVPLSLQGKLTESQLLLLGYQLNDWDFRILFRFLLKFRRKERQMLERGLVIQLKALNKREIGNADKTLDYLRDYYDQENFEVKWKKVQTFIRELWKEWNSDGQEK

SEQ ID NO: 5735 - DNA, 579 bp, Unknown
  Obtained from environmental sample
  misc_feature (1)..(579): n is a, c, g, or t
ttgaagcagcacgggattttcgccgcgaattatggcgtggtgcaaattccccaggacgaaaaagaagcccgccagatttttgagttcgccaaaaaaatgggaatgatcgccatcaccaccgaatccgtggattcgatcgacaccatcgaaaagctcgtcaaagaatacgacatcaaagtcggtttccacgatcatccgaaacgcgccaaggatccgaattacaaaatgtgggatccgaattacatcctttcggtcgtcaaagatcgcgatcatcgcattggttcctgcgccgacacggggcattgggtgcgctccggtttgaatccggtcgattgccttcggattttgaaaggccgcatcatcagcagccatctcaaagatttaaacgagttcggaaaagttgaagcgcacgacgttccgtatgggcaaggcgtctccaacatcaaaggagttctcgacgaattgaaagcgcaaaacttccagggaaacatctcggtcgaatacgaatatcactgggaaaattccgttccggaagtcaaacagtgcatcgatttcgtccggaattacggctccaagtaa

SEQ ID NO: 5736 - protein, 192 aa, Unknown
  Obtained from environmental sample
  misc_feature (1)..(192): Xaa is any amino acid
MKQHGIFAANYGVVQIPQDEKEARQIFEFAKKMGMIAITTESVDSIDTIEKLVKEYDIKVGFHDHPKRAKDPNYKMWDPNYILSVVKDRDHRIGSCADTGHWVRSGLNPVDCLRILKGRIISSHLKDLNEFGKVEAHDVPYGQGVSNIKGVLDELKAQNFQGNISVEYEYHWENSVPEVKQCIDFVRNYGSK

SEQ ID NO: 5737 - DNA, 555 bp, Unknown
  Obtained from environmental sample
  misc_feature (1)..(555): n is a, c, g, or t
atgaaaagaaatttgaaaataactcttatcgtaattctatttgtatttgttttgttcttattcttttataaatacaaaattgataaaccatataggattgtgaaagatatttctgatcttacgatcacaagaaatagtaagctttataagtatgataagtttgttgataattttgatggcagttcaaccatggaaattcgattttctataggctacaaggacataaaagaattaaaagagcaaacaaaaaaagaaaagtttaaaatcccacctgttagaggctttaattttggcgatgagattgaaaattatttagtgcctaaagattcagtgtactataagttggagggcgaagatatcatggattattctttaacggtagtaaattttacacaacggaaactaataataaaaaggtgcaaacttataaatgactcnattcagtcccatgatactagtcctctgttctttacggagtgtccaatgtcaaaaacattgcaagccgtgtctcacctcccagatctgtgcattggctggactcggcgcaataactaa

SEQ ID NO: 5738 - protein, 184 aa, Unknown
  Obtained from environmental sample
  misc_feature (1)..(184): Xaa is any amino acid
MKRNLKITLIVILFVFVLFLFFYKYKIDKPYRIVKDISDLTITRNSKLYKYDKFVDNFDGSSTMEIRFSIGYKDIKELKEQTKKEKFKIPPVRGFNFGDEIENYLVPKDSVYYKLEGEDIMDYSLTVVNFTQRKLIIKRCKLINDSIQSHDTSPLFFTECPMSKTLQAVSHLPDLCIGWTRRNN

SEQ ID NO: 5739 - DNA, 330 bp, Unknown
  Obtained from environmental sample
  misc_feature (1)..(330): n is a, c, g, or t
ttgcataaagtaatatcacccattttgacaggttatgaagatactaatgacttcgcaacaacaaaaaggattaagagaatttatggggattttgaagttgcttcaaaaggtctattgaatccgaaactagcaatttatctaattggtaatagaaaaatctggaattttattgaagagggtggaaatataattgagttattctcaggaaaaatctgcattgatgatttggactatcttcgaagaaagaaatttaaaattaaaaagagttttttaggagaagataaaattaatttcgaaaaaattcgccaaacgattataaactgtttctga

SEQ ID NO: 5740 - protein, 109 aa, Unknown
  Obtained from environmental sample
  misc_feature (1)..(109): Xaa is any amino acid
MHKVISPILTGYEDTNDFATTKRIKRIYGDFEVASKGLLNPKLAIYLIGNRKIWNFIEEGGNIIELFSGKICIDDLDYLRRKKFKIKKSFLGEDKINFEKIRQTIINCF

SEQ ID NO: 5741 - DNA, 669 bp, Unknown
  Obtained from environmental sample
  misc_feature (1)..(669): n is a, c, g, or t
atgaatggcttggagtcggattttttttttgccaaaaataaaccagcttttttcatcattcaaaaagtaccggcctcaacaaaatttattctaggtgtagctcattcaataaatgacaataaaatattccttgggattggaattctgttttttatgatcgcattctacattttcttaaaacgaanggtaggtcagattacgaaggataaaattatgcttgcttttcctgtaatcaaattgataactcaatatggaatcttagccaatttttctagaactctaggaatccttttggaaagctctattccaatcacaaaagcactgnagatctcagctgattcaatggacaattctcagtacaaaaaagtactgcttgatattactccgaaagtaaaactcggaagcacagttgccgcatcaatgagtgagcataagaagttttttccacctacttttgtaaaaatgatcgaagttggtgaagaaactgccacattggaagagaatttaatgtatctacatgagttttatgccgatgatgttcaggatatgagcaataaccttacgacattaattgagccaatacttcttgttttcattggaattatgattggtttattagcaatttctatcgtattcccgatataccagctctcagcaagtattaactaa

SEQ ID NO: 5742 - protein, 222 aa, Unknown
  Obtained from environmental sample
  DOMAIN (88)...(213): Bacterial type II secretion system protein F domain
  misc_feature (1)..(222): Xaa is any amino acid
MNGLESDFFFAKNKPAFFIIQKVPASTKFILGVAHSINDNKIFLGIGILFFMIAFYIFLKRXVGQITKDKIMLAFPVIKLITQYGILANFSRTLGILLESSIPITKALXISADSMDNSQYKKVLLDITPKVKLGSTVAASMSEHKKFFPPTFVKMIEVGEETATLEENLMYLHEFYADDVQDMSNNLTTLIEPILLVFIGIMIGLLAISIVFPIYQLSASIN

SEQ ID NO: 5743 - DNA, 732 bp, Unknown
  Obtained from environmental sample
  misc_feature (1)..(732): n is a, c, g, or t
atgttgcgcatttcttttttatacacaatgggctggaatatctctaaaattgcggagctcactgccgatcaaataatggaagaagtatgcaagttcgagatcaatagcaataattacaaaacgtttatcctacgaatgacagatgctgctgtagattttaatgaagaatcatttataggaattctaaatgtcttaattgaaaaaatggggtttgaaaaatcaatcgcagaagtgtgttatccctttataatacgcgtcggtatggtctggacgacaaaaaatatgattccagcccagcaacatttttctattcatattattcaaaataggatcatttccgaaacggataagtttaaagcaagcaataagatacccggagtaatgttgttttcacccggagcacaggatgaactatcgcttctttttatttattacctgttacgaaaaaataattggagtgtaatttatttaggaactaacatcaataaaaaatcaccaaaacagtttacccggcataactctgtagaatatgttttcgttcatgtttccaacttcccgggggatgcagatgtatattttgaagacttatgcaaatcttttcccggcaaaagaattattgttacaggcacagcagcgcaacggttacaaagaaaatttgcgaacttaattatcctaaaatcgaacaaagaaattaatgaatttatacaagacaataaatcagaacctgtttag

SEQ ID NO: 5744 - protein, 243 aa, Unknown
  Obtained from environmental sample
  misc_feature (1)..(243): Xaa is any amino acid
MLRISFLYTMGWNISKIAELTADQIMEEVCKFEINSNNYKTFILRMTDAAVDFNEESFIGILNVLIEKMGFEKSIAEVCYPFIIRVGMVWTTKNMIPAQQHFSIHIIQNRIISETDKFKASNKIPGVMLFSPGAQDELSLLFIYYLLRKNNWSVIYLGTNINKKSPKQFTRHNSVEYVFVHVSNFPGDADVYFEDLCKSFPGKRIIVTGTAAQRLQRKFANLIILKSNKEINEFIQDNKSEPV

SEQ ID NO: 5745 - DNA, 927 bp, Unknown
  Obtained from environmental sample
  misc_feature (1)..(927): n is a, c, g, or t
atgttgatcgacagaaatagtattctgttcaatgattcgggaaaacttttcaagctgaaagacgacctgaacctgctgcttggcgaagaaaaaacttcgctgtatcttggtgaatttgacgaggaatttgaatctgatgtaactccactttcaagcacgctaaaaaaacttacgggtgaaggcagcttcattctggttacatctcccgccgctcttgataaaaacataataaccgaagaaacattcaggaaaaatatcatatcccttaagaaagatactgaatatagttttgatgaacttgtatcaaaactaaaagaattcaatttcactaaaaagaaaattgttgaagaagaaaacgattacgcagtacgcggtggtataattgatatatacactgaaaatcttaatcagcccgtaaggatagagttctatggagatattgttgaatcaataagggaatttgaccctgttacacagcgctcaatagcgcagcttgaatcagttgaaatactgccctcggctgaaacaatgaaccgtgatgacagttcaacggaaaaacttatagattacatcaaaaatgatactttgttcctgcttgatgaacccgatctgataaaagaggaactgcctaacatctatttcaagagcgttagtttcaacaggtcatatttttcaggtttcccgttgataaaaagcgcatctttcaacaatgaggaaaaagaaaagatcaaagaactattctttgacgcanaaacccagccttcatttaattctaattcanaactattcgcggaaaatctaaaagagctttcaacctcaggatatgatgttttcataagctgcactgatgattaccagcttaaccgcacccgtgagcttgttgaagatctgttgaacaccgaaaacctttcccgtataaattcctga

SEQ ID NO: 5746 - protein, 308 aa, Unknown
  Obtained from environmental sample
  misc_feature (1)..(308): Xaa is any amino acid
MLIDRNSILFNDSGKLFKLKDDLNLLLGEEKTSLYLGEFDEEFESDVTPLSSTLKKLTGEGSFILVTSPAALDKNIITEETFRKNIISLKKDTEYSFDELVSKLKEFNFTKKKIVEEENDYAVRGGIIDIYTENLNQPVRIEFYGDIVESIREFDPVTQRSIAQLESVEILPSAETMNRDDSSTEKLIDYIKNDTLFLLDEPDLIKEELPNIYFKSVSFNRSYFSGFPLIKSASFNNEEKEKIKELFFDAXTQPSFNSNSXLFAENLKELSTSGYDVFISCTDDYQLNRTRELVEDLLNTENLSRINS

SEQ ID NO: 5747 - DNA, 420 bp, Unknown
  Obtained from environmental sample
  misc_feature (1)..(420): n is a, c, g, or t
ttgttgggtgattcaaaatacagtttgtttctgccggaacacttttttggtggggaaaccccgggggcttgggattttccaaagacttttaaaagttcactggccgggcggaacctaatgaaaataagcttgagcttgaggaccgttttggcaaagttgaccgatgaagtaatttcactgctccatcttattgggatcaagctgatacttttctcgatcggatttgaaaaaatcgtaatttcaggtgaccagctgaaattattctttgacctgaacaatgaaaatatatacacaagcgggtactttgaaaaagtactgggttttataaatgagcacttcaaaaacacatcacggggtaaaacatcaaaagagctcactatcggtgctattccgcattcccaggcagccaacacccgctga

SEQ ID NO: 5748 - protein, 139 aa, Unknown
  Obtained from environmental sample
  misc_feature (1)..(139): Xaa is any amino acid
MLGDSKYSLFLPEHFFGGETPGAWDFPKTFKSSLAGRNLMKISLSLRTVLAKLTDEVISLLHLIGIKLILFSIGFEKIVISGDQLKLFFDLNNENIYTSGYFEKVLGFINEHFKNTSRGKTSKELTIGAIPHSQAANTR

SEQ ID NO: 5749 - DNA, 720 bp, Unknown
  Obtained from environmental sample
  misc_feature (1)..(720): n is a, c, g, or t
ttgcatagcaccgatcccaatcataaatacagccacgaaaagaatattgttggaactgactaccgaatcgaagggggcgctttaatagttgaggtagactacaaagtggaaaacggaagaatatttgcaagtgatgccgcctttgacagaaggtacaccatctttttgaagcaaaatatttcaggctctatcgaacagcatgccgacaataaagacttgttaattttgcaacgcaaactttgcactaaaataacctatggtgattgtgttttgggagccgatctaacgatcaaccgcaagccggatacaagcattggtgatttgcaagatcaaccatcattggaagacattattgtcgagctcccttttgatataaacgatttgtttgaaatccctgacagatccaaagatatccccttcaaatcatcatcgctgtcaggccaacgaaatgattttgcctttaaaaaaggtatcatcagaatgattcaacataccatgctttctgggttaagtgatccaacttccaacaagcctggaggcattggatatcttcaatcaaaacattttcagaaaagactattgcgtgtgctgccagatgaaattttagaatcgccaatcgatcaacttgattttgttaactcgaaagtcaaagagaagttttcgaagagtgtgacgattaaagaaataatattgacgaatgatgtagaacttaggaaataa

SEQ ID NO: 5750 - protein, 239 aa, Unknown
  Obtained from environmental sample
  misc_feature (1)..(239): Xaa is any amino acid
MHSTDPNHKYSHEKNIVGTDYRIEGGALIVEVDYKVENGRIFASDAAFDRRYTIFLKQNISGSIEQHADNKDLLILQRKLCTKITYGDCVLGADLTINRKPDTSIGDLQDQPSLEDIIVELPFDINDLFEIPDRSKDIPFKSSSLSGQRNDFAFKKGIIRMIQHTMLSGLSDPTSNKPGGIGYLQSKHFQKRLLRVLPDEILESPIDQLDFVNSKVKEKFSKSVTIKEIILTNDVELRK

SEQ ID NO: 5751 - DNA, 1020 bp, Unknown
  Obtained from environmental sample
  misc_feature (1)..(1020): n is a, c, g, or t
atggcccggcaaaacggtgggcatagacctggtgaaaaaanggatgctgaaggcaactatactttatcctacagcgggcaaagaagctatacaaactgctgtaaaaatatatacacnagtgcttataaaaaggaaancctgcttacaacanctgttatgatttccacgaatgtgcgggtaatgcgctgcagggatgaaaaatattctgccctgcaaaatgatattgaaagaggccagcagaaaattaaagaacaggaaattattaccaacaatcagtctaatataattttcgcgatttccgtgtcactggcactggcgctcatctttggttttgttttgctgtattacctgcgtgagaataaaaaaattacagcaaggcttgctttaaaaaatgaagaaattctgaaacaaagtgaacagcttattgaacttggtaagaaagccaatgcagccaatgaggcaaagatccagttcttcacaaaaatgtcgcatgaattaagaacgccgcttacattaatacttggcccggttgaagacctcatggaaaatgagaaagtaaaccgtgttgcagcacaaagtttatcattgattcaaaagaatacattaagacttttaaagctcattaaccagttgatggatttcaggaaaattgaaattgataaactgaaaataaatgttgcggaaaacgatattgtttcttttttaaaccagataatagaagcatataaaaatattgcccgcaaaagaaatattgacctgcggttctttaccagccagtactttttaaatgtgtggtttgatgaaaccatgctcgacaaagtgctgttcaacctgctttccaacgcatttaagttcaccaacgataatggttatatacacatctttcttgaaaaaaatgaagcagcaaaaaatataaagattattattgaagataatggtgttggcatgagcgaagttgctgttgaacatgccttcgaactgttttaccaggggaacatgaaaataccgcgcacaggttag

SEQ ID NO: 5752 - protein, 339 aa, Unknown
  Obtained from environmental sample
  DOMAIN (266)...(338): Histidine kinase-, DNA gyrase B-, and HSP90-like ATPase
  misc_feature (1)..(339): Xaa is any amino acid
MARQNGGHRPGEKXDAEGNYTLSYSGQRSYTNCCKNIYTSAYKKEXLLTTXVMISTNVRVMRCRDEKYSALQNDIERGQQKIKEQEIITNNQSNIIFAISVSLALALIFGFVLLYYLRENKKITARLALKNEEILKQSEQLIELGKKANAANEAKIQFFTKMSHELRTPLTLILGPVEDLMENEKVNRVAAQSLSLIQKNTLRLLKLINQLMDFRKIEIDKLKINVAENDIVSFLNQIIEAYKNIARKRNIDLRFFTSQYFLNVWFDETMLDKVLFNLLSNAFKFTNDNGYIHIFLEKNEAAKNIKIIIEDNGVGMSEVAVEHAFELFYQGNMKIPRTG

SEQ ID NO: 5753 - DNA, 897 bp, Unknown
  Obtained from environmental sample
  misc_feature (1)..(897): n is a, c, g, or t
ttgctaatgcaaaattgctaccggttgctgcatgtgggcatttgtttaatgttacggtttactatagctgctattattttttctttcattattttaatatcctcctgtaatgaaaacgaaaataaaaagcagtatatcgttggcttttcacaatgcactatggtaaacaaatggcgtcaaaccatgctggatgaaatgaagcgtgaactggcatttcatcctgaagtaaaatttgtatttagagatgccaacggcaacacacaaaagcaaactgaacagatacaagagctgatcaatgaaaaaatagatttgttgattgtttcaccgcaggaagctgcaccagttacacccattgttgaaacagcttacaataaaggcattaaagtaattatagttgacagaagaacctcatcacaaaaatacactgcttacgttggcggcagcaattatgaagtgngatcaaccgctgcctcatttgccaattccattttaaaaggcaaaggcaacgttcttgaagtatcagatattccaggctcttctgcagatatagacaggcataacgggttctttacttcgcttcagcaatacccgggcataaaatatatttcaaaaatttatgaagaaggcgatgaccatccatccaataaaaactcaaccgggtttttaaaaaaacatcctgacataccnttaatatttacacagaacgaccgactggcgctggctgtttataatgctgccaaaaactcggcattgaaaataaaaccaagatcattggtgttgaatgattgcccggcaaaaacgtgccatagactgttgaaaaagaatgctgaaggaatatacttatcctacggcggaaaaaactatcaaactgcggaaaaaaataaacaacgggcttaa

SEQ ID NO: 5754 - protein, 298 aa, Unknown
  Obtained from environmental sample
  misc_feature (1)..(298): Xaa is any amino acid
MLMQNCYRLLHVGICLMLRFTIAAIIFSFIILISSCNENENKKQYIVGFSQCTMVNKWRQTMLDEMKRELAFHPEVKFVFRDANGNTQKQTEQIQELINEKIDLLIVSPQEAAPVTPIVETAYNKGIKVIIVDRRTSSQKYTAYVGGSNYEVXSTAASFANSILKGKGNVLEVSDIPGSSADIDRHNGFFTSLQQYPGIKYISKIYEEGDDHPSNKNSTGFLKKHPDIPLIFTQNDRLALAVYNAAKNSALKIKPRSLVLNDCPAKTCHRLLKKNAEGIYLSYGGKNYQTAEKNKQRA

SEQ ID NO: 5755 - DNA, 360 bp, Unknown
  Obtained from environmental sample
  misc_feature (1)..(360): n is a, c, g, or t
gtggctttgggacttgccccaatttttcaattaacaatcaattctgacaaaacgncaaagtgggatgcaggagcgtataacgaaataaataataacccagtagcggggaattttaattcaataattactgaagataaatataatgacatcgtgagtttgctcaattaccttgactttgaaaggttacgaaacaagtatgctgttggttggacagacgaccaatcatcaacattaaaaatcacttacgagaatggtaaggttaaatcaattcacgactatggattgattggaacatatggacttaacagggtttatcaattattatttgcattaagggaaaatcaaaagtggacgaaataa

SEQ ID NO: 5756 - protein, 119 aa, Unknown
  Obtained from environmental sample
  misc_feature (1)..(119): Xaa is any amino acid
MALGLAPIFQLTINSDKTXKWDAGAYNEINNNPVAGNFNSIITEDKYNDIVSLLNYLDFERLRNKYAVGWTDDQSSTLKITYENGKVKSIHDYGLIGTYGLNRVYQLLFALRENQKWTK

SEQ ID NO: 5757 - DNA, 867 bp, Unknown
  Obtained from environmental sample
  misc_feature (1)..(867): n is a, c, g, or t
atgatatcgggtcatggaaatattgaaacagccgttgaagcggtaaaaaaaggagcttatgattatatctccaaacctcctgacctcaaccggctgttgatcactatccgtaatgcgatggataaaggttcgctggtggttgaaaccaaagtgctgaagagaaaagtgagtaaggtgcaggatatgatcggtaattcttcaccgatcaaaaagatcaaggaaactattgaaaaagtcgctcccacggaggcacgcttgttaatcacgggagataacggcgtcggaaaggaactggtagcaagatgggttcacgaaaaaagtaaccgtgcttcgggtcccatggtggaagtgaactgtgcggccattcccactgagctgatcgaaagcgaattgttcggtcatgaaaaaggatcctttacttcagccatcaaacaacgtataggaaaatttgaatccgccaatgggggtacgttattcctggatgagataggggatatgagtgctaatgcgcaggcaaaagtattgcgtgccttgcaggaaggtaagatcacccgcgtgggcgcagataaagacatcacggtggatgtgcgggtaattgcggcaaccaataaagacctgctaaaagaagtggaagaaaaaaatttccgccttgacctctatcaccgcctaagtgtgatcatcattcatgttccatcattaaatgaaagaagggatgatatccccttactcgtagaccagtttctcaatgatatttgttctgattacggtgtaccccaaaaagacattggtgaggatgcgatgaaattgctgcaggaatacaactggactggtaatatcggggaattaagaaacgtggtcgaaagttag

SEQ ID NO: 5758 - protein, 288 aa, Unknown
  Obtained from environmental sample
  DOMAIN (62)...(283): Sigma-54 interaction domain
  misc_feature (1)..(288): Xaa is any amino acid
MISGHGNIETAVEAVKKGAYDYISKPPDLNRLLITIRNAMDKGSLVVETKVLKRKVSKVQDMIGNSSPIKKIKETIEKVAPTEARLLITGDNGVGKELVARWVHEKSNRASGPMVEVNCAAIPTELIESELFGHEKGSFTSAIKQRIGKFESANGGTLFLDEIGDMSANAQAKVLRALQEGKITRVGADKDITVDVRVIAATNKDLLKEVEEKNFRLDLYHRLSVIIIHVPSLNERRDDIPLLVDQFLNDICSDYGVPQKDIGEDAMKLLQEYNWTGNIGELRNVVES

SEQ ID NO: 5759 - DNA, 546 bp, Unknown
  Obtained from environmental sample
  misc_feature (1)..(546): n is a, c, g, or t
ttgaaaacaaaaacgctaaaagcaaataaggtaaacgtagtgacgttgggctgttccaagaatttggttgacagtgaggtattgatgggtcagttgaaagccaacaactatgatgtggtacatgaaagcaccaagaatgatgctggtattgtaatcatcaacacttgtggatttattgacaatgccaagcaggaaagcattgacacgattctgcattatgccaatctgaaagaaaagggaaagattgacaagctatacgttaccggatgtctttctgagcgctacaaaggcgatctggaacaggaaattcctattgtagacagctattttggaacacgagaattgccacgtttattaaaaacgttaaaagcagactacaaacacgaactgattggcgagcgcttactgactacaccaaaccattttgcctattttaaaatatctgaaagctgcgaccgtccctgctctttctgcgctattccattaatgcgtgccggacacatctctaaaactattgaagaattagttacagaagccaccagctag

SEQ ID NO: 5760 - protein, 181 aa, Unknown
  Obtained from environmental sample
  DOMAIN (10)...(111): Uncharacterized protein family UPF0004
  misc_feature (1)..(181): Xaa is any amino acid
MKTKTLKANKVNVVTLGCSKNLVDSEVLMGQLKANNYDVVHESTKNDAGIVIINTCGFIDNAKQESIDTILHYANLKEKGKIDKLYVTGCLSERYKGDLEQEIPIVDSYFGTRELPRLLKTLKADYKHELIGERLLTTPNHFAYFKISESCDRPCSFCAIPLMRAGHISKTIEELVTEATS

SEQ ID NO: 5761 - DNA, 894 bp, Unknown
  Obtained from environmental sample
  misc_feature (1)..(894): n is a, c, g, or t
ttgaaagtggtgagagatattgaaacatcagcgggtggcacggagacacctggtgaagaagaaaaaaaagggaaggtggttaagaaggcggggaagaggataggatataattatattattttgaaaagtttaaaggagagtcagaagaatgatgtggtgaaatgtttatatataaagagtttgtttaagtggggaatttgcgtgattaaggaggggacgtatggagactcgaaggatcggtgggggagagacataaaagacaaactaatctggcaaaaaaaacttcatgaacaacttcaaaataaggtaagagtacccaagtatctagacaattttgaagaaaatggaaattattatctggtaattgaatatataaaaggaaaatctctttataaagctataaaagaaaaaaaagagttaagagacagtttaattaaaggcgacaaattaggtcggacttttattacttatataatacagttaatagctttgctggatagactacatcagaataatattattcatagggatgtatcttcaaataactttatagttacatcatcaggaaaagtggccgtaattgatatggagctcagctattgcttcgaaaataatctgccatctccaccttttcaactaggtacatatggatttatgtcgccccagcaagaaaacatgaagactccagtagttaaagatgacattttctctattggatcaatactttttcaactatggacaggaatttcaccaaataagctaattggtacatcagaagaagatcttaccaanaaaatacatttcttttatccagataaaagcatttcagaaacagttattaattttgctacatatgaccccgatnaaggccacaattnaccactatttcactag

SEQ ID NO: 5762 - protein, 297 aa, Unknown
  Obtained from environmental sample
  DOMAIN (18)...(296): Protein kinase domain
  misc_feature (1)..(297): Xaa is any amino acid
MKVVRDIETSAGGTETPGEEEKKGKVVKKAGKRIGYNYIILKSLKESQKNDVVKCLYIKSLFKWGICVIKEGTYGDSKDRWGRDIKDKLIWQKKLHEQLQNKVRVPKYLDNFEENGNYYLVIEYIKGKSLYKAIKEKKELRDSLIKGDKLGRTFITYIIQLIALLDRLHQNNIIHRDVSSNNFIVTSSGKVAVIDMELSYCFENNLPSPPFQLGTYGFMSPQQENMKTPVVKDDIFSIGSILFQLWTGISPNKLIGTSEEDLTXKIHFFYPDKSISETVINFATYDPDXGHNXPLFH

SEQ ID NO: 5763 - DNA, 831 bp, Unknown
  Obtained from environmental sample
  misc_feature (1)..(831): n is a, c, g, or t
ttgaattttcatttaaaatatgctaacgggatttttaaatttcttgatgcaaatcaaactacttacactaatattaattattccaatggtatttcaggtcagggtatagcttatttgaattgcatttttcacctgtcagatgaagaaattaaaataaaattaaagaattatatagacattattattgaaaaacaatcaatcactgtttcttggattatttccgataaagaaaagtacaagacaactagaggatttgcacgtggcgcagccggtataatatattttttgctacaatattctttgaaatacaaagataattatgctttagaaagtgccgaacgagggttaaattggctgaaaaaagttgctatttatcacaaagataaaatagactggaaatcgactaataataaaaagattgatccctggtggtgcgaaggtgcccctggtatctctttaacattcatgaaagcatatagcatattcaaaacggatcagtataaaaaaattgcatatggtgctctattaaataatccagataaaattgtaaataataatcttagccaatacgacggtttatgtgggttaggcgagctttatttagaggctttcaaaatatttaaagaagaaatctggataaatcgtgctgaatggataatgcaagttgtaatgcaaatgaaaaaggaacacaacttatatggaccttactggctagtaaagaatgaacgtcaacctgtaatagattttatgactggaagtagcgggttaattcactttttattaagatactgctttcaagatagaatatcatttcctttattagggcaataa

SEQ ID NO: 5764 - protein, 276 aa, Unknown
  Obtained from environmental sample
  misc_feature (1)..(276): Xaa is any amino acid
MNFHLKYANGIFKFLDANQTTYTNINYSNGISGQGIAYLNCIFHLSDEEIKIKLKNYIDIIIEKQSITVSWIISDKEKYKTTRGFARGAAGIIYFLLQYSLKYKDNYALESAERGLNWLKKVAIYHKDKIDWKSTNNKKIDPWWCEGAPGISLTFMKAYSIFKTDQYKKIAYGALLNNPDKIVNNNLSQYDGLCGLGELYLEAFKIFKEEIWINRAEWIMQVVMQMKKEHNLYGPYWLVKNERQPVIDFMTGSSGLIHFLLRYCFQDRISFPLLGQ

SEQ ID NO: 5765 - DNA, 708 bp, Unknown
  Obtained from environmental sample
  misc_feature (1)..(708): n is a, c, g, or t
gtggacctgaacacggaagttcgcctgaagctggactataacggatacattaagaacgcctacattcttgtaaaggacaaaacacttgccacgcagataaaaaaggccctgtacaatatggagccctggaatccggcagtacgaaatggaaccttgatcaagtgcgatgttaaatttaatttgcagtatgcgtctgatggcaccatgaagttgaaaggaggaatcaccgtaccgtcttatcttgccaaatgcggaattaagacagatgaagagttgtttgatttttcgaaaaaggaaacaaaagaaaagaggattgccagtgtttttcaggtgcaggataacacaattttcaaagaagtgatcaggcgaaatcccctggatagtcttttgttggttgtagatctcacgggaagcatggggccttatattgcccaggtgcttgagttgatggcagaccttgtgatcaatgacaacccgcacgtgtcatgtgtgtctctttttaatgacggcgataaaacacctgacaaaaacaagcaggttggcagaacaggggggatccttattctggatggtgagataaccctggaggaacttggcaaggcggttctcangagcatgaagaatggttcaagcggagattgtatggagaatacattgaggcaacactcaaagggatcaaaaactgtaaggaatgcagggatgtggtga

SEQ ID NO: 5766 - protein, 235 aa, Unknown
  Obtained from environmental sample
  misc_feature (1)..(235): Xaa is any amino acid
MDLNTEVRLKLDYNGYIKNAYILVKDKTLATQIKKALYNMEPWNPAVRNGTLIKCDVKFNLQYASDGTMKLKGGITVPSYLAKCGIKTDEELFDFSKKETKEKRIASVFQVQDNTIFKEVIRRNPLDSLLLVVDLTGSMGPYIAQVLELMADLVINDNPHVSCVSLFNDGDKTPDKNKQVGRTGGILILDGEITLEELGKAVLXSMKNGSSGDCMENTLRQHSKGSKTVRNAGMW

SEQ ID NO: 5767 - DNA, 612 bp, Unknown
  Obtained from environmental sample
  misc_feature (1)..(612): n is a, c, g, or t
atgagcaggaaaactattttttatattgtttttttctttttgctggtgataggtttttattttacgatgggccggctgataccgggttttggaaaatcaagacttgagcctatcgggagagtatctcctttttcatttacgaaccaggatggaaaaacggtgacggagaaagatgtggccgggaagatctttgttgccgaatacttttttactacctgcaaaagcatatgcccgatcatgaatgcaaatatgaaaatagtgtatgagcgatttaaaaatgaaaaagactttcttatactttctcacacaagtgacccggctacggattctgcagcaagattaaaaaaatatgcagattcattgaatgttgataccgaaaaatggatctttcttacaggcaccaaggacagtctttatagacaagcccggtacagctataaaattgatgatcctaataataacccgcttaataacgaagtagattttcttcattcccagtttttttcattggttgataaaaagggagatgttagaaaaatttatgaagggaatgaaaagaaagatgtagaaaggatgataaaggagatagaagtattgctgaaagaaaaataa

SEQ ID NO: 5768 - protein, 203 aa, Unknown
  Obtained from environmental sample
  DOMAIN (9)...(184): SCO1/SenC
  misc_feature (1)..(203): Xaa is any amino acid
MSRKTIFYIVFFFLLVIGFYFTMGRLIPGFGKSRLEPIGRVSPFSFTNQDGKTVTEKDVAGKIFVAEYFFTTCKSICPIMNANMKIVYERFKNEKDFLILSHTSDPATDSAARLKKYADSLNVDTEKWIFLTGTKDSLYRQARYSYKIDDPNNNPLNNEVDFLHSQFFSLVDKKGDVRKIYEGNEKKDVERMIKEIEVLLKEK

SEQ ID NO: 5769 - DNA, 672 bp, Unknown
  Obtained from environmental sample
  misc_feature (1)..(672): n is a, c, g, or t
atgcacacatggcncgatactttgttttatttttatacanncctgcaacttccaaaaacctccccgatatattttaactggctatacctcanncagcagaagnaagtccgaaactcnntngcccggtttctccggaaatattattctgatgatgctgaaaganccttgcttttaggaatcaaccctnggcggtatgggcggggcattacaggcatcaattttactgcaccaaaacacttgagggaatattgcacaattaaaagtcctttttccggcactgagctttcagccgaattcatatatacgatgatcgaagcttatggtggaactaaaaaattttacaggaatttttttattggttctgtttgccctttaggctttgtgcaaaatggaaaaaatctaaattattatgacaacaaggagcttttgaaaacaatagaaccttttattgttgaaaatcttacaaagctggtttcttataaggtaaacaaagaaaaatgcatttgtatcggcggagaaaaaaactttgcttgcctgttttcacttaatcaaaaatatcagtggtttaaaaacattgtatcagtgcctcacccaagatttatcatgcagtataaaagaaagtatatccaggattttattaatctttatttggacgtgttaaaaagaaaataa

SEQ ID NO: 5770 - protein, 223 aa, Unknown
  Obtained from environmental sample
  misc_feature (1)..(223): Xaa is any amino acid
MHTWXDTLFYFYTXLQLPKTSPIYFNWLYLXQQKXVRNSXARFLRKYYSDDAERXLLLGINPXRYGRGITGINFTAPKHLREYCTIKSPFSGTELSAEFIYTMIEAYGGTKKFYRNFFIGSVCPLGFVQNGKNLNYYDNKELLKTIEPFIVENLTKLVSYKVNKEKCICIGGEKNFACLFSLNQKYQWFKNIVSVPHPRFIMQYKRKYIQDFINLYLDVLKRK

SEQ ID NO: 5771 - DNA, 417 bp, Unknown; identical to SEQ ID NO: 751
  Obtained from environmental sample
  misc_feature (1)..(417): n is a, c, g, or t

SEQ ID NO: 5772 - protein, 138 aa, Unknown; identical to SEQ ID NO: 752
  Obtained from environmental sample
  misc_feature (1)..(138): Xaa is any amino acid

SEQ ID NO: 5773 - DNA, 324 bp, Unknown
  Obtained from environmental sample
  misc_feature (1)..(324): n is a, c, g, or t
ttgtttggcatttgtaatttgcttcctggtaaaagtttgaaaaaatggctctacaagcaacatggaatagatgttctctccaatgatcatgcaggttgcattctcattcgtaaactgctcattgaatgtaaacccaagactggaaaaaaaatcaatggatgcctgcagctctttcacaggaaggttgacatagatctgggaaatcattttttttggcttttaaactgtagtgtatttgtatcacaaacatactacagcattcagttcaaccatggtggtcctttaagccaaaggttggggccattacgacagtgcggaaaataa

SEQ ID NO: 5774 - protein, 107 aa, Unknown
  Obtained from environmental sample
  misc_feature (1)..(107): Xaa is any amino acid
MFGICNLLPGKSLKKWLYKQHGIDVLSNDHAGCILIRKLLIECKPKTGKKINGCLQLFHRKVDIDLGNHFFWLLNCSVFVSQTYYSIQFNHGGPLSQRLGPLRQCGK

SEQ ID NO: 5775 - DNA, 330 bp, Unknown
  Obtained from environmental sample
  misc_feature (1)..(330): n is a, c, g, or t
gtgcctgattttgagtatgcgaatgaaggcaaaattgtaataataaaaaaattgcgtatttttttttattcaaaaatgagcaaatacggatttgactatactcctctctcagattcatatgataaaaccacagaatcgcagcgtatttcctcatttcttttctggcttgttgtagtatcagttttgataatttgtttttccattggtaaacggaatactgctccaataacatggaagggtaatagaaaaacaagaaagaaaaagcaaagtctaaaatctaattcagtttatattggtactggttcaataaattacaaacgaaaattttaa

SEQ ID NO: 5776 - protein, 109 aa, Unknown
  Obtained from environmental sample
  misc_feature (1)..(109): Xaa is any amino acid
MPDFEYANEGKIVIIKKLRIFFYSKMSKYGFDYTPLSDSYDKTTESQRISSFLFWLVVVSVLIICFSIGKRNTAPITWKGNRKTRKKKQSLKSNSVYIGTGSINYKRKF

SEQ ID NO: 5777 - DNA, 417 bp, Unknown
  Obtained from environmental sample
  misc_feature (1)..(417): n is a, c, g, or t
atgctcataggtcaattagtaaaagaaaccgggttatcgaaagacaccatccgtttttatgagaagcacgggttaattaaaatttcccgtaaggaaagaagagaaaacaactataaagagtattcaacagaaattctggaaaagctaatgactattaagcggcttaaagattttggctttacgctgaatgaagtttctgaaatgctggacctgattgaaatgaatgaagcaacctgtaacaatgtttctcataaaatatctgcgaaggttgagctattagatcagaagataaaagagctcataaacgttcgaacaatacttttagccggcgcaaaaaaatgtgccgggtattgtaatcccgatatggcagaagataattgcccgatcatagttcctcaaaaaagcccggaggtttag

SEQ ID NO: 5778 - protein, 138 aa, Unknown
  Obtained from environmental sample
  DOMAIN (2)...(41): MerR family regulatory protein
  misc_feature (1)..(138): Xaa is any amino acid
MLIGQLVKETGLSKDTIRFYEKHGLIKISRKERRENNYKEYSTEILEKLMTIKRLKDFGFTLNEVSEMLDLIEMNEATCNNVSHKISAKVELLDQKIKELINVRTILLAGAKKCAGYCNPDMAEDNCPIIVPQKSPEV

SEQ ID NO: 5779 - DNA, 609 bp, Unknown
  Obtained from environmental sample
  misc_feature (1)..(609): n is a, c, g, or t
gtgatagttatcccgatgaaaatccgnctttatactcaacgtcaacaagcaatacatccaaaaaaaattaaggaatcgatagggttcatgtatatgaatagaatccgaaaagaaatagaactcggactgataggtaagctggggttccaaattggtggagataactgttgttggaaagcacaagaaattgttcaacatgtagaaggtccctcagcgccaaacgcctttactgtaccgctgacctatattcaaccttcaaactcaaaaggaatccttaaatttctaattagcttatcggagccttggaaaaatgatattttgaaaacactgaattttctggctaaaagagatggtatgactgtttatgatgaagggcatatggagcataaaccacccaatattcctacatcatcacaaggtgaaatgattaataatttaaaattatttgctaagaaccatggaatggggtgttttgaacaaggacgagaagtctacaaaacaacaaagtatgcgaattcatttgatgaacaatacctccatcaaccttcacatttaaatcagcaaattgaaaatggagaattacacggaacagtttattttggaagttaa

SEQ ID NO: 5780 - protein, 202 aa, Unknown
  Obtained from environmental sample
  misc_feature (1)..(202): Xaa is any amino acid
MIVIPMKIRLYTQRQQAIHPKKIKESIGFMYMNRIRKEIELGLIGKLGFQIGGDNCCWKAQEIVQHVEGPSAPNAFTVPLTYIQPSNSKGILKFLISLSEPWKNDILKTLNFLAKRDGMTVYDEGHMEHKPPNIPTSSQGEMINNLKLFAKNHGMGCFEQGREVYKTTKYANSFDEQYLHQPSHLNQQIENGELHGTVYFGS

SEQ ID NO: 5781 - DNA, 756 bp, Unknown
  Obtained from environmental sample
  misc_feature (1)..(756): n is a, c, g, or t
ttgaggattgttaaggatttagttgatagagatatggcatatgaagttgatggcacagtttattttgaagtcagtaaatttgctaattatggaaagctttcgagattttctaaagaagaaatgattgccttatcaaaagaaagaggtgcagatccagaagatcctaataaaaaaactcctttagattttatactctggcagaaggcaaaaccaggagaaccaacatgggattcaccttggggaaaagggagaccaggatggcacatagaatgttcatcaatgatttacgattaccttggagcgagaattgatattcacggcggaggagaagacttaatctacccacaccacgagagcgagattgcccagagtgaaagctttactggtaaatctccatttgttaactacttcctgcatacaggaagtgtaggatatcatacggagaaaatgtcaaaatctttaggaaatttaataatggtttcagaactcctaaagcaatattctccaaatgcgattcggtacctacttttgtctcgtaagtgggatgatccatgggagtatagggattccgatattgaaaaagcggcaaaaaaggtggaggagcttaataatacaaacaataaaactggaaagcttgaggattttattgcagttctagaaaacaatttgaatacaagaggagcattaaaaatacttccaactcttcctaagaatgattttaaagtagccgccgagatactaggttttaagctataa

SEQ ID NO: 5782 - protein, 251 aa, Unknown
  Obtained from environmental sample
  DOMAIN (2)...(197): tRNA synthetases class I (C) catalytic domain
  misc_feature (1)..(251): Xaa is any amino acid
MRIVKDLVDRDMAYEVDGTVYFEVSKFANYGKLSRFSKEEMIALSKERGADPEDPNKKTPLDFILWQKAKPGEPTWDSPWGKGRPGWHIECSSMIYDYLGARIDIHGGGEDLIYPHHESEIAQSESFTGKSPFVNYFLHTGSVGYHTEKMSKSLGNLIMVSELLKQYSPNAIRYLLLSRKWDDPWEYRDSDIEKAAKKVEELNNTNNKTGKLEDFIAVLENNLNTRGALKILPTLPKNDFKVAAEILGFKL

SEQ ID NO: 5783 - DNA, 504 bp, Unknown; identical to SEQ ID NO: 2267
  Obtained from environmental sample
  misc_feature (1)..(504): n is a, c, g, or t

SEQ ID NO: 5784 - protein, 167 aa, Unknown; identical to SEQ ID NO: 2268
  Obtained from environmental sample
  DOMAIN (7)...(129): Transcriptional regulator
  misc_feature (1)..(167): Xaa is any amino acid

SEQ ID NO: 5785 - DNA, 684 bp, Unknown
  Obtained from environmental sample
  misc_feature (1)..(684): n is a, c, g, or t
ttgtattttactcttggtaaagcaatgctctacctgtgtaaagatcttcctttctggcacttttatagtttcccggaaatggcggcgttcaaaacattcgtatggataaaaacggtgcggaatgatcccgcctacaacaataaaaaattctcattagctgaatatccttttgaaggatgttataagctcggtcaggaaatgatacagcaatataacatgataccttcgattgaactctggaattatgaaagtatcaatagtactacacttcagattcagtattaccgcgatgcaggtatattttccaattccaaagatttgaatattgttattgattcctttgttcaaacacttgagcatattcagcaacaggttgaaaaaggaataaaatttttgcctggcgtcagcgatgtaaattataaagcatcacttaagttttttgtgaacgaagttattcttggcaacaatactattctggctgaagtaaatggtaataaactttcttttatcaactacaatacgcttgattatctttttacaaaagatgggcgctttacggaaattgtttttaataatttctataccctcatgagccgctccagccagattagtgaaaccggcgaaaaagagcgtaatcgttttttcagcaagttaaaagacaaaatatttcttttaaaaagttga

SEQ ID NO: 5786 - protein, 227 aa, Unknown
  Obtained from environmental sample
  misc_feature (1)..(227): Xaa is any amino acid
MYFTLGKAMLYLCKDLPFWHFYSFPEMAAFKTFVWIKTVRNDPAYNNKKFSLAEYPFEGCYKLGQEMIQQYNMIPSIELWNYESINSTTLQIQYYRDAGIFSNSKDLNIVIDSFVQTLEHIQQQVEKGIKFLPGVSDVNYKASLKFFVNEVILGNNTILAEVNGNKLSFINYNTLDYLFTKDGRFTEIVFNNFYTLMSRSSQISETGEKERNRFFSKLKDKIFLLKS

SEQ ID NO: 5787 - DNA, 615 bp, Unknown
  Obtained from environmental sample
  misc_feature (1)..(615): n is a, c, g, or t
atgggattctacgtggaagtggcttttgatggaacggtaggctttcttttatttgcgggcagggattttaacttggttattcttgatataaatcttcctggaatgaacggttatgatctatgcaaagccattcgttcccaaaaccagcaggtcccggtgcttatgctgacttcaatgggcgccctgaaagataaaattgagggatatgactcaggagccgatgattatatggttaaaccatttgaatttaaggagctgctgctgaaaatcagatccttgcttaagcggagcatgaaccagggtgcgcccgttggaaacgtcttgaaagcatctgacctggagatgaaccttgatagtaaagaagtaaaaagagacgagggcataattcatttgactgcgaaggaattccagttacttgaatacctgttacgtaataaaaacagggtagtatcgagagccgatattgctattaatgtgtgggacgtggattttgaaacgaacactaacgtgatcgacgtatacataagttatctgcggaataaggtcgataaaaattttgatcacaaattaattcagacccaggttggtatgggatatattctaaaagagcattaa

SEQ ID NO: 5788 - protein, 204 aa, Unknown
  Obtained from environmental sample
  DOMAIN (1)...(98): Response regulator receiver domain
  misc_feature (1)..(204): Xaa is any amino acid
MGFYVEVAFDGTVGFLLFAGRDFNLVILDINLPGMNGYDLCKAIRSQNQQVPVLMLTSMGALKDKIEGYDSGADDYMVKPFEFKELLLKIRSLLKRSMNQGAPVGNVLKASDLEMNLDSKEVKRDEGIIHLTAKEFQLLEYLLRNKNRVVSRADIAINVWDVDFETNTNVIDVYISYLRNKVDKNFDHKLIQTQVGMGYILKEH

SEQ ID NO: 5789 - DNA, 606 bp, Unknown
  Obtained from environmental sample
  misc_feature (1)..(606): n is a, c, g, or t
gtgataacaaatgataaaatgaatattctaggaattgcttctagtatgcgaaaagaatccactagcactagagctttaaaattaacacttgatatagtcaagacaaagtatgatgcaaaaatccaagttttagatttaaaacaaacgatactaccatttttgtattatgaagaacacaataaaaaagctgaaatctcaatagctgaaaaaatggtcaagtcggctgatgcatttattctttccacacccgattatcatggttctatggctggatctatgaaaaattttctagactacttttggtccgaattcgcaggaaaactttttgggtatatatgctcttctcatgaaaaaggcttgacagtaatggatcaaatgcgcacagctgtgagacaatgttatggatggagtatgccttatggtatctctataaatggagaaaaagactttaaaactaatggatatattagaaacgaagcagtattacgaagaatgcaaatgttagcaagagatattgtaatatacggtaaattacatagaaatcaatttcttaatgatttaagttcccaagaaataaatacatttgcctctcattatagacaataa

SEQ ID NO: 5790 - protein, 201 aa, Unknown
  Obtained from environmental sample
  DOMAIN (7)...(174): NADPH-dependent FMN reductase
  misc_feature (1)..(201): Xaa is any amino acid
MITNDKMNILGIASSMRKESTSTRALKLTLDIVKTKYDAKIQVLDLKQTILPFLYYEEHNKKAEISIAEKMVKSADAFILSTPDYHGSMAGSMKNFLDYFWSEFAGKLFGYICSSHEKGLTVMDQMRTAVRQCYGWSMPYGISINGEKDFKTNGYIRNEAVLRRMQMLARDIVIYGKLHRNQFLNDLSSQEINTFASHYRQ

SEQ ID NO: 5791 - DNA, 567 bp, Unknown
  Obtained from environmental sample
  misc_feature (1)..(567): n is a, c, g, or t
atgcaaagtgtttggtacggcaagccatacaccctgccctttttatatgttggtacatggagaaatattatgtttccccaaaaagggaaagatattccgtttactattgagaactatgcttacaaagacaagttcggaagagaaacagttacatgggttcgcaagtatcagtttccaaatcgtgaaaggagatttgatgcaacaatgatttacagcgaaaagagaaaacggattgttgattatttaggaacacatcaacaccttgcggttgatattgaaatgactgttgcaaaaaatgggggattaaaacttcattcagccgaacaacgattttatgaaggattctttagtttcaaatttccaatgatattttcgggcgatgcaaacgtttgtgaatggtttgacgataaagagcagaaattcaaaatctctgtagttgtagttaacaagacgtgggggaaattatttggctacgaaggaacatttgaaactgaatacatacctgtaaattccattacagacattccaaaagatgttttaccaaaaagagaagaaattcgtgagtaa

SEQ ID NO: 5792 - protein, 188 aa, Unknown
  Obtained from environmental sample
  misc_feature (1)..(188): Xaa is any amino acid
MQSVWYGKPYTLPFLYVGTWRNIMFPQKGKDIPFTIENYAYKDKFGRETVTWVRKYQFPNRERRFDATMIYSEKRKRIVDYLGTHQHLAVDIEMTVAKNGGLKLHSAEQRFYEGFFSFKFPMIFSGDANVCEWFDDKEQKFKISVVVVNKTWGKLFGYEGTFETEYIPVNSITDIPKDVLPKREEIRE

SEQ ID NO: 5793 - DNA, 414 bp, Unknown
  Obtained from environmental sample
  misc_feature (1)..(414): n is a, c, g, or t
atggttcgcaagtatcagtttccaaatcgtgaaaggagatntgatgcaacaatgatttacagcgaaaagagaaaacggattgttgattatttaggaacacatcaacaccttgcggttgatattgaaatgactgttgcaaaaaatgggggattaaaacttcattcagccgaacaacgattttatgaaggattctttagtttcaaatttccaatgatattttcgggcgatgcaaacgtttgtgaatggtttgacgataaagagcagaaattcaaaatctctgtagttgtagttaacaagacgtgggggaaattatttggctacgaaggaacatttgaaactgaatacatacctgtaaattccattacagacattccaaaagatgttttaccaaaaagagaagaaattcgtgagtaa

SEQ ID NO: 5794 - protein, 137 aa, Unknown
  Obtained from environmental sample
  misc_feature (1)..(137): Xaa is any amino acid
MVRKYQFPNRERRXDATMIYSEKRKRIVDYLGTHQHLAVDIEMTVAKNGGLKLHSAEQRFYEGFFSFKFPMIFSGDANVCEWFDDKEQKFKISVVVVNKTWGKLFGYEGTFETEYIPVNSITDIPKDVLPKREEIRE

SEQ ID NO: 5795 - DNA, 495 bp, Unknown
  Obtained from environmental sample
  misc_feature (1)..(495): n is a, c, g, or t
atggaaaataacgttataacacaatcaattagaaagtgtatagggaaatcccaagttaatagttgtagtataatttcaggatatattgcaggttggattcaggcactagtaaaaaaggatatgacaattatggcaactgaaatcaagtgtcgaggtaaagggaatgatatttgtcattttgttgttggttccaccaagcatgttcatgaatatctatcaaatcaaccaaataaatccagtaaagtcaacaacagtactgtgtcaaattatggttcttattttagttacttacatgaacagcaaagcaataataatggtcccaacttcatatcacttctcattgattttaatttatgtgtagattcgttcgggaaactgtctaacaaattatctaaaagtttgaaaaaagttccaaacaatgtagagaatttggtaatattcgaaaaccaaattttaagcaatttattgaaaggcttgttccgtacacaaatataa

SEQ ID NO: 5796 - protein, 164 aa, Unknown
  Obtained from environmental sample
  DOMAIN (3)...(64): V4R domain
  misc_feature (1)..(164): Xaa is any amino acid
MENNVITQSIRKCIGKSQVNSCSIISGYIAGWIQALVKKDMTIMATEIKCRGKGNDICHFVVGSTKHVHEYLSNQPNKSSKVNNSTVSNYGSYFSYLHEQQSNNNGPNFISLLIDFNLCVDSFGKLSNKLSKSLKKVPNNVENLVIFENQILSNLLKGLFRTQI

SEQ ID NO: 5797 - DNA, 522 bp, Unknown
  Obtained from environmental sample
  misc_feature (1)..(522): n is a, c, g, or t
gtgggaaatcgcatggcaaaaagaagtttggttattacaaaagggacgtgggtgccgtcagatggttttatctggctctacaaagatcaaattatgagaggccgttataaatggaaaggggatacgcttcaatattacaatccgttattaaggaaagctttttccatggcgcatttgcaggatgcattacaaaacgcggcatggcgcaataaggacaaagagggaactatcgtatttggcacagggaatgaacctttctggaatattgagcttgataataaagattcattgtcctttttactttccgaatgggagcatccattaaaaatgaaatttgaatcttcgtttagtaataccgatagtataggctatttggggaaaaatgattccatacgaatacatgttactatttttcctcagttttgcagcgatggtatgagcgatttcgcttaccgtaataaaataaaagtgcagtataaccagcaggtttacaatggatgtggaatattatataaacaatga

SEQ ID NO: 5798 - protein, 173 aa, Unknown
  Obtained from environmental sample
  misc_feature (1)..(173): Xaa is any amino acid
MGNRMAKRSLVITKGTWVPSDGFIWLYKDQIMRGRYKWKGDTLQYYNPLLRKAFSMAHLQDALQNAAWRNKDKEGTIVFGTGNEPFWNIELDNKDSLSFLLSEWEHPLKMKFESSFSNTDSIGYLGKNDSIRIHVTIFPQFCSDGMSDFAYRNKIKVQYNQQVYNGCGILYKQ

SEQ ID NO: 5799 - DNA, 831 bp, Unknown
  Obtained from environmental sample
  misc_feature (1)..(831): n is a, c, g, or t
ttgtgtccagaatttacggttttagaaccagattttttgatggacgtaacctctgtggccgaatgtttttcgcgcacgggcgacagcgtatatcaatatttagccaataagtttttgatgaaacagcattctttttctattatgaaggggaatatggccaacttttttctggacgaaattctgaaatcagacgaccctgagtcaatagattatcgcactatttttgctaaaacatttagaatcaatcctttagctttcgcgttgttcaaagacgaggaggtgaaacagttgttcaaagattgtttttaccattttgaaaacatcaaaacggtcattcgccgcgatttttccgactttaagattctaaaagaacaaaccctcattgaaccgtttttcctttcgcccacctttggcattcaggggcgattggacttgatgcacattcgcgcgggcgacgaggggcataaggatattattgaattgaaaagcggcaagtcgcccgacccaacgggggcgtcgcaaatgtggattaaccacctgattcaggtgcagttatacgacctgttgctggcctcggcctacgacgaagaccggaaagggtttaattttatcctgtattcggcggcgcagatgcaaaatatgcgccacgccagccgactgaaaggcttgcagcaacaggccattatggtgcgcaaccggatggtggccattgactttgaactggccgataccagtcccgaaaacttgcccaaaaagtcgatgggaaaattgaaaaccgaatttcacctgaacgaacagggttttatttttgaaaaatttcgccagaaatga

SEQ ID NO: 5800 - protein, 276 aa, Unknown
  Obtained from environmental sample
  misc_feature (1)..(276): Xaa is any amino acid
MCPEFTVLEPDFLMDVTSVAECFSRTGDSVYQYLANKFLMKQHSFSIMKGNMANFFLDEILKSDDPESIDYRTIFAKTFRINPLAFALFKDEEVKQLFKDCFYHFENIKTVIRRDFSDFKILKEQTLIEPFFLSPTFGIQGRLDLMHIRAGDEGHKDIIELKSGKSPDPTGASQMWINHLIQVQLYDLLLASAYDEDRKGFNFILYSAAQMQNMRHASRLKGLQQQAIMVRNRMVAIDFELADTSPENLPKKSMGKLKTEFHLNEQGFIFEKFRQK

SEQ ID NO: 5801 - DNA, 435 bp, Unknown
  Obtained from environmental sample
  misc_feature (1)..(435): n is a, c, g, or t
atgaaaaagatattattcatcgcagcaacagcagtcctattctctactacaacaatggccgcagagcccactgaaaaggtactggaagcatttagtaaaacatttaaccaggtaaaagatgtaagctggcaggatgttaatgaaaactacgaagccaactttaaccagaataacattacctatcgtgttatgtatgataaagaagggaacgtagtaaaaagcattcgttattattattctgtaaatcttcccatttttatccaggccaaactcagtaaaaagtttgatggtaaaaaagtttttggcgtaacagaaattacaacagaaagcgatgttacttattacattatcctggaagatgaaaaaacatggacacatgtacagtccgatgcgtttggaaacatgttcacagaaaagaaattaaaaaaagcataa

SEQ ID NO: 5802 - protein, 144 aa, Unknown
  Obtained from environmental sample
  SIGNAL (1)...(20)
  misc_feature (1)..(144): Xaa is any amino acid
MKKILFIAATAVLFSTTTMAAEPTEKVLEAFSKTFNQVKDVSWQDVNENYEANFNQNNITYRVMYDKEGNVVKSIRYYYSVNLPIFIQAKLSKKFDGKKVFGVTEITTESDVTYYIILEDEKTWTHVQSDAFGNMFTEKKLKKA

SEQ ID NO: 5803 - DNA, 660 bp, Unknown
  Obtained from environmental sample
  misc_feature (1)..(660): n is a, c, g, or t
atgcttagtctcctagttaaatttgcgcaattaagatctcatttggaggagttacaaaatggcaatttatattgcagagaaataaaatactttaaggagctagaagatgattccataagaggagatccttttgaggctgttataaaactagggattctcggcccaaatagtgagtttttaatcaggccaaaggatcagcccgaccagccgtggaagaaattaaatattataaaagggaggtatcaagcagctttgccaaacccattgggcaacttgttctgcatgtctttaattccagttgagtttaatgaggatccaaccttatttaaatttgatgaagagttcgaaaagttcggaaattatttcttactggtatataaccaaaaagagttttggaagagattaaaaaaagggttacgaaagaataaaattaagggtgttgggaaaatagtggactatgtagatttcagtacttatagtggcaaaaaaacactatttcaaaaggatgcaagttatgcgtggcaaaaggaaatcagattatacttagacactgaagctgatcgcccttttttattctctataggagatatatcagatatttcgatgatttacgatctcaaccaatacaaaggatttgtaataaagaaggggccactatga

SEQ ID NO: 5804 - protein, 219 aa, Unknown
  Obtained from environmental sample
  misc_feature (1)..(219): Xaa is any amino acid
MLSLLVKFAQLRSHLEELQNGNLYCREIKYFKELEDDSIRGDPFEAVIKLGILGPNSEFLIRPKDQPDQPWKKLNIIKGRYQAALPNPLGNLFCMSLIPVEFNEDPTLFKFDEEFEKFGNYFLLVYNQKEFWKRLKKGLRKNKIKGVGKIVDYVDFSTYSGKKTLFQKDASYAWQKEIRLYLDTEADRPFLFSIGDISDISMIYDLNQYKGFVIKKGPL

SEQ ID NO: 5805 - DNA, 573 bp, Unknown
  Obtained from environmental sample
  misc_feature (1)..(573): n is a, c, g, or t
gtgaatgttcgtgaactggtcaccaatgacattatctcatcattgaaaaacggtgacatcgatattggattactcgctacaccgcttggcgattcgaaattggatgagcaccctgttttttatgaagaattctttgcatacgtgtctgacgatgaaaaggtagcgaagaaaaaatatctccttccgaaagatatcgaccttagcaaactctggcttttagaagaagggcattgcttgcgaaatcaggttctaaatctttgtgagttgaagaaaaaagattttgaaagtgcacggctgcaatacgaagctggaagtattgagacgttgaaaaatttagtagatcatcacaaaggcattaccattctaccacacctggcaactttggatcttggtaaaaaacagaaagaacgcatcagagaatttgcccatccaaaaccgatgcgtgagatcagccttgtagtgaacaagaattttcatcgcataagcatccttgatgcgttgaagaaagaagtggaaaacaacttgccgataacgatcaacaaaagcaaaaagcgcagggtgatggagatctga

SEQ ID NO: 5806 - protein, 190 aa, Unknown
  Obtained from environmental sample
  misc_feature (1)..(190): Xaa is any amino acid
MNVRELVTNDIISSLKNGDIDIGLLATPLGDSKLDEHPVFYEEFFAYVSDDEKVAKKKYLLPKDIDLSKLWLLEEGHCLRNQVLNLCELKKKDFESARLQYEAGSIETLKNLVDHHKGITILPHLATLDLGKKQKERIREFAHPKPMREISLVVNKNFHRISILDALKKEVENNLPITINKSKKRRVMEI

SEQ ID NO: 5807 - DNA, 951 bp, Unknown
  Obtained from environmental sample
  misc_feature (1)..(951): n is a, c, g, or t
atggacaagattgcctttttcccnctttttccncatagcagcaaaataattgatgaccgtcacgcaaattgcaggcatgagctgttaagcaaggtaagactcagcaatgaaaggaaggttatcatgcagcaactcgagctgttagtcattgacgaaataagcatggtacgatgtgatacgctggatgccattgatgctatcctcagaaaagtaagaagcaaaccttcattaccgtatggtggtgtacaggtcttatacattggtgatatgtttcaacttccaccaataagaaatgaagaggactggaagtggttgcgagatcactatgctgaccagtactttttctcaagccatatcttaaaggaacagcctcctgtttatctcgaactaaaaaaggtctaccggcaaagcgatgcgtctttcatagaaattctgaataaggtccggcacaatgaaattgatcgtgttacgctggagatgttgcacagcagatataatccgtcatttaagatacctgaaaatgaaaattatattacacttacaacacacaatagcagcgccaacgaaattaatctgcaatctctttcaaaactaaagggcaacttgttttcattcaaagcaattatagaaggagagttttctgaaaaatcgtatccggccgatccttcattgcagttgaaggtgggtgcacaagtaatgttcattaagaatgacaccgagaaagtcaggcgatattataatggcaagatcggaatcgtagacnagatcgccgaggataagatctgggtgcgaacaaacggagatcaggatacattaatcgaagtgaaaaaagaaacatggaaaaatcttaagtatacactcaataagcaaaccggccacctggacgagactgaagcangctctttcactcantttccgctaaagctggcaggggcaaatactataacatag

SEQ ID NO: 5808 - protein, 316 aa, Unknown
  Obtained from environmental sample
  misc_feature (1)..(316): Xaa is any amino acid
MDKIAFFPLFPHSSKIIDDRHANCRHELLSKVRLSNERKVIMQQLELLVIDEISMVRCDTLDAIDAILRKVRSKPSLPYGGVQVLYIGDMFQLPPIRNEEDWKWLRDHYADQYFFSSHILKEQPPVYLELKKVYRQSDASFIEILNKVRHNEIDRVTLEMLHSRYNPSFKIPENENYITLTTHNSSANEINLQSLSKLKGNLFSFKAIIEGEFSEKSYPADPSLQLKVGAQVMFIKNDTEKVRRYYNGKIGIVDXIAEDKIWVRTNGDQDTLIEVKKETWKNLKYTLNKQTGHLDETEAXSFTXFPLKLAGANTIT

SEQ ID NO: 5809 - DNA, 957 bp, Unknown
  Obtained from environmental sample
  misc_feature (1)..(957): n is a, c, g, or t
atggatgggtccactatcatcaccgactacctctactctgaactattcactggagaagatatcaggaggatcataaacaagatccgggtcagattatttgaggcaggtgatgaataccatgattggataagtttggtaacctacctgcgacttccggaaggttacgatgatcagaaatacaagatttcgttattccttctaatggaaaaactgaaatcgatccgcaaccaaacggaacgctatgtaaccgaaaaaaaaatcactgaaaatcagtttctcaatagccggggtgaattgaaatcatgcatagcttatcttgaaaaagaattagctgaaattggggaaaaggcgaaatacgagaaagaaacccttgaaacatttggactgttaggcagctcttataaaagaattgctgaattgtattacacaaacgattttgtaaatggcgataagctctccataaaagaacaaaaagaagcgctggaaaaagcaagagactattataaaaaagcttgtgacaaaaacctttcccaccactggacaatagttcaatatctttctcttcattccgtcctgacaagttcccctgttgatattgactactggcatgcggccaagcaggcaatcaacaactgcaaaagtgacaatgacccctggccttgcggatcggagattgaattgtatttattagcaaataatcatgatgaagctacaaaaaaaatggtgctggacgcaatagacgcaatggtagtgattgcagctaaagacaagaaagacccggtattcccattggcatcgacgaaagcgcaattaaacaggtataagacatggtgggttaaagaaaatggatatcatctgaacccccacgccctgatcaatgatgatcaaactgtatccactantttaggaaaactagaaacgaaaatttccgaattgntnnaactaacatggaactag

SEQ ID NO: 5810 - protein, 318 aa, Unknown
  Obtained from environmental sample
  misc_feature (1)..(318): Xaa is any amino acid
MDGSTIITDYLYSELFTGEDIRRIINKIRVRLFEAGDEYHDWISLVTYLRLPEGYDDQKYKISLFLLMEKLKSIRNQTERYVTEKKITENQFLNSRGELKSCIAYLEKELAEIGEKAKYEKETLETFGLLGSSYKRIAELYYTNDFVNGDKLSIKEQKEALEKARDYYKKACDKNLSHHWTIVQYLSLHSVLTSSPVDIDYWHAAKQAINNCKSDNDPWPCGSEIELYLLANNHDEATKKMVLDAIDAMVVIAAKDKKDPVFPLASTKAQLNRYKTWWVKENGYHLNPHALINDDQTVSTXLGKLETKISELXXLTWN

SEQ ID NO: 5811 - DNA, 444 bp, Unknown
  Obtained from environmental sample
  misc_feature (1)..(444): n is a, c, g, or t
atgaaaagtttttattttttaatagctatggggatttcactcaatgcatcggcgtttcttgcaaaatcaaatcctaaagaagtgattgatgctgtcatcgaggcgcaaaagaaatcaaatcttgagtgcacagtggaaggtcgtactgaaaaatacaaattaagtggaatggatcttgccggcgtcatggcacaggttccaaagccagaagtaaaagtaaatgaaaattctgttccgcaaattatcatcaatggttctcaagaaggatacggatatgaagtcaatatagaggtctcgacgactcctgactttaatgatattcaaaaattgaaatttgaacattacaaatggattacaaaacgagttaatgtgggaacaatcacaaatcctcgatatcaagaaaataaaactaaagattactttgaaaatataagctgcccgtaa

SEQ ID NO: 5812 - protein, 147 aa, Unknown
  Obtained from environmental sample
  SIGNAL (1)...(18)
  misc_feature (1)..(147): Xaa is any amino acid
MKSFYFLIAMGISLNASAFLAKSNPKEVIDAVIEAQKKSNLECTVEGRTEKYKLSGMDLAGVMAQVPKPEVKVNENSVPQIIINGSQEGYGYEVNIEVSTTPDFNDIQKLKFEHYKWITKRVNVGTITNPRYQENKTKDYFENISCP

SEQ ID NO: 5813 - DNA, 522 bp, Unknown
  Obtained from environmental sample
  misc_feature (1)..(522): n is a, c, g, or t
atgccctcatccaataagattagtgcccgtatcctgataattgatgatgacgaagatgatttttttattacttcggaatacatccgtcaaatagaagaatatgagctagtaattgattggtgctataagtttagcgaagcagtacagcatttaaaaaataatacttacgatatttattttgttgactatcgccttggggcaaaaacgggcctggattttttgcgggaagcggttaatgccggagtggaagaacctataatactcttaaccggcaagggtaataaggaagtggatatagaggctatgcaaatgggagcaacggattaccttataaaaacagatcttactgttgataaactagaacgttgtatccgctattcgcttgaacgaacagcctatctgaaagcttttagagccaatgaaccgcagtatagaaatatttttgagctgtcgaaggatgctgttttttattgctggaaaaaattcctttcatttaaagatttcaacccaggccacatatga

SEQ ID NO: 5814 - protein, 173 aa, Unknown
  Obtained from environmental sample
  DOMAIN (9)...(132): Response regulator receiver domain
  misc_feature (1)..(173): Xaa is any amino acid
MPSSNKISARILIIDDDEDDFFITSEYIRQIEEYELVIDWCYKFSEAVQHLKNNTYDIYFVDYRLGAKTGLDFLREAVNAGVEEPIILLTGKGNKEVDIEAMQMGATDYLIKTDLTVDKLERCIRYSLERTAYLKAFRANEPQYRNIFELSKDAVFYCWKKFLSFKDFNPGHI

SEQ ID NO: 5815 - DNA, 705 bp, Unknown
  Obtained from environmental sample
  misc_feature (1)..(705): n is a, c, g, or t
ttgaactcaaacattgagcatctttctgaagaaagtaaacgcaggcttgagacaaatactttaagggtactggattccaaagatattaacgatagaaaagtaacggattcagcacctaaaatacttgatcacctcggcgcagaatccaggacacggtttgataatgttgtaaatgaactcacaaggcttggagttgatcatgaaattgatttcagaattgtaaggggattggattattacaccgatacaacattcgagttcctctccgaagatctcggttcacaggatgccctgggcggcggcggaaggtatgacggacttatcgaacaattaggaggtaagccaacccctggagttggttttggcagcggagttgaaagactgataatagttgctgaaaaaaacggatttgcttttggtgaacaaaaagctccgctggtatattttattgcactaagtgaagaagcaaggaatatagtttacggtttgatgaaaaaactccgcggggaaaatatttcctgcgaaacggacttattgggcagaagttttaaagctcaaatgcgggaagcaaacaagctcagttgtaaatatgtttatatcatcggagatgatgaattgcagaagaaaaagggacagttgaagaacatggcaaccggcgaccaggttgaaacagaatttgaaaaaataaaggagaaccttttttaa

SEQ ID NO: 5816 - protein, 234 aa, Unknown
  Obtained from environmental sample
  DOMAIN (146)...(232): Anticodon binding domain
  misc_feature (1)..(234): Xaa is any amino acid
MNSNIEHLSEESKRRLETNTLRVLDSKDINDRKVTDSAPKILDHLGAESRTRFDNVVNELTRLGVDHEIDFRIVRGLDYYTDTTFEFLSEDLGSQDALGGGGRYDGLIEQLGGKPTPGVGFGSGVERLIIVAEKNGFAFGEQKAPLVYFIALSEEARNIVYGLMKKLRGENISCETDLLGRSFKAQMREANKLSCKYVYIIGDDELQKKKGQLKNMATGDQVETEFEKIKENLF

SEQ ID NO: 5817 - DNA, 408 bp, Unknown
  Obtained from environmental sample
  misc_feature (1)..(408): n is a, c, g, or t
atgaaattcagaagacctaaaggtacaaaggatgtactgccaaaggaaattgcaaagtggcattatgtcgaagatattattcgaaaaactaccggattgttcaattttactgaaatacgtacacctacgtttgagaataccgagctctttaaaaggggtgttggaaccgatacagatatcgtaggcaaggaaatgtacacttttgaagataaaggcggtgattcgcttacattaaggccggaaggcactgcacccgttatgcgtgcatatgtggaaaacggaatgcaggcggaacagcccgttcataagctttattacctccacaacatgttcccgcacgaaaaaaccccaagccggaaggttcaaggaagcatacacaatttcggagcggaaataatccgaaagtga

SEQ ID NO: 5818 - protein, 135 aa, Unknown
  Obtained from environmental sample
  DOMAIN (8)...(135): tRNA synthetase class II core domain (G, H, P, S and T)
  misc_feature (1)..(135): Xaa is any amino acid
MKFRRPKGTKDVLPKEIAKWHYVEDIIRKTTGLFNFTEIRTPTFENTELFKRGVGTDTDIVGKEMYTFEDKGGDSLTLRPEGTAPVMRAYVENGMQAEQPVHKLYYLHNMFPHEKTPSRKVQGSIHNFGAEIIRK

SEQ ID NO: 5819 - DNA, 723 bp, Unknown
  Obtained from environmental sample
  misc_feature (1)..(723): n is a, c, g, or t
atgatcgattcatctgatgatccgtatatcctcacgccagaggaagaaaaggctgtgatcgatcatcacctggcacggttgaaagaacacgccgaatggacgatgcagagggagcttgggataaaaacagaggcagaactcaagctaaaactttctcaaatggattttgaaaaacaaattgaccgggaagcgattttgaaatatgcgaattcatgcaagtgccaggaaatttggaaaattgatcaggagaaaaaagccaaagaagatcaaaaaagaaaactgaaagaactcagggagaattggaccgcaaaaagaattttctcattgatgaaattcgtgagcaaagaatatttcgggaaagagttagtcatcgatgaagaaaataaaaatttgattatcgcaatctgctatttcctcagcgaagatccaaggttcgaaacggaacttgggtattcattccgaaaggggcttctcatccgtggggttagcggccttgggaaaacttacttattccaatgcgctgccagcaatgaactaaatccgattttcattcagagcatgattganattgctgatgaaatcaggtcagaaggagaattcaaaatacctatgaaaaacgaaaaaattttatacctggatgatgtcggcacagaggaagcaactgtaaaacattttgggacatcgataaacttttttaaaatttcattgagcaagtctacctga

SEQ ID NO: 5820 - protein, 240 aa, Unknown
  Obtained from environmental sample
  misc_feature (1)..(240): Xaa is any amino acid
MIDSSDDPYILTPEEEKAVIDHHLARLKEHAEWTMQRELGIKTEAELKLKLSQMDFEKQIDREAILKYANSCKCQEIWKIDQEKKAKEDQKRKLKELRENWTAKRIFSLMKFVSKEYFGKELVIDEENKNLIIAICYFLSEDPRFETELGYSFRKGLLIRGVSGLGKTYLFQCAASNELNPIFIQSMIXIADEIRSEGEFKIPMKNEKILYLDDVGTEEATVKHFGTSINFFKISLSKST

SEQ ID NO: 5821 - DNA, 477 bp, Unknown
  Obtained from environmental sample
  misc_feature (1)..(477): n is a, c, g, or t
gtgtttgctgtgttctacatcaaatcttttcttcgatctttggcactttacaaaaaatctgtattgagtcttggtctgaattccatatcaattttccagttcaaaaactattttcaccaggagttcgtttttaccgaacgaattgttggtatttgcggccgcaatggcgttggcaaaaccaatttgttggatgttattcactacctctgttttaccaaaagttatttttcaaggcaggatcagttgaacattcatcatggtcatgaaggcttccggctggagggacattttaatctgaacggaaaagatgaaagagccgtttgcatcttaagagaaacgggcaagaaagaattttcagtaaacgataatctctacatcaaattctcaaaacatatcgggcattatccctgcgtcattattgctccggatgacattcaattaatcattggggggagccaaggaagaagaaaattatag

SEQ ID NO: 5822 - protein, 158 aa, Unknown
  Obtained from environmental sample
  misc_feature (1)..(158): Xaa is any amino acid
MFAVFYIKSFLRSLALYKKSVLSLGLNSISIFQFKNYFHQEFVFTERIVGICGRNGVGKTNLLDVIHYLCFTKSYFSRQDQLNIHHGHEGFRLEGHFNLNGKDERAVCILRETGKKEFSVNDNLYIKFSKHIGHYPCVIIAPDDIQLIIGGSQGRRKL

SEQ ID NO: 5823 - DNA, 444 bp, Unknown; identical to SEQ ID NO: 291
  Obtained from environmental sample
  misc_feature (1)..(444): n is a, c, g, or t

SEQ ID NO: 5824 - protein, 147 aa, Unknown; identical to SEQ ID NO: 292
  Obtained from environmental sample
  misc_feature (1)..(147): Xaa is any amino acid

SEQ ID NO: 5825 - DNA, 498 bp, Unknown
  Obtained from environmental sample
  misc_feature (1)..(498): n is a, c, g, or t
ttgtcccgtcggcccctggctggcgggacggccggggatcttatgcaaaccccattttatcatctcaaatcaaatcatatgacagtcctgattttgagatcctattatcaaaatggtaccaacggggaaatgttcatcaacggcaaaaggatctgttacacgatcgagctgccgtggaaagacaacaaaaggagggtctcctgcatccgcgagggtacttatgaactagcgaagcgctacacagaaaagttcgggcaacacctgcacgtgaaaaatgtggagggccgtgactggatcctgatacacaagttcaatcacgcgctaaatgagagcaagggctgcattgcgccggttgaacagttaataggtgagggcatcggatcgccttcagatccagcaatgaaacgcctgctcaaactgctgcagccagccttcgcgaaaaagcaaaccattttcttaaccattaaaaaaaagaaagatgaaaaagtcgatcattga

SEQ ID NO: 5826 - protein, 165 aa, Unknown
  Obtained from environmental sample
  misc_feature (1)..(165): Xaa is any amino acid
MSRRPLAGGTAGDLMQTPFYHLKSNHMTVLILRSYYQNGTNGEMFINGKRICYTIELPWKDNKRRVSCIREGTYELAKRYTEKFGQHLHVKNVEGRDWILIHKFNHALNESKGCIAPVEQLIGEGIGSPSDPAMKRLLKLLQPAFAKKQTIFLTIKKKKDEKVDH

SEQ ID NO: 5827 - DNA, 528 bp, Unknown
  Obtained from environmental sample
  misc_feature (1)..(528): n is a, c, g, or t
atgataaataaaaaaatatcaacaatcgcaggtagtttaatgattatagctattgtagtagctctaggttttgttttctttattggaaaagaaaaagcaacacaaagtcaaaataatgctattttaaacaattcagatatcgggaataaagaagaaataaaacaagaggaagaaaaagtaattgaagaaaataaagaagagcccatattggaggaagtttctttttgtgaaaaaaattataatgtagaaaaaattgtgttaaatgatattgatgttataaaaagaatagcgacattgtctcagaataataaatatagaatatgcgagaatataaatagcaactctaattcatttggagaaaatcttcctgtaaaatttagcaaacaaaaatcgacggatgtagattataaggatggaatttatttcttaaatattaccctacaatttaaaattgatttaaatacaaataatatttacatccttggaggttacgctggcgaaccaactttcataggaaagttaaaataa

SEQ ID NO: 5828 - protein, 175 aa, Unknown
  Obtained from environmental sample
  misc_feature (1)..(175): Xaa is any amino acid
MINKKISTIAGSLMIIAIVVALGFVFFIGKEKATQSQNNAILNNSDIGNKEEIKQEEEKVIEENKEEPILEEVSFCEKNYNVEKIVLNDIDVIKRIATLSQNNKYRICENINSNSNSFGENLPVKFSKQKSTDVDYKDGIYFLNITLQFKIDLNTNNIYILGGYAGEPTFIGKLK

SEQ ID NO: 5829 - DNA, 696 bp, Unknown
  Obtained from environmental sample
  misc_feature (1)..(696): n is a, c, g, or t
ttgatccggaactctgttgtttcattaactctctttgcaggcacagtcggaaagatctttgtagtcgttattggcatcctctttctattgtccgtcataaccggcttcatcctataccgcaaagctatctggaaagccattcgattcaaaacagtctcccggtatcggggaaaagctgctttttattcttcgctgcatcgcaatgttggtgtctggacactattattcaacctgctgattatcgcgtctggtcttgtcttgagtataaccatcgcaaaaaatgcaatcaaaacatccggttcaaaatcaccagctattacccaggtggactttcctttggattcaatagttgaaaaagtaacccgttcaaatccggaattcgagatacacctggtgcgcattccggcttatagccatactattaagatcagtggacgctataaaaacgatccggcggtttacggagattatgccagttattttttaataaacgggctatcacaaaaaacagagaaaaaacaggtaatgtcggatcttcccttttcagaaaagctgttgttaatggcggcgcccttacattttggcaattttggaggcatcttcctgaaaattatctattgcttttttgggatcatgccggcaattttatccatcaccggatttctgatctggaaaaagagaaggagaataaaataa

SEQ ID NO: 5830 - protein, 231 aa, Unknown
  Obtained from environmental sample
  misc_feature (1)..(231): Xaa is any amino acid
MIRNSVVSLTLFAGTVGKIFVVVIGILFLLSVITGFILYRKAIWKAIRFKTVSRYRGKAAFYSSLHRNVGVWTLLFNLLIIASGLVLSITIAKNAIKTSGSKSPAITQVDFPLDSIVEKVTRSNPEFEIHLVRIPAYSHTIKISGRYKNDPAVYGDYASYFLINGLSQKTEKKQVMSDLPFSEKLLLMAAPLHFGNFGGIFLKIIYCFFGIMPAILSITGFLIWKKRRRIK

SEQ ID NO: 5831 - DNA, 318 bp, Unknown
  Obtained from environmental sample
  misc_feature (1)..(318): n is a, c, g, or t
atgcttgatatcttaattagaattgaatatagtaaacccgcggaaaatgaaaaaaaagtaatgaaaaaaattaattcttattttattttaaatattatttttacaggtaatttgcgaacatgtaaaagagatgaaattataattaaatatgaactaataaaagtttcacctggtattctactacaaggctgggatttgaaacaaacaatcactgaagcttatttgaaaaattgtaattcaaaaagaaaatttttgaaaaatatattcttaaattctcataaatttgcaaaatattcaaaaaacaatattagaatataa

SEQ ID NO: 5832 - protein, 105 aa, Unknown
  Obtained from environmental sample
  misc_feature (1)..(105): Xaa is any amino acid
MLDILIRIEYSKPAENEKKVMKKINSYFILNIIFTGNLRTCKRDEIIIKYELIKVSPGILLQGWDLKQTITEAYLKNCNSKRKFLKNIFLNSHKFAKYSKNNIRI

SEQ ID NO: 5833 - DNA, 441 bp, Unknown
  Obtained from environmental sample
  misc_feature (1)..(441): n is a, c, g, or t
ttgcaaaatattcaaaaaacaatattagaatataatgatagtaaaattgcaattttactgataaataatgataaaattacacctaaaatatttgaaccattagaaatttgtttctttgaaaaatatcacaggcagttattgaatttatctaaatctagtgataaatttccaaaaacattaactagagatgaacaatctcgttatgaacaatattataatcaatatatcttacgttctgaaaatagacaagaatataacaaaattcaagaaaaaggacaaaaagaagaaatcaatattgaaaataatttattgaataatttaattcanacattagatcaaatagtanatattagttgtgatctacaaattttagaagatganaatactgttgaaaaatattttttcagtatatttgataaatatattactgaatctatatag

SEQ ID NO: 5834 - protein, 146 aa, Unknown
  Obtained from environmental sample
  misc_feature (1)..(146): Xaa is any amino acid
MQNIQKTILEYNDSKIAILLINNDKITPKIFEPLEICFFEKYHRQLLNLSKSSDKFPKTLTRDEQSRYEQYYNQYILRSENRQEYNKIQEKGQKEEINIENNLLNNLIXTLDQIVXISCDLQILEDXNTVEKYFFSIFDKYITESI

SEQ ID NO: 5835 - DNA, 705 bp, Unknown
  Obtained from environmental sample
  misc_feature (1)..(705): n is a, c, g, or t
gtgattaaaccacttgttatatttttaaccgaaacacattactttagtgaaatcaaaataaatgaaatggcagaaactgatgaaaagattctttgtgtcgatataggcgggtctcatatcaaagctactgttatcgaccatcagggcaattttttacaaaaatatcaaagagaagacacgccgaagcctccttcaccggaaaaagtggtaaaactgattcttgaactatctcaacggtttcctcaatacaataaagtggctgctggttttccgggttacgttaaaaatggagtagtaaaaacggcgccaaaattgaacagtcaaatctggaaaaactttgaccttcaaaaagaaatacaatccaaattagataagcctgttttggttattaatgatgccgatttccaggggcttagcctcgcagaaggtaaaggagtggaaatgctgattacgttgggaactggctttggatcagcattactacaggatggaatgttgatgcctcatcttgagatgtctcagcatccggtgacaaaaaataaaaattacaatgattaccttggtaacgatgctttaaaaaaaattggcaaaaaaagatggaataaacgattgaaagaagtaattggaatattaaagacggtttttaattatgatcatttatacattagcggtggaaatgccaaaatcatagatttacttagatga

SEQ ID NO: 5836 - protein, 234 aa, Unknown
  Obtained from environmental sample
  DOMAIN (32)...(192): ROK family
  misc_feature (1)..(234): Xaa is any amino acid
MIKPLVIFLTETHYFSEIKINEMAETDEKILCVDIGGSHIKATVIDHQGNFLQKYQREDTPKPPSPEKVVKLILELSQRFPQYNKVAAGFPGYVKNGVVKTAPKLNSQIWKNFDLQKEIQSKLDKPVLVINDADFQGLSLAEGKGVEMLITLGTGFGSALLQDGMLMPHLEMSQHPVTKNKNYNDYLGNDALKKIGKKRWNKRLKEVIGILKTVFNYDHLYISGGNAKIIDLLR

SEQ ID NO: 5837 - DNA, 435 bp, Unknown
  Obtained from environmental sample
  misc_feature (1)..(435): n is a, c, g, or t
atgccagaatttgtaatcacttcatcggttgttttacgtaacggcattggcattaaagacggtgttgtttttgctgaacatccgggagttgatgcttcagcatttgcaaaggagttgtataaaaagctgggtactgactactccaagttttacaaaatggatcagctctgtaagttgtcttttgtttctgcagaattgcttctgaaaaataattcaatagcggaataccggcctgaagatgtggcattggtattttcaaatgcaagtgcttcgctcgatacagacaaaacctatttcagctcggttgaaaataaagacaactatnttcccagcccggctgtgtttgtttatacgcttccgaatatcatgatgggcgaaatttgtatcangcataaactgcttggagagatactttttttgtttctgaaaatttga

SEQ ID NO: 5838 - protein, 144 aa, Unknown
  Obtained from environmental sample
  misc_feature (1)..(144): Xaa is any amino acid
MPEFVITSSVVLRNGIGIKDGVVFAEHPGVDASAFAKELYKKLGTDYSKFYKMDQLCKLSFVSAELLLKNNSIAEYRPEDVALVFSNASASLDTDKTYFSSVENKDNYXPSPAVFVYTLPNIMMGEICIXHKLLGEILFLFLKI

SEQ ID NO: 5839 - DNA, 747 bp, Unknown
  Obtained from environmental sample
  misc_feature (1)..(747): n is a, c, g, or t
gtgtcactggcactggcgctcatctttggttttgttttgctgtattacctgcgtgagaataaaaaaattacagcaaggcttgctttaaaaaatgaagaaattctgaaacaaagtgaacagcttattgaacttggtaagaaagccaatgcagccaatgaggcaaagatccagttcttcacaaaaatgtcgcatgaattaagaacgccgcttacattaatacttggcccggttgaagacctcatggaaaatgagaaagtaaaccgtgttgcagcacaaagtttatcattgattcaaaagaatacattaagacttttaaagctcattaaccagttgatggatttcaggaaaattgaaattgataaactgaaaataaatgttgcggaaaacgatattgtttcttttttaaaccagataatagaagcatataaaaatattgcccgcaaaagaaatattgacctgcggttctttaccagccagtactttttaaatgtgtggtttgatgaaaccatgctcgacaaagtgctgttcaacctgctttccaacgcatttaagttcaccaacgataatggttatatacacatctttcttgaaaaaaatgaagcagcaaaaaatataaagattattattgaagataatggtgttggcatgagcgaagttgctgttgaacatgccttcgaactgttttaccagggtgaacatgaaaattaccgcggcacaggtttaggcctgcttatcaaagaactataa

SEQ ID NO: 5840 - protein, 248 aa, Unknown
  Obtained from environmental sample
  DOMAIN (166)...(248): Histidine kinase-, DNA gyrase B-, and HSP90-like ATPase
  misc_feature (1)..(248): Xaa is any amino acid
MSLALALIFGFVLLYYLRENKKITARLALKNEEILKQSEQLIELGKKANAANEAKIQFFTKMSHELRTPLTLILGPVEDLMENEKVNRVAAQSLSLIQKNTLRLLKLINQLMDFRKIEIDKLKINVAENDIVSFLNQIIEAYKNIARKRNIDLRFFTSQYFLNVWFDETMLDKVLFNLLSNAFKFTNDNGYIHIFLEKNEAAKNIKIIIEDNGVGMSEVAVEHAFELFYQGEHENYRGTGLGLLIKEL

SEQ ID NO: 5841 - DNA, 456 bp, Unknown
  Obtained from environmental sample
  misc_feature (1)..(456): n is a, c, g, or t
atgaatccgaaagattttttattgatccctgcattcatttttctcctggtatcctgccatcggcaattagtctcacccgatggcaacaagatcaactttgattattccaatattgataaccacggtttccgtaatggaatggaagccgtggattatgaattctgtattccggcagaacgaaatgaaattgaaaaagtgcagcaaattgagcctgatgtcaaagtgatgaaatcctcgcggggacgtgtgggttgcacgnatcagcagtggctttgcattgtcaatacgcgggacgatgcgtggaaagaaaaaactgggacaaaattgctaccttgcccctttgtcgaacgtataacagaaaacgttctacgagtagccacgaagttattggcgatgtatcaaaaattcattttcgggaaatttttatgtccaaaagaaaaatgctcatcagggtga

SEQ ID NO: 5842 - protein, 151 aa, Unknown
  Obtained from environmental sample
  misc_feature (1)..(151): Xaa is any amino acid
MNPKDFLLIPAFIFLLVSCHRQLVSPDGNKINFDYSNIDNHGFRNGMEAVDYEFCIPAERNEIEKVQQIEPDVKVMKSSRGRVGCTXQQWLCIVNTRDDAWKEKTGTKLLPCPFVERITENVLRVATKLLAMYQKFIFGKFLCPKEKCSSG

SEQ ID NO: 5843 - DNA, 423 bp, Unknown
  Obtained from environmental sample
  misc_feature (1)..(423): n is a, c, g, or t
ttggtagagatcattaatgaaaatagctaccagttttccatctttntactcatcgcctgtctnccggctgcaaaccagtttactatcttacctaatcgggcaaaacagaaactttttgcgcgcccgcatatccagtttatgatggccgtgaccgattttcgggaggcaaccggtgtgtggcccactaatcagttccagttagagaatcatacccggaaaaacaggcaggtcatccaggactttcaatacgagacgttgtatttcaccctaaaaaaagatgaccgcctcgaggtgttctttgataactataaaaaaacactctatctggatattccaggcaaaaccgatttaaacaggcttcatggtaagattaacttctacaaatcgggcgataagttagcgtggaaagtcaggatgctatag

SEQ ID NO: 5844 - protein, 140 aa, Unknown
  Obtained from environmental sample
  misc_feature (1)..(140): Xaa is any amino acid
MVEIINENSYQFSIFXLIACLPAANQFTILPNRAKQKLFARPHIQFMMAVTDFREATGVWPTNQFQLENHTRKNRQVIQDFQYETLYFTLKKDDRLEVFFDNYKKTLYLDIPGKTDLNRLHGKINFYKSGDKLAWKVRML

SEQ ID NO: 5845 - DNA, 819 bp, Unknown
  Obtained from environmental sample
  misc_feature (1)..(819): n is a, c, g, or t
gtgcaaatgaagaacggagaatatcgctggttcctgagcagggcttttccacataaagacgatagcggcagaattttaaaatggtttggcacagcaaccgatattcatacaggcaaaatgcaggcaaccattttagaagaaaaagtaaaaaaacgtacgaaagaattgaatgagctgaacctgtcgttaatacaatcgaataacgagttgcagcagtttgcgcatgtagccagccacgatttgaaagagcccctccgcaaaatcagaacatttgcaggtatgttaggcggagatattgaaagttctttctctgataaaggaaaactttatctcgaaaaaataaatgcggcagcaaaccggatgggaattatgattgaaggtgtgttaacatattccatgctcagcgccatacatcaaaaaattgaaaaagtagatttgtgcgaagttttcagaagcatcgaatctgatcttgaagttctcatcgatcaaaaatctgcaaaaatcagttatcatcatttgccggtgattgaaggcgcctctgttttgatctaccagttgttttataacctcataaacaactcactaaaattttcaaaaccggatcagctccctctaattgaaatttcatcttcagttctccaactggagcaaaaggaatttgttgcaataaagatcagcgacaacggaattggctttgaacaggaccttgcagaaaaaatatttcaaacttttttacgactcaattcaaaggacatgttgaaggcacggggctgggattgtccctatgcaaacgaatgcagaaaggcatggcgttcatga

SEQ ID NO: 5846 - protein, 272 aa, Unknown
  Obtained from environmental sample
  DOMAIN (178)...(263): Histidine kinase-, DNA gyrase B-, and HSP90-like ATPase
  misc_feature (1)..(272): Xaa is any amino acid
MQMKNGEYRWFLSRAFPHKDDSGRILKWFGTATDIHTGKMQATILEEKVKKRTKELNELNLSLIQSNNELQQFAHVASHDLKEPLRKIRTFAGMLGGDIESSFSDKGKLYLEKINAAANRMGIMIEGVLTYSMLSAIHQKIEKVDLCEVFRSIESDLEVLIDQKSAKISYHHLPVIEGASVLIYQLFYNLINNSLKFSKPDQLPLIEISSSVLQLEQKEFVAIKISDNGIGFEQDLAEKIFQTFLRLNSKDMLKARGWDCPYANECRKAWRS

SEQ ID NO: 5847 - DNA, 1038 bp, Unknown
  Obtained from environmental sample
  misc_feature (1)..(1038): n is a, c, g, or t
atggttggaggccacgctgaaggtgaagttctttattataataaccgtgtgaatgagtttgcaggagcatcgataaaaaaagacggaagctgggcctgggaaggattggtgcatcctgaagatttaatagcaacggaaaaagcatggacagatgctgttaagaacggaactgtttaccaggtagaacacagggtgcaaatgaagaacggagaatatcgctggttcctgagcagggcttttccacataaagacgatagcggcagaattttaaaatggtttggcacagcaaccgatattcatacaggcaaaatgcaggcaaccattttagaagaaaaagtaaaaaaacgtacgaaagaattgaatgagctgaacctgtcgttaatacaatcgaataacgagttgcagcagtttgcgcatgtagccagccacgatttgaaagagcccctccgcaaaatcagaacatttgcaggtatgttaggcggagatattgaaagttctttctctgataaaggaaaactttatctcgaaaaaataaatgcggcagcaaaccggatgggaattatgattgaaggtgtgttaacatattccatgctcagcgccatacatcaaaaaattgaaaaagtagatttgtgcgaagttttcagaagcatcgaatctgatcttgaagttctcatcgatcaaaaatctgcaaaaatcagttatcatcatttgccggtgattgaaggcgcctctgttttgatctaccagttgttttataacctcataaacaactcactaaaattttcaaaaccggatcagctccctctaattgaaatttcatcttcagttctccaactggagcaaaaggaatttgttgncataaagatcagcgacaacggaattggctttgaacaggacttgcaaaaaaatatttcaaactttttacgactcatttcaaagacatgtttgaggcacggggctgggatggtcttatgcaaacgaatgcaaaaaggctgccgttttcctagagcatttcaaaaacttctcaaaatactctag

SEQ ID NO: 5848 - protein, 345 aa, Unknown
  Obtained from environmental sample
  DOMAIN (242)...(329): Histidine kinase-, DNA gyrase B-, and HSP90-like ATPase
  misc_feature (1)..(345): Xaa is any amino acid
MVGGHAEGEVLYYNNRVNEFAGASIKKDGSWAWEGLVHPEDLIATEKAWTDAVKNGTVYQVEHRVQMKNGEYRWFLSRAFPHKDDSGRILKWFGTATDIHTGKMQATILEEKVKKRTKELNELNLSLIQSNNELQQFAHVASHDLKEPLRKIRTFAGMLGGDIESSFSDKGKLYLEKINAAANRMGIMIEGVLTYSMLSAIHQKIEKVDLCEVFRSIESDLEVLIDQKSAKISYHHLPVIEGASVLIYQLFYNLINNSLKFSKPDQLPLIEISSSVLQLEQKEFVXIKISDNGIGFEQDLQKNISNFLRLISKTCLRHGAGMVLCKRMQKGCRFPRAFQKLLKIL

SEQ ID NO: 5849 - DNA, 744 bp, Unknown
  Obtained from environmental sample
  misc_feature (1)..(744): n is a, c, g, or t
gtgaagcgttcatangggaggtattaccaatctgctgattacatttcgcattccaataccagaaagggattggtcaatcagctttatcagaaagtcagagattacacattgaatcaaaaggcaggtttgatcattgatagaacagtgaagcagggaaaaatattggatcttggagcgggtgtgggtgcctttctaaatactatgaaagaaagagggtgggagatcaccggcattgaaccagatgaaggtgcaaggcaaaaggcaaagactcttttcaatattgaacttaaagaaaccgattcattccatcagctttccgaaatcaattatgatgcaattacactttggcatgtgttggaacatgtgcaccagcttcatgattatgtagaacgattaaaggctttgctaaaggcaaacggaaaaatttttattgctgttccgaattattcatcgttagatagttctatttacaaattatattgggctgcttatgatgttccgcgtcacttgtatcacttctcaccaaaatcaatagatgttttaatgagccaacatggtttgaaagtgatctcgaaaaagcctatgtggtttgatagtttttatatcagcttattaagcagcaaatacaaaaacggaaaaacaaaatggatcagcgctggattgagtggattgcgatccaatttgagggcattaatgaataaagattattgcagctcgatcatttacatcattggaaaaagttag

SEQ ID NO: 5850 - protein, 247 aa, Unknown
  Obtained from environmental sample
  misc_feature (1)..(247): Xaa is any amino acid
MKRSXGRYYQSADYISHSNTRKGLVNQLYQKVRDYTLNQKAGLIIDRTVKQGKILDLGAGVGAFLNTMKERGWEITGIEPDEGARQKAKTLFNIELKETDSFHQLSEINYDAITLWHVLEHVHQLHDYVERLKALLKANGKIFIAVPNYSSLDSSIYKLYWAAYDVPRHLYHFSPKSIDVLMSQHGLKVISKKPMWFDSFYISLLSSKYKNGKTKWISAGLSGLRSNLRALMNKDYCSSIIYIIGKS

SEQ ID NO: 5851 - DNA, 444 bp, Unknown
  Obtained from environmental sample
  misc_feature (1)..(444): n is a, c, g, or t
ttggttgtatctcctgacaatgagcaaccaggcgaatccgatctaatagagaagaatataccatttgaacttaaagcctacaatgccctgatggaaaaaggcgtgcgaaacagagatgccttattgcgaacggaattctttaccgacgacgggagtttttatcctttcgcagatacaaccgtcacaggaatcgataacataaagccatacctgatcgcgtacagcagcggcaccgtgaccattgattcaatcatgtgctacacctatgattacaaaacccacggtacctatgtccttgagtatgatatgttcaaggtaaaatggacagtctctcccactgtttcaggacgaaccgaaggaaagggcattcgaatctggaaaaggcaagccgatcactcattaaaactgtatcgggaaatcgggacacataatcagttaaaataa

SEQ ID NO: 5852 - protein, 147 aa, Unknown
  Obtained from environmental sample
  misc_feature (1)..(147): Xaa is any amino acid
MVVSPDNEQPGESDLIEKNIPFELKAYNALMEKGVRNRDALLRTEFFTDDGSFYPFADTTVTGIDNIKPYLIAYSSGTVTIDSIMCYTYDYKTHGTYVLEYDMFKVKWTVSPTVSGRTEGKGIRIWKRQADHSLKLYREIGTHNQLK

SEQ ID NO: 5853 - DNA, 657 bp, Unknown
  Obtained from environmental sample
  misc_feature (1)..(657): n is a, c, g, or t
atgnatagttttcaatatacagttcatcaagaagggagtgtggaaaattctcacgcaagcagtcagatattaacctggactgttcatctaaagaatagaatgtatcaaacttgttggagctgggttcagttgaactatttgttcaataaagagataccagatgaggagtggcatatttcacccggtcgcaatggtgaatcggttgagtttttacctaatttcgagaaaagacattatcttatcaaggctcaatttaattactttgctgatatcttttattataaactcttttcagcttgggataatttaggacatattctcaataatatgtatgaactaaaaattgaaagagctaatttttatgaagctgttaaaacattgaaagacgtaaaatcagacttacacgataatctcaataatttaatagaatcagatgactttaagaaaatgcgtaaatacagacatagctcaacccataatgagttaataggacttatcaattccggttttacaaaagtttctgagaatcattatacagcgggttttcaagaatatgtaacatcttcgcaaattaaagataatgccgataaatccttaaatttaattactcaagcaattaaatttattaaagagcaagttcaaagtgatatgacataa

SEQ ID NO: 5854 - protein, 218 aa, Unknown
  Obtained from environmental sample
  misc_feature (1)..(218): Xaa is any amino acid
MXSFQYTVHQEGSVENSHASSQILTWTVHLKNRMYQTCWSWVQLNYLFNKEIPDEEWHISPGRNGESVEFLPNFEKRHYLIKAQFNYFADIFYYKLFSAWDNLGHILNNMYELKIERANFYEAVKTLKDVKSDLHDNLNNLIESDDFKKMRKYRHSSTHNELIGLINSGFTKVSENHYTAGFQEYVTSSQIKDNADKSLNLITQAIKFIKEQVQSDMT

SEQ ID NO: 5855 - DNA, 429 bp, Unknown
  Obtained from environmental sample
  misc_feature (1)..(429): n is a, c, g, or t
atgctagactattggaaactatggattttcaataaagagcaaattgaaaaagtgttgattaatcaaagtttttcaaaatcttttcaatctaatgaagatggtgttttaatcggaattgccggacggtttaaaaattggaagttcaaaaccctatctccaacatgtttggaaattgcagggtccatacacaagtattggaataatggcacaaacgaaaacaatttttcatttagttcggtaatagaaacaataaaagagttttgcaaggagtttaatttaaacccttcgcttgcctttattaaaaacttagagctaggagtcaacctacaattacaagtagatgccagtaaattattgatcanatcatttgttatcattacctacagccaaacaaaccgtatcgccgtaaaccagattgctatttcatag

SEQ ID NO: 5856 - protein, 142 aa, Unknown
  Obtained from environmental sample
  misc_feature (1)..(142): Xaa is any amino acid
MLDYWKLWIFNKEQIEKVLINQSFSKSFQSNEDGVLIGIAGRFKNWKFKTLSPTCLEIAGSIHKYWNNGTNENNFSFSSVIETIKEFCKEFNLNPSLAFIKNLELGVNLQLQVDASKLLIXSFVIITYSQTNRIAVNQIAIS

SEQ ID NO: 5857 - DNA, 816 bp, Unknown
  Obtained from environmental sample
  misc_feature (1)..(816): n is a, c, g, or t
ttggaaataataaagaaaattttctattatcattgggttttgataaatatttggaaaactgaaataatggaaaattctattaaccatatttctgataccgctctctggatcgcagcttacagggcaaaagagaccaaaagctgccagcctgtaattaatgatcatttagctgaaaaactggctggggaaaaaggattggagatggtcgcaactactccccataccgaatcaatggcttttgctatgatcgttaggacctgcgctattgatcgcctcgtagaaatagctatttctaaaggtattgataccgttattaacttgggtgcaggacttgataccagaccatacaggatgaatttaccttctgacctggtatggattgaggttgattttaaaaatattattgattataaaaatgaaattttaaaggctgaaaatccatgttgccacctgaaaagaatttctttagatctttcacaggatagtgatcgaaaagagctctttaaacaacttggaaataaaacaaaaagtgcactgattattacagaaggagtaattggctacttaaccaatcaacaggccgccaaactttcagaagacctatttagtatccccacattccatttctggatccaggattatagcaggggtaagttgagaaaaaacaaaggaaccaaagatctgcaaaaaaaattgaagaatgttcctatacagtttgaggttgaagagccattgagcttttttagtcgccaaggctggagggtaagtgaaaatctcctcattcttgatgaagctgatagaattggtaaaaattaa

SEQ ID NO: 5858 - protein, 271 aa, Unknown
  Obtained from environmental sample
  DOMAIN (46)...(267): Leucine carboxyl methyltransferase
  misc_feature (1)..(271): Xaa is any amino acid
MEIIKKIFYYHWVLINIWKTEIMENSINHISDTALWIAAYRAKETKSCQPVINDHLAEKLAGEKGLEMVATTPHTESMAFAMIVRTCAIDRLVEIAISKGIDTVINLGAGLDTRPYRMNLPSDLVWIEVDFKNIIDYKNEILKAENPCCHLKRISLDLSQDSDRKELFKQLGNKTKSALIITEGVIGYLTNQQAAKLSEDLFSIPTFHFWIQDYSRGKLRKNKGTKDLQKKLKNVPIQFEVEEPLSFFSRQGWRVSENLLILDEADRIGKN

SEQ ID NO: 5859 - DNA, 642 bp, Unknown
  Obtained from environmental sample
  misc_feature (1)..(642): n is a, c, g, or t
ttggactttccgtctgtatgttgtattttccttaatagaattgatgcaaacatgagattacttatacttagtcccggggccaccgttaatgactttgtcagaacctgggatcagttttacgattatggtaacgaggctatctaccacactatcataaaaaaaagacagttgacccctgatgatataatcaaaatataccaatggaaaaacaatatgggtaaacagggtgaagcgatgagctccaggaaactggattacgtatccagaattgtagctaagctagatgaaatcaacgatcttaaaatcaattttagcgtagaacgttataagacacatttcgaaaaactctctgccatttggggaatattactacttcatattattaagccagacaactatcccatctatgatcaacacgttcatcgggcatatcgatatataactggaaaggaaaccgcgaaaattccgtttactgataaaggtaaatacaatgtctattacacggagtatgtacccttttttcaagaattctattctaacacatccggtttaacacgaaagcatgttgataatgcactttgggctttcggcaaatttctatcaggggcaagagagaaggtaggcatatttaattatcaataa

SEQ ID NO: 5860 - protein, 213 aa, Unknown
  Obtained from environmental sample
  misc_feature (1)..(213): Xaa is any amino acid
MDFPSVCCIFLNRIDANMRLLILSPGATVNDFVRTWDQFYDYGNEAIYHTIIKKRQLTPDDIIKIYQWKNNMGKQGEAMSSRKLDYVSRIVAKLDEINDLKINFSVERYKTHFEKLSAIWGILLLHIIKPDNYPIYDQHVHRAYRYITGKETAKIPFTDKGKYNVYYTEYVPFFQEFYSNTSGLTRKHVDNALWAFGKFLSGAREKVGIFNYQ

SEQ ID NO: 5861 - DNA, 906 bp, Unknown
  Obtained from environmental sample
  misc_feature (1)..(906): n is a, c, g, or t
gtgaaattaatgataaagancttgaccccaaaaaatatattcgtgctcactacgacacntgagtnggaaataaatgaaaactcgggttatgaatttaaaaacatacctgccggcgctaatatgatgcaggtagcttatgacattattagtgaagggaaaaaagcacttgttttcgtggatgaatcctatgctactaatttttcccgtctcaatcgttttgtaaggccggtttttgaatcagaaggtagtactgtgtttattctttccaatataactgcgccgcaaaaatttaaaataaaggctaaacatgcaattgacgaaatagccatgacaaatgtggtagggatattacctggaaaaacaaagccaggcgagtatgttattttttctgcacactacgatcatttaggaataggaaagccggaaaacggtgacagtatttataatggagcaaatgatgatgctgcaggtacaacagcagtgatcatgttagccaatcattttaaaaaattaaataacaattcccgcacactggtgtttgccacatttacagcggaagaattaggaggttttggttcacaatatttttcaaaacaatttgatccaaagcaggtggtagccatgtttaatatcgagatgattggaaccgaaagtaagtgggggaaaaattctgcttatataaccggctttgaaaaaaccgatatgggaacaattctccaggaaaatctgaaaggtaccccattcagctttcaccccgatccttatcctgaacaggatttattttaccgttcggataatgcaaccttagcaaggcttggtgttcctgcccataccatttctacatcaaaaatggatagtgaaaaatattatcatcgtgtagatgatgagattgaaacgctggactga

SEQ ID NO: 5862 - protein, 301 aa, Unknown
  Obtained from environmental sample
  DOMAIN (126)...(203): Peptidase family M20/M25/M40
  misc_feature (1)..(301): Xaa is any amino acid
MKLMIKXLTPKNIFVLTTTXEXEINENSGYEFKNIPAGANMMQVAYDIISEGKKALVFVDESYATNFSRLNRFVRPVFESEGSTVFILSNITAPQKFKIKAKHAIDEIAMTNVVGILPGKTKPGEYVIFSAHYDHLGIGKPENGDSIYNGANDDAAGTTAVIMLANHFKKLNNNSRTLVFATFTAEELGGFGSQYFSKQFDPKQVVAMFNIEMIGTESKWGKNSAYITGFEKTDMGTILQENLKGTPFSFHPDPYPEQDLFYRSDNATLARLGVPAHTISTSKMDSEKYYHRVDDEIETLD

SEQ ID NO: 5863 - DNA, 558 bp, Unknown
  Obtained from environmental sample
  misc_feature (1)..(558): n is a, c, g, or t
atgaaaacaaaaactctcacatcgttaaagaattattcttactccgaaaaaaagatatttaaaaaagcaaaggattttcttcctattaacggcaccgatcatgttgaactttatgtaggtaacgcgaaacaagccgcgcattattataaaaccgcttttggattccaggaattagcttattgcggattggaaaccggtgttaaggaaagttgttcttatgttctgatgcagggaaagatccggttagtgttaaccacgccgcttgatcccaattcaaagatcgctgaacatataagaaaacatggggatggcgtgaaagtgatcgcacttgaagtggatgatgtgcgcactgcttattacgaaacgatgcgaagaggcgctaaatcgtatttcgcgcccgaaataatttctgataaagatggggaagtgatccgtgcggggattcatacttatggtgaaacgatccatgtgtttgttgagcggcgaaattataaaggcgtttttatgccggggttcgcaaaatggaaaacagaatacaatccgccgccggagggctaa

SEQ ID NO: 5864 - protein, 185 aa, Unknown
  Obtained from environmental sample
  DOMAIN (31)...(146): Glyoxalase/Bleomycin resistance protein/Dioxygenase superfamily
  misc_feature (1)..(185): Xaa is any amino acid
MKTKTLTSLKNYSYSEKKIFKKAKDFLPINGTDHVELYVGNAKQAAHYYKTAFGFQELAYCGLETGVKESCSYVLMQGKIRLVLTTPLDPNSKIAEHIRKHGDGVKVIALEVDDVRTAYYETMRRGAKSYFAPEIISDKDGEVIRAGIHTYGETIHVFVERRNYKGVFMPGFAKWKTEYNPPPEG

SEQ ID NO: 5865 - DNA, 378 bp, Unknown; identical to SEQ ID NO: 3211
  Obtained from environmental sample
  misc_feature (1)..(378): n is a, c, g, or t

SEQ ID NO: 5866 - protein, 125 aa, Unknown; identical to SEQ ID NO: 3212
  Obtained from environmental sample
  misc_feature (1)..(125): Xaa is any amino acid

SEQ ID NO: 5867 - DNA, 786 bp, Unknown
  Obtained from environmental sample
  misc_feature (1)..(786): n is a, c, g, or t
ttgagtctgatgaaaattgatttttacctgcgctttcatacgaaattcggtcagtcgctcgcaataacgggaaacctgcctgtattgggcagtgatgaaccgggcaaagctttgccaatgagctttcttagcgatgaactatggcaggcttctatcgaaattgatccttccgaaacccaaacacttcactaccgctatatttttattgatgaaaagggagtctcggaaaaagaggccgaaaaggaacgcatcattgaaatcaaaaaagcaaagcatgatcttttgctggcagatacctggaatgatccaagccttgtagagaactctttttactctactcctttcaaagaggtttttttcagagaccggaaaagacttaagcttaagaagaacaatttatatacgcatcagttcaaaataaaagcacctcttctttctcctgatgaaacagtttgtttactgggtagctccgaaaccttgggccaatggaatacggacacgccaattttattaagcaaaaaaggaaactggtggatagtaaaccttgaaattccggcatcggaatttgccatgtcgtacaaatatggtgtttacaatttgaagacgggtgcatttatccggtttgaaaatggagacaacaggatactgcataacgatggttctgtccataaaaaaacggtcattcacgatggttttttaagattgcctgttaaccggtggaaaggtactggtgttgccattcctgttttcagtttgcgcagcaataacagtttttggcattggtga

SEQ ID NO: 5868 - protein, 261 aa, Unknown
  Obtained from environmental sample
  misc_feature (1)..(261): Xaa is any amino acid
MSLMKIDFYLRFHTKFGQSLAITGNLPVLGSDEPGKALPMSFLSDELWQASIEIDPSETQTLHYRYIFIDEKGVSEKEAEKERIIEIKKAKHDLLLADTWNDPSLVENSFYSTPFKEVFFRDRKRLKLKKNNLYTHQFKIKAPLLSPDETVCLLGSSETLGQWNTDTPILLSKKGNWWIVNLEIPASEFAMSYKYGVYNLKTGAFIRFENGDNRILHNDGSVHKKTVIHDGFLRLPVNRWKGTGVAIPVFSLRSNNSFWHW

SEQ ID NO: 5869 - DNA, 729 bp, Unknown
  Obtained from environmental sample
  misc_feature (1)..(729): n is a, c, g, or t
atgtcggcggagaaaattctcaatgattggaaaaggaaactttataaacctgtatactggctcgaaggagaagagggatactttattgataaggtggtgaactatgccgaaaataatgttctcacggaatcggaagcatcattcaatttgtctatattttatgggaaggatgcatcatgggccgacgttgtaaatgcctgcatgcgatatcccatgttcgccgagaaacaggtagtattattgaaggaagcacagcagatgaaggagattgagaaacttgaaaactacatttcaaatccattaaaatctaccttgtttgttgtttgttataaagacaaaaaagtagatggtcgaagcaagttggcgaaagttctcaaggaaaaagcagaaatgctcagcaccaaaaagatgtatgagaaccagttgcctgaatggacctctgagttgatcaagtcaaaagggtacaccatttcgcagaagggtttattattactggtagatcatattggcaatgatctgaaccgcattgagaatgaagtcgacaaggtattggtgaatctatccaaacgaaaaaacattactgaagatgatatcgaaaagtacgttggtatcagcaaagaatataatcctttcgaattacagggggccatggcgcggaaagatctgtcgagggccatgcagattatacagtatttgaagcgaacccgaaagccgctcccatacatctga

SEQ ID NO: 5870 - protein, 242 aa, Unknown
  Obtained from environmental sample
  misc_feature (1)..(242): Xaa is any amino acid
MSAEKILNDWKRKLYKPVYWLEGEEGYFIDKVVNYAENNVLTESEASFNLSIFYGKDASWADVVNACMRYPMFAEKQVVLLKEAQQMKEIEKLENYISNPLKSTLFVVCYKDKKVDGRSKLAKVLKEKAEMLSTKKMYENQLPEWTSELIKSKGYTISQKGLLLLVDHIGNDLNRIENEVDKVLVNLSKRKNITEDDIEKYVGISKEYNPFELQGAMARKDLSRAMQIIQYLKRTRKPLPYI

SEQ ID NO: 5871 - DNA, 648 bp, Unknown
  Obtained from environmental sample
  misc_feature (1)..(648): n is a, c, g, or t
ttgttattcggcaaatgcatctctgtagnnaaaaatttatcattatcatcgggtatgaatgggaaaatatcaatacccgaaaataatattgaaatggtttcgccacgagcaattccaattctacttctgctatcaagagaattggcaatttccggatacatttcgggtattgggggcagcttaggatatacaatagtaggaaagaaagtctttgatgaattgcaaataaaattaccccctatgatgctctgggcaggggccgatgttttgacagggatagctcaaagagaagcaacaagatatttggaggagaacggaatatcaaatatgacagagttctttattcaaatcaataaacagaatgatgaactgaggaaaaaaattgaacccttaatattaaagcgaaatcaaatttataataacaaagatcaattacaggatctgttaagcgatttattttactataaacaggaacaaaggaaagttaaggatacaataaagaatgtccaaaaatctaaaaatgcattgaaactaagatcatgtattatcgattatgctgttaacattgggattgaacgtgtagagcatgaatggtctcacaaattagttgaaaataatgatttgaccaaacctgtggtactaaaatga

SEQ ID NO: 5872 - protein, 215 aa, Unknown
  Obtained from environmental sample
  misc_feature (1)..(215): Xaa is any amino acid
MLFGKCISVXKNLSLSSGMNGKISIPENNIEMVSPRAIPILLLLSRELAISGYISGIGGSLGYTIVGKKVFDELQIKLPPMMLWAGADVLTGIAQREATRYLEENGISNMTEFFIQINKQNDELRKKIEPLILKRNQIYNNKDQLQDLLSDLFYYKQEQRKVKDTIKNVQKSKNALKLRSCIIDYAVNIGIERVEHEWSHKLVENNDLTKPVVLK

SEQ ID NO: 5873 - DNA, 627 bp, Unknown
  Obtained from environmental sample
  misc_feature (1)..(627): n is a, c, g, or t
atgaaacaattcgaccttaacattgaaaaaatccttgagaactgggaaacgtaccatgcaataagagaaataattgctaatgctctcgacgagcaacttttaactgacacaaaagatgttgaaatcactaaagaaaactatacttggcatataagagattatggacgaggtttaaaatatacaaatctaacccaaaatgaaaatcaagagaaactcaccaatccttctgtcattggaaaatttggaattgggcttaaagatgctttggctacatttgacaggaaaggtattagggttctaattaaatcaaaatttggtgatattactctttctaaaactgcaaaagaagggtttgcagatataattacattacacgctaatatttctgacgccactgacgataaatttatcggaacagagtttataattgatggtgcaaccgatgaagatattaccaaagcgaaaaatttgtttttgaaatttactggtgaacagattttagaaaagacaaaggctggagacattgtaaacaaagtggnaagcataggtaaaatttatattaacggagtaaggntgcagaagagaaacgttcttatcagctatacatacacagctaacagtgcataa

SEQ ID NO: 5874 - protein, 208 aa, Unknown
  Obtained from environmental sample
  misc_feature (1)..(208): Xaa is any amino acid
MKQFDLNIEKILENWETYHAIREIIANALDEQLLTDTKDVEITKENYTWHIRDYGRGLKYTNLTQNENQEKLTNPSVIGKFGIGLKDALATFDRKGIRVLIKSKFGDITLSKTAKEGFADIITLHANISDATDDKFIGTEFIIDGATDEDITKAKNLFLKFTGEQILEKTKAGDIVNKVXSIGKIYINGVRXQKRNVLISYTYTANSA

SEQ ID NO: 5875 - DNA, 384 bp, Unknown
  Obtained from environmental sample
  misc_feature (1)..(384): n is a, c, g, or t
gtgagtactggcgctttaagtgatcttgaaaagataaccaggcaagctttcgcaagtattgtttattacggcttgaacgataaggttggtaatatcagttattatgatagttctggtcaaagcgagtataacttcaacaagccttatagtgagcaaacagctaagctgattgacgaagaggttaaaaagatggtggatatcgcttacgcgagaactaaacagatattggctacaaataaggataagctaaccatcctggccgaaaaacttctcgaaaaagaggtgatctttaaggaagaccttgaggagatctttggaaaacgtccgtttgaaaaggatgataatcacgaaaaaccggagatcaagatcgatccaacgacgtaa

SEQ ID NO: 5876 - protein, 127 aa, Unknown
  Obtained from environmental sample
  DOMAIN (1)...(104): Peptidase family M41
  misc_feature (1)..(127): Xaa is any amino acid
MSTGALSDLEKITRQAFASIVYYGLNDKVGNISYYDSSGQSEYNFNKPYSEQTAKLIDEEVKKMVDIAYARTKQILATNKDKLTILAEKLLEKEVIFKEDLEEIFGKRPFEKDDNHEKPEIKIDPTT

SEQ ID NO: 5877 - DNA, 300 bp, Unknown
  Obtained from environmental sample
  misc_feature (1)..(300): n is a, c, g, or t
ttgctacttaacatgtttacagggatttactcacccaagtataacccaagagcaatttataacgacattattcctctccctccatatcctgaacagcatcgcatcgtggcaaaattgaatcaattgctgcaaatgattagtcagttagaaaaacaaatattcctaagtcaagcacaagcaaaacaactgttccatgctgttttaacggaggcatttaacaaaaaggacagcaattctaaaattaaaatggtatcacttgcgaccgaagatgagggtagttataaaattgagagcaaatga

SEQ ID NO: 5878 - protein, 99 aa, Unknown
  Obtained from environmental sample
  misc_feature (1)..(99): Xaa is any amino acid
MLLNMFTGIYSPKYNPRAIYNDIIPLPPYPEQHRIVAKLNQLLQMISQLEKQIFLSQAQAKQLFHAVLTEAFNKKDSNSKIKMVSLATEDEGSYKIESK

SEQ ID NO: 5879 - DNA, 441 bp, Unknown
  Obtained from environmental sample
  misc_feature (1)..(441): n is a, c, g, or t
gtggcaacccggataaaggaaaatctgctagagaaatgcaatctccataccattgtgcgcttaccaaatggcgtatttgcaccgtatacagggattaaaaccaatctgcttttttttgaaaagggaacacccacaaaggaaatttggtatttcgaacatccttacccggaaggtataaaaaattacaacaaaacaaaacctattaatataaaagaatttgatctggagaaatcgtggtggaagaaaagactggagaatgaatatgcatggaaagtgagcgctgaagaaatcagaaggagaaattataatatggatatttcgaacccaagaaaaggatctagtgatggcgatctttcaataatagaattatttgataagattgagaatagacaactcgttataagctcaaccatacaaaaactgaaagaagaattattttag

SEQ ID NO: 5880 - protein, 146 aa, Unknown
  Obtained from environmental sample
  DOMAIN (1)...(103): N-6 DNA Methylase
  misc_feature (1)..(146): Xaa is any amino acid
MATRIKENLLEKCNLHTIVRLPNGVFAPYTGIKTNLLFFEKGTPTKEIWYFEHPYPEGIKNYNKTKPINIKEFDLEKSWWKKRLENEYAWKVSAEEIRRRNYNMDISNPRKGSSDGDLSIIELFDKIENRQLVISSTIQKLKEELF

SEQ ID NO: 5881 - DNA, 429 bp, Unknown
  Obtained from environmental sample
  misc_feature (1)..(429): n is a, c, g, or t
atggaccgcgatatgattatcgcggcccttcttcatgactccctggaagattgcgatgacctaactccagaacttctggagcactctttcggtaccaatgtcgtctctatcgtcaagttgctgagcaaagtgcccaaggaagggtatattgaaagactgaacaatgtccataactggaaagttctggttatcaaggcttgcgacagacttgataaccttcgttctttgatggttccaggtaccagtatcgatttccaaaagaagcaaatcaaagaaaccaaagaaaagtactttgcagtatttgataaaatggtcagtatatgtcctcccgaacatacaaccaacgtctctgctattagagatgagattcgtaggctgatagaaagatattccacaattatcgaactgaaagagcagagtggtgaataa

SEQ ID NO: 5882 - protein, 142 aa, Unknown
  Obtained from environmental sample
  misc_feature (1)..(142): Xaa is any amino acid
MDRDMIIAALLHDSLEDCDDLTPELLEHSFGTNVVSIVKLLSKVPKEGYIERLNNVHNWKVLVIKACDRLDNLRSLMVPGTSIDFQKKQIKETKEKYFAVFDKMVSICPPEHTTNVSAIRDEIRRLIERYSTIIELKEQSGE

SEQ ID NO: 5883 - DNA, 816 bp, Unknown
  Obtained from environmental sample
  misc_feature (1)..(816): n is a, c, g, or t
ttgaataaagaaatattaatagaaagactgaagtcacttgggttcaaggaatatgaatctaaagtccttatagttttattgagcggcaatcctttaagtgcatcagagatagccaaggaagcgaagatcataagaaattcaatttatgatatccttaaatcatttgttgaaaagggatattgtaatgaaattgaaaccaatacgatacttaattaccagataattgacccttctgtaattctggataagataaccagggattacaaaaaaagcttcaataaacgtatggaaagccttgccgaaactttcggtgagcttcaaaatatatataaaacagaatcggcaaaagtagatcttccagataagaatatccagcttatacgcggattcaacaagcacagggaagagaagtatattgatcttgtgaaagcttccgaaaaagagatacttggaatgtacagtccgcgccgggcagtagatgaaactgtcagccaggatgcaatttcatttctgaaaaagggcgggatcctcaaatcaatttatcaattgacaggngataaggatatggatactcagcttcttaaaggctgtgagcaattttccaagacaggggaagagttaagattatcagagttcanaataccccacatgacagtatttgattcagaagactgttttctgaaccttnctaatgataaaagcataccanagcacaaacaaagcggattaataatcaagaatccgggatatgcagggcatatgagaagattgttcctgaantanntggaaaaatctgtttcntttttcttgatttaa

SEQ ID NO: 5884 - protein, 271 aa, Unknown
  Obtained from environmental sample
  DOMAIN (5)...(258): Sugar-specific transcriptional regulator TrmB
  misc_feature (1)..(271): Xaa is any amino acid
MNKEILIERLKSLGFKEYESKVLIVLLSGNPLSASEIAKEAKIIRNSIYDILKSFVEKGYCNEIETNTILNYQIIDPSVILDKITRDYKKSFNKRMESLAETFGELQNIYKTESAKVDLPDKNIQLIRGFNKHREEKYIDLVKASEKEILGMYSPRRAVDETVSQDAISFLKKGGILKSIYQLTGDKDMDTQLLKGCEQFSKTGEELRLSEFXIPHMTVFDSEDCFLNLXNDKSIPXHKQSGLIIKNPGYAGHMRRLFLXXXEKSVSFFLI

SEQ ID NO: 5885 - DNA, 336 bp, Unknown; identical to SEQ ID NO: 973
  Obtained from environmental sample
  misc_feature (1)..(336): n is a, c, g, or t

SEQ ID NO: 5886 - protein, 111 aa, Unknown; identical to SEQ ID NO: 974
  Obtained from environmental sample
  DOMAIN (15)...(98): Acetyltransferase (GNAT) family
  misc_feature (1)..(111): Xaa is any amino acid

SEQ ID NO: 5887 - DNA, 801 bp, Unknown
  Obtained from environmental sample
  misc_feature (1)..(801): n is a, c, g, or t
atgaagcaaaccgttacaactgagtctttaagcttattggaaagagccttgtttattcttcaggatggcattggcattgttgaaaaagattttaccataagctatatcaattccgctgcgcaggatcttttggaaaagcaattccgtcaccgtcctttcgttggtgaatgtttcctggattatgttgcttctgaaaggcaggatatttacagggaatttgtttcaaaggcctttgaaaatgaaccttcgactttagaggtcgaatttcccggtcccacctggtatgaaataggatattatcccatgcctgatgaagaaggttttgttacgcatgtttgtatcaaggcgaaagagattacccaaaaaatagtattggaaaagaaattaaagcaggagagaagggagcgaaagaacaacatcattaaagcaacaatagaagcccaggaaaaagaaagaagcctcataggaagagaattgcatgacaatgtaaatcaggtattgaccactgttaaattatatactgagctcagctaccatggcgaagtgcctaatanagatttattanaacggtcagtacaacagatcaattattgcatagaagagatcagaagtttatcaagaaggctggctgttcctaaattgggagaattaggtttggaagatctgatcagagatctggttgatactggtaacatcacaaagaaaacttccatcaaattcctttcatatggaattaagaccgtgagttcaaagacgaaataccaaccactatttacagaattgtacaggaacacttactaa

SEQ ID NO: 5888 - protein, 266 aa, Unknown
  Obtained from environmental sample
  misc_feature (1)..(266): Xaa is any amino acid
MKQTVTTESLSLLERALFILQDGIGIVEKDFTISYINSAAQDLLEKQFRHRPFVGECFLDYVASERQDIYREFVSKAFENEPSTLEVEFPGPTWYEIGYYPMPDEEGFVTHVCIKAKEITQKIVLEKKLKQERRERKNNIIKATIEAQEKERSLIGRELHDNVNQVLTTVKLYTELSYHGEVPNXDLLXRSVQQINYCIEEIRSLSRRLAVPKLGELGLEDLIRDLVDTGNITKKTSIKFLSYGIKTVSSKTKYQPLFTELYRNTY

SEQ ID NO: 5889 - DNA, 696 bp, Unknown
  Obtained from environmental sample
  misc_feature (1)..(696): n is a, c, g, or t
atgatcggctttaatttttcaaaatatgatccttcagaaaatgcgaaatctgatttcgagaaattgcttgacctcttcatgcaactccttatttatacaaatggggattttgttgaggcgatgcaatggctcaatgaacttgataaagaaaataagctaacgaataatgattatggaattggtgattttcttgaagacttaaaagacaaaggctatgtgactgaaaattccgaaaccggtattataaagatcacttccaaatctgagcagggtatccgcaaaaaaagcctggaagaaatattcggtaaactcaaaaaaacaaagcaaggaaaccacaacacattcaagccgggaggcggagatgaaataaatcctgaaacccgcccattccagtttggagacaccatggaacagatcgattttacatcttccatccggaatgcccagatcaatcatggaatagaaagcttcagtatgtttgaagatgaccttgagatcagggaaacagatttcaagtcgcagacctcgacggtattaatgatcgatatctctcattcgatgatattgtacggcgaagacaggataacgcctgcaaaaaaagtagccatggccctcagtgagctgataccaaccaaatatccaaagaatacacttgacttggtgtattttgaaatgatgcgtggacaaaccaagtaa

SEQ ID NO: 5890 - protein, 231 aa, Unknown
  Obtained from environmental sample
  misc_feature (1)..(231): Xaa is any amino acid
MIGFNFSKYDPSENAKSDFEKLLDLFMQLLIYTNGDFVEAMQWLNELDKENKLTNNDYGIGDFLEDLKDKGYVTENSETGIIKITSKSEQGIRKKSLEEIFGKLKKTKQGNHNTFKPGGGDEINPETRPFQFGDTMEQIDFTSSIRNAQINHGIESFSMFEDDLEIRETDFKSQTSTVLMIDISHSMILYGEDRITPAKKVAMALSELIPTKYPKNTLDLVYFEMMRGQTK

SEQ ID NO: 5891 - DNA, 570 bp, Unknown
  Obtained from environmental sample
  misc_feature (1)..(570): n is a, c, g, or t
ttgctcgcttanactggtgaagtcgttcttgacctaggagccggtggtggtttcgatgtcttcttagctgcaaaacaagtgggtccaaatggaaaagtatttggtgtagatatgactcctgaaatgatcagcaaagctagaaataatgcgtccaaaaatggttatcaaaatgttgaatttcttttaggagaaattgaacatttacccttgccaaacaatactgtagatgtcatcatgtcaaattgcgttgtcaatctctcgacaaataaaacaaatgtttttaatgaatcttttcgagtattaaaagatggaggacgattggcaatttcagatatggttgcttataaaccattgcctccggaaatgattaaagacaaagatctttattgcaactgcatctcaggtgcaataacgattgacgagcttaaaaatattttaattaaagctggattcagcgatattgtgatagaacctcaggaaaacagtcgcatgtttattaaggattgggttcccggttctgatgctgaaaactatgtcgtctcagcaaaaattaaggcaaataaaccgtaa

SEQ ID NO: 5892 - protein, 189 aa, Unknown
  Obtained from environmental sample
  DOMAIN (1)...(167): ubiE/COQ5 methyltransferase family
  misc_feature (1)..(189): Xaa is any amino acid
MLAXTGEVVLDLGAGGGFDVFLAAKQVGPNGKVFGVDMTPEMISKARNNASKNGYQNVEFLLGEIEHLPLPNNTVDVIMSNCVVNLSTNKTNVFNESFRVLKDGGRLAISDMVAYKPLPPEMIKDKDLYCNCISGAITIDELKNILIKAGFSDIVIEPQENSRMFIKDWVPGSDAENYVVSAKIKANKP

SEQ ID NO: 5893 - DNA, 561 bp, Unknown
  Obtained from environmental sample
  misc_feature (1)..(561): n is a, c, g, or t
atgctcatttactttatgcaaaacacttctcagcaatacgatgctgccatttcacgctgtaaagatatctttttaaagaagatgaaagactatggaacagcgtggcgcaatttacgtcccacttcacttaccgaccagatctttataaaagcccagagaataaaaagtatcgaggaaaaaggcacccaaaaggtagaggacgatattaaaggagaatatatagggattattaattactgcctgattgccctgatccagaccgaactgaaaaacgacgggcggatggaacttccctacgaagaggtggaaacattatataacaaacacctggcaattaccaaaaaactcatggaagataaaaaccatgattacggagaagcctggcgcgaaatgagaatcagttccctcaccgacctcattctgatgaaaatattcagaagtaaacaaattgaagactataaaggcaagacgaatatcagtgaaggagtagaagcaaattatatggatatgatcaattattcggtgtttgccatgaatccgaatgtcgtaaataacctttaa

SEQ ID NO: 5894 - protein, 186 aa, Unknown
  Obtained from environmental sample
  DOMAIN (27)...(87): Domain of Unknown Function (DUF1599)
  misc_feature (1)..(186): Xaa is any amino acid
MLIYFMQNTSQQYDAAISRCKDIFLKKMKDYGTAWRNLRPTSLTDQIFIKAQRIKSIEEKGTQKVEDDIKGEYIGIINYCLIALIQTELKNDGRMELPYEEVETLYNKHLAITKKLMEDKNHDYGEAWREMRISSLTDLILMKIFRSKQIEDYKGKTNISEGVEANYMDMINYSVFAMNPNVVNNL

SEQ ID NO: 5895 - DNA, 864 bp, Unknown
  Obtained from environmental sample
  misc_feature (1)..(864): n is a, c, g, or t
ttgctgaaagaaattcataaattttatatttccttaaatgacacatcttatgccttgaccgttgtgaaaggtgttaaaccacagcgtctgcaatntgacacattaactcgaaatagcgaactaaaaattctgtacgaacaaaacgacaacaatgaatacctgaatctattgctgtcaaaatatccgattgacagtttaattaaagaatccaaatcagacagtgaaaaagcgttcagaatattaaattgggtacataaccagtggcaacatgatggaaacaatgaaccaaaaaaaaatgatgctatttcaattcttgaggaagttaagacagggaaaaatttccgttgtgtagaatatggtattgtggccactgcatgcctgaatgctgtgggattaaaagcgagagttttaggacttatgataaaagatgttgaaacaacaaaatatggggcgggacatgtcttattggaagtatatctcaatgatttaaataaatgggctttactggacggtcaatgggatgcagttccaatgttaaacaatataccactcaatgcagtagaatttcaaaaggcaattgtagaaagttatgacggtttagttatcaagacatcttccggcatttcaaaacggaattatattgattggatttatccatacctctactattttactattccatttgacaacagggaaaaaactaattccgaaacaaaaaagtcagaagagaaaagtcatttaatgttagttccactcggagcaaacatgccggcagtttttcaaatcacccacaaaattgactattgcctatataccaattcattgaacgacttttatgcatcacctgacatcagaaaaaaatag

SEQ ID NO: 5896 - protein, 287 aa, Unknown
  Obtained from environmental sample
  misc_feature (1)..(287): Xaa is any amino acid
MLKEIHKFYISLNDTSYALTVVKGVKPQRLQXDTLTRNSELKILYEQNDNNEYLNLLLSKYPIDSLIKESKSDSEKAFRILNWVHNQWQHDGNNEPKKNDAISILEEVKTGKNFRCVEYGIVATACLNAVGLKARVLGLMIKDVETTKYGAGHVLLEVYLNDLNKWALLDGQWDAVPMLNNIPLNAVEFQKAIVESYDGLVIKTSSGISKRNYIDWIYPYLYYFTIPFDNREKTNSETKKSEEKSHLMLVPLGANMPAVFQITHKIDYCLYTNSLNDFYASPDIRKK

SEQ ID NO: 5897 - DNA, 525 bp, Unknown
  Obtained from environmental sample
  misc_feature (1)..(525): n is a, c, g, or t
gtggcaccatattttgacgaagtttatgataaggtagtacaaaaagaactgcaaccttcagattatcttttgggcagaaaaacatttgagatctgggccggttactggcctgtacatggagacttttggccaggtattaatgaaggcaccaaatacgtgttttccaaaaacctgaaaaaatcggatccgatagtaacagggtggaaaaactccgttgtaataagaaatcttgcagatatcaaaaagcttaaaagcatgcccgccggtaagaaaggtgtaataaactctgatattcaagtttggggtagcagcaagttgattcaacttctacttaagaatgaccttgcagacgaactaagactcaaaattcaccctttgactttaggtaaaggaaaaaagctttttgacaatggaacgattccggcagcatttacattaatagagagtattgttacaccaactggagttattattgccaattacaagcgagccgggaaagtcaagacaggtactattggagtttaa

SEQ ID NO: 5898 - protein, 174 aa, Unknown
  Obtained from environmental sample
  DOMAIN (1)...(158): RibD C-terminal domain
  misc_feature (1)..(174): Xaa is any amino acid
MAPYFDEVYDKVVQKELQPSDYLLGRKTFEIWAGYWPVHGDFWPGINEGTKYVFSKNLKKSDPIVTGWKNSVVIRNLADIKKLKSMPAGKKGVINSDIQVWGSSKLIQLLLKNDLADELRLKIHPLTLGKGKKLFDNGTIPAAFTLIESIVTPTGVIIANYKRAGKVKTGTIGV

SEQ ID NO: 5899 - DNA, 453 bp, Unknown
  Obtained from environmental sample
  misc_feature (1)..(453): n is a, c, g, or t
atgatctcattaaaacgaacaaattcagacgatcctgattttcaaaaactggttattgaattagataaagatctaaggataagagacggtgaagatcactccttcttttcacaattcaataaaattgatgctatcaaatacgtggtggttgcttacaaaaataacacacctgttggctgcggcgccataaaatattatcaagaaaacattatggaagtgaaacgcatgtttgttcctttggaattacgagtacaaggaattgcatcacacgtactaagggaactggaaaaatggagcaaagaactgaatttcttcaccctgatattggagaccggcgaaaaaatgccggaagccattcagctttacaagaaaaataattacaaggtaattccaaattacgggcaatatgccggggtggaaaccagcgtgtgttttgagaagcgtttgatatga

SEQ ID NO: 5900 - protein, 150 aa, Unknown
  Obtained from environmental sample
  DOMAIN (49)...(128): Acetyltransferase (GNAT) family
  misc_feature (1)..(150): Xaa is any amino acid
MISLKRTNSDDPDFQKLVIELDKDLRIRDGEDHSFFSQFNKIDAIKYVVVAYKNNTPVGCGAIKYYQENIMEVKRMFVPLELRVQGIASHVLRELEKWSKELNFFTLILETGEKMPEAIQLYKKNNYKVIPNYGQYAGVETSVCFEKRLI

SEQ ID NO: 5901 - DNA, 351 bp, Unknown
  Obtained from environmental sample
  misc_feature (1)..(351): n is a, c, g, or t
gtgtggtgcaggtttagtttcgactttttttttgtatacactttcgaatcttatcatattgaattcctttcatcatttttgatgctagatcatgcaatacggtgtggattaacccagggactactttctggtcctgtggtagctattggaagaaatggttctactgaacagttgaaagaagttccatcgaagaagggaagattcgttctgatcgagacacccaatgaagttgaactggacatcagctcgactcagataaggaaactcattgcagagaacaaatctatagatcatttggcccctcctggagttgtgaaatacatcaaagaaaataagatactgatgaaatga

SEQ ID NO: 5902 - protein, 116 aa, Unknown
  Obtained from environmental sample
  misc_feature (1)..(116): Xaa is any amino acid
MWCRFSFDFFFVYTFESYHIEFLSSFLMLDHAIRCGLTQGLLSGPVVAIGRNGSTEQLKEVPSKKGRFVLIETPNEVELDISSTQIRKLIAENKSIDHLAPPGVVKYIKENKILMK

SEQ ID NO: 5903 - DNA, 432 bp, Unknown; identical to SEQ ID NO: 4401
  Obtained from environmental sample
  misc_feature (1)..(432): n is a, c, g, or t

SEQ ID NO: 5904 - protein, 143 aa, Unknown; identical to SEQ ID NO: 4402
  Obtained from environmental sample
  misc_feature (1)..(143): Xaa is any amino acid

SEQ ID NO: 5905 - DNA, 537 bp, Unknown
  Obtained from environmental sample
  misc_feature (1)..(537): n is a, c, g, or t
gtgtctaaagttaagattatgaaaaaagttgtttatataattgtcgccttaattgcttttttatttggagcttctgtttattatgtccaacctctttttgttccgatttctctttctgaattaagaaaaaatgaatctcactataaattcctcaaaataaaagtaatcgcaaaacttgaagtaactgaggaaaactcgcgctactttgtaaacttgaaagattgggaagctgactgttcgggcgataatttctgctttaatagtttagaattatcagaagaattgatgaacgagaatatttcgctgataaaagaattagtagaaaagaacaaaacagttacaaggtcaactttaataaacaataactactactgggcagtagatggcgagtattatgttgatgttgaagttacagggcatttagtcgaaaaggaaaataaaactttcggcggcacatactatgccataaaagtagagaagattatacaaaactcaccaatcaaattccttccaacaaaagaactgctcggacgataa

SEQ ID NO: 5906 - protein, 178 aa, Unknown
  Obtained from environmental sample
  misc_feature (1)..(178): Xaa is any amino acid
MSKVKIMKKVVYIIVALIAFLFGASVYYVQPLFVPISLSELRKNESHYKFLKIKVIAKLEVTEENSRYFVNLKDWEADCSGDNFCFNSLELSEELMNENISLIKELVEKNKTVTRSTLINNNYYWAVDGEYYVDVEVTGHLVEKENKTFGGTYYAIKVEKIIQNSPIKFLPTKELLGR

SEQ ID NO: 5907 - DNA, 348 bp, Unknown
  Obtained from environmental sample
  misc_feature (1)..(348): n is a, c, g, or t
gtgtccatcaccgctgtatacgacggcgtgaaactgatggattatttgctgaaaaaacatgacttcaaaaacaacaatgaaaaaccggacctgatcttacttgacctgaacatgccgcttatggacggctttcaggcactgaaccgcataaaatctataaacccgatccgggaaataccggtttatattattaccaccagcaacgcgaaaagggaaaaggagatagcgcttaaactcggcgccgcgggtttctattcaaagggagcaagctctaaagacatccgtcgaataatgtcggagatctgcaaagaatgtttcgatgaactaccgggtgaagtagcggaataa

SEQ ID NO: 5908 - protein, 115 aa, Unknown
  Obtained from environmental sample
  DOMAIN (1)...(105): Response regulator receiver domain
  misc_feature (1)..(115): Xaa is any amino acid
MSITAVYDGVKLMDYLLKKHDFKNNNEKPDLILLDLNMPLMDGFQALNRIKSINPIREIPVYIITTSNAKREKEIALKLGAAGFYSKGASSKDIRRIMSEICKECFDELPGEVAE

SEQ ID NO: 5909 - DNA, 876 bp, Unknown
  Obtained from environmental sample
  misc_feature (1)..(876): n is a, c, g, or t
atggatcacctcttcacaatcgaacttgcactagatgtattggaatcttccgtcacaagacaacttgtcggcgaattggctatcttcaaatatttacaggactcgaaaaatcattatgcgattggtcaaattatagaaataacgcttaagaactttttattagaggatcctacaattaaatccgtagcacgaaagagaggttcagttaatcctattagtgggatacaggatgttcacgtaggaaagctactttgtagcgcaatatttaccagttttgaggatctagttgaacccagcttattaggcacagttccaccaacaggaacgtatgtctatcaagtaaatgatgacattctaagtactattttagaaaagcaaaagaatagcttgctctatttagggaatagttatggttccaaaaccaaattgccaatgtggtttaagcattttgattacggagaaaatggtgctggagaagcctatcatctgggagtttttggaataactggatctggaaaatcaactctggcgaaaatgattctggctgcatactctaagtttcgtcagatgggcttactggtactagatcctgtaggagagttttctaaaagttttgcaaatgactatagcagtaacggggacaaggaatatccgaattctgattcaaatttcaatatgaaaaaaataatgaactctctaaataaacaagtcgtatcaataaatgttagaaatcttgttttagatagatggacattatttgaagaaatcttactggaatcacaaatccttcatcagctaacaattaaagggccaaataagggatttgccgtggatgcattgatacctaaacttagaaaacaaacgactttgagntaa

SEQ ID NO: 5910 - protein, 291 aa, Unknown
  Obtained from environmental sample
  misc_feature (1)..(291): Xaa is any amino acid
MDHLFTIELALDVLESSVTRQLVGELAIFKYLQDSKNHYAIGQIIEITLKNFLLEDPTIKSVARKRGSVNPISGIQDVHVGKLLCSAIFTSFEDLVEPSLLGTVPPTGTYVYQVNDDILSTILEKQKNSLLYLGNSYGSKTKLPMWFKHFDYGENGAGEAYHLGVFGITGSGKSTLAKMILAAYSKFRQMGLLVLDPVGEFSKSFANDYSSNGDKEYPNSDSNFNMKKIMNSLNKQVVSINVRNLVLDRWTLFEEILLESQILHQLTIKGPNKGFAVDALIPKLRKQTTLX

SEQ ID NO: 5911 - DNA, 576 bp, Unknown
  Obtained from environmental sample
  misc_feature (1)..(576): n is a, c, g, or t
ttgatatgtaatgcggaggggaaattatcttctctccccaaaccaatttcacatacagtgatggtagtacaatcgaatggaaagaacgagtgcgtttatttgattggtggcagaaagaaaaatgtaaatagcccaagcgatctttattcttctgcatttcaatttgatttaaaaacgaaagaatggaaagaaaaaagatccctgccttatacttcgtctgcaggcactggcgttgccgttggaacacattccattttattatttggtggcgataacggcgcaacttttcacaaaaccgaagaactcatttttgctatcaacaaggaaaaggacgaaacaagaaggaaacaacttgatgcagaaaaaataaaactgcaatcaacgcatcccgggttttgcaaacaagtgctttcgtacgatacaagaaaagatgaatggcaagctgctggctgtatttcgtatgattcgccggttacaacaacagcagttaaatggaacaataaaatcattatcccgggtggagaaataaaagcaggagtaagaacgccgcaaattctttcagctaaaattttttga

SEQ ID NO: 5912 - protein, 191 aa, Unknown
  Obtained from environmental sample
  misc_feature (1)..(191): Xaa is any amino acid
MICNAEGKLSSLPKPISHTVMVVQSNGKNECVYLIGGRKKNVNSPSDLYSSAFQFDLKTKEWKEKRSLPYTSSAGTGVAVGTHSILLFGGDNGATFHKTEELIFAINKEKDETRRKQLDAEKIKLQSTHPGFCKQVLSYDTRKDEWQAAGCISYDSPVTTTAVKWNNKIIIPGGEIKAGVRTPQILSAKIF

SEQ ID NO: 5913 - DNA, 642 bp, Unknown
  Obtained from environmental sample
  misc_feature (1)..(642): n is a, c, g, or t
gtgtgctgtgctgttggaaatcaagggcaagaagataatgatgaggtttatagatttttcaaccgtatttacagcttaggaaggatatattcaaaaagacttttcccatattttaataaagaagacgagcgagaattttcgattcgtttgaaagaaaaatttccaaatatcttatttattgatgatgacgtttggaactcgccaatcgcaccaactaaacaatttattgataagtgtcattccaaatttatttatatttggaataaagatattgttgatgaaatttatgtcgttaaatcacaagatggaaaatatcatggaagaaaagatgtagatgtaattagatttacaaggtgttatcacaagcctgaaggtctttggtatggtgaaattttgtttggttcgaattctgcctatccgaattttgaaccgatgaaaacctttacaaaagaagtttggaggatacttaacaaaatgtgcgagaaagtggttgcagtaaatcctcaaactagagacataataaatgacgacgtttcttatttcagagtaggtaaaaataccgttgagtggtgtaaagaaaatacgaataattttcttagttattaccaaacagcttttttaccaaaatcgttttatgaataa

SEQ ID NO: 5914 - protein, 213 aa, Unknown
  Obtained from environmental sample
  misc_feature (1)..(213): Xaa is any amino acid
MCCAVGNQGQEDNDEVYRFFNRIYSLGRIYSKRLFPYFNKEDEREFSIRLKEKFPNILFIDDDVWNSPIAPTKQFIDKCHSKFIYIWNKDIVDEIYVVKSQDGKYHGRKDVDVIRFTRCYHKPEGLWYGEILFGSNSAYPNFEPMKTFTKEVWRILNKMCEKVVAVNPQTRDIINDDVSYFRVGKNTVEWCKENTNNFLSYYQTAFLPKSFYE

SEQ ID NO: 5915 - DNA, 543 bp, Unknown
  Obtained from environmental sample
  misc_feature (1)..(543): n is a, c, g, or t
atgaatatagaaaaagagctaatagaaggctgcaaaaaaggaaaccgacaatcctttgaatccctgtacaaacagtacgcagggagattgctctctattgccatgcgctattcatttaccacctttgaagccgaagacatactgcaggatgccttcattaagatcttcaattcgattaaatcatacgaatacaaaggttcgtttgaaggatggttaaagagaattgtcgtaactactgcaatcaatcagtaccataaggacaaaaacaggcaattccaaacagactcctcttataccgaagaagaagatgacgatgtagttgatataatttcaaaaatgtctgctgacgaattgcttactatcattcaaacattgcctgatggttaccgtatggtatttaacatgtatgtcattgaaggttatacacacaaagagataggtgaattattatccatttcagaaggcacttcaaaatcacaactggctaaaggaagaatattattaaaaagtaaacttcttcagaaaggaataataacgttatga

SEQ ID NO: 5916 - protein, 180 aa, Unknown
  Obtained from environmental sample
  DOMAIN (121)...(170): Sigma-70, region 4
  misc_feature (1)..(180): Xaa is any amino acid
MNIEKELIEGCKKGNRQSFESLYKQYAGRLLSIAMRYSFTTFEAEDILQDAFIKIFNSIKSYEYKGSFEGWLKRIVVTTAINQYHKDKNRQFQTDSSYTEEEDDDVVDIISKMSADELLTIIQTLPDGYRMVFNMYVIEGYTHKEIGELLSISEGTSKSQLAKGRILLKSKLLQKGIITL

SEQ ID NO: 5917 - DNA, 333 bp, Unknown
  Obtained from environmental sample
  misc_feature (1)..(333): n is a, c, g, or t
atgaaagagcgtacagatctaatggataaatccataaaagaaaaatttgaaggccacgaagtacctgtaccttctcatttatggaattccattgaagcgaatttacccacggagaataacaacaccggtggaaatttcttcttcaagaagccattcatattatccattctggttatcagcacagtgatcattggaacatacttatacaaaacacccgatacacagaacaatcacacgaagactgtagtgaacgaaacatctngtcatgctaatttaatgaatcggcacccgtacaatcaancnacaattccatcattgattaaaagtcgataa

SEQ ID NO: 5918 - protein, 110 aa, Unknown
  Obtained from environmental sample
  misc_feature (1)..(110): Xaa is any amino acid
MKERTDLMDKSIKEKFEGHEVPVPSHLWNSIEANLPTENNNTGGNFFFKKPFILSILVISTVIIGTYLYKTPDTQNNHTKTVVNETSXHANLMNRHPYNQXTIPSLIKSR

SEQ ID NO: 5919 - DNA, 858 bp, Unknown
  Obtained from environmental sample
  misc_feature (1)..(858): n is a, c, g, or t
ttgcagggcggacgcaccgtgtatgataacctcaacaagtcgttgttgagggctatacctgtgtttgtagatagctttggaaattttattgaacttaactgggagtatgtttacaagggcaccatccgagatttttatccccctgttgaatttttaccttcgcagtccaactntcagttatatgccgaaagccttggtgatctaagccccgaacaacaaaacgaactgatctctaagatcggaaaaaaactttctattggcgaattaaaagcaaatatcgatttcgcgttcttatgtcttcatggcccttttggagaggacgggcgcatacagggcttatttgaatataacggcattccctacagcggttccggaattctggcttcttctattggcattgacaagagcattcaaaaagaattaatggtgaacaagggatttaatagcccggcttacattaccattaaacgcgacgattggatagacggaaaagcaagcggaacttttaaaagcgttaaagaaaaaataggatttccttgtgttgtaaaaccagccaatcaaggctccagtattggagtttcggttttaaacaaccccaacgaacatgaatttatgagcgccgttgaaaaagccctgttcaccaaatggctggatgctaaagagtggcaggcaatgaacgcggaagataagatcagttttattaaaacgctggccgatatccgcgagggaattggaatgccggtggcgatcacttatcctaaagaactaaactcgccggtaatttacgatccgaataaattgatagaatttttagacaagaatttaaaaagtgacgggtttattttagaaagcccttga

SEQ ID NO: 5920 - protein, 285 aa, Unknown
  Obtained from environmental sample
  DOMAIN (134)...(269): D-ala D-ala ligase C-terminus
  misc_feature (1)..(285): Xaa is any amino acid
MQGGRTVYDNLNKSLLRAIPVFVDSFGNFIELNWEYVYKGTIRDFYPPVEFLPSQSNXQLYAESLGDLSPEQQNELISKIGKKLSIGELKANIDFAFLCLHGPFGEDGRIQGLFEYNGIPYSGSGILASSIGIDKSIQKELMVNKGFNSPAYITIKRDDWIDGKASGTFKSVKEKIGFPCVVKPANQGSSIGVSVLNNPNEHEFMSAVEKALFTKWLDAKEWQAMNAEDKISFIKTLADIREGIGMPVAITYPKELNSPVIYDPNKLIEFLDKNLKSDGFILESP

SEQ ID NO: 5921 - DNA, 438 bp, Unknown
  Obtained from environmental sample
  misc_feature (1)..(438): n is a, c, g, or t
ttgaatttactaaatggagaatcaaatctatattttgacggaacctacattggaaaaacatttattgatgtaaattctacaaaagacactttatcattttctttaggaaaagacaataagattcaggtagaaagaaaacgagttcaggaaaaaagcacgaataaagtcattggttctcgtcagaaatttgaagtaacatgggaaatcaaagttaaaaacaatggaggagcatccattccgatcattattaaagatcagttcccggtaacagttgtaagtgacattaaagtaaaaagaggcgatgctccggaagccaagttagatgataaaaccggaattttgacatggagtttcatccttactccttctcaaagcaagacactgacctttgattattcagttgattcgcaacatggacaagtattgtacattgaataa

SEQ ID NO: 5922 - protein, 145 aa, Unknown
  Obtained from environmental sample
  misc_feature (1)..(145): Xaa is any amino acid
MNLLNGESNLYFDGTYIGKTFIDVNSTKDTLSFSLGKDNKIQVERKRVQEKSTNKVIGSRQKFEVTWEIKVKNNGGASIPIIIKDQFPVTVVSDIKVKRGDAPEAKLDDKTGILTWSFILTPSQSKTLTFDYSVDSQHGQVLYIE

SEQ ID NO: 5923 - DNA, 459 bp, Unknown
  Obtained from environmental sample
  misc_feature (1)..(459): n is a, c, g, or t
atgaccgacacaatagagaaacttaatagagacagtagtttatcccttaggctgatttgttccgagcaaaaggatgctaccctaaagctcatcttaatgactcatgaatttgtatacaaccatcctgatggcgtccaggtatttcatgtaacgggtcctaagatgtacaatgcttttgtatacttcatggattcatttgagcatatatacttcaatgtaaataattatatcacttcgaagagaaaccttagacaagtaaatagcagtctctattggcttaacagtgattaccaaaagtttaaaggccttcctggtgttgatgaggtagtaaaacacgctcaccagttctacaagataatctttcattatgggctcttagctgttgaagcatatgaagcactggcaaagcttaaaaaggctgaagaaagaatcgacaatgctattaaacaacttaaataa

SEQ ID NO: 5924 - protein, 152 aa, Unknown
  Obtained from environmental sample
  misc_feature (1)..(152): Xaa is any amino acid
MTDTIEKLNRDSSLSLRLICSEQKDATLKLILMTHEFVYNHPDGVQVFHVTGPKMYNAFVYFMDSFEHIYFNVNNYITSKRNLRQVNSSLYWLNSDYQKFKGLPGVDEVVKHAHQFYKIIFHYGLLAVEAYEALAKLKKAEERIDNAIKQLK

SEQ ID NO: 5925 - DNA, 555 bp, Unknown
  Obtained from environmental sample
  misc_feature (1)..(555): n is a, c, g, or t
ttggaatttttttttttttgtcctaatatagatataaataccccactgataaccatatatataatatttttatgggcaaagtacctgtcaccacgttcacccttaaaaaagtccaaaaataanaatttgaaaaagncagaacaggaaatccaattnntnatagagaagtaccctacgtttccagcttttgcaataccanctactaagataaacccaagggaaaaaacgacttctttaacacaggaaatattaatcctggttaatacttctggtatagcctatgtttggagaaccaacacaaccggaatatacaatgagaaggtaggcatgtggatcaagtcaggaagcactaagggggcttcagacttgttcatctgcttcacagtaggagaatgtagaggaagactcattgcagtggaattgaaacagggacatgataagctcaacccatcacaaataagattcaaagagaagatagaacaggcaggcgggcagttctgggaaataaggagcataagccagtttcagaagttatggaatgaattgacctcttaa

SEQ ID NO: 5926 - protein, 184 aa, Unknown
  Obtained from environmental sample
  DOMAIN (94)...(181): Protein of unknown function (DUF994)
  misc_feature (1)..(184): Xaa is any amino acid
MEFFFFCPNIDINTPLITIYIIFLWAKYLSPRSPLKKSKNXNLKKXEQEIQXXIEKYPTFPAFAIPXTKINPREKTTSLTQEILILVNTSGIAYVWRTNTTGIYNEKVGMWIKSGSTKGASDLFICFTVGECRGRLIAVELKQGHDKLNPSQIRFKEKIEQAGGQFWEIRSISQFQKLWNELTS

SEQ ID NO: 5927 - DNA, 939 bp, Unknown
  Obtained from environmental sample
  misc_feature (1)..(939): n is a, c, g, or t
atgaaaaatttatgtctgttaaatacagttaaagagttganggaatttgttggtttcttctcacgagagaataaaatcgatttgttaatagatctatcaaagaataaaaccattgttcctttctattattcatttatgtctactgcaattaataatcaaggagaattttcaatntggaatataaactcaccgaaaggtggtattcaaagcaacttcattagattggtagttaatgtagctaatttgtctataccaagtaagaaaagaagaatgttgtggcaagcggtcgtagataatttgattgatgaaacttctgagggttacgacatacccgttttggatgctaaagaagcaatgagagatgataaaaaatgtgctttattaatccaagcatatgtagataatatctataaaaaatttaaattaggtgactcaccttatgttgagtgcaaaattgttgatattgattcagaaagatggaatattacgccaaatataaattttaaagaattaaacgaaataacaggtaacgagttaacttttagacccgaaatgcctttaataggagaagtccaatctaatcgtttaatatggactgcccaaaaagagggttacgacttgtttttgggagatgtaatgagtcaagttgttggaaataagctttttgaagctgatgagaaggttaataaagcagaagatattattacggatttgaaagcaagagtagaatttcctgatataaaagaaagtgtaaatggcggcttcttaacagtaaatgagatttttaatattcgtaatcatggcaaacagtttagagaatggcttcaacaagagggtgagcgagatagagatgcaataatagcctatcataatgaaatagctaaaaaatctggtttgaccaaacgcacttcaagtacgcttaaattattggaaatttaa

SEQ ID NO: 5928 - protein, 312 aa, Unknown
  Obtained from environmental sample
  misc_feature (1)..(312): Xaa is any amino acid
MKNLCLLNTVKELXEFVGFFSRENKIDLLIDLSKNKTIVPFYYSFMSTAINNQGEFSXWNINSPKGGIQSNFIRLVVNVANLSIPSKKRRMLWQAVVDNLIDETSEGYDIPVLDAKEAMRDDKKCALLIQAYVDNIYKKFKLGDSPYVECKIVDIDSERWNITPNINFKELNEITGNELTFRPEMPLIGEVQSNRLIWTAQKEGYDLFLGDVMSQVVGNKLFEADEKVNKAEDIITDLKARVEFPDIKESVNGGFLTVNEIFNIRNHGKQFREWLQQEGERDRDAIIAYHNEIAKKSGLTKRTSSTLKLLEI

SEQ ID NO: 5929 - DNA, 351 bp, Unknown
  Obtained from environmental sample
  misc_feature (1)..(351): n is a, c, g, or t
ttgtctgcaaaaggaaacaaagcatctacatgggaagaattaattaatgctaagaaattaccatttatggcaatgttgagaaatcttcgtaatttgatatttactggagttcatcctcgcattcacaagtgggttatcagtaaattaaccaatgaaacaacagttgctaacagtagacaatttccaactcaatttttttctgcatatgaagttattccaaaagatttagatgattttaaagctaaattgcaagaacaaaacaaacctaaagaagggaaaaaaaacgagttaaaaaagctgttgtacctgcttacatgcctagcaattcttattcaagaaaagacaacataa

SEQ ID NO: 5930 - protein, 116 aa, Unknown
  Obtained from environmental sample
  misc_feature (1)..(116): Xaa is any amino acid
MSAKGNKASTWEELINAKKLPFMAMLRNLRNLIFTGVHPRIHKWVISKLTNETTVANSRQFPTQFFSAYEVIPKDLDDFKAKLQEQNKPKEGKKNELKKLLYLLTCLAILIQEKTT

SEQ ID NO: 5931 - DNA, 417 bp, Unknown
  Obtained from environmental sample
  misc_feature (1)..(417): n is a, c, g, or t
ttggagcagtccctgatttcggcgcatctcaaaattttgcgtgatgcaaaattgctccataccaggagagaagggcaacaaattttttatagcgtaaactacaaacaaataaatcacctgtcgaagcttacaggtaaattgctgcagtcggcaccatcgcaacaaaatgttgatataaaactaccagagagaaaagcaaaggtttcatcttctccttcttccaggttcaccccagcagaacaaaaagtgattcgtttggtatgtcagcaatatacaagcgaagaaatggccgaagaactggggctaagcaaaagaactgtagaaggctacagggcaaacattcttgaaaaaatgaaagcaaaaaactcagtaggtattttgatctatgctgtaaagaatggtcttttcaaaatctaa

SEQ ID NO: 5932 - protein, 138 aa, Unknown
  Obtained from environmental sample
  DOMAIN (73)...(130): Bacterial regulatory proteins, luxR family
  misc_feature (1)..(138): Xaa is any amino acid
MEQSLISAHLKILRDAKLLHTRREGQQIFYSVNYKQINHLSKLTGKLLQSAPSQQNVDIKLPERKAKVSSSPSSRFTPAEQKVIRLVCQQYTSEEMAEELGLSKRTVEGYRANILEKMKAKNSVGILIYAVKNGLFKI

SEQ ID NO: 5933 - DNA, 822 bp, Unknown
  Obtained from environmental sample
  misc_feature (1)..(822): n is a, c, g, or t
gtgcgaaaaacgcttaagccaaatgaagtagctatcgaaatgatccgatatcgttattttgatcacactttcacggattcgatcatttatgctgggctattcttgagaaatgaatttaaatcacccaaatcgattattctgaatgacggacaaaaaatggagacgcggtatttcaaatactatcgtaactccatgcaaaatagaattgctgataatgtttcctacaatgttttttggggtcccattcaaaaagaaattggattagcctctactatatacttatcggctgatggtgtgtacaaccaaatcaatctcgaggcaattcccaccccagacggcaagtacattctcgataactccaatattgtgatggttagcaatacaaaagatttatacttacgaaaagtcaagtcaagtcaggcggctaataacacagcagctatgtttggaaaccctcaattttatttagcttctggacaaggtggcatatcatcattacctggtacagaaaaagaaattaaccagttagattttctattaaagcaaaaaggatggagcaccagcgaatatcttgaaaaaaaggcaaccgaagagcanattaaagaacttgataatcctaaaatttttcacgtggctacacacggcttctataaaccaagtacagtttcagcggcaaatgcagtggaggaaaatgaagcaaagctcactcaaaatcctttaatgcgaaccgggcttcttttaaaaagtgctggtgatttactggatnagactgagtttattacnacatgnaggatggtattctcactgcttatgaagccatga

SEQ ID NO: 5934 - protein, 273 aa, Unknown
  Obtained from environmental sample
  misc_feature (1)..(273): Xaa is any amino acid
MRKTLKPNEVAIEMIRYRYFDHTFTDSIIYAGLFLRNEFKSPKSIILNDGQKMETRYFKYYRNSMQNRIADNVSYNVFWGPIQKEIGLASTIYLSADGVYNQINLEAIPTPDGKYILDNSNIVMVSNTKDLYLRKVKSSQAANNTAAMFGNPQFYLASGQGGISSLPGTEKEINQLDFLLKQKGWSTSEYLEKKATEEXIKELDNPKIFHVATHGFYKPSTVSAANAVEENEAKLTQNPLMRTGLLLKSAGDLLDXTEFITTXRMVFSLLMKP

SEQ ID NO: 5935 - DNA, 711 bp, Unknown
  Obtained from environmental sample
  misc_feature (1)..(711): n is a, c, g, or t
ttggtggaagttatggccggttctgtcaatagtgtgtattatcgcatgggttgtgggttgggttgctctcaacaaaaatgcgaaaggaaaatgaaaacatacttcaagtacggggtaatactgacctgtttcattttactattcttcatgttaagacgttgcggtaatggcaacgcaggaggcaaagtaaccgttgatacgctaacccagattgatacagtatttaaagaagtagcatcagacagcgagtacataatctacccatacgaaacggtacgttggaaaacaaaagaggtattcaaaacagatactcttgaaatattcgattaccgggacgttgatagtgctaagatacttgcagctttcttttcagaaagaagatacttggatagtgtcaacgtagagtatggaaaggtttacataagagataccgtaactcaaaaccagatagtaggcagatcagtttcaacccggttgaatattccaaccattaccaaaacagtcactatcacaaagccaccacgcactactctttacttgggtactgatttaaacggcaacaaagaagcattaatctattcagtaggtgtaaatgcaggatttgtttttaagaatggaaagtattggggattgggatatggattaaccaaagatggaggtgatttatataatatccggttcatgctaccaataaggcttaaaaaaagataa

SEQ ID NO: 5936 - protein, 236 aa, Unknown
  Obtained from environmental sample
  misc_feature (1)..(236): Xaa is any amino acid
MVEVMAGSVNSVYYRMGCGLGCSQQKCERKMKTYFKYGVILTCFILLFFMLRRCGNGNAGGKVTVDTLTQIDTVFKEVASDSEYIIYPYETVRWKTKEVFKTDTLEIFDYRDVDSAKILAAFFSERRYLDSVNVEYGKVYIRDTVTQNQIVGRSVSTRLNIPTITKTVTITKPPRTTLYLGTDLNGNKEALIYSVGVNAGFVFKNGKYWGLGYGLTKDGGDLYNIRFMLPIRLKKR

SEQ ID NO: 5937 - DNA, 576 bp, Unknown
  Obtained from environmental sample
  misc_feature (1)..(576): n is a, c, g, or t
atgaaaaaaccattttatatttttttaatcggtactcttttaattctttcctgcaaaaatcaaaaaacaaaactacaaggcgaatcaagttttttccctgttctgtcctttattaaaagccaggtagcccatgtggacacatctgtatatcggattatgaaagttataaaaacagacagcatttccgataccacttatttaaaaagagaacagtttagagacgcggccaaagactttttatccataccagatataagttccgaggaattaaaagatgattatacagaaacgaaattatttatccaggatatcgaccaggttgcattaaactatatgcctaaaaaaccagataaagaaataaccaggcaagaagtaatgataaaacctggcactgatggagataaagttcaatcaatatttatcaatcgaattaacaatagtaaagagggatcgatacataagatattattttgggaagtagataaacaattcaaaattgtgaccttaactcaatttcccgatcaacctgaaaaaacacaaactatagaggtgatatggaataactttccatcttaa

SEQ ID NO: 5938 - protein, 191 aa, Unknown
  Obtained from environmental sample
  misc_feature (1)..(191): Xaa is any amino acid
MKKPFYIFLIGTLLILSCKNQKTKLQGESSFFPVLSFIKSQVAHVDTSVYRIMKVIKTDSISDTTYLKREQFRDAAKDFLSIPDISSEELKDDYTETKLFIQDIDQVALNYMPKKPDKEITRQEVMIKPGTDGDKVQSIFINRINNSKEGSIHKILFWEVDKQFKIVTLTQFPDQPEKTQTIEVIWNNFPS

SEQ ID NO: 5939 - DNA, 744 bp, Unknown
  Obtained from environmental sample
  misc_feature (1)..(744): n is a, c, g, or t
atgacgcagtcggaatttcaaaagatatcatcggggttacctgttcttcctggcatttataaatattatgatgcaggaagcatgctattatatgtaggtaaagcaaaaaatataaaaaaaagagttagctcatattttaataaaaccctggatagctataaaacgcatgaacttgtaaaacggatcaaccgcatagagtttaccattgttaattcagaacaggatgcttttttattggaaaattcactgataaaacagttccaacccatcttcaacattaatcttaaagacgacaaaacttatccttacctggttattaaaaatgagcccttcccaagaatatttttaacaaggcaaaaaactgaagatggttcacaatatattggcccttttacttccgtaaataaagtaagagaccttcttggttttattaaacaaactatacctcttcgcacttgtcccttaaatcttaccgaaaaaaatattgaaaaaggaaaattcaaagtttgcctggaatatcatttaggaaattgcaaaggtccttgcgaagcccaccagtctcttgaagactataatgaaaatatcaaccaggtaaaaaatattttaaaaggaaacctgggatcggtaattcagcattttaagaaagaaatgaagaaaaatgctgaggccatggagtttgaaaaagcagaactggcaagaaaaaaaatcacttatctagaaaatacccaggccagctcaatctga

SEQ ID NO: 5940 - protein, 247 aa, Unknown
  Obtained from environmental sample
  DOMAIN (16)...(98): GIY-YIG catalytic domain
  misc_feature (1)..(247): Xaa is any amino acid
MTQSEFQKISSGLPVLPGIYKYYDAGSMLLYVGKAKNIKKRVSSYFNKTLDSYKTHELVKRINRIEFTIVNSEQDAFLLENSLIKQFQPIFNINLKDDKTYPYLVIKNEPFPRIFLTRQKTEDGSQYIGPFTSVNKVRDLLGFIKQTIPLRTCPLNLTEKNIEKGKFKVCLEYHLGNCKGPCEAHQSLEDYNENINQVKNILKGNLGSVIQHFKKEMKKNAEAMEFEKAELARKKITYLENTQASSI

SEQ ID NO: 5941 - DNA, 912 bp, Unknown
  Obtained from environmental sample
  misc_feature (1)..(912): n is a, c, g, or t
ttgatggcagacttcgttcaccttcacaaccatagtgagtactcgctcttagacggtttatcaaaaatcgagctaatggtagagcaagcaaaaaaacttggcatgacttccctagccataacagaccatggaagcttgtatggcgcaattaaattttacaaagcttgcaaagaagcggggataaaaccaattattggttgtgagatatacgtttccaaaagaagtagacacgacaaggaggccggaattgattctgattcaaaccatcttattcttcttgcaaaaaacgaagagggatataaaaacctaatgagaataatctcagttgcaaacctagaaggctactactacaaaccaagatcagacatggaacttttaaagcaacactcagagggcctaatttgtctatcggcctgcattaacgggtatgtttcagaaccacttttgcaaaaccaacaagaaactgcagaaaaaagagcactggaactatccgaaatctttggagagggaaacttctatttagaattacaaaaacatctaaacgttaaggatcaggacgaactgaatgaaaaactactcaagctttctgaaaaattaggcattccaatcgttgcaacaaatgacaaccattacacaaaanaagacgacgcagaggctcaggaaattcttctttgtattcaaactcaaactacaataactactcccaacagaaggctttcgatgattgactctcccgacttttacatgaagtcacctgatgagatggcaaatcttttcgcagaccaccggaaggcactgggaaataccgttaaagatgctaataaatgtgacttaaagatatctcttggcaaatggattatgccagtgtttgacgttccggaagatactacacgcggagtactccagaaatag

SEQ ID NO: 5942 - protein, 303 aa, Unknown
  Obtained from environmental sample
  DOMAIN (86)...(218): PHP domain C-terminal region
  misc_feature (1)..(303): Xaa is any amino acid
MMADFVHLHNHSEYSLLDGLSKIELMVEQAKKLGMTSLAITDHGSLYGAIKFYKACKEAGIKPIIGCEIYVSKRSRHDKEAGIDSDSNHLILLAKNEEGYKNLMRIISVANLEGYYYKPRSDMELLKQHSEGLICLSACINGYVSEPLLQNQQETAEKRALELSEIFGEGNFYLELQKHLNVKDQDELNEKLLKLSEKLGIPIVATNDNHYTKXDDAEAQEILLCIQTQTTITTPNRRLSMIDSPDFYMKSPDEMANLFADHRKALGNTVKDANKCDLKISLGKWIMPVFDVPEDTTRGVLQK

SEQ ID NO: 5943 - DNA, 417 bp, Unknown
  Obtained from environmental sample
  misc_feature (1)..(417): n is a, c, g, or t
atgactacaaacacgatactattattactactttctttagtaatagctggtggattgtcgtattttcaatatttttataaagccaaaaaccattcgaatgtgaatgtgtttttggcttttttgcgttttttaatcattttcggattattggttttactgattaatcctgtaatgactaagaattcgcttgaagttaccaaaacgccttttgcaattgcagtagataattcaagttcaattgtagcattgaaatctgataagagggtgactgaattatatcaaaaactgatttcaaatccggctcttcaggataagtttgaaattcaatcctatcagtttgatgccgattttaaaccttctgagagatttgattttaaaggaaacaaaccaatctggatgaaagttgcaagaatctaa

SEQ ID NO: 5944 - protein, 138 aa, Unknown
  Obtained from environmental sample
  SIGNAL (1)...(16)
  misc_feature (1)..(138): Xaa is any amino acid
MTTNTILLLLLSLVIAGGLSYFQYFYKAKNHSNVNVFLAFLRFLIIFGLLVLLINPVMTKNSLEVTKTPFAIAVDNSSSIVALKSDKRVTELYQKLISNPALQDKFEIQSYQFDADFKPSERFDFKGNKPIWMKVARI

SEQ ID NO: 5945 - DNA, 894 bp, Unknown
  Obtained from environmental sample
  misc_feature (1)..(894): n is a, c, g, or t
ttgaagtttttcctgcaatatgccgggactaaagcggtaaacgcagattttacaatttcgcagggaaattctgtgntagcaagagaaaaagtttctttttctctttctaaaaaaacagcgtccttaaatatattgttgcctgctgataaagttgggctgcaaattttcagggcaaatgtttcttctggcgtaaaagagaaaaacagttacaacaatatcaagaactttgcagttgaaataatcgatcaaaagtcaactattgcaatcgtatcgactataaatcatccggatattggagctttgaagcgttcaatcgaaacgaatgcacagcgcaaagtgattctggcaagacctaatgaaatagacaaattaaatgatgtttcggttttagtgttgtatcagccgaatagtgcttttaagcctatttttgataacaataaattggccggtacaaatagttttatcattacaggaaacaataccgattttaattttctaaaccaaaaacagaataatctggtttttaaaatgagtggtcagagagaagattatttaagcgaatttcagtcgcagtttaatttgtttgctattgaaaatattggttttgaaaattttcctccgcttcaaaatctcttcggaaatatcacagttaacggaaatgtatcggttttactttcgtcaaaaatcagaaacgtttctacaaacgcacctttattagctttcgctgaaaatcaaaacaaacgtaccgcttttctcttaggagaaaatagctggaaatggcgtctgcaaagtcatatcgacaatcagtcattcgaaaaatatgatgtttttgtagataagatcattcagtttttagcaacctcagcttcaaaaaaatcatggtcgtacaaatga

SEQ ID NO: 5946 - protein, 297 aa, Unknown
  Obtained from environmental sample
  misc_feature (1)..(297): Xaa is any amino acid
MKFFLQYAGTKAVNADFTISQGNSVXAREKVSFSLSKKTASLNILLPADKVGLQIFRANVSSGVKEKNSYNNIKNFAVEIIDQKSTIAIVSTINHPDIGALKRSIETNAQRKVILARPNEIDKLNDVSVLVLYQPNSAFKPIFDNNKLAGTNSFIITGNNTDFNFLNQKQNNLVFKMSGQREDYLSEFQSQFNLFAIENIGFENFPPLQNLFGNITVNGNVSVLLSSKIRNVSTNAPLLAFAENQNKRTAFLLGENSWKWRLQSHIDNQSFEKYDVFVDKIIQFLATSASKKSWSYK

SEQ ID NO: 5947 - DNA, 564 bp, Unknown
  Obtained from environmental sample
  misc_feature (1)..(564): n is a, c, g, or t
ttgggtttgatgggaattagtcttaagattttcacttacggtaatcntgagtattcatattatagtggtaaaggtgttttatgggtattgnatttattaatccaatggttcgatgatattacattcgttcattttctttatgaaaactcaaaaaaatataatgaggataattatcacaacagtggcttacttaagaataaatggtctgagtatattgaattaatgaatggtatgataaaaaggaagccaaatgaaagtgctcattatgaagtaaataaattaaacacatattggatggagcttcattttttttatagacatgtttctaaagtttttataaatgaagaattaattagccactatattaaccatttcaaagaaatctccttaagaatagagcaaggtttttcaaccaatccaaataggattttgtcaaatgggcttatgtggactatacacgatttttatgaacaacgagaaaatccccaaaaagcaaatgaaatcgccaaactaaataatacttatttaaatgtttggagagagattcctgagaaagaaaaatag

SEQ ID NO: 5948 - protein, 187 aa, Unknown
  Obtained from environmental sample
  misc_feature (1)..(187): Xaa is any amino acid
MGLMGISLKIFTYGNXEYSYYSGKGVLWVLXLLIQWFDDITFVHFLYENSKKYNEDNYHNSGLLKNKWSEYIELMNGMIKRKPNESAHYEVNKLNTYWMELHFFYRHVSKVFINEELISHYINHFKEISLRIEQGFSTNPNRILSNGLMWTIHDFYEQRENPQKANEIAKLNNTYLNVWREIPEKEK

SEQ ID NO: 5949 - DNA, 777 bp, Unknown
  Obtained from environmental sample
  misc_feature (1)..(777): n is a, c, g, or t
gtgcataaaactatcttctattacaataaaaaggagttaatagaagagaaatctgaagcaaaagaaattcccatggagcactataatctttggattgatattgtagatccatcaaatgaggatatctcaaccctgcaaaaagagttatcaataaatagcaaggcattagataaaattaaacaaaaatccaaaaaaccagttgtaaaagaaatagacaagaatacaaagttcattattttacttgatttgaaatttaacgatttacagcatcttgaaactaccccattatatttttatgttggtgagaaacggctagtgactatacattcaagtaagatagatctggtggctaaagtaaaaacaattcttgcagacagaaaaactattttagaatcttcagttgatgccctctattatagtataatttctggctttatggaagattacgaacagcttttgactgcaatagaattaaaagtttttgatatcgaaaaagatgctcagtatagaccttctagacgagtgttaaattatttggatgacttatctaaacaggtcattactcttcgtcggcatttttgggatgccagaaatgttgtaaattatcatgtcaacatggaaaaagataaggatgatatcaaatatttacagatagtatacaataatatcaatcagctcatagaaatgattcagtcctatcaggacacaattaactctacaagagaactattttcgagcagtatatcattacaaataaacgagactatgcgagtttga

SEQ ID NO: 5950 - protein, 258 aa, Unknown
  Obtained from environmental sample
  misc_feature (1)..(258): Xaa is any amino acid
MHKTIFYYNKKELIEEKSEAKEIPMEHYNLWIDIVDPSNEDISTLQKELSINSKALDKIKQKSKKPVVKEIDKNTKFIILLDLKFNDLQHLETTPLYFYVGEKRLVTIHSSKIDLVAKVKTILADRKTILESSVDALYYSIISGFMEDYEQLLTAIELKVFDIEKDAQYRPSRRVLNYLDDLSKQVITLRRHFWDARNVVNYHVNMEKDKDDIKYLQIVYNNINQLIEMIQSYQDTINSTRELFSSSISLQINETMRV

SEQ ID NO: 5951 - DNA, 531 bp, Unknown
  Obtained from environmental sample
  misc_feature (1)..(531): n is a, c, g, or t
atgaaattgaaaaaaggaattattttaattatcgcgtttcttggattcggcttgagcaacatcaatgcacagtctaaatttggatatgtaaatgctacagagcttttatatctgatgccggaaatgaaaaccgtgaatcacgttttagactcatttcaattaaccttggataaagagtataaggcattggtggatgactttaaccaagccgtgcaacagtgtgaaaaaactgaagccggccccctcagacaattatgtgaagaagaacttgccaaaaaacaggaaatcctttacaaggctcaggaaacatttaaaagtgagatcatggaaaaacaaaacaagttgatccagcctttaaatgacaagatccttaaatctattaaagaagtggccattgaaaaaggattacactatgtttttgacattagtatgggggtccttcttaactgggatgaaaaagacaacattgataaagatgtaagaaaaaaattaggtattgctgaagatgcaaaacttgacggtacaaaataa

SEQ ID NO: 5952 - protein, 176 aa, Unknown
  Obtained from environmental sample
  SIGNAL (1)...(20)
  DOMAIN (1)...(165): Outer membrane protein (OmpH-like)
  misc_feature (1)..(176): Xaa is any amino acid
MKLKKGIILIIAFLGFGLSNINAQSKFGYVNATELLYLMPEMKTVNHVLDSFQLTLDKEYKALVDDFNQAVQQCEKTEAGPLRQLCEEELAKKQEILYKAQETFKSEIMEKQNKLIQPLNDKILKSIKEVAIEKGLHYVFDISMGVLLNWDEKDNIDKDVRKKLGIAEDAKLDGTK

SEQ ID NO: 5953 - DNA, 459 bp, Unknown
  Obtained from environmental sample
  misc_feature (1)..(459): n is a, c, g, or t
ttgatgccgaagttaaaactactgcttttaggatgcttgttaatactgttgaagaatgctgaggggcaatcttacgccgtgcagtatgttataaaggatgccgattcttctttaaaaaataatattggattaaaagaaaaatttaactcccaatctgaagccaggtattttatcacaactattccaacgctgttacaaaccaaaggatatattacgggatcagttgatagcagtcaaatagattctttaggtgcttccgtgcatttatttttaggcctgcaatataaatgggcaaagatcaatacagagtctaaggacgaagacatactcgcggctgttcgttggccaaaggcctcattcagaaattccggaatggattggaaccaagtaaaaaactggcaggagcaaatattgacgtacctggaaaatagcgggtacccgttgcaaagatgttcttga

SEQ ID NO: 5954 - protein, 152 aa, Unknown
  Obtained from environmental sample
  SIGNAL (1)...(20)
  misc_feature (1)..(152): Xaa is any amino acid
MMPKLKLLLLGCLLILLKNAEGQSYAVQYVIKDADSSLKNNIGLKEKFNSQSEARYFITTIPTLLQTKGYITGSVDSSQIDSLGASVHLFLGLQYKWAKINTESKDEDILAAVRWPKASFRNSGMDWNQVKNWQEQILTYLENSGYPLQRCS

SEQ ID NO: 5955 - DNA, 642 bp, Unknown
  Obtained from environmental sample
  misc_feature (1)..(642): n is a, c, g, or t
ttgacaattaatagtttttatcagctattacccgatattattatgtacttgtataaccagtatgtttttaaagaaatgaattttggtatgaaatttacatttgtctttctttttgcttcatcacttttgttttttacttgcttacttatttttgataatatcacagtatctgctcaacaggaaaataaaacaacaacaaccataaatgcggatgataaattcggtattgaaaaaatatatcctaccaaatccaatggcagggaatggtatgttaacatgtcgaaccccaaaaatgatccaaatgtaacttttacctttaaccctagattagccaaacaggatgatggatcttggaaaataaaggatgacaaaattcgaattaatgtagacacattaaatgggacagaagaatggaaaaatgttgaaattactggatatgtaaaaattgactcgataatcaacccgcgtaaaagtgttattacagatattgactgggtagcaagaactgatcaacataatgaagactttccgtgtcacggcttgtcccttcatgggggcatttatcctgatggttctgcagcatggaaaaaagaaatttggtttaccggaggatatactaaaagaaaatcagttcctaaataa

SEQ ID NO: 5956 - protein, 213 aa, Unknown
  Obtained from environmental sample
  misc_feature (1)..(213): Xaa is any amino acid
MTINSFYQLLPDIIMYLYNQYVFKEMNFGMKFTFVFLFASSLLFFTCLLIFDNITVSAQQENKTTTTINADDKFGIEKIYPTKSNGREWYVNMSNPKNDPNVTFTFNPRLAKQDDGSWKIKDDKIRINVDTLNGTEEWKNVEITGYVKIDSIINPRKSVITDIDWVARTDQHNEDFPCHGLSLHGGIYPDGSAAWKKEIWFTGGYTKRKSVPK

SEQ ID NO: 5957 - DNA, 702 bp, Unknown
  Obtained from environmental sample
  misc_feature (1)..(702): n is a, c, g, or t
gtgagaattgaggaaaaagctaaaattattgaaaatattcaaggagacatttcttatatgacagaagtaattgaaataagaacaaagaaaataatcagcttaagaacttcagaagggaaacttaaagaaaaagagtatttgttaaaacatgttctatttctactaggagaaatagatggctttatttctactgatatcgttgaaggaagattatctgatgttttaatgaaaagtactaacttttatctaataccatttacagaaggtagatatgaaatcgctaatatatcatcaacgatgagaaaaataaaagatagagtatctcacggtctaactttgactttggtagataataaagatcacataacaaagaataaagaacagctaagcggaggcgatgaatcagctcttggtcttgcactcaggatttctatatcaaagcttatgtcgactatcagacctttcaaacatgtagaaaaaaaagtacctatgataaattttattataatggatgaacccatgaccagccttgacgaatttcgtagaaatgtaataatgaatattttaatgaaagatcagagctttagacagatctttcttatatctcatgctgaaataaatgaagaagaagaaaataattatcattctatagtaattaatgatgatgaaaattctaaaagaatggtagaatacttccattaa

SEQ ID NO: 5958 - protein, 233 aa, Unknown
  Obtained from environmental sample
  misc_feature (1)..(233): Xaa is any amino acid
MRIEEKAKIIENIQGDISYMTEVIEIRTKKIISLRTSEGKLKEKEYLLKHVLFLLGEIDGFISTDIVEGRLSDVLMKSTNFYLIPFTEGRYEIANISSTMRKIKDRVSHGLTLTLVDNKDHITKNKEQLSGGDESALGLALRISISKLMSTIRPFKHVEKKVPMINFIIMDEPMTSLDEFRRNVIMNILMKDQSFRQIFLISHAEINEEEENNYHSIVINDDENSKRMVEYFH

SEQ ID NO: 5959 - DNA, 912 bp, Unknown
  Obtained from environmental sample
  misc_feature (1)..(912): n is a, c, g, or t
atgagtatagaaaagaagtcatttccggaatcgcaacatgatttagtgaaatcttctgcattgctatttaaaaaagaaaaaaatgaagataaatttattcagctttgtagaggcccaaatatagttaatcaagaaattgaatcacttttgggagtatatccagaggtaattgaaaaaactgtatatattagacaaaaagaagtagataaacttgcactagcagatccaagtgaattaagggaactaatcaagaatttgtttggattaaatgatttcgacgatcatataaaaaaatacttaaagaatcaaattaataatattaatgaagaaatcaaagatttaaaaatacaaattggaagtttattaacagaacaaaatgaattggaaaaggagaaacaaattttagaagaaaaagaagaaaaactttcactaaaattacaggaaataaaaaaagataaaagtactttaatgagttatccatctcaagagatattacataaaattaaggtaataatagaaaaaatagagaaacataaaaaggacttagattacagagaaaaaatgtataattataaaaaagaaaatatattagtacaagaaaatcgtataaaagattttcaagataaaatatttctcttaaattcaaaaatttcaaacctttcaaaagaactacaagaatttccaccaaaagatagtataagaaaaataagtgatatattaaaaggaataataaatgatgaacaacaaataagaaatttggtatcaaaatcaaatcaaaaattaaatatagatattcaaaatatatcgataaataatgtagaagaacttaaaaaagtaaagaaaaaaatcaaattgaatttagaaagactgacaaagaaagatttcaatattaaatataatggaggaacataa

SEQ ID NO: 5960 - protein, 303 aa, Unknown
  Obtained from environmental sample
  misc_feature (1)..(303): Xaa is any amino acid
MSIEKKSFPESQHDLVKSSALLFKKEKNEDKFIQLCRGPNIVNQEIESLLGVYPEVIEKTVYIRQKEVDKLALADPSELRELIKNLFGLNDFDDHIKKYLKNQINNINEEIKDLKIQIGSLLTEQNELEKEKQILEEKEEKLSLKLQEIKKDKSTLMSYPSQEILHKIKVIIEKIEKHKKDLDYREKMYNYKKENILVQENRIKDFQDKIFLLNSKISNLSKELQEFPPKDSIRKISDILKGIINDEQQIRNLVSKSNQKLNIDIQNISINNVEELKKVKKKIKLNLERLTKKDFNIKYNGGT

SEQ ID NO: 5961 - DNA, 654 bp, Unknown
  Obtained from environmental sample
  misc_feature (1)..(654): n is a, c, g, or t
gtgggagcagttacaacaatctacaatgattgtactggtagccactttggttattaccgggatcgtagctttaatggatcttggagtaaacggtgttttaaaatttatatattctttattcaaataaaaatggacgaaacaaccaacatagaatcaactggtaaaatagatgacgatttttctgaaagtaaatcttcagaagaaaaggatacagttattgataatgcaggtctggaaaatgatcaggcagaaccagtaaaccaggaggaggccggcaataaagaatcattacctgaaaaggaaacaaagtggtatgtgctgcgggtggtaagtggcaaggaacgtaaaacgaaagaatatctcgacaaggatgttattcgtaatggatgggataaaattatcaaacaggtctttttgcccgtagagaaagtatataaagtgcttaatggaaagaaagtaatgcgggaaagaaatttttatccgggctatatcatgatcgaagtagcagatggaaagttatctgatgaaattattcagcatcttagtaacgtcagcaacgtaatgcattttttaactgatgggcagggctcaaaaaggcatatcatttctttacgcaaaacagaggtaaataaaatgctttggcaaggtggatga

SEQ ID NO: 5962 - protein, 217 aa, Unknown
  Obtained from environmental sample
  DOMAIN (101)...(144): Transcription termination factor nusG
  misc_feature (1)..(217): Xaa is any amino acid
MGAVTTIYNDCTGSHFGYYRDRSFNGSWSKRCFKIYIFFIQIKMDETTNIESTGKIDDDFSESKSSEEKDTVIDNAGLENDQAEPVNQEEAGNKESLPEKETKWYVLRVVSGKERKTKEYLDKDVIRNGWDKIIKQVFLPVEKVYKVLNGKKVMRERNFYPGYIMIEVADGKLSDEIIQHLSNVSNVMHFLTDGQGSKRHIISLRKTEVNKMLWQGG

SEQ ID NO: 5963 - DNA, 975 bp, Unknown
  Obtained from environmental sample
  misc_feature (1)..(975): n is a, c, g, or t
gtgactttttacagccacaaagacatcgaaaagctggagaaattcatgaagggcaacccggtcgccgaacaggaaatcggaagacagttattacttgaaacagtaggttatgccgaaacaacggnttgtcgccgtcgtgtactgctgaattatttcggtgaaaaatatgatcaggataattgcggaagctgcgacaattgtctgcatccgaaaccattgattgaagtgcaggatgaacttgcattgcttcttgaaactgttgtcgctgtaaaagaaaaacatcagggtgaacatgttgtaaatgtactcacgggtattgccgatcagcaggttaaaaattacaagcacgataaactggatgtatatgcggaaggacaggataaaaatgcacgattctggacagcattaatccgtcaggcattacttgcaggttatcttacaaaggatattgacaattacggattgctgaagatgagtccggaaggtctggctttcatcaggaatccggaaccattcaaaatttcgcttgatgcggattttgataataccgaaagtgatgatgatgatgatttcggggcaggtggtggtggcgcggccgatgagcaattgtttgcaatgcttaaggaccttcgtaagacatacgccaaacaaaagaacctgccgcctttcgttatcttccaggatccgtctctcgaagagatggctaccaattacccgatcacacttgatgaattaaagaacatcaccggtgttggttcaggtaaagcgatgaaatacggtcagccatttatcgcgctgattaaaaaatacgttgaggataatgatatcgaacgcgctgttgacctcgttgtaaaaagcgttgtgaacaaaagtggactgaaagtttatatcattcagaatatcgaccgtaaaatttcacttgaagatatttctgaagcgaaaggtatatcgataaagaacgatgagaataaataa

SEQ ID NO: 5964 - protein, 324 aa, Unknown
  Obtained from environmental sample
  DOMAIN (197)...(275): HRDC domain
  misc_feature (1)..(324): Xaa is any amino acid
MTFYSHKDIEKLEKFMKGNPVAEQEIGRQLLLETVGYAETTXCRRRVLLNYFGEKYDQDNCGSCDNCLHPKPLIEVQDELALLLETVVAVKEKHQGEHVVNVLTGIADQQVKNYKHDKLDVYAEGQDKNARFWTALIRQALLAGYLTKDIDNYGLLKMSPEGLAFIRNPEPFKISLDADFDNTESDDDDDFGAGGGGAADEQLFAMLKDLRKTYAKQKNLPPFVIFQDPSLEEMATNYPITLDELKNITGVGSGKAMKYGQPFIALIKKYVEDNDIERAVDLVVKSVVNKSGLKVYIIQNIDRKISLEDISEAKGISIKNDENK

SEQ ID NO: 5965 - DNA, 558 bp, Unknown
  Obtained from environmental sample
  misc_feature (1)..(558): n is a, c, g, or t
gtgaagctgcatctcaacataaataactgtatgcaatcttttctgatcctgattataatttcgctcatttcctgtaataaccctttaaaggaaacagcaaatattcaacccgattcaaattcgcaagcagattttacgattgacagtattttagcagacaccccaaagattttaaaggcagggaaagattatgtaactattgcaacatcgccatacgataaaatttattttggtgaaaggttttcaccctataagatcgaaccatatcatattgctgatcttgagcaggtaattgattcgttgattaaaaaagaaaacttaaccggtaattttagaaacaaatcacttatcgattataagtatcaaattttttcagctaaaacagcagaaaagaaattacaagccagagttcaagccatttgtattgcagaggctgataaaaagaaatggaattcatcaagcattttagttgatgatgtaggcgaatgttattttagcctcatttatgatttaactgataaaaaagtcatagcatttcaaattaatagcaacgagtaa

SEQ ID NO: 5966 - protein, 185 aa, Unknown
  Obtained from environmental sample
  misc_feature (1)..(185): Xaa is any amino acid
MKLHLNINNCMQSFLILIIISLISCNNPLKETANIQPDSNSQADFTIDSILADTPKILKAGKDYVTIATSPYDKIYFGERFSPYKIEPYHIADLEQVIDSLIKKENLTGNFRNKSLIDYKYQIFSAKTAEKKLQARVQAICIAEADKKKWNSSSILVDDVGECYFSLIYDLTDKKVIAFQINSNE

SEQ ID NO: 5967 - DNA, 561 bp, Unknown
  Obtained from environmental sample
  misc_feature (1)..(561): n is a, c, g, or t
ttggcaaagctattaccatatgaaagttacagtttagcgtcgcctctgtcaacagatcagataatcttgaagcttttgcacaatacattgactgcacaagagtatgtgagcgaatctgataaacgaatcttctcctttggtttgaaggcatggtcaaaaccttactggggatacattagaaatgatagtttcgaactacaacgtctcattaactatcgaaaccttggaaatcccaaaataagcggagtattaaaacctctgacaagcggtacggcaatacagattaagatgagacctggatgggccactacagtgtttataggctttgctttgttgatttgtttgtatgcactcggtttttcagtcgttcaatcaatcaaaacaaatcagatacataacggggtaatagtatcgagtggcatgctggttttcttatacttacttttattagtaccttttaaagcagaagcattaaaatctaaacagctcttatcaggtttgtttgataaagctcatgattcaatgatgaatactgctaacagaagtaaacaaaatgtttag

SEQ ID NO: 5968 - protein, 186 aa, Unknown
  Obtained from environmental sample
  misc_feature (1)..(186): Xaa is any amino acid
MAKLLPYESYSLASPLSTDQIILKLLHNTLTAQEYVSESDKRIFSFGLKAWSKPYWGYIRNDSFELQRLINYRNLGNPKISGVLKPLTSGTAIQIKMRPGWATTVFIGFALLICLYALGFSVVQSIKTNQIHNGVIVSSGMLVFLYLLLLVPFKAEALKSKQLLSGLFDKAHDSMMNTANRSKQNV

SEQ ID NO: 5969 - DNA, 519 bp, Unknown
  Obtained from environmental sample
  misc_feature (1)..(519): n is a, c, g, or t
ttgctttctgctaatcgattctcccataaacatagttttgaaccccatgatgatcctattattatatttgcagataaaataaagatttttgaagttctctcaaacctgctaaataacgcgatcaaattttcaaatggcgaatccatcactgtttcaaccacagagagtcaaaatgataggagtatagcaaaccatgtcaatttcaaaaatcccaaagatggaaaaagcaatatcgagaagatacaagacaatgaattagtaatagtatcaattagagataaaggaaaaggtattgacgaagaaattttacctcgactattcaataagtttgttacaaaatcaaaccaaggtacaggattaggactgtatatagcaaagagtattgttgaagcacatggaggccaaatttgggctcacaataacaagaataaaaatgggcaatcttctcttttagcttaccattacacacctaatacagttattcaaatccatcttcatagggcgactaactccttatga

SEQ ID NO: 5970 - protein, 172 aa, Unknown
  Obtained from environmental sample
  DOMAIN (24)...(168): Histidine kinase-, DNA gyrase B-, and HSP90-like ATPase
  misc_feature (1)..(172): Xaa is any amino acid
MLSANRFSHKHSFEPHDDPIIIFADKIKIFEVLSNLLNNAIKFSNGESITVSTTESQNDRSIANHVNFKNPKDGKSNIEKIQDNELVIVSIRDKGKGIDEEILPRLFNKFVTKSNQGTGLGLYIAKSIVEAHGGQIWAHNNKNKNGQSSLLAYHYTPNTVIQIHLHRATNSL

SEQ ID NO: 5971 - DNA, 759 bp, Unknown
  Obtained from environmental sample
  misc_feature (1)..(759): n is a, c, g, or t
gtgattttgattgataatcattcggcagacgcgagtgtggaaacaatcagacgaaaatttcctcaagttattttgattgaaaataaagataatcttggatttggcaaggcaaataatcaaggaatgaaaatagcgcaggggcaatatatttttctcctcaatagtgacacggtcgttctggatcatgcggtcaataccttggtggagtatctcgataaacatccagaagttgcctgtgttggaccgaagctcctcaatggcgatatgacatttcagcacgcatgtcgaaggaatttgccaaatcctgttaacgcttttttccatctctttgggcttgtaaaaatattcaagcgaagtaggcgtataactgcctacaaaagattcagtgataatccggatataaccgaaccagtcgaagcactctccggcgctgccatgatgtttcgaaaagaagtgtttgaaaaaaccggcggcttcgacgaaaagttttttttctatggcgaagatttggatctgtgcaaacgaatacaggatatgggtgaaaaaatcgtatatgtgagtgaggcgcgcattatccattttggagggggaagcagtaaaaaaagaaaagtaaaatccttggtaaatttttatgatgcaatgtggatatattatcaaaaacatttccacaagaatttcttgttcgattttttgatttttttaggcatcaaaataaaattatacctatccttaataaaaaatttctttaaacatatctaa

SEQ ID NO: 5972 - protein, 252 aa, Unknown
  Obtained from environmental sample
  misc_feature (1)..(252): Xaa is any amino acid
MILIDNHSADASVETIRRKFPQVILIENKDNLGFGKANNQGMKIAQGQYIFLLNSDTVVLDHAVNTLVEYLDKHPEVACVGPKLLNGDMTFQHACRRNLPNPVNAFFHLFGLVKIFKRSRRITAYKRFSDNPDITEPVEALSGAAMMFRKEVFEKTGGFDEKFFFYGEDLDLCKRIQDMGEKIVYVSEARIIHFGGGSSKKRKVKSLVNFYDAMWIYYQKHFHKNFLFDFLIFLGIKIKLYLSLIKNFFKHI

SEQ ID NO: 5973 - DNA, 684 bp, Unknown
  Obtained from environmental sample
  misc_feature (1)..(684): n is a, c, g, or t
atgcaaacagaacaaaaaacatccggtaaaaaaccagattatattcgtaaagcagcccgcatcctgatgaaggtgatcctttttttgatgctctttgttgttgttctttttctttttgctttaacccctcccgctcaaaaaatagctactaacaaagtagaaaactatcttcagaaaaagctcaaaacaaaagttgagatcggcagcattagcgtaggcctgggcggatggataaatttaaaagacgtttacgtagaagaccagacaaaagatacacttattgccggtggtaatatccaggctcacattacgcttagaaaacttcttaccaacgaagtggaagtaaaagagatcacactcgatcatataaccgcaaaaattaaaagaattttaccggatacggttttcaatttcaaatttgttgcagatgcatttataacagaccaaaataaaaataaggatactgctgaaaccgctcctttaaaactggatgtgtacaacctggttgtaaacaacagccgctttttatatgatgatgtaattacaggcaacaccatgtttttaaaagttggtaatctttctgcccgcattgatacgctcaatccctacgaatctcattttgtgatacctgctggttacttcacagatgtaaacatgcgctttaatcaaccaccccgctggtaa

SEQ ID NO: 5974 - protein, 227 aa, Unknown
  Obtained from environmental sample
  misc_feature (1)..(227): Xaa is any amino acid
MQTEQKTSGKKPDYIRKAARILMKVILFLMLFVVVLFLFALTPPAQKIATNKVENYLQKKLKTKVEIGSISVGLGGWINLKDVYVEDQTKDTLIAGGNIQAHITLRKLLTNEVEVKEITLDHITAKIKRILPDTVFNFKFVADAFITDQNKNKDTAETAPLKLDVYNLVVNNSRFLYDDVITGNTMFLKVGNLSARIDTLNPYESHFVIPAGYFTDVNMRFNQPPRW

SEQ ID NO: 5975 - DNA, 522 bp, Unknown
  Obtained from environmental sample
  misc_feature (1)..(522): n is a, c, g, or t
atgaaaattgcactatttacagatgggatttttccttatgttatcggtgggatgcagaaacattccttcaacctggcaaaatattttgccaggaacaaagtgtacataaatctgtatcataccaatcaaagtggatatgatatttcccggctggagttcttttctgaagaagaaaaaaaatatataagatcgtttgttgttgattttccgtctctaggaaatttccccggacattacatcagggaatcttttgaatattccaatcggattttcaaacttttttcaaaaaatgctgatgtagattttatttatgcgaaagggtttacagcctggaagctcttggatganaggcgtaagggatataaatgtgcccctgttggtgttaatttccatggctatgagatgttccagaagcctgctttccctagatccaggatagaacagttattattacgtaaacctgtaatatttagtattgcaaatgctgattacgtattttcatacnggagggggtatcactga

SEQ ID NO: 5976 - protein, 173 aa, Unknown
  Obtained from environmental sample
  misc_feature (1)..(173): Xaa is any amino acid
MKIALFTDGIFPYVIGGMQKHSFNLAKYFARNKVYINLYHTNQSGYDISRLEFFSEEEKKYIRSFVVDFPSLGNFPGHYIRESFEYSNRIFKLFSKNADVDFIYAKGFTAWKLLDXRRKGYKCAPVGVNFHGYEMFQKPAFPRSRIEQLLLRKPVIFSIANADYVFSYXRGYH

SEQ ID NO: 5977 - DNA, 552 bp, Unknown
  Obtained from environmental sample
  misc_feature (1)..(552): n is a, c, g, or t
ttgcccggtttctccggaaatattattctgatgatgctgaaaganccttgctttaggaatcaaccctgggcggtatggggcgggcattacaggcatcaatttactgcaccaaaacaacttgaggaatattgcacaattaaaagtcctttttccggcactgagctttcagccgaattcatatatacgatgatcgaagcttatggtggaactaaaaaattttacaggaatttttttattggttctgtttgccctttaggctttgtgcaaaatggaaaaaatctaaattattatgacaacaaggagcttttgaaaacaatagaaccttttattgttgaaaatcttacaaagctggtttcttataaggtaaacaaagaaaaatgcatttgtatcggcggagaaaaaaactttgcttgcctgttttcacttaatcaaaaatatcagtggtttaaaaacattgtatcagtgcctcacccaagatttatcatgcagtataaaagaaagtatatccaggattttattaatctttatttggacgtgttaaaaagaaaataa

SEQ ID NO: 5978 - protein, 183 aa, Unknown
  Obtained from environmental sample
  misc_feature (1)..(183): Xaa is any amino acid
MPGFSGNIILMMLKXPCFRNQPWAVWGGHYRHQFTAPKQLEEYCTIKSPFSGTELSAEFIYTMIEAYGGTKKFYRNFFIGSVCPLGFVQNGKNLNYYDNKELLKTIEPFIVENLTKLVSYKVNKEKCICIGGEKNFACLFSLNQKYQWFKNIVSVPHPRFIMQYKRKYIQDFINLYLDVLKRK

SEQ ID NO: 5979 - DNA, 567 bp, Unknown
  Obtained from environmental sample
  misc_feature (1)..(567): n is a, c, g, or t
ttgagtagttggaagctgataaatatgagttcccttatagacctgatttttttctctgaaaaaagaaaaaatcttctcgttcagttagataatggaccgatggatattgacgagattaaagagactcttaacgtgaaagcctgtgctataatgcctcagattaaaaaactgaaagatatggatttaatagagcagagagaagatatctaccaactttcggatattggagcagtgattgttgagaaaatgatccctcttacatctcttattaatgtttttgacgggaacaaagattactggtcaaaacatgataggtctcctattcccacaaacctgattaaaaaaattgacatgctaggaagatgccacctggatgagcccgatctagaccatcttttcgagtttccagagtttttgcgtgacagactaagcagctcaaaaattataaaatctttttactcctatttctgtcctgactgcccgtcgatccaggctgcctgtgcgaaaaatggggctgaagtgcacttgatcctcgacgaaagggtctacaaaagatttgaaaaatga

SEQ ID NO: 5980 - protein, 188 aa, Unknown
  Obtained from environmental sample
  misc_feature (1)..(188): Xaa is any amino acid
MSSWKLINMSSLIDLIFFSEKRKNLLVQLDNGPMDIDEIKETLNVKACAIMPQIKKLKDMDLIEQREDIYQLSDIGAVIVEKMIPLTSLINVFDGNKDYWSKHDRSPIPTNLIKKIDMLGRCHLDEPDLDHLFEFPEFLRDRLSSSKIIKSFYSYFCPDCPSIQAACAKNGAEVHLILDERVYKRFEK

SEQ ID NO: 5981 - DNA, 807 bp, Unknown
  Obtained from environmental sample
  misc_feature (1)..(807): n is a, c, g, or t
atgtcgctcgtgcaggacgtttctgagcgaaaagaaaatgaggaaaagttgaagcaaagtgaatcaaggtttaaagaagcccaaaaaatggcgcatgttggaaactgggaacttaatttttcaaccggtattcttacctggtcgcaggaggcacgccgcatttatggattatcgttagacaacaacaatgaatcatatcagtcgtggatttcaatgatccacccggcagacgttggttatgtaaaacgtatcactgccgaggcagaggcaaccataagcaatgcggctttctttcatcgcattgttcgcagggatggtagcataagacatctctattctaaatcgcaatttcaatttaacagtgatggaaagcctgtcggcttgtatggtgtggctcacgatgtaacagagatgaaagaagccgaagaggctttaaagcaaagtgaatttcgttaccggcagattgtagaaactgcacaggaaggcatttggctcgtcgatgaaagcaatcgcaccacttttaccaacaaaaaaatgtgtgaaattttaggatatctgcccaaagaaatgttggggaaagagttttatcatttcacggataatgagggtaaagaagccgggttaaaagcaatggaaaggagaaaagaaggtgtagcagaaaattttgattttcgttttataacaaaaaagggaaagcctatttggacaaacattagtgtgaattcaatattcactgatgatggaaattatagtggtgcactcgcaatggtctctgatatcactgaaaagaaaatntccagcccataa

SEQ ID NO: 5982 - protein, 268 aa, Unknown
  Obtained from environmental sample
  DOMAIN (150)...(209): PAS domain
  misc_feature (1)..(268): Xaa is any amino acid
MSLVQDVSERKENEEKLKQSESRFKEAQKMAHVGNWELNFSTGILTWSQEARRIYGLSLDNNNESYQSWISMIHPADVGYVKRITAEAEATISNAAFFHRIVRRDGSIRHLYSKSQFQFNSDGKPVGLYGVAHDVTEMKEAEEALKQSEFRYRQIVETAQEGIWLVDESNRTTFTNKKMCEILGYLPKEMLGKEFYHFTDNEGKEAGLKAMERRKEGVAENFDFRFITKKGKPIWTNISVNSIFTDDGNYSGALAMVSDITEKKXSSP

SEQ ID NO: 5983 - DNA, 1092 bp, Unknown
  Obtained from environmental sample
  misc_feature (1)..(1092): n is a, c, g, or t
ttggattttttaattttgacgcggaataaaagaatttccataacccatcatcgcgtcatttcgtattttaattcccccaggttgaattcatcgaatcaaatatacttttacaacaacctcaggagtcccttagccgtattgtatttaaccacagttctgttattgctgtctatttttttaaatgcaaaatctcctgtttctcttcctgccggcaaacctattgtattttttttgaccgacagtttaaaaaccaaaccatttaatccgggtaaaggctcagccaacattcttcgcagcgataccctgcctgtcccgcagacaaacatcctccccaacgattcaagcatcactattatttccgacactataagcaataacgacactattgagtttgcacaacaagacgacattaaagatatcatcaattataaagccgaagattccattgtgtacgatatcagcacaaaaaaaatgtacttgtataatgctgccgatgttcattaccagaaaattcagctgaattcaaattccattgatttcgattggaatgtgtttacgctcaccgcccgcggaacgctcgacagcaacgcgcaaatgtcgggcactccggtattcaccgatgacggaaaagaataccgcgctgattcgatgaaatataatttcaaaaccaagaaaggaattgtctatcatgtggtcaccaaagaaggtgatgcttacattcacagtgaanaagtgaagaaaaatgaatatgatgaatggtatggtgagaaatcgaaatacaccacttgcgacttagaccatccgcatttctacttcaaagcccaggaagtgaagatagtaccgaacaaagtgctggtgacaggtcctgcaaatctttgggtggcgatgtgccgaccccgctgtatttgctttcgaattntncnngtgagcaggncagcgctccgaaatatatgcccgatacggncagctggaagtacngccttcttnctcggcatncggctactactgggcgggaatgatatctgggttaaatttacggatgaaagcacatggaacttgcggcaacgaaagccaaaagcctgcgtaaaataa

SEQ ID NO: 5984 - protein, 363 aa, Unknown
  Obtained from environmental sample
  misc_feature (1)..(363): Xaa is any amino acid
MDFLILTRNKRISITHHRVISYFNSPRLNSSNQIYFYNNLRSPLAVLYLTTVLLLLSIFLNAKSPVSLPAGKPIVFFLTDSLKTKPFNPGKGSANILRSDTLPVPQTNILPNDSSITIISDTISNNDTIEFAQQDDIKDIINYKAEDSIVYDISTKKMYLYNAADVHYQKIQLNSNSIDFDWNVFTLTARGTLDSNAQMSGTPVFTDDGKEYRADSMKYNFKTKKGIVYHVVTKEGDAYIHSEXVKKNEYDEWYGEKSKYTTCDLDHPHFYFKAQEVKIVPNKVLVTGPANLWVAMCRPRCICFRIXXVSRXALRNICPIRXAGSTAFXLGXRLLLGGNDIWVKFTDESTWNLRQRKPKACVK

SEQ ID NO: 5985 - DNA, 381 bp, Unknown
  Obtained from environmental sample
  misc_feature (1)..(381): n is a, c, g, or t
atgcattttacagtagaagatattatcgatcttactgaaacatggttaattaagggagatttaaaccctgatatgctagcagaaaactttcagtttatctctccattctggaaaggaaataataaagctgaatttatagctaaatttttagacccaactgaatataaaaaactaagtttatccaacataactaaatttgatcccttattacaatttaaaggactggatgggaggcatttctctattattttgcaatatcatactcataacggcagcagtgtttgggaagctgttttaggaacagttgagaatggaatgcttattgaactacgctcaatttatgacttggaagctaccaaaaaagcgcatgggctagaataa

SEQ ID NO: 5986 - protein, 126 aa, Unknown
  Obtained from environmental sample
  misc_feature (1)..(126): Xaa is any amino acid
MHFTVEDIIDLTETWLIKGDLNPDMLAENFQFISPFWKGNNKAEFIAKFLDPTEYKKLSLSNITKFDPLLQFKGLDGRHFSIILQYHTHNGSSVWEAVLGTVENGMLIELRSIYDLEATKKAHGLE

SEQ ID NO: 5987 - DNA, 783 bp, Unknown
  Obtained from environmental sample
  misc_feature (1)..(783): n is a, c, g, or t
atggaaaattatatcgaattttgtcttaacccaccaaaaacctggattggtacaaaaaaggtatcacgtttcattgagaaaaatggaataagaaccgctaatgcaaaatggcgccctttcgttgctactattagcaaacaggattttaaaaaaggtgaaagaccaaataaaaataattatcaactatcgcaaaaatctattagagaaatatttacagtgttgagtagcttttatcaatatttattgctagatgaaaaagtgacagcaaatcctgttgctctgattaagcagaaaaataaatacttacaaaaacgacaacaacaaccatctgtaatgcgattaacgaataaacaatggcaaacatgccttcaagtagtaagagatatggcagaagaaaatccagataagcatgaaagaacattatttattttatctgcattatatttaatgtacctgcgtatttcagaattagtttcaaatgatcgttggactcccatgatgaaacatttctatcaaaaaacagatggttcgtggtggtttaaagtcgttggaaaaggaaataaattacgggaaatagcagtaagtgatgatatgcttgcggcattaaagcgttatcgagagaacttgcatcttaaccccctaccctcccctaccganaaaaattatcttttgtctaaagaaaaaggtaaaagttcaatgaccgattcacgtcacatccgcagaataattcagtattgtttcgataaaactattataagtttagagaagaaaaaatatttctga

SEQ ID NO: 5988 - protein, 260 aa, Unknown
  Obtained from environmental sample
  misc_feature (1)..(260): Xaa is any amino acid
MENYIEFCLNPPKTWIGTKKVSRFIEKNGIRTANAKWRPFVATISKQDFKKGERPNKNNYQLSQKSIREIFTVLSSFYQYLLLDEKVTANPVALIKQKNKYLQKRQQQPSVMRLTNKQWQTCLQVVRDMAEENPDKHERTLFILSALYLMYLRISELVSNDRWTPMMKHFYQKTDGSWWFKVVGKGNKLREIAVSDDMLAALKRYRENLHLNPLPSPTXKNYLLSKEKGKSSMTDSRHIRRIIQYCFDKTIISLEKKKYF

SEQ ID NO: 5989 - DNA, 483 bp, Unknown
  Obtained from environmental sample
  misc_feature (1)..(483): n is a, c, g, or t
ttgtcacttttagctatagtttctgcattagcagaaaaacaagatataggagtgaaaaaatcattaactggattaaattccgaaattgcatcagttgcttcatcaaccggaaatgtaaatattaagacagatttagtttttaatactcttggatacaggcccatacatgaagcattagcttataatatttcaccatttatagaaggtgttacatggaacaaagaaaattgctataaaattttgaaaaattcagggattaatactcataagaatggcaaattgagaacttttgcagaaatatctgaagaagaaaaaaatattattttagacgcaatcactaaatttatttttttatcaagtagaaataatagtaacaaagagattattgagaatatttccaacgaactagtaaatcaattatacgaatttgaactgaggacaataatagtatactacatgatggaagagaatttgcatttgtga

SEQ ID NO: 5990 - protein, 160 aa, Unknown
  Obtained from environmental sample
  misc_feature (1)..(160): Xaa is any amino acid
MSLLAIVSALAEKQDIGVKKSLTGLNSEIASVASSTGNVNIKTDLVFNTLGYRPIHEALAYNISPFIEGVTWNKENCYKILKNSGINTHKNGKLRTFAEISEEEKNIILDAITKFIFLSSRNNSNKEIIENISNELVNQLYEFELRTIIVYYMMEENLHL

SEQ ID NO: 5991 - DNA, 1173 bp, Unknown
  Obtained from environmental sample
  misc_feature (1)..(1173): n is a, c, g, or t
atgatggtgagatgggatcccgaatctactgttcgttctctttctgctccgggtcaattagaaaaaataggtactaatcaaacagtagccaatatgctcaaatctcatgttgatcaaaaagggatgattgacattggtaaaggtgttgagcatcatgttggagtcactcgaactcgacttgatactgctgttgctatcttaaaagagcaaggatatacagtaaatactatttatttaccacaagctaatcttcctggtcagtacactcctttaaaagttcttgctaagccgggtattacaaaggacgaagttaacagacgccgatcggaaattaaacaaattactgattattcagaagataatggtaggagttttcttcgtacacaacctccggtttctattagttctaagcgtattcaagtaaagtatggcccagaaggtggtcgagaagccgacggtgttatctatgttcgtcgtggagtaaaagacttacagattggatcaaatagctacgcacaagtccgtattgctgttgatggaactcattatctaaagggtatggctgtttataaagatgatatgcctcctggtgtagatcttatctttaatacaaataaatctgataccggtaataaacacgatgctatgaaagaatttgatttaaaagatcctgaaaatccatttggaacaattatacgtcagattcatgggcctgatggaaaagttatttcggctatgaatatagttggaggtaaagaaggagctggagaagagggttattgggatacttggtcaaaaaatctttcatctcanatactttctaagcagagtcctaaattagctaaacaacaattagatttaacatttgatcgtagtcgtcgagaatattctgaaaataactcgnctacaaatcccgnntatcgtaaagagcttcttttacgaattggtgatttctgtgattcgtcagctgtacagcttaaaagcagcagtttgcatcgacaggctaccaaagttatccttcctnnatcatcaatgaagccaaatgaaagttatgcttccagtatgaagaatggtgaaacagtagctcttattaaaatccaccccggtgaaacattcaaattccccagttggaaagtgaccataaaaatcctgagccncaaaaaacttgggtaa

SEQ ID NO: 5992 - protein, 390 aa, Unknown
  Obtained from environmental sample
  misc_feature (1)..(390): Xaa is any amino acid
MMVRWDPESTVRSLSAPGQLEKIGTNQTVANMLKSHVDQKGMIDIGKGVEHHVGVTRTRLDTAVAILKEQGYTVNTIYLPQANLPGQYTPLKVLAKPGITKDEVNRRRSEIKQITDYSEDNGRSFLRTQPPVSISSKRIQVKYGPEGGREADGVIYVRRGVKDLQIGSNSYAQVRIAVDGTHYLKGMAVYKDDMPPGVDLIFNTNKSDTGNKHDAMKEFDLKDPENPFGTIIRQIHGPDGKVISAMNIVGGKEGAGEEGYWDTWSKNLSSXILSKQSPKLAKQQLDLTFDRSRREYSENNSXTNPXYRKELLLRIGDFCDSSAVQLKSSSLHRQATKVILPXSSMKPNESYASSMKNGETVALIKIHPGETFKFPSWKVTIKILSXKKLG

SEQ ID NO: 5993 - DNA, 921 bp, Unknown
  Obtained from environmental sample
  misc_feature (1)..(921): n is a, c, g, or t
atgccccccggcatgggtaaagctgatgtaattatgatcgtttccattccaatatnttcagttgttataccagtaaaaaacgaggcaggtaaaatcagggaatgtattgaaggcattcttaaccaatcaataccagtgttggaaattatcgttgttgactcgggttcaactgatggtaccattgaaattttgaatgaatatgaaattgtaaaactggttcagattccttcagaacaatttaatcatggagaaacaagaaatttgggtgttagctatacttctggtgaatatgtgatactaacagtaggagatgcaaaaccgtacgacaaagattggataaaaaatttactggcaggttttgatgacagaaaagttgctggggtatgtggtatgcaagtagtagcacatcataagaataataacccggttgaatggttcaggccagttgaccaaacaacatcaatcacaaaacatgcttattcaaaagtggaattcgaaggtttatccccggtcgaaaaaaaacaagcctgtagctgggacgatgtaactgctatttaccggcgttcagtattgcaagaaattccttttcgcaaaacatcatattgtgaagatgcaatctgggcgaaggatgcacttttagcaggttatacaatagcatataatcctgccgcaagagtatatcattatcattttgaaaataaggattttacatttaaaagaacattgaccactttatatttccgttataaacactttggttttgttgggtcaagcccccgaaaaagcattttagatgatcttcggattgttaaaacaatttggaaatctttcccgatgaagtttaaagaaaatatattctggattaaatataatattgatcagtttaatgcaatgcgggatgctcaccatatcttcaactga

SEQ ID NO: 5994 - protein, 306 aa, Unknown
  Obtained from environmental sample
  DOMAIN (20)...(195): Glycosyl transferase
  misc_feature (1)..(306): Xaa is any amino acid
MPPGMGKADVIMIVSIPIXSVVIPVKNEAGKIRECIEGILNQSIPVLEIIVVDSGSTDGTIEILNEYEIVKLVQIPSEQFNHGETRNLGVSYTSGEYVILTVGDAKPYDKDWIKNLLAGFDDRKVAGVCGMQVVAHHKNNNPVEWFRPVDQTTSITKHAYSKVEFEGLSPVEKKQACSWDDVTAIYRRSVLQEIPFRKTSYCEDAIWAKDALLAGYTIAYNPAARVYHYHFENKDFTFKRTLTTLYFRYKHFGFVGSSPRKSILDDLRIVKTIWKSFPMKFKENIFWIKYNIDQFNAMRDAHHIFN

SEQ ID NO: 5995 - DNA, 741 bp, Unknown
  Obtained from environmental sample
  misc_feature (1)..(741): n is a, c, g, or t
atgaaagttaccgagcatatagcaaaagcacagtccaccctgttttccattgaaattctgccccctctgaagggtaaggacatcaattcgattttcaatggtatagatcccttaatggagtttaaaccggcctttattgatgttacataccaccgcgaggagtatgttttgcgcaaacgaaaggatggtggttatgataaagtcttcacccgcaagcgcccggggaccgttgcaatatgtgcagccctgatgaacaaataccatattgatacggtaccacacctgatctgtggcgggttcagcaaggaagaaacggaaaacgcactcatcgaacttaattttcttggtatagataatgtgcttgccctccgtggtgataatgtaaaaaatgaaagtgcttttgttgccgaaccggatggaaataaaaactcaatcgaactccttgagcagcttaaaaggatgaaccagggaatttacctcgacccggaattggagaatgccaccccaagcaatttctgcattggcgttgcaggttatcctgaaaagcattttgagtcgcccaacctggcaagcgacctgcgttggctgaaaacgaaagttgagaccggggccgattatatcgttacacagatgttctttaacaataagaagttcttttcttatgttgaagcgtgcaagcaaagcggcatcaatgtgccggtgatacctggcttaaagccactaccagtaagaaacatctga

SEQ ID NO: 5996 - protein, 246 aa, Unknown
  Obtained from environmental sample
  DOMAIN (2)...(246): Methylenetetrahydrofolate reductase
  misc_feature (1)..(246): Xaa is any amino acid
MKVTEHIAKAQSTLFSIEILPPLKGKDINSIFNGIDPLMEFKPAFIDVTYHREEYVLRKRKDGGYDKVFTRKRPGTVAICAALMNKYHIDTVPHLICGGFSKEETENALIELNFLGIDNVLALRGDNVKNESAFVAEPDGNKNSIELLEQLKRMNQGIYLDPELENATPSNFCIGVAGYPEKHFESPNLASDLRWLKTKVETGADYIVTQMFFNNKKFFSYVEACKQSGINVPVIPGLKPLPVRNI

SEQ ID NO: 5997 - DNA, 825 bp, Unknown
  Obtained from environmental sample
  misc_feature (1)..(825): n is a, c, g, or t
atgaataacttcttattaaaaacattggatgtatattttgaggaaatacttgggcttgaatcaaaaatttgggttgcagaaaatttgttaacacaaagagccaatgaaatcattgcagaaaaaagaacacataaatccttatttatggctgctacctcatatgaggatatgactttggaaaataaagataagagttggttcatgccaaatcattattatgatataacaatcgataatattgaaaacgaaattgaagacattataagtcagcagagttgtttatcaatttcccaagcttatgatgcctttgaaacctatttaatagatattttaactgaagtcatttatattaaacctgaattcatgagtattttaaaaattaagaatgcagatataaatgaaaaaagttccatgaggcaagcaattaaatcccaaaaaggaaaaaataataaaggattattatcactaataagaaagctttcttctcactatcgatcaaacgaatatgaaaacaattttaaaggtaaaatttctgattggtatgagttatattctaatgttaggcacgtcattgttcacaatcgtcaagttatacccaaagcatttctagattatttaaaactacataacgcggaaaaaaaatttcaaacagagtattcaacaaaagttatcggtgggaaacaatgtatttttttaaaagtagaacaggtgcgcaacataatttttcggcttaacagttttgcccattttgtatttaaaggactttctttggaatgcaatttanaaatcgatgtacctgaatttatttcagatttcttcanntag

SEQ ID NO: 5998 - protein, 274 aa, Unknown
  Obtained from environmental sample
  misc_feature (1)..(274): Xaa is any amino acid
MNNFLLKTLDVYFEEILGLESKIWVAENLLTQRANEIIAEKRTHKSLFMAATSYEDMTLENKDKSWFMPNHYYDITIDNIENEIEDIISQQSCLSISQAYDAFETYLIDILTEVIYIKPEFMSILKIKNADINEKSSMRQAIKSQKGKNNKGLLSLIRKLSSHYRSNEYENNFKGKISDWYELYSNVRHVIVHNRQVIPKAFLDYLKLHNAEKKFQTEYSTKVIGGKQCIFLKVEQVRNIIFRLNSFAHFVFKGLSLECNLXIDVPEFISDFFX

SEQ ID NO: 5999 - DNA, 549 bp, Unknown
  Obtained from environmental sample
  misc_feature (1)..(549): n is a, c, g, or t
ttgttatcattttcccaagcttatgatgcctttgaaacctatttaatagatattttaactgaagtcatttatattaaacctgaattcatgagtattttaaaaattaagaatgcagatataaatgaaaaaagttccatgaggcaagcaattaaatcccaaaaaggaaaaaataataaaggattattatcactaataagaaagctttcttctcactatcgatcaaacgaatatgaaaacaattttaaaggtaaaatttctgattggtatgagttatattctaatgttaggcacgtcattgttcacaatcgtcaagttatacccaaagcatttctagattatttaaaactacataacgcggaaaaaaaatttcaaacagagtattcaacaaaagttatcggtgggaaacaatgtatttttttaaaagtagaacaggtgcgcaacataatttttcggcttaacagttttgcccattttgtatttaaaggactttctttggaatgcaatttaaaaatcgatgtacctgaatttatttcaagatttcttcattag

SEQ ID NO: 6000 - protein, 182 aa, Unknown
  Obtained from environmental sample
  misc_feature (1)..(182): Xaa is any amino acid
MLSFSQAYDAFETYLIDILTEVIYIKPEFMSILKIKNADINEKSSMRQAIKSQKGKNNKGLLSLIRKLSSHYRSNEYENNFKGKISDWYELYSNVRHVIVHNRQVIPKAFLDYLKLHNAEKKFQTEYSTKVIGGKQCIFLKVEQVRNIIFRLNSFAHFVFKGLSLECNLKIDVPEFISRFLH

SEQ ID NO: 6001 - DNA, 324 bp, Unknown
  Obtained from environmental sample
  misc_feature (1)..(324): n is a, c, g, or t
gtgtatgaatactcgattgaagatatgaaaaccaaaggcgcgccggttgattggatcggtctggagcctgtggtcacttacacggtcgccgcttctctgccgtcccagccaaataatccgaacgcggccaagttgttcatcgagtggctgctctcgaaagaaggccaggaagtcatcaatcagtacggccgcgtgccgatccgcgacgacgtcgactcgaagtacggcaaaattctcaagcagcacaaactgctgatgacggatgtggatctcgggcaaaaagaagccgagataaacgaaacttttcgcaaactgttccggtag

SEQ ID NO: 6002 - protein, 107 aa, Unknown
  Obtained from environmental sample
  misc_feature (1)..(107): Xaa is any amino acid
MYEYSIEDMKTKGAPVDWIGLEPVVTYTVAASLPSQPNNPNAAKLFIEWLLSKEGQEVINQYGRVPIRDDVDSKYGKILKQHKLLMTDVDLGQKEAEINETFRKLFR

SEQ ID NO: 6003 - DNA, 837 bp, Unknown
  Obtained from environmental sample
  misc_feature (1)..(837): n is a, c, g, or t
ttgatcttcgccaaaagcgactcccatgccgatgacatcatcaacattgttcggcgggaatttgccgaagaaaataagttctgtaaaaaaataacttaccgcaccagcgaaggcccggaaaaggaagacccgaaaacggtgttgcagcaatttcgtatgagttattatcctcgcattgctgtaacggtagacatgattgcaaccggcaccgatattcgtccgcttgaagttttgctttttatgcgagatgtaaaaagccgtagctattacgagcagatgaaaggccgcggcacccgtacctgcacacttgacgaactcagaagcaccggaacacccgcagcaaaattcaccaaagatcattttgtaattattgatgctattggtgtagaaaaaagccagaagaccgacagccgcccactggagaaaaagccaggacttagtttaaaagaagtgctcgaaggaattgccatgggcaataaagatgaagaaatgctttccacacttgccaaccggttaatacggctagacaaacaaatcaacgataaagaaaaagcaaccttcgccgaaaaagccggtggcaaaaccatcaacagcgtagtaaaagatttgctgaatgcgtatgacgccgatacagttgaaagtttagagtctaaagttttgagtgaaaaccccaacgcatcacccgaagaacttaacaccaaactcaaaacccaacactcaaaacttattgaacaagctactgccatcttcaacaactacgacctccgcaactacattatcgacgtccgtaaaaaatacgaccagtttatagaccatatcaatcccgatgaagtataa

SEQ ID NO: 6004 - protein, 278 aa, Unknown
  Obtained from environmental sample
  misc_feature (1)..(278): Xaa is any amino acid
MIFAKSDSHADDIINIVRREFAEENKFCKKITYRTSEGPEKEDPKTVLQQFRMSYYPRIAVTVDMIATGTDIRPLEVLLFMRDVKSRSYYEQMKGRGTRTCTLDELRSTGTPAAKFTKDHFVIIDAIGVEKSQKTDSRPLEKKPGLSLKEVLEGIAMGNKDEEMLSTLANRLIRLDKQINDKEKATFAEKAGGKTINSVVKDLLNAYDADTVESLESKVLSENPNASPEELNTKLKTQHSKLIEQATAIFNNYDLRNYIIDVRKKYDQFIDHINPDEV

SEQ ID NO: 6005 - DNA, 837 bp, Unknown
  Obtained from environmental sample
  misc_feature (1)..(837): n is a, c, g, or t
gtggacctgcaaacaaaacaagttatgcgctggacctatagtgaaacaggcggtctgaacccggaatcatttgtcacacccgaattaattgaatatcccacgttcgattcggtgaacggaaaaccgcgaatgatcccggcattttattacaaacccaaaactgccgccccgaacaagccttttccggttgtgatcaggattcatggcggtccggaaagtcaaaccggttcctcctttagtgcgctataccaatactggattaatgaacttggtgtcgcagtaatcgatccaaacgttcggggttccgatggatatggcaagagttatctcctgatggataacgggatgcttcgggaagattcggtcaaagatatcggcaagctgctcgattggattgctactcgccctgagctcgattctgaccgggtcgctgtttatggtggttcttatggcggctacatggtgctctcttcggcgtctcattacagtgatcgtctaaaatgcgcggttgatattgttggaatcagcaactttgtcacgttcctgaaaacgacagaaaactatcggcgcgatctccgtcgcgctgaatatggggacgaacgggatgcaaaaatgcaggaattcctgctttcgatttccccgattcagaatgtgcaaaaaattaagaacgcctttgtttgttgttcagggaaaggaatgatcctcgggttccagtcaccgaaaccggaccaaatcgtaaaagcagtgcgaaacaaatggaagtcaaggcctgtaatctgcctgcaaattacgaaggaaatgggattcaaaaggaaaaacaatccgggacctttatga

SEQ ID NO: 6006 - protein, 278 aa, Unknown
  Obtained from environmental sample
  DOMAIN (77)...(278): Prolyl oligopeptidase family
  misc_feature (1)..(278): Xaa is any amino acid
MDLQTKQVMRWTYSETGGLNPESFVTPELIEYPTFDSVNGKPRMIPAFYYKPKTAAPNKPFPVVIRIHGGPESQTGSSFSALYQYWINELGVAVIDPNVRGSDGYGKSYLLMDNGMLREDSVKDIGKLLDWIATRPELDSDRVAVYGGSYGGYMVLSSASHYSDRLKCAVDIVGISNFVTFLKTTENYRRDLRRAEYGDERDAKMQEFLLSISPIQNVQKIKNAFVCCSGKGMILGFQSPKPDQIVKAVRNKWKSRPVICLQITKEMGFKRKNNPGPL

SEQ ID NO: 6007 - DNA, 483 bp, Unknown
  Obtained from environmental sample
  misc_feature (1)..(483): n is a, c, g, or t
atgcccaataaagaatacatctttcttgaaccgccagtaaaggatgaccctacatctcccgatgaatatatcaattcggcgctatcaaaaacccaagcaggcttattagttttcagtaactggcaggaatcaagagaaactaaaactgaaaaaatgcaacgcctgaaaaaagaaattgaatacctgtcgcggtcaggcatatctaaaccgcacatcaaaaaaggtattgaagaaaaagaagccgaactaagccaaatgtctttagatgtaaactccaaaaaatacgaaccttacaccatagccgcctttaacccggaattaaaagaacactttcatccagatgcggatatcgctgtcggcaaagtcgtctatgtacttaatatagctgctcaaactgaaatagattttaatggcaaaaaattcatagtgtgcaaaacaaattatattggcggaacaaaaaagcatccatacggcggcgcttaa

SEQ ID NO: 6008 - protein, 160 aa, Unknown
  Obtained from environmental sample
  misc_feature (1)..(160): Xaa is any amino acid
MPNKEYIFLEPPVKDDPTSPDEYINSALSKTQAGLLVFSNWQESRETKTEKMQRLKKEIEYLSRSGISKPHIKKGIEEKEAELSQMSLDVNSKKYEPYTIAAFNPELKEHFHPDADIAVGKVVYVLNIAAQTEIDFNGKKFIVCKTNYIGGTKKHPYGGA

SEQ ID NO: 6009 - DNA, 555 bp, Unknown
  Obtained from environmental sample
  misc_feature (1)..(555): n is a, c, g, or t
atgcctgactatagtaagaattttttaacatccatgaccggatatgtcaatatgaatgatccggaagaccccaagccaaaagcgtatatcccgcagttaaaaacatcgttggataccaccgcagacgtaagggacatactaagcaatatagtaggtagtaactattccagttggcaggacttcagcgcaaacgaggatgctaaggccagatacggggcattaattaataaggttggcaggccgctggctacaaaattagttactcaggcaataatatttaatcaacggcccgacacacagaatcaaaatctggaacagaagatacagtcattttataatataggcgctacggataaagaggtagcaggtgtattacaaaatgtaaagtcttttggatatggagttgtgccccggatttcggggaatccgtttttgcaggggaaatcatcgctgcaaagaaatgtatcttccccagccgggtcaccaattcagtcaaaaaaaataaaagagatcgttaagaccaaaaccaaattgttcctcccccttaacgaataa

SEQ ID NO: 6010 - protein, 184 aa, Unknown
  Obtained from environmental sample
  misc_feature (1)..(184): Xaa is any amino acid
MPDYSKNFLTSMTGYVNMNDPEDPKPKAYIPQLKTSLDTTADVRDILSNIVGSNYSSWQDFSANEDAKARYGALINKVGRPLATKLVTQAIIFNQRPDTQNQNLEQKIQSFYNIGATDKEVAGVLQNVKSFGYGVVPRISGNPFLQGKSSLQRNVSSPAGSPIQSKKIKEIVKTKTKLFLPLNE

SEQ ID NO: 6011 - DNA, 606 bp, Unknown
  Obtained from environmental sample
  misc_feature (1)..(606): n is a, c, g, or t
atggataattcaatcagaaaatattccgataaactaaatttaataaagcagactgtcggtgtagagcggattaaatttgaagaaccactttcttatcatgtgttttcaaaattgggaggacctgcggaagcactttatatagacacatcgcaaaaagagttgataaaaattttggatttaacttatgatcttaaagtgccgtatgtaattttaggtaacggaaccaaacaactaatcacggagcgtgggcttgaagggttggtaatcaaaaacagagcggatgatctgaaaattggcggaattaagggaaaagtcggaccaaaaggattaggcattgaagaggcaaccctggaggtggactccggagtaagcttaggcagacttaacgaatatttgaacaatcaaaacctacagcctattgagcagttaagttcgctgcaggcaacagttggtggagccatttttcttgacccctcacttcgggaaaaagtcagtaaagttaaggtctgggaagatcaggatgtatttgaggttgatacctgggatttaaaaagacacaatcaggtagtgatttcaatttttttgaaggttaaggcaaaggtataa

SEQ ID NO: 6012 - protein, 201 aa, Unknown
  Obtained from environmental sample
  misc_feature (1)..(201): Xaa is any amino acid
MDNSIRKYSDKLNLIKQTVGVERIKFEEPLSYHVFSKLGGPAEALYIDTSQKELIKILDLTYDLKVPYVILGNGTKQLITERGLEGLVIKNRADDLKIGGIKGKVGPKGLGIEEATLEVDSGVSLGRLNEYLNNQNLQPIEQLSSLQATVGGAIFLDPSLREKVSKVKVWEDQDVFEVDTWDLKRHNQVVISIFLKVKAKV

SEQ ID NO: 6013 - DNA, 807 bp, Unknown
  Obtained from environmental sample
  misc_feature (1)..(807): n is a, c, g, or t
atgtcacttttcaggtataatgccgagaacaggcttaaagaaagtgaaagaagatttaaagcattaacagaagtagccctttcaacaattatcatgatacagggtacaaaatttgtttattcaaatccctacgcagaagttcttaccgggtataaactttcggagcttctcaagatgaatttctgggatgtggttcatcctgacttcaaacaaatggtaaaacaaaggggacttgcaaggcaaagaggcgaagatgttccatccagctatgaattcaaaataatcaccaaagatggcagcacaaagtgggtacagacctcggcaactgttactgattttgagggcaggctatgtacacttgcaagtatcttcgatataactgacaggaaaaacgctgaagagatcctgaagcaaagcgaagagaagttcagggcagtggcagaatcgatgcctgcacagattgttattattcagaatgataaaattgtttattcgaatccttactcaggctcaataacgggttacaccgaaaatgagctgctggggaaaaatttctgggatctggttcaccctgatttctccaaaatggcaagatcaggagttaccttagctgtaaaaaaacataaaagtgtaacggataattatgaattgaaaatagttaccaaagataataaacaaaagtggatcagtttttcagcaagggaaatcgagtacaacggggaccccgcacttcttggcatagcaacagatattactganagtaaaagaataagcggcgaaaatgaaagaaagccagcagcgttatag

SEQ ID NO: 6014 - protein, 268 aa, Unknown
  Obtained from environmental sample
  DOMAIN (141)...(202): PAS domain
  misc_feature (1)..(268): Xaa is any amino acid
MSLFRYNAENRLKESERRFKALTEVALSTIIMIQGTKFVYSNPYAEVLTGYKLSELLKMNFWDVVHPDFKQMVKQRGLARQRGEDVPSSYEFKIITKDGSTKWVQTSATVTDFEGRLCTLASIFDITDRKNAEEILKQSEEKFRAVAESMPAQIVIIQNDKIVYSNPYSGSITGYTENELLGKNFWDLVHPDFSKMARSGVTLAVKKHKSVTDNYELKIVTKDNKQKWISFSAREIEYNGDPALLGIATDITXSKRISGENERKPAAL

SEQ ID NO: 6015 - DNA, 657 bp, Unknown
  Obtained from environmental sample
  misc_feature (1)..(657): n is a, c, g, or t
gtgtgcggagttcataatattagattaagattcacttccaaaggtctatggaatattatttctctatattctgactccgaatatttgataaagaatattgacttgaaaagcaatagagacattgttctttatgatcttgattttggggatcatgtaatcaagacaaccatacacaaaactgatactattgaagtaatagtggcctgttctgagaatcaaatatctatagacctacctggtttggcccgaattaccagcagtttaacaagactagaagaaaggttacaaagagttgttgatgaatatcttaaactaaacttgaaatcaaatatttcttccgggtctttagcagttaaaggtccaatactagatcatatgtcttggatagtcactatgtggcactttggtagggattctcttgtaacataccgaggtgaaatgtttgaaatcagttggaagaacgcattaggcgtgtttaataggatttactctaagcaatttaaaaataaaaaaaaagtcttgataagaaaagagattcaagagtatcctaataaaccattgggcgaagcattcttggaaaaaatgatggtaactcaagaattagatcaatactatcttaatagaaattttcaagaatctattggaggtcttgcataa

SEQ ID NO: 6016 - protein, 218 aa, Unknown
  Obtained from environmental sample
  misc_feature (1)..(218): Xaa is any amino acid
MCGVHNIRLRFTSKGLWNIISLYSDSEYLIKNIDLKSNRDIVLYDLDFGDHVIKTTIHKTDTIEVIVACSENQISIDLPGLARITSSLTRLEERLQRVVDEYLKLNLKSNISSGSLAVKGPILDHMSWIVTMWHFGRDSLVTYRGEMFEISWKNALGVFNRIYSKQFKNKKKVLIRKEIQEYPNKPLGEAFLEKMMVTQELDQYYLNRNFQESIGGLA

SEQ ID NO: 6017 - DNA, 639 bp, Unknown
  Obtained from environmental sample
  misc_feature (1)..(639): n is a, c, g, or t
ttgtgcgatacagtcagtgacataaaggaattaattattccagaaaatgggacgatttccattaattatccgctcaccccctcaagagctagttcccttagcactagaaccacgcatccctttgtcataaatacattccaagaacttattattagaacgggtatcgggataaatttaattaacccttattcactatcaactaaaggcgaaatggtaaagacgtgttcaaatattgtttcactcaaaaaatcctacaaagattctgtttcctgtggtaaaaggggaagaaggcaacactgggatctaaaaactggcacagaccattgtggcgtatgtatgccatgcatttataggcgaggagcccttcacaaggtcggacttgataatcagacttatggaatagatattttgtcagcatcatctatttataattatgttgatatgcctgcactatttgattatttgaaaaccgtcgtctcaaaagagaaaatcaaaaggggcttgttggttaatggaagtttaaaccaagatgtgcttgaagattatgcagaggttgtcattagatctagaagagaacttttgaagtggttttctgataagggaaatagttacattaaaggcgaattgggtattaaatga

SEQ ID NO: 6018 - protein, 212 aa, Unknown
  Obtained from environmental sample
  misc_feature (1)..(212): Xaa is any amino acid
MCDTVSDIKELIIPENGTISINYPLTPSRASSLSTRTTHPFVINTFQELIIRTGIGINLINPYSLSTKGEMVKTCSNIVSLKKSYKDSVSCGKRGRRQHWDLKTGTDHCGVCMPCIYRRGALHKVGLDNQTYGIDILSASSIYNYVDMPALFDYLKTVVSKEKIKRGLLVNGSLNQDVLEDYAEVVIRSRRELLKWFSDKGNSYIKGELGIK

SEQ ID NO: 6019 - DNA, 822 bp, Unknown
  Obtained from environmental sample
  misc_feature (1)..(822): n is a, c, g, or t
atgtttgtagcggccgacgggccgcgtacagaaaaggaaggcgaaaaggaacgttgcgaccaggcaaggaaaattgcaactgccgtggattgggattgcgaagtaaaaactttattccgcgatgaaaacataggctgcggccgcggccctgccgaagcaattagctggttttttgaacatgtggagcagggaattattttagaagatgattgcttgccagcacagagttttttttcttttagtgaagaacttttggagaaatataaatacaataatagaatctggcatatttgcggaaattctttttttcaaaatcaaagtcaaacatcttattatttttctagctatggccatatatggggctgggcgtcctggagaagagcttggaagcactatgattttaatttaaaaaatattgatcgttctattttaatcttgagattaaatgacacttttatttctaaggaagaaaaacttttttggttaaatcactatgatcacgttcataagttgaaatataaagatttctgggactatcaatggtctttaatattatggtataataaagctctttcaataacgcctacaaaaaatttaattagaaacataggttttggtgattatgcaacacacacaactgataaaaattcctggctttctgaattaaagacttttgaaatttcaaacgttgttcataataatagtatcattcaaaataagatagcagatcgttatacttcaaaaaaaatatttggtattcaatccaaaaatgaattaatactaaaacgaattaaacatatcgttaagaaaattagtaaataa

SEQ ID NO: 6020 - protein, 273 aa, Unknown
  Obtained from environmental sample
  misc_feature (1)..(273): Xaa is any amino acid
MFVAADGPRTEKEGEKERCDQARKIATAVDWDCEVKTLFRDENIGCGRGPAEAISWFFEHVEQGIILEDDCLPAQSFFSFSEELLEKYKYNNRIWHICGNSFFQNQSQTSYYFSSYGHIWGWASWRRAWKHYDFNLKNIDRSILILRLNDTFISKEEKLFWLNHYDHVHKLKYKDFWDYQWSLILWYNKALSITPTKNLIRNIGFGDYATHTTDKNSWLSELKTFEISNVVHNNSIIQNKIADRYTSKKIFGIQSKNELILKRIKHIVKKISK

SEQ ID NO: 6021 - DNA, 765 bp, Unknown
  Obtained from environmental sample
  misc_feature (1)..(765): n is a, c, g, or t
atggttttcgctcaatcaggttttgggaagacgaatttagtcaaagttttgttatacaacatgattagcaacaaagattatgggaaattggtttttgacctaaacggagaatatgctctccgtgggacttctacatatggactgggggatattgatgaagccttagtaaaacaaaatcttgttgtttatacagacaaagagttgccaagaacatataaagatgcagatcgtttcatcttcggtggaaaagttcgtctgaacatgcatagaaatctatcggtgggggatatcttaaacttcggagccgggttttctgaagttatgaaatcgttcctgttttatctggacgaagaaggtgttgagaattttgtgcagaacattgatgactatgtagaaaatccagccaacttacatcgtgatttttcggatttctttggaaagatggaaaagaaaggagaggaagccagcgccagaaaaacagtcatggctattagaaagcggatccgacacctgattgatgacgataagggtctgcattctagctcatcaaaacttgttgaggatgtttttaagtatttacagcaagggaagactattgtgatagatttgtctcttcgagacaatatagaagcgagcataatttcaactatcttaatcagaaagcttttcgagcagaacaaagaanatttcacttctcnaagaacggacaaggtaattaaagctgttgttttcgtagaggaagcacaaaatgtttttgtcggatga

SEQ ID NO: 6022 - protein, 254 aa, Unknown
  Obtained from environmental sample
  misc_feature (1)..(254): Xaa is any amino acid
MVFAQSGFGKTNLVKVLLYNMISNKDYGKLVFDLNGEYALRGTSTYGLGDIDEALVKQNLVVYTDKELPRTYKDADRFIFGGKVRLNMHRNLSVGDILNFGAGFSEVMKSFLFYLDEEGVENFVQNIDDYVENPANLHRDFSDFFGKMEKKGEEASARKTVMAIRKRIRHLIDDDKGLHSSSSKLVEDVFKYLQQGKTIVIDLSLRDNIEASIISTILIRKLFEQNKEXFTSXRTDKVIKAVVFVEEAQNVFVG

SEQ ID NO: 6023 - DNA, 429 bp, Unknown
  Obtained from environmental sample
  misc_feature (1)..(429): n is a, c, g, or t
atggcgaaggttacggtattcgtttttgacgaacagaatgataagttgattgaaatngtaggcctagctgaccccgttattggcttggaaatgagagatgttaagtcaatagattggtctaaagatcaaaagttagatcgcctttataactgtatgactgcttacatcttaggagcgattccgccctatagccgaattttgggtggaaaactggtcgcattaactgtgatgtttccagaggtgcgaaaatggttttacaacaagtacagaaattcaaaatcaattattaccaatatccaaaagaagccacatttggtttatgtagatactatgggagcctttggaaaatcatcaatatataatcgtctattcaattggcctcaatctaaaaactcaaaaatcagtatctcaacagtgttttggagataa

SEQ ID NO: 6024 - protein, 142 aa, Unknown
  Obtained from environmental sample
  misc_feature (1)..(142): Xaa is any amino acid
MAKVTVFVFDEQNDKLIEXVGLADPVIGLEMRDVKSIDWSKDQKLDRLYNCMTAYILGAIPPYSRILGGKLVALTVMFPEVRKWFYNKYRNSKSIITNIQKKPHLVYVDTMGAFGKSSIYNRLFNWPQSKNSKISISTVFWR

SEQ ID NO: 6025 - DNA, 507 bp, Unknown
  Obtained from environmental sample
  misc_feature (1)..(507): n is a, c, g, or t
atggctaaacgaaaaaaccctatcagggctgtcaatacaactaaaaggacaagaaagccaaaaaagaaaaaacgatccctggcaggactttttatcatcattggtctcttgatagccaccactattttctatattgttacccaaaaaaacaaacctctttcaccaaaatccttcagagaaatgattccaaaaggatttccaacggtgggaattgatgtttcccatcaccagggagaaatggattgggatgaattatttaataaaagtggttatgattctttgatacagtttgtttattgcaaagctacggaaggagacactcatattgatactcagtgggaacgcaatcgaaaacaattaaacaatttaggaattcccaatggagcctatcatttttttcgttccaaagaagattcaaaatcacaagtccagcattttttgaaacattggaagaaaagagatattgatttaccacctgttttagatgtcgaaacagaaggtttctga

SEQ ID NO: 6026 - protein, 168 aa, Unknown
  Obtained from environmental sample
  DOMAIN (71)...(167): Glycosyl hydrolases family 25
  misc_feature (1)..(168): Xaa is any amino acid
MAKRKNPIRAVNTTKRTRKPKKKKRSLAGLFIIIGLLIATTIFYIVTQKNKPLSPKSFREMIPKGFPTVGIDVSHHQGEMDWDELFNKSGYDSLIQFVYCKATEGDTHIDTQWERNRKQLNNLGIPNGAYHFFRSKEDSKSQVQHFLKHWKKRDIDLPPVLDVETEGF

SEQ ID NO: 6027 - DNA, 657 bp, Unknown
  Obtained from environmental sample
  misc_feature (1)..(657): n is a, c, g, or t
atgaaatctttaatcataatcttttcactcattttgttttttactgcctgtaaaaatcaaaagggaggagtgcaaactacaggtcaggtgattgaaaattccattacactcaccgacgcacaaatgaggaatgcaaaaattgaaaccgggaaaatagagcagaaggaaatttcatctgtgctaaaggtcaatggacggatagatgtgccaccacaaaatttagtatcggtaagtgtacctcttggaggttatctcagatcaactaaactcctcccgggtatgcacataaataaaaatcaggtgattgctataattgaagatcatcaatatattcagcttcagcaggattatctaacggctaaagcgcaattcggttatcatgaaagtgaatacaaaaggcagaaggaattgaacgaaagcaaagccaccagcgataaaatgtatgagcaggcaagatcaacttatcaaactcaaaaaatattgataagatcattagaggaaaagttgaagttgatccgtattaatccaaacagccttaatgaaaataatatctncaaaagcattaacatctattcgcccattaatggatttgtttctaaagtaaatgtgaacattggaaaatatattactcctggagaagtactttttgaattgtaa

SEQ ID NO: 6028 - protein, 218 aa, Unknown
  Obtained from environmental sample
  SIGNAL (1)...(18)
  misc_feature (1)..(218): Xaa is any amino acid
MKSLIIIFSLILFFTACKNQKGGVQTTGQVIENSITLTDAQMRNAKIETGKIEQKEISSVLKVNGRIDVPPQNLVSVSVPLGGYLRSTKLLPGMHINKNQVIAIIEDHQYIQLQQDYLTAKAQFGYHESEYKRQKELNESKATSDKMYEQARSTYQTQKILIRSLEEKLKLIRINPNSLNENNIXKSINIYSPINGFVSKVNVNIGKYITPGEVLFEL

SEQ ID NO: 6029 - DNA, 621 bp, Unknown; identical to SEQ ID NO: 1345
  Obtained from environmental sample
  misc_feature (1)..(621): n is a, c, g, or t

SEQ ID NO: 6030 - protein, 206 aa, Unknown; identical to SEQ ID NO: 1346
  Obtained from environmental sample
  misc_feature (1)..(206): Xaa is any amino acid

SEQ ID NO: 6031 - DNA, 810 bp, Unknown
  Obtained from environmental sample
  misc_feature (1)..(810): n is a, c, g, or t
ttggaaacaatgaataaaattaataaaatcgcaatcttacataggtatcctccgcgcttagtagtagcaacgaacgcgtcatttttggaattcctaaaacagatgtcaagcgagttttcacaagtttactatgttacttatcgcgaacaaaatatggagcctatcgaaggtgttagcattgtgcgcattccattgtcttttaaccgatggaataactgcgacaaagtgttaaaaactgttttgtggattattggtgtacctgtttttgcactcttgttcaaaaaaaagctgggattttcggcagtttactgtgatgattcagtcccctactacggatttttgataaaattactcaacccaggtttaaaagtcgttatacgcttaggagatttgcaaagcgcttatgagctagctgaaaaaaataaactagctttcaaaattgcacaaaaattagaactttttatgtggaagtacatcgacggcgtaattccgatctcaggggctatgcgcgactacttaatcagcatagggatgccggcagaaaaactagaagtagttgaagaaagtatcaatatcgataaagtttcagaaacagttgaaagtaccgattttacaaaaaaccaacggcaaatttaccgtaatgtttcatggcgccttggtaaaaagttaaaggaanttgaaacattgctcaaagcatttaaaaaatttttctccgataaatctggtaaaagtgggattgatcatcgcggggcgggggccctgaagaaactaaaaccaaaactttggagtcaagaacttaggtttaaataa

SEQ ID NO: 6032 - protein, 269 aa, Unknown
  Obtained from environmental sample
  misc_feature (1)..(269): Xaa is any amino acid
METMNKINKIAILHRYPPRLVVATNASFLEFLKQMSSEFSQVYYVTYREQNMEPIEGVSIVRIPLSFNRWNNCDKVLKTVLWIIGVPVFALLFKKKLGFSAVYCDDSVPYYGFLIKLLNPGLKVVIRLGDLQSAYELAEKNKLAFKIAQKLELFMWKYIDGVIPISGAMRDYLISIGMPAEKLEVVEESINIDKVSETVESTDFTKNQRQIYRNVSWRLGKKLKEXETLLKAFKKFFSDKSGKSGIDHRGAGALKKLKPKLWSQELRFK

SEQ ID NO: 6033 - DNA, 858 bp, Unknown
  Obtained from environmental sample
  misc_feature (1)..(858): n is a, c, g, or t
ttgctgaacagcgtatcctctcataagaaactttcacatttttttatgcgtggacaaaacggtatttatgaaataagcactgcaactattcacccgacaagtgatcctgaaaggcttagcaggcccaatggatattttgctgcaggaaggctttggaaaaatgaacggctcgaaaagatctctgaattaacaggtacaactatagagcttgtcggcctggatgcaagggattcagttgaaaaagcagcagatcctcataattttgtttctaacagctttcacctgctttatacctgggataaaaaacctttggcttacgttcggtctgaaaaacaggctgaaatgataaaaataatgcatgatcaatctgataaacaattcatcctgataatagtatttgtatcagtactgcttgtgctgatgagcgtatcactttattacattgttaacaaaccgctcagcaaattatcaaggagcctgaaagaccatgacccttccggaatccaaaaccttcttcacaaaaaaagtgaatacggtgagatggcaaatcttgtaaatgagtttttcgttcagaaagaaaaacttgtaaaagagatcgaagtgagaattgagactgaacaaaagatcagagtatcggaagaaaaactgaaaaactcgctcanagaaaaggatgtcctgctcaaggaaagtcatcacagggtaaaaaacaatctccagatagtaatgagccttatcaggctgcaggttaacaggatggatgacaaatgtacaatacagcatttgcagaccagcttaaacagaatacgttcgatatctctcgttcacgaaatgctttaccgttccggaagatcttggtag

SEQ ID NO: 6034 - protein, 285 aa, Unknown
  Obtained from environmental sample
  DOMAIN (229)...(283): Histidine kinase
  misc_feature (1)..(285): Xaa is any amino acid
MLNSVSSHKKLSHFFMRGQNGIYEISTATIHPTSDPERLSRPNGYFAAGRLWKNERLEKISELTGTTIELVGLDARDSVEKAADPHNFVSNSFHLLYTWDKKPLAYVRSEKQAEMIKIMHDQSDKQFILIIVFVSVLLVLMSVSLYYIVNKPLSKLSRSLKDHDPSGIQNLLHKKSEYGEMANLVNEFFVQKEKLVKEIEVRIETEQKIRVSEEKLKNSLXEKDVLLKESHHRVKNNLQIVMSLIRLQVNRMDDKCTIQHLQTSLNRIRSISLVHEMLYRSGRSW

SEQ ID NO: 6035 - DNA, 945 bp, Unknown
  Obtained from environmental sample
  misc_feature (1)..(945): n is a, c, g, or t
atgtattctcaattaaacaataaaccaaagtcagatttcttccagttaaaatacttgtcactcaaagattcagttaacaatttggaaaagttggccagcatagcggaaatagagaataacagggccttggaaagacttgaagctgaaaaacaaaaagagaacgctatcagtgacatgaaacgcggggcggaaaagcgaatgcaaaatttggtcacgggatttgttgtattctcgttcattatggttcttattttctctattatcatcttccgtcgatttaaattctcaaaaaaacaaaatgagatcattgaggaaaagcaaaaagagatcctggattctatacactatgcaaaacgtattcaatctgctttactcgcacacagagattatattgattcgcacttaaaagataatttcattctcttcaaaccaaaagatattgtaagcggagatttttattgggcagcgaatagggataataaattctatttagcgtcttgcgatagcactgggcacggagttccgggcgcgttcatgagtttgcttaacattgggtttttaggagaagctattaaagaaaaaaatatccttgaaccgaataagatcctcaatcatgtacgtgaacgtttgatagatggaattagtaaagaagggcagaaggatggatttgatggaattttaatttgcgttgataagcaaaatagtaaacttacttacgctgcggcaaacaacgcgcctgtagttgtgcgcaatggtgaactcctggaattggaatgcgatcgcatgccggtgggacagggcggaagtaatgagccatttagactttttacttttgaaacaaaaccttccgacattctttatttgtataccgatgggtatcctgatcagtttgtggacccaaaagaaaaaaatttctgtacaaacgttttcatgatctgttggtag

SEQ ID NO: 6036 - protein, 314 aa, Unknown
  Obtained from environmental sample
  DOMAIN (158)...(310): Stage II sporulation protein E (SpoIIE)
  misc_feature (1)..(314): Xaa is any amino acid
MYSQLNNKPKSDFFQLKYLSLKDSVNNLEKLASIAEIENNRALERLEAEKQKENAISDMKRGAEKRMQNLVTGFVVFSFIMVLIFSIIIFRRFKFSKKQNEIIEEKQKEILDSIHYAKRIQSALLAHRDYIDSHLKDNFILFKPKDIVSGDFYWAANRDNKFYLASCDSTGHGVPGAFMSLLNIGFLGEAIKEKNILEPNKILNHVRERLIDGISKEGQKDGFDGILICVDKQNSKLTYAAANNAPVVVRNGELLELECDRMPVGQGGSNEPFRLFTFETKPSDILYLYTDGYPDQFVDPKEKNFCTNVFMICW

SEQ ID NO: 6037 - DNA, 948 bp, Unknown
  Obtained from environmental sample
  misc_feature (1)..(948): n is a, c, g, or t
gtgaagcaccttaacccaagcctgatctacctgtggttaacgatttacataagcttcagtttagtcgtttattccactttcttatttcctcaactccaggtcaaaaactatttttcgcttaccggcaaaaaagatgcgccggtcaatgcttttgtgcaggataacagcggatttctctggctgggcactaatgacggggtttacaaatttgacgggcgcacagcggcacagatcggaaaagagtaccaggtattaaaacagcaggtatcagcgatctttatcgacagaactgaaaccttgtggataggtaccaaatcaggtaaggtctattttctttcaggtaccaggctggattccttgaaaatgcccggtgccaatgaggaaaaaataacctcgttcaacgaactcgacggaaagttatggatcggtacttatggtaacggcctgtacacttatcaaaatggccaggtcgctcattttaatgttgaaaatggcctgagcgacaatgtgatctacaaaatcaccagcgataaagtcaaaacgctatggtgcggcactgatgccgggatcacagagatcgttacgggaggtgcgaaaccggcatttaagatcatttcagacaaacatggactgcctgataacatcgtccgggatatttcttttgaggaaaaacagctgctcattgccatgcaggactctgggctttgttcttataatcttgaaaaaggccgcatcgaanaaaatatgttttcgagcggttggagcctcggtgcggtcataaacgccaataacctgggccgcaacaagctcatcattgctaccgaaaagagcggcctgctggtgttcgagaacggcgggatgtttagctataactacgaaagctatttgcagtcgtcatccattaccagctgctcattgaccgcgaaaagcaagtctggatcgctctaa

SEQ ID NO: 6038 - protein, 315 aa, Unknown
  Obtained from environmental sample
  misc_feature (1)..(315): Xaa is any amino acid
MKHLNPSLIYLWLTIYISFSLVVYSTFLFPQLQVKNYFSLTGKKDAPVNAFVQDNSGFLWLGTNDGVYKFDGRTAAQIGKEYQVLKQQVSAIFIDRTETLWIGTKSGKVYFLSGTRLDSLKMPGANEEKITSFNELDGKLWIGTYGNGLYTYQNGQVAHFNVENGLSDNVIYKITSDKVKTLWCGTDAGITEIVTGGAKPAFKIISDKHGLPDNIVRDISFEEKQLLIAMQDSGLCSYNLEKGRIEXNMFSSGWSLGAVINANNLGRNKLIIATEKSGLLVFENGGMFSYNYESYLQSSSITSCSLTAKSKSGSL

SEQ ID NO: 6039 - DNA, 786 bp, Unknown
  Obtained from environmental sample
  misc_feature (1)..(786): n is a, c, g, or t
ttgaatttcaccattggtacgaattatgcttcggataaactgaatttccttactttcggaacatcgaaaatcatacttatgcaaaaattatcgtttttactgatcggacttttcatttccgttcaatcattctcacagaaaaaagagatcaccaatgaactgatttgggcgagccgaacattttctgccaaatcggtagatgaagttcgttcgatgaaagacggcgaacatttcaccactcttgaatcttttgaaacatccgaattgttcatcaataaatatgcttataaagattataataagaaaggtacgatcgtctcctcaaaggaattgaaatataacaataaagaattggccattgaagattacgaattcaatgcggatgaatcaatgttgttgattgcaaccgaggtagaatacatttacagaagatcgttcatggcgaattatttcatctatgatatcaataaaaaaacggtgaaaccattggcggatccaaaagatggaaaacaaatgctggccgaattttctccggatggaaaacatgtggctttcgtaaggaataacaatattttcatttacgaattggcaaccggaaaaagaaacggccgtcaccaccgatggagaaaaaaacaagatcatcaatggatcaaccgattggggtttacgaagaggaatcgcccttcgccaaaggtttctattgttcgaatgacagtaaaaaaaatcgcctattatcgttttgatgaatcggaagtaaaagaattcaccatgacttttttacaatga

SEQ ID NO: 6040 - protein, 261 aa, Unknown
  Obtained from environmental sample
  misc_feature (1)..(261): Xaa is any amino acid
MNFTIGTNYASDKLNFLTFGTSKIILMQKLSFLLIGLFISVQSFSQKKEITNELIWASRTFSAKSVDEVRSMKDGEHFTTLESFETSELFINKYAYKDYNKKGTIVSSKELKYNNKELAIEDYEFNADESMLLIATEVEYIYRRSFMANYFIYDINKKTVKPLADPKDGKQMLAEFSPDGKHVAFVRNNNIFIYELATGKRNGRHHRWRKKQDHQWINRLGFTKRNRPSPKVSIVRMTVKKIAYYRFDESEVKEFTMTFLQ

SEQ ID NO: 6041 - DNA, 504 bp, Unknown
  Obtained from environmental sample
  misc_feature (1)..(504): n is a, c, g, or t
atgactacatctaaaactctcttatttatattgtttcttgtaatgactcaattagctgaaggtcaaacaaacaaaaacacatacgttattgtacagattaatcccgtttatgagagcggattagtctcctacacgcctgacccttatctactagtatcgagaaagtttgacgagaactttaaacgggatgttttctttgcctcgatgacaaaaaagaaatttcggaaacagtccgacctaatcgattcaatatctaaacactttgacgtttattcaatcagatttgattccgcccaaaagcaagttcagcaaattattacggacagaaacaactttggaaactcatttttaattcctcttgtgccggaagttagcggagtaaaagcctatctgattacgttgttctcaagacaaataaatagggtacaatatcaagtagttaaaaaagattgtggcctgcattgggaagattgtgaggtaagagtttcaaatattgatttttaa

SEQ ID NO: 6042 - protein, 167 aa, Unknown
  Obtained from environmental sample
  SIGNAL (1)...(18)
  misc_feature (1)..(167): Xaa is any amino acid
MTTSKTLLFILFLVMTQLAEGQTNKNTYVIVQINPVYESGLVSYTPDPYLLVSRKFDENFKRDVFFASMTKKKFRKQSDLIDSISKHFDVYSIRFDSAQKQVQQIITDRNNFGNSFLIPLVPEVSGVKAYLITLFSRQINRVQYQVVKKDCGLHWEDCEVRVSNIDF

SEQ ID NO: 6043 - DNA, 636 bp, Unknown
  Obtained from environmental sample
  misc_feature (1)..(636): n is a, c, g, or t
atgaatagacgtcgaatacgttcatctcgtctctcaagaacaagtgaaaaacagaacaaaaaacaagctgtttattttacggcgggcataatacttctgataattattcttattcagttcggacctttattaatcaatgtttttggtaatgtcgtatatacaataagaggcggagatgcaagcgataaagtcgaagttggagaaaaaatataccaacctcccattttgatcggtattcctgaagctacacaaagcagcaagatatcattttccggcattgctccggaaagtgatggtatcgttgagatttatgttaatgatgatttggaggaagaaatcgatttaggaaataagacagattttaatattgaggatataagaatttctaagggtgaaaatagaatcaagtcaggttttttgaagatgaagacacaagtacatttagtgatgactatgtggtcaaatatatcacagaagaaaccaagcctggaaatctcctccccttccgatnacgctacatttacaaaagcagacnagagcatccaagtgtctggaaaaacggaacgnaaatacagttcagttaattcgtcaggncgatgtcgaaaacaatggggaatctcttacacctgcagctaa

SEQ ID NO: 6044 - protein, 211 aa, Unknown
  Obtained from environmental sample
  misc_feature (1)..(211): Xaa is any amino acid
MNRRRIRSSRLSRTSEKQNKKQAVYFTAGIILLIIILIQFGPLLINVFGNVVYTIRGGDASDKVEVGEKIYQPPILIGIPEATQSSKISFSGIAPESDGIVEIYVNDDLEEEIDLGNKTDFNIEDIRISKGENRIKSGFLKMKTQVHLVMTMWSNISQKKPSLEISSPSDXATFTKADXSIQVSGKTERKYSSVNSSGRCRKQWGISYTCS

SEQ ID NO: 6045 - DNA, 471 bp, Unknown
  Obtained from environmental sample
  misc_feature (1)..(471): n is a, c, g, or t
atgcctgagggaccatccattgtaatcctgactgaagaaacaagtcgttttgtcggaagaaaaatccttgctgtatccggcaatacaaaaaccattgaattagaaagactgctcaacaaaaaagtgctcgatatccggagctggggtaagcacttcctgatttgcttcaatggattcacggtacggattcatttcatgctgtttggatcttatgctattgatgcgcaaaaagaaaaccggctcatcaggttacacctgcgatttacaaatggagagataaatttttatgcctgctcggtaaagattatcgaaggagatataaatcttcactatgactggtctggtgatgtgatgaatgacaagtgggatgccagaaaagcaaggaaaaaaataaaagaaatacctgatggtttgatttgtgatacacttcttaatcaaaacatctttgcaggtgtaggtaatatttattaa

SEQ ID NO: 6046 - protein, 156 aa, Unknown
  Obtained from environmental sample
  DOMAIN (1)...(101): Formamidopyrimidine-DNA glycosylase N-terminal domain
  misc_feature (1)..(156): Xaa is any amino acid
MPEGPSIVILTEETSRFVGRKILAVSGNTKTIELERLLNKKVLDIRSWGKHFLICFNGFTVRIHFMLFGSYAIDAQKENRLIRLHLRFTNGEINFYACSVKIIEGDINLHYDWSGDVMNDKWDARKARKKIKEIPDGLICDTLLNQNIFAGVGNIY

SEQ ID NO: 6047 - DNA, 570 bp, Unknown
  Obtained from environmental sample
  misc_feature (1)..(570): n is a, c, g, or t
ttgaaatggataagttctgataaaagttttgcaacgagattagtggcatttgctattgttgaaggaatattcttttcaggagcgttttgtagtatcgattggatgaaaaaacgaaaactcggattaacaggattagaagatagtaacaatatgattagccgagatgaatctctacatactgcattcgctgtttatttgtacatcacatatataaatcataaactttccgaatctgaaattgaagaaataataaaagaggcagttgaaattgagaaagaattcataactgaatcaatcccatgttctttactcggcatgaattcagcattaatgaaaacttacatagaatttatagcaaatagattaagtgtgcaattaggatataagaaaatatatcccggagcagttcaaccattttcctggatggaagatagaaatctacaggagataactaactttttcgacaaacgatcacagaattacaaaaaaaaagttgttcgtgattattcacaaattgatagaattgatgataaaccgaaattaaattttggtgatgattttgatttctaa

SEQ ID NO: 6048 - protein, 189 aa, Unknown
  Obtained from environmental sample
  DOMAIN (1)...(143): Ribonucleotide reductase, small chain
  misc_feature (1)..(189): Xaa is any amino acid
MKWISSDKSFATRLVAFAIVEGIFFSGAFCSIDWMKKRKLGLTGLEDSNNMISRDESLHTAFAVYLYITYINHKLSESEIEEIIKEAVEIEKEFITESIPCSLLGMNSALMKTYIEFIANRLSVQLGYKKIYPGAVQPFSWMEDRNLQEITNFFDKRSQNYKKKVVRDYSQIDRIDDKPKLNFGDDFDF

SEQ ID NO: 6049 - DNA, 870 bp, Unknown
  Obtained from environmental sample
  misc_feature (1)..(870): n is a, c, g, or t
atgcccgatggaaccgtttggattatctcaaaaaagttgccaaaaaattattttgatgtgggattgctgaggaccaggagtttcattcgcggcagccagggctacacaagaatattttcggttgttgcaatttattccacttccttcaaaggggatttgatcagattattcatgacattgcattgcaaaaaacttcacgtgatttttgttatggatagagcaggattagttggagccgatggaccgacacatcatggggtatttgatttaagttatctgcgtatgattcctggtatggtggttatggctcccaaagatgaagctgagcttcgtgatatgctttacactgctactgaatataaaaatggacctatcgccttaagatatccaagaggctctgcacttggagtagaattaaaagaaggatttacaaaactggaaatcggtaaagctgaaaaattaatcgatggagatgatgttgcattacttgctctcggctctatggtggattattcattaaaagctgctgaaaaactaaaagcatttgggataagttctcaagttataaatatgcgttttgctaaaccccttgataccgaaatgctggatagtgttgcaaagaaatttaacaaaattgttacgctggaggaaaataatttacccggtggatttggcagcgcagtaggcgaatattttattgccaataattataaaaacgatttacaatttattgcattaccggacaaatttattgatcatggaacgcaggaagagcttcatcatttattgggtgttgatcctgatggaattgtagaaaaagtgaaagagtttgtacaattaaataaaatcaaacatagggtttctatctaa

SEQ ID NO: 6050 - protein, 289 aa, Unknown
  Obtained from environmental sample
  DOMAIN (1)...(136): Transketolase, pyridine binding domain
  misc_feature (1)..(289): Xaa is any amino acid
MPDGTVWIISKKLPKNYFDVGLLRTRSFIRGSQGYTRIFSVVAIYSTSFKGDLIRLFMTLHCKKLHVIFVMDRAGLVGADGPTHHGVFDLSYLRMIPGMVVMAPKDEAELRDMLYTATEYKNGPIALRYPRGSALGVELKEGFTKLEIGKAEKLIDGDDVALLALGSMVDYSLKAAEKLKAFGISSQVINMRFAKPLDTEMLDSVAKKFNKIVTLEENNLPGGFGSAVGEYFIANNYKNDLQFIALPDKFIDHGTQEELHHLLGVDPDGIVEKVKEFVQLNKIKHRVSI

SEQ ID NO: 6051 - DNA, 1047 bp, Unknown
  Obtained from environmental sample
  misc_feature (1)..(1047): n is a, c, g, or t
ttgatttcggaggacgttttccctcgatgcagcttgtggctcgatgataaaaagaacgtgacgataaaaggtgctggtattgacaaaacagttttaagcttcaaagggcagatttctggcgcagagggaatcaagattacaaattcttcaggaatcttgcttcaggatctttccgtgcaggatacgaaaggtgatgcaataaaaacgcaaatggtcgatggcattacttttaaaaacgtgaaggccgaatggaccaatggtggtaaaaaagataatggtgcttacggtctttatccggttcagtgtacaaatgttttgatcgatggctgcacggccatcggggcgagtgatgcaggaatttacgttggtcaatccaaatacattatcgttaagaattcgaaagcaactcaaaacgttgcaggaattgaaattgaaaattcctggtatgccgatgtctacgataacgaagcatacaacaacaccggaggcatcttgatttttgaccttcctgatttgattcaaaaagaaggaggttttgtccgcgtttttagaaacaatattcacgataacaatcacattaactttgccccgaaaggaaatacggtaggcaaagttccgcagggtaccggcctgatgattttagcaacacgtcatgtggaagcctttgaaaataagatcgtcaataatatttctgcaggaaccgccatcgtgagttatcacattacagaaaatcctataaacgataaggactacaaaccttttccggccaacatctacatccacgacaactattatgagcgcccaaaagtaaaagcaaccagcaaaggcagacttggaaagatgtataagttcaaactgaggtttggaaaagatgtgccgcatattttgtatgacggcattgaagacaaagacnataaggagcgcaatatctgcatcaagaacaacacgaacgctacgtttgtgaacattgatgccgagaatggattcaaaaataatcacgcgatatgtcaccgcacgattgcacacagtcgccaatcagtcctgtaa

SEQ ID NO: 6052 - protein, 348 aa, Unknown
  Obtained from environmental sample
  misc_feature (1)..(348): Xaa is any amino acid
MISEDVFPRCSLWLDDKKNVTIKGAGIDKTVLSFKGQISGAEGIKITNSSGILLQDLSVQDTKGDAIKTQMVDGITFKNVKAEWTNGGKKDNGAYGLYPVQCTNVLIDGCTAIGASDAGIYVGQSKYIIVKNSKATQNVAGIEIENSWYADVYDNEAYNNTGGILIFDLPDLIQKEGGFVRVFRNNIHDNNHINFAPKGNTVGKVPQGTGLMILATRHVEAFENKIVNNISAGTAIVSYHITENPINDKDYKPFPANIYIHDNYYERPKVKATSKGRLGKMYKFKLRFGKDVPHILYDGIEDKDXKERNICIKNNTNATFVNIDAENGFKNNHAICHRTIAHSRQSVL

SEQ ID NO: 6053 - DNA, 678 bp, Unknown; identical to SEQ ID NO: 2527
  Obtained from environmental sample
  misc_feature (1)..(678): n is a, c, g, or t

SEQ ID NO: 6054 - protein, 225 aa, Unknown; identical to SEQ ID NO: 2528
  Obtained from environmental sample
  DOMAIN (145)...(222): Transcriptional regulatory protein, C terminal
  misc_feature (1)..(225): Xaa is any amino acid

SEQ ID NO: 6055 - DNA, 945 bp, Unknown
  Obtained from environmental sample
  misc_feature (1)..(945): n is a, c, g, or t
ttgatcggaagattatggtatgatacaaaatcgttgacacntgataaaatagagccaatcgaaaaagncagtaacaaaaagggatacgattaccttgatttttctttggcaactgacggattggtggcagaaagagagcaaggaatcacgattgatgttgcgcatatttatttttcgactgcaaagaaaagttacattattgccgatactccgggtcacgtagaatatacaagaaacatggttacaggagcttcgacttctcaggtttctatcattttgatcgatgccagaaaaggtgtaatcgagcaaacttaccgtcactttttcatcaataatttattgagagtaaaagaagtaatcgttgccatcaacaaaatggatttggtggattattctgaagaagttttcaataaaatcaaagctgattttgaggctttaaatgcaaaaagtactttcaaagaacaaaacgtaagctacattccgttaagtgcaatcaacggcggaaacgttgtggacaaatcggagaatatgccttggtacgaaggacaaacggttttagagcatttagaaggattacatgcttctgatgtatacgaagcaggaaaagcacgtttcccagttcagacggttattcgtccaaaaacagaagaatatcacgattttagaggttacgctggaaaattatacggaaactcaatcaaagttggagatgctgtaacagttcttccttctttaacagagtcaaaagttactaaaattcactttttcgataaaacatttgacgaagctacagcaggttcttcaatcacaatcgaattagaaaatgatatcaatgtaacgagaggtgatatgattgtaaaatcaagcgaacttccaaaaattgaaaaagacattaccacaacagtttgctggatggacagtaaaaaacntggttgcgggaactaa

SEQ ID NO: 6056 - protein, 314 aa, Unknown
  Obtained from environmental sample
  DOMAIN (221)...(286): Elongation factor Tu domain 2
  misc_feature (1)..(314): Xaa is any amino acid
MIGRLWYDTKSLTXDKIEPIEKXSNKKGYDYLDFSLATDGLVAEREQGITIDVAHIYFSTAKKSYIIADTPGHVEYTRNMVTGASTSQVSIILIDARKGVIEQTYRHFFINNLLRVKEVIVAINKMDLVDYSEEVFNKIKADFEALNAKSTFKEQNVSYIPLSAINGGNVVDKSENMPWYEGQTVLEHLEGLHASDVYEAGKARFPVQTVIRPKTEEYHDFRGYAGKLYGNSIKVGDAVTVLPSLTESKVTKIHFFDKTFDEATAGSSITIELENDINVTRGDMIVKSSELPKIEKDITTTVCWMDSKKXGCGN

SEQ ID NO: 6057 - DNA, 303 bp, Unknown
  Obtained from environmental sample
  misc_feature (1)..(303): n is a, c, g, or t
atgcttctgatgtatacgaagcaggaaaagcacgtttcccagttcagacggttattcgtccaaaaacagaagaatatcacgattttagaggttacgctggaaaatatacggaaaaactcatcaaagtggagatgctgtaacagttcttcctttctttacagagtcaaagttactaaaattcactttttcgataaaacatttgacgaagctacagcagggtcttcaatcacaatcgaaatagaaaatgatatccatggtacgagagttgaattgattgtaaaatcagcgaacttccaaaattga

SEQ ID NO: 6058 - protein, 100 aa, Unknown
  Obtained from environmental sample
  misc_feature (1)..(100): Xaa is any amino acid
MLLMYTKQEKHVSQFRRLFVQKQKNITILEVTLENIRKNSSKWRCCNSSSFLYRVKVTKIHFFDKTFDEATAGSSITIEIENDIHGTRVELIVKSANFQN

SEQ ID NO: 6059 - DNA, 312 bp, Unknown
  Obtained from environmental sample
  misc_feature (1)..(312): n is a, c, g, or t
gtgaaattgttctacaatcaaagattgctcgaagtgcggcagagcgtttacaagttgctaacgaaaattttgaccatacagaaatatggagttctatacaatctatacttgttgctactggaaatatttcaaagattctttggccaaacaagaagtatgaaaaacgtggtgaaagattgcgagaaatacttaaggtggaaaaaaatagtcctattaataatcgtgaatttagaaaccgtttttttgagcattatgatgaaatggtcgaagaatggtttaaacgccaacccaatggggtgtatatcgatttag

SEQ ID NO: 6060 - protein, 103 aa, Unknown
  Obtained from environmental sample
  misc_feature (1)..(103): Xaa is any amino acid
MKLFYNQRLLEVRQSVYKLLTKILTIQKYGVLYNLYLLLLEIFQRFFGQTRSMKNVVKDCEKYLRWKKIVLLIIVNLETVFLSIMMKWSKNGLNANPMGCISI

SEQ ID NO: 6061 - DNA, 828 bp, Unknown
  Obtained from environmental sample
  misc_feature (1)..(828): n is a, c, g, or t
ttgctaactgaaattgggaatttcgaggaagacagcctcgacgagcaaactcatttagttaacctttaccgcaatatcgtctccgacgctttcgatccatatgtgaatttgattgtcgcaaccttgcagtttgtcgatggagaattcacgggtatccagcaaaccaatctcgggcttggggagcgaaataagtatgaatacgctttggcgagattgaaaccgactcatttattcgatgggtacaatccgatcgtacgaaatgctgtttctcactccggtactgaaggtgttgtctacgaagatggtcgggtcgtattccgagaaataaagaggggaacggcacctgttataaaggtggaaaagtggacaaaccaggtcctgcgcgaaaagatttttcaactcatggactttgttcatgccatcgataattgcatcgaaatcattggctttgatacaagtgatattgtcaaggggaataaaaacctttcaaacaagttttttgatgagattctgacaaaggacgacaggctggaaatccataaggagctagagtctcaggttaatattatcttaagtcaagaatccatcgactacgaaaccaaactgaaaatcctgagtgcaatattttcaaatgagtgcaagaagcgtggtatgccttttcagggcattgccttcagtaacgaagcaaaattaattcgaatcgaagtaccggcggcacccaccgatttgaacaacgatttggatatcattgataaaactttaaagctaagccgttacggaattattgcggctctcttgtacaaatttcactacaaaaaattcgaataa

SEQ ID NO: 6062 - protein, 275 aa, Unknown
  Obtained from environmental sample
  misc_feature (1)..(275): Xaa is any amino acid
MLTEIGNFEEDSLDEQTHLVNLYRNIVSDAFDPYVNLIVATLQFVDGEFTGIQQTNLGLGERNKYEYALARLKPTHLFDGYNPIVRNAVSHSGTEGVVYEDGRVVFREIKRGTAPVIKVEKWTNQVLREKIFQLMDFVHAIDNCIEIIGFDTSDIVKGNKNLSNKFFDEILTKDDRLEIHKELESQVNIILSQESIDYETKLKILSAIFSNECKKRGMPFQGIAFSNEAKLIRIEVPAAPTDLNNDLDIIDKTLKLSRYGIIAALLYKFHYKKFE

SEQ ID NO: 6063 - DNA, 747 bp, Unknown
  Obtained from environmental sample
  misc_feature (1)..(747): n is a, c, g, or t
gtgcaggtaatttttttagaaaagaaaattgaagccttacatattacccgcagtatgcaggacagggcagatcaattaacagatgaggctgacaaagtcaatcgtcggctcttaatgatcactcaactttccaacctttcattgcagctttatagctggtatatcaaaagcggacatacacgaaccgaaaaagaggaagcagcattaacgaattatctgcaagaacatttaccgcctgacactttaaaactaaccggtttttatgagcgactttatctataccagagttattgctggtatgcatttatccggcaagactttctcttatattatcgcaatacacaaaaatgggttgatctttttacggccgaaccttttatgatagaggtagaaaccattcactatataaaaggaatgcacaacctgctaaatgctcacttcgatttacagaattatcaaaaatttgatgaggccttaaaacagtttgaaaagttcgccacttctgaggttagtaagaacaatgacaacaaccgtatccaggtgtttatttatttatatacagcaaagcttaataaacattttatggacggcacttttaaagagggaatcaaacttgttcctgaattggaagaaaagctggaggaacattctttatatatggataggcatagggtgcttattttttattacaagatcgcttcgctttattttgggagtggagattatgaaaaagcattgattatttaa

SEQ ID NO: 6064 - protein, 248 aa, Unknown
  Obtained from environmental sample
  misc_feature (1)..(248): Xaa is any amino acid
MQVIFLEKKIEALHITRSMQDRADQLTDEADKVNRRLLMITQLSNLSLQLYSWYIKSGHTRTEKEEAALTNYLQEHLPPDTLKLTGFYERLYLYQSYCWYAFIRQDFLLYYRNTQKWVDLFTAEPFMIEVETIHYIKGMHNLLNAHFDLQNYQKFDEALKQFEKFATSEVSKNNDNNRIQVFIYLYTAKLNKHFMDGTFKEGIKLVPELEEKLEEHSLYMDRHRVLIFYYKIASLYFGSGDYEKALII

SEQ ID NO: 6065 - DNA, 753 bp, Unknown
  Obtained from environmental sample
  misc_feature (1)..(753): n is a, c, g, or t
atgtttaacctgaagaaggacaagtccgggaaacccataagggacgaaaaaggtaaagttatacaaacttcccctaagattcaggaagctggaaagatttgtgagaacctattagagttggatggagaactacccaagaagatagtaaagttcatgtcattgcgcaataggttgagtatattaactggttggcttgagaatccacgccttgcttgggatggtagactccctgctggatcttcaggtatggccaacacttatcgacaacgtcacgtttgtatagtcaatgttcctaaagcgcaagacgatgttttgttaggtaaggaattccgggaactgtttactgttgaaaagggtaataagctcataggatgtgaccaagctgcattagaagcaagatgtgaaggacattggacgtatccgtatgacaacggagagagtgctaacatccttataaatggtgacatccatagtaagatggctaaggtattctttccagtagagacaaaagactttgatataaattccccggacttcagtaaggatgatccaaagttcaagcctttcaggtctatatcaaaaaattcgaggttcggaattgtgtacggaagttcacctactaagctttctaagatgatccggaagtcggagaaggaaggtaagaagtatcacgatgctttctgggaagcaaacccagggctcaaaaaatttaaagatcatctcgaacttgtgtgggagagggaaggaaaataa

SEQ ID NO: 6066 - protein, 250 aa, Unknown
  Obtained from environmental sample
  misc_feature (1)..(250): Xaa is any amino acid
MFNLKKDKSGKPIRDEKGKVIQTSPKIQEAGKICENLLELDGELPKKIVKFMSLRNRLSILTGWLENPRLAWDGRLPAGSSGMANTYRQRHVCIVNVPKAQDDVLLGKEFRELFTVEKGNKLIGCDQAALEARCEGHWTYPYDNGESANILINGDIHSKMAKVFFPVETKDFDINSPDFSKDDPKFKPFRSISKNSRFGIVYGSSPTKLSKMIRKSEKEGKKYHDAFWEANPGLKKFKDHLELVWEREGK

SEQ ID NO: 6067 - DNA, 447 bp, Unknown
  Obtained from environmental sample
  misc_feature (1)..(447): n is a, c, g, or t
ttgtacattcaagcttatgaatatgtactgactaaaagcataacacgaccgacggtttgctttatcatcataccatctgaagtttataaaaaattatcttctattagatacgccgggcaaagttattttaatttgagacggtatttgaaagcgcagttaatagttatgcctcaagctatccctgtgcaaattattttagaagatacaattactcaaaaaagaaaatcattacaagacttgtccatgcaggcatggaatttttgtgttgcaaactattacaagagcagttgcattccctggacacttactttaaaggataagcacacttgcttcataggcattagttttcataaggttttaactgctgataaaaatacaaatgcgtcaagcgtagcgcaagcattaaactatgagggcaaagggctattttttgtggtgacattttga

SEQ ID NO: 6068 - protein, 148 aa, Unknown
  Obtained from environmental sample
  misc_feature (1)..(148): Xaa is any amino acid
MYIQAYEYVLTKSITRPTVCFIIIPSEVYKKLSSIRYAGQSYFNLRRYLKAQLIVMPQAIPVQIILEDTITQKRKSLQDLSMQAWNFCVANYYKSSCIPWTLTLKDKHTCFIGISFHKVLTADKNTNASSVAQALNYEGKGLFFVVTF

SEQ ID NO: 6069 - DNA, 408 bp, Unknown
  Obtained from environmental sample
  misc_feature (1)..(408): n is a, c, g, or t
atgtttcgcaatattagaatatattacttaattgctctcaaatttatttcccggaatacaaaagccctgtctgtattatttatactgcttttgggattgggaatttttttatggcaggccgcctttttttctcctaaggatagtattacagaaggttttataggtacttttcaggaacatgatttacccatagaagtcacaaggcttttatctaaaagccttgttgattccgataatggtggtaattttaaaccaggtttggtagaaggttgggaaacaaacaatgatgccacaaattataaatttaaactcaaaaatgatttaaagtggacagacggtaccagtattaagtcttcagatttggaatttgctataccagacgtggaggtatctaccagagacaaataa

SEQ ID NO: 6070 - protein, 135 aa, Unknown
  Obtained from environmental sample
  misc_feature (1)..(135): Xaa is any amino acid
MFRNIRIYYLIALKFISRNTKALSVLFILLLGLGIFLWQAAFFSPKDSITEGFIGTFQEHDLPIEVTRLLSKSLVDSDNGGNFKPGLVEGWETNNDATNYKFKLKNDLKWTDGTSIKSSDLEFAIPDVEVSTRDK

SEQ ID NO: 6071 - DNA, 339 bp, Unknown
  Obtained from environmental sample
  misc_feature (1)..(339): n is a, c, g, or t
atggttccacaattcattaaagataaagaactccctcataagcctggtgtatacattttcaaagatggatccgggaagactatttatgttggtaaagccattgatttaaataacagagtcaactcatatttctcttcacatcacactggcagttttaaaacagaggctttgattgaaaaaattcgggatgttgaaactattttagtggaatcagaattagaggccttaattttagaagccaatttaatcaaaaaattcttgcctccatacaatatccgtttaactgatgataaagactacctatatataaagataacaaaagaaccttttcccaagtaa

SEQ ID NO: 6072 - protein, 112 aa, Unknown
  Obtained from environmental sample
  DOMAIN (14)...(97): GIY-YIG catalytic domain
  misc_feature (1)..(112): Xaa is any amino acid
MVPQFIKDKELPHKPGVYIFKDGSGKTIYVGKAIDLNNRVNSYFSSHHTGSFKTEALIEKIRDVETILVESELEALILEANLIKKFLPPYNIRLTDDKDYLYIKITKEPFPK

SEQ ID NO: 6073 - DNA, 561 bp, Unknown; identical to SEQ ID NO: 1287
  Obtained from environmental sample
  misc_feature (1)..(561): n is a, c, g, or t

SEQ ID NO: 6074 - protein, 186 aa, Unknown; identical to SEQ ID NO: 1288
  Obtained from environmental sample
  misc_feature (1)..(186): Xaa is any amino acid

SEQ ID NO: 6075 - DNA, 702 bp, Unknown
  Obtained from environmental sample
  misc_feature (1)..(702): n is a, c, g, or t
ttggccaaaaaagggggggcaacccggaaattggaatttattggggggcctgaaggccagccaaggtttttttccaaaagccaattttttggggggatagtccatttttgggccggaacccaatacaaacataagcccgataaggcttgcccattcccggcacctttccccggaggaacaaaggagccatcggttttgcagggaagcttagacttgcatgtcattccgaaatcgaaaagcagaattattttgccccgtaaaaattatttctatccggatctcccgaaaggttaccaggtgtcgcagcatactacgccaatatgcaaagggggattcataacaatcagcactttcgctggtgaaaagaatgttcagttgaacaggatccatctggaagaagatgcgggtaaaagtcttcatgatgtgtatactgaggaaacagcgctcgattataatcgggccggcgtgtctcttttggaaattgtcactgaaccagacttaagtagcggcgaggaagcacatgcttatttaacggagctccgtaagctcgtccggtatctggaaatatgtgatggaaatatggaagaagggagttttcgttgtgatgcaaatatttccgtaagaaaaccaggtgaagaaaaactggggacaaaagtagaagtaaaaaatcttaactcaatcaggaatgaaaaatgcatctga

SEQ ID NO: 6076 - protein, 233 aa, Unknown
  Obtained from environmental sample
  DOMAIN (35)...(231): PET112 family, N terminal region
  misc_feature (1)..(233): Xaa is any amino acid
MAKKGGATRKLEFIGGPEGQPRFFSKSQFFGGIVHFWAGTQYKHKPDKACPFPAPFPGGTKEPSVLQGSLDLHVIPKSKSRIILPRKNYFYPDLPKGYQVSQHTTPICKGGFITISTFAGEKNVQLNRIHLEEDAGKSLHDVYTEETALDYNRAGVSLLEIVTEPDLSSGEEAHAYLTELRKLVRYLEICDGNMEEGSFRCDANISVRKPGEEKLGTKVEVKNLNSIRNEKCI

SEQ ID NO: 6077 - DNA, 873 bp, Unknown
  Obtained from environmental sample
  misc_feature (1)..(873): n is a, c, g, or t
atgctgccacgcaatagcatgcaaaaaaatatgtctggtacagtaaccgaagaacaatacgatggcccctttgtacaatatgcaggcaaccaggttctggtaaattatatcaacgacgataatggaacaaaaactgtaaaaactgaaacccttactttggggcaaaaagaacagttatcactaaaagtaatgacagatattccgggcaagtcttttcacgtagctctgaagaaaaaaatgcagaatgaaaaatgtgagtttaataagccggccaacttatttgttctttccgatattgaaggcaattttggcgccttacgaaaattactggtggcaaataaaatcatcaatgaagatctgaaatggaagtttgataacgggcacctggtgttgattggtgatttttttgatcgtggtcagcaggttacagaattgctttggtttatttactctttagaagagaaagcaaaagcggatgggggttatgttcattttattttaggcaatcatgaaataatgaacctcagtgctgacctgcgttatgtaaataaaaaatatttagagaatgcgggtttgctaaatcaaaattatgtttcgctttatgatgaaaattcggagttgggaagatggctgcgcacaaaaaatatagttgaaaaaatcggtgatatcctttttacccacgggggtatatcagatgaaattaataaactgaacctgtccattgctgatataaataaattagcccgaccgtattatggcgacactacatttaattacacaaatccggggtcagatattctccttagcgataacgggcctttctggtaccgtggctattatgaaaaaaacaatcccgatataccttacaaatag

SEQ ID NO: 6078 - protein, 290 aa, Unknown
  Obtained from environmental sample
  DOMAIN (91)...(274): Calcineurin-like phosphoesterase
  misc_feature (1)..(290): Xaa is any amino acid
MLPRNSMQKNMSGTVTEEQYDGPFVQYAGNQVLVNYINDDNGTKTVKTETLTLGQKEQLSLKVMTDIPGKSFHVALKKKMQNEKCEFNKPANLFVLSDIEGNFGALRKLLVANKIINEDLKWKFDNGHLVLIGDFFDRGQQVTELLWFIYSLEEKAKADGGYVHFILGNHEIMNLSADLRYVNKKYLENAGLLNQNYVSLYDENSELGRWLRTKNIVEKIGDILFTHGGISDEINKLNLSIADINKLARPYYGDTTFNYTNPGSDILLSDNGPFWYRGYYEKNNPDIPYK

SEQ ID NO: 6079 - DNA, 339 bp, Unknown
  Obtained from environmental sample
  misc_feature (1)..(339): n is a, c, g, or t
ttgaatttatacaacaatgctttttatgctgtaaaacaaaaaagcaaagaagcgaatggcgcttataagcccctcgtttccgtaactacaaaaaaagttggtaataaaatggaattatcaataaaagataacggtgacggtattccgcanaaagtacttgataaaatttttcaaccttttttcaccacaaaacctgcaggacagggaactggccttggcttatcactaagctatgatgttattaaagcatatggaggagaggtgaaggtagaaacaaaagaaagagagttcgccgagtttatcattcatatgcctatcactaaatacagcgaggcttaa

SEQ ID NO: 6080 - protein, 112 aa, Unknown
  Obtained from environmental sample
  DOMAIN (4)...(107): Histidine kinase-, DNA gyrase B-, and HSP90-like ATPase
  misc_feature (1)..(112): Xaa is any amino acid
MNLYNNAFYAVKQKSKEANGAYKPLVSVTTKKVGNKMELSIKDNGDGIPXKVLDKIFQPFFTTKPAGQGTGLGLSLSYDVIKAYGGEVKVETKEREFAEFIIHMPITKYSEA

SEQ ID NO: 6081 - DNA, 636 bp, Unknown
  Obtained from environmental sample
  misc_feature (1)..(636): n is a, c, g, or t
atgattgcaccccngnttcagaaaaagcttcttaatgatatttttgtgcataactcttcaccaatgaaaaatcttttaattctttttgcctcttttattttgagttctgtttcttttgctcaaacaagtgtgaacaaacttcctactattgacaaatcgccaatggacatggcgtactaccctatcaattacccggttttaaaaattcaggataaggccaccggacctttgattgcacgggttatatatagccggccgcaaaaaaacaaccgtgtagtatttggcgagctggtagaatataatactgtttggcgcatgggagcaaacgaggccactgaaatagagttttatcgggatgtaaaaattggcggtaaaaaaattttaaaaggaaagtataccttatatgcccttgtaaccccaaatgagtggacagtaattttgaataaagaaacggatacctggggcgcattcaaatacgatcagaaaaaagatgttgttcgaacaaccgttcctgtgcaacaaaatatggagcctgcggaagtatttacggtattttttgaaaagataaccaacggcattaatttaaatattgcatgggacacggtacttgtttcattgccaatactattgaaataa

SEQ ID NO: 6082 - protein, 211 aa, Unknown
  Obtained from environmental sample
  misc_feature (1)..(211): Xaa is any amino acid
MIAPXXQKKLLNDIFVHNSSPMKNLLILFASFILSSVSFAQTSVNKLPTIDKSPMDMAYYPINYPVLKIQDKATGPLIARVIYSRPQKNNRVVFGELVEYNTVWRMGANEATEIEFYRDVKIGGKKILKGKYTLYALVTPNEWTVILNKETDTWGAFKYDQKKDVVRTTVPVQQNMEPAEVFTVFFEKITNGINLNIAWDTVLVSLPILLK

SEQ ID NO: 6083 - DNA, 333 bp, Unknown
  Obtained from environmental sample
  misc_feature (1)..(333): n is a, c, g, or t
atgatgagaacaatccatatagctttgagcaagagagtcgatgcaaccactgagcctatagagatacattgtaaggtcagggtgtatatcgcgagcactgatggtaaagtaagagagtatatcgtggtatattatgtttctgcagagaagaagagtaagggaatatattcattgaagagtttattattcgcagcagacatagatnagcgaaaatcttatacgatatttgttacgatacaaataggagacaagacgtgttttggttttagatataagattggatattatcagtatccaagctcacctatgtctgtggaagtggtcagattgtag

SEQ ID NO: 6084 - protein, 110 aa, Unknown
  Obtained from environmental sample
  misc_feature (1)..(110): Xaa is any amino acid
MMRTIHIALSKRVDATTEPIEIHCKVRVYIASTDGKVREYIVVYYVSAEKKSKGIYSLKSLLFAADIDXRKSYTIFVTIQIGDKTCFGFRYKIGYYQYPSSPMSVEVVRL

SEQ ID NO: 6085 - DNA, 801 bp, Unknown
  Obtained from environmental sample
  misc_feature (1)..(801): n is a, c, g, or t
atgcaccaactatacaacccgtttgtatctgttattacacccttttataatggagaaatttatttggtagaaaccattgaaagtgtaatgcagcaggagtatacaaattgggagctgctcttaattgatgatggttcttccgatggtagtacaagtattgcgaaattttattcaataaaatatccaaataaaatttattatttagaacatgataatcatgtgaacaggggaccatctgcaagcagaaatcttggcattgctaaagcgaagggtgaactattggctttccttgattctgatgattattggttgcctggtaaattaaaaaagcaggtcggactatttaatcagtatcccaatgcaacagcattatgtgaggcaactaaattctggagtagctggtctgaccaccagaataaggatgttataatacaggtggcaaagaataccgacaaattatattatgcaccatctttaacttcgttggtttaccccttgngaaatggctcaggattttgtacatgcggcctcattgttaaaaaaaagctgcttgataaaattggcggttttgatgaaaactttataggtaaaaaccaattatttgaagaccaggtgctttttgtaaaactttacttgcatgccaatgtttacatttcttcattatgtaacaatttttacaggcagcggcccagattcattaatgcatggtctttatacagaaaggatattcttcagagggaaaactttttttttcntaattggcttagaacctatttagaaaaggatttcaatcaaggataa

SEQ ID NO: 6086 - protein, 266 aa, Unknown
  Obtained from environmental sample
  DOMAIN (10)...(188): Glycosyl transferase
  misc_feature (1)..(266): Xaa is any amino acid
MHQLYNPFVSVITPFYNGEIYLVETIESVMQQEYTNWELLLIDDGSSDGSTSIAKFYSIKYPNKIYYLEHDNHVNRGPSASRNLGIAKAKGELLAFLDSDDYWLPGKLKKQVGLFNQYPNATALCEATKFWSSWSDHQNKDVIIQVAKNTDKLYYAPSLTSLVYPLXNGSGFCTCGLIVKKKLLDKIGGFDENFIGKNQLFEDQVLFVKLYLHANVYISSLCNNFYRQRPRFINAWSLYRKDILQRENFFFXNWLRTYLEKDFNQG

SEQ ID NO: 6087 - DNA, 372 bp, Unknown
  Obtained from environmental sample
  misc_feature (1)..(372): n is a, c, g, or t
atggttatgagaacgacaagcgaaaggaagaacatgtacgaggtgatcaacggcatgatcatggacaaactgcaaaacggtaaaatgccctggaaacagacctggaataatttcggcccggcaaggaactacgtaagcaagaaaccttatcggggaatcaatgcattggtccttaacaataccgattatgaatatccattgttcctaacattccttcaagtcaagcagcttggtggatatatcaagaaggggtcgaagagtattgaagtaatctactggaagactttggagttcgagaatgatgagaagatcaagcgcatcccgtttctcaggtactataacgtgtttaatgtagaatgtgggaaggggtga

SEQ ID NO: 6088 - protein, 123 aa, Unknown
  Obtained from environmental sample
  misc_feature (1)..(123): Xaa is any amino acid
MVMRTTSERKNMYEVINGMIMDKLQNGKMPWKQTWNNFGPARNYVSKKPYRGINALVLNNTDYEYPLFLTFLQVKQLGGYIKKGSKSIEVIYWKTLEFENDEKIKRIPFLRYYNVFNVECGKG

SEQ ID NO: 6089 - DNA, 783 bp, Unknown
  Obtained from environmental sample
  misc_feature (1)..(783): n is a, c, g, or t
gtgaacgagctcacgaaagaacaagcagaacatttggtcgcaaagggcatccattcagatgatatcgttgaaatactttactttaaagcgccagaaaagaatacttttcattccacggagagacgtacaattcacaagatagagataccgtttcgctcactacccaaaggtagggactatgattggatgtatggctttaagaagcaacaaatagctgagggtatcgggctgtgtcctagagagaggaacatgttcctcgcaggcaagctatactatgaaccagataccgttacggctgacgaaaaaaaggaaatatttattgatgataccaacaacctgaagccagagatcgaatgggaatttctgggtattaaatatatgcgacaggagatagatgagacagaaaaaaggcgcctagccgaaatgattgccgctgagaaaagattgaaaatggatttgctggataaatatttgcagcaagctggtagcagtataaaaaaacttgcaaaagaaaatattgatgaggctgttgaattgtactaccgggtcatggattttaaagagcgtaggctgaatgtagttgggaaagtacccatatatattgaccttgatagctttttgcatatttacatgcggcatgttgaggagttcaaagtgacagatcactttgaagacaaagacaacttccagtgggaggaagatgacgtatatgctgtgatggctaacattattaaagaagttgatgaagagattcaagacttctttgctaaaaatcccgggtaa

SEQ ID NO: 6090 - protein, 260 aa, Unknown
  Obtained from environmental sample
  misc_feature (1)..(260): Xaa is any amino acid
MNELTKEQAEHLVAKGIHSDDIVEILYFKAPEKNTFHSTERRTIHKIEIPFRSLPKGRDYDWMYGFKKQQIAEGIGLCPRERNMFLAGKLYYEPDTVTADEKKEIFIDDTNNLKPEIEWEFLGIKYMRQEIDETEKRRLAEMIAAEKRLKMDLLDKYLQQAGSSIKKLAKENIDEAVELYYRVMDFKERRLNVVGKVPIYIDLDSFLHIYMRHVEEFKVTDHFEDKDNFQWEEDDVYAVMANIIKEVDEEIQDFFAKNPG

SEQ ID NO: 6091 - DNA, 534 bp, Unknown
  Obtained from environmental sample
  misc_feature (1)..(534): n is a, c, g, or t
atgctgggttattataaattacctgaggctaccaaggaagccattgatacggatggctggttccacaccggtgatatcggaacttttgtggaaggaaaattcctgaaaataacagatcgtaaaaaagaagtatttaaaaccagtggaggtaaatatattgcgccgcagccgatggaaaataagttcaaagaatctccatttattgaacaaattatggtaattggagagaatgagaaattccctggagcattaattaccccggcctgggattatttaaaaggatggtgtaccaaaaacggaatctctttccaaagcaatgaagatatcattcaaaaaccggaagtattagctgtttaccaaaaggaagttgatttctacaataatgaattcggaagctgggaaaccattaaaaaattcgaattattaccggttgactggagtattgagggtggtgaaatgacccctactttaaagctcaaaaggaagcctattttatcaaaatatgctcaatacgttaccaagatttatagctaa

SEQ ID NO: 6092 - protein, 177 aa, Unknown
  Obtained from environmental sample
  misc_feature (1)..(177): Xaa is any amino acid
MLGYYKLPEATKEAIDTDGWFHTGDIGTFVEGKFLKITDRKKEVFKTSGGKYIAPQPMENKFKESPFIEQIMVIGENEKFPGALITPAWDYLKGWCTKNGISFQSNEDIIQKPEVLAVYQKEVDFYNNEFGSWETIKKFELLPVDWSIEGGEMTPTLKLKRKPILSKYAQYVTKIYS

SEQ ID NO: 6093 - DNA, 327 bp, Unknown
  Obtained from environmental sample
  misc_feature (1)..(327): n is a, c, g, or t
atggccaactctttaactaaggaaaattatttaaaagccatatttgctttgtctaaccaaacagatgaggtaactgtaaatgagctttccaaaaatctaggtataaaaatgcctacagttaccagcatgatgaaaaagctggcagaaaaaaagctggtgaactatgaaagctacagacctgtacgattaacggaaaaagggaaaaaagaagctgggatcatcatacgncaacatcgcctgaccgaaatgtttttagtggagataatgggttttggctggaaagagtgcatgaaattgcgaaacagtggagcatgtacaatcgcctga

SEQ ID NO: 6094 - protein, 108 aa, Unknown
  Obtained from environmental sample
  DOMAIN (4)...(62): Iron dependent repressor, N-terminal DNA binding domain
  misc_feature (1)..(108): Xaa is any amino acid
MANSLTKENYLKAIFALSNQTDEVTVNELSKNLGIKMPTVTSMMKKLAEKKLVNYESYRPVRLTEKGKKEAGIIIRQHRLTEMFLVEIMGFGWKECMKLRNSGACTIA

SEQ ID NO: 6095 - DNA, 402 bp, Unknown
  Obtained from environmental sample
  misc_feature (1)..(402): n is a, c, g, or t
ttgtttgtataccgaaatggatggaactccggaagaaaaacaatgtgggagaaaaatcgtgaagaagctaatacgggtcccgcctacatttcctcaggtctaattatgacagcacacttaaagacgatggctttacanttgatttgctttccaaaacagggtcaacaaatcgaacggtctgctaatcctatgaaaccgctaatattctatgaaatcaaccggcaaggtaattatggtttctatcaaagccgcattgttactcaaaagaatccggccaagaaatctcaaaaaaaagcttcctggaccaaaaaccaattcttagttaattttcaaaggnttatattaaacaagtggtttcttcaaacaaaattggggaaccgggttttggaccggaaattttaa

SEQ ID NO: 6096 - protein, 133 aa, Unknown
  Obtained from environmental sample
  misc_feature (1)..(133): Xaa is any amino acid
MFVYRNGWNSGRKTMWEKNREEANTGPAYISSGLIMTAHLKTMALXLICFPKQGQQIERSANPMKPLIFYEINRQGNYGFYQSRIVTQKNPAKKSQKKASWTKNQFLVNFQRXILNKWFLQTKLGNRVLDRKF

SEQ ID NO: 6097 - DNA, 360 bp, Unknown; identical to SEQ ID NO: 3945
  Obtained from environmental sample
  misc_feature (1)..(360): n is a, c, g, or t

SEQ ID NO: 6098 - protein, 119 aa, Unknown; identical to SEQ ID NO: 3946
  Obtained from environmental sample
  misc_feature (1)..(119): Xaa is any amino acid

SEQ ID NO: 6099 - DNA, 942 bp, Unknown
  Obtained from environmental sample
  misc_feature (1)..(942): n is a, c, g, or t
atgaaaatattttttttaagtttcaatattaaacatgtttttgttattgtgttgctgttgccatttagttgttgggcgcaaaaaataatgatagatgaacaggataataattccatncaaagaaaaattgagctctctcaattaaaattggtgtcaacggctaagacaaaaatgaatttttctcttggtagtattggcccttcaatttatttacgattaagcgggtctggcacaggagccgaaatagttaatgtaggcgataaggttatttttcatttagataatgacagcactgttactgttcaatcagaatctttacaaacctacgatgttgagggtattacaagtacttacaaccacatttataatctttcacctgatgggttgaaaaaattgagcaaccataatttaaaacgattaaaaaaatatcatgcagaagaatttgatgatattgttatccctaatcaaagtggaagacaggtaaaaaattttagtaaatttctttttgaagaacttaaaaaaagaaatctactccagccggatagtttattgatagccaaaaaaaagacgccatcggattctcttcggaaaacagcgcaggaagaaacaagtcctcaattaaaaaacagtagcgctgcatttcctggtggagaagaagtatggatgaattttttgaaaaggaatttgaaccctccttctgaactaaaagcaaatgaaaaaaaggtcgtgcaggtgcagtttatggttaatgaagatggttcgataaaagaagtagaaattgtgcaatccgccgggccttcatttgacaaagaagtaataagggtactaaaaagaatgccttactggaagccggctgttgaaaatggccgccgggttaataccctcattacaaaatcaataacttttattcgggatgatgcctctgcaagtttgtcaaaataa

SEQ ID NO: 6100 - protein, 313 aa, Unknown
  Obtained from environmental sample
  misc_feature (1)..(313): Xaa is any amino acid
MKIFFLSFNIKHVFVIVLLLPFSCWAQKIMIDEQDNNSXQRKIELSQLKLVSTAKTKMNFSLGSIGPSIYLRLSGSGTGAEIVNVGDKVIFHLDNDSTVTVQSESLQTYDVEGITSTYNHIYNLSPDGLKKLSNHNLKRLKKYHAEEFDDIVIPNQSGRQVKNFSKFLFEELKKRNLLQPDSLLIAKKKTPSDSLRKTAQEETSPQLKNSSAAFPGGEEVWMNFLKRNLNPPSELKANEKKVVQVQFMVNEDGSIKEVEIVQSAGPSFDKEVIRVLKRMPYWKPAVENGRRVNTLITKSITFIRDDASASLSK

SEQ ID NO: 6101 - DNA, 675 bp, Unknown
  Obtained from environmental sample
  misc_feature (1)..(675): n is a, c, g, or t
atgaaagaggcaatcctaaccaaaaagaaatttgggatggactctctttatagtagttggttcgtaaaagaatcaacccactttatatttcactttcaggacactaccgggcagaatatagaaaattatattcaaaaaatggaatttgcttatgatacaattaatagtttttttaatgccagtttgccaaaaaaaattgacttctttatttggattgattctgatgtggcaaaaagtcatttgctaacaaagaatgcgcatactttaacttatgtttgtgtaactcatactacatttaaaatcagaagtggacatcacgagctaacacattctatttctcattatgcagttgaaataagtagaagaaatgaactaattagagaaggaatatgcacttattttgatttatataaaataaattatttagattatattaaaatcaggaaaagtaataaagtatccatcaaagacatttggaataaaccagattcaataaatgattatttactttaccctctaggtgctgaattagtaaaacgattaattaataattttggaaaggaacaatttttaaaatttatgcaggatcaatcttataacaatgctaaaattgtatttggaaataagttaagcaatgtaattgacacattggaaaatgaaataaatggtaaataa

SEQ ID NO: 6102 - protein, 224 aa, Unknown
  Obtained from environmental sample
  misc_feature (1)..(224): Xaa is any amino acid
MKEAILTKKKFGMDSLYSSWFVKESTHFIFHFQDTTGQNIENYIQKMEFAYDTINSFFNASLPKKIDFFIWIDSDVAKSHLLTKNAHTLTYVCVTHTTFKIRSGHHELTHSISHYAVEISRRNELIREGICTYFDLYKINYLDYIKIRKSNKVSIKDIWNKPDSINDYLLYPLGAELVKRLINNFGKEQFLKFMQDQSYNNAKIVFGNKLSNVIDTLENEINGK

SEQ ID NO: 6103 - DNA, 975 bp, Unknown
  Obtained from environmental sample
  misc_feature (1)..(975): n is a, c, g, or t
atgttttttgaattaggaaatggcaaatgggatgtttcaggcctgcgtcaaaacctgcaaaaaattctgccggaccaatcattttttgaaaagcttgaaatgaaagttgtgcttccctctgttggagagcgggtatttgaattaaatgcgcggcagttactcaatgagaatagtaatgagcaattaatcctactcgctatccaggacgttactgaccgtaaaatatttgaacaggaattggagcgtcaggtgatagaacgaacaaaagaattaaaagaagcgaacctcagccttcagcattccaatgaaaacctccagcaatttgcatctattgcgtctcacgacctacaggaacccctccgtaagatcaaaacgtttaccgcgatgttaaatcgtcaatttgctactcatatagaagacgagggcaaagagatcatcaataaaataaagttgtctgctgaccgtatgtctgaattgatcaaagctgttttgagatattcaaaaattgttcatgctgaaaaagaatacctggtcaccaacctggatgaggttttaaaaaatgtggtggatgatcttgatctgctcatatcagaaacgaaagcggaactggtttataaggaaccgctgcctcanatagatgcaattcctctgcagatgaaccaattattttataatctcctgaccaatgctattaaatttcgccgggaagatgttgcgccacggattaccataacatcaagaatgatcaacgctgacgagatcaaaaaatatccggattttaaagaagaactgccgcacgtggaaaatctggntttcgataatggggttggatttgacaacaatttgnagagcagattttcaagatatcgaaagttatacacggctgatgaatttaaagcactggaattgggtggccctatgcaaccgatcggtagaaatcatcacggccagtatttgctaagtcaaaggaaatga

SEQ ID NO: 6104 - protein, 324 aa, Unknown
  Obtained from environmental sample
  DOMAIN (104)...(172): His Kinase A (phosphoacceptor) domain
  misc_feature (1)..(324): Xaa is any amino acid
MFFELGNGKWDVSGLRQNLQKILPDQSFFEKLEMKVVLPSVGERVFELNARQLLNENSNEQLILLAIQDVTDRKIFEQELERQVIERTKELKEANLSLQHSNENLQQFASIASHDLQEPLRKIKTFTAMLNRQFATHIEDEGKEIINKIKLSADRMSELIKAVLRYSKIVHAEKEYLVTNLDEVLKNVVDDLDLLISETKAELVYKEPLPXIDAIPLQMNQLFYNLLTNAIKFRREDVAPRITITSRMINADEIKKYPDFKEELPHVENLXFDNGVGFDNNLXSRFSRYRKLYTADEFKALELGGPMQPIGRNHHGQYLLSQRK

SEQ ID NO: 6105 - DNA, 447 bp, Unknown; identical to SEQ ID NO: 3077
  Obtained from environmental sample
  misc_feature (1)..(447): n is a, c, g, or t

SEQ ID NO: 6106 - protein, 148 aa, Unknown; identical to SEQ ID NO: 3078
  Obtained from environmental sample
  misc_feature (1)..(148): Xaa is any amino acid

SEQ ID NO: 6107 - DNA, 990 bp, Unknown
  Obtained from environmental sample
  misc_feature (1)..(990): n is a, c, g, or t
ttggattcgttgttacccttttcccttaaaattgatttccctcgcctcagggtggcaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaacaccttggcaataaagttaaacttgaaagtgaagtaacatcaattcaaaaaacagaaaaaggattccaggttaattttatacagaatggaactcagcataatattgattgcaataaaattatttcaactatcccggcttatattgccgtagatctgttttcacattttgatgatggtttaataaaacattttaatgagatatattatccgcctgtccttgtcctattccttgtttataaaaaagaaaacattaaacgtccattagatggatttggttttcttataccttctaaagaaagaaaatctttccttggtgcaatctggagttcagtaatattcccaaacagatctgatgatgacacggcttcatttactttgtttgtcggcggtgcaagaaaccccgaaataggaagtattgataaagaaatattaatcggcaaagttaaaaaagagtttgaagatttaatgaaaatttcaggaactcctgaacttcaaacatacaaatactggagtaaagcaattcctcaatacaatattggctatgttgaacacgaaaaatattttgatgaatttgaaagaaaaaatcccggaataattttaagcggcaactaccgcggtggaatttctgtcggggattgcataaagaatgcagcaatagttgcagataaagtaacaaagttttaa

SEQ ID NO: 6108 - protein, 329 aa, Unknown
  Obtained from environmental sample
  misc_feature (1)..(329): Xaa is any amino acid
MDSLLPFSLKIDFPRLRVANXXXXXXXXXXXXXXXXXXXXXXXXXXXXXXXXXXXXXXXXXXXXXXXXXXXXXXXXXXXXXXXXXXXXXXXXXXXXXXXXVKHLGNKVKLESEVTSIQKTEKGFQVNFIQNGTQHNIDCNKIISTIPAYIAVDLFSHFDDGLIKHFNEIYYPPVLVLFLVYKKENIKRPLDGFGFLIPSKERKSFLGAIWSSVIFPNRSDDDTASFTLFVGGARNPEIGSIDKEILIGKVKKEFEDLMKISGTPELQTYKYWSKAIPQYNIGYVEHEKYFDEFERKNPGIILSGNYRGGISVGDCIKNAAIVADKVTKF

SEQ ID NO: 6109 - DNA, 756 bp, Unknown; identical to SEQ ID NO: 5781
  Obtained from environmental sample
  misc_feature (1)..(756): n is a, c, g, or t

SEQ ID NO: 6110 - protein, 251 aa, Unknown; identical to SEQ ID NO: 5782
  Obtained from environmental sample
  DOMAIN (2)...(197): tRNA synthetases class I (C) catalytic domain
  misc_feature (1)..(251): Xaa is any amino acid

SEQ ID NO: 6111 - DNA, 315 bp, Unknown
  Obtained from environmental sample
  misc_feature (1)..(315): n is a, c, g, or t
atgtatgagtttattaaaaaaactggtgctatactacggttggaaaattttaaaataataaaatcagatgtatttcgctttatagataactgcaatgatcagttcgattttatttttgccggcccaccatatgcacttaccaacattgatgacctgccaaaaaaaatttttgaaaaaaacctcttaacatccgggggatggtttgtactggagcatactcccaggaatgattataaaacattcccattctataaaacagaaagaaattacggtacaacagtgtttacgatctttaaagcaagggatgaagaataa

SEQ ID NO: 6112 - protein, 104 aa, Unknown
  Obtained from environmental sample
  misc_feature (1)..(104): Xaa is any amino acid
MYEFIKKTGAILRLENFKIIKSDVFRFIDNCNDQFDFIFAGPPYALTNIDDLPKKIFEKNLLTSGGWFVLEHTPRNDYKTFPFYKTERNYGTTVFTIFKARDEE

SEQ ID NO: 6113 - DNA, 507 bp, Unknown
  Obtained from environmental sample
  misc_feature (1)..(507): n is a, c, g, or t
ttgtatcttcccattatgctgaaagcagaggcacgtaaatattaccgtgataaacggatggcgttgaccaatgctgaacgttctaaactcgatgacttattactgatacaatttcagacaatgaaacttccctttattcaaaccatgctcagttactggcccattgaagaaaataaagaaccgaatacccatttatttactgactttattgaattcagaaacccggaagtaaaaatctgttaccccaaaagcgattttaaaaatatactgatgacagctgtcataacagatgaagacacaaagtttaaaaagaacagtcaccagatttatgaacctgtaaatggtgatgtggctcttcccccggagattgaactgatttttgtacccttgttgggttttgataacgatggattccggctgggatatggtaagggtttttatgataaatatctctggcaatgtaaccgtgaatgcattattgtgggatttagctattttgatccatag

SEQ ID NO: 6114 - protein, 168 aa, Unknown
  Obtained from environmental sample
  DOMAIN (8)...(168): 5-formyltetrahydrofolate cyclo-ligase family
  misc_feature (1)..(168): Xaa is any amino acid
MYLPIMLKAEARKYYRDKRMALTNAERSKLDDLLLIQFQTMKLPFIQTMLSYWPIEENKEPNTHLFTDFIEFRNPEVKICYPKSDFKNILMTAVITDEDTKFKKNSHQIYEPVNGDVALPPEIELIFVPLLGFDNDGFRLGYGKGFYDKYLWQCNRECIIVGFSYFDP

SEQ ID NO: 6115 - DNA, 483 bp, Unknown
  Obtained from environmental sample
  misc_feature (1)..(483): n is a, c, g, or t
gtgtggtttgtcatttctccccaaaatccccttaaaaatgcagacggcctattaaataattatgaccgcttacatttagttagcaaagcgatagaaaatgatatgaggatgaaagcaagtgatattgaatttcatctcccgaaaccttcttatacagtcactactttgtcgtatttaaaagaaaaatatcctgagcatgaatttaccatcattatgggaagtgatagttttcaaaatctctctaagtggaaaaactttaaaattattgtaaataattaccagctaataatttataaaaggcctggctttggaatagaaaaccatctgggagctaaaataataattatgaacgctcctttattagaaatatcggctacatatatacgtgaacttgtaaaagaaaataaatcaataaagtatttagtgcctaataatatagaagaggaaataaaaactaataggttttacaatcaaaaaaaatag

SEQ ID NO: 6116 - protein, 160 aa, Unknown
  Obtained from environmental sample
  DOMAIN (1)...(131): Cytidylyltransferase
  misc_feature (1)..(160): Xaa is any amino acid
MWFVISPQNPLKNADGLLNNYDRLHLVSKAIENDMRMKASDIEFHLPKPSYTVTTLSYLKEKYPEHEFTIIMGSDSFQNLSKWKNFKIIVNNYQLIIYKRPGFGIENHLGAKIIIMNAPLLEISATYIRELVKENKSIKYLVPNNIEEEIKTNRFYNQKK

SEQ ID NO: 6117 - DNA, 408 bp, Unknown
  Obtained from environmental sample
  misc_feature (1)..(408): n is a, c, g, or t
gtggcttatgcatttatttttatctatccattaacggtaagcaaatcgcccaaatttttagttggtaaatggaatgttgaaactttaataaaagggaaagacactatcaattcaacggcatggctaacagactctacagcatggaaaaacatttacttggataagtttggcagttttacaataaatccaaatccctatgtagttgaaacaaaaagagcagggaagggacaatttaattacagcgataaaacacatgttctatcgcttctaatttggtctcaaaataaacctaaagacagctttcaatttcaagtaacagaagcagacgaaaaacatataaagctgtatggccaacatcgcggacaactacttcaaatgaatttattgaaggacgactacaggaattaa

SEQ ID NO: 6118 - protein, 135 aa, Unknown
  Obtained from environmental sample
  misc_feature (1)..(135): Xaa is any amino acid
MAYAFIFIYPLTVSKSPKFLVGKWNVETLIKGKDTINSTAWLTDSTAWKNIYLDKFGSFTINPNPYVVETKRAGKGQFNYSDKTHVLSLLIWSQNKPKDSFQFQVTEADEKHIKLYGQHRGQLLQMNLLKDDYRN

SEQ ID NO: 6119 - DNA, 816 bp, Unknown
  Obtained from environmental sample
  misc_feature (1)..(816): n is a, c, g, or t
ttgccttttttttctgtttnccagaaaaattatcatttaaaatttaaaacaaaagactatcaacaagttaaaaaaaatccaaccgtttattttagagatagcgttgaagccttaaattacctcaaagaatttcaatattttgctattaaaaaaggatatctattggcttcagtagattctttttactacaaaaacaaagaactggaagcaaatttttatgtaggattgaaatttgacaaagcaaagatttctatggataaagaagatttatcctttgtaaagagaaaagcaagtgtgaatgaaaaattacttttaaaacttgattttaatcccaaagaaatcagttctttgatgtctcaaatccaaaaagcttacgaaaatagtggttatcctttttgtaaagtttatttggaggatattgaaatcactgaacgtgatttaaaagcaaaattagttgttttaaaacacaaagaatttcggattaagaaaatcaatatggtaggtaatcccctgatttcaaaaaaattgatttcttcttatattcaaataaaggaaggtgatttatttaaccaatcaaaaattgctgaaataagttctaaaatcaaacaaatcaattttattgaagaggtcaaaccttccgaattgttgtttacagaagagggaacggaaatttttctttacctgaaagcaaaacctgtaagtttgatcaatggtgttgttgggttacaaccggatccgattaaaaacaaactttatttaacaggagaattgcgcttaaagttggtaaatgttttgaaaaaagcagnaattatttga

SEQ ID NO: 6120 - protein, 271 aa, Unknown
  Obtained from environmental sample
  misc_feature (1)..(271): Xaa is any amino acid
MPFFSVXQKNYHLKFKTKDYQQVKKNPTVYFRDSVEALNYLKEFQYFAIKKGYLLASVDSFYYKNKELEANFYVGLKFDKAKISMDKEDLSFVKRKASVNEKLLLKLDFNPKEISSLMSQIQKAYENSGYPFCKVYLEDIEITERDLKAKLVVLKHKEFRIKKINMVGNPLISKKLISSYIQIKEGDLFNQSKIAEISSKIKQINFIEEVKPSELLFTEEGTEIFLYLKAKPVSLINGVVGLQPDPIKNKLYLTGELRLKLVNVLKKAXII

SEQ ID NO: 6121 - DNA, 342 bp, Unknown
  Obtained from environmental sample
  misc_feature (1)..(342): n is a, c, g, or t
ttgaaggatatttcgcgagtaaaaattttcacttttaccgatcctgtcttggcccttgaacactttcaagttaatgaatatgcttatgtgcttgtaatatcagattttaaaatgccaggattaaatggtatggaatttctaaaaaagataaaggctttgaatccctttgtgagaacaatattaatgactgccttcgaaatagaggataagatatttggtgaatataccaagaataagattattgatgcattccttcaaaagccaattggaatgcatgatctaattaaggaggtagatactcagttacattcctacgaaaatcaaaaaaggctaccttcctaa

SEQ ID NO: 6122 - protein, 113 aa, Unknown
  Obtained from environmental sample
  DOMAIN (2)...(106): Response regulator receiver domain
  misc_feature (1)..(113): Xaa is any amino acid
MKDISRVKIFTFTDPVLALEHFQVNEYAYVLVISDFKMPGLNGMEFLKKIKALNPFVRTILMTAFEIEDKIFGEYTKNKIIDAFLQKPIGMHDLIKEVDTQLHSYENQKRLPS

SEQ ID NO: 6123 - DNA, 1017 bp, Unknown
  Obtained from environmental sample
  misc_feature (1)..(1017): n is a, c, g, or t
gtggcatgtgcagtggaggtgcctgctccgaatgtgacaggtatcatttcctcagataattgtgagggcggtgcgcctgttaccttcgtaggtgatgtgatcacaaatcagacctgcgcaaacagatatacaattactcgtacttatagggcacgggacatatgtgaaaatcaaagtcaatgcagtcaaatcattactgtatttgataacacgctcccaacaataatatgtcccgccaatattactgtagaatgtgtggaagatgtgccgttgccaaatgttgcaggcattatttcatcagacaactgtggtggagtgaacgtcatcacattcgtaggagatgtgatcacgaatcaaacttgcccaaatcaatattccataattcggacttaccgggctacggatgtctgcggtaattcagttacctgtagtcaattgatcaccgtaatggataatatacctcccgtaattacttttattaatccattgctcgaaggagataccgtgtccgttcaatgctatggacaggatccggaatggaatatccctgtattcgatgaaagcagtgtaagtgccatagacaattgcgcaggacaggtcacgctgactttcaaccaggtattagtgaatgaaggtgattgcattgaagatggctatattaatttgtatcgtctgacctggacagctatagatgtatgcggcaatagtgctaatgtttctatattccttcaattggttgataccattccgcctgttattgagggaatcccggctgacataactgtgagctgcgacgaattaccagcattacctacagtctttgctgtagatgaatgtttgtgtgcttgtgtagtcctattcgaagaatcaatattgctccagggatgtcaaaatggccaggtactgacaaggtcgtggactgccattgaccggtgtggaaatcaaactattgagacacagttgatcacactgattgacgatgaagctccggcgattcaattacccagctcaatctga

SEQ ID NO: 6124 - protein, 338 aa, Unknown
  Obtained from environmental sample
  misc_feature (1)..(338): Xaa is any amino acid
MACAVEVPAPNVTGIISSDNCEGGAPVTFVGDVITNQTCANRYTITRTYRARDICENQSQCSQIITVFDNTLPTIICPANITVECVEDVPLPNVAGIISSDNCGGVNVITFVGDVITNQTCPNQYSIIRTYRATDVCGNSVTCSQLITVMDNIPPVITFINPLLEGDTVSVQCYGQDPEWNIPVFDESSVSAIDNCAGQVTLTFNQVLVNEGDCIEDGYINLYRLTWTAIDVCGNSANVSIFLQLVDTIPPVIEGIPADITVSCDELPALPTVFAVDECLCACVVLFEESILLQGCQNGQVLTRSWTAIDRCGNQTIETQLITLIDDEAPAIQLPSSI

SEQ ID NO: 6125 - DNA, 726 bp, Unknown
  Obtained from environmental sample
  misc_feature (1)..(726): n is a, c, g, or t
atgaagaaatcactggaagttcttattctgtttttcctcatttcgtctgtcgtattttctcaacaggtggtaataaatggagaagcccctgatttcaagggaaaagaaattgctgtgtttgtttatgatgatctcatttcaaaaaaagaagttgaaaaggcaagtgctattgttgacgaaacaggaaaattcaaattcgaattctcaatcaacgaaactcaaaaagtatttattcaagtaaataaacaacggtcttctttgtttattgaaccgggaaagcaatacaaggcttttataccgccggcagattcaacaaaacatgttaatcctagtaatttttctgatgttggtttgtatgttttggataataatgattcacttgagctaaataacctgatcatagatttcaataaaaaaattgatgatttctggatgaaaaattatacgctgtttgtgatgagtcgtggacgttctaaacttgatagttttacgaaggctacaaataaaaattacagtaccataaagaatgaatatttccgtaagcatgttgagtattcactggcttcccttacgcaaggtgtttcacaaggaaaaaagaacaggaggaagtttatttttgtggcaaacctatattgtataataattacgagtatatgtatttatttaatgaaatttttaaacagtattttacaaaagctgcttatgataaaaaaggtgcaggtatga

SEQ ID NO: 6126 - protein, 241 aa, Unknown
  Obtained from environmental sample
  misc_feature (1)..(241): Xaa is any amino acid
MKKSLEVLILFFLISSVVFSQQVVINGEAPDFKGKEIAVFVYDDLISKKEVEKASAIVDETGKFKFEFSINETQKVFIQVNKQRSSLFIEPGKQYKAFIPPADSTKHVNPSNFSDVGLYVLDNNDSLELNNLIIDFNKKIDDFWMKNYTLFVMSRGRSKLDSFTKATNKNYSTIKNEYFRKHVEYSLASLTQGVSQGKKNRRKFIFVANLYCIIITSICIYLMKFLNSILQKLLMIKKVQV

SEQ ID NO: 6127 - DNA, 360 bp, Unknown
  Obtained from environmental sample
  misc_feature (1)..(360): n is a, c, g, or t
ttggcttatctgatagttcaactgttttatccaatacaaaaatctgctctctcatacctcaaagttcggggtataaagttaactaaaggttatttgagtttaccgttttgcgaaaataatgtttttgtgtacgtttgtcgtatgagaaaaagtggtggatcggcgcataagattgcggagtttttgttgcagataaaagctattaagttgcaaccaaataagccttttacatgggcatcagggtggaaatcacccatatactgtgataacagaaaaacgctttcctatcctaaaataagaacatacatacgtcagcagtttgtcaatgtaattgcggaagaatttggtaagccggattga

SEQ ID NO: 6128 - protein, 119 aa, Unknown
  Obtained from environmental sample
  misc_feature (1)..(119): Xaa is any amino acid
MAYLIVQLFYPIQKSALSYLKVRGIKLTKGYLSLPFCENNVFVYVCRMRKSGGSAHKIAEFLLQIKAIKLQPNKPFTWASGWKSPIYCDNRKTLSYPKIRTYIRQQFVNVIAEEFGKPD

SEQ ID NO: 6129 - DNA, 525 bp, Unknown
  Obtained from environmental sample
  misc_feature (1)..(525): n is a, c, g, or t
atgagagagcagatttttgtattggataaaacagttgaactatcagataagccaaacgcggtttttgagcagaataccatttatataaaacacgattcccggcaaaacttaaaaaagacctacgaattattctatgaatcgggagtaattaagcacctttttatttttcatacagattttgaactcctaaaaaaagatttcttgagtttgtttgaaatgatagaaggcgccggaggtctcgtaaaaaacaataaaggagaaatattgatgattttccgaaatgggaaatgggacatcccaaaagggaaaatagaaaaaggagaaaaaaaagatgttgcagcgatacgggaagtagaagaggaatgtggtattgaccaactatctattatcaaggagttaccttatacacttcatatatacaaactcaaaaatgatttttttctaaagaagacatattggtttttaatgaggagtgatttttccggaaaactaacacccgcactcgacgaaggaataccaaagtaa

SEQ ID NO: 6130 - protein, 174 aa, Unknown
  Obtained from environmental sample
  misc_feature (1)..(174): Xaa is any amino acid
MREQIFVLDKTVELSDKPNAVFEQNTIYIKHDSRQNLKKTYELFYESGVIKHLFIFHTDFELLKKDFLSLFEMIEGAGGLVKNNKGEILMIFRNGKWDIPKGKIEKGEKKDVAAIREVEEECGIDQLSIIKELPYTLHIYKLKNDFFLKKTYWFLMRSDFSGKLTPALDEGIPK

SEQ ID NO: 6131 - DNA, 324 bp, Unknown
  Obtained from environmental sample
  misc_feature (1)..(324): n is a, c, g, or t
ttgacaccggaaatttcaaaaattaatttatacgagcaccttaaaaaaacagatacagataccaagggttcaaccagccgttatgaaacagaatatttcatggaaatacctggtgatagtgatggtgtttgggaagttgacggctccaaatttgttcccaactttgacaaaaaaatgagcaaaatagtaagcgactgcgctgtgttggcccaaaagatagccactaaacaggctggctatttttatgcacaggtaagcgtgttcaaagaaaaaagaccagtggtattattaaacatcataagagaatacaacgattgcaaatag

SEQ ID NO: 6132 - protein, 107 aa, Unknown
  Obtained from environmental sample
  misc_feature (1)..(107): Xaa is any amino acid
MTPEISKINLYEHLKKTDTDTKGSTSRYETEYFMEIPGDSDGVWEVDGSKFVPNFDKKMSKIVSDCAVLAQKIATKQAGYFYAQVSVFKEKRPVVLLNIIREYNDCK

SEQ ID NO: 6133 - DNA, 342 bp, Unknown
  Obtained from environmental sample
  misc_feature (1)..(342): n is a, c, g, or t
atggtgaatattattcacggatcgtttttgtcttcttcttttcactttcgggttgatgtgctatatcaatttattgatataatacaatttcttacattagattggtcctcagcttctacttttagttcaaaaaaaacccttatccctaaattgaaaatatttaattcattaactcatctatttatttacacaaatcgaattaattttctgccttcgatcacttgcaactcgggaagaattctggataatttaataattaaactttgtgtcattttgaaaggtttaagtattttgaaatttgaattatttttaacaaaagggaaaaaaatttcaaattcctaa

SEQ ID NO: 6134 - protein, 113 aa, Unknown
  Obtained from environmental sample
  misc_feature (1)..(113): Xaa is any amino acid
MVNIIHGSFLSSSFHFRVDVLYQFIDIIQFLTLDWSSASTFSSKKTLIPKLKIFNSLTHLFIYTNRINFLPSITCNSGRILDNLIIKLCVILKGLSILKFELFLTKGKKISNS

SEQ ID NO: 6135 - DNA, 765 bp, Unknown
  Obtained from environmental sample
  misc_feature (1)..(765): n is a, c, g, or t
atgctgataataggagaccctgataaagctttcaaattatctttttatccaaatgatggggtagggcttatgcgcattgaatttatcatcaattcttttgtaaaagtgcatcctatggccttggtaaagtttcatgaattaaaagataaaaaagtcaaaaaacaaattgaatcaataacccaccattatccggataaaaagcaatatttcattgacaaattagcggagggaatggcaaccatcgcggctgctttttacccaaaggatgtaatcgtacgcatgagtgattttaaaacgaatgaatatgccaatttaattgggggtatcacgttcgagccggaggaagaaaatcctatgttaggtttcaggggcgcttcgcgttactataatgagctttataaagaaggttttgccttggaatgtgctgccataaaaaaagtaagaaaagatatgggccttgataatgtgaaagtgatgatacctttttgcaggaccgttgatgaaggtaaaaaggtaatagaggtaatggagcaaaacggtttagataggaagagggatgcccgcttacagatttatgtgatggcagaaatacccagcaatgttttattggcagagaaattcgctgaaatatttgatgggttttctatcggctccaacgaccttacacagttgacgcttggcatagaccgcgactcttccattgtaagtaatttattcagtgagcaaaatgaggcggctaaaatgatgatttcaatggtcatttga

SEQ ID NO: 6136 - protein, 254 aa, Unknown
  Obtained from environmental sample
  DOMAIN (1)...(254): PEP-utilising enzyme, TIM barrel domain
  misc_feature (1)..(254): Xaa is any amino acid
MLIIGDPDKAFKLSFYPNDGVGLMRIEFIINSFVKVHPMALVKFHELKDKKVKKQIESITHHYPDKKQYFIDKLAEGMATIAAAFYPKDVIVRMSDFKTNEYANLIGGITFEPEEENPMLGFRGASRYYNELYKEGFALECAAIKKVRKDMGLDNVKVMIPFCRTVDEGKKVIEVMEQNGLDRKRDARLQIYVMAEIPSNVLLAEKFAEIFDGFSIGSNDLTQLTLGIDRDSSIVSNLFSEQNEAAKMMISMVI

SEQ ID NO: 6137 - DNA, 762 bp, Unknown
  Obtained from environmental sample
  misc_feature (1)..(762): n is a, c, g, or t
ttgcagccaattttgaaaaaggctatgaacgaaccgctggtgtcgataattacaatcgtgtataacggggagcggtatatcgaacaggcaatgttgagcgtgctcaatcagacttattcgaatatcgagtatatcatcgtggacggtggttcgaaagatggcaccatttccatcattaataaatatcgtaaccgcatcgaccagttcgtgtcagaaaaagatcgtggcatcagcgacgcattcaacaagggcatcggcatggcaaacggcgaattgatcggtattcttaatgctgacgactggtatgaaaaagacgctgtggccgaggttgttaagcacagggccaatgccgaagtgatctatggcgatatgcaattctggaatgacgatgcacctgattttgtcgtgaagggcaatcatgcattgctcgaacacgagatgacgatcaaccatcccacagtttttgtaaagaaatcaagctatgagaaacttggtttattcgacgaaagctttaagtgtgcgatggattacgatatgttacttcgattgaaagtgaacggcagccggtttgcttatataccgagagtgttagcgaatatgcgctggggaggttttagcgatgcaaaatggatgattggctgcaaggaaacacttgacatcaaaaataaatacctgccgaaacgcaaattcatgaatcacctctatttctacaagcacgtattggccatatcgatcccaaaattcctaactcgcatcacctga

SEQ ID NO: 6138 - protein, 253 aa, Unknown
  Obtained from environmental sample
  DOMAIN (15)...(165): Glycosyl transferase
  misc_feature (1)..(253): Xaa is any amino acid
MQPILKKAMNEPLVSIITIVYNGERYIEQAMLSVLNQTYSNIEYIIVDGGSKDGTISIINKYRNRIDQFVSEKDRGISDAFNKGIGMANGELIGILNADDWYEKDAVAEVVKHRANAEVIYGDMQFWNDDAPDFVVKGNHALLEHEMTINHPTVFVKKSSYEKLGLFDESFKCAMDYDMLLRLKVNGSRFAYIPRVLANMRWGGFSDAKWMIGCKETLDIKNKYLPKRKFMNHLYFYKHVLAISIPKFLTRIT

SEQ ID NO: 6139 - DNA, 378 bp, Unknown; identical to SEQ ID NO: 4353
  Obtained from environmental sample
  misc_feature (1)..(378): n is a, c, g, or t

SEQ ID NO: 6140 - protein, 125 aa, Unknown; identical to SEQ ID NO: 4354
  Obtained from environmental sample
  misc_feature (1)..(125): Xaa is any amino acid

SEQ ID NO: 6141 - DNA, 564 bp, Unknown
  Obtained from environmental sample
  misc_feature (1)..(564): n is a, c, g, or t
atggatcttactttatataacgattcctatgatntattttgtatgaatttaaagaaacaaaattccggtgttttagaaattggctgcggacccggcaatatatcaaaatacctgctgtcaaaaaggaatgacttaaaaattaccggaattgacattgcaccggctatgattaaactcgctaaagtcaacaatccggcggctgagtttttcgaattagatatcagatcccttaatcaaattgaaaaaagattcgaaggaattattggtggattttgtttaccgtatttatccggtgatgattgcttaaaattatttaatgactgcagaaatttactgagcgatgatggaatactgtatttaagttatattgaaggcgatggtaaatcagactatttaacaggaagcagtggccatcgtacttatttttatgatcatcagctgcataatattaaagatcagcttaaagaacatgatttcgaaattgcccgcacgttgcagaaggatttcaataataatggtactgatgaagtacataccatattaatagcaaaaaaaactgcctga

SEQ ID NO: 6142 - protein, 187 aa, Unknown
  Obtained from environmental sample
  misc_feature (1)..(187): Xaa is any amino acid
MDLTLYNDSYDXFCMNLKKQNSGVLEIGCGPGNISKYLLSKRNDLKITGIDIAPAMIKLAKVNNPAAEFFELDIRSLNQIEKRFEGIIGGFCLPYLSGDDCLKLFNDCRNLLSDDGILYLSYIEGDGKSDYLTGSSGHRTYFYDHQLHNIKDQLKEHDFEIARTLQKDFNNNGTDEVHTILIAKKTA

SEQ ID NO: 6143 - DNA, 630 bp, Unknown
  Obtained from environmental sample
  misc_feature (1)..(630): n is a, c, g, or t
atgaataagtataaagaaacgtttacaacctggaataaagtagcagagttataccaggaaaagttcatggatcttactttatataacgattcctatgatttattttgtaatgaattaaagaaacaaaattccggtgttttagaaattggctgcggacccggcaatatatcaaaatacctgctgtcaaaaaggaatgacttaaaaattaccggaattgacattgcaccggctatgattaaactcgctaaagtcaacaatccggcggctgagtttttcgaattagatatcagatcccttaatcaaattgaaaaaagattcgaaggaattattggtggattttgtttaccgtatttatccggtgatgattgcttaaaattatttaatgactgcagaaatttactgagcgatgatggaatactgtatttaagttatattgaaggcgatggtaaatcagactatttaacaggaagcagtggccatcgtacttatttttatgatcatcagctgcataatattaaagatcagcttaaagaacatgatttcgaaaatgcccgcacgttgcagaaggatttcaataataatggtactgatgaagtacataccatattaatagcaaaaaaaactgcctga

SEQ ID NO: 6144 - protein, 209 aa, Unknown
  Obtained from environmental sample
  misc_feature (1)..(209): Xaa is any amino acid
MNKYKETFTTWNKVAELYQEKFMDLTLYNDSYDLFCNELKKQNSGVLEIGCGPGNISKYLLSKRNDLKITGIDIAPAMIKLAKVNNPAAEFFELDIRSLNQIEKRFEGIIGGFCLPYLSGDDCLKLFNDCRNLLSDDGILYLSYIEGDGKSDYLTGSSGHRTYFYDHQLHNIKDQLKEHDFENARTLQKDFNNNGTDEVHTILIAKKTA

SEQ ID NO: 6145 - DNA, 648 bp, Unknown
  Obtained from environmental sample
  misc_feature (1)..(648): n is a, c, g, or t
atgaactggctgcttcttcttgagattgtttatatagccgttcttattttagtttgcttacgcattatttacgatactcgcagtacaaccaaaacattggcttacctgctgttggctatttttcttccggttgccggtataatcttctatttttctttcggcacaaactatcgcaaaagaaaaatgtacagtaaaaaacttatagaaaacgaagagctggctaaaaaactaagagaagatatatttcattcttccaaacaaacttttactgagcatgatgctgcccttgaaggcaataaggaactggcacacatgcttgttaaggataccaacagtcctttgacctcaagcaatgcagtaaagctgctgataaatggagaaaataaatttcccgaagttattaaggcgctgcaacaggcaaagcatcacatccatgtcgaatactatatttatgacgatgataaaattgggaaagaaattgagcaagtgctaattcaaaaagcanaagaaggcgtagctgtccgcttcatttacgatgattttggcagccggtctattcgccgaaagttagttaatcgtttaaaggctggtggtatagaagcttttccttttttaaagtgtactttgtcgctnttgctaaccggctga

SEQ ID NO: 6146 - protein, 215 aa, Unknown
  Obtained from environmental sample
  misc_feature (1)..(215): Xaa is any amino acid
MNWLLLLEIVYIAVLILVCLRIIYDTRSTTKTLAYLLLAIFLPVAGIIFYFSFGTNYRKRKMYSKKLIENEELAKKLREDIFHSSKQTFTEHDAALEGNKELAHMLVKDTNSPLTSSNAVKLLINGENKFPEVIKALQQAKHHIHVEYYIYDDDKIGKEIEQVLIQKAXEGVAVRFIYDDFGSRSIRRKLVNRLKAGGIEAFPFLKCTLSLLLTG

SEQ ID NO: 6147 - DNA, 663 bp, Unknown
  Obtained from environmental sample
  misc_feature (1)..(663): n is a, c, g, or t
ttgaatggcgcctcaaattctactgtattagttccaggtgcttctgcaccggccgcaattaatacaataaaatctctaaaaatggtaaaatatcctgtaacaataataagttcagacacaaaccctatctcagcagggttttatttgtctgatgcgcatgaagtgttaccagaaatagatagccaatcatacacgactagactttttgaaataattgcaaagcacaatattggtattctgatgccatcatcaggctatgacatatatcattttagtaaaaataaaggaaaattattggagcgcggagcattggctgttgtaagcgatgaaggagtcatggaaaaatgcagggacaaaatggagacttttacttttctttctcaaaagtttgcattacctttcacaacgtctgaccctgataaaataagagaatttccactaattgcaaaaccaagatacggtaaaggaagcaaaggaatagtaaaaatagacaacgaggatgatctaaaatacgtccaatcaaaaaatgataacttgatttttcaagaatatttgccaggcaccgaatacactatagatgtactgtcggatttggatggtgaacccgatatgctgttccgcgaatcagactacaaacaagagctggaatttccacatgggtaa

SEQ ID NO: 6148 - protein, 220 aa, Unknown
  Obtained from environmental sample
  misc_feature (1)..(220): Xaa is any amino acid
MNGASNSTVLVPGASAPAAINTIKSLKMVKYPVTIISSDTNPISAGFYLSDAHEVLPEIDSQSYTTRLFEIIAKHNIGILMPSSGYDIYHFSKNKGKLLERGALAVVSDEGVMEKCRDKMETFTFLSQKFALPFTTSDPDKIREFPLIAKPRYGKGSKGIVKIDNEDDLKYVQSKNDNLIFQEYLPGTEYTIDVLSDLDGEPDMLFRESDYKQELEFPHG

SEQ ID NO: 6149 - DNA, 978 bp, Unknown
  Obtained from environmental sample
  misc_feature (1)..(978): n is a, c, g, or t
ttgattgtttggggtaacaaaaagtggctgagaatcagcacaaaaaaaggcagccaaacggccctcaatttcgggcgtgggataaatataagtactggctctatttacaaaccaaatacatggtatactctctttgatttcaatgaaacagatggttcaaaacataccacatttgttaccagtgaccgtgatggaaaaattaattntgctgtaaatcatcaaagtcatctggttggcatataccaaaaaaaagatcctcctgaaattgtatttgttcaacataaagtgaataataaaaatatattccttgatcacaaaaaagaatgcgatctcaaactcagattattaaatagaggagcaacttcgagcagtaaaatcaaggtcacacttagttcgccaacagaagaagttactatagcaaatccaaccattgaatttacaggcatacctccaggtgcagctatctggatgccggctgatttcaaaattaccgctgcaagcaaacctgtttccgatgggtcgcctttccaggcaaggtttaatctttctgttactgacgttaaaggcaatacgtggaaagatgagtttgatgcgcctatattttacgatgttcctgaatttaccaatattggcattgatgatggagatagtgagatatttggaagcggcgatggagataatactgcagagccgggagaaaccataatgatttaccaggatagtcatcgtacccggttatattacgatgacccatatattgacaacgaaaaattatttgatgaactgcaaccggataaatggggagacggttatgcattgtcgtcattaattcacatttccaaagattgccctatcggtcatcaaatacggtttttagcaaattatgaagtgaaagattggaagactattaaaagaaatgtaacctggggaagttttactataacaatcggtaaaccggcgaaaaataagttcaaataa

SEQ ID NO: 6150 - protein, 325 aa, Unknown
  Obtained from environmental sample
  misc_feature (1)..(325): Xaa is any amino acid
MIVWGNKKWLRISTKKGSQTALNFGRGINISTGSIYKPNTWYTLFDFNETDGSKHTTFVTSDRDGKINXAVNHQSHLVGIYQKKDPPEIVFVQHKVNNKNIFLDHKKECDLKLRLLNRGATSSSKIKVTLSSPTEEVTIANPTIEFTGIPPGAAIWMPADFKITAASKPVSDGSPFQARFNLSVTDVKGNTWKDEFDAPIFYDVPEFTNIGIDDGDSEIFGSGDGDNTAEPGETIMIYQDSHRTRLYYDDPYIDNEKLFDELQPDKWGDGYALSSLIHISKDCPIGHQIRFLANYEVKDWKTIKRNVTWGSFTITIGKPAKNKFK

SEQ ID NO: 6151 - DNA, 531 bp, Unknown
  Obtained from environmental sample
  misc_feature (1)..(531): n is a, c, g, or t
atggcccccggagaatttgaggaatttacccgtgagcttaatgaaagcaaacccatgaccagggctgattttagaaattcatggatagtgccgaaaaaaaggcgggctccattttccgggagtgatataaagagccggcgccagtatgattcactagtaaaggcggggaaaataaaacatggctggtttgaaaggcaaatggcattcaaggaaattgaaatgaatgaaaagtataagggtgaccaggaccagattctgaaagcttttgtaaacaaccttgtgcacagtttcccccaaatgctgttcatttcgcttcctttattcgccctggtgcttaaattactgtacatacggcggaaacagtattattatgtgagccatgcgattttcagcgtgcagtattacatttttgtttttataatgctgttcgtcctgctcttcctgcagaaaattaacaaccagctcgactggttgatgtatggggaacctgcaggtactcacgttcatgattatcttcttttacctctataa

SEQ ID NO: 6152 - protein, 176 aa, Unknown
  Obtained from environmental sample
  misc_feature (1)..(176): Xaa is any amino acid
MAPGEFEEFTRELNESKPMTRADFRNSWIVPKKRRAPFSGSDIKSRRQYDSLVKAGKIKHGWFERQMAFKEIEMNEKYKGDQDQILKAFVNNLVHSFPQMLFISLPLFALVLKLLYIRRKQYYYVSHAIFSVQYYIFVFIMLFVLLFLQKINNQLDWLMYGEPAGTHVHDYLLLPL

SEQ ID NO: 6153 - DNA, 804 bp, Unknown
  Obtained from environmental sample
  misc_feature (1)..(804): n is a, c, g, or t
atgccactcgggtatcgtgcaggactttttttagatcaactgtctctatccttgaaacaattaaaaaaatatgcttcaactaatcaaattttaatgttatctggaagtggttctacaccgcctcaacccgaattagttgatgtcataaaagaatggaataagaaagttgatggaaaaaatggaacaaaatctaaaagtggatataatatgatcatgtctactcctcttcaatattttgattatttagaaaaacaaaacatcaaatttaaagtaagaaaaggagaaatgtattctggaaaattctctgctgtatatccagatagtacctccacacgtatgtggctaaaacaaggaatgaaagaatttgaaaatagcattctacttcttgaaagattagatgctttagcatggttaattaatatacacgacgaaaatatctcagatcagcttcaaaagtattggaagaaaatactatttgttgcaatgcatgatgttttaccaggtacaggagttgatgaaatatacaacgaagtaagggaaatatttgaaaacgagagaaagagtatagaaagatcaattttagaatatttgagaaaaatttcattaatgactaactatgataatgacatttttatttttaacccactctcgtggttagttacaaattggacagaaatcattttagaatttaatgaaggtgaaatcaatggtataagttgcctcaagagtggagatcaaattatagagatagaaattctagattattctttataccaagatgattctattaaaaaaatagcctag

SEQ ID NO: 6154 - protein, 267 aa, Unknown
  Obtained from environmental sample
  misc_feature (1)..(267): Xaa is any amino acid
MPLGYRAGLFLDQLSLSLKQLKKYASTNQILMLSGSGSTPPQPELVDVIKEWNKKVDGKNGTKSKSGYNMIMSTPLQYFDYLEKQNIKFKVRKGEMYSGKFSAVYPDSTSTRMWLKQGMKEFENSILLLERLDALAWLINIHDENISDQLQKYWKKILFVAMHDVLPGTGVDEIYNEVREIFENERKSIERSILEYLRKISLMTNYDNDIFIFNPLSWLVTNWTEIILEFNEGEINGISCLKSGDQIIEIEILDYSLYQDDSIKKIA

SEQ ID NO: 6155 - DNA, 369 bp, Unknown
  Obtained from environmental sample
  misc_feature (1)..(369): n is a, c, g, or t
atgcatgacgacccagtgaatgaatcatcatgtccctctagggtaggattagctgtcaaaggaatttcacacaaagaaatagaaagaggggatattatctgttctggcgatagcataaagaccgtagatacagaaatattagtaacaaatttttcaaaaaataagtattataacggtgagattacagacacacaaacatatttaatttcagttgggctacaaataaaacctttaaaaatattaattaataatactaaaatattgttaattttagaaaaacctattgcctatcatgaaaaacaaaaatttttaatattgaaacctgatagtaaaactactagaataatagctgaaggatcattcccttaa

SEQ ID NO: 6156 - protein, 122 aa, Unknown
  Obtained from environmental sample
  misc_feature (1)..(122): Xaa is any amino acid
MHDDPVNESSCPSRVGLAVKGISHKEIERGDIICSGDSIKTVDTEILVTNFSKNKYYNGEITDTQTYLISVGLQIKPLKILINNTKILLILEKPIAYHEKQKFLILKPDSKTTRIIAEGSFP

SEQ ID NO: 6157 - DNA, 831 bp, Unknown
  Obtained from environmental sample
  misc_feature (1)..(831): n is a, c, g, or t
gtggctattattgcccttaccaaatattttgatgagtttactaaaaagcactatgaaaaaattcagcgtggattaaatctgaatgatgatgatttaaaagaagtaatgcaacaaatcaccaggcttaatccaaaacccggcggaaatattggtgggccacacaaggctgaaagttatgtagtgcctgatttttttatcttcaataattcgggtaaactggagttaacccttaactccaaaaacgcacctgagttacgcatcagtgaaggttatagagacatgttgaaagagtatgaccgcggtgcaaaaaaagaccggcgtcaaaaagaagcagtactttttattaagcaaaaaattgatgctgctaaatggtttattgatgctatcaaacaaagacagcatactttgctaagcacaatgaccgcaattatgaaccaccagtatgagttctttttaactggtgatgaaacgacgctcaaaccaatgatccttaaagatattgcagaaaaaaccgggcttgatatttcaacggtaagccgtgtagccaacagcaaatttgtgcaaacagaatttggtacttatcgcctgaaatttttctttagcgaatcattgaccacagatacaggtgaagaagtatctacccgggaagtaaaaaaaatactcagcgacctgatagaatatgaaaacaaaaagaagcccttaagcgatgaacgtttgaccgagttacttcaggaaaaaggctataacattgcaaggcgaacggtagcgaagtaccgggagcaattaaatataccagttgcccgtcttcgtaaagattataagatatcatga

SEQ ID NO: 6158 - protein, 276 aa, Unknown
  Obtained from environmental sample
  DOMAIN (112)...(272): Sigma-54, DNA binding domain
  misc_feature (1)..(276): Xaa is any amino acid
MAIIALTKYFDEFTKKHYEKIQRGLNLNDDDLKEVMQQITRLNPKPGGNIGGPHKAESYVVPDFFIFNNSGKLELTLNSKNAPELRISEGYRDMLKEYDRGAKKDRRQKEAVLFIKQKIDAAKWFIDAIKQRQHTLLSTMTAIMNHQYEFFLTGDETTLKPMILKDIAEKTGLDISTVSRVANSKFVQTEFGTYRLKFFFSESLTTDTGEEVSTREVKKILSDLIEYENKKKPLSDERLTELLQEKGYNIARRTVAKYREQLNIPVARLRKDYKIS

SEQ ID NO: 6159 - DNA, 624 bp, Unknown
  Obtained from environmental sample
  misc_feature (1)..(624): n is a, c, g, or t
ttgatatgnattcttgggtggattgtaagttctagtatggaagatacaaaaaataaaagattaattgcatatcatgaagttggtcatgctattgtagcatcattactagaaaagcatgatgaagttgaaaaagttagtataatcccaagaggatctgctaaaggggttacttggtttacatctgaagacgaccaaattcttgttactcgttcacagttattacaacgaattatgacaatcttaggtggtcgtatggcagaaatcattgtttttggtcaacctgaactttcaacaggtgctactgatgatttacaacaatgtacaaaaattgcacgacaaatggtaactcgttatggaatgtcaggtattggtccacgtgctcttgaaaataatactaatgaaagactattttcaaatggtaaaaagaatcctcttgcagatagaattgataaagaagtccacaaaattgtaaaatcttgtgaatatttaacaatgaaaattgtattagataacagagttattatagatcttcttgttgacaaattattagaagatgaaaatatgaatggtgacgacttccgaaaaatggtaattaaatatacacttcctccaagcaaaaaataa

SEQ ID NO: 6160 - protein, 207 aa, Unknown
  Obtained from environmental sample
  DOMAIN (9)...(196): Peptidase family M41
  misc_feature (1)..(207): Xaa is any amino acid
MIXILGWIVSSSMEDTKNKRLIAYHEVGHAIVASLLEKHDEVEKVSIIPRGSAKGVTWFTSEDDQILVTRSQLLQRIMTILGGRMAEIIVFGQPELSTGATDDLQQCTKIARQMVTRYGMSGIGPRALENNTNERLFSNGKKNPLADRIDKEVHKIVKSCEYLTMKIVLDNRVIIDLLVDKLLEDENMNGDDFRKMVIKYTLPPSKK

SEQ ID NO: 6161 - DNA, 669 bp, Unknown
  Obtained from environmental sample
  misc_feature (1)..(669): n is a, c, g, or t
gtgccgatattgtatcgttggagaaaatgtgtattcgaaaagaatcgtcagtgggacatcattgaaaaactnggcttcggcaaatgcagactttctatcgccgtgccgcgcacatgggaatacgataatatcaaatgtctgaagggcaagcggatcgctaccagctatccacatatggtgacttcattcctgaaaaaaaatcatgtcaccgccgaaattcatgagatcagcgggtctgtcgagattgccccgggaattggtctggcagatgtcgttgctgatttggtgagcagtggctctacattatttatgaatggcctgaaagaagtggaaacgattttgaattctcaggcagtgctgataaaaaataaacaacttcagccttttgctatctcactccttgacaaattgttgttccgcatacaggcggttaaaaaagcaaaaagaaacaaatacattttgcttaatgctccgaatgacaacctcgacaaaattattgcactgttgcccggaatgaaaagtccgacggtattaccattggcggaaagtggatggagtagtattcacagcgtattgagtgaagatcagttttgggagtgcatcgaaaatctgaaagccgccggcgcgcagggaatcctggtagtgcctatagaaaaaatggtcatctga

SEQ ID NO: 6162 - protein, 222 aa, Unknown
  Obtained from environmental sample
  DOMAIN (11)...(145): ATP phosphoribosyltransferase
  misc_feature (1)..(222): Xaa is any amino acid
MPILYRWRKCVFEKNRQWDIIEKLGFGKCRLSIAVPRTWEYDNIKCLKGKRIATSYPHMVTSFLKKNHVTAEIHEISGSVEIAPGIGLADVVADLVSSGSTLFMNGLKEVETILNSQAVLIKNKQLQPFAISLLDKLLFRIQAVKKAKRNKYILLNAPNDNLDKIIALLPGMKSPTVLPLAESGWSSIHSVLSEDQFWECIENLKAAGAQGILVVPIEKMVI

SEQ ID NO: 6163 - DNA, 309 bp, Unknown
  Obtained from environmental sample
  misc_feature (1)..(309): n is a, c, g, or t
atggccgatataataacaaggtgtaaaaaccaaattgacactatcgaaaagcaaatcctactccttcccctcatgaaagcattcgtagacggacaaacaatccaatggaaaaaccaccgtggagaatgggaagatgctgacaatcccggcttctttataaatcaggaataccgaatcaaaccgaaactttggtacgttattgaattgaaaaaatccatcccatatcctctactaattgatgatcgatatctcgaatcctacaaaaaccgacacgacttcgttcgtatcatcacgaccttcgaattctaa

SEQ ID NO: 6164 - protein, 102 aa, Unknown
  Obtained from environmental sample
  misc_feature (1)..(102): Xaa is any amino acid
MADIITRCKNQIDTIEKQILLLPLMKAFVDGQTIQWKNHRGEWEDADNPGFFINQEYRIKPKLWYVIELKKSIPYPLLIDDRYLESYKNRHDFVRIITTFEF

SEQ ID NO: 6165 - DNA, 915 bp, Unknown
  Obtained from environmental sample
  misc_feature (1)..(915): n is a, c, g, or t
atgcaatatcatccgcatggcgatgcgtctattggagatgcattagtgaatatggttcagaaagatttgctgattgatacgcagggaaattggggcgatatccgaaccggcgacgaagccgcgncagcacgttatattgaaggccgtttaagcaaatttgctttagaggttttattcaataacaaaaccactaactggcaattaagttacgatggcaggaaaaatgagcccgttacgcttcctgtaaaatttcctttggttttagctcacggtgctgatggcattgctgtgggtcttgcaactaaaatcttgccgcacaattttattgagctcatacaagcttcaatcaagcatttaaaaggaagaaaatttgatctctatcctgattttctaaccggcgctatgattgatgttacagactacaacgaaggcaaaagaggaggcagggttaaagtaagggcacatattgaggaggtagataaaaaatcattggttataaaaagtgttccttatggtgttactacaattcaattaattgattctatagttaaagccaatgaccagggaaaaatcaagattaaaaaagtaactgataatactgcagctgaagtagaaataatgattgacctggcaccgggtatttcggccgatataaccattgatgcgctttataaatttacagattgcgaagtttcaatttcacccaacacatgtgttatcatcaataacaaaccacattttgtgagtgtgcaggagcttttacgtgtttcaacagacaacacaaaagccttactacaaaaggaacttgaaataaaattggcagagttgcaagataaatggcattacacatcattagaaaaaatatttttgaagaaaagatatataaggagcggagaaaaaatagaaacctggtaa

SEQ ID NO: 6166 - protein, 304 aa, Unknown
  Obtained from environmental sample
  DOMAIN (1)...(300): DNA gyrase/topoisomerase IV, subunit A
  misc_feature (1)..(304): Xaa is any amino acid
MQYHPHGDASIGDALVNMVQKDLLIDTQGNWGDIRTGDEAAXARYIEGRLSKFALEVLFNNKTTNWQLSYDGRKNEPVTLPVKFPLVLAHGADGIAVGLATKILPHNFIELIQASIKHLKGRKFDLYPDFLTGAMIDVTDYNEGKRGGRVKVRAHIEEVDKKSLVIKSVPYGVTTIQLIDSIVKANDQGKIKIKKVTDNTAAEVEIMIDLAPGISADITIDALYKFTDCEVSISPNTCVIINNKPHFVSVQELLRVSTDNTKALLQKELEIKLAELQDKWHYTSLEKIFLKKRYIRSGEKIETW

SEQ ID NO: 6167 - DNA, 738 bp, Unknown
  Obtained from environmental sample
  misc_feature (1)..(738): n is a, c, g, or t
gtggccacaacaaatgaaatctacgatcagtacaaggtgaaaatgcaacgtattgccgatttgcgtcatgcacatgcggttttgcaatgggaccaggaaacttacctgcctaaaaaaggggcggagatgcgaggccggcaattaagtactatatcagaacttgctcaccagttatttagcgaggatgaattgggatctattctaagggaattaaaaggaagaggcgatatagatatttcggaaaaaagaaatgtagaattgacgttggaggattatgaaaaaaacaaaaaatattcttccgaatttgtgcgaaaactttctgatcaggtaaataaaacttttcatgcatggattgctgcaagagagcaaaacagtttcttcgtgtttgaaaacgatctttctgtcttaattgatttaaagaaacaggaaacagatatactgggttataaagaccatccttataatgcacttttagatgaatttgagaaaggtgctactattcaattgctggacaaaacgtttacctccctcttgcctaaactaagagaaataatttcaaccatagtttcgaagccacaggtagatgattcctttttgtatcaacattttccaaaacaacagcaatgggaatggggtatgtacctgttaaaacaattgaattttgattttgaagcaggacggcaggacataagtgagcacccctttagcaccagtttaatagcaatgatgtacgcataa

SEQ ID NO: 6168 - protein, 245 aa, Unknown
  Obtained from environmental sample
  DOMAIN (2)...(245): Carboxypeptidase Taq (M32) metallopeptidase
  misc_feature (1)..(245): Xaa is any amino acid
MATTNEIYDQYKVKMQRIADLRHAHAVLQWDQETYLPKKGAEMRGRQLSTISELAHQLFSEDELGSILRELKGRGDIDISEKRNVELTLEDYEKNKKYSSEFVRKLSDQVNKTFHAWIAAREQNSFFVFENDLSVLIDLKKQETDILGYKDHPYNALLDEFEKGATIQLLDKTFTSLLPKLREIISTIVSKPQVDDSFLYQHFPKQQQWEWGMYLLKQLNFDFEAGRQDISEHPFSTSLIAMMYA

SEQ ID NO: 6169 - DNA, 516 bp, Unknown
  Obtained from environmental sample
  misc_feature (1)..(516): n is a, c, g, or t
atgataagagttggcctcctgagtgatacccatagttttattgacccaaaaatatttgaggtctttaaagaggttgatgaggtatggcatgccggtgatttaggaaccattgaattgtgtgatgaactcaaaaagtttaaacccttttatgccgtgcatggtaacattgatgggaaagatattcgcgcagattatcctctgaacctgtcgatagaaagagaagggtttagaattctaatgactcatataggtggttatcccggtagttatgagcctaaggcaagaagaaagattgaagagataaagccggatatctttatttgcggacactcgcatattcttaaagtgatgcgcgatcctaaatacaacaacatggtagtgatgaacccgggggctgctggcgttcagggttttcataaaataaaaacggttttgcgatttaccctgaacaatgggaaaattgaaaacctcgaagcagttgaattgggtaagagaggagaaataaaacaggaatga

SEQ ID NO: 6170 - protein, 171 aa, Unknown
  Obtained from environmental sample
  DOMAIN (2)...(114): Calcineurin-like phosphoesterase
  misc_feature (1)..(171): Xaa is any amino acid
MIRVGLLSDTHSFIDPKIFEVFKEVDEVWHAGDLGTIELCDELKKFKPFYAVHGNIDGKDIRADYPLNLSIEREGFRILMTHIGGYPGSYEPKARRKIEEIKPDIFICGHSHILKVMRDPKYNNMVVMNPGAAGVQGFHKIKTVLRFTLNNGKIENLEAVELGKRGEIKQE

SEQ ID NO: 6171 - DNA, 333 bp, Unknown
  Obtained from environmental sample
  misc_feature (1)..(333): n is a, c, g, or t
atggatataatactattctccggtcgaagtgataatataaaacctgaacttcgtgaatacttggaaagctttattgaaagcaattttctaaaaatcataacaagtagtagattcgattgggcgtttatgggtttagactttgaaaaaaagagcagaatccttttgaatatgttgaaatatggaatagatcatgatccggagttttggtttaagttagagtctcanaaaagcaaaaaagataaaaataatctgatttgtagtaaaattgaattggctataggcatcgatttgatatgtggcaggaagctgntaatacatattacccccctctaa

SEQ ID NO: 6172 - protein, 110 aa, Unknown
  Obtained from environmental sample
  misc_feature (1)..(110): Xaa is any amino acid
MDIILFSGRSDNIKPELREYLESFIESNFLKIITSSRFDWAFMGLDFEKKSRILLNMLKYGIDHDPEFWFKLESXKSKKDKNNLICSKIELAIGIDLICGRKLXIHITPL

SEQ ID NO: 6173 - DNA, 558 bp, Unknown
  Obtained from environmental sample
  misc_feature (1)..(558): n is a, c, g, or t
atgcggattcgtgtggaaatttgtggcgtaaaaaacaacaagattatgataacattaaatacatcccgaattcttgttccttttgatttttcaatcacttcaaaaaaagccttaaaacatgctgcttcgttggcgcaattatacgacggagagttgcaactgctgtatgttcgcaaagccaagtccatcgtaagcatgggatattccatcgcagagttaagggaactggcggccgagtctgacaattataaaaagatgatggaaagcaccgcaaaagaaattagagaagaatttaatatcccggttaaagtgttggtaggcttaggcaaacgcattcccggaattattgctgcttgcgaaaagaatggcgtcggactgattgtcatgggcaccgaaggttcagaatctgtaagtaatcttttcagcggcagtaattcacgcaaagtagtatcgcgctcagagatacctgtgataacagttcgctcggagcctcaaagaaaaggctatgaaaatattttgataccggttgaccttcaaaacacacacgccaaaaaatga

SEQ ID NO: 6174 - protein, 185 aa, Unknown
  Obtained from environmental sample
  DOMAIN (21)...(161): Universal stress protein family
  misc_feature (1)..(185): Xaa is any amino acid
MRIRVEICGVKNNKIMITLNTSRILVPFDFSITSKKALKHAASLAQLYDGELQLLYVRKAKSIVSMGYSIAELRELAAESDNYKKMMESTAKEIREEFNIPVKVLVGLGKRIPGIIAACEKNGVGLIVMGTEGSESVSNLFSGSNSRKVVSRSEIPVITVRSEPQRKGYENILIPVDLQNTHAKK

SEQ ID NO: 6175 - DNA, 507 bp, Unknown
  Obtained from environmental sample
  misc_feature (1)..(507): n is a, c, g, or t
atgagagatttatatatgcttaaattttttcgtttattttttttattcataatttttgtaaattcactacaggcgcagcaattagaaaaaaaattagcttattatcaagtccccttaatttttaatagttggtacccatctattgtcgttgatataaaagggataaaaattccgctgcaattggatcttggtgcagcatctcttgatttgactctcaatccaaatttaataaaaaagtatgcgataaaagttaattattctggaaataaaaaaaatttgtcggatacgcaaggaagaaaaaccattgtcagagagtttattttatccgaagcgaagatcggaaatctgaccatttacaatatcaaagggtatgaaactcatccctttccttgnggtactcccggtgatccgccaaagggaatagaaaatggtgtaataggcctnagcatgctgaataaattgatagtgtcattatttgatataaaaataaaaaacttttttttataa

SEQ ID NO: 6176 - protein, 168 aa, Unknown
  Obtained from environmental sample
  misc_feature (1)..(168): Xaa is any amino acid
MRDLYMLKFFRLFFLFIIFVNSLQAQQLEKKLAYYQVPLIFNSWYPSIVVDIKGIKIPLQLDLGAASLDLTLNPNLIKKYAIKVNYSGNKKNLSDTQGRKTIVREFILSEAKIGNLTIYNIKGYETHPFPXGTPGDPPKGIENGVIGLSMLNKLIVSLFDIKIKNFFL

SEQ ID NO: 6177 - DNA, 471 bp, Unknown
  Obtained from environmental sample
  misc_feature (1)..(471): n is a, c, g, or t
atggagagggccagggtaaggcatatgaataacattacagattacaaaaagaaaaaagtattaatttttggacttgggttaaaccagggtggagtgggctctgctcgctactttgcaaagttaggggcagtagttagagtaactgacttaaaatctgaggagattttaaaaccttcattagaatcattaaaagagtttaaggatattgagtatattctcgagaaacatcgggaagaagatattgattgggcagatttaattattaaaaatcccgcggtaaaacctggtaatcactatattgaatatgcaaaggctaagggaaaaaaagttgaaacagatatgggaattttgcttgatattgttaacccatcccagattattgggattactggaacaaaaggaaaatctactacctcttcgttaatctatgaggttgttaaaaataaatttaaccatgtgttttgggggtaa

SEQ ID NO: 6178 - protein, 156 aa, Unknown
  Obtained from environmental sample
  misc_feature (1)..(156): Xaa is any amino acid
MERARVRHMNNITDYKKKKVLIFGLGLNQGGVGSARYFAKLGAVVRVTDLKSEEILKPSLESLKEFKDIEYILEKHREEDIDWADLIIKNPAVKPGNHYIEYAKAKGKKVETDMGILLDIVNPSQIIGITGTKGKSTTSSLIYEVVKNKFNHVFWG

SEQ ID NO: 6179 - DNA, 426 bp, Unknown
  Obtained from environmental sample
  misc_feature (1)..(426): n is a, c, g, or t
ttgcaagtaaccagtgaacaagtacatgatggaaaaatattacccgaattagtggatgatataactataaaacagaacaaagtagttgaaactgccattatggatggtgcctatgatagtaacaataattttcaatttctatcatttaaaggaattcaaccagcaattaaggtaagaaagaatgccaagtatagaaagacaaaccattatttgagaaacaagaacgtacaatcacagaaaaccaatctacaaaaatggaaagatagcgtaggctatggacaaagatggattgtagaaactgtcttctcctgtatcaagaggatgtttggagaatatgttactgctataagatttgagaacatgataaaggagataatactgaaagcatctttgtataactggtttcaaagtataactgttacataa

SEQ ID NO: 6180 - protein, 141 aa, Unknown
  Obtained from environmental sample
  DOMAIN (6)...(134): Transposase DDE domain
  misc_feature (1)..(141): Xaa is any amino acid
MQVTSEQVHDGKILPELVDDITIKQNKVVETAIMDGAYDSNNNFQFLSFKGIQPAIKVRKNAKYRKTNHYLRNKNVQSQKTNLQKWKDSVGYGQRWIVETVFSCIKRMFGEYVTAIRFENMIKEIILKASLYNWFQSITVT

SEQ ID NO: 6181 - DNA, 615 bp, Unknown
  Obtained from environmental sample
  misc_feature (1)..(615): n is a, c, g, or t
ttgactgctgcaggaagaattgtatccgggcagttaattagaactctcttaattaaaattcagaaagtggatcgaaaaattgaaaagggacgctggaataaaaaaagaatatggaccattgccggtattacggggattgccttgttaatttttgcaagcatctattttacttcgggcaaatcaaaactaaatgttgatgttgaaaggataaccattagcgaagtaagaaaagatgcattccaggaaactatcccgctaaatggcgtggtgcttccccaaaccactatttatcttgatgccgttgaaggtggaagggtagaggaaaaatatgtcgaggacggcgctttcctgaaaaaaggccagcccattctgcggttgtcaaatacagatttggaattaagtttggtaaaccagcaaacatctgtttacaacctgctgacacaaatgcagattgcaaaaaatgctgcgcaacaaaataccaccaccaagctcaatcaaaaaacggatgtagaaagtgctttaaaagaagcgaagcgcatttatgaactggataaatatttatacgagaaaaaggctatcgggttgcaggaattaaacaggcagaaaataatataa

SEQ ID NO: 6182 - protein, 204 aa, Unknown
  Obtained from environmental sample
  misc_feature (1)..(204): Xaa is any amino acid
MTAAGRIVSGQLIRTLLIKIQKVDRKIEKGRWNKKRIWTIAGITGIALLIFASIYFTSGKSKLNVDVERITISEVRKDAFQETIPLNGVVLPQTTIYLDAVEGGRVEEKYVEDGAFLKKGQPILRLSNTDLELSLVNQQTSVYNLLTQMQIAKNAAQQNTTTKLNQKTDVESALKEAKRIYELDKYLYEKKAIGLQELNRQKII

SEQ ID NO: 6183 - DNA, 426 bp, Unknown
  Obtained from environmental sample
  misc_feature (1)..(426): n is a, c, g, or t
gtggaaaggaatgcaggggaacgtggaggcagcccgggtgacctgatcgtactgattgaagaagaaactcatcagcaccttcatcgcgacggactgaatgtagcttatgatttgtatatatctttccccgaagcagttttcgggacgcaggtggaagtgcccaccattgacgggagagcaaagatcaagatacccccggggacacagagtgggaagatattcaggctgaaaggaaaagggtttcctcatgtgaacagctatgagaaaggagatcagctgatccaggtaaatatctggacgccgcaaaatgttagttcagaagaaaaaaacatgcttgaaaaaatgcaggactccgacaattttcagcctaaacctgaaaagaatgaaaagtcgttttttgataaagtaagagaaatgttctcttag

SEQ ID NO: 6184 - protein, 141 aa, Unknown
  Obtained from environmental sample
  DOMAIN (4)...(116): DnaJ C terminal region
  misc_feature (1)..(141): Xaa is any amino acid
MERNAGERGGSPGDLIVLIEEETHQHLHRDGLNVAYDLYISFPEAVFGTQVEVPTIDGRAKIKIPPGTQSGKIFRLKGKGFPHVNSYEKGDQLIQVNIWTPQNVSSEEKNMLEKMQDSDNFQPKPEKNEKSFFDKVREMFS

SEQ ID NO: 6185 - DNA, 324 bp, Unknown; identical to SEQ ID NO: 2941
  Obtained from environmental sample
  misc_feature (1)..(324): n is a, c, g, or t

SEQ ID NO: 6186 - protein, 107 aa, Unknown; identical to SEQ ID NO: 2942
  Obtained from environmental sample
  SIGNAL (1)...(19)
  misc_feature (1)..(107): Xaa is any amino acid

SEQ ID NO: 6187 - DNA, 747 bp, Unknown
  Obtained from environmental sample
  misc_feature (1)..(747): n is a, c, g, or t
atggctgctactgattttaaaatattaattattgatacggacgaggagatactgtcatcggttcaaactgcattgaaaactgaaggatttcagacaaaagtgtgttcaaattcccgggaagcaattcgtattgccaaggaggagcagccgcaactggtattgctggaacttctaatgcctgaattggatggcattgacatcagtattgaacttcgtcaaaatgttgaactggaaaacacattgattgtttttcataccgagcggaatgaagactattctcnaatagccgctttttatgccggagccgatgattatattataaagcccggtgagccacgtgtacttatcagccggnttgaagcattattaaaagacactcacaccaacacaggaaacaaaaaagcaagtagcaggattaccattgatcgtgaaccgtaccttattttaaagatgggactgaaatatcttaacacgaaaggaattcagctctcccctaatatcccccttccaaaaaaaatttacccgcaaaagaatttcccgtttaatagggctttaaaactttccaaaaaacaaacattgaggtcctttcgaaaatttaaaagaaactggggaataattcctccaactttaaaggggtcgtttatagccctcaatttaccacggggcttaaaaaaaccaaaaaaaaaaggggccttgagaggcctccttatatttgggggcgccaaaaatttaaatacaaaccccctt

SEQ ID NO: 6188 - protein, 249 aa, Unknown
  Obtained from environmental sample
  DOMAIN (6)...(127): Response regulator receiver domain
  misc_feature (1)..(249): Xaa is any amino acid
MAATDFKILIIDTDEEILSSVQTALKTEGFQTKVCSNSREAIRIAKEEQPQLVLLELLMPELDGIDISIELRQNVELENTLIVFHTERNEDYSXIAAFYAGADDYIIKPGEPRVLISRXEALLKDTHTNTGNKKASSRITIDREPYLILKMGLKYLNTKGIQLSPNIPLPKKIYPQKNFPFNRALKLSKKQTLRSFRKFKRNWGIIPPTLKGSFIALNLPRGLKKPKKKGALRGLLIFGGAKNLNTNPL

SEQ ID NO: 6189 - DNA, 432 bp, Unknown
  Obtained from environmental sample
  misc_feature (1)..(432): n is a, c, g, or t
gtgtatgttattggccctgatgatcccttatattttaccgataccgtacaaaccccggccggtacgttaagggccagaaagatagatagcttttattcatattctcgtgttcagcttaacttaaaagataatctcgttttagatcagcaaaagaatttgattgccaatgtaggcgttaaaaatgtggaaccgggagaattgaattccatatcagagaaattagaattatatatttttcagaaagataaattcatcagatcctatcaattagtgccttctaatattgacacattagctaaaatgattactggcacagcatctgagcaggtgtttttgcccgttggaaaatatatagttaagcttgcaataacttcgcggctaccaggttatccatctttaagcagtacgaactttaacttggtaataaaataa

SEQ ID NO: 6190 - protein, 143 aa, Unknown
  Obtained from environmental sample
  misc_feature (1)..(143): Xaa is any amino acid
MYVIGPDDPLYFTDTVQTPAGTLRARKIDSFYSYSRVQLNLKDNLVLDQQKNLIANVGVKNVEPGELNSISEKLELYIFQKDKFIRSYQLVPSNIDTLAKMITGTASEQVFLPVGKYIVKLAITSRLPGYPSLSSTNFNLVIK

SEQ ID NO: 6191 - DNA, 342 bp, Unknown
  Obtained from environmental sample
  misc_feature (1)..(342): n is a, c, g, or t
ttgtgtttttgctggatagggggatttgctattggcatgtcgcacaaccggccgaggttggcagtgagtgcatattccacggacctatttctaaagggtcccgaaactaccgaacccacggttgattgtaatggtgatggaaatcccgatacaaattgggacattctaaattgcagattcaatcaatataaagatgtagacaaaatcccttcaaaaatcgaagactggcgcatttgggataagaatactaacggtgaaaataaaattgctaaagttcactacaacacagtgacagacgaaattgtaattttttgtgagaagaaaaaatgcgaagcacagtag

SEQ ID NO: 6192 - protein, 113 aa, Unknown
  Obtained from environmental sample
  misc_feature (1)..(113): Xaa is any amino acid
MCFCWIGGFAIGMSHNRPRLAVSAYSTDLFLKGPETTEPTVDCNGDGNPDTNWDILNCRFNQYKDVDKIPSKIEDWRIWDKNTNGENKIAKVHYNTVTDEIVIFCEKKKCEAQ

SEQ ID NO: 6193 - DNA, 954 bp, Unknown
  Obtained from environmental sample
  misc_feature (1)..(954): n is a, c, g, or t
ttgactgcttctgtcatgggtgatgttcaagctacgtatcactctgaagccgaatctacctataaaacgaagttttatgtgggcatgacttcgatcactgaatgggtcgagcatccaaataatcgtagagaacctatcgaattcattggtataaattctttagcttttgcagaaaacgaaaaattaactaataaattagttaataacataatgacgctcatcaacacacgtgagtatcttactaaccttcgtgaaatacaaaagtctagtatcatgttggtgtttttagcaagattaggttcgcctagcgcgaagtcttatttaaatagccaaattcaatatttaacagagctgggatcttttcgcgaatggctggaattttatcgtcatggagaagagttattaaaattatgggatgaggttaataaaactttaaaccattttgttaattgcataaataaaaaagaaacggtaaaaacttttatcgatgtgataaatgccctcaaccctttttgcttaagtgaagtttgtcagcggattttacgaagaaaagaatggcgcaatgctctttcaacaataaaaccgaatatactagcggaaattaatataacagaagaacaaagcaatatacattgtcttcttaacttgcataatgatgcgagcaaatctcaattgcaattgagtgaattaagaggcacaacgacttccgttactaaaatatctgtgactaatactttgaacnaagtgaataaacaacggcagaaaaaaagactaccgttattaccaccttatgatttgagaaagcttgcttcggggtttgtcgtatttaaatttgcggctcctgaagagaaaaaagcgtgcccctcttctccatttagagcatgggaggacagggggcttttcgatagtcttaagaagggtgttcattcatccctgtccgattactatttttga

SEQ ID NO: 6194 - protein, 317 aa, Unknown
  Obtained from environmental sample
  misc_feature (1)..(317): Xaa is any amino acid
MTASVMGDVQATYHSEAESTYKTKFYVGMTSITEWVEHPNNRREPIEFIGINSLAFAENEKLTNKLVNNIMTLINTREYLTNLREIQKSSIMLVFLARLGSPSAKSYLNSQIQYLTELGSFREWLEFYRHGEELLKLWDEVNKTLNHFVNCINKKETVKTFIDVINALNPFCLSEVCQRILRRKEWRNALSTIKPNILAEINITEEQSNIHCLLNLHNDASKSQLQLSELRGTTTSVTKISVTNTLNXVNKQRQKKRLPLLPPYDLRKLASGFVVFKFAAPEEKKACPSSPFRAWEDRGLFDSLKKGVHSSLSDYYF

SEQ ID NO: 6195 - DNA, 990 bp, Unknown
  Obtained from environmental sample
  misc_feature (1)..(990): n is a, c, g, or t
ttggttgatttcgagcttgcagtaaatcatgagaaaacatcgattcaaatcactccctttactattgaatcggaatgggcgctagcacttaagtcatttttctttcgaccaactccagatgaacagaaagatgatatatggaattattttgcattggcgttccagtactccaagaagagccctgacgaaagcgtgttagcgtttgcccttaataaattcttttacgttcgaatagaaagaaataactgggacattttcgagtcgttactcctaaaaacgggtcttgcagagacttctacgcttcacttgattgctagattattgatttcttacagatcgtttattacgaaacgaaaaattaagaactttgcctatgagctaattaaacaacacgctcaaaaaaatcatgactatgaagttacatgggcgttgtggctgttgaaacagttcgaaattaccgttcgcaaagatattttagaaatggtctttcagacaaatagcgtaacagcaatattggtcggcttggaaatattgcaacaacagaagaatcgtgttgatacacagcctgtgttggaaaagtttgatgaggagaatttaactactcaatattggctattagtctatgagatagctatgaaaggttggttgggagcatcgaccaaaatacttgacaacaattttttcttcagtattttgagggacaaatctatttcattttatgatgaaaaagcgagtttagagcctatcaaggttcaaaggagcctactcaataaaatccttggcaaaatcgatcaagttgaaaagtcattcaggaaaataaaggttaagacaaacaataagaaataccgtaagttatatagaattgaaaagataagaaagaagaatagtcgagatgattccaaaatagctctccaatcgaacagcatcttcgaatgctgcgcaataacacgatcagcaaacagatactccatacgacggccatttgtttag

SEQ ID NO: 6196 - protein, 329 aa, Unknown
  Obtained from environmental sample
  misc_feature (1)..(329): Xaa is any amino acid
MVDFELAVNHEKTSIQITPFTIESEWALALKSFFFRPTPDEQKDDIWNYFALAFQYSKKSPDESVLAFALNKFFYVRIERNNWDIFESLLLKTGLAETSTLHLIARLLISYRSFITKRKIKNFAYELIKQHAQKNHDYEVTWALWLLKQFEITVRKDILEMVFQTNSVTAILVGLEILQQQKNRVDTQPVLEKFDEENLTTQYWLLVYEIAMKGWLGASTKILDNNFFFSILRDKSISFYDEKASLEPIKVQRSLLNKILGKIDQVEKSFRKIKVKTNNKKYRKLYRIEKIRKKNSRDDSKIALQSNSIFECCAITRSANRYSIRRPFV

SEQ ID NO: 6197 - DNA, 861 bp, Unknown
  Obtained from environmental sample
  misc_feature (1)..(861): n is a, c, g, or t
atgtttgcccgtattcgcagatcgggactggtttccataactgatgaagataatgcttctgacgcaatagaaaaacatcgactccgtgaggagaaagcaaaatattttgacgaaaagctacgggaattgtttaagacatacctagaaatgattgataaaggcgtatttctccgaagtgaagctaagaaagaagaaattcaacagataaaagacgaagtcgttgaagcgcggcaaataaaaaattctttaaaagctgagatagatgaatttaaagaaaaaattagtcaggatcttgctaatgcagaaatactccatctaaaagatattttctggaaaactgctgaaataaatagacgcgatataaaaaaatggataataggcattactataatggccgtgatcttaggtgtttttatttattgttttgcgaatcaatgttggattgatctccaatgcttttttaataatcaaaatacattacttgagttgcagaagccgaatactataaagcttactaatgaaaatattcgaattctatttatttacgaactggtaaaaaaagccgtgttgcgattgttttttctatcgctaatggtgtttctgttgaagtttttaattcgcaattataatgccttaatgcataatattacattgaatgaaagcaaagcaaataccttggccgcgttatttagaagtgttgatactatgaccaagccggaagacaaagatgcactaatgaaaataggtgcgaaggagatatttgtgctatcaaaaactgggtatttgcaaaaagaagatgctagcatcgatttgaagttgtttgaaaaactatcttcgatactaaataancataaagaataa

SEQ ID NO: 6198 - protein, 286 aa, Unknown
  Obtained from environmental sample
  misc_feature (1)..(286): Xaa is any amino acid
MFARIRRSGLVSITDEDNASDAIEKHRLREEKAKYFDEKLRELFKTYLEMIDKGVFLRSEAKKEEIQQIKDEVVEARQIKNSLKAEIDEFKEKISQDLANAEILHLKDIFWKTAEINRRDIKKWIIGITIMAVILGVFIYCFANQCWIDLQCFFNNQNTLLELQKPNTIKLTNENIRILFIYELVKKAVLRLFFLSLMVFLLKFLIRNYNALMHNITLNESKANTLAALFRSVDTMTKPEDKDALMKIGAKEIFVLSKTGYLQKEDASIDLKLFEKLSSILNXHKE

SEQ ID NO: 6199 - DNA, 489 bp, Unknown
  Obtained from environmental sample
  misc_feature (1)..(489): n is a, c, g, or t
atgattggcatctatccttttgctggtgtatcagagaaccatcatcctctggaaacatgttcagacatctggaaatgggcaatagatcttctgaagcttggcaaacatggaaaacaatttcctgtgatatgtgctgacttgttctacttggacaattcagcacaaaacatcctcctagacaaatcaatgacttaccattgttctgtgaaaaaaaactggtttccatatatttttaatcatttggaaggaaaagtaaaagatatggataaatgggcagccatggaaaatacaaaaacaggtgagattgcaactttcacatggtcaggagaccctaacattggtaagaagcacctgatgtcttcactcatgaaaaaacaccctggtaagcaaccagcaaacaacccacctgggtgggatgtttacaaatacatgtatgctggttgcaaccagtttaatcagcaaattgggctttttgtatggccctattga

SEQ ID NO: 6200 - protein, 162 aa, Unknown
  Obtained from environmental sample
  misc_feature (1)..(162): Xaa is any amino acid
MIGIYPFAGVSENHHPLETCSDIWKWAIDLLKLGKHGKQFPVICADLFYLDNSAQNILLDKSMTYHCSVKKNWFPYIFNHLEGKVKDMDKWAAMENTKTGEIATFTWSGDPNIGKKHLMSSLMKKHPGKQPANNPPGWDVYKYMYAGCNQFNQQIGLFVWPY

SEQ ID NO: 6201 - DNA, 720 bp, Unknown
  Obtained from environmental sample
  misc_feature (1)..(720): n is a, c, g, or t
atggattttgattcaattctgatatctcatatgaccgattctgacagcacaaagggagaactgatcgaattactgatagttgatgatgaaaagctggtacgggacagtttacacaagatttttgaatctgacgggcaaaaagcggtttcggcgcaaagcggccgggaggccatagacatcttgaacagacaccgggtggagctggttttgctggacctgaacatgccggatttcaatgggtatgatgtgttgaaacatatcgatgatatgggattaaaatcccaggtgattgtgatcagcggagacgccggtttcgtagaggcgaggcgcaccctgcgctatagttttgtccatgatttcattaaaaagccctacgaggtcaaagcattaaaaaataccgtcgcgaaagcgcaaaaaatcattcatttgcaagatcaaaaccaacagattctgaatcgtctgcatcattcggaacagatgcatcgtttttttgtagaaaactctccggacatcatttttctaatgaatgagactggaagtttcacctatttgaataaagccgtagaaactattttagggcggtcgctggccgaaataacggggaaacattattcgaatgtggtctataaggaagactggagaaaagccgaggcatttttaacagtgcggctctggatcaaaatccaaaaacggccagntacgcctgctgggtcaaaatga

SEQ ID NO: 6202 - protein, 239 aa, Unknown
  Obtained from environmental sample
  DOMAIN (159)...(221): PAS domain
  misc_feature (1)..(239): Xaa is any amino acid
MDFDSILISHMTDSDSTKGELIELLIVDDEKLVRDSLHKIFESDGQKAVSAQSGREAIDILNRHRVELVLLDLNMPDFNGYDVLKHIDDMGLKSQVIVISGDAGFVEARRTLRYSFVHDFIKKPYEVKALKNTVAKAQKIIHLQDQNQQILNRLHHSEQMHRFFVENSPDIIFLMNETGSFTYLNKAVETILGRSLAEITGKHYSNVVYKEDWRKAEAFLTVRLWIKIQKRPXTPAGSK

SEQ ID NO: 6203 - DNA, 984 bp, Unknown
  Obtained from environmental sample
  misc_feature (1)..(984): n is a, c, g, or t
ttgtttttggtcatctcctggtataaagttgtaccttgtgtgagattgaaacaacaatctctgcgtatgtcaaaaaagaaattcaaagagcggaaagagaagaaaaacaaggaagaagtaaagtcacttcgcaaaaccattctcgatattttcgaggaaaatccaggtaaggcatacgacttcaaacaaattgcccgtaaaacggattccaagaaaaaagaacttaacaaagagatctttaaaattctggatgaactggttgatgatggaaagatcaagcacctgcccaccggtggctacgcctcagcccgtaaacccaaaaccgttaccggtcgcgtggaccatgtaaaccctcgcttcgcctatgtcgttacagctgatcccgaagccaaagacatctatgtaaaaaccaccgatctcgcctcagcgcttcatggcgataccgtggaggtggaaatgtataaaaagagtcgtggtgccaatcccgaaggtgaagtaacaaacatcgttacacgggcgcgcacacgttttgtgggcaggatcgaagtatccaagaactacgcgttcgtggtgcccgattttaaaaaaatctaccaggactttttcatttatccggagaacatcaacggggcgaaaaccaatgacaaagtcgtttttgaagtgactaagtggcctgtaggcgataagaacccggaagccaaagtctcgaanattctgggccaaacaggtgaaaacaatgctgagatccacagcatcatggccgagtttgatctgccgttccgtttccccaccgaagttttgctggaagccgaanacatttcggttgagataccaaaagaggagattaaaaagcggaaaggactttcgcgagatactttacgtcaccatcgatccggagaacgcaaagatttgacgatgcatctcttttcggagttggaaacggtcttacgaataggggtaccatggcgatgtatcgactactaa

SEQ ID NO: 6204 - protein, 327 aa, Unknown
  Obtained from environmental sample
  misc_feature (1)..(327): Xaa is any amino acid
MFLVISWYKVVPCVRLKQQSLRMSKKKFKERKEKKNKEEVKSLRKTILDIFEENPGKAYDFKQIARKTDSKKKELNKEIFKILDELVDDGKIKHLPTGGYASARKPKTVTGRVDHVNPRFAYVVTADPEAKDIYVKTTDLASALHGDTVEVEMYKKSRGANPEGEVTNIVTRARTRFVGRIEVSKNYAFVVPDFKKIYQDFFIYPENINGAKTNDKVVFEVTKWPVGDKNPEAKVSXILGQTGENNAEIHSIMAEFDLPFRFPTEVLLEAEXISVEIPKEEIKKRKGLSRDTLRHHRSGERKDLTMHLFSELETVLRIGVPWRCIDY

SEQ ID NO: 6205 - DNA, 396 bp, Unknown; identical to SEQ ID NO: 1837
  Obtained from environmental sample
  misc_feature (1)..(396): n is a, c, g, or t

SEQ ID NO: 6206 - protein, 131 aa, Unknown; identical to SEQ ID NO: 1838
  Obtained from environmental sample
  misc_feature (1)..(131): Xaa is any amino acid

SEQ ID NO: 6207 - DNA, 333 bp, Unknown
  Obtained from environmental sample
  misc_feature (1)..(333): n is a, c, g, or t
ttggttatcctcataagcttttacaatttcagttttcaattcatcaggaattggaaacaaagcgggattaaaatccccaatggtaaaattatatacagaacttccctgcttaattttttcattgatctctccggccagtttaatgatttccgaaccaatgaggttttgagcaaggtcagatacttttttcgacatagttataagtggaaacagattttgaaatacaccatttttgttccgcccgcaacatacctccatcggcccaaaatccnaaatcagttggntgttaatggtggtcgtttttataagggtttgaagttctgcccagtttga

SEQ ID NO: 6208 - protein, 110 aa, Unknown
  Obtained from environmental sample
  misc_feature (1)..(110): Xaa is any amino acid
MVILISFYNFSFQFIRNWKQSGIKIPNGKIIYRTSLLNFFIDLSGQFNDFRTNEVLSKVRYFFRHSYKWKQILKYTIFVPPATYLHRPKIXNQLXVNGGRFYKGLKFCPV

SEQ ID NO: 6209 - DNA, 336 bp, Unknown
  Obtained from environmental sample
  misc_feature (1)..(336): n is a, c, g, or t
atgaataagcaagaggcttacgaagaagcggttaaggagatcaaagggatcatcgacggagaaacagatctgattgccaatttatccaatacggtggccatcctcaaagaaaaattccacttctggtggatcggcttttacatagtaaaaagtgaccaattggttttaggtccttttcaggggccggtggcctgtacccgtattgcaaaaggaaaaggagtttgtggaaccagctgggagcaaaaacaaaccattcttgttcctgatgtgcatcagtttccagggcatatcgcctgcagctcagccagtaattcagaaatcgtaattccggtttaa

SEQ ID NO: 6210 - protein, 111 aa, Unknown
  Obtained from environmental sample
  misc_feature (1)..(111): Xaa is any amino acid
MNKQEAYEEAVKEIKGIIDGETDLIANLSNTVAILKEKFHFWWIGFYIVKSDQLVLGPFQGPVACTRIAKGKGVCGTSWEQKQTILVPDVHQFPGHIACSSASNSEIVIPV

SEQ ID NO: 6211 - DNA, 474 bp, Unknown
  Obtained from environmental sample
  misc_feature (1)..(474): n is a, c, g, or t
ttggacacaacaaagccatatttaaaacagctggcaaaattaaatgaagaaattgagggtttgatttctcaggttgaaaattataaaaagcagcggagtgaaacaccaagcagaatcaaaatcggcgaaatgcctgaaaatttcagatataacagacttgatactgaaagtaaacacttccagaacatcattaaaatgatttgttacagagccgaaacctcttgtgcaaatgtatttgccgatttttacggaaaatacgaaaatgaaaaaagagatttagttaaatgtattataaacgcaagaggagatatcatagccgactacaaaaacaatattctgtccgtcagtttatattcacttgcaaatccaagaatgaacagagctctcgaaatgttgtgtaatttaattaatgaagcggaggtcaaatatcccggtaccgaaatgtccctttttttcaaaactgcgaactcctga

SEQ ID NO: 6212 - protein, 157 aa, Unknown
  Obtained from environmental sample
  misc_feature (1)..(157): Xaa is any amino acid
MDTTKPYLKQLAKLNEEIEGLISQVENYKKQRSETPSRIKIGEMPENFRYNRLDTESKHFQNIIKMICYRAETSCANVFADFYGKYENEKRDLVKCIINARGDIIADYKNNILSVSLYSLANPRMNRALEMLCNLINEAEVKYPGTEMSLFFKTANS

SEQ ID NO: 6213 - DNA, 516 bp, Unknown
  Obtained from environmental sample
  misc_feature (1)..(516): n is a, c, g, or t
ttgagccgtctcctgcgtgtcggggaagaaaaaataaaagatgatttaaaaaaaattacagcctttcacattatcgaatatataccgcaaaacgatgcaccctttatcatttttaaaaagaaccgggtggcaacggaaaatcttaccatcaatttatcattgtacaaaaaaaggaaagaagcatttattgaacgtgtaaaaaaaattattgagtatacacaaacaaaagaatgcaggagcatttttgtcaactattattttggcgactatgatattaaagcctgcggtatttgtgataattgccgcagggcaaagactttacatttgtcaacagaagaattcgaaaaaattaaaaactgcattttcgttgttcttaaagcaaaaagcatcggctcatcggaattattgcgaacgctccagggcatcagcaaagaaaaagcctggagtgttttaaattttctccaggctgaacaaaaggtttttataaatgaaaaaggcgaattgtctttgagctaa

SEQ ID NO: 6214 - protein, 171 aa, Unknown
  Obtained from environmental sample
  misc_feature (1)..(171): Xaa is any amino acid
MSRLLRVGEEKIKDDLKKITAFHIIEYIPQNDAPFIIFKKNRVATENLTINLSLYKKRKEAFIERVKKIIEYTQTKECRSIFVNYYFGDYDIKACGICDNCRRAKTLHLSTEEFEKIKNCIFVVLKAKSIGSSELLRTLQGISKEKAWSVLNFLQAEQKVFINEKGELSLS

SEQ ID NO: 6215 - DNA, 684 bp, Unknown
  Obtained from environmental sample
  misc_feature (1)..(684): n is a, c, g, or t
ttgctttcgagaaaaaacatcgagtcaggaaatgcctatcagaaagcaaaatcactttatgaaggaaggcagaaaaacaaaatcataaaggaaaatctaccgaaggcttggcaaaaactgatttccgagcctgatgaaaagtttgtagagttgttaaatgaaactctcgaaaaaatttgcggttacaaagcggaagaatatcaaataacagattttcttcaacaggtgtttccaggcgtttctataaattcaattgttaagcaaaatacaataattccggttgaagttaaacccaatcgagtcagctcgagagaaaatccgcatccgaaatctcagtatgatactattgtcgtttcagctagagaagagggatttttgacggagtttattgggaataaatgctggtacgctatcagaatgaatccggcaatgattcccaaaattaaatatattgcggcatatcaagtagctccaatttctgcaattacttatatagctgaaatttcaagaattgaatcttatcaaaacagcggtaaatatattcttttcttcaaaagcgatccggaaaaaattaaagaagtgaaattaggaaaacttccgggaaaagctcctcaatcgccgaggtattcaacgcgaaaagaaatattaaatgccaaatcacttgatgatttatttaacttttaa

SEQ ID NO: 6216 - protein, 227 aa, Unknown
  Obtained from environmental sample
  misc_feature (1)..(227): Xaa is any amino acid
MLSRKNIESGNAYQKAKSLYEGRQKNKIIKENLPKAWQKLISEPDEKFVELLNETLEKICGYKAEEYQITDFLQQVFPGVSINSIVKQNTIIPVEVKPNRVSSRENPHPKSQYDTIVVSAREEGFLTEFIGNKCWYAIRMNPAMIPKIKYIAAYQVAPISAITYIAEISRIESYQNSGKYILFFKSDPEKIKEVKLGKLPGKAPQSPRYSTRKEILNAKSLDDLFNF

SEQ ID NO: 6217 - DNA, 1041 bp, Unknown
  Obtained from environmental sample
  misc_feature (1)..(1041): n is a, c, g, or t
gtgaagaaagaagagcaaggtgccggcgaccagggaatgatgtttggctatgcgaccagcgaaacagataattacatgccgttagcgcttgatctcgcgcatcgcattttgattgaactctccgctattcgtcgtgaaggtaagctcatgaagtatctccgcccggacgcgaagtcacaggtgacgatcgagtacagcgatgacaacaaaccgatgcggattgacagcattgtcgtgagcacacaacatgatgaatttgtattgtcaaaaaatggaaaggcagatgacaagctccgcgcacaaaaaagtatgcaggcacagatcagggaagatgtcatcaacatcgtgctcccgcgcgtgcagaaaaaattgaaaccatcgctgcgcaaattatttaccaagaacatcacctatcacatcaaccccaccggcaattttgtgattggcggtccgcatggtgataccggtctgacaggtcgcaagatcatcgtcgatacgtatggtggcaaaggcgcgcatggtggcggtgcattctccggtaaagatcctagcaaggtagaccgttccggtgcatacgctacccgtcatatcgctaaaaatcttgtcgctgcaggtgtgtgcgatgaagttttagttcaagtctcgtatgctatcggtgttgcggagccgacgaatatatatgtgaatacgttcaattcaagccgggttgagctgagtgatgctgagatttcggatcgcgtgaagaagatattcccgatgcgcccgtacgatattgagcagcgccttaaactgcgcaagcccatctacagtgaaacggcatcctatggacacatgggccgcacaccggaaatgaaagaggtcaccttctatgatggcagtggcaaagcgaaaaccgtaaaaattgaaacctttacctggnagaaactcgacatggtgaaggatgtcaaaaagctttcaactgagttgatggcgtggttgcaaagtggggtagtattttttgaaaacccgttattactgggaatgaaaaagatccctccttga

SEQ ID NO: 6218 - protein, 346 aa, Unknown
  Obtained from environmental sample
  DOMAIN (4)...(146): S-adenosylmethionine synthetase, central domain
  misc_feature (1)..(346): Xaa is any amino acid
MKKEEQGAGDQGMMFGYATSETDNYMPLALDLAHRILIELSAIRREGKLMKYLRPDAKSQVTIEYSDDNKPMRIDSIVVSTQHDEFVLSKNGKADDKLRAQKSMQAQIREDVINIVLPRVQKKLKPSLRKLFTKNITYHINPTGNFVIGGPHGDTGLTGRKIIVDTYGGKGAHGGGAFSGKDPSKVDRSGAYATRHIAKNLVAAGVCDEVLVQVSYAIGVAEPTNIYVNTFNSSRVELSDAEISDRVKKIFPMRPYDIEQRLKLRKPIYSETASYGHMGRTPEMKEVTFYDGSGKAKTVKIETFTWXKLDMVKDVKKLSTELMAWLQSGVVFFENPLLLGMKKIPP

SEQ ID NO: 6219 - DNA, 789 bp, Unknown
  Obtained from environmental sample
  misc_feature (1)..(789): n is a, c, g, or t
gtgacgatcgagtacagcgatgacaacaaaccgatgcggattgacagcattgtcgtgagcacacaacatgatgaatttgtattgtcaaaaaatggaaaggcagatgacaagctccgcgcacaaaaaagtatgcaggcacagatcagggaagatgtcatcaacatcgtgctcccgcgcgtgcagaaaaaattgaaaccatcgctgcgcaaattatttaccaagaacatcacctatcacatcaaccccaccggcaattttgtgattggcggtccgcatggtgataccggtctgacaggtcgcaagatcatcgtcgatacgtatggtggcaaaggcgcgcatggtggcggtgcattctccggtaaagatcctagcaaggtagaccgttccggtgcatacgctacccgtcatatcgctaaaaatcttgtcgctgcaggtgtgtgcgatgaagttttagttcaagtctcgtatgctatcggtgttgcggagccgacgaatatatatgtgaatacgttcaattcaagccgggttgagctgagtgatgctgagatttcggatcgcgtgaagaagatattcccgatgcgcccgtacgatattgagcagcgccttaaactgcgcaagcccatctacagtgaaacggcatcctatggacacatgggccgcacaccggaaatgaaagaggtcaccttctatgatggcagtggcaaagcgaaaaccgtaaaatttgaaacctttacctgggagaaactcgacatggtgaaggatgtcaaaaaagctttcaacctgagttga

SEQ ID NO: 6220 - protein, 262 aa, Unknown
  Obtained from environmental sample
  DOMAIN (2)...(86): S-adenosylmethionine synthetase, central domain
  misc_feature (1)..(262): Xaa is any amino acid
MTIEYSDDNKPMRIDSIVVSTQHDEFVLSKNGKADDKLRAQKSMQAQIREDVINIVLPRVQKKLKPSLRKLFTKNITYHINPTGNFVIGGPHGDTGLTGRKIIVDTYGGKGAHGGGAFSGKDPSKVDRSGAYATRHIAKNLVAAGVCDEVLVQVSYAIGVAEPTNIYVNTFNSSRVELSDAEISDRVKKIFPMRPYDIEQRLKLRKPIYSETASYGHMGRTPEMKEVTFYDGSGKAKTVKFETFTWEKLDMVKDVKKAFNLS

SEQ ID NO: 6221 - DNA, 342 bp, Unknown
  Obtained from environmental sample
  misc_feature (1)..(342): n is a, c, g, or t
ttgcatgtagttgatatttctcatcctcaatatgaggagcaatacggagttgtgaacaagactttgcaggaactacattcatttgacaagcccacaataaccatttttaataagatggatctgtacgaaaaaaacacttttgatgaatggctgcctggtaatattaaggaagaaattttagatgaattgaaagataaatggcaaagggaaacaaacggaaattgtgtatttgtttctgcaactgaaagaaaaaatatcgaatcacttcgacaggtaattctaaacaaagtaagaggtatttaccaggaaaggtatccttacaaagccgagttttacttttaa

SEQ ID NO: 6222 - protein, 113 aa, Unknown
  Obtained from environmental sample
  misc_feature (1)..(113): Xaa is any amino acid
MHVVDISHPQYEEQYGVVNKTLQELHSFDKPTITIFNKMDLYEKNTFDEWLPGNIKEEILDELKDKWQRETNGNCVFVSATERKNIESLRQVILNKVRGIYQERYPYKAEFYF

SEQ ID NO: 6223 - DNA, 378 bp, Unknown
  Obtained from environmental sample
  misc_feature (1)..(378): n is a, c, g, or t
atgtttctgttgcaatttaccaagactaggcgaaaggctccaaggccttcgcgattgttatgcgaattaaaagaagggccaaatggtcaactgacttgggctacttcgataccagaaggcaaagataagaacatcgagaagtgggtaatatacctgaaatggatcgctgaacataaacctacatttcagcttgagattgcgcaagcacatggcgtatcagctcaggcaattaacaaacatattgataagctgaattcaaaaggctatttggatgggcttatcgttacgaaaaatggacatgaatttctctcgagcataaaaaatcaacctaggggggttgatcaacctgcagcgtttaggaggttgatcgatggttga

SEQ ID NO: 6224 - protein, 125 aa, Unknown
  Obtained from environmental sample
  misc_feature (1)..(125): Xaa is any amino acid
MFLLQFTKTRRKAPRPSRLLCELKEGPNGQLTWATSIPEGKDKNIEKWVIYLKWIAEHKPTFQLEIAQAHGVSAQAINKHIDKLNSKGYLDGLIVTKNGHEFLSSIKNQPRGVDQPAAFRRLIDG

SEQ ID NO: 6225 - DNA, 381 bp, Unknown
  Obtained from environmental sample
  misc_feature (1)..(381): n is a, c, g, or t
atgctcagtaagctcctgtattatataatcataatccccctttccctgctcccattccggctgctttatataatttccgattttctatatattgttatctattatattgccggctacaggaaaaaagtagtcataaaaaatatccaaaattcatttccggaaaaaagtcctgctgaacagaccaccatcatcaaaggtttttacaggcacatgtgtgatcttatagttgaaagtctgaaaatatttaccatcacaggcaaaaatgcccggcaaagaatgaaactgctgaatcctgaattcattcagcaatattacaatgaaggaaaaagtattatcatggccggcggtcatctgaacaactgggaattatttgctgtgtaa

SEQ ID NO: 6226 - protein, 126 aa, Unknown
  Obtained from environmental sample
  misc_feature (1)..(126): Xaa is any amino acid
MLSKLLYYIIIIPLSLLPFRLLYIISDFLYIVIYYIAGYRKKVVIKNIQNSFPEKSPAEQTTIIKGFYRHMCDLIVESLKIFTITGKNARQRMKLLNPEFIQQYYNEGKSIIMAGGHLNNWELFAV

SEQ ID NO: 6227 - DNA, 351 bp, Unknown
  Obtained from environmental sample
  misc_feature (1)..(351): n is a, c, g, or t
ttgatcgagaagtttttgggcttgatcggcagcggcgtcaaagaagtaaagatccgaactgaagagatccttgatatcaaatttcgcaaaggcattttcaaacgaggtgtgaagatcgagatccggaccaagactttcgcgaagttaaccgaattgccgacaagcgacgggaaaatatcactcaagctcgacaaagacgatttcgaacgcggccgcggcgctgtcgcacagctgcaaaaggacattgaggaacacgctgattcgctgccgcccgcgcagacgccggtcagttccctgttcacggatgaatccgaagacgaaacgaaattgctcgaagtggaggaaaaataa

SEQ ID NO: 6228 - protein, 116 aa, Unknown
  Obtained from environmental sample
  misc_feature (1)..(116): Xaa is any amino acid
MIEKFLGLIGSGVKEVKIRTEEILDIKFRKGIFKRGVKIEIRTKTFAKLTELPTSDGKISLKLDKDDFERGRGAVAQLQKDIEEHADSLPPAQTPVSSLFTDESEDETKLLEVEEK

SEQ ID NO: 6229 - DNA, 360 bp, Unknown
  Obtained from environmental sample
  misc_feature (1)..(360): n is a, c, g, or t
atgctttcgaagcccggggtgaataccggtttagaatcaactgcgataatgaaaaaaatgatttatataacccagctaatctacataaaagaaggccagcaggaagtgttccatcaatttgaagacattgccataccgacaatttcgaaacataacggacggcttctattacgcattcaaccgacagatgattgtttcattgaatccaacattgagaagccatatgaaatacacattgttgagttcgacagcgaacaggactttgaaaatttcaaaaacgataaggaacgacaaaaatttttacatctgaaagaccaatcagtaaaatacgcaacattgattcaaggcacgaagatttaa

SEQ ID NO: 6230 - protein, 119 aa, Unknown
  Obtained from environmental sample
  misc_feature (1)..(119): Xaa is any amino acid
MLSKPGVNTGLESTAIMKKMIYITQLIYIKEGQQEVFHQFEDIAIPTISKHNGRLLLRIQPTDDCFIESNIEKPYEIHIVEFDSEQDFENFKNDKERQKFLHLKDQSVKYATLIQGTKI

SEQ ID NO: 6231 - DNA, 360 bp, Unknown
  Obtained from environmental sample
  misc_feature (1)..(360): n is a, c, g, or t
atgtttaaggggaaagttaacgagcttacacttcgtttcctggtttacctgtgcgaaaagaacaggataaacctgctttacgatattactgatgacttcgcaacactggtaaacgaaaaacaaggcgttgtgcttgcaaaagtaaaaacagccatcgaaattaccgatggcgaaaagaaggctcttacagacaagttaagattgttcacaggaaaagaaattcaggcaacatattcagttgacccggctattaaaggcggattcattgcaagtgttgatgataaaataatagatgccagcattttaaggcagctcgagcttcttaaagaaaaattcttgatgggaagcatcaataattga

SEQ ID NO: 6232 - protein, 119 aa, Unknown
  Obtained from environmental sample
  DOMAIN (1)...(112): ATP synthase delta (OSCP) subunit
  misc_feature (1)..(119): Xaa is any amino acid
MFKGKVNELTLRFLVYLCEKNRINLLYDITDDFATLVNEKQGVVLAKVKTAIEITDGEKKALTDKLRLFTGKEIQATYSVDPAIKGGFIASVDDKIIDASILRQLELLKEKFLMGSINN

SEQ ID NO: 6233 - DNA, 429 bp, Unknown
  Obtained from environmental sample
  misc_feature (1)..(429): n is a, c, g, or t
atgaataatctagttattgtagcaattccggaagaaaacgattatatttacaaagtatctagcgaaaaagttcctcatatgacacttttacttcttggagaagatgtaactaaagttaagaatcttgataaaattttagattttgtaaaacattctgcgaatacatcacttaatcgttttggattggaagtagatcgtcgaggaatattaggtcctgataaagcggatgtattattcttttctaaaaatacgtggagtggatttaaaaaagtaaatgagtatagatcttatttacttaagaaaataatattcgtacagcgtatgaatctactacccagtttccagaatggnatcctcatattactcttggnattcctgaaacacccgcaaaaccagacgaacgcgattatcccagaattnaatatgtaa

SEQ ID NO: 6234 - protein, 142 aa, Unknown
  Obtained from environmental sample
  misc_feature (1)..(142): Xaa is any amino acid
MNNLVIVAIPEENDYIYKVSSEKVPHMTLLLLGEDVTKVKNLDKILDFVKHSANTSLNRFGLEVDRRGILGPDKADVLFFSKNTWSGFKKVNEYRSYLLKKIIFVQRMNLLPSFQNGILILLLXFLKHPQNQTNAIIPEXNM

SEQ ID NO: 6235 - DNA, 429 bp, Unknown
  Obtained from environmental sample
  misc_feature (1)..(429): n is a, c, g, or t
atgacaagagaaatttcctactatgaatttgttggtattctggtccctagtgtaatattattgtttactacacaaatgattataggtaagtatggatatgaatggtttgatttttccaaagttggcgaatctatagttttcttagttatttgctatggaataggacatctattacatagtcttggtaatgtgtttgaagcagttgtctggtggattacaggtggcaagcccacaaaatggataaacggaaaacagaattattggaagaagctcttcgatacttcagatctggaaaagataaaaactaaaattgcacttgaatttggaagtgacactagcaaggatcatggaagacttatctattcaaaattgttcgacaaaggcaaagctggcagaattgatattttcaatggtaatcttcatgtatag

SEQ ID NO: 6236 - protein, 142 aa, Unknown
  Obtained from environmental sample
  misc_feature (1)..(142): Xaa is any amino acid
MTREISYYEFVGILVPSVILLFTTQMIIGKYGYEWFDFSKVGESIVFLVICYGIGHLLHSLGNVFEAVVWWITGGKPTKWINGKQNYWKKLFDTSDLEKIKTKIALEFGSDTSKDHGRLIYSKLFDKGKAGRIDIFNGNLHV

SEQ ID NO: 6237 - DNA, 756 bp, Unknown
  Obtained from environmental sample
  misc_feature (1)..(756): n is a, c, g, or t
gtgtcttcatctccctttgtacattatttaacaaaccagtttctccaattcgctccaaagctgcatcctgttggagacaagtatttttttagtactttcaaaccagaaccacacatgaaacaagaaaaaatcacactggctttagtagatgaccaccagatcgttatagacggtctgaccgccctgttaaaaggtcatgaccagttcaaattcgcctttgctactaccgattcagctgaagtaatggaccggatcgccaccacacccgttgatatcctgctgacggacgtgatgatgcctaatcttcccggcaaccagctggccaggcaggtaagggaaaaataccccaacgtaaagatccttgctttatccatgagtggccagggcgacctggtgaacgaaatgatcaatgatgcggatatttccgggtatgtattgaaaaatatcggtaagcaggaactcgtaaaagccatcgagaagatcgccaacggcgggatttatttcagcgaagaagtgatcgacgaattgcaacgggccagtacccggcgcaaacaaaaagaacaagcgcatctcaccgaccgcgagatcgagatcattcgcctgatcgaaaaagaatacaataataaactgatcgccgaaaccttattcatcagtgaacgtaccgtagaaacccaccggaagaatattttccgcaagacgaataccaactccgtgatcggcctggtgaaatatgcgtatgagcataagctgatttga

SEQ ID NO: 6238 - protein, 251 aa, Unknown
  Obtained from environmental sample
  DOMAIN (188)...(245): Bacterial regulatory proteins, luxR family
  misc_feature (1)..(251): Xaa is any amino acid
MSSSPFVHYLTNQFLQFAPKLHPVGDKYFFSTFKPEPHMKQEKITLALVDDHQIVIDGLTALLKGHDQFKFAFATTDSAEVMDRIATTPVDILLTDVMMPNLPGNQLARQVREKYPNVKILALSMSGQGDLVNEMINDADISGYVLKNIGKQELVKAIEKIANGGIYFSEEVIDELQRASTRRKQKEQAHLTDREIEIIRLIEKEYNNKLIAETLFISERTVETHRKNIFRKTNTNSVIGLVKYAYEHKLI

SEQ ID NO: 6239 - DNA, 852 bp, Unknown
  Obtained from environmental sample
  misc_feature (1)..(852): n is a, c, g, or t
ttggctttagatatagtttttacttactcgcaagataagtctcctactgtacattatttgggtatctttggagacaataattctggaaaaagtagtattggcgatgtttttgaagccttagcatatagaacggtgaatacaactgatcccagtccggctaacatatttagatctcttggccctgttgaaccaggtcaaataaccctagtccttgatgaggccgaaaaaattgaccagtcttatgacatgatgacaattctaaagaccggttatgactataggaaaacagtctcaaaggttaatgattttagtcgcaaatcagaaaaattcttcacctattgtcaaaagttgattattggcgaacgtgctccaagtccaattagagcaaaggggttaaacgacaggttattgtcagatatagtttactatggaactcctacatatgatattaaagaaatactaaatactactcattccagcgacgagatatgtcaaaccttatttaaagagattcaagaatttagaaaacttttgtttatttataggctaattcattttgaagatcctatcaaaaatttagatattggtataaaaggaagaaaaaaagaactcgtaaagccgtatatcctattattttcaaatatatcttcagaacgcgataatcaaatattccaagaaattcaaaacacatttgatatattcttaagattaaagtctgaaaagaaagaattcacgttggaggcggcaatggtgccgattgttgtagagttaatggaccaatcctttattaccaaaataaagtttactgatttttgggataaactccgatcggtaatacgaggtaatttttga

SEQ ID NO: 6240 - protein, 283 aa, Unknown
  Obtained from environmental sample
  misc_feature (1)..(283): Xaa is any amino acid
MALDIVFTYSQDKSPTVHYLGIFGDNNSGKSSIGDVFEALAYRTVNTTDPSPANIFRSLGPVEPGQITLVLDEAEKIDQSYDMMTILKTGYDYRKTVSKVNDFSRKSEKFFTYCQKLIIGERAPSPIRAKGLNDRLLSDIVYYGTPTYDIKEILNTTHSSDEICQTLFKEIQEFRKLLFIYRLIHFEDPIKNLDIGIKGRKKELVKPYILLFSNISSERDNQIFQEIQNTFDIFLRLKSEKKEFTLEAAMVPIVVELMDQSFITKIKFTDFWDKLRSVIRGNF

SEQ ID NO: 6241 - DNA, 306 bp, Unknown
  Obtained from environmental sample
  misc_feature (1)..(306): n is a, c, g, or t
atgaaatacttcttgattatactccttatttcttataggccctgctttgggcaaaattatttagataaaaaaattattatcgtagtaagcgacacttcaaatctatacgatcaagcgagagtagctctaggaaagaatgattttattattaaagaaaatggcaacaaacattttattactacacatcctagagaatttaaaaagattccgggctttgctattgccaatgcagaagtaaaaaccgatacagttattattactggtcacttttctttaatgaaaaatacaaatgttggttatacatag

SEQ ID NO: 6242 - protein, 101 aa, Unknown
  Obtained from environmental sample
  misc_feature (1)..(101): Xaa is any amino acid
MKYFLIILLISYRPCFGQNYLDKKIIIVVSDTSNLYDQARVALGKNDFIIKENGNKHFITTHPREFKKIPGFAIANAEVKTDTVIITGHFSLMKNTNVGYT

SEQ ID NO: 6243 - DNA, 456 bp, Unknown
  Obtained from environmental sample
  misc_feature (1)..(456): n is a, c, g, or t
atgataacgggctacaacttaaccaagccaaaactttatcgcaatatgtggagcctgggatggagacagtttgttccttttatgatcactattgttgtaatactgctaaccgatttgctcattggtgttagtattggtctgttgatctcaacttattttattatcaggaataactttaaagcagaatataaaattcaaaaaacaaaccaacacgaaacagaagtatttttcatcaagctcaacacaaatgttacatttctaaataaggtaaaactcaaagatgctttagatcaaattcccgaatactccatacttaccattgacggcagtgactgcaattttattgactacgatattcttgagatcatttcagagtacagcaacaaagcacacgataaacatgttgaattgcatttgaaaggaattgaaaaagtaaatgtaacggccatacattaa

SEQ ID NO: 6244 - protein, 151 aa, Unknown
  Obtained from environmental sample
  misc_feature (1)..(151): Xaa is any amino acid
MITGYNLTKPKLYRNMWSLGWRQFVPFMITIVVILLTDLLIGVSIGLLISTYFIIRNNFKAEYKIQKTNQHETEVFFIKLNTNVTFLNKVKLKDALDQIPEYSILTIDGSDCNFIDYDILEIISEYSNKAHDKHVELHLKGIEKVNVTAIH

SEQ ID NO: 6245 - DNA, 462 bp, Unknown
  Obtained from environmental sample
  misc_feature (1)..(462): n is a, c, g, or t
atgaaatattttctctttatttttttattatcatgtcctgtaacactttcaaatgaaattatttacacagatcctgttaacggcgcggaaatggtaaatattgaaaactgcctgacatttggattttcctctgctcctgcgataaatgctgatgatcttgcaggcaatataatagtaatgggttcattaagcggaaggcaccggggtagagtcatattaaaggaaaacaataaaaaaatcatcttcctgcctgatgaaccatttagttttaatgaacaagttacagtcaggttttatggtgcattgagcaagtatgttacagcgggttcatttcttgaaaatttcacattttatactacatcaaagaaaattatttatgatccggtaaaaggttggaaaaagaaacgggcatatcattacaaaaccctgcgatgtcttcccaccccctgtgcgaatacataa

SEQ ID NO: 6246 - protein, 153 aa, Unknown
  Obtained from environmental sample
  SIGNAL (1)...(17)
  misc_feature (1)..(153): Xaa is any amino acid
MKYFLFIFLLSCPVTLSNEIIYTDPVNGAEMVNIENCLTFGFSSAPAINADDLAGNIIVMGSLSGRHRGRVILKENNKKIIFLPDEPFSFNEQVTVRFYGALSKYVTAGSFLENFTFYTTSKKIIYDPVKGWKKKRAYHYKTLRCLPTPCANT

SEQ ID NO: 6247 - DNA, 309 bp, Unknown
  Obtained from environmental sample
  misc_feature (1)..(309): n is a, c, g, or t
gtgatatgttatatttaccaaattcaaaatttcgattctctttttaaaaatggaggttatatggccgggctaaatcacctggattattatcgtttgccctggaatctatcggacaacattatttcgtggcttgaaccaactgcaaaatgcaatcttgcctgttttggatgttacagaaaaaacgagatcaacagccataaaaccctgcatgaaatcaagaaagacttaatgtatttatgcattacaggaaagtccgatagtatatccatagcagggggtggaaccactgctgcctccgccaaaagttga

SEQ ID NO: 6248 - protein, 102 aa, Unknown
  Obtained from environmental sample
  misc_feature (1)..(102): Xaa is any amino acid
MICYIYQIQNFDSLFKNGGYMAGLNHLDYYRLPWNLSDNIISWLEPTAKCNLACFGCYRKNEINSHKTLHEIKKDLMYLCITGKSDSISIAGGGTTAASAKS

SEQ ID NO: 6249 - DNA, 579 bp, Unknown; identical to SEQ ID NO: 4677
  Obtained from environmental sample
  misc_feature (1)..(579): n is a, c, g, or t

SEQ ID NO: 6250 - protein, 192 aa, Unknown; identical to SEQ ID NO: 4678
  Obtained from environmental sample
  misc_feature (1)..(192): Xaa is any amino acid

SEQ ID NO: 6251 - DNA, 534 bp, Unknown
  Obtained from environmental sample
  misc_feature (1)..(534): n is a, c, g, or t
atgggaattcagggactgggtaaaacaagccggttctttttcggaagcaattcacgatctctcatcaacaaatctacctgcccggtactcgttattccggagacaatcctcttcaagaaaccagagaaaattgtttttgcaaccgactattacgacagcgatctagatgctttacttcaactggtactgatcgcgaagccttttaattctgaaattattatggtgcatgtattcgacgaaaaggaggaggagcagtcggaacaaagcatgatacagtttatttcgaatgaaatatttaaaacagttgattatccccggatcacttatcgagcctattacaataaagatacatcacagggtattaagaatttctgtgattttacaggtgctgatctggtggtgctttccgcccggaagcaaaacatatttcagaagatatttggcaaaagtattacgaaagatctcgtttaccaaagtgacattcccttgttggtttttcatgtacataagatggaaacctctggtgctatttaa

SEQ ID NO: 6252 - protein, 177 aa, Unknown
  Obtained from environmental sample
  misc_feature (1)..(177): Xaa is any amino acid
MGIQGLGKTSRFFFGSNSRSLINKSTCPVLVIPETILFKKPEKIVFATDYYDSDLDALLQLVLIAKPFNSEIIMVHVFDEKEEEQSEQSMIQFISNEIFKTVDYPRITYRAYYNKDTSQGIKNFCDFTGADLVVLSARKQNIFQKIFGKSITKDLVYQSDIPLLVFHVHKMETSGAI

SEQ ID NO: 6253 - DNA, 384 bp, Unknown; identical to SEQ ID NO: 3909
  Obtained from environmental sample
  misc_feature (1)..(384): n is a, c, g, or t

SEQ ID NO: 6254 - protein, 127 aa, Unknown; identical to SEQ ID NO: 3910
  Obtained from environmental sample
  DOMAIN (22)...(127): Hsp20/alpha crystallin family
  misc_feature (1)..(127): Xaa is any amino acid

SEQ ID NO: 6255 - DNA, 477 bp, Unknown
  Obtained from environmental sample
  misc_feature (1)..(477): n is a, c, g, or t
gtgttngagagcagagtgaacaaactggttgttgctgacattgcacacagatattatcctccccatcatgaatcaattttatctgcattaaaatcgctcaatccttctcagttgagttcgagaaaggaagcggaagaactactgcgtatttctattcacgatgaaggaacgattcaatttctcctgaagaatctttattggaaagatgataaaacgctgggatggcgtttcggcctgaatgaaatcgaacgtaatatcgatatggtaggagaagcattgccggtaaaaaagatttcagttccaactctttttctcaaaggtgaaaagtccggatatattactgctgaggatgaagtcatgatcagacagattttcactaatgtaaaaatcgatacaatcagcggtgcaggacattgggttcatgctgaaaatccaaaagagtttctgagtaaaacggtagaatttttaaaggcctga

SEQ ID NO: 6256 - protein, 158 aa, Unknown
  Obtained from environmental sample
  misc_feature (1)..(158): Xaa is any amino acid
MXESRVNKLVVADIAHRYYPPHHESILSALKSLNPSQLSSRKEAEELLRISIHDEGTIQFLLKNLYWKDDKTLGWRFGLNEIERNIDMVGEALPVKKISVPTLFLKGEKSGYITAEDEVMIRQIFTNVKIDTISGAGHWVHAENPKEFLSKTVEFLKA

SEQ ID NO: 6257 - DNA, 543 bp, Unknown
  Obtained from environmental sample
  misc_feature (1)..(543): n is a, c, g, or t
ttgattggtaatttgccggcaatgaagattattgttcgtttaccgaattggctgggtgatatggtaatgtccgttgcttttttacatgaattatacaaacaatatcctggtgcagaagtgagtgtgattgctaagaaaggtttgcatgaactattggcgtttttcccgccgataaaacatgggtttatttttagtaaagaagaatttaaaggagtaaaagggttgatggattttggaaaaaagatccgcaagacggacaattttgacctgttcttttgtttgccggactctttttcttctgctttgatggcatcggcctctggtgcaaaagcaacggtgggatataaaaaggaactgaggggttttttgctgacaaactcataccaaaaaccaaaggacctgcatagagttgatgaatatttaaacctcctgcaactttacacagaaaaagaaacaggtattcctactgtacacattcaacatcaatttcaaaagaaagactatatcgttgtgaacataattcgaagcttatcgcgacggtaa

SEQ ID NO: 6258 - protein, 180 aa, Unknown
  Obtained from environmental sample
  misc_feature (1)..(180): Xaa is any amino acid
MIGNLPAMKIIVRLPNWLGDMVMSVAFLHELYKQYPGAEVSVIAKKGLHELLAFFPPIKHGFIFSKEEFKGVKGLMDFGKKIRKTDNFDLFFCLPDSFSSALMASASGAKATVGYKKELRGFLLTNSYQKPKDLHRVDEYLNLLQLYTEKETGIPTVHIQHQFQKKDYIVVNIIRSLSRR

SEQ ID NO: 6259 - DNA, 600 bp, Unknown
  Obtained from environmental sample
  misc_feature (1)..(600): n is a, c, g, or t
atgctggcattaaaaggacaaacaggtgagagtagcggccacaaacaaaacaaacagattatgggacaggggataaatcaggaatatcttgatccgggtgtacatccaggagatgacttttacctgtttgtcaatggaggctggatgaaatccaccgagatcccggaagaccgtaattcatggggaagctttcacgaattgtcaaaaaacacggacgaaaaagtcctgaaaattttagacgaagagctaaagcgggagggtcccgccaggaataaggcagcaagattatttgaaagcggaatgaatatagccaggattgaagccgccggaatagagggcctccatcccatatttgataaaattgattcacttgacaaaaaagtaaacctggccgcactcctcggaattctgacaaanaaaagccttggtgncattgtccactttagtgttcatcccgatctcggcgatagtaaaaaatacgctgcgtacctggagccccgcatactcggcttacctgagcgcgatttttatctggacgatgatgaaaagggccaggnatatcagagatcattacctggaatacatccggtacattcttga

SEQ ID NO: 6260 - protein, 199 aa, Unknown
  Obtained from environmental sample
  misc_feature (1)..(199): Xaa is any amino acid
MLALKGQTGESSGHKQNKQIMGQGINQEYLDPGVHPGDDFYLFVNGGWMKSTEIPEDRNSWGSFHELSKNTDEKVLKILDEELKREGPARNKAARLFESGMNIARIEAAGIEGLHPIFDKIDSLDKKVNLAALLGILTXKSLGXIVHFSVHPDLGDSKKYAAYLEPRILGLPERDFYLDDDEKGQXYQRSLPGIHPVHS

SEQ ID NO: 6261 - DNA, 420 bp, Unknown
  Obtained from environmental sample
  misc_feature (1)..(420): n is a, c, g, or t
atgaacgtaaaaacgcagatcaaggagtacatcgaagctcaacctgagtcaaagcgcgttgacatgcaggaattgcaccgccttattcagtcattaaaaccaaaatgccaattatggttccttgatggaaaaaacgctgagggcaaagtggtttcaaacccgaatattggatatggcgcttacaccataaaatatgccgacggaactagcagggagttttatcaaatcggacttagcgccaacactagcgggatctctgtctatattctcggttacgacgataagacatacttatccaaaacgtatgcaaaaaagctgggcaaggcaagcgtgaccgggtattgcataaagttcaaaactctaaaagacataaatattgaaacgcttaaagaggcggtaagaaataggcttgaaacctag

SEQ ID NO: 6262 - protein, 139 aa, Unknown
  Obtained from environmental sample
  misc_feature (1)..(139): Xaa is any amino acid
MNVKTQIKEYIEAQPESKRVDMQELHRLIQSLKPKCQLWFLDGKNAEGKVVSNPNIGYGAYTIKYADGTSREFYQIGLSANTSGISVYILGYDDKTYLSKTYAKKLGKASVTGYCIKFKTLKDINIETLKEAVRNRLET

SEQ ID NO: 6263 - DNA, 375 bp, Unknown
  Obtained from environmental sample
  misc_feature (1)..(375): n is a, c, g, or t
ttgctgaaaacagaaataaatgttcagcctgtcatcgtaaaccggatgattcatttcatcaaatgtcaaaagaaaattgcgacaagtgtcacacagttgataaatggaagccatctaccttcgatcattcttcctattttctccttgacaaagatcataacgcagaatgcaacacctgtcataccaataataatttcaatgcctacacatgttatggttgtcacgagcattccgaaaataaaattaggagtgagcatcaggaacatggcatttataatttttctgattgcgcctcatgtcacaaaagtggtgatgagcatgatatcagaaatggagaaaagttcaagcaggataaatcagaagttaagaaagtga

SEQ ID NO: 6264 - protein, 124 aa, Unknown
  Obtained from environmental sample
  misc_feature (1)..(124): Xaa is any amino acid
MLKTEINVQPVIVNRMIHFIKCQKKIATSVTQLINGSHLPSIILPIFSLTKIITQNATPVIPIIISMPTHVMVVTSIPKIKLGVSIRNMAFIIFLIAPHVTKVVMSMISEMEKSSSRINQKLRK

SEQ ID NO: 6265 - DNA, 834 bp, Unknown
  Obtained from environmental sample
  misc_feature (1)..(834): n is a, c, g, or t
atggatggagtagaattttattatttttctggaactggaaattcgctatatgttgcaaaagagttgcaaaaacgaattccagaagcaagactcattccaatcgtaagtctcctgaataaagatattatagaaaccaatggagaaatagtgggcattattttcccgattcatcgcatgacattccccattcctgttaagaaattctttgagaaactggacctaaaatcagcgaaatatatttttgctatagccacgcgagaaggcaccaaacacatagcctttattgaaatagaaaagatactggaaaaaagaggcaaaagcctgaattcttacttcactctgaatatgccctataacgacccaagatcaaaagactggtgtccagcatcagaagaggaaattgcaaaattagaatccgaagtccagagtaaacttgattctattcaaaaaatcatcatgaagcaggaaaatagccgggaagaagattctgattcttctccatctaattatgtattacaacacttacttcatttaggaatgattatttccgaacacagtggtaagaaagattatttttatgcagattcgaagtgcataggctgtggaacttgtgaaaaagtttgtttatccagaaaaataaaaatggaaaacaaaaaaccagtatggcaagaggatgtcaaatgctatctttactatgcctgtcttaattactgtcctgtgcatgcgactcaaatcaaatcaaaaatctacatgaaatcatttaccgaagaaaacgaaagatattctcatccatatgcaacaccaggtgtaattgctgaaacaaaaagcaaatga

SEQ ID NO: 6266 - protein, 277 aa, Unknown
  Obtained from environmental sample
  DOMAIN (191)...(214): 4Fe-4S binding domain
  misc_feature (1)..(277): Xaa is any amino acid
MDGVEFYYFSGTGNSLYVAKELQKRIPEARLIPIVSLLNKDIIETNGEIVGIIFPIHRMTFPIPVKKFFEKLDLKSAKYIFAIATREGTKHIAFIEIEKILEKRGKSLNSYFTLNMPYNDPRSKDWCPASEEEIAKLESEVQSKLDSIQKIIMKQENSREEDSDSSPSNYVLQHLLHLGMIISEHSGKKDYFYADSKCIGCGTCEKVCLSRKIKMENKKPVWQEDVKCYLYYACLNYCPVHATQIKSKIYMKSFTEENERYSHPYATPGVIAETKSK

SEQ ID NO: 6267 - DNA, 1008 bp, Unknown
  Obtained from environmental sample
  misc_feature (1)..(1008): n is a, c, g, or t
ttgtcgatatttatatacaggcgattcaaatcgcaaagacccgatccaagcagtgttcaggccaaggtagattcttttctgcttcagaaaggtccggccgataccacggcgtactacgattttcattccctgcaaatcgcattcgactatgtatggcaccagttattggacgaaacgctggttaatctaacggataaaatacacaatgatcttgaaaactcagggaaaaaaggactgttgcaatcaattcaggaacgaatgcaaggagccgtaagttccagaaaaaatataatggttgcggtactcgacgatatgcggtggtacacccaagaagaagtgcctacggaaatctcgacggcttttgatatcaccttcatcgaatacgatgcgctcactcatgataataagataaagctggcctctctggccaaggacatcaattattatgaagcgcaagccctttccttccaggcagcgcatcaggattttgcaacgcttgcgtcggtattaagagatcagggtgagcgaattatcgacaatatccggatcaacagcccttatacaaccaatcagcttctcaaggaactgcaggaaaggctgctttccaaatatgaatttaccgtatttgctgccgataaagactatcacagcattaattttggcttgatgaacacctttcgccagaagtgggaaccgctttcttaccaggcgggtaagctggtaaaaaccataccgctttctccaaaagaagaaagaaagtattcggtgaaaacgacaatcaattccaagattactagaaaacaggctcaaaaatacaatacatcgctccagcaggaggtcaatacaacctctcgcgccgagtcggaaatcgtcgccnaagcgcacgataaatccaactttcacatgagcgtgaaattgggatactcgaaaaatagttcccaggtcacattcggcaagggatgcgaaaaaagatccctctcagccaaaaaagattcaggnaagcggtga

SEQ ID NO: 6268 - protein, 335 aa, Unknown
  Obtained from environmental sample
  misc_feature (1)..(335): Xaa is any amino acid
MSIFIYRRFKSQRPDPSSVQAKVDSFLLQKGPADTTAYYDFHSLQIAFDYVWHQLLDETLVNLTDKIHNDLENSGKKGLLQSIQERMQGAVSSRKNIMVAVLDDMRWYTQEEVPTEISTAFDITFIEYDALTHDNKIKLASLAKDINYYEAQALSFQAAHQDFATLASVLRDQGERIIDNIRINSPYTTNQLLKELQERLLSKYEFTVFAADKDYHSINFGLMNTFRQKWEPLSYQAGKLVKTIPLSPKEERKYSVKTTINSKITRKQAQKYNTSLQQEVNTTSRAESEIVAXAHDKSNFHMSVKLGYSKNSSQVTFGKGCEKRSLSAKKDSGKR

SEQ ID NO: 6269 - DNA, 516 bp, Unknown
  Obtained from environmental sample
  misc_feature (1)..(516): n is a, c, g, or t
ttggccttgcgtcttttcaatactacagaaaatgtgattggcagatctgtcattcatcagcacgattttgaatatattgtttcaggaattatgaaagtgccttccaattcctcgttacaatttgacttcgcgttgtcaatggaacgatttaaggacattataggagataattttaattggggaagtacgggacctttttgttacattttgttaagacccggtactgacgttgagcaattcaataaaaaaattgctgactatgttaaagtcaaaaccaataacgaagttacgcatcgtacaatgtttgtacgatcttattcaaaggcatatttgtacggcaaatacgagaatggtgttgttgttggcggaagaattacatacgtgaagttattctctattattgctgtttttattttggtgatcgcgtgcattaacttcatgaatctttctaccgctaaagcgtcaaaaaggattaaggaaattgggattaaaaaagcaattggagcacaacngtaa

SEQ ID NO: 6270 - protein, 171 aa, Unknown
  Obtained from environmental sample
  misc_feature (1)..(171): Xaa is any amino acid
MALRLFNTTENVIGRSVIHQHDFEYIVSGIMKVPSNSSLQFDFALSMERFKDIIGDNFNWGSTGPFCYILLRPGTDVEQFNKKIADYVKVKTNNEVTHRTMFVRSYSKAYLYGKYENGVVVGGRITYVKLFSIIAVFILVIACINFMNLSTAKASKRIKEIGIKKAIGAQX

SEQ ID NO: 6271 - DNA, 459 bp, Unknown
  Obtained from environmental sample
  misc_feature (1)..(459): n is a, c, g, or t
atggtttacgaaggaacggattacattttctacacaaacatacccgggaacaaaataattctttcagttcttaaaacagtttctgaaaaatggaaagagatgcaaggatttattacaaccgaagattcatccgattctgattttatttttcttccgaacaaagaagatttagataaaagatggattggcgtttacgtttataaaactgctgaaattcgtcaagaagcgcagagattgggagttggagtaaatgaagatatagataaaaatacttttcagatatttttcagcattctaaataatgtaaagcttgaaacagttgtaaataagcgtaatgaagcatttagaaatcctaaattgcctgatgtaacccttatattgatccntatgaggcattggtttgctgttcggagttttacgaaatcacgttgtcagttttcgagaaccggcaaaagatga

SEQ ID NO: 6272 - protein, 152 aa, Unknown
  Obtained from environmental sample
  misc_feature (1)..(152): Xaa is any amino acid
MVYEGTDYIFYTNIPGNKIILSVLKTVSEKWKEMQGFITTEDSSDSDFIFLPNKEDLDKRWIGVYVYKTAEIRQEAQRLGVGVNEDIDKNTFQIFFSILNNVKLETVVNKRNEAFRNPKLPDVTLILIXMRHWFAVRSFTKSRCQFSRTGKR

SEQ ID NO: 6273 - DNA, 432 bp, Unknown; identical to SEQ ID NO: 4401
  Obtained from environmental sample
  misc_feature (1)..(432): n is a, c, g, or t

SEQ ID NO: 6274 - protein, 143 aa, Unknown; identical to SEQ ID NO: 4402
  Obtained from environmental sample
  misc_feature (1)..(143): Xaa is any amino acid

SEQ ID NO: 6275 - DNA, 498 bp, Unknown
  Obtained from environmental sample
  misc_feature (1)..(498): n is a, c, g, or t
atgagaaccttaataacactattcccactatttatcttcattatacttggagttgtaggtatcttttctcaagactttgttcagacaaacaatacactatacaaatggtttattttacctgcgaccattcccggaagttattattcttttgcactaacaccaaattgctccaaagctaaaggtggtggaattgctctaggacgtattgcaatcacaatactcatttttgcacttacattccgagcagctcaagggtatatcattttgtttaactgcaatcttggctcacaaaaggaaactgatgttagcgggactgtcgcatatgtcaacttcccaaaaccaaaaaaaatcttagataagaattctatatcaatagtagatagtagcagcggtaagataatcgctttagaggttccaactgatgcctatcatgtgggccaaagattcaagaaaaaaatgttgaaaggctcatttggcattttgtatagtccaaagtaa

SEQ ID NO: 6276 - protein, 165 aa, Unknown
  Obtained from environmental sample
  misc_feature (1)..(165): Xaa is any amino acid
MRTLITLFPLFIFIILGVVGIFSQDFVQTNNTLYKWFILPATIPGSYYSFALTPNCSKAKGGGIALGRIAITILIFALTFRAAQGYIILFNCNLGSQKETDVSGTVAYVNFPKPKKILDKNSISIVDSSSGKIIALEVPTDAYHVGQRFKKKMLKGSFGILYSPK

SEQ ID NO: 6277 - DNA, 879 bp, Unknown
  Obtained from environmental sample
  misc_feature (1)..(879): n is a, c, g, or t
atgattaaacgaaacattaaaaaagttgcagttttaggcagtgggataatgggctcacggattgcctgtcattttgcaggcattggtgtccaggttttattgttggatattgtccccaacgaagctaaagaatcgggcaacaaacagcaacgtaataaattagtgaacgatgcattgcaggcagcaatcaaatccaatccctctcctctttatacacctgatgctgtaaaaaaaattactacaggaaactttgatgataatttaaaagatatagctacctgtgactggataatagaagtggtggtagaaaagctggatatcaaacgttctctttatgaaaaggtggaaacttttagaaaaccaggaacgctgataacatccaatacttccggtattccgattcatttattaagtgaaggccgcagtgaggattttaaaaagaatttttgtggtacacatttttttaatcccccaagatatttacgactcctggaaattattccgacaaatgatactgacgtggccgttgttgatttcctgatgcactatggtgacctctatttgggaaagacaacagtcctggcaaaagatacaccagcttttatcgccaatcgcattggcgtatatggcatcatggccatttttagcctggtagaaaaaatgggtttaacgattgatgaagtggatgctttaaccgggccgattattgggcgaccaaaatcggccacttttcgcactgctgatgtagtgngtattgatacactggtaaaagttgcaaaaggtgtttatgaaaattgtccaaatgatgaagcgaaagatagtttcaaaataccagcctggttaaataaaatgattgaaaaacaattggcttggcgataa

SEQ ID NO: 6278 - protein, 292 aa, Unknown
  Obtained from environmental sample
  DOMAIN (201)...(291): 3-hydroxyacyl-CoA dehydrogenase, C-terminal domain
  misc_feature (1)..(292): Xaa is any amino acid
MIKRNIKKVAVLGSGIMGSRIACHFAGIGVQVLLLDIVPNEAKESGNKQQRNKLVNDALQAAIKSNPSPLYTPDAVKKITTGNFDDNLKDIATCDWIIEVVVEKLDIKRSLYEKVETFRKPGTLITSNTSGIPIHLLSEGRSEDFKKNFCGTHFFNPPRYLRLLEIIPTNDTDVAVVDFLMHYGDLYLGKTTVLAKDTPAFIANRIGVYGIMAIFSLVEKMGLTIDEVDALTGPIIGRPKSATFRTADVVXIDTLVKVAKGVYENCPNDEAKDSFKIPAWLNKMIEKQLAWR

SEQ ID NO: 6279 - DNA, 702 bp, Unknown
  Obtained from environmental sample
  misc_feature (1)..(702): n is a, c, g, or t
atgctcgaggcctcacatgcattgggatttgagaacgacactgccactatgcatattgcgaaaaagatggttgaccatgctctcgccaatggctgggataatagcgtcggtggattttatgatgaaggatattattttaagggcaaaccatctatctcaattattgcagatacaaaaaattggtgggcacaggcagagggtttaaatacgcttctaatgatggatgattattatcccgatgataaatggcagtactatgagaaatttaaaatgctctggaagtatgtgcagactaatttaattgaccaggaacatggaggctggtactccggtggattagacaaagaacccaaacaaaagaccgccttaaaaggccatatatggaaggcagcttatcatgatctgagagcattgatgaattgcattcaacgtttagatccagacaaaattccgccatctcctcctgaaaatttaagagtgcagaaaataaagaagtcagacattttgagatgggataaggcggaggacaataaaaatttattgggttattatatttatcgcggcggtgaaaggattggttatacaccgttgacttattttgatgtgaaagattttaagcaggagaggagaagtgatttttcaataagatcaattgatttttctggtaatgaatctgagcttggcaagtcaatttctttttag

SEQ ID NO: 6280 - protein, 233 aa, Unknown
  Obtained from environmental sample
  misc_feature (1)..(233): Xaa is any amino acid
MLEASHALGFENDTATMHIAKKMVDHALANGWDNSVGGFYDEGYYFKGKPSISIIADTKNWWAQAEGLNTLLMMDDYYPDDKWQYYEKFKMLWKYVQTNLIDQEHGGWYSGGLDKEPKQKTALKGHIWKAAYHDLRALMNCIQRLDPDKIPPSPPENLRVQKIKKSDILRWDKAEDNKNLLGYYIYRGGERIGYTPLTYFDVKDFKQERRSDFSIRSIDFSGNESELGKSISF

SEQ ID NO: 6281 - DNA, 819 bp, Unknown
  Obtained from environmental sample
  misc_feature (1)..(819): n is a, c, g, or t
atgatgactaaaaaaattaatcagaaggatatcaatgatgcagtttggaaagcttgtgatactttccggggaagcatagacccgagtgtatataaagattatgtgcttacaatgcttttcataaaatacttgagtgacgttcatgatgataaatacgaagcttatcttaaaaaatataatgatgataaagaaagagctaaaagagctatgcagcatgagcgattcatagtacctgaacatagtcactttaaatatttgtttaatcatcgaaacgaacttaacatcggagagttgattgatattgcccttgaagatttggtggaagccaacagggaaaaactatacagcgaagacggtgccggcattttccaaaatattaattttaacagcagtgtattaggtgatacaaaagacaagaataccaggctcaaaaatttattgcttgattttaataaggaagctttagacctaaggccctcacaccttgagggcactgacatcattggtggagcatatatgtttctcattgaaaattttgccagtgatgccggtaaaaaggcgggagaattttttacaccaaaagaagtttcaacgctcattgctaagcttactagatctgctcccaggtcacgtatctgcgatcccacttgtgggtccgcctccttgnnctataagctggtgaagaagtggctcagatatttttctctttatggacaggaagcaatggaaagtactgggctttggcggtatgaaatatgttttacacggcttgataatgcaaccattcgttggggcgataccattagaaatcaaaattaa

SEQ ID NO: 6282 - protein, 272 aa, Unknown
  Obtained from environmental sample
  DOMAIN (7)...(242): Type I restriction modification system, M protein
  misc_feature (1)..(272): Xaa is any amino acid
MMTKKINQKDINDAVWKACDTFRGSIDPSVYKDYVLTMLFIKYLSDVHDDKYEAYLKKYNDDKERAKRAMQHERFIVPEHSHFKYLFNHRNELNIGELIDIALEDLVEANREKLYSEDGAGIFQNINFNSSVLGDTKDKNTRLKNLLLDFNKEALDLRPSHLEGTDIIGGAYMFLIENFASDAGKKAGEFFTPKEVSTLIAKLTRSAPRSRICDPTCGSASLXYKLVKKWLRYFSLYGQEAMESTGLWRYEICFTRLDNATIRWGDTIRNQN

SEQ ID NO: 6283 - DNA, 834 bp, Unknown
  Obtained from environmental sample
  misc_feature (1)..(834): n is a, c, g, or t
gtgggaaaaagcaccttaatgaatgcgctcctgggcgaatcgctgtcgattgtaacaccgaaagcgcagaccacacgtcaccgcatccgcggcattctgaacggtgaggattaccagattattttcagcgatactccgggtatcatggagccatcctacaaattgcatcaccggatgctgaattcggtaaatgaaacgtttgaagattctgatctggtaatgtttgtgacggaagtgaaagaccgcaggattacagatgaactcaaacagcaactggaatttaccaaagtaccattgtatgtgctgatcaacaaggtcgataccagcacacaggaagaagtggaggaagcggttcagtactggaaagagttgctgaaaccggaagcaatttttccggtagcggcgttgcataaattttataccgatgtactgttgaagaacatcgttgaaaaattaccggaggcgccggcttatttcgacaaaaacggagaggtgagcgatcgcaacgtacgtttttttgtgaccgaaatgatcagggagcggattctccatctctatcagaaagaaattccttattcagtagaaattgcggttacttcatataaagaagcggaagatatagacaggatatacgttacaattttttgtgaacgggaatcacagaaagcaattctgctgggacatcagggaaaggcaatcaaaaaactgggtattgaaagcagattgcggattgaagaatttacaggtaaaaaagtacatctcgaattaagcatcaaggtagccggcgactggcgcaacaatgaacggatgcttcgtgatttcggatacgaataa

SEQ ID NO: 6284 - protein, 277 aa, Unknown
  Obtained from environmental sample
  DOMAIN (212)...(276): KH domain
  misc_feature (1)..(277): Xaa is any amino acid
MGKSTLMNALLGESLSIVTPKAQTTRHRIRGILNGEDYQIIFSDTPGIMEPSYKLHHRMLNSVNETFEDSDLVMFVTEVKDRRITDELKQQLEFTKVPLYVLINKVDTSTQEEVEEAVQYWKELLKPEAIFPVAALHKFYTDVLLKNIVEKLPEAPAYFDKNGEVSDRNVRFFVTEMIRERILHLYQKEIPYSVEIAVTSYKEAEDIDRIYVTIFCERESQKAILLGHQGKAIKKLGIESRLRIEEFTGKKVHLELSIKVAGDWRNNERMLRDFGYE

SEQ ID NO: 6285 - DNA, 942 bp, Unknown
  Obtained from environmental sample
  misc_feature (1)..(942): n is a, c, g, or t
gtgatggctctcagaggcatcgatgaaggctatactttgaaaattacttcgcatggtaaggaggatatacttaaaggaaaagaaaaagtgagcctggtgattccaaggccgagtgaaactcctgtaccaaagcaaagatttgcaaggtcagaacccaataaattatttgaagaactgcgaagcctgagaaaactgattgccgattcagaaggacttcctccctacatcattttcaacgataaaacactttccgaaatgagcatgtatgcacctcacacacgggcggaaatgctgaaaattacaggggtgtcggaaaacaaaatgatcaaatatggcagtgatttcttaaaagttacttctcaattcccacaatcaataaacaaaaataataatgataagggtgttgcagaagttttgaatgcagtcaaaatacaaggcttcattactgaaatgcgggaaaaaaaacttcggctcacccatcatacacttggaaaaatattactcggatccggcagaaaatcggtgcctgcaggtgctgaatccctttcttttttcggtgttttaaaagacacaacaacctataaaaatatcggtcctatactaaaaaaatattttcaagaaaataatattataaaccatgagtttgaagtgcatgagtttttcaactcaccgcattttaattatttttcagcaaatgaaataaatgcgtttaaatccgaaataaaatcccttggaattaaaaagcccgatgctaccctgcttccacacatgcttgagctaagaaaaaaatttcccagggcttatgaaccgtgnggcgaggaagagttccggatttataggcaattaatagaaaaaaccaatgatccggtagtactttcttccngtttaggacgaanttatgctttcgtgacagcctatttatctaaagtgacgaataattag

SEQ ID NO: 6286 - protein, 313 aa, Unknown
  Obtained from environmental sample
  DOMAIN (49)...(129): HRDC domain
  misc_feature (1)..(313): Xaa is any amino acid
MMALRGIDEGYTLKITSHGKEDILKGKEKVSLVIPRPSETPVPKQRFARSEPNKLFEELRSLRKLIADSEGLPPYIIFNDKTLSEMSMYAPHTRAEMLKITGVSENKMIKYGSDFLKVTSQFPQSINKNNNDKGVAEVLNAVKIQGFITEMREKKLRLTHHTLGKILLGSGRKSVPAGAESLSFFGVLKDTTTYKNIGPILKKYFQENNIINHEFEVHEFFNSPHFNYFSANEINAFKSEIKSLGIKKPDATLLPHMLELRKKFPRAYEPXGEEEFRIYRQLIEKTNDPVVLSSXLGRXYAFVTAYLSKVTNN

SEQ ID NO: 6287 - DNA, 351 bp, Unknown
  Obtained from environmental sample
  misc_feature (1)..(351): n is a, c, g, or t
atgacacatttatcaaaaggaattttgatgcagaaaaagaaaaatggaagtatgataatgataataatattaatgagtgagaaatcattgatttgtatatatacaaataaggagagaaatgaatttgctattggtttaaaagaagatgagaattttagagcaatgacgaaagcagacgaattttatacaagatttgttgatgcttttgatcaactaattgacaagaatggaatagattgggaacaagaattaaagaattggattgcagctgcaaagaaaaatgaaactatatatgttgaagtggatcttcctggttacaatgaactatcagatagaaaattgtctaaatag

SEQ ID NO: 6288 - protein, 116 aa, Unknown
  Obtained from environmental sample
  misc_feature (1)..(116): Xaa is any amino acid
MTHLSKGILMQKKKNGSMIMIIILMSEKSLICIYTNKERNEFAIGLKEDENFRAMTKADEFYTRFVDAFDQLIDKNGIDWEQELKNWIAAAKKNETIYVEVDLPGYNELSDRKLSK

SEQ ID NO: 6289 - DNA, 486 bp, Unknown
  Obtained from environmental sample
  misc_feature (1)..(486): n is a, c, g, or t
atgaagaagttattcccggtcgttctttttttattgtccatgaatgttttgcaagcacaaattccaaaatggaaaattacggatgttgaaaattatatgaagacggaggaagggatacttgtcataaatttctgggccacattctgcaaaccatgtgttgctgaaataccgtccttcattaagataacaaataagtataagaatagcaacgttaagctattgctaatcagcctggacctgccatctttctacccgactaaaatacagtcatttgcaaagaagaggaatttcaatgcacccattgtctggctgagcgaaaccgatgctgattatttctgtcccaggatcgattccagttggagcgggtctattcctgctaccttgatcataaacacaaaaacaggttacagaaaattctttgaggaagaaatagagcctgatgtttttgagaatgaattgaaaaaagcaattaaaggagttgagtag

SEQ ID NO: 6290 - protein, 161 aa, Unknown
  Obtained from environmental sample
  SIGNAL (1)...(19)
  misc_feature (1)..(161): Xaa is any amino acid
MKKLFPVVLFLLSMNVLQAQIPKWKITDVENYMKTEEGILVINFWATFCKPCVAEIPSFIKITNKYKNSNVKLLLISLDLPSFYPTKIQSFAKKRNFNAPIVWLSETDADYFCPRIDSSWSGSIPATLIINTKTGYRKFFEEEIEPDVFENELKKAIKGVE

SEQ ID NO: 6291 - DNA, 510 bp, Unknown
  Obtained from environmental sample
  misc_feature (1)..(510): n is a, c, g, or t
atgttctctagatttgatagaaatagttatcgtttacgaataatgttagataaacatggaaagctatgtcatactatttcagaactgcatccactttccgataatttgaaaattattgtatcacaaaataaaatttattcaaataataagtttcaatatttcaaaacaactaatcgcaaattgtatgataaggagtataaaaaatattcctttaaaaattattttgatataatttattttaatgagaaaggcgaactagctgagggttcgattacaaatatttttatttataaggatgatgtaatatctactccaccactgaataccggaatattatctggaatctatagaaagcatctattaagaaataattctggcatacgggaaaggaaactttatttagacgatctgctgaaagcggataaaatagttctaacaaactctgtgcaaggtgaggttattgttgataaattatttcttaatgaatttgagtttattgaatttaaataa

SEQ ID NO: 6292 - protein, 169 aa, Unknown
  Obtained from environmental sample
  misc_feature (1)..(169): Xaa is any amino acid
MFSRFDRNSYRLRIMLDKHGKLCHTISELHPLSDNLKIIVSQNKIYSNNKFQYFKTTNRKLYDKEYKKYSFKNYFDIIYFNEKGELAEGSITNIFIYKDDVISTPPLNTGILSGIYRKHLLRNNSGIRERKLYLDDLLKADKIVLTNSVQGEVIVDKLFLNEFEFIEFK

SEQ ID NO: 6293 - DNA, 1032 bp, Unknown
  Obtained from environmental sample
  misc_feature (1)..(1032): n is a, c, g, or t
atgaacgtgagcccgaaattatcgcgcttgctggccgcaaagttcgatcacgattgctacgaatatggcagtcggggtaccgatataaanttaggtggtaatgctgaagtcatggcgaaaaaaactgtaaatgacgaaacacnaccagagtatgctgaagcattagcaaaatttcgtgatcaatgtatgcgtgaacatgacgaagtcgtaaaagtcggtggattgtacatcgtagggaccgagcggcacgaatctcgccgaattgataatcagttgcgtggtcgtgctggtcgtcagggtgatccgggcgcatctaaattctacctttctctagaagataatttaatgcgtatttttaatggagagagaattcaaaaaatcatggggatgttaaacattccagatgacgaaccaattactgcgggaatggtcactagagccattgaaggatctcagagaaaagtggaaggccatcactttgatatccgtaaaaatcttcttgaatatgacgatgtgatgaaccaacagagaaatgcgatctacggaatgcgccgaaaagttcttatcggagaagatattgaacgcatttatttagatatgatgggcgacgtcgtttcgactttactggatacttatatccctgaagatcagaaaaaagagacttggagtttggacggcctgaacaacgcactatcgactcaatttggatttaaagtggattggaatacggtaccgcaaacttcagaaaaaattacggaagctgtgagtactgcggtaaaagaaatttatgaccgtcaaaaaaaggcgatgggacagtttttcttagaagtacaaaaaatgattctgttgcaggccattgatcaacgatggaaagaacatcttttgattatcgataagttaaaggaaggtattggactacgtggatactctgggaaagatccattgatcgagtataaaaaagagngcattcactgctttgaaaatctgaatcacacgattaaagcggataccgtgaaaaagaatgccggataa

SEQ ID NO: 6294 - protein, 343 aa, Unknown
  Obtained from environmental sample
  DOMAIN (138)...(342): SecA Wing and Scaffold domain
  misc_feature (1)..(343): Xaa is any amino acid
MNVSPKLSRLLAAKFDHDCYEYGSRGTDIXLGGNAEVMAKKTVNDETXPEYAEALAKFRDQCMREHDEVVKVGGLYIVGTERHESRRIDNQLRGRAGRQGDPGASKFYLSLEDNLMRIFNGERIQKIMGMLNIPDDEPITAGMVTRAIEGSQRKVEGHHFDIRKNLLEYDDVMNQQRNAIYGMRRKVLIGEDIERIYLDMMGDVVSTLLDTYIPEDQKKETWSLDGLNNALSTQFGFKVDWNTVPQTSEKITEAVSTAVKEIYDRQKKAMGQFFLEVQKMILLQAIDQRWKEHLLIIDKLKEGIGLRGYSGKDPLIEYKKEXIHCFENLNHTIKADTVKKNAG

SEQ ID NO: 6295 - DNA, 1032 bp, Unknown; identical to SEQ ID NO: 6293
  Obtained from environmental sample
  misc_feature (1)..(1032): n is a, c, g, or t

SEQ ID NO: 6296 - protein, 343 aa, Unknown; identical to SEQ ID NO: 6294
  Obtained from environmental sample
  DOMAIN (138)...(342): SecA Wing and Scaffold domain
  misc_feature (1)..(343): Xaa is any amino acid

SEQ ID NO: 6297 - DNA, 450 bp, Unknown
  Obtained from environmental sample
  misc_feature (1)..(450): n is a, c, g, or t
ttgcctgtcctgataagggtaaaggattatctttgcacccttcaaaaaaacaacataataatgaagaatctatacctgatactgattaccctttgtaccacgatgataggcctggcccaaaccaagaatgatccggatgccaaaaaggtgctggatgcggtgagtgccaagttcaagaccttcaaaactgtaaaagcctcatttacctataaggttgaaaatgcggccggtaaagccctttcttcaaaaaatggttcaattctgatgaagggcactaaataccgggtcagcttcagtggccaggatattttcagcgatggaaaaaccgtttggaactatgataaggaagccaatgaagtaaccatcagcaacctcgacgcatcgggcagcacgattaccccgcagaaattattacgaatttttatgataatgattttctctacaagatga

SEQ ID NO: 6298 - protein, 149 aa, Unknown
  Obtained from environmental sample
  misc_feature (1)..(149): Xaa is any amino acid
MPVLIRVKDYLCTLQKNNIIMKNLYLILITLCTTMIGLAQTKNDPDAKKVLDAVSAKFKTFKTVKASFTYKVENAAGKALSSKNGSILMKGTKYRVSFSGQDIFSDGKTVWNYDKEANEVTISNLDASGSTITPQKLLRIFMIMIFSTR

SEQ ID NO: 6299 - DNA, 450 bp, Unknown; identical to SEQ ID NO: 6297
  Obtained from environmental sample
  misc_feature (1)..(450): n is a, c, g, or t

SEQ ID NO: 6300 - protein, 149 aa, Unknown; identical to SEQ ID NO: 6298
  Obtained from environmental sample
  misc_feature (1)..(149): Xaa is any amino acid

SEQ ID NO: 6301 - DNA, 744 bp, Unknown
  Obtained from environmental sample
  misc_feature (1)..(744): n is a, c, g, or t
ttgtgtgcttgttttgtnggtattcgtacaggcgaaagtctgaatcgctggagaactatagcgngtcacgggacaaaatttcaagagcgcaaatggacaaatcttgtagccaaaacgctatggaatatctatccgatttatgattggcacactgaggacatctggaaatttcatggcaaaacgaatcttccgtacaacaaactttatgaccgtatgcaccaggcagggttaagcattcaccagatgcgaatttgccagccttacggagatgaccagcgcaaagggttatggcttttccacctgatagaacctgagacatggtcacgcattgtagcacgagtgaatggcgcaaatcagggtgctttatatgccaatgaatcggggaatatcttggggcgaatcaaaatcgacaaaccacaagggcatacatgggaaagtttcgccatgctattgctgggttcaatgcctgagaaaatggcggagcattacaagaacaagattgcggtattcatcaaatggtatcaagatcgtggttatccagacggaatccctgatgaaatgccaaacgacaaagaagcggggcgcgaagtccccagttggcggcgcgtctgtaagatgctgctcaagaatgattattgggcaaaaacacttggatttgaaccgcaaaaaggaacggcgcatcaacaatacctagcacttatggcaaaaaggaggcaacaatggggtatcttcccgctatcttag

SEQ ID NO: 6302 - protein, 247 aa, Unknown
  Obtained from environmental sample
  misc_feature (1)..(247): Xaa is any amino acid
MCACFVGIRTGESLNRWRTIAXHGTKFQERKWTNLVAKTLWNIYPIYDWHTEDIWKFHGKTNLPYNKLYDRMHQAGLSIHQMRICQPYGDDQRKGLWLFHLIEPETWSRIVARVNGANQGALYANESGNILGRIKIDKPQGHTWESFAMLLLGSMPEKMAEHYKNKIAVFIKWYQDRGYPDGIPDEMPNDKEAGREVPSWRRVCKMLLKNDYWAKTLGFEPQKGTAHQQYLALMAKRRQQWGIFPLS

SEQ ID NO: 6303 - DNA, 744 bp, Unknown; identical to SEQ ID NO: 6301
  Obtained from environmental sample
  misc_feature (1)..(744): n is a, c, g, or t

SEQ ID NO: 6304 - protein, 247 aa, Unknown; identical to SEQ ID NO: 6302
  Obtained from environmental sample
  misc_feature (1)..(247): Xaa is any amino acid

SEQ ID NO: 6305 - DNA, 468 bp, Unknown
  Obtained from environmental sample
  misc_feature (1)..(468): n is a, c, g, or t
gtgttccgcatgtaccagggacctgttatctgggccaacaaaagccaggtaacgggtgacaccgtttaccttttcactaaaaacaaaaaagcagacagggtaaaagtttttgaaaacagttttctaatcaatgaaatggatcccggtatttacaaccaggttaaatccacccgcatggacgcatactttacacagggaagtattgactctgttcgcgcagccggtaatgcggaatgtatatattatatacaggatgaagacagcgcctatactggcgtgaacgaatccaaatcagatattatggacatttactttgccgccgatgcactccgcaaagttgtttttcgttcaggcgtttccggtaccatctggcccatccgccaaaaaagtccttccgaaatgcgccttcccaaattcaactggcttgaagcaaaaaggcccaagacaaagttcgaattattcgaatag

SEQ ID NO: 6306 - protein, 155 aa, Unknown
  Obtained from environmental sample
  misc_feature (1)..(155): Xaa is any amino acid
MFRMYQGPVIWANKSQVTGDTVYLFTKNKKADRVKVFENSFLINEMDPGIYNQVKSTRMDAYFTQGSIDSVRAAGNAECIYYIQDEDSAYTGVNESKSDIMDIYFAADALRKVVFRSGVSGTIWPIRQKSPSEMRLPKFNWLEAKRPKTKFELFE

SEQ ID NO: 6307 - DNA, 372 bp, Unknown; identical to SEQ ID NO: 5479
  Obtained from environmental sample
  misc_feature (1)..(372): n is a, c, g, or t

SEQ ID NO: 6308 - protein, 123 aa, Unknown; identical to SEQ ID NO: 5480
  Obtained from environmental sample
  misc_feature (1)..(123): Xaa is any amino acid

SEQ ID NO: 6309 - DNA, 342 bp, Unknown
  Obtained from environmental sample
  misc_feature (1)..(342): n is a, c, g, or t
atgacgcaaggattcaaggatgagtttgcgactatcgatattttagtggatagtgataccaaaacaggacgtacagatgcctttatcgtagcctttacgaaagtggaaaagcaggcaagacgggtttttacttatacaatttatcagtttccaacatttagtctgagcgattataaaaatattctgaacatcatttcgtcaaaggggtttctttattttgggaattttgttaaagggtttgatgctatataccccaaatcttttgaagcgattgttggaaacgctttatatgattcatttctaaaaacagactttcccaggttacaaaaactgaaaaaataa

SEQ ID NO: 6310 - protein, 113 aa, Unknown
  Obtained from environmental sample
  misc_feature (1)..(113): Xaa is any amino acid
MTQGFKDEFATIDILVDSDTKTGRTDAFIVAFTKVEKQARRVFTYTIYQFPTFSLSDYKNILNIISSKGFLYFGNFVKGFDAIYPKSFEAIVGNALYDSFLKTDFPRLQKLKK

SEQ ID NO: 6311 - DNA, 624 bp, Unknown
  Obtained from environmental sample
  misc_feature (1)..(624): n is a, c, g, or t
atggaatttgttcccttcgacgacaaaaactttgacagcgagggaaagatgattgataaaccggaggcattaatggttcatgaagtagaagagggaaaagaatatgctttactcatgagcaccaactcaggcgcatggcggtatttaattggcgatacggtgcggtttgtgaacaaaccaaaaagcgaaattgtaattactggccgtaccaaacactttttaagtctcgtaggagaacatttaagtgtagagaatatgaacaaggccattgaaatggtaagtaacgagtttaatatttctattcccgagtttacggttgtaggttttcctcatcaaaacatgtttgctcacaaatggtatgtagcctgcaacgattctatcaatgccgacaaattaattaaaagaatagaccaacatctttgtgaattgaatgatgattatgctgttgaaagaacatcggcactgaaagagatttttattgaaatcttacccgaagaaacgtttatgaagtttatggaagaagaaggaaagttgggtagccaacataaatttccgagagtgatgaagggtaagatgttgaaggaatggaatgagtttcttgcaaagcaggcacatgtttcttaa

SEQ ID NO: 6312 - protein, 207 aa, Unknown
  Obtained from environmental sample
  misc_feature (1)..(207): Xaa is any amino acid
MEFVPFDDKNFDSEGKMIDKPEALMVHEVEEGKEYALLMSTNSGAWRYLIGDTVRFVNKPKSEIVITGRTKHFLSLVGEHLSVENMNKAIEMVSNEFNISIPEFTVVGFPHQNMFAHKWYVACNDSINADKLIKRIDQHLCELNDDYAVERTSALKEIFIEILPEETFMKFMEEEGKLGSQHKFPRVMKGKMLKEWNEFLAKQAHVS

SEQ ID NO: 6313 - DNA, 750 bp, Unknown
  Obtained from environmental sample
  misc_feature (1)..(750): n is a, c, g, or t
atggctgaaattcgccggcagaaaattatccggtattcagttacaggaggattgataggagcgtttttatttttagtcattgtatatctgcaacgtaataaaattgcaaaggagaaaaagagaagcgaacagctcctgttaaatattctgcccgctgaaactgcggaggaattaaaagctaccggttcggtaacggcaaaaacactcaacaatgttactgtaatgtttaccgactttaaaaatttcacatctgttagcgaaaagcttactgcacaggagttggtaaaacaaatcaattactgctatagcgagtttgacagaatcgtagcgaggcatggcatagaaaaaattaaaactattggtgactcctatatgtgcgcaagtggtttgcccgggcccaatgaaggacatgctgaagttaccgtgagtgccgctttggaaattcgcgattttatgttgaaagaaaaacagaaaaatgaagaagaaggcaggaaattttttgagatacgaattggaatacactctggttgcgtagttgcaggtgttgtaggtctcaataagtttgcctacgatatttggggtgacaccgttaatattgcagcacgcatggaatcgtccggagaaaccggtaagattaatatcagttcctcaacgcatgcattaattaaggataaattttcattcactccgagagggaaagtattaacaaaaaataagggtgaaattgaaatgtatttcgtggacttgtaa

SEQ ID NO: 6314 - protein, 249 aa, Unknown
  Obtained from environmental sample
  DOMAIN (64)...(249): Adenylate and Guanylate cyclase catalytic domain
  misc_feature (1)..(249): Xaa is any amino acid
MAEIRRQKIIRYSVTGGLIGAFLFLVIVYLQRNKIAKEKKRSEQLLLNILPAETAEELKATGSVTAKTLNNVTVMFTDFKNFTSVSEKLTAQELVKQINYCYSEFDRIVARHGIEKIKTIGDSYMCASGLPGPNEGHAEVTVSAALEIRDFMLKEKQKNEEEGRKFFEIRIGIHSGCVVAGVVGLNKFAYDIWGDTVNIAARMESSGETGKINISSSTHALIKDKFSFTPRGKVLTKNKGEIEMYFVDL

SEQ ID NO: 6315 - DNA, 300 bp, Unknown; identical to SEQ ID NO: 2663
  Obtained from environmental sample
  misc_feature (1)..(300): n is a, c, g, or t

SEQ ID NO: 6316 - protein, 99 aa, Unknown; identical to SEQ ID NO: 2664
  Obtained from environmental sample
  misc_feature (1)..(99): Xaa is any amino acid

SEQ ID NO: 6317 - DNA, 300 bp, Unknown; identical to SEQ ID NO: 2663
  Obtained from environmental sample
  misc_feature (1)..(300): n is a, c, g, or t

SEQ ID NO: 6318 - protein, 99 aa, Unknown; identical to SEQ ID NO: 2664
  Obtained from environmental sample
  misc_feature (1)..(99): Xaa is any amino acid

SEQ ID NO: 6319 - DNA, 867 bp, Unknown
  Obtained from environmental sample
  misc_feature (1)..(867): n is a, c, g, or t
ttggcaagcgtaaaaattggcaaaaaatacggctatatcaataaacagggaaagctggttattccagcccggtatacagtagcgaaatctttcaggaaaggatatgttcccaacgttaagaaggatggaggcgatagtgtattatttgcaggagcgtcgctggttcctaacggttatgagatttgtattaacagcaagggtgtaagaatgccgaaatgccccgcaatcaacgagggttcggtgctcgaaaaccaggttccggtggaaaccgtagtccggcaaaagaactacagtgtgccaaacagtggtggccttttcgacaaaatagtagatgactataagatcgaagggagtgatgagacttattatatagccatcaaaaataatcaatacggagtttttaatacaaaatttgacacgatcgttccctttcaatatgattctatcaaagttgtaagaaatacaggcacaccttacttagaagtaaataaaagtggcttgtacggaattatgttaacggatggcaagatggctattgctcccgaaagcactaggcttattgcaatagatgggggtaacggtaaccagtatgtgatagttcgcaagaacggtaaaacttttgtgaaagacttaaagaacaatgatattatcgcttcaggatacaatgacatagtttttgataatggcggattcattattacgggcgataataatctgaaagggtattactttatagataatacagtcattcagccaaaatataaggatgtaaggcttgtagacggaacgcgttatttactggtaaaaactcctgctgacaaagtgggttatattaactccgcangcgatgaatatttcgtagaataa

SEQ ID NO: 6320 - protein, 288 aa, Unknown
  Obtained from environmental sample
  DOMAIN (9)...(25): KWG Leptospira
  misc_feature (1)..(288): Xaa is any amino acid
MASVKIGKKYGYINKQGKLVIPARYTVAKSFRKGYVPNVKKDGGDSVLFAGASLVPNGYEICINSKGVRMPKCPAINEGSVLENQVPVETVVRQKNYSVPNSGGLFDKIVDDYKIEGSDETYYIAIKNNQYGVFNTKFDTIVPFQYDSIKVVRNTGTPYLEVNKSGLYGIMLTDGKMAIAPESTRLIAIDGGNGNQYVIVRKNGKTFVKDLKNNDIIASGYNDIVFDNGGFIITGDNNLKGYYFIDNTVIQPKYKDVRLVDGTRYLLVKTPADKVGYINSAXDEYFVE

SEQ ID NO: 6321 - DNA, 615 bp, Unknown
  Obtained from environmental sample
  misc_feature (1)..(615): n is a, c, g, or t
atggattcgaacataaataatacaaatgtaaaatcaaatccattagatgaaactggatttaaattattaagtttcgaaaacggtaaaacaaaatttgtagcgcaagggataaatgatgtagatagaacatatttttcatttcatgagttacaatattctagatggataaattttgtagaattaaccgaaaaaactatttcaaaattattagaaatccaaaatcaaatatttgttacaggaataagtttaacatatgttgacgagttccagtggaaagacaattctaaaattgattttgagaaaattataaatgctgagtcagaatatttaccaaaaaactttactgtaattagtgaggggcaattagttaatacacgtgaacttaaaaacgatattgataagcagtttgatagattagaaattactgttcgatcttcaattactaaaaatattacactaaatcataatcaaaccattttatttaaaaatcctttagaactaccaaacgatttagaattaataaaaaaagaattgactatgttacatgaatccaataaagagtttttacgtaaaacacttaaaaaagaggttttagaattaattgaattaaaataa

SEQ ID NO: 6322 - protein, 204 aa, Unknown
  Obtained from environmental sample
  misc_feature (1)..(204): Xaa is any amino acid
MDSNINNTNVKSNPLDETGFKLLSFENGKTKFVAQGINDVDRTYFSFHELQYSRWINFVELTEKTISKLLEIQNQIFVTGISLTYVDEFQWKDNSKIDFEKIINAESEYLPKNFTVISEGQLVNTRELKNDIDKQFDRLEITVRSSITKNITLNHNQTILFKNPLELPNDLELIKKELTMLHESNKEFLRKTLKKEVLELIELK

SEQ ID NO: 6323 - DNA, 303 bp, Unknown
  Obtained from environmental sample
  misc_feature (1)..(303): n is a, c, g, or t
atgaaattcttctctttattttactgtttcctcctcctgggactgaattttgctcttgcccaaacgcccgtgctgcgtagggtcacttataaaatttctatcatcaattcgtcaccggaaccaataaaaggatacctcttcaatttgtccgacagctcggtcaaagttggattttggcccgtctcgttcggcgacccgggaggtgcccgggagaacttcaaagaactcaattataaggatatatctgagataagcttaaagcgaaaccacggcgcaggccggggagcatggaagggtgcgtga

SEQ ID NO: 6324 - protein, 100 aa, Unknown
  Obtained from environmental sample
  SIGNAL (1)...(20)
  misc_feature (1)..(100): Xaa is any amino acid
MKFFSLFYCFLLLGLNFALAQTPVLRRVTYKISIINSSPEPIKGYLFNLSDSSVKVGFWPVSFGDPGGARENFKELNYKDISEISLKRNHGAGRGAWKGA

SEQ ID NO: 6325 - DNA, 348 bp, Unknown
  Obtained from environmental sample
  misc_feature (1)..(348): n is a, c, g, or t
ttgttgtgtttgancgggcagcttttaaaacgacnaaatggaggcaatacactcggaatcaatcaaatttccaatgtaatcccggaatcatattcattacttcaaaattatccaaatccatttaatccgggtacaaagataaggttctctattccgaaagcatccctgacaaaaatcatagtttatgatattctgggaaaggaagtaaaaacaatagttgacaattcactggcagctggaacgtacgaaactgaattcgattcctcagaactttcttcaggaatatatttttacagattgataactaaagactattccgaaacaaaaaaaatggttttgatgaaataa

SEQ ID NO: 6326 - protein, 115 aa, Unknown
  Obtained from environmental sample
  misc_feature (1)..(115): Xaa is any amino acid
MLCLXGQLLKRXNGGNTLGINQISNVIPESYSLLQNYPNPFNPGTKIRFSIPKASLTKIIVYDILGKEVKTIVDNSLAAGTYETEFDSSELSSGIYFYRLITKDYSETKKMVLMK

SEQ ID NO: 6327 - DNA, 603 bp, Unknown
  Obtained from environmental sample
  misc_feature (1)..(603): n is a, c, g, or t
atgtatagccaaaatttggaggaaaaatatattttagaatacttcggaaaccgtataggggctttcctggatcttggttgcaatgactgcaaaaccttttcgaatactcgcgcactcgcggagcgtggatggaaaggagtgttagtagatccgagcccgaaagcgattgagaaatgcaaagagctatacaatgggcataaaggattctatatttatccctatgctatttcagatcacaacgggaaagctatgctacaagagtccggcgcgttgtgttctgcagaagatgttggattggtaagtacttttcacgctcacgaaatggacaggtttaagcgaacggtaaagtatgaaccggtagaggttaagactttcaagtggcggactttctttaacagattgcggataaaggaatttacaatgataagcctggatgttgaaggctcagagctggacattctcccagatatggacttattaaaaacagaacttatagttattgagtggaacagtaaaccggaactgaaaatcgagtatgacaaatatcttcaagggtttaaaattatttatacgtcaggagaaaatttaatttacgcaagatga

SEQ ID NO: 6328 - protein, 200 aa, Unknown
  Obtained from environmental sample
  misc_feature (1)..(200): Xaa is any amino acid
MYSQNLEEKYILEYFGNRIGAFLDLGCNDCKTFSNTRALAERGWKGVLVDPSPKAIEKCKELYNGHKGFYIYPYAISDHNGKAMLQESGALCSAEDVGLVSTFHAHEMDRFKRTVKYEPVEVKTFKWRTFFNRLRIKEFTMISLDVEGSELDILPDMDLLKTELIVIEWNSKPELKIEYDKYLQGFKIIYTSGENLIYAR

SEQ ID NO: 6329 - DNA, 300 bp, Unknown
  Obtained from environmental sample
  misc_feature (1)..(300): n is a, c, g, or t
gtgaatcttacaatacacacccgcaattgggcgcaggcaatagctttgcaggtatcctctccctttgaaattgcgattgtaggaaatgattggaaagagaaactcaaccagtttcagaaatactttttatccaattcaatttatttaggaggaaacacagaagggagtttttcactgctccaggataaattaatgccgggtaaaacaatgatttatgtgtgtaaaaataaaacctgcaaaatgcctgtggaagaagtagatgacgcattgaagcaaattaaaagccagatgcttccttaa

SEQ ID NO: 6330 - protein, 99 aa, Unknown
  Obtained from environmental sample
  misc_feature (1)..(99): Xaa is any amino acid
MNLTIHTRNWAQAIALQVSSPFEIAIVGNDWKEKLNQFQKYFLSNSIYLGGNTEGSFSLLQDKLMPGKTMIYVCKNKTCKMPVEEVDDALKQIKSQMLP

SEQ ID NO: 6331 - DNA, 348 bp, Unknown
  Obtained from environmental sample
  misc_feature (1)..(348): n is a, c, g, or t
gtgcctggaaattttcttttttctttagttggtatatatgggaaacaggatcaggaaatgaaattcatcagactttttcttcagaataaagacgcgaagattctaggccaggattctgaggaaattaaaggtccgcaatgcgatggttgcgatacacctaaacttgatgattcactctcagaaaattggaaacctataatcggtttttcttcttctatttttccattgccagcgatgattctagatacaagcggcacggaaggaatctctcgcagtctttggacttttgattctgaaggaaaaaagcaggtatttaccgattatgagtatacggtaaactgtcattga

SEQ ID NO: 6332 - protein, 115 aa, Unknown
  Obtained from environmental sample
  misc_feature (1)..(115): Xaa is any amino acid
MPGNFLFSLVGIYGKQDQEMKFIRLFLQNKDAKILGQDSEEIKGPQCDGCDTPKLDDSLSENWKPIIGFSSSIFPLPAMILDTSGTEGISRSLWTFDSEGKKQVFTDYEYTVNCH

SEQ ID NO: 6333 - DNA, 939 bp, Unknown
  Obtained from environmental sample
  misc_feature (1)..(939): n is a, c, g, or t
gtgggttatatagccgttagattttttattattaaagacccccagggtagaacaattatgagctttggggcaaatcaggatattacagaacgaatattacgtgaacaagaaaaaattgaacttgagaaacaactgagagatcgtaattatgaacttgagaaaatgattcatgatcttaaacagatgcagagcagcctggtacaaagtgaaaagcttgcgtcattggggcagctaagcgcgggtatagctcatgaaataaataatccgctttcatttgtttcaagtaatatcaaccggttaagagaatacttttatgatacagttgcgttattaaaaaagtggcagagcctcgaacccgtgcttccttctgaaccatgtattactcagaaattaaaagaaattattcagttttccgcggaaattgattttagttttattctccaggattttgagagaatgatgacaagcatacaggaaggaactgaacgaattaaaaaaattgttgagggaacccggggctttgcacatttaaatgacgatacatttggcgctgccgatattaacattgcaatagatgaaaccttaacaattctatggaatgaaatcaaatataaagcaataattgaaaagaattatggcgctttaccccctgtaaggtgtaacatcggcgaaataaaacaggtccttgtcaatctgttaataaatgccgcccaggctatacctgaaaaaggaattattgaaattaaaaccacatttgaagaatcgctggtaataattaaaatcaaggattcaggatcccgaaatccaaatgataaaataaaccgtattttcgacccatttttcacaactaaaaccagtgggaaaaagaaacagggtttaggcctatggatattgtttcacaattataaaaaaaacataacggtctctattgcccgttga

SEQ ID NO: 6334 - protein, 312 aa, Unknown
  Obtained from environmental sample
  DOMAIN (74)...(180): His Kinase A (phosphoacceptor) domain
  misc_feature (1)..(312): Xaa is any amino acid
MGYIAVRFFIIKDPQGRTIMSFGANQDITERILREQEKIELEKQLRDRNYELEKMIHDLKQMQSSLVQSEKLASLGQLSAGIAHEINNPLSFVSSNINRLREYFYDTVALLKKWQSLEPVLPSEPCITQKLKEIIQFSAEIDFSFILQDFERMMTSIQEGTERIKKIVEGTRGFAHLNDDTFGAADINIAIDETLTILWNEIKYKAIIEKNYGALPPVRCNIGEIKQVLVNLLINAAQAIPEKGIIEIKTTFEESLVIIKIKDSGSRNPNDKINRIFDPFFTTKTSGKKKQGLGLWILFHNYKKNITVSIAR

SEQ ID NO: 6335 - DNA, 987 bp, Unknown
  Obtained from environmental sample
  misc_feature (1)..(987): n is a, c, g, or t
atggattttgcgttacaaaagatccatcctccgaaaaacaagcaaaagccgtacgaagacttttgggcaaaaatttatatatcggacaaatttttttcgattgaagataactgcggtggtatcccaaaaaaaattgccgaggaaagtgcttttcgacttgggagagcggatttaaagcaagataaggaccttccaacggttggtatgtacggcattgggatgaagcgtgccatattcaaaatggggacaaaggcacgggttacttctaagcataaacgctattcgtactacgttgatattcttcccacttggctatctgacgataaagactggatgttgcctctaaccgatacccaagacggtttagacaacgaaggaacacgtattgtagttagcaaattgcatgactatattgccaggcaattcactagccctaattttgagaaggaactgcgagcagacattggtcgattctttgcgatcattatgacgaaggggtttaccgtgttcctgaacgataaagaagtccctttgtcggattttcgattgcttttccataaggattttgacatgcctaatagaattcaaccttatgtgtataaagcaaaaattaatggcgttttaatagaaatggtagttggtttttatagtgggttagcttccgcgaacgaaactgaaacggaagaagaagaagaaaaggagaagccgactcgaaagggcgaaaatgcgggatggaccgtaatttgtaacgatagagtagtactttaccgcgataaatcgagattgacgggatggggaatcagggatgtcccgatgtatcacacccagtttagagcgattgcaggggtggtcattttttccagcccctattcgctaaacttgcctctgggaacgacgaagcgcaatatcgatactagctctgaggtgtatcaaaaggcttttggatcgaatgatggatggattgaaacagtttacaaatttcactaa

SEQ ID NO: 6336 - protein, 328 aa, Unknown
  Obtained from environmental sample
  misc_feature (1)..(328): Xaa is any amino acid
MDFALQKIHPPKNKQKPYEDFWAKIYISDKFFSIEDNCGGIPKKIAEESAFRLGRADLKQDKDLPTVGMYGIGMKRAIFKMGTKARVTSKHKRYSYYVDILPTWLSDDKDWMLPLTDTQDGLDNEGTRIVVSKLHDYIARQFTSPNFEKELRADIGRFFAIIMTKGFTVFLNDKEVPLSDFRLLFHKDFDMPNRIQPYVYKAKINGVLIEMVVGFYSGLASANETETEEEEEKEKPTRKGENAGWTVICNDRVVLYRDKSRLTGWGIRDVPMYHTQFRAIAGVVIFSSPYSLNLPLGTTKRNIDTSSEVYQKAFGSNDGWIETVYKFH

SEQ ID NO: 6337 - DNA, 486 bp, Unknown; identical to SEQ ID NO: 2853
  Obtained from environmental sample
  misc_feature (1)..(486): n is a, c, g, or t

SEQ ID NO: 6338 - protein, 161 aa, Unknown; identical to SEQ ID NO: 2854
  Obtained from environmental sample
  DOMAIN (7)...(161): Peptide methionine sulfoxide reductase
  misc_feature (1)..(161): Xaa is any amino acid

SEQ ID NO: 6339 - DNA, 966 bp, Unknown
  Obtained from environmental sample
  misc_feature (1)..(966): n is a, c, g, or t
atgtgtggaatcgtagggtatgcaggggaaaattctgctgcatctgttattatagaatccctgaaaaaactcgagtatcgtggatatgattctgccgggatttcggttctgggcagcggagtcgatacttacaaatcagtaggtaaaatcgtaaaccttgaaaccacaatccctaacagtataggtggcaatataggaatagggcatacccgctgggcaacccacggaagaccaagcactataaatgctcacccgcacaactcaggaaatccgtgcaagatctcggttgtgcataatggaatcatagaaaactacatggcgttgaaagagcgactgactgaagaaggatacgaatttaagtcggaaactgatacagaagtgattgcacatctcctgcacaaacatctctacgggaagcctgacggaaaagaagccaggtgcgaacttcttacaggactcagggaagcgctaaaagagattgaaggttcttatgcccttgcaattctctgttctgatgaacagggaaaactcgtacttgcgcggaaagacagcccgcttgttattggactaggaaaaggggaaaactttgccgcatcggatgtaactgcttttttgaattatacaagggatgttatttttgtaaacgattttgaaaccgcagttatgactcctacaagtgtgaagatctttgacaaagaaagaaaaccccgcaaaagaagaatgaaaagatcgagtgggattttgaagctgctgaaaaacccggcaacaaacatttcatgcttaagggaaaatcccgagccgggtgagtgcgaattcataaccccctttccgggtaagggcctccggagcttgaaaggaaccctttttcttaaccaaattaattttgacctaaggattaaaaaaaaaaaacttttaaggnggttcaaatttcgggcagtgggaaacttccctggcattacgaggctt

SEQ ID NO: 6340 - protein, 322 aa, Unknown
  Obtained from environmental sample
  DOMAIN (2)...(134): Glutamine amidotransferases class-II
  misc_feature (1)..(322): Xaa is any amino acid
MCGIVGYAGENSAASVIIESLKKLEYRGYDSAGISVLGSGVDTYKSVGKIVNLETTIPNSIGGNIGIGHTRWATHGRPSTINAHPHNSGNPCKISVVHNGIIENYMALKERLTEEGYEFKSETDTEVIAHLLHKHLYGKPDGKEARCELLTGLREALKEIEGSYALAILCSDEQGKLVLARKDSPLVIGLGKGENFAASDVTAFLNYTRDVIFVNDFETAVMTPTSVKIFDKERKPRKRRMKRSSGILKLLKNPATNISCLRENPEPGECEFITPFPGKGLRSLKGTLFLNQINFDLRIKKKKLLRXFKFRAVGNFPGITRL

SEQ ID NO: 6341 - DNA, 927 bp, Unknown
  Obtained from environmental sample
  misc_feature (1)..(927): n is a, c, g, or t
ttgggaggaacaaatcaatcaagaatccatttattattcccngggctgaaaaaagtaaatattgattcaaaccttaatcctaattacacctttgaaaattttgttgaaggagattgcaaccgtttagccagatctgcaggttatgcagtggcaaagaatcccggtggtacttctttcaatccattaatggtttatggtagcactggtttgggtaaaacccacctgctccatggaatcggaattgagatcaaaaagaattttcccaacaaaactgtactttatgtaccgtctgaaaaattcattaaccaatttattgactcggtaaaaaataccagcagtaatgatttcgtgaatttctatcagttggtggatgttttgattattgacgatgttcaatatttagccggcaaggaaaaaacacaggatgtgttcttccatatatttaatcacctgcaccaaaatggtaaacaacttattttaagttccgacaaaccaccagtggagttgcagggtatggaacaacgtcttctgtctcgttttaaatggggtctgtctgcagacttacaaattcctgagttagaaacaagaattgctattcttgaaaagaaaatttacaacgatggtatagaattaccaaaagatgtaattgaataccttgcttacagtattactactaatattcgtgagctggaaggtgctttgatctcattaatcgctcagtcatcattgaacaagaaggaagttactcttgatcttgccaaaaagatgatcgataagtttgtgaagaacaatgcccgtgaagtatctattgactacattcaaaaagtagtttgcgattattttgaattaccgatagagttaatgaaatcaaaaacacggaaacgtgaagtagttcaggcaaaggcaaattgctatgtattttgctaa

SEQ ID NO: 6342 - protein, 308 aa, Unknown
  Obtained from environmental sample
  DOMAIN (25)...(306): Bacterial  dnaA  protein
  misc_feature (1)..(308): Xaa is any amino acid
MGGTNQSRIHLLFPGLKKVNIDSNLNPNYTFENFVEGDCNRLARSAGYAVAKNPGGTSFNPLMVYGSTGLGKTHLLHGIGIEIKKNFPNKTVLYVPSEKFINQFIDSVKNTSSNDFVNFYQLVDVLIIDDVQYLAGKEKTQDVFFHIFNHLHQNGKQLILSSDKPPVELQGMEQRLLSRFKWGLSADLQIPELETRIAILEKKIYNDGIELPKDVIEYLAYSITTNIRELEGALISLIAQSSLNKKEVTLDLAKKMIDKFVKNNAREVSIDYIQKVVCDYFELPIELMKSKTRKREVVQAKANCYVFC

SEQ ID NO: 6343 - DNA, 723 bp, Unknown
  Obtained from environmental sample
  misc_feature (1)..(723): n is a, c, g, or t
atgaacaatcaacgatttttagttaatccgcttcaattatcgcaagagaaatcattaaaaactcttgtagaaaacagaactatttacaatttgaatcattgtgaattaaatctatttgaaacctacgaatcgactcaaaaagttcctttaaaatttaatgatttggtggtcactagtatgctgagaggcaaaaaaatcatgcatctttttgatgatcctgaatttgtatatcttccaggtgaaaccgtgattgttccttcaaatgtagaaatgaaaattgattttcctgaagcttcaaaaaataatccgacgcaatgtctagcattagcaatagatcaggataaaattgctgaaatcctaaatttcttaaatgaacagtatcctaaagaaggaagcaatatgtattggcagctaaattatcagaattatttcttttataataatatcgaaatggctgcaacaatcaacaaactcataaaagaatgcatgagcacatcgattactaaagatatttttgccgatttgacattaaaagaattgctaattagaattattcagacgcaaacggtaaaatctattgatgaagganaatttctagacgccaataatccaataaaagaagtcacagaatacattaaacaaaatctgaaagaaaatatcaatttaaaatcgctaagcgaaaaaacctgcatgagcaccactttctttctaccgtttctttaa

SEQ ID NO: 6344 - protein, 240 aa, Unknown
  Obtained from environmental sample
  misc_feature (1)..(240): Xaa is any amino acid
MNNQRFLVNPLQLSQEKSLKTLVENRTIYNLNHCELNLFETYESTQKVPLKFNDLVVTSMLRGKKIMHLFDDPEFVYLPGETVIVPSNVEMKIDFPEASKNNPTQCLALAIDQDKIAEILNFLNEQYPKEGSNMYWQLNYQNYFFYNNIEMAATINKLIKECMSTSITKDIFADLTLKELLIRIIQTQTVKSIDEGXFLDANNPIKEVTEYIKQNLKENINLKSLSEKTCMSTTFFLPFL

SEQ ID NO: 6345 - DNA, 345 bp, Unknown
  Obtained from environmental sample
  misc_feature (1)..(345): n is a, c, g, or t
ttgataaagaaaatttttagacgccattatccaataaaagaagtcacagaatccattnaacaaaatctgaaagaaaatatcaatttaaaatcgctagcgaaaaaagcctgcatgagcaccacttctttctaccgtttctttaaacgcgaactcggaatgagtccgattgagtatattttgaatgagaaaataaaatgtgccaaaaatctattaaagaatccaaccctgcaaattaatgaagtttgttatttagctggctttgaagatgccaattacttcatcagattatttaagaaatacgaaggaattacgccaaaacagtatcagttactttatattaattaa

SEQ ID NO: 6346 - protein, 114 aa, Unknown
  Obtained from environmental sample
  DOMAIN (14)...(60): Bacterial regulatory helix-turn-helix proteins, AraC family
  misc_feature (1)..(114): Xaa is any amino acid
MIKKIFRRHYPIKEVTESIXQNLKENINLKSLAKKACMSTTSFYRFFKRELGMSPIEYILNEKIKCAKNLLKNPTLQINEVCYLAGFEDANYFIRLFKKYEGITPKQYQLLYIN

SEQ ID NO: 6347 - DNA, 375 bp, Unknown
  Obtained from environmental sample
  misc_feature (1)..(375): n is a, c, g, or t
gtggctgcaaaatccaaaaaagatcccccatctaaagaattgcccagttccgaacttgaaccgcaaagatatgaaggacgtccgctcattctaatccttgataactatgttttggattgtatcggtgaacttccttcagacaaaaaagctttgatcatcacaattgttcaaaaggcgttcggcggcggtgctgattggaaaaaaactgttcgcgaccttttacagctttccgattcgattgaagataacattcgaagtttgtggagcgaaaataagaagattgctgcgcaaaataattccgaattgcatcccgttcaatttgccaaaatgattgttgatgacaacttcgccgagttcatcgacaaacaaacctaa

SEQ ID NO: 6348 - protein, 124 aa, Unknown
  Obtained from environmental sample
  misc_feature (1)..(124): Xaa is any amino acid
MAAKSKKDPPSKELPSSELEPQRYEGRPLILILDNYVLDCIGELPSDKKALIITIVQKAFGGGADWKKTVRDLLQLSDSIEDNIRSLWSENKKIAAQNNSELHPVQFAKMIVDDNFAEFIDKQT

SEQ ID NO: 6349 - DNA, 927 bp, Unknown
  Obtained from environmental sample
  misc_feature (1)..(927): n is a, c, g, or t
atgcaacgatattggtggtgggatccttttgctagtgctacagcgctttaccgaaaaaacctaagacatcatattgctgaaaaaatgcattgttgcgctaaaacgtttgcagattttgctgtatgcctttctttaacaagcactcactattattctacaatccttttcagacatgcagatcaatggctttctaaaatccctaactggatcttcaatatagccaagcatactgagcccatctacaaaaaatctcaccttgtagcagaggcttacttaggatttagttccttagataaaatcgaccttcttctaatccaatattttgttgattcccaaaaagaacctaaaaaatggctttctgtatccacagataaaagattattatctgtgattttcccaaaaacacagatctcacataaacggttgcttacgctaattacaaacttacttaatatgaaaaaacacacaataaacgtctttgctatgctatgtaatatgcttgtttatcaaatacaaactcaagaaaaggttatagagagacaaaagtgtgtggaaagttttgctcaagaaaatcttataacattacgagagagcatcaactggaaagaggatgagttcaagaacattctcctgaaattttcgaaaaaagaattcaatctcgatatcgaaccatttaaaataatttctacagaaacagctacagaacanaaagaggactttttcttgcgggttttcgcanaagtgctctttncagcacagatattagaaacaaaatgtgatctgcctaanagatctcttctcgcttctcttgaattaaacatcgatcgttttatcgagcaacatacagcagaaagtcttactactccacaactactcaaaaagcttatccctaagcaaaaaatctcctctcatcctatctacagatga

SEQ ID NO: 6350 - protein, 308 aa, Unknown
  Obtained from environmental sample
  misc_feature (1)..(308): Xaa is any amino acid
MQRYWWWDPFASATALYRKNLRHHIAEKMHCCAKTFADFAVCLSLTSTHYYSTILFRHADQWLSKIPNWIFNIAKHTEPIYKKSHLVAEAYLGFSSLDKIDLLLIQYFVDSQKEPKKWLSVSTDKRLLSVIFPKTQISHKRLLTLITNLLNMKKHTINVFAMLCNMLVYQIQTQEKVIERQKCVESFAQENLITLRESINWKEDEFKNILLKFSKKEFNLDIEPFKIISTETATEXKEDFFLRVFAXVLFXAQILETKCDLPXRSLLASLELNIDRFIEQHTAESLTTPQLLKKLIPKQKISSHPIYR

SEQ ID NO: 6351 - DNA, 915 bp, Unknown
  Obtained from environmental sample
  misc_feature (1)..(915): n is a, c, g, or t
gtgagaccctttttcagtaccccttttaacaacaaaaaaagaatttgcttatcggattgtgagaaaatgcatctgtgtgccaaaaccttcgctgattttggcttccgcatttctttaaagcaaaattattatccctacatccttctacatcatgcgcacagatggttaactcatattcccgcacggtgccttcaggaaaacaaagagatacaatttttttgccgtgataagatgaaacgctttcattccaagatttatatcaacaaacagatctttcaagcttatagttctttagatccaatttttaccttactcactaaatatttgctctcttctttaaaagacccatttaagcaacaaataatatctgaggatcacttacttttaaacttcatcttctcaaacgatctgtttaataaagagcttttactacaatttattgcatcgttatttgatactgacgagttgacgctcaacagtttttcagttttttgcgaaaggcttaaaccaaacaataacccagaaaagagcgtattacttagactctttgctgaagagcctctttcggaaaaagatttactagatctcctctctacattgtcttccgtagaaggtttgacaataaatgcctttgcgatcttatgcaatctcctcactataccaaagactttagagagcatcgattggagcaataaaaaacttcatacacttttatttgctctcacttccaagaatttttatctgcacacacctccccttcgtaaatataaacttcctctaggagctaaaggaaaagaccaagatcatcctctgatccaattttttggatatactttgcgccaaactcaatcgttagaaaaaaaatgcagtcttccgaaaaatacactgattagcccactcaactgcacatcctga

SEQ ID NO: 6352 - protein, 304 aa, Unknown
  Obtained from environmental sample
  misc_feature (1)..(304): Xaa is any amino acid
MRPFFSTPFNNKKRICLSDCEKMHLCAKTFADFGFRISLKQNYYPYILLHHAHRWLTHIPARCLQENKEIQFFCRDKMKRFHSKIYINKQIFQAYSSLDPIFTLLTKYLLSSLKDPFKQQIISEDHLLLNFIFSNDLFNKELLLQFIASLFDTDELTLNSFSVFCERLKPNNNPEKSVLLRLFAEEPLSEKDLLDLLSTLSSVEGLTINAFAILCNLLTIPKTLESIDWSNKKLHTLLFALTSKNFYLHTPPLRKYKLPLGAKGKDQDHPLIQFFGYTLRQTQSLEKKCSLPKNTLISPLNCTS

SEQ ID NO: 6353 - DNA, 621 bp, Unknown
  Obtained from environmental sample
  misc_feature (1)..(621): n is a, c, g, or t
atgaaagaaaatttaaatgatgccatcagaaatttcttcaaaggcagaagacagtcattgaaactttttaaccaattacgaaggatcattgaaaaatacggtacaccagaaatcgaagtcctgaagactcagatctcctttggtgaagtctataaatatatatggatttggctgccccagaagtgggtgccatcccggccggaaaacagcattacattaacgatccttaccggaaaaaaaatacaaagcagcagggtaacggaatctttgcagcctaagaaaggattctggacccatcatatcctgattgatagtgaaaaagctattgatagtgaaatcgagcaactgatacaggccagctatgagttctacagggaaaggctggaaattaaatcaaagaagctaagaggaaaaagctataattgctgcatgtttggaagtttcaagaagtgtcgatatttatcgaaatcctttcaccggaaactaaaaagattttcgtccaaacaaaccgaaacccccagcatttttatgagcattgatgaaggtatatccggagaaaaatcaaaaacatttctgcccttttcgaaaaacttttctaagaaatttaaccttattgcttaa

SEQ ID NO: 6354 - protein, 206 aa, Unknown
  Obtained from environmental sample
  misc_feature (1)..(206): Xaa is any amino acid
MKENLNDAIRNFFKGRRQSLKLFNQLRRIIEKYGTPEIEVLKTQISFGEVYKYIWIWLPQKWVPSRPENSITLTILTGKKIQSSRVTESLQPKKGFWTHHILIDSEKAIDSEIEQLIQASYEFYRERLEIKSKKLRGKSYNCCMFGSFKKCRYLSKSFHRKLKRFSSKQTETPSIFMSIDEGISGEKSKTFLPFSKNFSKKFNLIA

SEQ ID NO: 6355 - DNA, 666 bp, Unknown
  Obtained from environmental sample
  misc_feature (1)..(666): n is a, c, g, or t
atgtatccattgagcaccgattcaaattactacaaagatctatggaccaaacccaataatcacggtacaatattctggaagaatgtagactttggtaaaaaagaatacaaattacaggaacatatgttcaggcaattattggttagtataaagaatctaaacaggcttcatgttgacgaaagagagataaagtcggtgcttgaagttggtgcaggcactggtagaatggcaaagatagtttggaatgaatttccaaatataaaggcatatgatgctgtagatattcataataaaataactaatgcctattataatactgatcataatttatttaataaaataaattggtatgatttggatataacgggtaaatactttgatgaagcatttagaggtagacagtatgatttggtgcttgcaagtgaggtattaatgcatataaaaccaagtgatatagaagtggtgattaaaaaggtaacacgtcttctcgcaccgaaaggtcttataatcaatatggattggttctttgaaccaaatgctctgaccggaggaggatggtgttttatccatgactatcataaaatgtatgaagaaaacggattaactccaatctttacagcggatatgaaggaaataaaacaaaagatattctgttatggtgtgtaa

SEQ ID NO: 6356 - protein, 221 aa, Unknown
  Obtained from environmental sample
  misc_feature (1)..(221): Xaa is any amino acid
MYPLSTDSNYYKDLWTKPNNHGTIFWKNVDFGKKEYKLQEHMFRQLLVSIKNLNRLHVDEREIKSVLEVGAGTGRMAKIVWNEFPNIKAYDAVDIHNKITNAYYNTDHNLFNKINWYDLDITGKYFDEAFRGRQYDLVLASEVLMHIKPSDIEVVIKKVTRLLAPKGLIINMDWFFEPNALTGGGWCFIHDYHKMYEENGLTPIFTADMKEIKQKIFCYGV

SEQ ID NO: 6357 - DNA, 345 bp, Unknown; identical to SEQ ID NO: 175
  Obtained from environmental sample
  misc_feature (1)..(345): n is a, c, g, or t

SEQ ID NO: 6358 - protein, 114 aa, Unknown; identical to SEQ ID NO: 176
  Obtained from environmental sample
  misc_feature (1)..(114): Xaa is any amino acid

SEQ ID NO: 6359 - DNA, 351 bp, Unknown; identical to SEQ ID NO: 115
  Obtained from environmental sample
  misc_feature (1)..(351): n is a, c, g, or t

SEQ ID NO: 6360 - protein, 116 aa, Unknown; identical to SEQ ID NO: 116
  Obtained from environmental sample
  misc_feature (1)..(116): Xaa is any amino acid

SEQ ID NO: 6361 - DNA, 351 bp, Unknown; identical to SEQ ID NO: 115
  Obtained from environmental sample
  misc_feature (1)..(351): n is a, c, g, or t

SEQ ID NO: 6362 - protein, 116 aa, Unknown; identical to SEQ ID NO: 116
  Obtained from environmental sample
  misc_feature (1)..(116): Xaa is any amino acid

SEQ ID NO: 6363 - DNA, 630 bp, Unknown
  Obtained from environmental sample
  misc_feature (1)..(630): n is a, c, g, or t
ttgaaacagctttcagatgttcaaatttttaataaaggacaaggaatatttaccaagaaaaatgaagttgccacgattgaacaatcaatcaggagtaacaaatccatttatgagccattggggattgttgatatttcaatgtttgaaaaacaacattctgatttgctgaatatcgaatacacaacatttgaaacaagtcgtgagagattccaaaaggaaaattcaagacaaacaagagaacttgaagaacaaaagcaaaggaaagaaagagaagtaatcatcaagataaacgaatttaaacagccttcagaagctatattaagtaaattcaaggattggcgttctgatgttaattccctacccgattcaacacatttagagttaatcactgaatatcaaaatttccttgctaggttggagaatgataatcttccaaagtttgaaaagaaattcaatgactatttgcaagaaacaattaccaataaagtaggtgattttagaatgttctttgaaacctggtcagattcaatcaaagaaaacatcaaacatttgaacgaatctttgaaagagattgacttcaaaaataaaccccaaacctacattcaacttggtgcacctaacanagattaa

SEQ ID NO: 6364 - protein, 209 aa, Unknown
  Obtained from environmental sample
  misc_feature (1)..(209): Xaa is any amino acid
MKQLSDVQIFNKGQGIFTKKNEVATIEQSIRSNKSIYEPLGIVDISMFEKQHSDLLNIEYTTFETSRERFQKENSRQTRELEEQKQRKEREVIIKINEFKQPSEAILSKFKDWRSDVNSLPDSTHLELITEYQNFLARLENDNLPKFEKKFNDYLQETITNKVGDFRMFFETWSDSIKENIKHLNESLKEIDFKNKPQTYIQLGAPNXD

SEQ ID NO: 6365 - DNA, 306 bp, Unknown
  Obtained from environmental sample
  misc_feature (1)..(306): n is a, c, g, or t
atggccattaagaaatgtatcgatggcttcctgcaaatgtttaaggataaaaactgggacggtttctggattcacatagatgttgatgtgttgaatgataccattatgcctgcggtggatagtcnccagccaggcgggctggaatacagtgagctgaaccaggtactgcatatgcttttaaggcatccaaaagcaacaggcctggaaataaccatcctcgaccccgaccttgacccatcagggatttacacaaaagaatttgtaaagaatttttgtactaccgttaattcaattttgaaaagttaa

SEQ ID NO: 6366 - protein, 101 aa, Unknown
  Obtained from environmental sample
  misc_feature (1)..(101): Xaa is any amino acid
MAIKKCIDGFLQMFKDKNWDGFWIHIDVDVLNDTIMPAVDSXQPGGLEYSELNQVLHMLLRHPKATGLEITILDPDLDPSGIYTKEFVKNFCTTVNSILKS

SEQ ID NO: 6367 - DNA, 444 bp, Unknown
  Obtained from environmental sample
  misc_feature (1)..(444): n is a, c, g, or t
ttgacttcacatcaaggtcatagtttgattgaaattggaaaagcttcacaaaaaatcaaagccaaaataacagaagttggtttaaacttcaacaaatcattcgaaacacttcaaaatataacgacaagattcgctgattcgaaaagagaatcttatagattgaaaaatgaacttaataggtttttttattatttatttttgaaatttttaaaattcacattcaaattcaaaataaataataaaagtaaatccaaagaattgaaacatcaatcaacaaatgatatcaaaaacaaaattgaaattctcaaaaaacaactcatttcaattcacaaacaaaatgacaaagatcatgaaacaatgttgacaaaactacaatcaaactatgatcaacatcaaatccacttcaatctttgtcaaaatgttttatttattttaatattttga

SEQ ID NO: 6368 - protein, 147 aa, Unknown
  Obtained from environmental sample
  misc_feature (1)..(147): Xaa is any amino acid
MTSHQGHSLIEIGKASQKIKAKITEVGLNFNKSFETLQNITTRFADSKRESYRLKNELNRFFYYLFLKFLKFTFKFKINNKSKSKELKHQSTNDIKNKIEILKKQLISIHKQNDKDHETMLTKLQSNYDQHQIHFNLCQNVLFILIF

SEQ ID NO: 6369 - DNA, 900 bp, Unknown
  Obtained from environmental sample
  misc_feature (1)..(900): n is a, c, g, or t
gtgtttgctactgcactgcacaccgagtggcgtgattacaagatcaacattattgacacacccggttttgatgattttgtcggagagatggtgtctgccgtcaggatagcagatacctgcgtggttgtagttaacgcgcaacacggtgttgaagtaggtaccgaactgatctggaattacatcgatcgtttcaacaaacccacaatttttgccatcaaccaactcgatcatccaaaagcagattttgaaacttctttaacatcactaaaagaacgttttggaagcgctgtgacccagatgcaataccccttcaacagcggggaaggttttaatgccattatcgacctgctgaaaatggtgatgtataaattttccgttgacggtggcaaaccaaaaaaacttcctattcccgaatcggaaaaagaaaaagcagagcgactgcacaatgatcttgtagagaaagctgcagaaaacgatgagaaattaatggaaaaatacttcgagaagggcacactcgatgaagatgagttacggcagggattaaaactcggaatgatcaagcatgatgtgttcccggtgttttgtatgtcagctaaaaaaaatatgggcagtggacgaatgatgggattcatcgataatgtggcaccaacacctcttgaagcaagcccggaacgaagcattgaaggaaatgaggtgcctttggacccggcaaaacccacagtattgtttgtgtttaaatcccatctcgaacctaacctcggaaaactttcgttttttaaagtgatctcaggggaaatagcaacaggtagtgaacttgtaaaaccgccgaacaggaacagtccaaaaaaatacatcatcctttttatcagggaagggcaaaaaaacaaaaccccgggttga

SEQ ID NO: 6370 - protein, 299 aa, Unknown
  Obtained from environmental sample
  DOMAIN (1)...(219): Elongation factor Tu GTP binding domain
  misc_feature (1)..(299): Xaa is any amino acid
MFATALHTEWRDYKINIIDTPGFDDFVGEMVSAVRIADTCVVVVNAQHGVEVGTELIWNYIDRFNKPTIFAINQLDHPKADFETSLTSLKERFGSAVTQMQYPFNSGEGFNAIIDLLKMVMYKFSVDGGKPKKLPIPESEKEKAERLHNDLVEKAAENDEKLMEKYFEKGTLDEDELRQGLKLGMIKHDVFPVFCMSAKKNMGSGRMMGFIDNVAPTPLEASPERSIEGNEVPLDPAKPTVLFVFKSHLEPNLGKLSFFKVISGEIATGSELVKPPNRNSPKKYIILFIREGQKNKTPG

SEQ ID NO: 6371 - DNA, 312 bp, Unknown; identical to SEQ ID NO: 1127
  Obtained from environmental sample
  misc_feature (1)..(312): n is a, c, g, or t

SEQ ID NO: 6372 - protein, 103 aa, Unknown; identical to SEQ ID NO: 1128
  Obtained from environmental sample
  misc_feature (1)..(103): Xaa is any amino acid

SEQ ID NO: 6373 - DNA, 309 bp, Unknown; identical to SEQ ID NO: 1129
  Obtained from environmental sample
  misc_feature (1)..(309): n is a, c, g, or t

SEQ ID NO: 6374 - protein, 102 aa, Unknown; identical to SEQ ID NO: 1130
  Obtained from environmental sample
  misc_feature (1)..(102): Xaa is any amino acid

SEQ ID NO: 6375 - DNA, 681 bp, Unknown
  Obtained from environmental sample
  misc_feature (1)..(681): n is a, c, g, or t
atgaccagaacagaactcatcaggcagatcaggcagaaagaatcttatctgtgtgtaggattggatacggatattcaaaaaattccatcgcatcttttaaaagagaaagatccggtattcactttcaataaagcgattatcgatgcaacacatccttttactgttgcctataagccaaatcttgctttttacgaaagtaatggtgtagaaggatgggaaagtcttcaaaaaacactggagtatattcccagagattgtttcactattgctgatgcaaagagaggtgatattgggaatacgtcagctttatatgcaagagctttttttgaaaaaatgaattttgactctgtaacagtagcgccttatatgggagaagattctgtgaaaccttttctggagtttaaagataaatgggtgatattacttgcactcacatccaatccgggtgcaaatgattttcaaaccaaaacattaggtgatggtaatgaaatggtttttgaaaaagtattgaccatctcacagcaatggggaactattgaaaacctgatgtatgtaattggagcaacacgtgctgacctggtgaagaaagtaagggagattgtaccagatcactttttattagttcctggagttggtgcgcaaggcggagacctcgaaaacatttctaaggaaaggacttaa

SEQ ID NO: 6376 - protein, 226 aa, Unknown
  Obtained from environmental sample
  DOMAIN (15)...(200): Orotidine 5'-phosphate decarboxylase / HUMPS family
  misc_feature (1)..(226): Xaa is any amino acid
MTRTELIRQIRQKESYLCVGLDTDIQKIPSHLLKEKDPVFTFNKAIIDATHPFTVAYKPNLAFYESNGVEGWESLQKTLEYIPRDCFTIADAKRGDIGNTSALYARAFFEKMNFDSVTVAPYMGEDSVKPFLEFKDKWVILLALTSNPGANDFQTKTLGDGNEMVFEKVLTISQQWGTIENLMYVIGATRADLVKKVREIVPDHFLLVPGVGAQGGDLENISKERT

SEQ ID NO: 6377 - DNA, 504 bp, Unknown
  Obtained from environmental sample
  misc_feature (1)..(504): n is a, c, g, or t
atgaaacaattaaattccttaatcagtaaagcgcaaagttcttctttttatttatggattttaaacttttttgctgcgagattagttccatttaataagtcacattctttaaccataaaaaaaattactcctcaatccattgaggttgaattaccatataggaaaagcaatttgaatcatataaaaggtattcatgcctgtgctttggctaccttatgcgaatacagtaccggtgtggttttgctggcgtccataaatcctgagttataccggattattttgaagaatattcatgtaacctaccattaccaggcaaagcaggcagtaagagccaaatttgagctaaccacggaatggattgagcgtgaagttgtagtcccattaaaaagcaccgatgctatattcaaagaatttacggtagaggtgtatgatctaagcaataaccatatttgtactggtttaattaattggcaaataaagtcgtggaagaaggttaaatcctaa

SEQ ID NO: 6378 - protein, 167 aa, Unknown
  Obtained from environmental sample
  misc_feature (1)..(167): Xaa is any amino acid
MKQLNSLISKAQSSSFYLWILNFFAARLVPFNKSHSLTIKKITPQSIEVELPYRKSNLNHIKGIHACALATLCEYSTGVVLLASINPELYRIILKNIHVTYHYQAKQAVRAKFELTTEWIEREVVVPLKSTDAIFKEFTVEVYDLSNNHICTGLINWQIKSWKKVKS

SEQ ID NO: 6379 - DNA, 678 bp, Unknown
  Obtained from environmental sample
  misc_feature (1)..(678): n is a, c, g, or t
ttgtcacctgtaaaatttttcaccagcaacaacgaagaaattgaatttgaccttattgcttactgggatggataccttattcttatcgaagcaaaatgcacgaaatccatatatcgtggctctgaactatatcgaagtcgaaaagctatcgaagatgcagttcaacaattaaatttacgagagaaatctattttggataattgggatgcctttcgaatagcagcaaaagaattagcattacctcaccaaccaattaatcctaacagagttttaaagatagccattacaaatgtcttagtatttacaggaatggtgatagataaagtcgtagttactgatgagcactgcctaaagaggttttttggcgaaccagatattgaattgcttcagctttcacccaaagatggaattcaagtaattggatcggttgggagaattagaaaatccgacaaaataattgcgcctgaactcttcccatacttgagcaacccgccacaagttaatatggtaaaggaatgtctaaataaagaactactggtcctgccaaaaataaatgaaaaggaccctagtattggaatgttacaccttgtttacaacccccaaaaactgaaaattctaaaatcatccaaaaaacttcttggaataaaaaaatcgaaaccaagaaaacgacacagataa

SEQ ID NO: 6380 - protein, 225 aa, Unknown
  Obtained from environmental sample
  misc_feature (1)..(225): Xaa is any amino acid
MSPVKFFTSNNEEIEFDLIAYWDGYLILIEAKCTKSIYRGSELYRSRKAIEDAVQQLNLREKSILDNWDAFRIAAKELALPHQPINPNRVLKIAITNVLVFTGMVIDKVVVTDEHCLKRFFGEPDIELLQLSPKDGIQVIGSVGRIRKSDKIIAPELFPYLSNPPQVNMVKECLNKELLVLPKINEKDPSIGMLHLVYNPQKLKILKSSKKLLGIKKSKPRKRHR

SEQ ID NO: 6381 - DNA, 951 bp, Unknown
  Obtained from environmental sample
  misc_feature (1)..(951): n is a, c, g, or t
gtgtttccgtggaatatggagactaaaccagtaattaaatctttactggaaaacccagagattgagaaagtatttcactatggcacacatgatgccaatgtattgtggacatttggtattgatgtaatcaactataagcatgacacactaatcatgcaaaatagtttagaaccagagatgccccgctcattaaactttttaacttctgtctatacacgcgagccttattataaacaagagggtcggggtgatttgccagaagattcaaaagtgtgggctgtgcgttctgataagcagaagatttatatttacaatggaaaggattgctgctgcacatatgagatacatgagaagctattaaaagaaattgatagtgatgcattagcagctaagacatatcagcacaaaatgaattgtttgcctatggcatttagaatgtctcgcgcagggatgaatgttaatttagaattgcgagatacatttagacaatctctattacataaatgggcagctaagcagcagatattaaatgctatagcaggtaagagtgttaatgtaaatagtaagaaagatatgccgtggttactatatgaaaagttgaagctgccagtaagaaggaatagaggaagtggaattactactgacgaagatgcaatcatttcgttaatgactttctccacncataagattaagaatttaaaacaacagtcagctatagatgattgggaaattaaattagaagcatgtaggttgataatggaaattagaggcacacgtaaaatgttatccacatatatagatgctaagctaagtgacgataacagattacgctctacatataaagtagctaataccacaatggataaatgggctgctgaacagtggattgataagacaggactgaatggacagacatttccgcgtgggatattaacatttgggaaaacttaa

SEQ ID NO: 6382 - protein, 316 aa, Unknown
  Obtained from environmental sample
  misc_feature (1)..(316): Xaa is any amino acid
MFPWNMETKPVIKSLLENPEIEKVFHYGTHDANVLWTFGIDVINYKHDTLIMQNSLEPEMPRSLNFLTSVYTREPYYKQEGRGDLPEDSKVWAVRSDKQKIYIYNGKDCCCTYEIHEKLLKEIDSDALAAKTYQHKMNCLPMAFRMSRAGMNVNLELRDTFRQSLLHKWAAKQQILNAIAGKSVNVNSKKDMPWLLYEKLKLPVRRNRGSGITTDEDAIISLMTFSTHKIKNLKQQSAIDDWEIKLEACRLIMEIRGTRKMLSTYIDAKLSDDNRLRSTYKVANTTMDKWAAEQWIDKTGLNGQTFPRGILTFGKT

SEQ ID NO: 6383 - DNA, 582 bp, Unknown
  Obtained from environmental sample
  misc_feature (1)..(582): n is a, c, g, or t
atgagctatacaaagatcacgaacttcaacgccggcaagaagttgtcggataacctgaataacctgatgcagaacaagctcaatgtgatcgtttacaattttgtcgacatgctgagccacgcgcgcactgaaatggaggtcatccgcgagcttgcggagaacgaaccggcataccggggtattacttacagctggttcgagcattcgccgttgtttgacattatcaaacaacttgcagcaaagaagatcaaggtggttattaccaccgatcacggaaccgttcatgtaaaggagccgaccaagatcctgggcgacaagaatgtgaacaccaatctccgttacaagcagggaaaagcgcttgaatacagcgcgaaggaagtgttcgagatcaaaaatccggccgatgctttccttccgcgtcagcatccaagcacgcggtttgtttttgccagagaggacaggttctttgcctatccgaacaactttaatcactacgtaaattattacaggaatactttccagcacgggggcgtcagcctcgaggaaatgatcatcccatacatagtgctcacagcaaggtaa

SEQ ID NO: 6384 - protein, 193 aa, Unknown
  Obtained from environmental sample
  misc_feature (1)..(193): Xaa is any amino acid
MSYTKITNFNAGKKLSDNLNNLMQNKLNVIVYNFVDMLSHARTEMEVIRELAENEPAYRGITYSWFEHSPLFDIIKQLAAKKIKVVITTDHGTVHVKEPTKILGDKNVNTNLRYKQGKALEYSAKEVFEIKNPADAFLPRQHPSTRFVFAREDRFFAYPNNFNHYVNYYRNTFQHGGVSLEEMIIPYIVLTAR

SEQ ID NO: 6385 - DNA, 924 bp, Unknown
  Obtained from environmental sample
  misc_feature (1)..(924): n is a, c, g, or t
gtggtgactgcgatcagcggggatgaggccatcgatacggtcagggacgaccggtccatcagcgctgtgttgctcgacgagaacatgccggggatcagcgggcttgaaactttgctgaagatcaagcaggccaacggcgacctgccggtggtaatgatcaccaaaagcgaggaagagcacattatggatgatgccataggcggaaagatagcagactatcttatcaaacctgtgaatcctaaccagatcctgctctctctcaaaaaggcgcttgataataagcggcttgtgagcgaaaagaccaatacagattatcgtaaggagtttggccagatcggcatgacgatcaatgacaatctaacgtgggaagagtgggcggaagtttataagaaaatcatatactgggaactggaaatggatgccctgcaggataaaagcatgctcgacgtgctcaagatgcagaaatcagatgcgaacaaccagtttttcaagttcattgaaagaaattacgtcaactggctgagtggaaaggaccccaatccgccggtgatgagccacacgttatttaagaacaaatttcttcccgagcttgcgggacccgatcctgttttttttattctcattgacaatctccggttcgatcagtggaaagtgatccagccgctggtgatggattatttcaaggttgaaaccgaagattcgtttttcagcatcctgccaacggccacgcagtatgcacgcaatgccattttcagcggtttgctgccgagtgagattgaaaagagattccccgacaaatggctcaacgacgaagaggagggcggtaagaacctgcacgaagagttttttatcccggcacaactgaagcgtcctcggaaagatgtaaaaatgacctattccaagatcaccgactttcacccccgg

SEQ ID NO: 6386 - protein, 308 aa, Unknown
  Obtained from environmental sample
  DOMAIN (1)...(95): Response regulator receiver domain
  misc_feature (1)..(308): Xaa is any amino acid
MVTAISGDEAIDTVRDDRSISAVLLDENMPGISGLETLLKIKQANGDLPVVMITKSEEEHIMDDAIGGKIADYLIKPVNPNQILLSLKKALDNKRLVSEKTNTDYRKEFGQIGMTINDNLTWEEWAEVYKKIIYWELEMDALQDKSMLDVLKMQKSDANNQFFKFIERNYVNWLSGKDPNPPVMSHTLFKNKFLPELAGPDPVFFILIDNLRFDQWKVIQPLVMDYFKVETEDSFFSILPTATQYARNAIFSGLLPSEIEKRFPDKWLNDEEEGGKNLHEEFFIPAQLKRPRKDVKMTYSKITDFHPR

SEQ ID NO: 6387 - DNA, 753 bp, Unknown
  Obtained from environmental sample
  misc_feature (1)..(753): n is a, c, g, or t
ttgaaagctgaagggaaaaagggttttggcccgggattagatcgaaacctttatgttggggacagggatttaaaaattcggtatcctgccaattatacaaaaaccacccattctgtgcggatcaaccaatttggcaacctgatagaagacttgctggtaaacgatatcaaccaggtcgtacaaaccgatataacatatttctggatgaagggcagctttgcatacatggtctttatcattgatgtttattctcgaatgatagtgggctatcacgcctccttaaacctggaagcggcaggtaatctaaaagctttaaaaatgatgattcaactgcgaggcgcaaagaaattaaaaggtctcatccatcactcagataagggatctcaatatcattttaaagaatatcttaaagaattaaaggatcatggtattaaaataagtatgtgtgatacagcttggcaaaatgcttatacagaacgaatcaaccggaccatgaaatatgagtatttacggcaccgtaagattgataatattaaaaaattacgaaaatgtctggatgcagatgtaaaggcctataataccgaccggcctcattggagcttgccacaacaaatgtcacctgcagccttcgaggaatacctaaaaactgaaaaagggaagatgcgcccagaaatgaaaatttataaaagtgaaaaaaatgagttttttttagccatgaggcaatccgataaaaagaaagcagccaaaatatga

SEQ ID NO: 6388 - protein, 250 aa, Unknown
  Obtained from environmental sample
  DOMAIN (52)...(212): Integrase core domain
  misc_feature (1)..(250): Xaa is any amino acid
MKAEGKKGFGPGLDRNLYVGDRDLKIRYPANYTKTTHSVRINQFGNLIEDLLVNDINQVVQTDITYFWMKGSFAYMVFIIDVYSRMIVGYHASLNLEAAGNLKALKMMIQLRGAKKLKGLIHHSDKGSQYHFKEYLKELKDHGIKISMCDTAWQNAYTERINRTMKYEYLRHRKIDNIKKLRKCLDADVKAYNTDRPHWSLPQQMSPAAFEEYLKTEKGKMRPEMKIYKSEKNEFFLAMRQSDKKKAAKI

SEQ ID NO: 6389 - DNA, 591 bp, Unknown
  Obtained from environmental sample
  misc_feature (1)..(591): n is a, c, g, or t
atgaaaacaactattgtcctgcttctcatcattttttcaacgaaaggcctttgtcaattaagtagtcctaaaaaggtcttgcttgacatcagtcttaataaaacgattgaacacgaaaatcaaacttatcccacaatttttgagaaaatcacagaaagaagggctgatgatggtacggtattagtgcaacaaacgcctgttatcgataccgtagcagccgacctaatagtaaattatactgcgaaaaatggaacgaatcaaatttatataaggtcgtcaagcgctagcgtaaacggtgacaccttggagatttcattgttcaaccatagtgcatatatttcctgggagtatagaattttgataattaaggatatctatcaaattgagacctggttcaccccacccattaatcacaaaaaaatacaaattctgcctactacaacagtttttaaaattaattcattggacttcagtaaaggacgagaattgaaagggtacacaaaattgcaaggccagtgtcagggtgatgatcaatcatgcttttcacgtgacataataattgaaggaaattttaaagtaaaaattaagtag

SEQ ID NO: 6390 - protein, 196 aa, Unknown
  Obtained from environmental sample
  misc_feature (1)..(196): Xaa is any amino acid
MKTTIVLLLIIFSTKGLCQLSSPKKVLLDISLNKTIEHENQTYPTIFEKITERRADDGTVLVQQTPVIDTVAADLIVNYTAKNGTNQIYIRSSSASVNGDTLEISLFNHSAYISWEYRILIIKDIYQIETWFTPPINHKKIQILPTTTVFKINSLDFSKGRELKGYTKLQGQCQGDDQSCFSRDIIIEGNFKVKIK

SEQ ID NO: 6391 - DNA, 390 bp, Unknown
  Obtained from environmental sample
  misc_feature (1)..(390): n is a, c, g, or t
gtgaaattaggatacccaattaaacattggctgacgtcattaatcattggaccgacaataatgattgtctatgacaccatagaaaattcaaaattgatgaatgacgcagtcggagtatactttttatttgtatcgtttggactactcttctcacttccgacatttatattatatgcattgacatacaatgcaataattaagaccgacaaatcgaatttaacaatcaagacaattttgattgcacttggtattcttggagtagttgtgacattctcattaattaaagggacattgatatttaaagcaacaatcttctattccatcggactattaattgggagtcttttttataacgtaagaccaaaagaaataaaagaacaaacaaattga

SEQ ID NO: 6392 - protein, 129 aa, Unknown
  Obtained from environmental sample
  misc_feature (1)..(129): Xaa is any amino acid
MKLGYPIKHWLTSLIIGPTIMIVYDTIENSKLMNDAVGVYFLFVSFGLLFSLPTFILYALTYNAIIKTDKSNLTIKTILIALGILGVVVTFSLIKGTLIFKATIFYSIGLLIGSLFYNVRPKEIKEQTN

SEQ ID NO: 6393 - DNA, 417 bp, Unknown
  Obtained from environmental sample
  misc_feature (1)..(417): n is a, c, g, or t
ttgataatggaacaatgttattctttttttagtgaaacaaaaaacaaatatgttatagaccacataaactcaaataggctagataataggctgtcaaatttacaagctattacacaaagagctaatttatcaaaagaaagaaccttaaaatctagtcttccgtgtggggtttggcatcaaaaaacaaaaaaagctaatacctacatgcgtgctactattagcattttaaataaaagaacatttttgggcgtatttaaatcaaaagaaacggcttcacaagcctaccaaatagccttatctatacataataaaggtaaatcgctaaacgatgtttacaaagcagtgaacaattttagaatatcaataggattaaagcctactaaaacaaaacacactacatctacgcaaaatatttaa

SEQ ID NO: 6394 - protein, 138 aa, Unknown
  Obtained from environmental sample
  DOMAIN (1)...(49): HNH endonuclease
  misc_feature (1)..(138): Xaa is any amino acid
MIMEQCYSFFSETKNKYVIDHINSNRLDNRLSNLQAITQRANLSKERTLKSSLPCGVWHQKTKKANTYMRATISILNKRTFLGVFKSKETASQAYQIALSIHNKGKSLNDVYKAVNNFRISIGLKPTKTKHTTSTQNI

SEQ ID NO: 6395 - DNA, 723 bp, Unknown
  Obtained from environmental sample
  misc_feature (1)..(723): n is a, c, g, or t
gtggaagccctttactatttctatcgccagaagtttttaaatgaaacgcaaaaagattttgtgaacaatttcacccacgaatttaaaacacctgtttctgttatcaatcttgctgcggaagtactcgcacggcctggtatcattaatcgtcccgaaaaactaagccagtatgctgctattgtacaataccagggaaattacctgcaagaccagatagaaaaattattacactatgcacatgccgaaacccatcttttgcatttgcataaggagcaggtagaacttcattcacttattgaagaagctttgatgaatttgcaacctttaatagttgataaaacagcacagatcaaatgcgaactattggctgaaaattcttttttgtttgccgacaaaggatacattttgattgttataaccaaccttttggaaaatgccttgaaatatgctaaggatccaaaagttatcatcagtactgagaatgaaagttcgtttatcattctatccgtcaaggacaacggcaaaggaatagaaaagaaataccgggcaaggattttcaaaaaattttttcgggtaccaaacggcgaacaaatttctgccagggggtttgggttgggtcttgcttttgtaaaacgcattgttgattcgcatcacggaaaaatatccctggagagcatacccggagtaggcagcgactttaaaattaaaataccactttcatga

SEQ ID NO: 6396 - protein, 240 aa, Unknown
  Obtained from environmental sample
  DOMAIN (16)...(84): His Kinase A (phosphoacceptor) domain
  misc_feature (1)..(240): Xaa is any amino acid
MEALYYFYRQKFLNETQKDFVNNFTHEFKTPVSVINLAAEVLARPGIINRPEKLSQYAAIVQYQGNYLQDQIEKLLHYAHAETHLLHLHKEQVELHSLIEEALMNLQPLIVDKTAQIKCELLAENSFLFADKGYILIVITNLLENALKYAKDPKVIISTENESSFIILSVKDNGKGIEKKYRARIFKKFFRVPNGEQISARGFGLGLAFVKRIVDSHHGKISLESIPGVGSDFKIKIPLS

SEQ ID NO: 6397 - DNA, 579 bp, Unknown
  Obtained from environmental sample
  misc_feature (1)..(579): n is a, c, g, or t
ttggactacctctgcctaaatcacctaagaaaacggaatgtggcttnacgtgggagggagttccagttattcaaggctgcacnccttaaaacaaagtaccaggaattagttatggatatgttcatctttcggtatttctgtttgggaatgaggataaaggatcagctgctacttgaaaagagtcagattgttgatggaaggattagttacgttacgagcaaaacccggaagccatttgaatttaaactcccaaaggaatgcattaggattataaaaaagtaccctaaagggagatatgtatttccgttgatgaaagaattggatggacaagctcaagctgattatataaacgatgtgatcagcaccatgaataaaaccttgaagcgaatagcgaagtatgcaggcatacaaaagaatctgaacacgcactcctcaaggcatacatttgcatttataaatcaggacaagggatcacattttatacaaaaggcattcgaccacgaaaatattaataccacagaagggtatatcgaaagtttagccaatcaggattctttggtaagtcaggttaaaaagtaa

SEQ ID NO: 6398 - protein, 192 aa, Unknown
  Obtained from environmental sample
  DOMAIN (16)...(186): Phage integrase family
  misc_feature (1)..(192): Xaa is any amino acid
MDYLCLNHLRKRNVAXRGREFQLFKAAXLKTKYQELVMDMFIFRYFCLGMRIKDQLLLEKSQIVDGRISYVTSKTRKPFEFKLPKECIRIIKKYPKGRYVFPLMKELDGQAQADYINDVISTMNKTLKRIAKYAGIQKNLNTHSSRHTFAFINQDKGSHFIQKAFDHENINTTEGYIESLANQDSLVSQVKK

SEQ ID NO: 6399 - DNA, 648 bp, Unknown
  Obtained from environmental sample
  misc_feature (1)..(648): n is a, c, g, or t
atgttcaattccttgaagccaactcacttctttatttactttttgtttttgctggcaacttcttgttcaaagaagatcattcctgataaaccttttctttcaaaaacaaatttcaaaatggattctttgcctgagtcggaagtaaacatcccgatccaggtaaacatgaaaccgctttaccagcttgcagaaaaaaaagttgcactggtatatgcttcgcccaaatggccggacgactgggtcacaattgattgtgccaacaggtataaataccagtttgtaagaggaccattgcaatttgctgctgcaggcagctcaatgaatttagggtttactggttattataaaattatcgggtcaacgagagtatgtgttggtaatacggttgtatctccatggacaccagcttgtcgttgcggctttgaagaaggtgaaagaaaagtaaagatcagttttataaatacagttaaagttttaccagactttaaaataaacctgaacataaccaggcaagaaccggtgccgatcgacaaatgcaccgtatgtattttcggcgcagatattacaaaccaggtaatgaaaggcttaaaagatgaacttgatcttgcgaaaaaagcattgaagattcttttggtgttgttgacctga

SEQ ID NO: 6400 - protein, 215 aa, Unknown
  Obtained from environmental sample
  misc_feature (1)..(215): Xaa is any amino acid
MFNSLKPTHFFIYFLFLLATSCSKKIIPDKPFLSKTNFKMDSLPESEVNIPIQVNMKPLYQLAEKKVALVYASPKWPDDWVTIDCANRYKYQFVRGPLQFAAAGSSMNLGFTGYYKIIGSTRVCVGNTVVSPWTPACRCGFEEGERKVKISFINTVKVLPDFKINLNITRQEPVPIDKCTVCIFGADITNQVMKGLKDELDLAKKALKILLVLLT

SEQ ID NO: 6401 - DNA, 843 bp, Unknown
  Obtained from environmental sample
  misc_feature (1)..(843): n is a, c, g, or t
atggacaccagctngtcgttgcggcttgaagaaggtgaaagaaaagtaaagatcagttttataaatacagttaaagttttaccagactttaaaataaacctgaacataaccaggcaagaaccggtgccgatcgacaaatgcaccgtatgtatnttcggcgcagatattacaaaccaggtaatgaaaggcttaaaagatgaacttgatcttgcgaaaaaagcaattgaagattcttttggtgttgttgacctgaagccacaggtgcagcaattatggaacaagttggatgtttcatataatctttatggattgggttggttaaagatcaatccgcaaaagatcaggattaccaggttatttgcatacaatgattcgctgaatatttttcttgggatgacggctaagccagtaataagttttgaaaaaactgctgatataatgacccttgcgcctaacatggataactccgtttcaaaacccggttttaatattttcctcgatgccattttaaattatgattcgttaagcaatattttaaatactcaattgaaaggaaaagaatttgacgtttcaaaaggaaattcgaaaaaagttcttgttatagacgattgcagaatttatggcacggggaatgaaaagctaattatcaaaatggggttttcaggaactaatagcggcatagcttattttacgggcaaacctttttatgatgcaactaaaaaaatgatcgaagtaaaagatattgatttcgatgtaaaaacaaaaagccttttattgaaatcagctgattggctttttaataaacgtantcatcaacgaaattgccagggtgtcaaaatttga

SEQ ID NO: 6402 - protein, 280 aa, Unknown
  Obtained from environmental sample
  misc_feature (1)..(280): Xaa is any amino acid
MDTSXSLRLEEGERKVKISFINTVKVLPDFKINLNITRQEPVPIDKCTVCXFGADITNQVMKGLKDELDLAKKAIEDSFGVVDLKPQVQQLWNKLDVSYNLYGLGWLKINPQKIRITRLFAYNDSLNIFLGMTAKPVISFEKTADIMTLAPNMDNSVSKPGFNIFLDAILNYDSLSNILNTQLKGKEFDVSKGNSKKVLVIDDCRIYGTGNEKLIIKMGFSGTNSGIAYFTGKPFYDATKKMIEVKDIDFDVKTKSLLLKSADWLFNKRXHQRNCQGVKI

SEQ ID NO: 6403 - DNA, 714 bp, Unknown
  Obtained from environmental sample
  misc_feature (1)..(714): n is a, c, g, or t
ttggtcgtcgatgacgaaccagatgttttaatgcttacctgtactgcattggaagatgcaggcttcgatgtaattaaagcaaaagatgtacctacggccagaaaactcctcctttccgaaatcccagatgtgattgtcacagatttgatgatgccggatgaaagcggctattcattgattaaatacattcgcgaaaaatcgggaattaaaaccacacccatcgtagttacttcagtactggattctgaagcagaagttttgcagcaaggcgctgacatatatttgccaaaaccatttacccctgaagaattaattaaaatggttaccgacctggtgaaccgtgaagaagtcccaaaattaatcgaaaaagcgagagatttaatccgcgaaaaaaattatcctgaagcaaaaatagttttaaagcaggtggttgatggcagcgttgatgaaacatatttagcattttcatctttttacttaggagaaatcagccgtcagtcgggcgaaactgaagaggcggaaaatcattacaaacaagcgattcaaaatagcactcaattttggcgcgcatacaacgagcttggaaatatttatcatgggcgagcagatgtgcgaagagcacttgcgtattgggaaaagtcgctattgattaatcctgatcaaaaagaactgaaagaatcagtcaataagttgcaaagagaaattatcagctaa

SEQ ID NO: 6404 - protein, 237 aa, Unknown
  Obtained from environmental sample
  DOMAIN (188)...(221): TPR Domain
  misc_feature (1)..(237): Xaa is any amino acid
MVVDDEPDVLMLTCTALEDAGFDVIKAKDVPTARKLLLSEIPDVIVTDLMMPDESGYSLIKYIREKSGIKTTPIVVTSVLDSEAEVLQQGADIYLPKPFTPEELIKMVTDLVNREEVPKLIEKARDLIREKNYPEAKIVLKQVVDGSVDETYLAFSSFYLGEISRQSGETEEAENHYKQAIQNSTQFWRAYNELGNIYHGRADVRRALAYWEKSLLINPDQKELKESVNKLQREIIS

SEQ ID NO: 6405 - DNA, 507 bp, Unknown
  Obtained from environmental sample
  misc_feature (1)..(507): n is a, c, g, or t
ttgaaaatgagtgaaatggggaattccacttcaagtaatactgattctaaagtaattcaaaatgaaccaaagcaaattattaatgattcaaatattatttatgatgaaaaattgataatgaaaagacataaaccaaattatcttaaagttgaaaaagaagttcaatttggaaagaaaggatcaaatcanaatgaatttgattcaccttatgatgcanaaatagataagaatggtaacctatatgtttgtgaatgttataatcatcgtgttcaagttttcaattctaattcagaaataaaattcnaaagattcattggtactggagaaaaattaatgaatcccatcagtcttgcttttaataaagatggaaatatatttgtatcgaaatcagctcngaatcaaatcgaatttattcattcagaaagaggtttgttgcaatcagtttcttcaaagacagctcctttgaantggccnacttgtatatcagttgatagtaatgatcgataa

SEQ ID NO: 6406 - protein, 168 aa, Unknown
  Obtained from environmental sample
  DOMAIN (66)...(93): NHL repeat
  misc_feature (1)..(168): Xaa is any amino acid
MKMSEMGNSTSSNTDSKVIQNEPKQIINDSNIIYDEKLIMKRHKPNYLKVEKEVQFGKKGSNXNEFDSPYDAXIDKNGNLYVCECYNHRVQVFNSNSEIKFXRFIGTGEKLMNPISLAFNKDGNIFVSKSAXNQIEFIHSERGLLQSVSSKTAPLXWPTCISVDSNDR

SEQ ID NO: 6407 - DNA, 951 bp, Unknown
  Obtained from environmental sample
  misc_feature (1)..(951): n is a, c, g, or t
gtggggnnnnggattatgaattggtcgccatatcatcgaccaaaaagtgttgtccgtagtccgcgttccacagtgggaactttgacagaaatttatgattatctgagaattctatttgccaatatgggcgaaccgcattgtcctttgtgtggagttttgatggcgaaaaaaagcaaccgagaaatattggcagaaattaaaaaatttcccgataaaacaatggtagtgattctggcctcttttaataaaaaagaaaagaatataatagaaaacttaaatcacatcagccaactaggttatgctagggtaaggatgaacgaaaaaattctgacagttaatgaagctttttctttgattaaggaaaatggagatttgtccgatattgatattgttgtcgatagaattgttttggatattaaaaatattgacgaagaaagaatcttagactccatcgaaacagctatgagaatcggtaatggttcagtaaagatagtagtggataataaagagacctattcttacaatagggatttcgtgtgtagtaaatgtgatataaaaatcaaagaaataaccccgcgtcatttttcttttaataatcccgaaggggcttgtcaggaatgttcaggcttgggggtaaaaatgaaaatttcagccgacttagtcattcccaatagaaaattatctatcgcagagggcgctatcaagccctgggggagcgtaggtgggagaaatggcaatagcggacaagggatgcagctacttgaaaaattagcaaaacaatttaaattttctctgcataaccccatgaataaattatctaaagtgaatttggatattattctctacggcgataaagagggcgaagttgatggagtaattggtcaatggaggataaatacagaagtaccaaatctgatcatgccagaagtgaaatcgaaaaatatatggtga

SEQ ID NO: 6408 - protein, 316 aa, Unknown
  Obtained from environmental sample
  misc_feature (1)..(316): Xaa is any amino acid
MGXXIMNWSPYHRPKSVVRSPRSTVGTLTEIYDYLRILFANMGEPHCPLCGVLMAKKSNREILAEIKKFPDKTMVVILASFNKKEKNIIENLNHISQLGYARVRMNEKILTVNEAFSLIKENGDLSDIDIVVDRIVLDIKNIDEERILDSIETAMRIGNGSVKIVVDNKETYSYNRDFVCSKCDIKIKEITPRHFSFNNPEGACQECSGLGVKMKISADLVIPNRKLSIAEGAIKPWGSVGGRNGNSGQGMQLLEKLAKQFKFSLHNPMNKLSKVNLDIILYGDKEGEVDGVIGQWRINTEVPNLIMPEVKSKNIW

SEQ ID NO: 6409 - DNA, 603 bp, Unknown
  Obtained from environmental sample
  misc_feature (1)..(603): n is a, c, g, or t
atgcatgcacatagtgcatatcaatctaaaacgattttgcagcaaatgaaccaaaccattgctttgtttgataagcaaataaaacaaattggaaaagcaattaaagaacatattgcatcaagcccggaagcgaagtcgaaatttgataatgtatgcgcaataaaagggctcgggctcattagcgtcgctacggttgttgcagaaacgaacggttttattttatttgaaaactacaagcagttggtaagttatgccggttatgatgtagttgaaaatcaatcaggaaatcatattggaaaaacacgcatatcgaaaaaaggcaaccctagaatacggcgtattttacacatgcctgcactggtggtcaaaaaatataaggaaccacctttcattaacctttataaccgaacttttgaacgacatggaattaaaatgaaaagctatgtagccatacaaaaaaaactattagtaatgatctattatttatggaagaaaaatgaaaaatacaacccaaattatgatatgaacatccaagaaaaggagctggtgttgccctctctgcttgcctttgaaaaaggcaaaaatgaagtagcctcattataa

SEQ ID NO: 6410 - protein, 200 aa, Unknown
  Obtained from environmental sample
  DOMAIN (24)...(134): Transposase IS116/IS110/IS902 family
  misc_feature (1)..(200): Xaa is any amino acid
MHAHSAYQSKTILQQMNQTIALFDKQIKQIGKAIKEHIASSPEAKSKFDNVCAIKGLGLISVATVVAETNGFILFENYKQLVSYAGYDVVENQSGNHIGKTRISKKGNPRIRRILHMPALVVKKYKEPPFINLYNRTFERHGIKMKSYVAIQKKLLVMIYYLWKKNEKYNPNYDMNIQEKELVLPSLLAFEKGKNEVASL

SEQ ID NO: 6411 - DNA, 432 bp, Unknown
  Obtained from environmental sample
  misc_feature (1)..(432): n is a, c, g, or t
atggctcaaaaaatccttattgtccaaaccgcgttcctcggagatgccctcctcgccatccccctcgtccgccgtgtaagaaagctttatcccagccatgaactccatttgttgtgtcgccaaggttttggcgagattttcgaaaaattaaaacttgtagataaagcatgggaaataaataagaaaaacgaagaanatcgtgattctgttttcagtgatataaagaaaatagaatttgaatatatattttccccgcatgaatccatccgcactgccattctggttttccaaatgagtccaaaaacaaaattgggtttaaaaatggtgggacttttttgcatttacaaaaaccgtggaaaaaacaaaaaatttccgatgctcttcgacgctttctattttggaccggntgatccagacttcctgaaaaactaa

SEQ ID NO: 6412 - protein, 143 aa, Unknown
  Obtained from environmental sample
  misc_feature (1)..(143): Xaa is any amino acid
MAQKILIVQTAFLGDALLAIPLVRRVRKLYPSHELHLLCRQGFGEIFEKLKLVDKAWEINKKNEEXRDSVFSDIKKIEFEYIFSPHESIRTAILVFQMSPKTKLGLKMVGLFCIYKNRGKNKKFPMLFDAFYFGPXDPDFLKN

SEQ ID NO: 6413 - DNA, 579 bp, Unknown
  Obtained from environmental sample
  misc_feature (1)..(579): n is a, c, g, or t
gtgagatttttcttggtggcattattcttggttccgaacgtctcttgtacgactatgatgctcgaaaaagcgcagaaagagcgggaagctaggatttatgaacctgttggtgctaaagcccatttctatgaagataattttatcaaggtgagctacttaccatcaacgatcgattcgggtgttggctttcagtttgaaaataagagcaacaagcctttaagaatcgtctgggatgaatctacttttattgattttaatggagaatctcagcgaattattcatacgggagtgagattagtggaacgaaatcagtctcagcccccttcagtaattccgccactagctaagctgactgacgaaattaccccgacgaatagaatcgacttcacttcgggccaatatggaggttgggtctattctccgatttgtggcaagagggacgtatggacacaggagatgaaggacaaggattgcgtcggaaaaacatttggatacttcattacctatgaggtggacggcaagcaaaagaacttttctgtaaaatacaaactgacctcgataaagaagacccggcgatga

SEQ ID NO: 6414 - protein, 192 aa, Unknown
  Obtained from environmental sample
  misc_feature (1)..(192): Xaa is any amino acid
MRFFLVALFLVPNVSCTTMMLEKAQKEREARIYEPVGAKAHFYEDNFIKVSYLPSTIDSGVGFQFENKSNKPLRIVWDESTFIDFNGESQRIIHTGVRLVERNQSQPPSVIPPLAKLTDEITPTNRIDFTSGQYGGWVYSPICGKRDVWTQEMKDKDCVGKTFGYFITYEVDGKQKNFSVKYKLTSIKKTRR

SEQ ID NO: 6415 - DNA, 468 bp, Unknown; identical to SEQ ID NO: 3925
  Obtained from environmental sample
  misc_feature (1)..(468): n is a, c, g, or t

SEQ ID NO: 6416 - protein, 155 aa, Unknown; identical to SEQ ID NO: 3926
  Obtained from environmental sample
  misc_feature (1)..(155): Xaa is any amino acid

SEQ ID NO: 6417 - DNA, 1062 bp, Unknown
  Obtained from environmental sample
  misc_feature (1)..(1062): n is a, c, g, or t
gtggctctggaaaaagcagagcatgacgtaaataaatattttgaaaaaatgaactcttcaacaaggttcaatcttgttatggcaaattcaaaatcaagtccagaagattctctcgaggcaataaaacaattacattccattggagctaaaattattgttgggccagctacaagcactgcagttttaggtgcgaaagaatacgcagatactaatgacattatactaatcagttactctagtacttctccattactttctataccaggagataatcttttccgattggtaccagatgataccaatcaaggaaaggttattgcaaagcgaatgattgatgatggaataaaagtaattgtaccactgtggagaggcgacatctatggaaatgaactttacaaatcgacaaaatatcaatttgaaaaactaggtggaaaaattgaagaagggataaactataaaccacatacaggtaaatttgctacaagtttacatagaattaatttcattatgtggaatgaagatctagaaagattaaacagtattgtagataaggcaataaaaaaatatggcactaaatctgtaggagtttttctaatatcttacgatgaagtaacacctatcttaattcaatcttctatgtatcattcgcttggtaacatcagatggtatggcagtgatagtattgctcagaatcatcacattacaaagaatatagattctgcactatttgcaattaanaccaatttttcaaatcctttatactccatagatacaaaatcacctaaaattcatgagctaatcgcaatattagaaaggcagttacacgatggaggttccataacctatccctgcatagcttacgattctttttggatttctcctttaagctgtatgcaaatagtaccaataattatcttgttgatcataaaaatagtagtaagaactctttcaaaacatggtttcaaaaacacagaatcttttgataacggtatttcaggcaaaaatacacttaatgatgcaagggatcggattggtgaaaatatgatttctggcatattctaa

SEQ ID NO: 6418 - protein, 353 aa, Unknown
  Obtained from environmental sample
  DOMAIN (1)...(350): Receptor family ligand binding region
  misc_feature (1)..(353): Xaa is any amino acid
MALEKAEHDVNKYFEKMNSSTRFNLVMANSKSSPEDSLEAIKQLHSIGAKIIVGPATSTAVLGAKEYADTNDIILISYSSTSPLLSIPGDNLFRLVPDDTNQGKVIAKRMIDDGIKVIVPLWRGDIYGNELYKSTKYQFEKLGGKIEEGINYKPHTGKFATSLHRINFIMWNEDLERLNSIVDKAIKKYGTKSVGVFLISYDEVTPILIQSSMYHSLGNIRWYGSDSIAQNHHITKNIDSALFAIXTNFSNPLYSIDTKSPKIHELIAILERQLHDGGSITYPCIAYDSFWISPLSCMQIVPIIILLIIKIVVRTLSKHGFKNTESFDNGISGKNTLNDARDRIGENMISGIF

SEQ ID NO: 6419 - DNA, 537 bp, Unknown
  Obtained from environmental sample
  misc_feature (1)..(537): n is a, c, g, or t
atgcttttagcgggtgacgaatgcagccgtacacaaaagggaaataataatgcctactgccaggataatgaaatttcatggtttgattggaataatattgacaatgatcttcgtgagtttacaaaaaaactgatcgaaattagaaaaaagttcaaagtcttaagcaggagaaaatggttccaggggcatttaattaagggtgttaaagaagaagatataaaatggttcttaccatcaggcgatgaaatcaaagatgatgcatgggaaaatcttagaacgaaaactttcggtgtatttctaaacagcaaagctcataaagaaaatgggcatgatgaaataagctacagcctttacatgatatttaattcttctcacgatgaagtggaatgcattttacctgaagccaattattcgaatacctggtttaatattctgaatacagaaatcaatcaggatgaatttgaacctcttcccagtcacgcttctgttaagatagcatcccgtagtattctactttttacgactacatcatcatga

SEQ ID NO: 6420 - protein, 178 aa, Unknown
  Obtained from environmental sample
  misc_feature (1)..(178): Xaa is any amino acid
MLLAGDECSRTQKGNNNAYCQDNEISWFDWNNIDNDLREFTKKLIEIRKKFKVLSRRKWFQGHLIKGVKEEDIKWFLPSGDEIKDDAWENLRTKTFGVFLNSKAHKENGHDEISYSLYMIFNSSHDEVECILPEANYSNTWFNILNTEINQDEFEPLPSHASVKIASRSILLFTTTSS

SEQ ID NO: 6421 - DNA, 417 bp, Unknown
  Obtained from environmental sample
  misc_feature (1)..(417): n is a, c, g, or t
ttgctcatgaatatacccatggagtccctccataacgaatctattcttttctattattacacatcggggcgaataaagaattcgctctcaaacctttggggtggaaatttttcaacaaacgaaatgtggggggccaataattacataggagtaccaatggccccccgggaaagaatccaacacatcccggaactgttccccgaatataaaacaccacaaccggatggggaatctcgaaaaaatgtccaagccttcattatcaagggggtgaactcaaaggcggggttcccacacaaagggggacaaaaaaaatttttttcgcgccccaaggaggatctcaggaaaatattctccctcgtggaaaaatgtttcattttaaacacccgatttttttccgggcgatatataattttttct

SEQ ID NO: 6422 - protein, 139 aa, Unknown
  Obtained from environmental sample
  misc_feature (1)..(139): Xaa is any amino acid
MLMNIPMESLHNESILFYYYTSGRIKNSLSNLWGGNFSTNEMWGANNYIGVPMAPRERIQHIPELFPEYKTPQPDGESRKNVQAFIIKGVNSKAGFPHKGGQKKFFSRPKEDLRKIFSLVEKCFILNTRFFSGRYIIFS

SEQ ID NO: 6423 - DNA, 600 bp, Unknown; identical to SEQ ID NO: 4887
  Obtained from environmental sample
  misc_feature (1)..(600): n is a, c, g, or t

SEQ ID NO: 6424 - protein, 199 aa, Unknown; identical to SEQ ID NO: 4888
  Obtained from environmental sample
  misc_feature (1)..(199): Xaa is any amino acid

SEQ ID NO: 6425 - DNA, 372 bp, Unknown; identical to SEQ ID NO: 2987
  Obtained from environmental sample
  misc_feature (1)..(372): n is a, c, g, or t

SEQ ID NO: 6426 - protein, 123 aa, Unknown; identical to SEQ ID NO: 2988
  Obtained from environmental sample
  misc_feature (1)..(123): Xaa is any amino acid

SEQ ID NO: 6427 - DNA, 486 bp, Unknown
  Obtained from environmental sample
  misc_feature (1)..(486): n is a, c, g, or t
ttggaaatcgcaaagttgatttgtggagacgaaagcagctttccatatagaacttcattctttataacaaaattttttaaggatttagggctcccttatgctcatgatggatcaacgcgtagattttggataagggatactttgttattattaaacattcacgagttttcaatgataataagaaaaggtctgtttaacaaaagagattttcgaaaatatgccaaggataaaaatttgaactttgagcaagaatatcagaatgcaatcaatgaatttaagcaaattcttaatgaaagcatgcaaattaatgatggaatagatttgacatacctcttggatttaaacattaatgttgaattgctcttcgacaggaaaactaaaactgatgacgaggaacttgacaaattaattaatgaggcaaaagatcgcttctttcttcctaaagacaaacaaattgctttagaaaaacntgtgggatgcatttga

SEQ ID NO: 6428 - protein, 161 aa, Unknown
  Obtained from environmental sample
  misc_feature (1)..(161): Xaa is any amino acid
MEIAKLICGDESSFPYRTSFFITKFFKDLGLPYAHDGSTRRFWIRDTLLLLNIHEFSMIIRKGLFNKRDFRKYAKDKNLNFEQEYQNAINEFKQILNESMQINDGIDLTYLLDLNINVELLFDRKTKTDDEELDKLINEAKDRFFLPKDKQIALEKXVGCI

SEQ ID NO: 6429 - DNA, 486 bp, Unknown
  Obtained from environmental sample
  misc_feature (1)..(486): n is a, c, g, or t
gtgcgtatcataagtgggaaatataaaggccgtcaaataaagccaccgggcaatttgccggttcgtcctactaccgattttgcaaaaaccgggttatttaatttactcgaaaccaggtacgatcttcaaaactttaattgcctcgatttattttctggcacagggggcattagtcttgaactgatttcaagaggttgcaaacacgtaacagctgtcgaccgcgatcaaaaatgtactgaatttcttaaaagtgtttcagcaaaactgggtatatcaaatatcaccgtgttcagaagggatgttaacttaattctaaaaaaattaaatctaaaatatgacctcatttttgcagatccgccatttgacatgaaaattcatgaagacctgcacgatttggtatttggtcaaaacctgctgctgccttcaggtgtttttatcatggaacacgcttcaccggattcatatgttcaacctcnccggttttga

SEQ ID NO: 6430 - protein, 161 aa, Unknown
  Obtained from environmental sample
  DOMAIN (1)...(160): Conserved hypothetical protein 95
  misc_feature (1)..(161): Xaa is any amino acid
MRIISGKYKGRQIKPPGNLPVRPTTDFAKTGLFNLLETRYDLQNFNCLDLFSGTGGISLELISRGCKHVTAVDRDQKCTEFLKSVSAKLGISNITVFRRDVNLILKKLNLKYDLIFADPPFDMKIHEDLHDLVFGQNLLLPSGVFIMEHASPDSYVQPXRF

SEQ ID NO: 6431 - DNA, 540 bp, Unknown
  Obtained from environmental sample
  misc_feature (1)..(540): n is a, c, g, or t
ttggaatctcttcaaaaaaaattacacaccctctcctctgctttttttaattctttaaataattccgaaaaaaataataaacggcgtttagtgaggaaaatagaattattggaaatggggggggaagaaaaaaaattattattctactcccctctttctccggattttgatattttaaaaatcggcttaactgctccccgatctcttttgaatgaattgatagatatacgagttgttaaaagggtcgatcaaggaatgatttctgaagcggaaaatttatatgaaaatggcttatctctgggtcggatgaaagagctgggactcgaatatagattgctagctgatctaatatcaggaaagattaattttgaggaatttactaaaatattaaaaataaaaattcaccaatatgccaaacgtcagatgacttggtttaaaagagatcagagtatttattggtttgatatatcaactaatagttgggagaaagagctagtaactttagcttcaaattggtacaatagtatgagtgatgagtga

SEQ ID NO: 6432 - protein, 179 aa, Unknown
  Obtained from environmental sample
  DOMAIN (1)...(157): IPP transferase
  misc_feature (1)..(179): Xaa is any amino acid
MESLQKKLHTLSSAFFNSLNNSEKNNKRRLVRKIELLEMGGEEKKLLFYSPLSPDFDILKIGLTAPRSLLNELIDIRVVKRVDQGMISEAENLYENGLSLGRMKELGLEYRLLADLISGKINFEEFTKILKIKIHQYAKRQMTWFKRDQSIYWFDISTNSWEKELVTLASNWYNSMSDE

SEQ ID NO: 6433 - DNA, 594 bp, Unknown
  Obtained from environmental sample
  misc_feature (1)..(594): n is a, c, g, or t
atgggcccgcctccggggacgaatgttgaaaagttaaaactttttttcggtttgggtcaagagctcccgatggtggattggctgttgccctgggttttcgaaaaagaccctttnccaaatgtagaagcaaaagatgaccgggtgctcagggtatattcacagcatatctncaggaaaatgacacagtgtgcaggatggtctacagagtctaaaaacgcgatcgaggagattctgtcagtcatgaaagccacttctcatgagatcagccagatgaagtccaatatcctcaatgatctccagaagtaccatcgcgccggctggctcatgatccgcgattatcattttgactttgtattcaaagtgattaaagaaaatatcctgcgtggccgttcggaaggattataccgtgaagattttgatgtggataccattgcaaagcttcacctctcgacaggattcagtttgtttgatgaacaactttntccgtcagattccatccccaagagtgtcattttcaatgaatatatcatgcatttcctacatggcattgtctcccctaaaggactcagttatttaaaaaagaaactttcctga

SEQ ID NO: 6434 - protein, 197 aa, Unknown
  Obtained from environmental sample
  misc_feature (1)..(197): Xaa is any amino acid
MGPPPGTNVEKLKLFFGLGQELPMVDWLLPWVFEKDPXPNVEAKDDRVLRVYSQHIXRKMTQCAGWSTESKNAIEEILSVMKATSHEISQMKSNILNDLQKYHRAGWLMIRDYHFDFVFKVIKENILRGRSEGLYREDFDVDTIAKLHLSTGFSLFDEQLXPSDSIPKSVIFNEYIMHFLHGIVSPKGLSYLKKKLS

SEQ ID NO: 6435 - DNA, 462 bp, Unknown
  Obtained from environmental sample
  misc_feature (1)..(462): n is a, c, g, or t
atggcctcattatttgaggcgtttgtaagaaatttttataaaaaggagcaatcagcgttaaaagtacggcgtgaagctatttattgggacttgactcccatagacgatagtaatatctcctatctaccagaaatgcataccgatattacattggaatcaccggaccgaaaaataattatagacacgaaatattatactaacacgctctctaaaaattatgattcacttaagtttcattcagaaaatatgtatcaattatattcatatttaaaaaacaatgaacttaatccgaagcatccaaagaattcatgtgcagagggcattcttttgtatccttcagtagagtataacttaagagagtcatttcaaatgggctcgcataagcttaccatttgcacagttgatttaaatagtgattggaaaataattagtaaatcgcttaaggaattaatttctaaataa

SEQ ID NO: 6436 - protein, 153 aa, Unknown
  Obtained from environmental sample
  misc_feature (1)..(153): Xaa is any amino acid
MASLFEAFVRNFYKKEQSALKVRREAIYWDLTPIDDSNISYLPEMHTDITLESPDRKIIIDTKYYTNTLSKNYDSLKFHSENMYQLYSYLKNNELNPKHPKNSCAEGILLYPSVEYNLRESFQMGSHKLTICTVDLNSDWKIISKSLKELISK

SEQ ID NO: 6437 - DNA, 747 bp, Unknown
  Obtained from environmental sample
  misc_feature (1)..(747): n is a, c, g, or t
gtgtccggagatttcgacaacttaaaattactccaacgattcgccaaaacttcttcaactcttgataaaaaagacaaattaactgaagaagtactcactgaagagttatctaaacttgacctaagcgatgttcaattacgacaagttaagagcattttcttagagaacgaatcaatcgatgaaattagtgaattaattggatcagacaaaacctcaaatttaattgagctaatcgaccgagccaagaatttagatttatcggtcagttttgttccgtatatggtacgaggacttgattattacactggtacgattatcgaatgccggattgacggctatccgtccagcgtcgctggtggtggtcgttacgataatttggtcgagagtttaattggccaaaagatcccagcttttgggctgtcatttggcgtcgatcgattagtggatgttctcgatgaagacaaaggattatctgagacaacaatatttatcgccagactgccggaaaccacggaggcacttaacccttgggttcgagaacttagaaattcaggtaaaaatgttgaagtatatttagacgaaacggtggaattaggcaaacaaataaaatacgccgacaaacgagggtttgttgaaatgttaattccgctggaagccgattggaaagagggtaaaatcgtcgtcaagaaccttgaaagtggcgatcaaaaatcagttgatcgaaagagtcttactgatgccaaataa

SEQ ID NO: 6438 - protein, 248 aa, Unknown
  Obtained from environmental sample
  misc_feature (1)..(248): Xaa is any amino acid
MSGDFDNLKLLQRFAKTSSTLDKKDKLTEEVLTEELSKLDLSDVQLRQVKSIFLENESIDEISELIGSDKTSNLIELIDRAKNLDLSVSFVPYMVRGLDYYTGTIIECRIDGYPSSVAGGGRYDNLVESLIGQKIPAFGLSFGVDRLVDVLDEDKGLSETTIFIARLPETTEALNPWVRELRNSGKNVEVYLDETVELGKQIKYADKRGFVEMLIPLEADWKEGKIVVKNLESGDQKSVDRKSLTDAK

SEQ ID NO: 6439 - DNA, 351 bp, Unknown
  Obtained from environmental sample
  misc_feature (1)..(351): n is a, c, g, or t
ttgaaagtggcgatcaaaaatcagttgatcgaaagagtcttactgatgccaaataattttcccgctaagaagcacccaagcctctttgcacttgaggaatcaatcctcgaatattggcaaaaagaaaaaatctttgaaaaatctttagaacaaaataaaaaccatgaaagttattcgttttacgacgggacgccgtttataacggggcatccgcactacgcaactttattacnaagtatcgccaaagatgtaatcccacgattccaaaccatgaaaggcaaatatgtccgccggacttggggttgggatgttcacgggctgccagcccgaactcaagttgaaaaaaagtag

SEQ ID NO: 6440 - protein, 116 aa, Unknown
  Obtained from environmental sample
  misc_feature (1)..(116): Xaa is any amino acid
MKVAIKNQLIERVLLMPNNFPAKKHPSLFALEESILEYWQKEKIFEKSLEQNKNHESYSFYDGTPFITGHPHYATLLXSIAKDVIPRFQTMKGKYVRRTWGWDVHGLPARTQVEKK

SEQ ID NO: 6441 - DNA, 417 bp, Unknown
  Obtained from environmental sample
  misc_feature (1)..(417): n is a, c, g, or t
atggcaaaaacaagtaaactttctaatgtagtacaggtagaagattatattaaaaatcttgatcatcccctgcgcgatgttgtagcttcattgcggaaaataattttaagcatcgataaaaaaatcgccgaacaaataaaatggaactctcccgctttttactatacaggcgaaatgaaggcttttgatccaaaagaatataaaagagatatcgtagtttttaaccttcacaaaaaagatcttgtactgcttatttttccaacaggtgcgagaatcaatgatcaatcggcccttctggcaggcaaattcacagatgggaggaagacagccagcttcaaatcgctggaagatgtaaaaaagaaagaaaaagaccttcggaatgttataaaaacctggttacaatcagttgataaatga

SEQ ID NO: 6442 - protein, 138 aa, Unknown
  Obtained from environmental sample
  misc_feature (1)..(138): Xaa is any amino acid
MAKTSKLSNVVQVEDYIKNLDHPLRDVVASLRKIILSIDKKIAEQIKWNSPAFYYTGEMKAFDPKEYKRDIVVFNLHKKDLVLLIFPTGARINDQSALLAGKFTDGRKTASFKSLEDVKKKEKDLRNVIKTWLQSVDK

SEQ ID NO: 6443 - DNA, 645 bp, Unknown
  Obtained from environmental sample
  misc_feature (1)..(645): n is a, c, g, or t
atgnaagagatcgatttcgaatacttacaggggaaagcacggatgatcttgcgcgacgcgaaaaaggaacgggatgtaaaagcgaacgttaggatcagaaaagacagcgttatttggatgactttctcagtaatcggcgttcagggaggtaaagcgcttattaacaaggattcgattacgatcgtcagcaacgtcgacaaagaatattatgttttcgactacgctgaactttcaaagcgttataatttcgacattaatttcaacgttatccaatcggccatgctgggcaatctcatttctccacgcgaaacgggagatgaggtcgctcaggagacttcgtattttttgctaaaacaaaataagggaaccattaacgtagcgaactacatcaactccgcaagtatgaaaatagaaaaggttgagatgaaagagggtaataccagcaattccttggtaattaactacgccaacttccaacctttaagcaacaaattatttccatacaacggaacaatcagcttgttctataaaactctatcgggagtattaaacacaaccattattttcgaatataataaggctgaggtaggtgataaagagcttaagtttccttttaatattcctaaacgatatgtgcgcaggtag

SEQ ID NO: 6444 - protein, 214 aa, Unknown
  Obtained from environmental sample
  misc_feature (1)..(214): Xaa is any amino acid
MXEIDFEYLQGKARMILRDAKKERDVKANVRIRKDSVIWMTFSVIGVQGGKALINKDSITIVSNVDKEYYVFDYAELSKRYNFDINFNVIQSAMLGNLISPRETGDEVAQETSYFLLKQNKGTINVANYINSASMKIEKVEMKEGNTSNSLVINYANFQPLSNKLFPYNGTISLFYKTLSGVLNTTIIFEYNKAEVGDKELKFPFNIPKRYVRR

SEQ ID NO: 6445 - DNA, 708 bp, Unknown
  Obtained from environmental sample
  misc_feature (1)..(708): n is a, c, g, or t
ttgggattgtatttttgctggtgtggtcagtgcgcaaaattacgaacaatgcagtgtaccggtaggatagtaaatgacttgaagtcgccgatgccgaacgcctatcttcattgggaccccggctatggcgaggggatagattatattactatttccggcgctacagacgagcagggcagattcaaataccaggaagtctgcccgatcggtaatttaaaattgttcgttacttcaagtctgtccgcgaatgtttacgcgccgttgctgccccctttcgcttacggcagtaaactttaccgacaaattaagccgctgtcgatcgtgaaaaatgagaaaagtgatttaaatttgggtgacgtgccggtgcaaatctattactcggctgtcggcataagctttctcaatgaggcgggagcgcccttaatgacaactaaagatggatgggatcaggtaagactccgcatccgtgacaaaaaccggaaaattatgtcggaaaacacgctgacgtccgattgggtagaaaaagccgttcgcttgcagagttcatcgatcgcgatgcagttgccggtcggtgaatggagcatcgaactcgctctagatccgaaaaaagataaatggcttaaacctgacaaatcactaataattcaaagatcggaaagcgggatggaaattactttacggatgtcttcaaatacagcagcgaaataa

SEQ ID NO: 6446 - protein, 235 aa, Unknown
  Obtained from environmental sample
  misc_feature (1)..(235): Xaa is any amino acid
MGLYFCWCGQCAKLRTMQCTGRIVNDLKSPMPNAYLHWDPGYGEGIDYITISGATDEQGRFKYQEVCPIGNLKLFVTSSLSANVYAPLLPPFAYGSKLYRQIKPLSIVKNEKSDLNLGDVPVQIYYSAVGISFLNEAGAPLMTTKDGWDQVRLRIRDKNRKIMSENTLTSDWVEKAVRLQSSSIAMQLPVGEWSIELALDPKKDKWLKPDKSLIIQRSESGMEITLRMSSNTAAK

SEQ ID NO: 6447 - DNA, 921 bp, Unknown
  Obtained from environmental sample
  misc_feature (1)..(921): n is a, c, g, or t
ttggatgttaatagtgctaaaaaaatggatggactcaacaaaattaaactacaagccaggccggttatattccccgataagccagtaagtatcactgtagctgaaatgccaaaaacgcttgtgcttatcccggatcttaatatccccgggggggtatctaattattacaggactttgcagttgaattcaaatggtaacatcgactattttaccattaataccaacaaagcccaatccaatatagcggcaatcattcggctggcaggtaaatattgcaggttcttcttcaggttgatcaggggcaattatgaaacagttgtgactaatccttctctggattatggtaagtcttttcacagggatatgatttttatcctgattacccatttgcttggcaggaaatcggtagtatttttcagaggatggttcgatccctatgaacaaaagatcaaacagagcaaatggaaaacatttctcttcaacatcagttatgcaaaagcttcaaaatacatagtactcggtaatattttcaagcagaaacttttagggttaggcgtgccgtctacaactgagttttttattgaaaccacggtggcggattcaagttttctaccagaattagacctacataaaaagcaagcttcgtatgaagaggaattaaacatcctgtttttatcaagaatagaaaaagaaaaagggatactgattgctttggatgcatttcaacagtttaccgaaaattttccgcagcgaaaatcaacctttacgattgcaggagatgggattgacctgcccatggtaaaagcttatgtggcagataaacagatagaaaatgtaaagtntcctgggtcatgtgaatgctgtagagaagaagaaagtgttactggaagctcatgttatgatttttccgagntttactga

SEQ ID NO: 6448 - protein, 306 aa, Unknown
  Obtained from environmental sample
  misc_feature (1)..(306): Xaa is any amino acid
MDVNSAKKMDGLNKIKLQARPVIFPDKPVSITVAEMPKTLVLIPDLNIPGGVSNYYRTLQLNSNGNIDYFTINTNKAQSNIAAIIRLAGKYCRFFFRLIRGNYETVVTNPSLDYGKSFHRDMIFILITHLLGRKSVVFFRGWFDPYEQKIKQSKWKTFLFNISYAKASKYIVLGNIFKQKLLGLGVPSTTEFFIETTVADSSFLPELDLHKKQASYEEELNILFLSRIEKEKGILIALDAFQQFTENFPQRKSTFTIAGDGIDLPMVKAYVADKQIENVKXPGSCECCREEESVTGSSCYDFSEXY

SEQ ID NO: 6449 - DNA, 657 bp, Unknown
  Obtained from environmental sample
  misc_feature (1)..(657): n is a, c, g, or t
atgnatagttttcaatatacagttcatcagaaagggagtgtggaaaattctcacgcaagcagtcagatattaacctggactgttcatctaaagaatagaatgtatcaaacttgttggagctgggttcagttgaactatttgttcaataaagagataccagatgaggagtggcatatttcacccggtcgcaatggtgaatcggttgagtttttacctaatttcgagaaaagacattatcttatcaaggctcaatttaattactttgctgatatcttttattataaactcttttcagcttgggataatttaggacatattctcaataatatgtatgaactaaaaattgaaagagctaatttttatgaagctgttaaaacattgaaagacgtaaaatcagacttacacgataatctcaataatttaatagaatcagatgactttaagaaaatgcgtaaatacagacatagctcaacccataatgagttaataggacttatcaattccggttttacaaaagtttctgagaatcattatacagcgggttttcaagaatatgtaacatcttcgcaaattaaagataatgccgataaatccttaaatttaattactcaagcaattaaatttattaaagagcaagttcaaagtgatatgacataa

SEQ ID NO: 6450 - protein, 218 aa, Unknown
  Obtained from environmental sample
  misc_feature (1)..(218): Xaa is any amino acid
MXSFQYTVHQKGSVENSHASSQILTWTVHLKNRMYQTCWSWVQLNYLFNKEIPDEEWHISPGRNGESVEFLPNFEKRHYLIKAQFNYFADIFYYKLFSAWDNLGHILNNMYELKIERANFYEAVKTLKDVKSDLHDNLNNLIESDDFKKMRKYRHSSTHNELIGLINSGFTKVSENHYTAGFQEYVTSSQIKDNADKSLNLITQAIKFIKEQVQSDMT

SEQ ID NO: 6451 - DNA, 630 bp, Unknown
  Obtained from environmental sample
  misc_feature (1)..(630): n is a, c, g, or t
atgaaagagcctgaaatattcaggctcttttttttaaatttaagtgcatccgctatccaaatgaaaaacatttttttgctttcgctgctggccttgtgcgttggctgttcgaagaattcgtacgatccggaaacctatctccccaaacccgatcagcaacgctttcttttaagcatcgtacgttattccgataaacttcctccacgttcctcgcatgcaaccaaatttgatcatcagtttgatgaatactaccaggaagttgcgaagagctataacattaaatcttattatataagcgacgatcaaactcactttgtgttggtgacgcgtccggcccgaagtattacgccaatgcgagaggctatcggtattaaaatcaaatatgattcaaaaaaagaaattgctttgtatgaggaaattttccggacgtggaagatgcccgaagaaaagctaaacgaacgatatcccatactttttgaaaaaatgattgccggagaaagtcttgaagagttctattcaaaaaacgcaggtgaccagtatatagaatttcccgacgatcgtttttatttcgataaaacggaacgaaagtggcgtgacaaaatcttcgactcgcttaaagtagagaactaa

SEQ ID NO: 6452 - protein, 209 aa, Unknown
  Obtained from environmental sample
  misc_feature (1)..(209): Xaa is any amino acid
MKEPEIFRLFFLNLSASAIQMKNIFLLSLLALCVGCSKNSYDPETYLPKPDQQRFLLSIVRYSDKLPPRSSHATKFDHQFDEYYQEVAKSYNIKSYYISDDQTHFVLVTRPARSITPMREAIGIKIKYDSKKEIALYEEIFRTWKMPEEKLNERYPILFEKMIAGESLEEFYSKNAGDQYIEFPDDRFYFDKTERKWRDKIFDSLKVEN

SEQ ID NO: 6453 - DNA, 783 bp, Unknown
  Obtained from environmental sample
  misc_feature (1)..(783): n is a, c, g, or t
atgctgtcctttggtaaactttattgtatcattgtaattattctgcattccatctttgggaatgccatagttcttttctttacaatatataaagaaacactttatttgcaaataataccatcattcatggctacaactcctgctcaaaaatttaaaataaaagaaggctttaccctgcgcaccatcaatgcaccggctgattttgcaaaacaactcggcgccctgcccaatgaggtaaccattaccaccagcggaaagaattttcagcagcttcactggtttgtgctcaacaaagcccagctcgataaagaacttcccaaagtaatgcccctcgtaaaaggcgacgtgctatgctggtgttattaccccaaaggcacgagcagtctgcaaaccgatcttacccgcgacaaaggctgggacaatctgttgcagcgcgaagagtttcattggatcagtcttatttcctttaacgatacctggtcggcttttgcattccgtcagaaaacggaagccgatgcaaacaaagaaaccaaaccgaaagaacggcccatcctcgattatatagatgccaaacaaaagatcgttcgcctgcccgattacctgaaagctgtgcttacaaaaaataaaaaggccaataccttttttgagtcgctttcgttcaccaacaaaaaggaatatgtggaatgggtggtgaccgccaaacgggatgaaacccgtaaacaaagggtggccgatacgctcgaccggttattgaaaggctggaagaatccgcggaatatataa

SEQ ID NO: 6454 - protein, 260 aa, Unknown
  Obtained from environmental sample
  misc_feature (1)..(260): Xaa is any amino acid
MLSFGKLYCIIVIILHSIFGNAIVLFFTIYKETLYLQIIPSFMATTPAQKFKIKEGFTLRTINAPADFAKQLGALPNEVTITTSGKNFQQLHWFVLNKAQLDKELPKVMPLVKGDVLCWCYYPKGTSSLQTDLTRDKGWDNLLQREEFHWISLISFNDTWSAFAFRQKTEADANKETKPKERPILDYIDAKQKIVRLPDYLKAVLTKNKKANTFFESLSFTNKKEYVEWVVTAKRDETRKQRVADTLDRLLKGWKNPRNI

SEQ ID NO: 6455 - DNA, 591 bp, Unknown
  Obtained from environmental sample
  misc_feature (1)..(591): n is a, c, g, or t
atgacaaaggccgaagcaacgagattgagcattttacaaaagtcgtttgaactgatctatgtaaaaggatatcaaacaaccagcatagatgatattctggcaaccacccaggttacaaaaggcgccttctattaccattttaaaaataaagatgaaatgggtttggccatcatagatgaattgctgaaaccctcttttgctgcttcctttatgaaaccgcttcaatcgggcaccgacccggttaaagtcatttacgacatgatgcacggtatactgatgaagaatgattttatgaaagtagagcacggttgcccggcagccaatcttacactggaaatggcgccctggcacaatgactttaccaaagcgctgaacgatctctctgaagaatggaagaatgccattgaacaatgcattaagaatggaaagaaaagtggcaacatcagggccgatgtaaaacctgaacaggtagctgtttttattatgagcggctactggggcatcaggaacatgggcaaactcaccaacagtaaaactgtttatctcatctacttaaagcaactgaaagactacctcccatcgcttcattaa

SEQ ID NO: 6456 - protein, 196 aa, Unknown
  Obtained from environmental sample
  DOMAIN (11)...(57): Bacterial regulatory proteins, tetR family
  misc_feature (1)..(196): Xaa is any amino acid
MTKAEATRLSILQKSFELIYVKGYQTTSIDDILATTQVTKGAFYYHFKNKDEMGLAIIDELLKPSFAASFMKPLQSGTDPVKVIYDMMHGILMKNDFMKVEHGCPAANLTLEMAPWHNDFTKALNDLSEEWKNAIEQCIKNGKKSGNIRADVKPEQVAVFIMSGYWGIRNMGKLTNSKTVYLIYLKQLKDYLPSLH

SEQ ID NO: 6457 - DNA, 723 bp, Unknown
  Obtained from environmental sample
  misc_feature (1)..(723): n is a, c, g, or t
ttgaaattngagcgtttgaaaaaaatctttaagaaagaaaagatagaagttaaaagcgaaggttatcttaacaatcttgagctgcgctttcccaatgaaccggcgcgtcataaattactggatgtcgtcggagatcttgcattggttggctacccgatcaaagccaagatcattgcaaacagacccggtcatagcagcaacgtggagtttgcaaaaaaaataaagcaatacataaaaaagaacaaacatacccgcggtgttcccgtttatgaccccacgcgacctccggtttatgacctggcatatatcgaaaaaaaactaccgcaccgctttccattccttttgctggataagatcattgaattaagtgatacccatattgtgggtataaaaaatgtaacatttaacgaatggttttttcagggtcattttcccggtaatccggtgatgccgggagtattgcagattgaggcattggcacaatgtggaggaatactggcaatgaacatgagccctgagggcctgtatgatacttatttcctgaagatcgataactgcaaattcaaacaaatggtaaaaccgggtgataccatgctgctgaaaatggagctctcgggaccgatccgtcgcgggatctgtgaaatgaaaggcaccgtatatgttggtaataaggtttgcactgaggccgatctcgtggctcanattgtgaaacgaaataattga

SEQ ID NO: 6458 - protein, 240 aa, Unknown
  Obtained from environmental sample
  DOMAIN (141)...(228): Thioesterase superfamily
  misc_feature (1)..(240): Xaa is any amino acid
MKXERLKKIFKKEKIEVKSEGYLNNLELRFPNEPARHKLLDVVGDLALVGYPIKAKIIANRPGHSSNVEFAKKIKQYIKKNKHTRGVPVYDPTRPPVYDLAYIEKKLPHRFPFLLLDKIIELSDTHIVGIKNVTFNEWFFQGHFPGNPVMPGVLQIEALAQCGGILAMNMSPEGLYDTYFLKIDNCKFKQMVKPGDTMLLKMELSGPIRRGICEMKGTVYVGNKVCTEADLVAXIVKRNN

SEQ ID NO: 6459 - DNA, 756 bp, Unknown; identical to SEQ ID NO: 5781
  Obtained from environmental sample
  misc_feature (1)..(756): n is a, c, g, or t

SEQ ID NO: 6460 - protein, 251 aa, Unknown; identical to SEQ ID NO: 5782
  Obtained from environmental sample
  DOMAIN (2)...(197): tRNA synthetases class I (C) catalytic domain
  misc_feature (1)..(251): Xaa is any amino acid

SEQ ID NO: 6461 - DNA, 666 bp, Unknown
  Obtained from environmental sample
  misc_feature (1)..(666): n is a, c, g, or t
ttgggctctttatcttggaaccctgctgatattttccagctttctttttcagaaaaaggactttgtatgaaaaagtcagggctaataattctggttacctatctcttagcaatctcggttaattattacgcgtactccaagtatcgcgttaattcaaacctgtttacgcaaatgttgtatttgccatccgggaaatatctcaaaccggcttcgtttggctatcatgcgttgctttctgattttgtttatctctggtcaatccagtactatggtgatccaattttcagtccgaaaatggaatatctaaaacatacttacgacatcatcactgaattggatccacattacatcgatgcctaccagactggtgcattgttcatgttttatgaaggaaggaatccgaaatctggtttggaattacttgataaaggcattgaaaggaatcccaatgaatggattctgccggcagatgcaggtttctattgctacatgaatttaaaagataaacgtcgagcaatcgactatttcaataaagtgattaaaattccaactgctcctgctcaggcaaaacgttttctggctggaatgcattttcaaattggcgatacgaaattggcttatgacctttggaaagagattacgaaacgtccgataaagctcacataa

SEQ ID NO: 6462 - protein, 221 aa, Unknown
  Obtained from environmental sample
  misc_feature (1)..(221): Xaa is any amino acid
MGSLSWNPADIFQLSFSEKGLCMKKSGLIILVTYLLAISVNYYAYSKYRVNSNLFTQMLYLPSGKYLKPASFGYHALLSDFVYLWSIQYYGDPIFSPKMEYLKHTYDIITELDPHYIDAYQTGALFMFYEGRNPKSGLELLDKGIERNPNEWILPADAGFYCYMNLKDKRRAIDYFNKVIKIPTAPAQAKRFLAGMHFQIGDTKLAYDLWKEITKRPIKLT

SEQ ID NO: 6463 - DNA, 771 bp, Unknown
  Obtained from environmental sample
  misc_feature (1)..(771): n is a, c, g, or t
ttgacaattacaaaactattcaagctattgaaagatactgtgtcgttatcaaacattacccaaagcggtgaagtcagtacaagtttatacgaagatgattttaacgagcactggcttataaatcagaatatttatatggatgaaataagtataaagaaacgttacaacccctggaataaagtagcagagttataccaggaaaagttcatggatcttactttatataacgattcctatgatttattttgtaatgaattaaagaaacaaaattccggtgttttagaaattggctgcggacccggcaatatatcaaaatacctgctgtcaaaaaggaatgacttaaaaattaccggaattgacattgcaccggctatgattaaactcgctaaagtcaacaatccggcggctgagtttttcgaattagatatcagatcccttaatcaaattgaaaaaagattcgaaggaattattggtggattttgtttaccgtatttatccggtgatgattgcttaaaattatttaatgactgcagaaatttactgagcgatgatggaatactgtatttaagttatattgaaggcgatggtaaatcagactatttaacaggaagcagtggccatcgtacttatttttatgatcatcagctgcataatattaaagatcagcttaaagaacatgatttcgaaattgcccgcacgttgcagaaggatttcaataataatggtactgatgaagtacataccatattaatagcaaaaaaaactgcctga

SEQ ID NO: 6464 - protein, 256 aa, Unknown
  Obtained from environmental sample
  misc_feature (1)..(256): Xaa is any amino acid
MTITKLFKLLKDTVSLSNITQSGEVSTSLYEDDFNEHWLINQNIYMDEISIKKRYNPWNKVAELYQEKFMDLTLYNDSYDLFCNELKKQNSGVLEIGCGPGNISKYLLSKRNDLKITGIDIAPAMIKLAKVNNPAAEFFELDIRSLNQIEKRFEGIIGGFCLPYLSGDDCLKLFNDCRNLLSDDGILYLSYIEGDGKSDYLTGSSGHRTYFYDHQLHNIKDQLKEHDFEIARTLQKDFNNNGTDEVHTILIAKKTA

SEQ ID NO: 6465 - DNA, 609 bp, Unknown
  Obtained from environmental sample
  misc_feature (1)..(609): n is a, c, g, or t
atgaataagtataaagaaacgtttacaacctggaataaagtagcagagttataccaggaaaagttcatggatcttactttatataacgattcctatgatttattttgtaatgaattaaagaaacaaaattccggtgttttagaaattggctgcggacccggcaatatatcaaaatacctgctgtcaaaaaggaatgacttaaaaattaccggaattgacattgcaccggctatgattaaactcgctaaagtcaacaatccggcggctgagtttttcgaattagatatcagatcccttaatcaaattgaaaaaagattcgaaggaattattggtggattttgtttaccgtatttatccggtgatgattgcttaaaattatttaatgactgcagaaatttactgagcgatgatggaatactgtatttaagttatattgaaggcgatggtaaatcagactatttaacaggaagcagtggccatcgtacttatttttatgatcatcagctgcataatattaaagatcagcttaaagaacatgatttcgaaattgcccgcacgttgcagaaggattncataataatggtactgatgaagtacataccatattaa

SEQ ID NO: 6466 - protein, 202 aa, Unknown
  Obtained from environmental sample
  misc_feature (1)..(202): Xaa is any amino acid
MNKYKETFTTWNKVAELYQEKFMDLTLYNDSYDLFCNELKKQNSGVLEIGCGPGNISKYLLSKRNDLKITGIDIAPAMIKLAKVNNPAAEFFELDIRSLNQIEKRFEGIIGGFCLPYLSGDDCLKLFNDCRNLLSDDGILYLSYIEGDGKSDYLTGSSGHRTYFYDHQLHNIKDQLKEHDFEIARTLQKDXIIMVLMKYIPY

SEQ ID NO: 6467 - DNA, 375 bp, Unknown
  Obtained from environmental sample
  misc_feature (1)..(375): n is a, c, g, or t
ttgcgcaagacactgaatttcgggcacaccgttggtcatgccatagaagggtgttttctcgaaaagcaggaaccgatgttgcacggtcacgcggtcggtttaggaatgattgcagaagcctggatttcaaaagaaatgaacctgatttctgattccgaattcaaccaggttgagtctgtctgcaaacgttattttggaaaatatctcactgaaaaagtgaatacagaacgcattcttcagttaatgcaaaacgacaaaaagaacacaaccggaaaaatcaatttttcactgctgaatggaattggaaaatgccaatttgatgttgcggtttcaacagagttgattctgaaaagtctggaatattttaagaagtag

SEQ ID NO: 6468 - protein, 124 aa, Unknown
  Obtained from environmental sample
  misc_feature (1)..(124): Xaa is any amino acid
MRKTLNFGHTVGHAIEGCFLEKQEPMLHGHAVGLGMIAEAWISKEMNLISDSEFNQVESVCKRYFGKYLTEKVNTERILQLMQNDKKNTTGKINFSLLNGIGKCQFDVAVSTELILKSLEYFKK

SEQ ID NO: 6469 - DNA, 324 bp, Unknown; identical to SEQ ID NO: 2941
  Obtained from environmental sample
  misc_feature (1)..(324): n is a, c, g, or t

SEQ ID NO: 6470 - protein, 107 aa, Unknown; identical to SEQ ID NO: 2942
  Obtained from environmental sample
  SIGNAL (1)...(19)
  misc_feature (1)..(107): Xaa is any amino acid

SEQ ID NO: 6471 - DNA, 453 bp, Unknown
  Obtained from environmental sample
  misc_feature (1)..(453): n is a, c, g, or t
atgaagctgagagtagcacttgattcaggaccgctggtgggcggacatgcaataaggggtattggtgtagtagtcagagagtacatacaagcattagagggcaaaggttcaaaaaataaaacacaaatttctgttgatgcgtttgacttcagccaagatgccggtaaaaagaagctacttgttggtaattacgatattgtacattaccctatttttttcccttacaacctgtatttaccggaaaataagccggcaaataaagttattgtcactatacacgacttaatacaattaatttaccctaaaaattatcctcccggagtaaggngtaagctcaattttattaaacaaaagcgaaggcttgcttatgcagataaaatattaactgtatccgaaacatctaaaaaggatattgtcaggcttttaaatgtacctgcttcaaaaatgaagtag

SEQ ID NO: 6472 - protein, 150 aa, Unknown
  Obtained from environmental sample
  misc_feature (1)..(150): Xaa is any amino acid
MKLRVALDSGPLVGGHAIRGIGVVVREYIQALEGKGSKNKTQISVDAFDFSQDAGKKKLLVGNYDIVHYPIFFPYNLYLPENKPANKVIVTIHDLIQLIYPKNYPPGVRXKLNFIKQKRRLAYADKILTVSETSKKDIVRLLNVPASKMK

SEQ ID NO: 6473 - DNA, 534 bp, Unknown
  Obtained from environmental sample
  misc_feature (1)..(534): n is a, c, g, or t
atgaagcatttgatatgctcacaagcggacccggatgcgttgttattttataatgattacaacactgaaaatccgtccaagcgtgaaaaaatattccagcttctaaaaagactgattgatacaaaaattccaattcatggtgtgggcttgcaaggtcactggtcgatttatgaacccactgaaaccgagctgcgaaactcactggaaaaattcaagactttgggcattgctgtgcaaatcaccgaacttgatgtttctgtttatccactcgaacacagccggcgtgatgcgcggcccggcgaacccaacactctcactgatgagatgactcaaaaacaaattgaacaatacaaaatgattttcagtgtgcttcgtgaatacaaagaaatcattaccggcgttacgttctggaatgtttcagacaaacacagctggcttgattcgtttccggtggccggaagaaaaaattaccctttgctgttcgaccaaaatctcgtgcctaaaaaagcgtattgggaagtggttaaattttaa

SEQ ID NO: 6474 - protein, 177 aa, Unknown
  Obtained from environmental sample
  DOMAIN (2)...(177): Glycosyl hydrolase family 10
  misc_feature (1)..(177): Xaa is any amino acid
MKHLICSQADPDALLFYNDYNTENPSKREKIFQLLKRLIDTKIPIHGVGLQGHWSIYEPTETELRNSLEKFKTLGIAVQITELDVSVYPLEHSRRDARPGEPNTLTDEMTQKQIEQYKMIFSVLREYKEIITGVTFWNVSDKHSWLDSFPVAGRKNYPLLFDQNLVPKKAYWEVVKF

SEQ ID NO: 6475 - DNA, 453 bp, Unknown
  Obtained from environmental sample
  misc_feature (1)..(453): n is a, c, g, or t
atggaaaaacacggtatgaagcccccaaaagagagagcgatcaaaaacatcctgataacgcagcctaggccagaatccgataagtcgccatactatgagcttgccaggaaatacaacctacagttgtcttttcagccctttatacgtattgaaggaattccctctaaagatttcagaaaacagaaaattgatatcactgcctattctgctgttattttcaccagccgtaatgccattgatcattttttccgcacctgcgaggaaatgagaatatctgtttcgcaggaaacaaagtatttctgcattactgaagctgtggctttgtacctccagaagtttatcctgtaccgtanacgcaaagtgttttacggtgctgatggcaccaataaaagtttgtttgatgtggtgaacaaacacaaaagcaacgaaaagttttttatacccctgcagtga

SEQ ID NO: 6476 - protein, 150 aa, Unknown
  Obtained from environmental sample
  misc_feature (1)..(150): Xaa is any amino acid
MEKHGMKPPKERAIKNILITQPRPESDKSPYYELARKYNLQLSFQPFIRIEGIPSKDFRKQKIDITAYSAVIFTSRNAIDHFFRTCEEMRISVSQETKYFCITEAVALYLQKFILYRXRKVFYGADGTNKSLFDVVNKHKSNEKFFIPLQ

SEQ ID NO: 6477 - DNA, 981 bp, Unknown
  Obtained from environmental sample
  misc_feature (1)..(981): n is a, c, g, or t
ttgcataatatgcgcaccctcaatcacatgcctgtagatagacaaatcgtcatcgctcaagagactctcgatatttatgcgccactagcaaacagacttggtatcagctgggtaaaaatagaacttgaagatttaagtctacgctatttgaagccagaaatttattacaagttagtccaaaaggtctctaagaagaaaaaagaacgagaaaaatacatcaatgaagtcatcaacgacatcgaagcagatcttaaaaaagaaggcatcaaggcagaaattcacggcagaccaaaacatttctattcgatctataaaaaaatggaagccagtaacatcgattacgaacaagtttatgatgttttggctttccgcgttctcgtcaatagcgtcgtgcaatgttacgaagttttaggtgtcgttcataatctttggaagcccattcctggaagattcaaagacttcatcgccatgcccaaggctaataactatcaaagtttgcacacgacagtaattgggcccggaggcgagagagttgaaattcaaattagaacccatgaaatgcatctcactgccgagcgtgggattgccgcacactggaaatataaagagggtggtggcattgataaagaaacagaaaaacgatttgaatggctccatcaattattgcaatggcatcaacaactcaaagatccttctgaatttttagagacaatcaagacagacttatttgccggtgacatttacgttttcacgcctcaaggcgatgtcatgggatttccatttggctctacagctttggacttcgcctacagtgtgcacacagatgtcggcaatcggtgtgtgggcgctaaagttaacgggaaaatcgttccccttaagcataaacttaaaaacggtgattctattgagatcattacttcaaataatcaaaagccaacaaaagattggctcaagatggtgccacccgtcgcgctaaaataa

SEQ ID NO: 6478 - protein, 326 aa, Unknown
  Obtained from environmental sample
  DOMAIN (243)...(306): TGS domain
  misc_feature (1)..(326): Xaa is any amino acid
MHNMRTLNHMPVDRQIVIAQETLDIYAPLANRLGISWVKIELEDLSLRYLKPEIYYKLVQKVSKKKKEREKYINEVINDIEADLKKEGIKAEIHGRPKHFYSIYKKMEASNIDYEQVYDVLAFRVLVNSVVQCYEVLGVVHNLWKPIPGRFKDFIAMPKANNYQSLHTTVIGPGGERVEIQIRTHEMHLTAERGIAAHWKYKEGGGIDKETEKRFEWLHQLLQWHQQLKDPSEFLETIKTDLFAGDIYVFTPQGDVMGFPFGSTALDFAYSVHTDVGNRCVGAKVNGKIVPLKHKLKNGDSIEIITSNNQKPTKDWLKMVPPVALK

SEQ ID NO: 6479 - DNA, 909 bp, Unknown
  Obtained from environmental sample
  misc_feature (1)..(909): n is a, c, g, or t
atgctccatcatttattgcaatggcatcaacaactcaaagatccttctgaatttttagagacaatcaagacagacttatttgccggtgacatttacgttttcacgcctcaaggcgatgtcatggaatttccatttggctctacagctttggacttcgcctacagtgtgcacacagatgtcggcaatcggtgtgtgggcgctaaagttaacgggaaaatcgttcccttaaagcataaacttaaaaacggtgattctattgagatcattacttcaaataatcaaaagccaacaaaagattggctcaagatggtgcacaccagtcgcgctaaaaataaaatccgcgcttacatcaagagcgaagaacgaaaacgtgcgattacccttggtactgagatgctggagaaaaactttaaaaaatacggtcttaatatcaaagactttttaaaatctcctcatcaagaaaaacttatcaaggatttgtccttgagcgaattcaatgacatctatgcacaagttggatacgggaaaattcctcctgtgaaaatcattgagcttgtagctcctgaaaaaaccaaagagccacttaaagaagcagctgagcccgacagttttctgcagaaggtttttaaatctgcattacagaagagttcaaaaacacgctcggctattcagattcaaggtatgaccgatatcctcgttcgctttggtaaatgctgtagtcctattccaggtgatgcggttgttggtttcatcacaaggggtcgaggaatcacagttcatttagctcaatgtccgaaagtttttgacttggatcaagacaggcgcgtggatgttgagtggaatttgaattcacaatctgaaagatcagctaaacttagaattgtctgtgtggatgaaccagggctctga

SEQ ID NO: 6480 - protein, 302 aa, Unknown
  Obtained from environmental sample
  DOMAIN (27)...(90): TGS domain
  misc_feature (1)..(302): Xaa is any amino acid
MLHHLLQWHQQLKDPSEFLETIKTDLFAGDIYVFTPQGDVMEFPFGSTALDFAYSVHTDVGNRCVGAKVNGKIVPLKHKLKNGDSIEIITSNNQKPTKDWLKMVHTSRAKNKIRAYIKSEERKRAITLGTEMLEKNFKKYGLNIKDFLKSPHQEKLIKDLSLSEFNDIYAQVGYGKIPPVKIIELVAPEKTKEPLKEAAEPDSFLQKVFKSALQKSSKTRSAIQIQGMTDILVRFGKCCSPIPGDAVVGFITRGRGITVHLAQCPKVFDLDQDRRVDVEWNLNSQSERSAKLRIVCVDEPGL

SEQ ID NO: 6481 - DNA, 414 bp, Unknown
  Obtained from environmental sample
  misc_feature (1)..(414): n is a, c, g, or t
atgatagtaaatagtatccctaaaccgtctctggcttattttgtagattcctcccgaaaaataaaatatcttaatgattactttgtggaaatttgcaatcttaaaagctctaatgaaataatcgggttttctccttccgatattatagaaagcagtacactggtacatggtaataataaaactaaggcccttgctgaaaaggtgctcgaaactggagaagctatttataaccttgaaggggcgcttaaatttagaggcgcaaataagaccctttccgtaatatgttccgctgttccggtaagagatgattccgaggttatagttggcagccttacaatcataactgatatgacagaaatcagagaaaacgaaaaacaggtccagggacttttacttatactgaaatctgtttaa

SEQ ID NO: 6482 - protein, 137 aa, Unknown
  Obtained from environmental sample
  misc_feature (1)..(137): Xaa is any amino acid
MIVNSIPKPSLAYFVDSSRKIKYLNDYFVEICNLKSSNEIIGFSPSDIIESSTLVHGNNKTKALAEKVLETGEAIYNLEGALKFRGANKTLSVICSAVPVRDDSEVIVGSLTIITDMTEIRENEKQVQGLLLILKSV

SEQ ID NO: 6483 - DNA, 684 bp, Unknown
  Obtained from environmental sample
  misc_feature (1)..(684): n is a, c, g, or t
atgaaggttgcaaaggttttacataatccaaatgctggggacggagataattctgatcgagatttgatcgccgcccttgaggcggaaggctacaggtgtagctatttatccacaaaagagaagggatgggaaaaaaaggattgggacaagattgaatccgaagagatcgattttgttgttgtcgccggtggagatggtaccgttcggaaactcgccggtgagctattggaacgaaaacttatcgaaaaaaaactaccgattgcacttttgccttttgggacggcgaataatattgccagaacacttggtattgccggcggagcggatgaaatcatcaaaagctggaaacaacatgagataaaaaaatatgatgttggtcggattgatggcattaagaaacataacttctttattgagagctatggctatggcgtatttccgaggttgatgaaggagatgagaaagctggataaaagcttattcgaaactcctgaagaaaagattaagacagctttgcaaattcttcacggcgttattttgaactataaaccgaagctctgcaagctaaaggttgatggagaagattatactggcaagtttctgttggtagaaattatgaataccagttcgattgggccgaacctccatctggcaccgtttgctgatcctggagatgtgcattga

SEQ ID NO: 6484 - protein, 227 aa, Unknown
  Obtained from environmental sample
  DOMAIN (3)...(131): Diacylglycerol kinase catalytic domain (presumed)
  misc_feature (1)..(227): Xaa is any amino acid
MKVAKVLHNPNAGDGDNSDRDLIAALEAEGYRCSYLSTKEKGWEKKDWDKIESEEIDFVVVAGGDGTVRKLAGELLERKLIEKKLPIALLPFGTANNIARTLGIAGGADEIIKSWKQHEIKKYDVGRIDGIKKHNFFIESYGYGVFPRLMKEMRKLDKSLFETPEEKIKTALQILHGVILNYKPKLCKLKVDGEDYTGKFLLVEIMNTSSIGPNLHLAPFADPGDVH

SEQ ID NO: 6485 - DNA, 795 bp, Unknown
  Obtained from environmental sample
  misc_feature (1)..(795): n is a, c, g, or t
ttgatgaacaatggcggctggatccgtgttgatgtaaacaacggtgcactgatcaattttagtagtctttctgcaggcaattacaaattaagtttccggaagctgaatggtttcggccccaataattattcttataaagaaatagcatttagcattaaaactccctggtaccagcgttggtggttttacctgctcgcggccctgttactttgggctgccatcctggtatacctgcggttccgaacaagacaataccaggtccgccaacgcaagctggaaaaacaggtggccgataaaacaaaggagttgaaggagcagaacgagatccttgaaaaaaataacacgatcaaatcgaggctgatctccattattagccatgatattataacaccattgaaatttgtaacggtagcaggaaagaacctgattgaaaaaagaaaaatgatgcctgaagaactgcagcaggaaaccatcagggaaatgaccaatacaacccaggagttgcagttcctgtcgaccaatatcctgaactggatcaaataccagaatgagaacaggttgcctgcccgcgaactgttcaacctgcatgaattggtaagccaggtgctggggcttgtttcctcactggcaagacaaaaaaaccttgttctcgaaaataatgtgagcgagtcgctggaggtccagcaattttatgaaccgctgaagatccttgtctataatcttttgcgcgacgcgatccattttaccgagaaaggcagcatcgtcatcgatgccagaaaaactggccggacctga

SEQ ID NO: 6486 - protein, 264 aa, Unknown
  Obtained from environmental sample
  DOMAIN (116)...(184): His Kinase A (phosphoacceptor) domain
  misc_feature (1)..(264): Xaa is any amino acid
MMNNGGWIRVDVNNGALINFSSLSAGNYKLSFRKLNGFGPNNYSYKEIAFSIKTPWYQRWWFYLLAALLLWAAILVYLRFRTRQYQVRQRKLEKQVADKTKELKEQNEILEKNNTIKSRLISIISHDIITPLKFVTVAGKNLIEKRKMMPEELQQETIREMTNTTQELQFLSTNILNWIKYQNENRLPARELFNLHELVSQVLGLVSSLARQKNLVLENNVSESLEVQQFYEPLKILVYNLLRDAIHFTEKGSIVIDARKTGRT

SEQ ID NO: 6487 - DNA, 441 bp, Unknown
  Obtained from environmental sample
  misc_feature (1)..(441): n is a, c, g, or t
ttgtatctaacggataagtattttatttttcaaaagatctataatgcacatgataaaaagaaaaattgggagataatcatcttgtttgagtccgtacaaatagaacaatggggagtacaggagggatcaagaaggaatacgatagtaggtggagcaggtggaataaataataactatgttatcggttgtgctttcattaatgaatctggaaaacgacataggcttgttataccttatgtggatgaaaatggaataaagcaatctcctatctttggtgtttccttactgaaggaggatctaataagacatttggcaacaaatctctatgaaatggtagttaagaattgtaaaactaatcatgacgaagaaaatgtttcagactctaacaaagtcatttcgagtgatccattagttgtccttaaaggagatttgcaagggtga

SEQ ID NO: 6488 - protein, 146 aa, Unknown
  Obtained from environmental sample
  misc_feature (1)..(146): Xaa is any amino acid
MYLTDKYFIFQKIYNAHDKKKNWEIIILFESVQIEQWGVQEGSRRNTIVGGAGGINNNYVIGCAFINESGKRHRLVIPYVDENGIKQSPIFGVSLLKEDLIRHLATNLYEMVVKNCKTNHDEENVSDSNKVISSDPLVVLKGDLQG

SEQ ID NO: 6489 - DNA, 840 bp, Unknown
  Obtained from environmental sample
  misc_feature (1)..(840): n is a, c, g, or t
gtgaaatatgacgataaatttctggaaaacgccagggaaatatctagctgtgttccagtttatataaataaaataccagatattgatgcctcatttcataattctcaagatactcaacactctattttaaacagattctcagaagatgccatattggataatactaacatatcaaaatctttgatgacattttcagaattctttttagcatataaattggccgcctccaaacaaaccgacctaatatttatggatagaagtctatcaaatatgtattcgagtttattatatgatacatcaaagaaaagtgattggaaagagacgagttccttactaaattatgaaatagatgcagctccctttgatgaaaatgattttacccttgcaaggtataacatattaaatgaagcgttaaagattcctccttgcaggggagattacttaagatattctgtttttttcaagattctagaaaaaggctctattgattttgagaccctttgtagttatttagaagttgaaagtagtgataaaaagaaaactgaccaagttaaaaagtaccttgatacatggatacatgaaaatgtaattgaaaatatcaataatcaatattctatttctgaaaaatacaaatctaatcaagagagaattagaaaattagtggattcaataggaaatcaaatttttgatagtgaaaccgacccattcacgattaccaaggaggtagatggagaaagaaaaaaacagtggataactacaacggacttggcatttcttacactttttgcattttatctcctcatagaagaatgttggaagataacggctttaattgtataa

SEQ ID NO: 6490 - protein, 279 aa, Unknown
  Obtained from environmental sample
  misc_feature (1)..(279): Xaa is any amino acid
MKYDDKFLENAREISSCVPVYINKIPDIDASFHNSQDTQHSILNRFSEDAILDNTNISKSLMTFSEFFLAYKLAASKQTDLIFMDRSLSNMYSSLLYDTSKKSDWKETSSLLNYEIDAAPFDENDFTLARYNILNEALKIPPCRGDYLRYSVFFKILEKGSIDFETLCSYLEVESSDKKKTDQVKKYLDTWIHENVIENINNQYSISEKYKSNQERIRKLVDSIGNQIFDSETDPFTITKEVDGERKKQWITTTDLAFLTLFAFYLLIEECWKITALIV

SEQ ID NO: 6491 - DNA, 510 bp, Unknown
  Obtained from environmental sample
  misc_feature (1)..(510): n is a, c, g, or t
gtgggaaatcatggtttagaaggaaccacaaaaacctccttaaaagaattaagacaacaatcattaaagtggaaaaaagttttagaaaaagttctcaaaaattccaaagacattgtaattgaagataaacgctattctctttcattacattatcgaaatgccaaagtacccgctcacgcaaagaaattgatcgaacaagccgtactatcccttgaaggagaacctaagattaccttaggaaaatatgtttttaacatcattccaaaattgggtcccgacaagggggaagcacttcaaaaacttaaaaaaagagtaaacgcttcggcttgtttttttatcggagatgattgtacggatgaagatgtattccgcctacaggacaaagaccttcttaccgttcgagtttacaagaatcataattcccgcgcaaaattttatattaaaaaacgaaatgaaataaattttattttaaggaaaataattcaagtaaaaacccaacgggggtcgtag

SEQ ID NO: 6492 - protein, 169 aa, Unknown
  Obtained from environmental sample
  misc_feature (1)..(169): Xaa is any amino acid
MGNHGLEGTTKTSLKELRQQSLKWKKVLEKVLKNSKDIVIEDKRYSLSLHYRNAKVPAHAKKLIEQAVLSLEGEPKITLGKYVFNIIPKLGPDKGEALQKLKKRVNASACFFIGDDCTDEDVFRLQDKDLLTVRVYKNHNSRAKFYIKKRNEINFILRKIIQVKTQRGS

SEQ ID NO: 6493 - DNA, 315 bp, Unknown
  Obtained from environmental sample
  misc_feature (1)..(315): n is a, c, g, or t
gtgaaatttcaaagcaatgaatcgaattctttatcccccccccaagaaaatgacaaacaaaaaagcccggcttggaattactttatcaaaaaagaagattacggatattgtcaaatccaaggatgcaagaaaattatttctgcgaaaggaacaacgacaggtctacttaaccatctaatacaagtccataaaatcgattttccaaaaaattcaaataatttaagaaatgaagatcaagtcaatcaagaggccggtttaaaacacagaaaaatttttaaatacctaaagattttcatacctatactagagagttga

SEQ ID NO: 6494 - protein, 104 aa, Unknown
  Obtained from environmental sample
  DOMAIN (22)...(64): BED zinc finger
  misc_feature (1)..(104): Xaa is any amino acid
MKFQSNESNSLSPPQENDKQKSPAWNYFIKKEDYGYCQIQGCKKIISAKGTTTGLLNHLIQVHKIDFPKNSNNLRNEDQVNQEAGLKHRKIFKYLKIFIPILES

SEQ ID NO: 6495 - DNA, 396 bp, Unknown
  Obtained from environmental sample
  misc_feature (1)..(396): n is a, c, g, or t
atggaaagtaaaaatctttcgctcgataaacactggatgacttttgagcatatcaaaaacttgttatcttatcaacaatcactatcaattacctctgaagctcgtgatgaaataattaaatgccgtaaatatcttgatgcaaaacttgatggctcagaagagctgttttatggcattaatacaggtttcggttttttccaggatataaaaattgacaagccacaattaagagaattacacaataacctgttgaaatctcatgcctgcgggctgggagagcaggtgccgaatgatattgtgaagctgatgatgatgctcaagataaaaagcttaagctatggttactcaggcgttggaattgaaatagtcaaaccgtttagtggacatgtacaataa

SEQ ID NO: 6496 - protein, 131 aa, Unknown
  Obtained from environmental sample
  misc_feature (1)..(131): Xaa is any amino acid
MESKNLSLDKHWMTFEHIKNLLSYQQSLSITSEARDEIIKCRKYLDAKLDGSEELFYGINTGFGFFQDIKIDKPQLRELHNNLLKSHACGLGEQVPNDIVKLMMMLKIKSLSYGYSGVGIEIVKPFSGHVQ

SEQ ID NO: 6497 - DNA, 453 bp, Unknown
  Obtained from environmental sample
  misc_feature (1)..(453): n is a, c, g, or t
gtgtgtcatggcgtgcaggttggcactaaaactcattcatttattaaattttttaataaggaagaaatttcatatagaccaaaaattccttcttcagaaatatttgatgcatacgtagaagcaagatgtattgaattatttctaacagaagaagcagctttgcaatggataagagacagacaagaatatgaagatatgattttagtaggaaggaactataataccgttcatatacaaccaatattcaaagttagatatttgggtaatgtagaagaaatgaaaaaagaaataaattccattaaagaaaaatttaaaaatatcgagcgtaatctggtcataccacttgaaggacacttaaaagttcctttgttagaaaataaaaataaagaaataggtcatattgatttttccaattactctctcgacaatactgaaaaatgcgtcattcagtag

SEQ ID NO: 6498 - protein, 150 aa, Unknown
  Obtained from environmental sample
  misc_feature (1)..(150): Xaa is any amino acid
MCHGVQVGTKTHSFIKFFNKEEISYRPKIPSSEIFDAYVEARCIELFLTEEAALQWIRDRQEYEDMILVGRNYNTVHIQPIFKVRYLGNVEEMKKEINSIKEKFKNIERNLVIPLEGHLKVPLLENKNKEIGHIDFSNYSLDNTEKCVIQ

SEQ ID NO: 6499 - DNA, 327 bp, Unknown
  Obtained from environmental sample
  misc_feature (1)..(327): n is a, c, g, or t
atgacgagttataatctcgataaaaaaaaaatttacctatgtgtttttcttatgcttgtttgtgttatacttgatacctctcttattaaaatctataatatagttgacaaaaacattttgtcaatctcagagaaaaagatattgtttcttttgaattcactttttttatttggagtggaattttcctttttaataatccttaagaaacacttagatcaatataacaatacaaatttttcaaagaatacttttaggcttactattgcctttttagcaacaatagnatctgtattttttatcttattttaccaaaaaattttttcttaa

SEQ ID NO: 6500 - protein, 108 aa, Unknown
  Obtained from environmental sample
  misc_feature (1)..(108): Xaa is any amino acid
MTSYNLDKKKIYLCVFLMLVCVILDTSLIKIYNIVDKNILSISEKKILFLLNSLFLFGVEFSFLIILKKHLDQYNNTNFSKNTFRLTIAFLATIXSVFFILFYQKIFS

SEQ ID NO: 6501 - DNA, 1131 bp, Unknown
  Obtained from environmental sample
  misc_feature (1)..(1131): n is a, c, g, or t
ttgttcggggagtattttgttttctttgggaaggatgcgtattttaggtttcaacccaacaaggatgcgggtcggggacagatattttttttcattttgttgaaggagagctttttatttttcaaggcgccagatgggacaaccattaatgcaggcctgggattatgtataagaatttctgggaggaaacagcaatcgaaaatcgttctccccgttcacaaatttcgtgccgagcttaaaagatatttcaaagacttccgagaagtttgtagaacaactgatggtaagcagatccggagtgtatattctggatttctggctgacaagtttagtatgcacaatgctccagacacagatattccaatagcattaacaatggaatcagaagtttctctgttggatgagcttctggcagactgtccagctcaatatgctactgaatctgggtttcctgagaagaagtgggccaatgttaccacaacattaaaagatctggacactacaaagttgcattatgttgtcttaccagataatcatatttgcatagacttggatctaaaagacgagaatggtaataagtctatgattttaaatatggaagcagcagccaagtttcttccaacctattctgaacttagtaagagtggtggtggaattcatcttcattatatttatgatggagacgtcgataggcttggttctatctgggatgaaggaatagaaataaagagaactattcgtggtgagaatggaccaacatcattgcggcgcaaactatcaaaatgtaatagcactccaatagctcatctgaatagtggattgcccttgaaaggagcaaagatgattgacccaaaagctatagcaagcgagaagggtcttcgagaattgattcttaagaatctaagaaaggagatccacccaggtacaaagccctcaatggactttatatttaagatccttgaagatgcctataattctgggatgaagtatgatttgacgccaatgaaaccaagtattctggtgtttgccaacaacagtacaaatcatgcagactattgtattaagcttatcaaaaagatgaagttcaagtctgaggatattgttgaagagccgngttcacccatcaattaa

SEQ ID NO: 6502 - protein, 376 aa, Unknown
  Obtained from environmental sample
  misc_feature (1)..(376): Xaa is any amino acid
MFGEYFVFFGKDAYFRFQPNKDAGRGQIFFFILLKESFLFFKAPDGTTINAGLGLCIRISGRKQQSKIVLPVHKFRAELKRYFKDFREVCRTTDGKQIRSVYSGFLADKFSMHNAPDTDIPIALTMESEVSLLDELLADCPAQYATESGFPEKKWANVTTTLKDLDTTKLHYVVLPDNHICIDLDLKDENGNKSMILNMEAAAKFLPTYSELSKSGGGIHLHYIYDGDVDRLGSIWDEGIEIKRTIRGENGPTSLRRKLSKCNSTPIAHLNSGLPLKGAKMIDPKAIASEKGLRELILKNLRKEIHPGTKPSMDFIFKILEDAYNSGMKYDLTPMKPSILVFANNSTNHADYCIKLIKKMKFKSEDIVEEPXSPIN

SEQ ID NO: 6503 - DNA, 567 bp, Unknown
  Obtained from environmental sample
  misc_feature (1)..(567): n is a, c, g, or t
atgtataacaactctgaaaaatttaaagtattaatagaattgcaagccgcagtatcaaaattggaaaaaatccctaatttttttaaacttattccagagacaaaaacaaactttgtgtattcaacagagagacccaaaaattttgatgatattgcaggggttttgggtagattgattgatctgggaaccagtattagaactccaaatgtcgtccaattcggagcttccctgcatgtttctaatgcaattttatcagccaccaaatttaattcattacttaggtccgccatcaatattcgaaacaatccaagtatcatcgagatttgcgaaaataattttaggtgctctagttattctagaaagtacgaaacaaaagaggttaagaagacagaaggattctcgataaaatgggggattagtgaagcctttatacaaaatccggatgcagaaatagtttatcacgatggcgattttggaaaggagcctatggttattatgtttggacaagatccaaaggaggttttagaaaaaataagaattattctacaatactatgtcaacaactaa

SEQ ID NO: 6504 - protein, 188 aa, Unknown
  Obtained from environmental sample
  misc_feature (1)..(188): Xaa is any amino acid
MYNNSEKFKVLIELQAAVSKLEKIPNFFKLIPETKTNFVYSTERPKNFDDIAGVLGRLIDLGTSIRTPNVVQFGASLHVSNAILSATKFNSLLRSAINIRNNPSIIEICENNFRCSSYSRKYETKEVKKTEGFSIKWGISEAFIQNPDAEIVYHDGDFGKEPMVIMFGQDPKEVLEKIRIILQYYVNN

SEQ ID NO: 6505 - DNA, 333 bp, Unknown
  Obtained from environmental sample
  misc_feature (1)..(333): n is a, c, g, or t
atgcctggcagatgccgggcattttggtttcagtatttttgttgctatctaaggcataaaattttctttcaatttagcatggctaaagaaattaaaagattaagctggaaaaatttcattgctacgcctgaatctggtgcaacaacgttcattaactatgatgatgaagaaaatattcttgaaataaaatttgtcagtggcatttatcattatttcgatgtgccgcaaaatgtttggaaagaattaaaagcttatgtagaagcaggtggctcttcaggtaaatttgtcaacttgattataaagccactttataaatataaaaaactgcgatga

SEQ ID NO: 6506 - protein, 110 aa, Unknown
  Obtained from environmental sample
  misc_feature (1)..(110): Xaa is any amino acid
MPGRCRAFWFQYFCCYLRHKIFFQFSMAKEIKRLSWKNFIATPESGATTFINYDDEENILEIKFVSGIYHYFDVPQNVWKELKAYVEAGGSSGKFVNLIIKPLYKYKKLR

SEQ ID NO: 6507 - DNA, 348 bp, Unknown
  Obtained from environmental sample
  misc_feature (1)..(348): n is a, c, g, or t
atgaattgcggaacgatccgcgttttcaatatccacctactaacgaaggacgtcagcaatgtgtcaacgattatcaaaatatcatcaatgaagtggatcgaggaattacaaaggtctttgatatcagacctaaaatcggagttaaagtggaacgcgtaccggcatttaaagaagcaggatcttccggcgcctactacgaacctgcttccatggatggggtgcgccccggagtgttctttgcaaacttgcgtgatatggccgaagttccgaagtggagcatgcgcacacttgcttatcatgaagcgatacctggccatcattttcaactcggaattcagcaagaactga

SEQ ID NO: 6508 - protein, 115 aa, Unknown
  Obtained from environmental sample
  misc_feature (1)..(115): Xaa is any amino acid
MNCGTIRVFNIHLLTKDVSNVSTIIKISSMKWIEELQRSLISDLKSELKWNAYRHLKKQDLPAPTTNLLPWMGCAPECSLQTCVIWPKFRSGACAHLLIMKRYLAIIFNSEFSKN

SEQ ID NO: 6509 - DNA, 816 bp, Unknown
  Obtained from environmental sample
  misc_feature (1)..(816): n is a, c, g, or t
atgatgattgtattgatgaaccgatttttactgaaaaagttaatggggattataaaagtaagagattactctgattttacagatgcatctcaaagcggaaaatttaaattaccttcaaaaacatatttaattgttatcccaccatattccagacctaatattcaactcatagtcactgaagaggagattataaaaggagtaattccatcggttcaaccaaaagttaaattacttaatgattcaacactaattaatgaagaagttgaatttgaagacgctgtgattgagaatataaatcagaaagagctggaaattgttggctctggctggtatcgaaacaattactttgttcaggtaaaaattaatactcatatatttgatgtaagttcaaatcaaataagagtaataaaaaatgcaaagctgatagtaaattttgattccggttatccattttcattcgacgaaacaactttgaacaataaaattatttctaatgattttgatcagatgattattaactatcaaatgatagaacagttcaaaggtaaacagccattattgcttgaagatacaaccggcagctggataaactacggattagaattcttgaaaatcggtacggcaaaagatgcaatattcagaataacaaaatctgatcttgaagcaaaagggatagttacgtcatcgataaatcctaaaacttttagattaattgagtcaggtgttgaaattccaataacagtgattggacaggatgataatgtatttaatgacaacgattatatccaattttatggaacgcttaattatccctga

SEQ ID NO: 6510 - protein, 271 aa, Unknown
  Obtained from environmental sample
  misc_feature (1)..(271): Xaa is any amino acid
MMIVLMNRFLLKKLMGIIKVRDYSDFTDASQSGKFKLPSKTYLIVIPPYSRPNIQLIVTEEEIIKGVIPSVQPKVKLLNDSTLINEEVEFEDAVIENINQKELEIVGSGWYRNNYFVQVKINTHIFDVSSNQIRVIKNAKLIVNFDSGYPFSFDETTLNNKIISNDFDQMIINYQMIEQFKGKQPLLLEDTTGSWINYGLEFLKIGTAKDAIFRITKSDLEAKGIVTSSINPKTFRLIESGVEIPITVIGQDDNVFNDNDYIQFYGTLNYP

SEQ ID NO: 6511 - DNA, 450 bp, Unknown
  Obtained from environmental sample
  misc_feature (1)..(450): n is a, c, g, or t
atgcttggacaactgaacactgatcaaattgaagcgctacttcacaacgaagtcattggacgcattggttgtaatgcagacggcaaaacatacgttgtgccaatcacgtttgtgtacgacggagaatgtgtttatggtcacagtgccgtagggatgaaaatcgacatgatgcggaagaatcctaatgtatgtttcgaagtcgacgcaatgcaaaacatggcgaattgggaaagcgtaatcgcgtggggaacatttgaagagcttcatggcgccgcggcaatgaatgggaagcaaaagctgattgaccatctgaaaccgttgatgacaagtgaaaacaacccgccctcccaaggaaggcctcgccccatcaaaaaaacgtcggtaaaaaggcaccggttgtgtatcccattccgttggaaaaaaaaaaacggtaggtatgaaaaacgttaa

SEQ ID NO: 6512 - protein, 149 aa, Unknown
  Obtained from environmental sample
  misc_feature (1)..(149): Xaa is any amino acid
MLGQLNTDQIEALLHNEVIGRIGCNADGKTYVVPITFVYDGECVYGHSAVGMKIDMMRKNPNVCFEVDAMQNMANWESVIAWGTFEELHGAAAMNGKQKLIDHLKPLMTSENNPPSQGRPRPIKKTSVKRHRLCIPFRWKKKNGRYEKR

SEQ ID NO: 6513 - DNA, 696 bp, Unknown
  Obtained from environmental sample
  misc_feature (1)..(696): n is a, c, g, or t
atgagcaaaattaaattccgtaacaggcaggatagcacttttaccactacactacattcaagaattgaagattattttaaggaaaacaaattatctcaaaaaggaaactggctgatgggcgtgaaggttgttttcttccttggaggtttcttaggcagttatttcctgatatacctttcaggagagagtatcttcctttcaataatgagttggctgctgatgggtttcttcaccgcttttgtaggattcaatatttcgcacgacgcggttcatggttctctttctcaaaataaatttttgaaccgggttctcgggtatacattcaacctcgcaggtaccaataagtacatgtggaagatccttcataatgtgatccatcatacttatacaaatattcccggctttgatgaagacttggaaccaggtggtttgatccggctttcaacggaaaacaaattaaagaaaatccacaaataccagcattggtatgcatacctgctttattcccttacttctctttcttgggtgtttaaaaaggactttgaaactttttttagaaaaaaattgggtaattatgaaaacaagagtcatccgttgaaggaatattttattctgtttatttcaaaatttttgtatttcttcgttttcatcgccttgccagttatgcttactccgcttccgggtggttcaatctga

SEQ ID NO: 6514 - protein, 231 aa, Unknown
  Obtained from environmental sample
  DOMAIN (71)...(224): Fatty acid desaturase
  misc_feature (1)..(231): Xaa is any amino acid
MSKIKFRNRQDSTFTTTLHSRIEDYFKENKLSQKGNWLMGVKVVFFLGGFLGSYFLIYLSGESIFLSIMSWLLMGFFTAFVGFNISHDAVHGSLSQNKFLNRVLGYTFNLAGTNKYMWKILHNVIHHTYTNIPGFDEDLEPGGLIRLSTENKLKKIHKYQHWYAYLLYSLTSLSWVFKKDFETFFRKKLGNYENKSHPLKEYFILFISKFLYFFVFIALPVMLTPLPGGSI

SEQ ID NO: 6515 - DNA, 528 bp, Unknown
  Obtained from environmental sample
  misc_feature (1)..(528): n is a, c, g, or t
ttggatcaaaataaaatatttctattaaaagttgatacattttggaacaagatttgggaaattaaatataaaaaagatactttagatttaagaggtttcgcgatagatcaaacaaatgacagcggctttgttataagtggtgatgcattttattctcctttttcagataattcattatctgacccacagttactatatgtgctaaagttaaataagaacgggcaaattaatccgatcgggataaatttaatttctagtaaaataccaatagattatagactttaccaaaattatcctaacccatttaatcctgtaaccaacatcaaatttgaaattcccaaagatttaaatgtaagtatcaagatatatgatattctcgggcgggaagtattcaattttaatgaatataaaaaagcaggcagttatgaagttcagtttgatggttctaattttgccagtgggatgtatttttataagttagaggctgatgggtttacagctacgaagaagatggttttgttgaagtaa

SEQ ID NO: 6516 - protein, 175 aa, Unknown
  Obtained from environmental sample
  misc_feature (1)..(175): Xaa is any amino acid
MDQNKIFLLKVDTFWNKIWEIKYKKDTLDLRGFAIDQTNDSGFVISGDAFYSPFSDNSLSDPQLLYVLKLNKNGQINPIGINLISSKIPIDYRLYQNYPNPFNPVTNIKFEIPKDLNVSIKIYDILGREVFNFNEYKKAGSYEVQFDGSNFASGMYFYKLEADGFTATKKMVLLK

SEQ ID NO: 6517 - DNA, 867 bp, Unknown
  Obtained from environmental sample
  misc_feature (1)..(867): n is a, c, g, or t
atggncgaaggcgcattcataaccataactaacggtgttaatcttcgcaataaaaaagatgttgacggcaatgcgcaggacaacaaaatattctctaacctgaaggatctgcttgagcttaccaattccatttactgtatcggatatgggtttgaaacgacagataacggcacgcagcgttttaggattgaaaaaatagattatttctataacaatagcatcaaagttttatcccttggtaaagtttacgatataaaaaagaagattgattccaagcgatattacaatcaaatagagtatggctattccacaaagatagacattggccaggtaaatgctatcgatgagttcaacacactacgacgttcatcccttccaattaaaaatacaaaaggacagttaaaagtcgccactaacattattaccagtggatacgccatagaatatgaaagaaggctttcgaatggcacaaaagacggcaagtatgatgataacaactttgctatcgttgttatccgtgatggcgaaacattcagaacaaaaacaggatcggaagctgacggatatatcgcggcatcgttctcaaatgttataagccctgaaacttcctacaaccttgatataagccctgccagatgtttaaagaattggtcaaaaatcattgctgcatgcctggtaaatagtacgagcaaagaagtaaaattctcttatggagaaacgaattataaaatgacttcccaaaagacgggcgaagtacaaatagttagtgaagatggaagtattgatttgacttatataaatcctatctatgaaccttttatatatacgttgcaaatacgtaccttgtccagatcgatgtcaacataa

SEQ ID NO: 6518 - protein, 288 aa, Unknown
  Obtained from environmental sample
  misc_feature (1)..(288): Xaa is any amino acid
MXEGAFITITNGVNLRNKKDVDGNAQDNKIFSNLKDLLELTNSIYCIGYGFETTDNGTQRFRIEKIDYFYNNSIKVLSLGKVYDIKKKIDSKRYYNQIEYGYSTKIDIGQVNAIDEFNTLRRSSLPIKNTKGQLKVATNIITSGYAIEYERRLSNGTKDGKYDDNNFAIVVIRDGETFRTKTGSEADGYIAASFSNVISPETSYNLDISPARCLKNWSKIIAACLVNSTSKEVKFSYGETNYKMTSQKTGEVQIVSEDGSIDLTYINPIYEPFIYTLQIRTLSRSMST

SEQ ID NO: 6519 - DNA, 516 bp, Unknown
  Obtained from environmental sample
  misc_feature (1)..(516): n is a, c, g, or t
atgacagtagcgttacagcaattttatagaatcttttgggaagatgaagtttgcagaaatattttcttgcaacataaagagcttttgctcgaaaaaaactcattggatataagaatcacggactactaccttcaaaggattgtgctttcgaattcgctgaaccaaaaaggagggaattccgaagacaaaatgatttttcgccaagagaataagtttactcacatcttaaataaaataaaagattctaaagacaaatatttgaacgaagaaagaatcaaaaactactttactcaacgatatggtgaaactattcatctcgcaaaaaaacaagccgaggaagaaggatggttgaatttcattttccgacttttggaagaaataaacaaccctgaagaagataacagtttttttaggattctaactgaatataaagttattccgcccgaaattgacaacagtgggaaacttgaaaaatatattgaatctgaattttcaaatgaagcgagaaagttttaa

SEQ ID NO: 6520 - protein, 171 aa, Unknown
  Obtained from environmental sample
  misc_feature (1)..(171): Xaa is any amino acid
MTVALQQFYRIFWEDEVCRNIFLQHKELLLEKNSLDIRITDYYLQRIVLSNSLNQKGGNSEDKMIFRQENKFTHILNKIKDSKDKYLNEERIKNYFTQRYGETIHLAKKQAEEEGWLNFIFRLLEEINNPEEDNSFFRILTEYKVIPPEIDNSGKLEKYIESEFSNEARKF

SEQ ID NO: 6521 - DNA, 327 bp, Unknown
  Obtained from environmental sample
  misc_feature (1)..(327): n is a, c, g, or t
gtgacatcagtaatttttttggctgctataaatgaatatgatatgatcctcgaagaagatggtgaaacaaatagacttgtggagtctttgaaactctggaaagccttgactgggtctcaattttttaaaaatactccatttatattatttttaaacaagtctgatctcttttcagaaaaaattaaaacgataccgttaggcaaaatatttatagattaccctggtttgtttattttattcttcaagagcctacttaaagcaaaattaaaaaactatttacggcagggttgtgaatcagatttttcattctcagaaatagaacactag

SEQ ID NO: 6522 - protein, 108 aa, Unknown
  Obtained from environmental sample
  DOMAIN (2)...(98): G-protein alpha subunit
  misc_feature (1)..(108): Xaa is any amino acid
MTSVIFLAAINEYDMILEEDGETNRLVESLKLWKALTGSQFFKNTPFILFLNKSDLFSEKIKTIPLGKIFIDYPGLFILFFKSLLKAKLKNYLRQGCESDFSFSEIEH

SEQ ID NO: 6523 - DNA, 495 bp, Unknown
  Obtained from environmental sample
  misc_feature (1)..(495): n is a, c, g, or t
gtgaggtggataaattattttacaggatcgtttcttcacaatttgtacctgtgttttcccctgggtatatatctaaacgataaatatggaataaaatttgtgtttttcagaagcatgaaacaggaatccccgccgttgatatcatttattacagactatgatcttgagcaaccaaacggtgtgatctgtttcacagccgaagttcgtttccagtcgaaaagaaatatcttcaaattcatcagccctgtacatgttataaccatatccataaaacatatggatgttatttacctccttaatccggatattgacggggaaaagatcaaaacgatgtatacgaataatcagcggttcaggtattcgccagacaagaaacaatttgagataagaggtaaatccaggcgctatggatactattcactggtaattatcccaattaccaagcattgtgagcatgagacgatctcagaattgaaagcaacaaagtataattaa

SEQ ID NO: 6524 - protein, 164 aa, Unknown
  Obtained from environmental sample
  misc_feature (1)..(164): Xaa is any amino acid
MRWINYFTGSFLHNLYLCFPLGIYLNDKYGIKFVFFRSMKQESPPLISFITDYDLEQPNGVICFTAEVRFQSKRNIFKFISPVHVITISIKHMDVIYLLNPDIDGEKIKTMYTNNQRFRYSPDKKQFEIRGKSRRYGYYSLVIIPITKHCEHETISELKATKYN

SEQ ID NO: 6525 - DNA, 654 bp, Unknown
  Obtained from environmental sample
  misc_feature (1)..(654): n is a, c, g, or t
ttgggacaggttcacggtggaaaaccgaccattttctatcctgaccttatgatcaagctgcagccgtatgaggtaatcgcgcgctttgttatccaactcctcgctatcgaaactcaacaggctttcaaaaagataaaagtccgaaaacaccacagaaaaatgatgccggtaatattcacgattggtatcggtaaccgtttcaccatccacacgaataacgcctttttccggcacataaagcccgatcaaaagcaaagccaacgtggacttgccgctgccgttgccgccggtgagaaaaaccagttcgcctggatgcagtttgaaattaatcggcccaagcaaaaagtcaccaacggtgtcgtcgcgataataacggtgcgttacatcgacaagctccagactgtttacctttttccttaccgtccatgcgtcccgatgttgttgtcggtgacaattgttctcgatatcctggttcagatatttcaactttcccagagcaacttgcgcccgccccaagacgggcaagctattaaaaacactggccagtggcgccatcatatacatgacagcaaaaacagcaccggtaattgtttccataggcagcaacaggattccgtcaaaacgaagaaaaataatccgacatcaaaaaaatga

SEQ ID NO: 6526 - protein, 217 aa, Unknown
  Obtained from environmental sample
  misc_feature (1)..(217): Xaa is any amino acid
MGQVHGGKPTIFYPDLMIKLQPYEVIARFVIQLLAIETQQAFKKIKVRKHHRKMMPVIFTIGIGNRFTIHTNNAFFRHIKPDQKQSQRGLAAAVAAGEKNQFAWMQFEINRPKQKVTNGVVAIITVRYIDKLQTVYLFPYRPCVPMLLSVTIVLDILVQIFQLSQSNLRPPQDGQAIKNTGQWRHHIHDSKNSTGNCFHRQQQDSVKTKKNNPTSKK

SEQ ID NO: 6527 - DNA, 441 bp, Unknown
  Obtained from environmental sample
  misc_feature (1)..(441): n is a, c, g, or t
atgcgtttattagaatatgcttttacaggttctgaaaagaaaaaaaaaaattcggatttagaagttttaagaaaagttagaatattgattcctactcaaggagcgacagtagctcctcctttaggccctactttaggacaatttggtcttaatataaaagatttttgtgataagtttaatgagagaactaaaaattatgataatgattttattgttactacatggttaactttatatagtaataagactttaatattttatataaaaactcctcctatttcttttttaattaatgaagatgatgaatccattgaggttgattttttttcttattatgttgctttttctacaatatataaagttattattataaaaaataaggatttaaatataggttatttttctattttaaaatctataattggtaccttaaaagtatga

SEQ ID NO: 6528 - protein, 146 aa, Unknown
  Obtained from environmental sample
  DOMAIN (25)...(84): Ribosomal protein L11, N-terminal domain
  misc_feature (1)..(146): Xaa is any amino acid
MRLLEYAFTGSEKKKKNSDLEVLRKVRILIPTQGATVAPPLGPTLGQFGLNIKDFCDKFNERTKNYDNDFIVTTWLTLYSNKTLIFYIKTPPISFLINEDDESIEVDFFSYYVAFSTIYKVIIIKNKDLNIGYFSILKSIIGTLKV

SEQ ID NO: 6529 - DNA, 753 bp, Unknown
  Obtained from environmental sample
  misc_feature (1)..(753): n is a, c, g, or t
atgaataaaaaaattgcggttgtgttattgaatctaggtggaccagatgaccaatcagcagtgcagaattttttgttcaatctgttttacgataaggcaataatttcacttcccaatcccttccgattttttctcgcaaaattcatttcttcaaaacgtgctcccatcgcaaaacatatttaccaacagatcggtggtggctcgccaattttagctgagactaaaaaacaagccgatgcgttggaaaaaaaactcaatgaaaatagcgtcgataaatacaagctatttatctcgatgcgctattggcatcctttctcgagtgaggccttgagtgaggtaaaaaaatatcatcctgacgaagttattttacttccgctttacccacaattttccgcttccaccacttggtcatcgattgaagattggaaaaaaaatgctgaaaaactaaagataaattatccgatcaaaaccatctgctgctatccgagcaatgaaaaatttatcgcggctcatgtggctcttattgaaaaatcaaaagtaaaaatccctgaccaatctaaagtaagaatcttattttctgcgcatggattgcccaagaaaaacattgtggctggtgatccatatcagcatcaaattgagaagactgtggagcagatagtaaaaaaactatccataaaaaatctcgattttgtaatttgctatcagtcgaaagtggggcggctccaatggttaggggccagcactgacgaatga

SEQ ID NO: 6530 - protein, 250 aa, Unknown
  Obtained from environmental sample
  DOMAIN (4)...(250): Ferrochelatase
  misc_feature (1)..(250): Xaa is any amino acid
MNKKIAVVLLNLGGPDDQSAVQNFLFNLFYDKAIISLPNPFRFFLAKFISSKRAPIAKHIYQQIGGGSPILAETKKQADALEKKLNENSVDKYKLFISMRYWHPFSSEALSEVKKYHPDEVILLPLYPQFSASTTWSSIEDWKKNAEKLKINYPIKTICCYPSNEKFIAAHVALIEKSKVKIPDQSKVRILFSAHGLPKKNIVAGDPYQHQIEKTVEQIVKKLSIKNLDFVICYQSKVGRLQWLGASTDE

SEQ ID NO: 6531 - DNA, 450 bp, Unknown
  Obtained from environmental sample
  misc_feature (1)..(450): n is a, c, g, or t
atggttaacaggaaaaaaagtacaaaaaaaattctgacttacttctttttattaattattattgttgcagttttgtttatcgcatacaaaaacggtaaaatttttatctatattccggaaacggacacacctctnttgtccccaaccccaagtcctcaagttagtctagaaacatataccaactccaatcccgactttcaattcaaatatccgaaaacattttacgaatgtgaaaagctgaacatttctgaaanatggataatgaatggtagcgcaaacggaataaatatttattgtaaaaaaaatctaaacttgacacagattatttatcaaaaatctcaaaaagaaattttggaatgttggtatagcctgctaccccgacacaaacctttttttgaacatacggagaactcaaagattagttgtggctggagtaaagctaangaataa

SEQ ID NO: 6532 - protein, 149 aa, Unknown
  Obtained from environmental sample
  misc_feature (1)..(149): Xaa is any amino acid
MVNRKKSTKKILTYFFLLIIIVAVLFIAYKNGKIFIYIPETDTPLLSPTPSPQVSLETYTNSNPDFQFKYPKTFYECEKLNISEXWIMNGSANGINIYCKKNLNLTQIIYQKSQKEILECWYSLLPRHKPFFEHTENSKISCGWSKAXE

SEQ ID NO: 6533 - DNA, 351 bp, Unknown
  Obtained from environmental sample
  misc_feature (1)..(351): n is a, c, g, or t
gtggttaagaaccactgcatgatgaagtttcgcaaggaagccagcgatggcaagaaacgcgagcaatgggagaaagattcgcaacaggttgtggaatcagcctcgtcggagcatctaaaagaagcagaagacaaagagttcattttgcaaaatctgcatgaaggtattggagaattgaaagaagagcagcgcacctgcatcgaattattttacatgaagaattgcagttatgcggagatcacggccatcaccggatacagcaccagcgaagtgaagagctatatccaaaacgggaagcgaaacctgaaaaatataatcaagcaaaaaaatgaccgcgcacaggaaggataa

SEQ ID NO: 6534 - protein, 116 aa, Unknown
  Obtained from environmental sample
  DOMAIN (55)...(104): Sigma-70, region 4
  misc_feature (1)..(116): Xaa is any amino acid
MVKNHCMMKFRKEASDGKKREQWEKDSQQVVESASSEHLKEAEDKEFILQNLHEGIGELKEEQRTCIELFYMKNCSYAEITAITGYSTSEVKSYIQNGKRNLKNIIKQKNDRAQEG

SEQ ID NO: 6535 - DNA, 450 bp, Unknown
  Obtained from environmental sample
  misc_feature (1)..(450): n is a, c, g, or t
ttgccttgggcgagaatgaaatacgttcgtaaactggtggaattacatttgcgaccaattagtttaaccaatgaaaatattacggattctgccattcgacgtttattgtttgatgccggccaggatattgacgacctgatgatcctttgtgaaagtgacatcacctccaaaaacaaactaaaggttaagcgttacctggccaattttgaaatggtacgtgaaagatgcaaagaagtggaagaaaaagaccacatccgtaactggcaaccgcccatcaccggaaatatcatcatggaagtatttggaattcctccttcaaagcccgttggcattatcaaggacgcaatcaaggatgcaattttggatggaatcattaccaacgactacgaaacggcgtatcaatatatgctggaaaaaggtaaggaatgcggcctaaagcctgttcactga

SEQ ID NO: 6536 - protein, 149 aa, Unknown
  Obtained from environmental sample
  misc_feature (1)..(149): Xaa is any amino acid
MPWARMKYVRKLVELHLRPISLTNENITDSAIRRLLFDAGQDIDDLMILCESDITSKNKLKVKRYLANFEMVRERCKEVEEKDHIRNWQPPITGNIIMEVFGIPPSKPVGIIKDAIKDAILDGIITNDYETAYQYMLEKGKECGLKPVH

SEQ ID NO: 6537 - DNA, 405 bp, Unknown
  Obtained from environmental sample
  misc_feature (1)..(405): n is a, c, g, or t
ttgacgtttaaccaaccgtacagattcatggccattttgaaattcagaatttatttggaagaagatgatagcgtttacagggatgttgtgatccggcatacccaaagttttcaggaattacatgaaacaatactgaaggcatttgagtttgatagcaaacaccaggcaactttttatcgaagcaatgacaactggcaaaggggcagggaaatttcattagagaaatatgacagggcttacaaagctcctccattattaatgaagganacaaccatcggttccgaaataaaagatccaaatcaaaaatttatctacgtttatgattttgccaagaactggacttttttagtggaactgataaacgtttcaaaggaagaaaatcaaaactcacctatccttctatga

SEQ ID NO: 6538 - protein, 134 aa, Unknown
  Obtained from environmental sample
  misc_feature (1)..(134): Xaa is any amino acid
MTFNQPYRFMAILKFRIYLEEDDSVYRDVVIRHTQSFQELHETILKAFEFDSKHQATFYRSNDNWQRGREISLEKYDRAYKAPPLLMKXTTIGSEIKDPNQKFIYVYDFAKNWTFLVELINVSKEENQNSPILL

SEQ ID NO: 6539 - DNA, 438 bp, Unknown
  Obtained from environmental sample
  misc_feature (1)..(438): n is a, c, g, or t
atgattaagaatggctttgaaatcatagattatggcagtgaacaatatcggcagatgttaaagcttcgagatgatattttacgcaaaccattaggattgaattttaaaaaagaggaattagaaaaagaaaaagattatttgcttataggcgcatttgaggaggataaaatgttagcgtgttgtatgttggtggaagaaaactcaaaaacggtaaggttgcggcagatggctgtactcaatgatttacaaggaaaaggcattggaaaagccctgatgatttttgcagaaaacctggcccgcgacagaggctataaaaaaataactatgcatgcccgtaaaattgctactggcttttatgaaaaactgggttatgtaaaagttgggcatgaattccaggaaattacgattccacattatttaatggagaagaagttataa

SEQ ID NO: 6540 - protein, 145 aa, Unknown
  Obtained from environmental sample
  DOMAIN (49)...(125): Acetyltransferase (GNAT) family
  misc_feature (1)..(145): Xaa is any amino acid
MIKNGFEIIDYGSEQYRQMLKLRDDILRKPLGLNFKKEELEKEKDYLLIGAFEEDKMLACCMLVEENSKTVRLRQMAVLNDLQGKGIGKALMIFAENLARDRGYKKITMHARKIATGFYEKLGYVKVGHEFQEITIPHYLMEKKL

SEQ ID NO: 6541 - DNA, 645 bp, Unknown
  Obtained from environmental sample
  misc_feature (1)..(645): n is a, c, g, or t
gtggagcagttcccgatcctcctggaccactttatccgcacaaaggaagacactgccaacgaagcgcatcgggtcagcaagaagaaggtggccgagacccaagagcagttcgtcgacgaagtgtcccggctggtgcgggagcatttggaaggaacggccttctacgccggtggcaactcgttcaccgagagcttgggacgggtcaactttttgaaagacgtcatcgagcacaaggatggctggcggattttctacattaacggcaagccgatcacgcaggaggctcacctgcaactcctctatcgcctgacctggttcgcatcgcggatggacgtcaaccgtgaggtcaacaacggccggggtccggtggactacaagatctcggaaggcaacgccgacaagacgctggtggaattcaagctcgcacggaacaccaagctgaaaatgaacctgcagaaccaggtgcagatctacgaaaaggccaacaacacgtcgtcgtccatcacggtgatcctctacttcaccgatagcgagtgggcgaaggtaaaaaaaatactgcaggacctgaacatcgacaagagcaagaacatcgtcctgatcgatggccgctccaccaacaaaccctctgcgtcgaccgtgaagtag

SEQ ID NO: 6542 - protein, 214 aa, Unknown
  Obtained from environmental sample
  misc_feature (1)..(214): Xaa is any amino acid
MEQFPILLDHFIRTKEDTANEAHRVSKKKVAETQEQFVDEVSRLVREHLEGTAFYAGGNSFTESLGRVNFLKDVIEHKDGWRIFYINGKPITQEAHLQLLYRLTWFASRMDVNREVNNGRGPVDYKISEGNADKTLVEFKLARNTKLKMNLQNQVQIYEKANNTSSSITVILYFTDSEWAKVKKILQDLNIDKSKNIVLIDGRSTNKPSASTVK

SEQ ID NO: 6543 - DNA, 474 bp, Unknown; identical to SEQ ID NO: 665
  Obtained from environmental sample
  misc_feature (1)..(474): n is a, c, g, or t

SEQ ID NO: 6544 - protein, 157 aa, Unknown; identical to SEQ ID NO: 666
  Obtained from environmental sample
  misc_feature (1)..(157): Xaa is any amino acid

SEQ ID NO: 6545 - DNA, 369 bp, Unknown
  Obtained from environmental sample
  misc_feature (1)..(369): n is a, c, g, or t
atgaatgcagcattattcagaaatgcctatagctacaaacctcagtctacggtcgcagagttgttaaatcgcggaatgattaaggttgtcaacgatccacggcttggcaaagatggctttgacattcggtgtatgacaactgttcacgattcattcgtatttaagtttcacaaaagccagattccaaacttgcttcaaatcttgttaatcatcaaagatcatatgactcacacatttacttataaaggaaaaagtttcactatcggattggacgctaagattggcacaagttgggctggaaatactgctgaaataagtaactttacacaagaagaaatagataaagctttaaataaaataggatattaa

SEQ ID NO: 6546 - protein, 122 aa, Unknown
  Obtained from environmental sample
  misc_feature (1)..(122): Xaa is any amino acid
MNAALFRNAYSYKPQSTVAELLNRGMIKVVNDPRLGKDGFDIRCMTTVHDSFVFKFHKSQIPNLLQILLIIKDHMTHTFTYKGKSFTIGLDAKIGTSWAGNTAEISNFTQEEIDKALNKIGY

SEQ ID NO: 6547 - DNA, 402 bp, Unknown
  Obtained from environmental sample
  misc_feature (1)..(402): n is a, c, g, or t
ttgttcggacgacctcgtaggttcttaggtgaaatgaatgcagcattattcagaaatgcctatagctacaaacctcagtctacggtcgcagagttgttaaatcgcggaatgattaaggttgtcaacgatccacggcttggcaaagatggctttgacattcggtgtatgacaactgttcacgattcattcgtatttaagtttcacaaaagccagattccaaacttgcttcaaatcttgttaatcatcaaagatcatatgactcacacatttacttataaaggaaaaagtttcactatcggattggacgctaagattggcacaagttgggctggaaatactgctgaaataagtaactttacacaagaagaaatagataaagctttaaataaaataggatattaa

SEQ ID NO: 6548 - protein, 133 aa, Unknown
  Obtained from environmental sample
  misc_feature (1)..(133): Xaa is any amino acid
MFGRPRRFLGEMNAALFRNAYSYKPQSTVAELLNRGMIKVVNDPRLGKDGFDIRCMTTVHDSFVFKFHKSQIPNLLQILLIIKDHMTHTFTYKGKSFTIGLDAKIGTSWAGNTAEISNFTQEEIDKALNKIGY

SEQ ID NO: 6549 - DNA, 702 bp, Unknown
  Obtained from environmental sample
  misc_feature (1)..(702): n is a, c, g, or t
atgttatgtgggattgtttatcctgatccattgttagctctaaaaagcagttacagatcaacgcaaaatcacctttgggcaggaatggcaaaagaaacagcacaccagctgggcacacctgtttcttccctggaaggttgggtagagattttaaaagaaacacacaaagatgaaagttttgtacccgaaatagaaaaagatgtcacaaggcttaggctggtgtcggaccgttttggaaaaattggaagcacaccgcagctggaagaaaaaaatattattgagcaggtacagcacatgatggaatatatacgtaaaagagccggtggcaaagtaagttttaacttgattacacataacgttcacctgatcccggtaaagatctctgccccgctttttgactgggtgattgaaaaccttttaaaaaatgccttggatgccatggagggcaaaggttccattgttattgatataaaaaactatgctgataacgtggtaatagatgtgacagataccggtaaaggcattcggaaagaaaatatctccagggttttcaaacccggttttaccacaaaaaaacgtggttggggcctgggacttagtttatcaaaacgcattattgaacaatatcacaaaggaagtttaacggtaaaaaattcagagccggggaaaggcacaacttttcgaattgttttaagaaaataa

SEQ ID NO: 6550 - protein, 233 aa, Unknown
  Obtained from environmental sample
  DOMAIN (127)...(233): Histidine kinase-, DNA gyrase B-, and HSP90-like ATPase
  misc_feature (1)..(233): Xaa is any amino acid
MLCGIVYPDPLLALKSSYRSTQNHLWAGMAKETAHQLGTPVSSLEGWVEILKETHKDESFVPEIEKDVTRLRLVSDRFGKIGSTPQLEEKNIIEQVQHMMEYIRKRAGGKVSFNLITHNVHLIPVKISAPLFDWVIENLLKNALDAMEGKGSIVIDIKNYADNVVIDVTDTGKGIRKENISRVFKPGFTTKKRGWGLGLSLSKRIIEQYHKGSLTVKNSEPGKGTTFRIVLRK

SEQ ID NO: 6551 - DNA, 471 bp, Unknown; identical to SEQ ID NO: 719
  Obtained from environmental sample
  misc_feature (1)..(471): n is a, c, g, or t

SEQ ID NO: 6552 - protein, 156 aa, Unknown; identical to SEQ ID NO: 720
  Obtained from environmental sample
  misc_feature (1)..(156): Xaa is any amino acid

SEQ ID NO: 6553 - DNA, 771 bp, Unknown
  Obtained from environmental sample
  misc_feature (1)..(771): n is a, c, g, or t
atgcttgactctattttgaaagacgatcctgataaaatatcatcatatgaacctgtgtatcgacaatatggtttgcttaaaaaatacctgcagaaatatcgtgtacacgaaagtgaagaaggatggccaatatcgtcatcaggcattaaagaacttaggtatggagatacatccaatattatttctgaaataaaaaaacaactttacctgtttgaagatttggaagtaaagaattctacaaatgtattcgacgaggaaatggaatccgcagtgaagatttttcaaaagcgtcacggattaaaggaagatggtataattacaggtacaaccctgactgcgatgtcagtatccgtacatgaacgcatgcagcagatattaatcaacatggagcgttgcaggtgggtaccagctgaacagagaggagattacctggtcgtaaatatcccagcctttaaattgttcgtgtataccaacgatgtgttagattggagttgtaacgtaattgtcggcaaatcaaaagcaactaacaatactataatcttcaatgagaatttagagtacatcgtttttagtccttattggaatattcctaanaatattttaatcaaagagacgctgaaggaaattaagagggacccggaatacctggggaggcatgatatggaggttgtcgatgccaaggagcatatcattcctgtatcttcaatcgaatggagcaaatacacaaaatcattttcatatatcatccgccaaacggccgggagacaataa

SEQ ID NO: 6554 - protein, 256 aa, Unknown
  Obtained from environmental sample
  DOMAIN (57)...(118): Putative peptidoglycan binding domain
  misc_feature (1)..(256): Xaa is any amino acid
MLDSILKDDPDKISSYEPVYRQYGLLKKYLQKYRVHESEEGWPISSSGIKELRYGDTSNIISEIKKQLYLFEDLEVKNSTNVFDEEMESAVKIFQKRHGLKEDGIITGTTLTAMSVSVHERMQQILINMERCRWVPAEQRGDYLVVNIPAFKLFVYTNDVLDWSCNVIVGKSKATNNTIIFNENLEYIVFSPYWNIPXNILIKETLKEIKRDPEYLGRHDMEVVDAKEHIIPVSSIEWSKYTKSFSYIIRQTAGRQ

SEQ ID NO: 6555 - DNA, 459 bp, Unknown
  Obtained from environmental sample
  misc_feature (1)..(459): n is a, c, g, or t
atgagtttgttttcatttttcaaaaaggatttttttactgaagaagaaaaacttcagatcattgaagctgttcgcaatgcagaaagaatgacaagtggcgaagtgagggtattcgttgaaaaccgctgcagctacatggatgccatcgaccgggcaaaagaaatatttgctgaattgaaaatgaatgaaactgatgataagaatgccgtgctcgtgtatgttgctttgaaagataaacaactagctatttttggtgatgaaggaattcatagcaaattgggccatgaatactggaacactgaagtaaaaaaaatgatagacagttttaataaagaaaactatgccgaagggataaaacaagtggtagaagatattggtgaggcgctgacacacctttttccttacaataatgatactgataaaaatgaattgccggatgatattgtattcggtaaataa

SEQ ID NO: 6556 - protein, 152 aa, Unknown
  Obtained from environmental sample
  DOMAIN (10)...(132): Domain of unknown function (DUF477)
  misc_feature (1)..(152): Xaa is any amino acid
MSLFSFFKKDFFTEEEKLQIIEAVRNAERMTSGEVRVFVENRCSYMDAIDRAKEIFAELKMNETDDKNAVLVYVALKDKQLAIFGDEGIHSKLGHEYWNTEVKKMIDSFNKENYAEGIKQVVEDIGEALTHLFPYNNDTDKNELPDDIVFGK

SEQ ID NO: 6557 - DNA, 723 bp, Unknown
  Obtained from environmental sample
  misc_feature (1)..(723): n is a, c, g, or t
atgactaagtttataatttttactgataatgacaatgcgtgttttnccttgagaaatcctttcagggtattgaaggatggaaatgcctttggtaatataggtagaccagtcggtgtcatttcatataaagaagtcatgatgcttctgaatcctattttgtttatgatgaaattcaaggattatgatatacttattcttgctgataaagtgtttactgatactagtcaatatgtaaaatatataaaggcatttgccaatggcgaacaagacatttatgttcttttacataaaggcagtgtcgaccaaaaagatgttgagcgaaaaaagtatcaaatcgaattaattaaaactgcccttggtgaagattttgaaaactttgaagaacaaaatcactcatcttcttcgatatactggaatgaccttttagaaattgctaaagctatttcagaaaaatcgaaagatgagcatacttatcataagcttttatcaaatctcaagttgaaattccctgatcgatataaagaagccgaaatcaatttgaggatttcgttacgaattttatgcagaaaaattcaatcaagaataattaatagtgagaacgaatttatagaagaaattgctttattgaagcaaagcgcgaaattaaagttggttgtgagtgatattgataaaatcaagtatgaaagttttcggactgaatgtttatcaactcaaactatataa

SEQ ID NO: 6558 - protein, 240 aa, Unknown
  Obtained from environmental sample
  misc_feature (1)..(240): Xaa is any amino acid
MTKFIIFTDNDNACFXLRNPFRVLKDGNAFGNIGRPVGVISYKEVMMLLNPILFMMKFKDYDILILADKVFTDTSQYVKYIKAFANGEQDIYVLLHKGSVDQKDVERKKYQIELIKTALGEDFENFEEQNHSSSSIYWNDLLEIAKAISEKSKDEHTYHKLLSNLKLKFPDRYKEAEINLRISLRILCRKIQSRIINSENEFIEEIALLKQSAKLKLVVSDIDKIKYESFRTECLSTQTI

SEQ ID NO: 6559 - DNA, 996 bp, Unknown
  Obtained from environmental sample
  misc_feature (1)..(996): n is a, c, g, or t
ttggatactaatacacttgaaggcgacttagatgcaattataaaaacactgttcaccaagtccttatccttatactatttgccaaagttttttattcaaccagatgaagacaaagcgaatattacaatattaccagattttaaatcacacattcgctataaagaagtaaaggcggaattcaataattatgtggaaatatttaattcagcgattaaatataatacagagaaaattaattacagacctctatctaaaattaaaggcgataataacacatttgttcaaaatttatcactatccaatgttgattatgaacttgtaaaagatagaagtgaaaagtttcacagaaatgatcctcttccgaaccatcttttacttcatcatttgtatgatgagagattatacaaaaacaaaaatgataattacaaaacaattttaatttcaattccaatgttgggtgcacctttttttacatccacaaatcaattcaatggacagggggcgctttttctttactttgttactgataaacaaattgacgagtccttccgaataaggattaattcacttgtaaaaagcatttctgaaacgaacaaaaatttaacctacaactatttgttcgatgtgggttacagatttgcgaaagaggccaaaagaaattcaataaaagctgctatctcgcaagtaatagatagacagatgtcacacaacattaattctcatgtcttggcaaatcttgttactaaagacgatttacagccggcactgattagaccgtttctaaagtacttacaaaccaggattgaatttattgcagatatagtaacaacagaaccactcataacgtttcctttctcattaaaggatgatattctaagccgatttattaataatgaggaaggtaaccctgaccaaaacgatataacgaaaaaaaagccagaatatctgctcaaaatatcagtgaatccagccgaagtacttatgagatgcaaatga

SEQ ID NO: 6560 - protein, 331 aa, Unknown
  Obtained from environmental sample
  misc_feature (1)..(331): Xaa is any amino acid
MDTNTLEGDLDAIIKTLFTKSLSLYYLPKFFIQPDEDKANITILPDFKSHIRYKEVKAEFNNYVEIFNSAIKYNTEKINYRPLSKIKGDNNTFVQNLSLSNVDYELVKDRSEKFHRNDPLPNHLLLHHLYDERLYKNKNDNYKTILISIPMLGAPFFTSTNQFNGQGALFLYFVTDKQIDESFRIRINSLVKSISETNKNLTYNYLFDVGYRFAKEAKRNSIKAAISQVIDRQMSHNINSHVLANLVTKDDLQPALIRPFLKYLQTRIEFIADIVTTEPLITFPFSLKDDILSRFINNEEGNPDQNDITKKKPEYLLKISVNPAEVLMRCK

SEQ ID NO: 6561 - DNA, 309 bp, Unknown
  Obtained from environmental sample
  misc_feature (1)..(309): n is a, c, g, or t
ttggaggaaactttagtttccagatttatttttggaaagatattattttcattttttgtcggagaaaatatgtctaagtattgcatttccaaatacatatttgataacgatttgtgcgcaatacaagctgtgaaagatggtgctggtgttggtatattgccaaagtttgcgctcgaggaagctgaagagttattgattttngatgttgaaactgagctgaagccttttagcatgtatgtcaccaattctggcaataaaaaaaacagctacgtcgatttggttgccgattatttgaagtatgcgttataa

SEQ ID NO: 6562 - protein, 102 aa, Unknown
  Obtained from environmental sample
  misc_feature (1)..(102): Xaa is any amino acid
MEETLVSRFIFGKILFSFFVGENMSKYCISKYIFDNDLCAIQAVKDGAGVGILPKFALEEAEELLIXDVETELKPFSMYVTNSGNKKNSYVDLVADYLKYAL

SEQ ID NO: 6563 - DNA, 777 bp, Unknown
  Obtained from environmental sample
  misc_feature (1)..(777): n is a, c, g, or t
ttgactgatatatgtgggagagctccttgtgcctcttcattatggttgcatgagcaaaaacaagcagcaatatctaagcaagagctattagattataatcctgatttcgacggaacattgtatgttgatggggattggatcaagaaagggtggaaaaagaagtttgaaactctgatcggaagagagattacattaaaagaatggaaaaagatgcgatatcaatccgtttatgttatagccacaaaagaaaaagtaattttggattttgaggttactgacagggtaccaacaattgaagctcttattcctcttttccttcgaataaaagaccgatttccagaaggcaaaatacaaaagattgtttctgatgaagataaagcgatcattggagctgtaaaaagcgtttttcctgaagtgattcactctttttgtgtatttcatcaattgaaaaacgttagcaagaaatatagtgatgaatttgaatctgtaaaaaacattccaatgaatgataaacttgtgtacaatgagatctgtcaattaatacagtctgatacggtcattaattctgttgtgtgttttcaaaatatcctaaacatggcctctaatcttgaactttcaaaagcatctcatanagcgatttcttatgcaaaagagattttcgataagaacataagctatttgaaaaaaggatttacaccagagacggataatacaatggaacagatattttctttgataggagatattgtagacaaagcaagatcatttcaaaactga

SEQ ID NO: 6564 - protein, 258 aa, Unknown
  Obtained from environmental sample
  misc_feature (1)..(258): Xaa is any amino acid
MTDICGRAPCASSLWLHEQKQAAISKQELLDYNPDFDGTLYVDGDWIKKGWKKKFETLIGREITLKEWKKMRYQSVYVIATKEKVILDFEVTDRVPTIEALIPLFLRIKDRFPEGKIQKIVSDEDKAIIGAVKSVFPEVIHSFCVFHQLKNVSKKYSDEFESVKNIPMNDKLVYNEICQLIQSDTVINSVVCFQNILNMASNLELSKASHXAISYAKEIFDKNISYLKKGFTPETDNTMEQIFSLIGDIVDKARSFQN

SEQ ID NO: 6565 - DNA, 312 bp, Unknown
  Obtained from environmental sample
  misc_feature (1)..(312): n is a, c, g, or t
atgaaggattacgatagtgtcattatttggttagattatttcaacaagaatttgtctagagaaaaaggaagaaaagtgtctaaatcccttgctgtttatgacccgcttgtttcagagttggttagtgccgttgaatcactaggacatagtgttgacaaagatcaaattaatgaaggtgcacgttttccaaagcgatctcatattaaatccgggtacattatgatagaaaaaaaaggtttaaaaaaaaattccttggtaaagggtatttccgaaaaaatagtggtaaatagagcgaaatcaaagggtagatag

SEQ ID NO: 6566 - protein, 103 aa, Unknown
  Obtained from environmental sample
  DOMAIN (7)...(97): SRP19 protein
  misc_feature (1)..(103): Xaa is any amino acid
MKDYDSVIIWLDYFNKNLSREKGRKVSKSLAVYDPLVSELVSAVESLGHSVDKDQINEGARFPKRSHIKSGYIMIEKKGLKKNSLVKGISEKIVVNRAKSKGR

SEQ ID NO: 6567 - DNA, 852 bp, Unknown
  Obtained from environmental sample
  misc_feature (1)..(852): n is a, c, g, or t
ttgctatttaaaaacggtttcgtcggcatgataattccaaatacgtggttaacaaacctaacacagacaaaaattcgtaactaccttgtttgtaaaacaaatatcaatgagatagttcatttcagacagaaggtattcaaaaaagtcaccgttgatacagaaatagtcatttttaaaaatagttttaataataactgccaaacaaaagtttctgtagttaactcgatagattcctttgtaaatggaatagatgactctgaagttaaatacataattcatgatcaaactaaatggtgcagcttgaatggcggagttatcaatgttttcctagatcaatttgaggaacagcttgccgcaaaatgttcggatatttccttaccaataaaatctatctgtttaaccaatgtcggaattaaaccatatcaagttggcaaaggaatacctccacaaacaaaggatactgtaacaaataggatatttgacagcaaaatactaaaaagcaatgaatacaaacaatatttacgtggaaaggatataaataaatatataatttcacctcttgaagaaagatatataaaattcggtccgtggttagcagagccaagaccagccattgattttaatagtcctgaaaagcttttgttgcgacaaactggtgacagtcttatagcaactcttgatacaagttgttatctttgcctaaacaatctccatgtgataattatcanagaaaaatcatataatattcgatatttactcggaatcatcaactcgaggttactttattggtattatcacacaatgaaccctgaagttggtgaagcgttagcagaagttaaaagactaatgtag

SEQ ID NO: 6568 - protein, 283 aa, Unknown
  Obtained from environmental sample
  misc_feature (1)..(283): Xaa is any amino acid
MLFKNGFVGMIIPNTWLTNLTQTKIRNYLVCKTNINEIVHFRQKVFKKVTVDTEIVIFKNSFNNNCQTKVSVVNSIDSFVNGIDDSEVKYIIHDQTKWCSLNGGVINVFLDQFEEQLAAKCSDISLPIKSICLTNVGIKPYQVGKGIPPQTKDTVTNRIFDSKILKSNEYKQYLRGKDINKYIISPLEERYIKFGPWLAEPRPAIDFNSPEKLLLRQTGDSLIATLDTSCYLCLNNLHVIIIXEKSYNIRYLLGIINSRLLYWYYHTMNPEVGEALAEVKRLM

SEQ ID NO: 6569 - DNA, 495 bp, Unknown
  Obtained from environmental sample
  misc_feature (1)..(495): n is a, c, g, or t
gtgatgttttttgcttcgttgtttgagagcagagtgaacaaactggttgttgctgacattgcacacagatattatcctccccatcatgaatcaattttatctgcattaaaatcgctcaatccttctcagttgagttcgagaaaggaagcggaagaactactgcgtatttctattcacgatgaaggaacgattcaatttctcctgaagaatctttattggaaagatgataaaacgctgggatggcgtttcggcctgaatgaaatcgaacgtaatatcgatatggtaggagaagcattgccggtaaaaaagatttcagttccaactctttttctcaaaggtgaaaagtccggatatattactgctgaggatgaagtcatgatcagacagattttcactaatgtaaaaatcgatacaatcagcggtgcaggacattgggttcatgctgaaaatccaaaagagtttctgagtaaaacggtagaatttttaaaggcctga

SEQ ID NO: 6570 - protein, 164 aa, Unknown
  Obtained from environmental sample
  misc_feature (1)..(164): Xaa is any amino acid
MMFFASLFESRVNKLVVADIAHRYYPPHHESILSALKSLNPSQLSSRKEAEELLRISIHDEGTIQFLLKNLYWKDDKTLGWRFGLNEIERNIDMVGEALPVKKISVPTLFLKGEKSGYITAEDEVMIRQIFTNVKIDTISGAGHWVHAENPKEFLSKTVEFLKA

SEQ ID NO: 6571 - DNA, 591 bp, Unknown
  Obtained from environmental sample
  misc_feature (1)..(591): n is a, c, g, or t
atgatatttccatcctggtttctcgacatccagatgcccgagataacgggtatggaatttttaaaatcgctgaaaaatccaccctgcgtgattttcactaccgcttattctgaatacgcagtggatggatttaaccatgacgctatcgattacctgctgaagccaatctcatttgaccgctttctgaaagcaacgaacaaagccatcaccacgcttacacagggcaagcagccgaaagaatctgcagtagtgaaaaccgaaaacgagagcgacttcatctttgtaaaatccgacaagaagattgtgaaaatcgggctcgatgaaatcctctacatcgaaggattgaaagactacgtgatgatttttacgcccacaggcagagtgatcaccctgcaaacaatgaaaaacctggaggaaaaactgccttcggataaatttatccgcatccaccgctctttcatcatctcactgaacagggtaaaaagcatcaccggcaatgctgttgacatcaacggaaaactcatccctatcggcaagctctaccgcgacccgtttatgaaggtggtagaaaaagatagcctcattaaatag

SEQ ID NO: 6572 - protein, 196 aa, Unknown
  Obtained from environmental sample
  DOMAIN (99)...(190): LytTr DNA-binding domain
  misc_feature (1)..(196): Xaa is any amino acid
MIFPSWFLDIQMPEITGMEFLKSLKNPPCVIFTTAYSEYAVDGFNHDAIDYLLKPISFDRFLKATNKAITTLTQGKQPKESAVVKTENESDFIFVKSDKKIVKIGLDEILYIEGLKDYVMIFTPTGRVITLQTMKNLEEKLPSDKFIRIHRSFIISLNRVKSITGNAVDINGKLIPIGKLYRDPFMKVVEKDSLIK

SEQ ID NO: 6573 - DNA, 612 bp, Unknown
  Obtained from environmental sample
  misc_feature (1)..(612): n is a, c, g, or t
atgcggcgaaaaagagtatttatcggaataaacgacgtttcgggattttcgataagattcaagaacggttttaacaaaattggtgttgatgcggatttttactcgcctgcagggcacatttatggattcaagactgataaactgatcaagtattcaaaaaacagttttatcaggaagattcagaaaatttcgcttcttgcaaaaatgatactgaagtatgattacttcctttacatatctccttcatcgatcctgaaggactttcaggatataaagctgttaagaaagttcgggaagacgacaatgatgctttttacaggttgtgacctgagaatacctgaaaaaatctctcattacaaatggaatccgtgcagcgggtgcacaccggaatacaaggaattcgtaaaatgcgtgattgatacgaaaaaaataatgatacggcatcttgaaaatacttttgatataatcggggctccttttgaagcagcaggttatcttgagaaaaaatatttcaatgcaattttcccttttgatatggatgaattcgataagtataaagaccgggcttattcaccttcaaagcctttgaagatatttcatgcgccatcntaa

SEQ ID NO: 6574 - protein, 203 aa, Unknown
  Obtained from environmental sample
  misc_feature (1)..(203): Xaa is any amino acid
MRRKRVFIGINDVSGFSIRFKNGFNKIGVDADFYSPAGHIYGFKTDKLIKYSKNSFIRKIQKISLLAKMILKYDYFLYISPSSILKDFQDIKLLRKFGKTTMMLFTGCDLRIPEKISHYKWNPCSGCTPEYKEFVKCVIDTKKIMIRHLENTFDIIGAPFEAAGYLEKKYFNAIFPFDMDEFDKYKDRAYSPSKPLKIFHAPS

SEQ ID NO: 6575 - DNA, 315 bp, Unknown
  Obtained from environmental sample
  misc_feature (1)..(315): n is a, c, g, or t
atgaatacacagaattttaaaaaggtgacagctgatgggctggatatttttttccgggaagccggtgataaaaacaaattggctaaaatcacaaaaacgcatttcaataaaacgctgacaaatctaattactgaacgacttctcattgaagccaaaagggaattgtaccttaccaacaaatcaataaaagaagtagcttatgagttaggttatgacgatgaatactatttcagtcgcttttttaaaaagaatgtaaacatctcgccccagatttatcgcgaaacagtgggttttggaaaagcagaaattaattaa

SEQ ID NO: 6576 - protein, 104 aa, Unknown
  Obtained from environmental sample
  DOMAIN (50)...(94): Bacterial regulatory helix-turn-helix proteins, AraC family
  misc_feature (1)..(104): Xaa is any amino acid
MNTQNFKKVTADGLDIFFREAGDKNKLAKITKTHFNKTLTNLITERLLIEAKRELYLTNKSIKEVAYELGYDDEYYFSRFFKKNVNISPQIYRETVGFGKAEIN

SEQ ID NO: 6577 - DNA, 390 bp, Unknown
  Obtained from environmental sample
  misc_feature (1)..(390): n is a, c, g, or t
ttggctctccgaagcacaggaacgcatggtgctagcagtctcaccgggaaatatcgcggctctgcaaaaatatgcgacacctttgatactgagttaacagacatcggtaagttcacgggtgatggacggcttgntgttcgctatgatgcgagtgtcgttgtgagtatgataatggaatcctgcataaagggaatcccccaaagagaactgaaagccgatatcaagaaaccgaatatccagaaatccaatctcgattaccccgtatcgaatatcaaagacaattggtccttccccttccttccccaaaaatcccaggaaaagttcccgttattcctatcctacaaccaccaaattccaggggggccgggttttcaaaccatgaccgggatt

SEQ ID NO: 6578 - protein, 130 aa, Unknown
  Obtained from environmental sample
  misc_feature (1)..(130): Xaa is any amino acid
MALRSTGTHGASSLTGKYRGSAKICDTFDTELTDIGKFTGDGRLXVRYDASVVVSMIMESCIKGIPQRELKADIKKPNIQKSNLDYPVSNIKDNWSFPFLPQKSQEKFPLFLSYNHQIPGGPGFQTMTGI

SEQ ID NO: 6579 - DNA, 639 bp, Unknown
  Obtained from environmental sample
  misc_feature (1)..(639): n is a, c, g, or t
ttgattgttgatggtgaagaagtcaggtcacataatttacaaattacttcgatgggctggctgtgcctggctgagatgtctcctatccctgtttattttaaaaaagaggattcacataaaaaggacaggattganatagacagagccattctcgctaattataatctccctttaaaccctgtacctcccaaaatcaggttcttcaaccagggagacctgggtgatctcatgaatgataattttgttttccagactacgctcaaaaatgatttcaatgaaggaagtaatacctgtcagtatgtagaagtattgatccaatgtaaagacgatataatcattatccctttatcagcaaaggcatgtgcgggagatttactgctgcgtgctgccgggatgtatttgccgagcaaaaaagctgatctgactggctttggagctgatcttaccaaatggaccacattaagggtagagacaaaagacaaaaaaatgagcttttatgtaaatgatgtattagcctcatcatttgtttttccaaatgatccaacgggtattgtaggcgtgcaatatcgcttcaatggcgtgggtgcggtccgtgaagcatggtttgagaataagagtggcagacgtgtgctgaaatag

SEQ ID NO: 6580 - protein, 212 aa, Unknown
  Obtained from environmental sample
  misc_feature (1)..(212): Xaa is any amino acid
MIVDGEEVRSHNLQITSMGWLCLAEMSPIPVYFKKEDSHKKDRIXIDRAILANYNLPLNPVPPKIRFFNQGDLGDLMNDNFVFQTTLKNDFNEGSNTCQYVEVLIQCKDDIIIIPLSAKACAGDLLLRAAGMYLPSKKADLTGFGADLTKWTTLRVETKDKKMSFYVNDVLASSFVFPNDPTGIVGVQYRFNGVGAVREAWFENKSGRRVLK

SEQ ID NO: 6581 - DNA, 666 bp, Unknown
  Obtained from environmental sample
  misc_feature (1)..(666): n is a, c, g, or t
gtggccgaacgtttaaaaagatggagagatcgtcacggaaataacatgcaccaattcatcattggcggtaatattggaaaaaataaagtgacccctaatgaggatgcctggaaggattacgagatctgcttcaaggaacttcatccatatgttgattatttcgttgtgaatgtaagcagccctaatactcccggtttgcgtgaactgcaggagaaagactcactccataagatcctgcgtcacctacagatgataaataacggcaaagcggtgtccaaaccgatccttctaaagattgcacccgatcttacacccgagcaggtggatgatgtagtagacctggctttggaaatccaattggatggactggtttgtgcgaacacaacgattagtcgcaacgctttggaaactcccaaagcagagatcgaaaaaatcggcgcgggcgggctgagcggaaaacctgtgaaagaacgggccactgaaattgtcaattatatccaccagcgtacaaaaggtgaaatccctattatagcttcaggaggtgtgtttaccggtgaagatgcgcgagaaaaatttaatagcggcgcatcccttgtgcaggtatggaccggttttatttatgaaggaccttctatcgtaaaaaggatctgtaaatccttactctaa

SEQ ID NO: 6582 - protein, 221 aa, Unknown
  Obtained from environmental sample
  DOMAIN (1)...(221): Dihydroorotate dehydrogenase
  misc_feature (1)..(221): Xaa is any amino acid
MAERLKRWRDRHGNNMHQFIIGGNIGKNKVTPNEDAWKDYEICFKELHPYVDYFVVNVSSPNTPGLRELQEKDSLHKILRHLQMINNGKAVSKPILLKIAPDLTPEQVDDVVDLALEIQLDGLVCANTTISRNALETPKAEIEKIGAGGLSGKPVKERATEIVNYIHQRTKGEIPIIASGGVFTGEDAREKFNSGASLVQVWTGFIYEGPSIVKRICKSLL

SEQ ID NO: 6583 - DNA, 399 bp, Unknown
  Obtained from environmental sample
  misc_feature (1)..(399): n is a, c, g, or t
ttgccagaactagcaaatcaatataaatacacctttttgtgtgacgacagctttgaaaaaattcgcccattagttagtagcgcaagaagcatctgcaccgatagtacaggcgtatacacatcaaagatgattagccaaatttttccagatatagccatcccatttgacacagcatcaaaatccataatgaaacagtgcggttataatcccaacgattatggaaatggaatgttaaaagaagaagttcttaattttatcaaacagaatcgattatcagcgagcaaatttaggtcttttgatgatgctccattaagtatttgggaaaattatccgcccctaaatggagaggtcacaacattcagccgagttattgacaaactattttatagccagaaatag

SEQ ID NO: 6584 - protein, 132 aa, Unknown
  Obtained from environmental sample
  misc_feature (1)..(132): Xaa is any amino acid
MPELANQYKYTFLCDDSFEKIRPLVSSARSICTDSTGVYTSKMISQIFPDIAIPFDTASKSIMKQCGYNPNDYGNGMLKEEVLNFIKQNRLSASKFRSFDDAPLSIWENYPPLNGEVTTFSRVIDKLFYSQK

SEQ ID NO: 6585 - DNA, 336 bp, Unknown
  Obtained from environmental sample
  misc_feature (1)..(336): n is a, c, g, or t
atggtcgagaaaatgggaattctgaaacgcggcggtagcaaagaaaaaatcgtagacgtacaatacggcgtaccagatctggtccaaaacgatttgcatatatcgcgggcggtagggaaccgagatcaaccaggtggtcaatactacgatcaggatgagatagaaataatacagcggaaagatccgcagcaagcgcctgccgtaaaacttaaggaagtactctctcgacgaaaatccctgcttcatatccagcaggataccggtaatgaggaaaccggagaggacgaaaaacaacgaaacccccacccagcccatttgaagatagtctgtgtgtaa

SEQ ID NO: 6586 - protein, 111 aa, Unknown
  Obtained from environmental sample
  misc_feature (1)..(111): Xaa is any amino acid
MVEKMGILKRGGSKEKIVDVQYGVPDLVQNDLHISRAVGNRDQPGGQYYDQDEIEIIQRKDPQQAPAVKLKEVLSRRKSLLHIQQDTGNEETGEDEKQRNPHPAHLKIVCV

SEQ ID NO: 6587 - DNA, 894 bp, Unknown
  Obtained from environmental sample
  misc_feature (1)..(894): n is a, c, g, or t
gtgaccggaaaaatagaattgaaggaactaggaagagtacttctacacctcaatcaaaagagaggttataaaagcagcaggaagagtgacgtagaccaaagtaaggaaacagaatatgtagcagcagtcaataacaggtttggacaaattcaagaactcgggtttactgttgggcaatatttttatcatggccttaaagaagatcctcattatagggtaaaagaacaggtatttccaagaatagcctaccaggaagagtttgacctcataataaaagaacagaaaaagcattatcctaatctactaacggaccagaaatgcaatgaaataaggaatgagatcatttactatcaaaggcctctaaaatcccaaaaaagcagggtttccatttgtgagtttgaaggaaagttcgagaccatcagcaaagaagacaaatcgagggaagtttttgttggtccgaaggttgcaccaaggtcttctccgctattccagctttgtaagatatgggaaacaataaatcatataaaactgaagtcgaagacaggagatgaactggaaatcaacccagagcaaagactaaagttatttgaatttctggacaatcatgaacacttatctacttctgaatttttcaaaatcctgaatgtaaggaaagaagattactatgttaacaagcagttggaaaaaggactacaaggcaatataaccaaggctaaaatttctgctattctgaaggatctgcctaatanagatgaactaacaagatttgatctttctttagatcataaaaccgggagaatatttgaagaaaaagtgtcttctacttttgaaaaggacctttatacagattgtggcacattctctattcatttactgaaaaagatgatggcataa

SEQ ID NO: 6588 - protein, 297 aa, Unknown
  Obtained from environmental sample
  misc_feature (1)..(297): Xaa is any amino acid
MTGKIELKELGRVLLHLNQKRGYKSSRKSDVDQSKETEYVAAVNNRFGQIQELGFTVGQYFYHGLKEDPHYRVKEQVFPRIAYQEEFDLIIKEQKKHYPNLLTDQKCNEIRNEIIYYQRPLKSQKSRVSICEFEGKFETISKEDKSREVFVGPKVAPRSSPLFQLCKIWETINHIKLKSKTGDELEINPEQRLKLFEFLDNHEHLSTSEFFKILNVRKEDYYVNKQLEKGLQGNITKAKISAILKDLPNXDELTRFDLSLDHKTGRIFEEKVSSTFEKDLYTDCGTFSIHLLKKMMA

SEQ ID NO: 6589 - DNA, 774 bp, Unknown
  Obtained from environmental sample
  misc_feature (1)..(774): n is a, c, g, or t
atgaatgtcattgcaaagttccttcaatggatctattgtgtttatgcgtntattctgttcgtcaccatcatgctgatcttgtttccgtttgttatcatcgcctcattttttggaaggatccgcggcgggaatacgatatttaaaatttgcagagtgtgggccgatacctggttccccttaatatttatttttccaaagcgttctttcgagatgccacaccataaatcgaagtcgtacatttttgtgatcaaccatagctccctgcttgacgctgccctgcttccaaaagcgtttcgtcaacgtgtgcgcccgcttggaaaggttgagatgagtaagatacctgtttttggatttatttaccggaaggcgatcgtttctgttgaccgcaacgatgccaggaaccgggctcaaagtattcgaattttaaaatcgatcattggtaaaggaatatccgttttgatctttccggaaggaacatataatgaaacaaagttgcccttaaaagatttttataatggtgcatttcgggtagcgattgagacacaaacaccgatcaaaccggttttgttccttgacgcttatgacaggatgcatcatcaaaatattttttcattaaaccccggcaaatgcaggattgtcttccttgacgagattcccgtggcagggcttggcctcagtgacaccgaagacttaaaatggaaggtttatcaggtcatggaaaggaaactgcaggaatataggaaagatctcacggcgtcaaaaacgagntggtga

SEQ ID NO: 6590 - protein, 257 aa, Unknown
  Obtained from environmental sample
  DOMAIN (63)...(191): Acyltransferase
  misc_feature (1)..(257): Xaa is any amino acid
MNVIAKFLQWIYCVYAXILFVTIMLILFPFVIIASFFGRIRGGNTIFKICRVWADTWFPLIFIFPKRSFEMPHHKSKSYIFVINHSSLLDAALLPKAFRQRVRPLGKVEMSKIPVFGFIYRKAIVSVDRNDARNRAQSIRILKSIIGKGISVLIFPEGTYNETKLPLKDFYNGAFRVAIETQTPIKPVLFLDAYDRMHHQNIFSLNPGKCRIVFLDEIPVAGLGLSDTEDLKWKVYQVMERKLQEYRKDLTASKTXW

SEQ ID NO: 6591 - DNA, 477 bp, Unknown
  Obtained from environmental sample
  misc_feature (1)..(477): n is a, c, g, or t
atgactaaacaagcagagaaagttttgaaaataacttatctcgaagcaaagctttataaaagcgaagtgatcggtacagaacatttgctattatcacttttacgtgatgacgataatcttgccgcgcagatcatggctcaatttaatatttcgtatgatgatgtccgcatgcatctcgatgcaattatacgtggtgatggtagtgtaaaaaaagaagatataaaggttgaatcgaaatctactatattaggtgattttgaaacaaactcgccatacgatacaaataaaaatagaacaatcgttcttaacacgatagaaaaaataatctactcttggaaagaatcanattgngattttgaaaaaaatgttgactttatagggaaagaagtcggcaaactccatactatattaaatgataatggtcaattggttttagacgaagctttaaacaaaatactatggctgatgcaagaatga

SEQ ID NO: 6592 - protein, 158 aa, Unknown
  Obtained from environmental sample
  DOMAIN (12)...(64): Clp amino terminal domain
  misc_feature (1)..(158): Xaa is any amino acid
MTKQAEKVLKITYLEAKLYKSEVIGTEHLLLSLLRDDDNLAAQIMAQFNISYDDVRMHLDAIIRGDGSVKKEDIKVESKSTILGDFETNSPYDTNKNRTIVLNTIEKIIYSWKESXXDFEKNVDFIGKEVGKLHTILNDNGQLVLDEALNKILWLMQE

SEQ ID NO: 6593 - DNA, 432 bp, Unknown
  Obtained from environmental sample
  misc_feature (1)..(432): n is a, c, g, or t
atggcaagaataaatttaaaaaccatcttctcaaaaaaagcagaattcatttctattttgcctgccctggttgatggtatgaagtcagacgtttggattgaagacgagtccggaaagttgatggctggaacacaaaatgaagaaactttatgtagttaccctatacaccttgacgaagaactggtgggctgggtaaagggtgatgataaaggaaagattatcgccgatcttttgatgtatctattacagaaggaaaaagaaaagaaaaaactgggtagcgaggtgttgaatctttatcaggaaatcaatctcatttttaatttttctgaaaaactggcgcagacaattgatgcccctgccatttgtgccatcacgctcaacgaagccagtcatgtaataaggtccgaagacggtgtggttatttatggataa

SEQ ID NO: 6594 - protein, 143 aa, Unknown
  Obtained from environmental sample
  misc_feature (1)..(143): Xaa is any amino acid
MARINLKTIFSKKAEFISILPALVDGMKSDVWIEDESGKLMAGTQNEETLCSYPIHLDEELVGWVKGDDKGKIIADLLMYLLQKEKEKKKLGSEVLNLYQEINLIFNFSEKLAQTIDAPAICAITLNEASHVIRSEDGVVIYG

SEQ ID NO: 6595 - DNA, 771 bp, Unknown
  Obtained from environmental sample
  misc_feature (1)..(771): n is a, c, g, or t
gtgggacgaacctggctagaggttcaagaaataattaaaagtgtgatttttgattccggcttaaacccaaacctagttagtgatgcggatgatattggagttattcaaggaagaattgttcaaaatatatacaattatccaattattatttgtgatgtaagtggaaaaaatccaaatgtaatgttcgaattaggcataaggctcgcttttgataaaccaacaataataattaaggatgataaaacggactattctttcgacacttctccgattgagcacattggttatccgagagatcttagatttgcaaaagtcatattgttcaaagaaaagctgaaaaataaattattggcgactctaaaaaagtcacaagaggacaagaattactcgccctttttaaaacattttggcgaattcgttgtcccaaaacttgagcaaaaggaagtcgggtttaatgattttgtggtcaatagcctaaatgacataagaaatgaaatatccagaataaagcaacatagttcgaaaacatcatcagaaaaggaaactttgtcggaggaagaattaaaaattaaaacaaaagaagaaagagaaaaatttttgaaggaatacctagaagggcttgtggaaaagcataattataaaacagtcagtcaactaaagaaaaccacattcacttataaaaaatcttgggaagaacttgggttttctgacgaggaactgaatcgcttatttgcaaaaattgctcgttcaattaaatttcctgaaaaatag

SEQ ID NO: 6596 - protein, 256 aa, Unknown
  Obtained from environmental sample
  misc_feature (1)..(256): Xaa is any amino acid
MGRTWLEVQEIIKSVIFDSGLNPNLVSDADDIGVIQGRIVQNIYNYPIIICDVSGKNPNVMFELGIRLAFDKPTIIIKDDKTDYSFDTSPIEHIGYPRDLRFAKVILFKEKLKNKLLATLKKSQEDKNYSPFLKHFGEFVVPKLEQKEVGFNDFVVNSLNDIRNEISRIKQHSSKTSSEKETLSEEELKIKTKEEREKFLKEYLEGLVEKHNYKTVSQLKKTTFTYKKSWEELGFSDEELNRLFAKIARSIKFPEK

SEQ ID NO: 6597 - DNA, 351 bp, Unknown
  Obtained from environmental sample
  misc_feature (1)..(351): n is a, c, g, or t
ttgataaatgggttcacttcggattttttgcgcttcttctttttttatggcgatttcattttcctgccaatcaaaatatgcccgtcagcttatctatgggccgttggctaccgagtaagtgtaaaattgattcagcatttttttattgctaaccgaacgtttgatggaggtgatattgttgcccacattggcggtgctggtgcagggatctggtttttggacaggaagttaacaaaaaatgacccctgtaaaaacaggggtcgcaacaaaactaactcttatgaaaaattgactgcttatggaaaaaatttcttaaaacccaaatatttgccaaatttggggaaaaggtaa

SEQ ID NO: 6598 - protein, 116 aa, Unknown
  Obtained from environmental sample
  misc_feature (1)..(116): Xaa is any amino acid
MINGFTSDFLRFFFFYGDFIFLPIKICPSAYLWAVGYRVSVKLIQHFFIANRTFDGGDIVAHIGGAGAGIWFLDRKLTKNDPCKNRGRNKTNSYEKLTAYGKNFLKPKYLPNLGKR

SEQ ID NO: 6599 - DNA, 906 bp, Unknown
  Obtained from environmental sample
  misc_feature (1)..(906): n is a, c, g, or t
atgattagactgaaacttttcctgcttccgacggtaatcattttgttttcgtcttgtaaaaacgaacaaggcaatacttatgcaataaaggactttagaaaatcccttcaaccctttctttataaagttgtgacgacaggaattgtcacgtactatgacagttcacaaattaagagcatcgccgatgacgaattacgtcgacttagcaaggctgaaaatccggtattgagagcgacagcacttagggaaatgcttgacagaaactcgtttaatccttttgacatagtaatgaagcatctcgacgatacggcgattgtggctacagataatggagagtttggaatcaagtttgaaacagtttcagattgtttaatagaacgaacaacttgggagacagctcaagcaagagacaaaaccattgaatcagtcttgacaaaacataattatttaagttctgcctataacattcttacaaaaatagaggctcaggaaaagtactacccattcataaaggacatggcaacacgccctagacgtctagaccggtatgaaggttatgaattggctttctatganattgaatacgcactatatggacttgccaaattccagaagaaagaagatgtccaaattataaaagacaaattgatgaagcatgtgtggaagttaagtgatgtttcctttcagactatgaaagaatttcccgacactgnctaccttgacgttntacagacatatcatcgcagacagttttataatttctcaggaattnaacctcatggatttactggattnnnatgcgatagggctgctcccctgagattcatcngagcattggnntgtacacanancggaaggagtgcaaaacttattaaacaccatgctaacttacttgccaaggtataa

SEQ ID NO: 6600 - protein, 301 aa, Unknown
  Obtained from environmental sample
  misc_feature (1)..(301): Xaa is any amino acid
MIRLKLFLLPTVIILFSSCKNEQGNTYAIKDFRKSLQPFLYKVVTTGIVTYYDSSQIKSIADDELRRLSKAENPVLRATALREMLDRNSFNPFDIVMKHLDDTAIVATDNGEFGIKFETVSDCLIERTTWETAQARDKTIESVLTKHNYLSSAYNILTKIEAQEKYYPFIKDMATRPRRLDRYEGYELAFYXIEYALYGLAKFQKKEDVQIIKDKLMKHVWKLSDVSFQTMKEFPDTXYLDVXQTYHRRQFYNFSGIXPHGFTGXXCDRAAPLRFIXALXCTXXGRSAKLIKHHANLLAKV

SEQ ID NO: 6601 - DNA, 885 bp, Unknown
  Obtained from environmental sample
  misc_feature (1)..(885): n is a, c, g, or t
atgtcatcgcggatcggcgatctattagtgagaacgggattagtgacccccgagcagcttgcacaggcgcaagaagctgagaaagcgtcaggcggatttctcggttctcatcttgtgaaacttggcttcatcaccgaacaagattttgctcaaacggtgagcaagcagtacggcgtaaagatcatacagctcgtcgactatactatcgaagaggcgaccttgcagctcattccgcacaatctcgcgcttaaacacaacgtgcttccggtagtcaaaaaggaaagcatgctgaccgtcgccatggtcgatccgtcgaatatggtcgcgctcaacgacataaagttcattaccggtctcgatattcaggtcgtactaaccactgaatccgaactgaaacaaacacaggaaaagtactacgaaaataatgttcaatacgacaagatcatcaacgacttcgatgaaaccgatgtcgaggtcgtcgatcgggaagaatcgataaatctcaccgagcttgaaaagcagactgaagatgctcccgttgttaaacttgtgaatgcgattttgactgatgccataaaaaagggcgcgtcggacattcacgtcgagccgtatgagaagagcttccgggtgcgatttcgtattgatggcgtgctttatgagataatgaagccgcctccaaagctgaaaaatgcgattacgtcccgcctgaaaatcatggctgagctcgatatcgccgagcgaagaatgccccaggatggccgtattaagttgaagctcggcaaacggaaaggagatggattttcgagtaaacgtcccttccgacgctcttcggcgagaagggtgttcttcgacttctcgataaatcgaatctgcagctcgatatga

SEQ ID NO: 6602 - protein, 294 aa, Unknown
  Obtained from environmental sample
  DOMAIN (38)...(145): GSPII_E N-terminal domain
  misc_feature (1)..(294): Xaa is any amino acid
MSSRIGDLLVRTGLVTPEQLAQAQEAEKASGGFLGSHLVKLGFITEQDFAQTVSKQYGVKIIQLVDYTIEEATLQLIPHNLALKHNVLPVVKKESMLTVAMVDPSNMVALNDIKFITGLDIQVVLTTESELKQTQEKYYENNVQYDKIINDFDETDVEVVDREESINLTELEKQTEDAPVVKLVNAILTDAIKKGASDIHVEPYEKSFRVRFRIDGVLYEIMKPPPKLKNAITSRLKIMAELDIAERRMPQDGRIKLKLGKRKGDGFSSKRPFRRSSARRVFFDFSINRICSSI

SEQ ID NO: 6603 - DNA, 765 bp, Unknown
  Obtained from environmental sample
  misc_feature (1)..(765): n is a, c, g, or t
atgaaaaaactgaacaatgagctcaagcaaaaaaatcataagctcgaattgtacaataaagaactcgactcatttacctacattgccagccatgatttaaaggaaccgatcagaaaaatccttacctatagcgagcagatggaaatggaagattatggaaatttatccgacttgaacagaaagcaattaagccgcattaagcagtccgcccagcgcatgcaaaatcttttgaacgatcttttattatactcacatgtaaacatcagtgataaaacatttgaagaggtcgatctcaacaaaatcgttgacgatgtaatcgataatctcagggaagagataaccgaaacgcatacggagataaaagcagacaagcttcctgtgatcaaaagcatgccttttcagatcaagcagttatttgaaaaccttatcagcaattctataaaatacaaacaagatcatataccgccggcaattcttatagggggatacgtaatgaatgaaaaagatattaccgaaaaattttataaggaaagcgatcagtattacaagctgttttttcaagacaatggttccggttttgaacagatgtacgaagaaaaaatattcaagctttttcaacgtctccattctaaaacaaataaacctggaaccgggattggcctgacgatttgcaaaaagatcgtggataatcacaatggctttatcaaagcaaccagcgaaataaataaaggaaccaggtttgaaatttatctgccgatgaattaa

SEQ ID NO: 6604 - protein, 254 aa, Unknown
  Obtained from environmental sample
  DOMAIN (21)...(89): His Kinase A (phosphoacceptor) domain
  misc_feature (1)..(254): Xaa is any amino acid
MKKLNNELKQKNHKLELYNKELDSFTYIASHDLKEPIRKILTYSEQMEMEDYGNLSDLNRKQLSRIKQSAQRMQNLLNDLLLYSHVNISDKTFEEVDLNKIVDDVIDNLREEITETHTEIKADKLPVIKSMPFQIKQLFENLISNSIKYKQDHIPPAILIGGYVMNEKDITEKFYKESDQYYKLFFQDNGSGFEQMYEEKIFKLFQRLHSKTNKPGTGIGLTICKKIVDNHNGFIKATSEINKGTRFEIYLPMN

SEQ ID NO: 6605 - DNA, 396 bp, Unknown
  Obtained from environmental sample
  misc_feature (1)..(396): n is a, c, g, or t
ttgtatcacaaaataaaatttatttcaaataataagtttcaatatttcaaaacaactaatcgcaaattgtatgataaggagtataaaaaatattcctttaaaaattatttgnatataatttattttaatgagaaaggcgaactagctgagggttcgattacaaatatttttatttataaggatgatgtaatatctactccaccactgaataccggaatattatctggaatctatagaaagcatctattaagaaataattctggcatacgggaaaggaaactttatttagacgatctgctgaaagcggataaaatagttctaacaaactctgtgcaaggtgaggttattgttgataaattatttcttaatgaatttgagtttattgaatttaaataa

SEQ ID NO: 6606 - protein, 131 aa, Unknown
  Obtained from environmental sample
  misc_feature (1)..(131): Xaa is any amino acid
MYHKIKFISNNKFQYFKTTNRKLYDKEYKKYSFKNYLXIIYFNEKGELAEGSITNIFIYKDDVISTPPLNTGILSGIYRKHLLRNNSGIRERKLYLDDLLKADKIVLTNSVQGEVIVDKLFLNEFEFIEFK

SEQ ID NO: 6607 - DNA, 831 bp, Unknown
  Obtained from environmental sample
  misc_feature (1)..(831): n is a, c, g, or t
gtgtctaaattggttacgaaaaatattgtctccaaaattatttatccacattctcctgaactattgagaatttggtctcgtcatgtccctgacacaataaaatatgaaggcaagaatttcaaattagaatatgaggtacttaaatcagaaacaatttttaaaatttcatattcaaagataattccgcttgaattggaactctctaatgattttttgaatgaacagggtttattaatatacaatgttctaaactatattttaaccacactaaggactttcgaccacgcagatttacagtttaagagaattgaatcaaatggtttgactaaaatcaaaattgatatttactcaaataacgaagttttagaaaaaacttttgactactcacccaagtacgaacctcctcttcaatttcaaaatctatttatgcagttagaagaccatgatggtttagaaggttttcattttgcatttgaagatgaacaactgtttgccattggtttgcttattgaagcaaatcattcattgttgaaaagtgaatacaatgtttcaattcttcattgctgtactgccattgaatcttgcattttccccatgttagaagagtattttaggaaactattctttaataaaggaagttctaatgttaagtctttaattaaagaactacccatgagtttaaaatatgaatttatgtttggagcggttgaaaagaatttatttataaatcagggagaactgttagaaagacttaaaagaacaataaaattcgaaattcaatcattcactctggttattcagcgaaaagaaatgaagcctttgaactgttaa

SEQ ID NO: 6608 - protein, 276 aa, Unknown
  Obtained from environmental sample
  misc_feature (1)..(276): Xaa is any amino acid
MSKLVTKNIVSKIIYPHSPELLRIWSRHVPDTIKYEGKNFKLEYEVLKSETIFKISYSKIIPLELELSNDFLNEQGLLIYNVLNYILTTLRTFDHADLQFKRIESNGLTKIKIDIYSNNEVLEKTFDYSPKYEPPLQFQNLFMQLEDHDGLEGFHFAFEDEQLFAIGLLIEANHSLLKSEYNVSILHCCTAIESCIFPMLEEYFRKLFFNKGSSNVKSLIKELPMSLKYEFMFGAVEKNLFINQGELLERLKRTIKFEIQSFTLVIQRKEMKPLNC

SEQ ID NO: 6609 - DNA, 1086 bp, Unknown
  Obtained from environmental sample
  misc_feature (1)..(1086): n is a, c, g, or t
gtgatattggcgaaagtacaattgatcctggatgaagcttacctggcggtggaaatgnccgttccaaggaaaaacctacagccaaatccaaggtgcgcaacatacagacggaaaccaaaaccgaaggtcacnagaaagaaaaaaccagttgaaaaacctaaatccgatacacttgaagtgtcctgtttcattagcntggtgggaaacgatattaccctgcagttcaacagcgatgacntgaaatgggacggaaatgtcagcctgcatgccaaattcaattctaagttcgggatttttgaaggggacggtgttttggctgacggccaatgggtgaagtggagcgcgatacgcaatgaaacagcggataaagacaaaaaaccggaagataagaaagaggaggacaaggacgaaataacactttggtatccaaatatggcctatggctttgaaaagaaacccgaaggagaaaatatcgtctttcagaatgtcaccgtctggaccaatgaaaaggaagggcgcatttacaacggaacagtggtggttgaaaatggtaaaatcaaacacgttggttcaggttcgggacccctgcctaaaaacgcccgggtaatcgatggaaaaggcatgcacctcacttcggggatcattgacgagcattcgcatattgccataaacaaaggagttaacgaaggcggtcaggccgtttcggccgaagtgagtatcggtgacgtgcttcaatccgatgacatcgagatttaccgtcagctcagcggcggggtaacggcggcacagttactgcacggctcagccaacccgatcgggggacagtcggcgctcgtgaagttgaaatggggacatacgccccaggagatgctgatcccgaacgctccgaaattcatcaaatttgccttgggagaaaacgtcaaacaagccaattggggtgagtttaacaccgtgcgtttcccgcaaacccggatgggtgttgaacaagtgatgtatgatgcctttgagcgcgcccgggcttacgaaaaagaaaaaacggccaacccgaacggtacaggaaggatctcgaacggaagatcaaaataa

SEQ ID NO: 6610 - protein, 361 aa, Unknown
  Obtained from environmental sample
  misc_feature (1)..(361): Xaa is any amino acid
MILAKVQLILDEAYLAVEMXVPRKNLQPNPRCATYRRKPKPKVTRKKKPVEKPKSDTLEVSCFISXVGNDITLQFNSDDXKWDGNVSLHAKFNSKFGIFEGDGVLADGQWVKWSAIRNETADKDKKPEDKKEEDKDEITLWYPNMAYGFEKKPEGENIVFQNVTVWTNEKEGRIYNGTVVVENGKIKHVGSGSGPLPKNARVIDGKGMHLTSGIIDEHSHIAINKGVNEGGQAVSAEVSIGDVLQSDDIEIYRQLSGGVTAAQLLHGSANPIGGQSALVKLKWGHTPQEMLIPNAPKFIKFALGENVKQANWGEFNTVRFPQTRMGVEQVMYDAFERARAYEKEKTANPNGTGRISNGRSK

SEQ ID NO: 6611 - DNA, 705 bp, Unknown
  Obtained from environmental sample
  misc_feature (1)..(705): n is a, c, g, or t
ttggacactaaatacacccgttctctggatgatatcaaagaagaatattcttcatggctctatcagcaacgaaaaaagaaaaatgtctttccaaaaaaatcagtattagtagttggaagtatggcttttttgctgctcgttggatatttcgtaatacctccaattttaaattctaaaaaaaacagcgcacatagattatcagctcaggaaatagccgcttcaaaacctgatttcattcagactaataaaataccagatgtaccgggcactcttaagaaaaatacaaaaacgacaaattcaccacaaaaaaagaagaccaaatcagctaatgaatcttctaaaacgtactcgaataaagaaagagataagatagataattacatcgattcccttaaggatatagaaaaccatagaactgagccggtcgaagaggtaacgtatgaacctatttccaccaatcaaaatggctcccgccaaagcactaaaagagatgacgaatcaaccataaaaaaagtaccaactggtaaagaaaatacttcaacgtctattagtgaattaataaaactaagtgagtcgacagggagcggatcaccacacttgagtttatacaacaatagcaataatcatataaacttcgttgccgttgatgtttactattataaatccanatcaaaagcttctacaaaagaaaaccctttattttaa

SEQ ID NO: 6612 - protein, 234 aa, Unknown
  Obtained from environmental sample
  misc_feature (1)..(234): Xaa is any amino acid
MDTKYTRSLDDIKEEYSSWLYQQRKKKNVFPKKSVLVVGSMAFLLLVGYFVIPPILNSKKNSAHRLSAQEIAASKPDFIQTNKIPDVPGTLKKNTKTTNSPQKKKTKSANESSKTYSNKERDKIDNYIDSLKDIENHRTEPVEEVTYEPISTNQNGSRQSTKRDDESTIKKVPTGKENTSTSISELIKLSESTGSGSPHLSLYNNSNNHINFVAVDVYYYKSXSKASTKENPLF

SEQ ID NO: 6613 - DNA, 771 bp, Unknown
  Obtained from environmental sample
  misc_feature (1)..(771): n is a, c, g, or t
ttggcgtcaaaaccaatggattgtttacgccagatacaactttcttatttaaaaataaaaatgatgttcagaaaatattatctaccgctcttcattttgcttttttcttctaccggcttttcccaagagagaaaagaaatagtagcggcagatgtcgtgactattaattcaaaaatactgaatgaaaaacggactgtctgggtttacagccctggtaataaaaaagataggaaggcttatccggtgctttatgttttagatggagaaactcattttaattctgttatcgctatggttgaacatctgagcggtgcgagtattattccacggatgatcgttgtaggcattttgcattcaaacaggatgaaagatttaacgccttctggtaaaaatgctggtgttggcagcaacagcgaaaatacaggtggcggcaagaattttatctcgtttgtaaacgatgaactttttccattaatcgaattgaaatattctactgctccgtatagactactgttcggtcattctttaggtggactaactgtaataaacaccctgatacatcataaagatttatttaatgcctatgcttccattgatgccagtttgtggtgggagcagcacaggcttttagatgaaagtaaagtagctcttgcagtacacaattacccgaataaaaaactctttttggccattgctaatcgcatggaaaaaggcatgacacaagcgctgttcaggcagatacaactgaaaatactgaatgataagatataa

SEQ ID NO: 6614 - protein, 256 aa, Unknown
  Obtained from environmental sample
  DOMAIN (49)...(251): Putative esterase
  misc_feature (1)..(256): Xaa is any amino acid
MASKPMDCLRQIQLSYLKIKMMFRKYYLPLFILLFSSTGFSQERKEIVAADVVTINSKILNEKRTVWVYSPGNKKDRKAYPVLYVLDGETHFNSVIAMVEHLSGASIIPRMIVVGILHSNRMKDLTPSGKNAGVGSNSENTGGGKNFISFVNDELFPLIELKYSTAPYRLLFGHSLGGLTVINTLIHHKDLFNAYASIDASLWWEQHRLLDESKVALAVHNYPNKKLFLAIANRMEKGMTQALFRQIQLKILNDKI

SEQ ID NO: 6615 - DNA, 405 bp, Unknown
  Obtained from environmental sample
  misc_feature (1)..(405): n is a, c, g, or t
atgaaaataccattaaatatattaaataaagataatgataataaagaaaatgatttatttaaaattgcatcttctattcctttacaaggtttaactgcacattatttatgtacaagtgtttataaagtaaataaaaatgatagtgtattaattcatgctggagcaggaggaactggtggattattaatacaaatgtgtaaaaatatatttaattgtaaatgtgtaataacaacagtaagtaatgaagaaaaagcaaaaatcgcattatcatatggtgcagattattgtataaattattcaaaagaaaatttttatgaaaaagtaatggaaataacaaataaagaaggagtaaatgtagtttatggtttgttgttgtttttttatataaaaataaaaaataaataa

SEQ ID NO: 6616 - protein, 134 aa, Unknown
  Obtained from environmental sample
  misc_feature (1)..(134): Xaa is any amino acid
MKIPLNILNKDNDNKENDLFKIASSIPLQGLTAHYLCTSVYKVNKNDSVLIHAGAGGTGGLLIQMCKNIFNCKCVITTVSNEEKAKIALSYGADYCINYSKENFYEKVMEITNKEGVNVVYGLLLFFYIKIKNK

SEQ ID NO: 6617 - DNA, 978 bp, Unknown
  Obtained from environmental sample
  misc_feature (1)..(978): n is a, c, g, or t
ttgcatgaaaaaatgaaaggttttggagctcatgttgaaaccataaccatcaaagccaaacggatctcttactatataaaacatacacgttatctcataaagtatggtaaaaaaaataagatcgatgtggtttactcccacctgcaatttgtaaatctaattgctgtttttgccagattcttcatgaaaacaaaagtttttccttgtcgccaccactctaccgatgttgtgcttagaggaaataaaaacgccatacgtcaggataaactggtaaaccggttttcgaaaaaaataattgtggtttccaatgcggttaaagatcaaatggtgaagcatgaaggtgttaattcggcaaagatcgagtgtattcccttgggctataattttgatctgtatgataaaccagataaaaccgaagtagaaaaaataaaaaaacaactgaattgtgattttatattattggtgattggccgaatgacgataaataaaaggcatacaatcgcactggaagtactgaataatttaatcaagtcgggattgaatgtaaaaatgatactgatggatgaaggccctgaaaaaacaaatttggaaaattacattgttcaacataatttatcggacaaagtaatattcaccggttttttaagcaacaccatgaattatgtagatgcaggcgacctcttattacatccttccgtttcagaagcaagtaatcaggtggtaaaagaggccgctttactgaataaaacagccattgtgtgcaaaggggttggtgattttgaagaatatttcattcacggtaccaatggatttttagtgtctcagaacaatacagtaaatgaaatgacggaactggttaaaatatattatacaaaaaagaatgagttgaatgctttaggtagtgaattaaaaaaagccgtcacaacaaaattcgacataaaacatgtatccgaagcttacttaaaacttgcgcaataa

SEQ ID NO: 6618 - protein, 325 aa, Unknown
  Obtained from environmental sample
  DOMAIN (138)...(306): Glycosyl transferases group 1
  misc_feature (1)..(325): Xaa is any amino acid
MHEKMKGFGAHVETITIKAKRISYYIKHTRYLIKYGKKNKIDVVYSHLQFVNLIAVFARFFMKTKVFPCRHHSTDVVLRGNKNAIRQDKLVNRFSKKIIVVSNAVKDQMVKHEGVNSAKIECIPLGYNFDLYDKPDKTEVEKIKKQLNCDFILLVIGRMTINKRHTIALEVLNNLIKSGLNVKMILMDEGPEKTNLENYIVQHNLSDKVIFTGFLSNTMNYVDAGDLLLHPSVSEASNQVVKEAALLNKTAIVCKGVGDFEEYFIHGTNGFLVSQNNTVNEMTELVKIYYTKKNELNALGSELKKAVTTKFDIKHVSEAYLKLAQ

SEQ ID NO: 6619 - DNA, 576 bp, Unknown
  Obtained from environmental sample
  misc_feature (1)..(576): n is a, c, g, or t
atgacgtctcctcttgtaagcataatcatccccatgtataatcaacaacctgcttttttaaaggcatgtattgaaagtgctattgggcaaagctacaagaacatcgagatcattatatcagataaccattctacgaacgaagccccgactatacttgatcaatataagggtcgaaatataaaaattttcaaaccctcatctcatctttcactggtggataattttatttttgccgcttctcatgcaaatggggaattcatcacttttttaagttcagatgatattttatatcctaaatgtattgaaaaagtaattaaaccacttttattggataaaaacattgcttttggttattgtgaaaatgcaatgatagatgtaaggngcgatcaaacttatttggtacgagatttgaaatttaaaaccggtgtttattcaaaaaaagaaatagcacacaaaatgtacaaccgatcggaatattgnatcattggcggagtgatgcgtaccgaatggtataaacaaaccggattcaaaaaagatatcattgccggagattggatcttggatttcaattactaa

SEQ ID NO: 6620 - protein, 191 aa, Unknown
  Obtained from environmental sample
  DOMAIN (7)...(175): Glycosyl transferase
  misc_feature (1)..(191): Xaa is any amino acid
MTSPLVSIIIPMYNQQPAFLKACIESAIGQSYKNIEIIISDNHSTNEAPTILDQYKGRNIKIFKPSSHLSLVDNFIFAASHANGEFITFLSSDDILYPKCIEKVIKPLLLDKNIAFGYCENAMIDVRXDQTYLVRDLKFKTGVYSKKEIAHKMYNRSEYXIIGGVMRTEWYKQTGFKKDIIAGDWILDFNY

SEQ ID NO: 6621 - DNA, 630 bp, Unknown
  Obtained from environmental sample
  misc_feature (1)..(630): n is a, c, g, or t
ttgtatattgccttaatgaaatctaaattcaaccaacatgtaaaaaaactacgtgaagtcatcaaccgctttgatccggatagtaacaggctcaaggtttctcttataaatgaaattgctcaaaacaagattttattcaccagtgtcctgactacctattatgaaaccctgctttttatcatggcatttccaccggataaaaaaacactggacctggcagaaagcgaagtccttcgcataacagggctattaaaaaagcaacccggaaaggtaaaagcgcaattcgtcaattcaggtatcccgttttctgttcacagcgggtccttttcccatgattgtatccgctggttgttatcacatccggatggtcatgtatccatcaatagcattgacaatacattattcgacctgaacgaagttttaaaagttacgctgccttcacaggaaagaagtgaaactacgatcggatatacgaatgaagatttactaaacgaacttgttcccgataaaaaattacagcttcaatatattatcaatgaattaagtcatcttgacagcactccatacattaaagaccattatctaaccggcctcggtgtatttactgatgtacaccaaaaaacattctga

SEQ ID NO: 6622 - protein, 209 aa, Unknown
  Obtained from environmental sample
  misc_feature (1)..(209): Xaa is any amino acid
MYIALMKSKFNQHVKKLREVINRFDPDSNRLKVSLINEIAQNKILFTSVLTTYYETLLFIMAFPPDKKTLDLAESEVLRITGLLKKQPGKVKAQFVNSGIPFSVHSGSFSHDCIRWLLSHPDGHVSINSIDNTLFDLNEVLKVTLPSQERSETTIGYTNEDLLNELVPDKKLQLQYIINELSHLDSTPYIKDHYLTGLGVFTDVHQKTF

SEQ ID NO: 6623 - DNA, 1101 bp, Unknown
  Obtained from environmental sample
  misc_feature (1)..(1101): n is a, c, g, or t
gtgcaattttgtaaaagttggaaaagttctcccggaaaatttgttttctcactttggaaaagcgtcaaacccgtgtttttttggaaaattgttgaaaaaggtaaatccagtggggcgcggctatttggggtttcggcccaacttcaaggttccttcaagaaaaatgtttttggcccgggagaatttaacaggaatttggaaaaaattttttgcaatccaggaaaagaaacttcccgttcaatggaaggcgctttgaatgtgccattcacaatgttaagggacatcttatttttcatccttgtctctttcattccaaatgttgacattaaattaaatttcaacttattaaaacaagacacttcatttttaacacttgacaggaatgctgcaatctacctggctttaaatgcaacttcaaaattgaaatttcttacaggtttaaaatcgaatactgcactgggaagtactcaatccaataatattcagggagagaattacgacttcaaattttttaattatggaatcgggtacacgttggcaacattagatgatatcttttatccaatgaaaggatggagcattgccgttgatatttcaacagggaacaagaaaattttaaattacgaatcggtaagcacagatattcgtattcctgccaatgcaatgcaatgggcaggcgaagcaactgtacaaacatttatacgaataggtaaaaaggccaccttgttaaatcaatttcagggaggaactgtacaaagtcaaaatttggtattaagtgatctgtatcggattggaggattgaaaacgttaagagggtttaatgaaaacaattattatgtgtcagattttgctatttatactcttgagtataggtatttcacagatgaatcttcgtatgtgatgctttttgccaatcaggcttatatgcataataaactcaatggtaatttcaccgattggccaatagggtttggaacaggtattagttttagcacaaaggcaggcatttttcagtttatttatgctcttggatacgcaaaggatcaacctcttagtttaaatctttcaaaaattcattttggtttagtctctaggttctag

SEQ ID NO: 6624 - protein, 366 aa, Unknown
  Obtained from environmental sample
  DOMAIN (42)...(366): Surface antigen
  misc_feature (1)..(366): Xaa is any amino acid
MQFCKSWKSSPGKFVFSLWKSVKPVFFWKIVEKGKSSGARLFGVSAQLQGSFKKNVFGPGEFNRNLEKIFCNPGKETSRSMEGALNVPFTMLRDILFFILVSFIPNVDIKLNFNLLKQDTSFLTLDRNAAIYLALNATSKLKFLTGLKSNTALGSTQSNNIQGENYDFKFFNYGIGYTLATLDDIFYPMKGWSIAVDISTGNKKILNYESVSTDIRIPANAMQWAGEATVQTFIRIGKKATLLNQFQGGTVQSQNLVLSDLYRIGGLKTLRGFNENNYYVSDFAIYTLEYRYFTDESSYVMLFANQAYMHNKLNGNFTDWPIGFGTGISFSTKAGIFQFIYALGYAKDQPLSLNLSKIHFGLVSRF

SEQ ID NO: 6625 - DNA, 726 bp, Unknown
  Obtained from environmental sample
  misc_feature (1)..(726): n is a, c, g, or t
gtgtcttgccgagacaatgaacagccaagcaaaattgttttggacaaagtcatttacggtgatgaagaaacaggaaaatacgtatacaaaaatggtcaactaatcaggtacgagtactactcaatagataagctaatacagtacgacctttataattatacggacgacttgctgacatcaaaaaagtattactcattaaataatgacggacaatttgagaaattttccgaagccacaatcacatatgatttagacaacaatttaagtgaagtatcaatagagcaaattgacagacagataacctacaaggccacgtggacaaataattacataacaaagattgagcgtatagaagacaacatatcaaccaacacagaattagaatacaatgacaaagggaacatcatcaaatttattgacttttcaagtgacggctctattaactacattttagaatgtgaatatgatagtaatcctaatcctaaatataaattaaatgacccgacagacattgttttcctcgattttacaaatagctcaccgaataatgcgacttcgataatacaaaaaatagattttgacagcgaggtatacgcgacaacagaaataacatacacttacaatgacaagggattaccaaatgaaagacagtaccaagttactgccttaggagagacacgagtgactttagcaaagtttttttataaaagcataaagacaaattga

SEQ ID NO: 6626 - protein, 241 aa, Unknown
  Obtained from environmental sample
  misc_feature (1)..(241): Xaa is any amino acid
MSCRDNEQPSKIVLDKVIYGDEETGKYVYKNGQLIRYEYYSIDKLIQYDLYNYTDDLLTSKKYYSLNNDGQFEKFSEATITYDLDNNLSEVSIEQIDRQITYKATWTNNYITKIERIEDNISTNTELEYNDKGNIIKFIDFSSDGSINYILECEYDSNPNPKYKLNDPTDIVFLDFTNSSPNNATSIIQKIDFDSEVYATTEITYTYNDKGLPNERQYQVTALGETRVTLAKFFYKSIKTN

SEQ ID NO: 6627 - DNA, 435 bp, Unknown; identical to SEQ ID NO: 4871
  Obtained from environmental sample
  misc_feature (1)..(435): n is a, c, g, or t

SEQ ID NO: 6628 - protein, 144 aa, Unknown; identical to SEQ ID NO: 4872
  Obtained from environmental sample
  misc_feature (1)..(144): Xaa is any amino acid

SEQ ID NO: 6629 - DNA, 576 bp, Unknown
  Obtained from environmental sample
  misc_feature (1)..(576): n is a, c, g, or t
atgaaattcctgatcgttggccttggaaatattggaaatgaatacgcccatacccgtcataatatcgggtttgacgtggcaatggcatttgcatccaaacatgggggccagttttctaatgaaagactggcgtataagtcggaggtaaaatggaagggcaggatctttgtttgtatttgtcccaccacctatatgaacctcagtggcaaggcagtaaagtattggcttgataaagaaaagattgacattgaaaacagccttactatcgtagatgaggttgcgcttcctttgtcgaggatcaggttgagacctggcggaagctcaggaggacataatggtttgaaaagcattgaagagttgttgggaacccagcaatatcccaagctcaggtttgggatcgggaacgattatcccaagggcatgcaggtggattatgtattaggcaaatggaggaaggaagaagagccactggtcaaactaaagatagataggtgcattgatgtgatagagagttttgccaccattggaatagcccatgccatgaataaattcaacaatgtggaaattacgttatga

SEQ ID NO: 6630 - protein, 191 aa, Unknown
  Obtained from environmental sample
  DOMAIN (4)...(185): Peptidyl-tRNA hydrolase
  misc_feature (1)..(191): Xaa is any amino acid
MKFLIVGLGNIGNEYAHTRHNIGFDVAMAFASKHGGQFSNERLAYKSEVKWKGRIFVCICPTTYMNLSGKAVKYWLDKEKIDIENSLTIVDEVALPLSRIRLRPGGSSGGHNGLKSIEELLGTQQYPKLRFGIGNDYPKGMQVDYVLGKWRKEEEPLVKLKIDRCIDVIESFATIGIAHAMNKFNNVEITL

SEQ ID NO: 6631 - DNA, 486 bp, Unknown
  Obtained from environmental sample
  misc_feature (1)..(486): n is a, c, g, or t
atgaaaacaacaacagaacacgatgaacgaatagcgaatatgacatttgcttcagtgtatcctcactatctgacaaaagtggagaagaaaggcagaacgaaagaagaattgcaccaggttataaagtggttgacagggtttaatgaaaagcagctgcaggaagtgattgatgagaagcttacgtttgcagaattctttagcagagccaggttaaaccccaatgccagtcttataacgggagtaatctgtggctatcgtgtggaagaaatcgaaaatcccttgacccaacagaccaggtacttagacaagctggtggatgagctggcgaaaggcagaaagatggagaagatcttgcggatagctaaaaacaaacaaccagggaagtacgaaaaaaaaattcttttattgggccttccctactgtaaaaatgcaaaaactctgcccgcattgaaaattttcaggaaccaatttaatgccaccctttaa

SEQ ID NO: 6632 - protein, 161 aa, Unknown
  Obtained from environmental sample
  misc_feature (1)..(161): Xaa is any amino acid
MKTTTEHDERIANMTFASVYPHYLTKVEKKGRTKEELHQVIKWLTGFNEKQLQEVIDEKLTFAEFFSRARLNPNASLITGVICGYRVEEIENPLTQQTRYLDKLVDELAKGRKMEKILRIAKNKQPGKYEKKILLLGLPYCKNAKTLPALKIFRNQFNATL

SEQ ID NO: 6633 - DNA, 729 bp, Unknown
  Obtained from environmental sample
  misc_feature (1)..(729): n is a, c, g, or t
ttgaaaatttcaggaacaatttattgcatctttttatctttcttgtttttcagttgtcgcactgttaaggattctgattttatggtaagcaaaaacagcttcggaactattctgcctaaacttgaagggaatcttgatctggagaatattcataaatatctgtcttatggaaaaattaaattatccggctatcatcatggagtgataaaaatcaaagaggaccctgattcacttaaattatttatggttgataagaatttgtcatttcatcagcagaaaataaatcgtgaatctgattcattagtcatttttattgaagaccctgaatttaagaagaaggattacctaatgaatccggataaatattatacaaaagcagattttaagacagatcaacgagtagatgatctgatacagctattttccaatgaaatgaagagtggaatagctacatcagattctataatgaatggaagtgtacatctggaactgctttctttcagggaaaagcgaagtacacccttactcttcttatcagcctggacattatgctcttctgctcttattggaattcctttaacaaacgtaacaacttcgcttgaaattcaactgactatttataacaacaaggatcaaattgcaggtaaatacactggcaaaggaaaagggactgcatggatagcattgtattggggctatggaaaggatggtggagaaaatctgcattga

SEQ ID NO: 6634 - protein, 242 aa, Unknown
  Obtained from environmental sample
  misc_feature (1)..(242): Xaa is any amino acid
MKISGTIYCIFLSFLFFSCRTVKDSDFMVSKNSFGTILPKLEGNLDLENIHKYLSYGKIKLSGYHHGVIKIKEDPDSLKLFMVDKNLSFHQQKINRESDSLVIFIEDPEFKKKDYLMNPDKYYTKADFKTDQRVDDLIQLFSNEMKSGIATSDSIMNGSVHLELLSFREKRSTPLLFLSAWTLCSSALIGIPLTNVTTSLEIQLTIYNNKDQIAGKYTGKGKGTAWIALYWGYGKDGGENLH

SEQ ID NO: 6635 - DNA, 561 bp, Unknown
  Obtained from environmental sample
  misc_feature (1)..(561): n is a, c, g, or t
atgacaagattacaatcagtgcaaactgagcaagaaaaagaaaatataattaaatatttaaccaaacaagaattaccaataggtatgacaaaacaccagaattataatttcaaaaagagatgtgaaaaatttattataattaacaagattctttatttaaaggaagaagaaggtgatcatagaatggttttaccggatgaaaacaaagatgttatgaaactggaagtagagaaatgtcacaagttaaatcattacgggatgcataaaatggaacaatattgcgcaaaattgtattttcggatagatagagaaataattaggaatgttgtagctacttgtaatttgtgtactcaatgtcaaccacttaagaagtatcaaaaaatcaaaagtatttttgcaacaaaaccttttgaaagagtccagatagatcctatgtacctacgtaaatttgtacaagaaagtaagggatttaattggatgtccgttcttgttgacgtctattcaaagttttgcattacatggtccatcaagacaaaagaaagtacagtcgactctcgatag

SEQ ID NO: 6636 - protein, 186 aa, Unknown
  Obtained from environmental sample
  misc_feature (1)..(186): Xaa is any amino acid
MTRLQSVQTEQEKENIIKYLTKQELPIGMTKHQNYNFKKRCEKFIIINKILYLKEEEGDHRMVLPDENKDVMKLEVEKCHKLNHYGMHKMEQYCAKLYFRIDREIIRNVVATCNLCTQCQPLKKYQKIKSIFATKPFERVQIDPMYLRKFVQESKGFNWMSVLVDVYSKFCITWSIKTKESTVDSR

SEQ ID NO: 6637 - DNA, 360 bp, Unknown; identical to SEQ ID NO: 6231
  Obtained from environmental sample
  misc_feature (1)..(360): n is a, c, g, or t

SEQ ID NO: 6638 - protein, 119 aa, Unknown; identical to SEQ ID NO: 6232
  Obtained from environmental sample
  DOMAIN (1)...(112): ATP synthase delta (OSCP) subunit
  misc_feature (1)..(119): Xaa is any amino acid

SEQ ID NO: 6639 - DNA, 357 bp, Unknown; identical to SEQ ID NO: 2887
  Obtained from environmental sample
  misc_feature (1)..(357): n is a, c, g, or t

SEQ ID NO: 6640 - protein, 118 aa, Unknown; identical to SEQ ID NO: 2888
  Obtained from environmental sample
  misc_feature (1)..(118): Xaa is any amino acid

SEQ ID NO: 6641 - DNA, 357 bp, Unknown
  Obtained from environmental sample
  misc_feature (1)..(357): n is a, c, g, or t
ttgggatcctgtgagcgcgaccggataaaggcagttgtagctgagaatatgccggccaactgccggagtctgaagacttnttcggagctcaatgaagatctcaacgaaatgaatcacaaaggatntccggttagcttcaaggagaaggttgcgttctgtagtcttcaactttcatttgcgaagaaaggtgaaaacggccaagtcaattcagatattgatattgatttgcttaccgatattggtcatttcggcgaagtaatcaagaacaagatcacaaagatgaagactgatcctttcacaatctatgttttgctcttcgatcaggggatcagaccactatacacaatcaaggtctga

SEQ ID NO: 6642 - protein, 118 aa, Unknown
  Obtained from environmental sample
  misc_feature (1)..(118): Xaa is any amino acid
MGSCERDRIKAVVAENMPANCRSLKTXSELNEDLNEMNHKGXPVSFKEKVAFCSLQLSFAKKGENGQVNSDIDIDLLTDIGHFGEVIKNKITKMKTDPFTIYVLLFDQGIRPLYTIKV

SEQ ID NO: 6643 - DNA, 336 bp, Unknown
  Obtained from environmental sample
  misc_feature (1)..(336): n is a, c, g, or t
ttgagtattgagggcaagttggtaaagggagtaaaaatggaagaagcggaaaaggcattgcaggaagaattggaaaaaataaaatcaaatgctgttagtaaggaggagcttcaaaaagtaaagaacaaaacggaaagtattatagcttttgaagacatgagcattatgaacagagcaaacagcctggccttttatgagctgttaggtgatgccgacctgatgcatacagaattagaccgctataataagataaccgtagaaaatatattggaagagagtaatacaatttttaaagaaacaaattgtagtacactttggtatttgagcaagaattaa

SEQ ID NO: 6644 - protein, 111 aa, Unknown
  Obtained from environmental sample
  misc_feature (1)..(111): Xaa is any amino acid
MSIEGKLVKGVKMEEAEKALQEELEKIKSNAVSKEELQKVKNKTESIIAFEDMSIMNRANSLAFYELLGDADLMHTELDRYNKITVENILEESNTIFKETNCSTLWYLSKN

SEQ ID NO: 6645 - DNA, 627 bp, Unknown
  Obtained from environmental sample
  misc_feature (1)..(627): n is a, c, g, or t
atgaattgccgcataacgcactctgttcaaatcggcgaaacggtgtctgagataaataaaactattgaatcgttaaacattggccttgttattatgggaattcagggactgggtaaaacaagccggttctttttcggaagcaattcacgatctctcatcaacaaatctacctgcccggtactcgttattccggagacaatcctcttcaagaaaccagagaaaattgtttttgcaaccgactattacgacagcgatctagatgctttacttcaactggtactgatcgcgaagccttttaattctgaaattattatggtgcatgtattcgacgaaaaggaggaggagcagtcggaacaaagcatgatacagtttatttcgaatgaaatatttaaaacagttgattatccccggatcacttatcgagcctattacaataaagatacatcacagggtattaagaatttctgtgattttacaggtgctgatctggtggtgctttccgcccggaagcaaaacatatttcagaagatatttggcaaaagtattacgaaagatctcgtttaccaaagtgacattcccttgttggtttttcatgtacataagatggaaacctctggtgctatttaa

SEQ ID NO: 6646 - protein, 208 aa, Unknown
  Obtained from environmental sample
  misc_feature (1)..(208): Xaa is any amino acid
MNCRITHSVQIGETVSEINKTIESLNIGLVIMGIQGLGKTSRFFFGSNSRSLINKSTCPVLVIPETILFKKPEKIVFATDYYDSDLDALLQLVLIAKPFNSEIIMVHVFDEKEEEQSEQSMIQFISNEIFKTVDYPRITYRAYYNKDTSQGIKNFCDFTGADLVVLSARKQNIFQKIFGKSITKDLVYQSDIPLLVFHVHKMETSGAI

SEQ ID NO: 6647 - DNA, 621 bp, Unknown
  Obtained from environmental sample
  misc_feature (1)..(621): n is a, c, g, or t
atgctgaattttgaaatactgtttgaagatggttctgtgattgtggttgcaaaaccggcgggattaatggtggaagccgacaggttcggcaatccgagcttggaagaggaaattgccaggtattttaaggaaaagcgtgtctcgcagaatacaattatcggtattgttcacaggctggacaggccggtgagcggtgtgatgatcatcgcgaaaaaaagaagtgtattaaaagaattaaacgatcagtttgaaaaagggttagtagacaaaacttatttcgcaactgttgaaggaaagcctgcaaaacaggaagcgcatttgcagcattatttgcgcaaggattcaaatttgaaaaaagcgatcatctacagaaacaagcaacacgataccgcgaaatgtgaattgatatataaggaaataaaatcagataaaaatacaagcctgctcgaagttcatcccctcaccggaaaatatcaccagatacgggcgcagctttcttttatcggctgcccgattgtcggggatgtgaaatacaattcaaaaattaagtataaacccgattcaatttgcctgcattcgcaatcagttgaattctttcacccggttgaaaagaaaaaatga

SEQ ID NO: 6648 - protein, 206 aa, Unknown
  Obtained from environmental sample
  DOMAIN (12)...(167): RNA pseudouridylate synthase
  misc_feature (1)..(206): Xaa is any amino acid
MLNFEILFEDGSVIVVAKPAGLMVEADRFGNPSLEEEIARYFKEKRVSQNTIIGIVHRLDRPVSGVMIIAKKRSVLKELNDQFEKGLVDKTYFATVEGKPAKQEAHLQHYLRKDSNLKKAIIYRNKQHDTAKCELIYKEIKSDKNTSLLEVHPLTGKYHQIRAQLSFIGCPIVGDVKYNSKIKYKPDSICLHSQSVEFFHPVEKKK

SEQ ID NO: 6649 - DNA, 336 bp, Unknown
  Obtained from environmental sample
  misc_feature (1)..(336): n is a, c, g, or t
atggttcatatcttagttggaaagcattttatacaaaatccagaaaataaactattcataaatcataaagacggtaataggtggaataatttaattggtaatcttgaatggtcaaccaatgcagaaaatcaaaaacattcctatgatgtgttagggaatgttgctgtaaaaggagaagaaaacggtcaatcaaaaattacaactgcacaagtaataaaaataagacaaagctataaaacaggaataactcaaaaacgattatctcaagaattcaaagtatctcaaagtaatataggatttattgtaaactacaaaagatggaagcacgttatttaa

SEQ ID NO: 6650 - protein, 111 aa, Unknown
  Obtained from environmental sample
  DOMAIN (1)...(50): HNH endonuclease
  misc_feature (1)..(111): Xaa is any amino acid
MVHILVGKHFIQNPENKLFINHKDGNRWNNLIGNLEWSTNAENQKHSYDVLGNVAVKGEENGQSKITTAQVIKIRQSYKTGITQKRLSQEFKVSQSNIGFIVNYKRWKHVI

SEQ ID NO: 6651 - DNA, 468 bp, Unknown
  Obtained from environmental sample
  misc_feature (1)..(468): n is a, c, g, or t
ttgcggacaaccataagctcgcaaaaacatcaggcactcccggcaaaaacacaactgattaatcatttcatcattaacggtgaatggtatctggtggatttgccaggctatggatttgcaaaagtttcgcaaaccgcgcgtaacaggtgggaacagatgattgaaaactacctgcgtaaaagagaaaatctcgcgaatgtttttgttcttatcgatggacggcatacaccgcagaaaatcgatatcgactttatcaataaattgggtaaatgggaggtgcctttctccattgtctttacgaagtcggataaagaaacccaaaagatagtaagtcagaatgtaaaactgtttctcggcaagttgagggaaagctggcagtttctgcctgaacattttgttacaagtgcaacaaaaaaaacgggaaaggaaaaactattaggctttattgaaaaagccatcaatggttag

SEQ ID NO: 6652 - protein, 155 aa, Unknown
  Obtained from environmental sample
  misc_feature (1)..(155): Xaa is any amino acid
MRTTISSQKHQALPAKTQLINHFIINGEWYLVDLPGYGFAKVSQTARNRWEQMIENYLRKRENLANVFVLIDGRHTPQKIDIDFINKLGKWEVPFSIVFTKSDKETQKIVSQNVKLFLGKLRESWQFLPEHFVTSATKKTGKEKLLGFIEKAING

SEQ ID NO: 6653 - DNA, 504 bp, Unknown
  Obtained from environmental sample
  misc_feature (1)..(504): n is a, c, g, or t
ttggggcggaaaatccccatgatattttcagccgttgttgcggtagatcttaaaaatggtattggtgccaataataaacttatgtggcatctgccggccgaccttaaattctttaagtcggttactatggggcatcctattattatgggccgcaagacctacgaatctattggacgtttgttaccgggccgaagaaatgtgatcattacacgtaacgccgattataaagttgatggcgctgaggtttacggaagtattaaagaggctattgatcattgcaggaacgaggaaaaagtatttatcattggcggagccgagatctttaagcaaagtatggatcatttgaatgagatctaccaaacggtggtgaaacatacctttgcggcggataccttcatggatcctatcgataccagaaaattcaaaagggtgtggagtgaggagcataaggcggatgagaagaacaaatacgattacacgtttgaaaagtatgagaggatctag

SEQ ID NO: 6654 - protein, 167 aa, Unknown
  Obtained from environmental sample
  DOMAIN (8)...(166): Dihydrofolate reductase
  misc_feature (1)..(167): Xaa is any amino acid
MGRKIPMIFSAVVAVDLKNGIGANNKLMWHLPADLKFFKSVTMGHPIIMGRKTYESIGRLLPGRRNVIITRNADYKVDGAEVYGSIKEAIDHCRNEEKVFIIGGAEIFKQSMDHLNEIYQTVVKHTFAADTFMDPIDTRKFKRVWSEEHKADEKNKYDYTFEKYERI

SEQ ID NO: 6655 - DNA, 771 bp, Unknown
  Obtained from environmental sample
  misc_feature (1)..(771): n is a, c, g, or t
atgctgctggctggttatttaagcaaagacatagaggagtatggtgttataaaaattaccaaagcaggtgaagccttcctcaaaaaaccaaagtcattcaagatagtactgaataacctgtttgaagaagcgaatgaggatgatgaagaaggaagcgatgaagccacaggtgccgccacggatgaaaaactttttgaaatgctgaaagaattgcggcaaaaagaagcaaggaaaaaaggcctgccgccatttgttattttcctggaaacgtcgttgcaggatatggcgacgctttatcctgttaccgttgcggacctggataaatgccagggtgtaagcaagggtaaggcgatgcgttatggcaaaccatttgttgaaatgattgccaactatgtaactgaaaacaatattgaaaggccggatgattttgtaatgaagagcgtcgtgaataaaagcggcaataaggtcttcatcatacagcagacggataagaaaatgccgctcgagacaatagcaaagaataaaggctggagattggatgaaatgctggaagaaatggaaactatcgcagccagcggcaccaagctcaacctggactatgcgatagatgaaatgatagatgaagatgaccaggatgaaataatggaatacttcaagggttgcgaaacctcgtcattgcaggtagcgcaggaagagttgtctgatcataatttcacctgggagcaactgaagatcatgcgtatcaagtttttagcgcaatatggcatgtaa

SEQ ID NO: 6656 - protein, 256 aa, Unknown
  Obtained from environmental sample
  DOMAIN (58)...(138): HRDC domain
  misc_feature (1)..(256): Xaa is any amino acid
MLLAGYLSKDIEEYGVIKITKAGEAFLKKPKSFKIVLNNLFEEANEDDEEGSDEATGAATDEKLFEMLKELRQKEARKKGLPPFVIFLETSLQDMATLYPVTVADLDKCQGVSKGKAMRYGKPFVEMIANYVTENNIERPDDFVMKSVVNKSGNKVFIIQQTDKKMPLETIAKNKGWRLDEMLEEMETIAASGTKLNLDYAIDEMIDEDDQDEIMEYFKGCETSSLQVAQEELSDHNFTWEQLKIMRIKFLAQYGM

SEQ ID NO: 6657 - DNA, 414 bp, Unknown
  Obtained from environmental sample
  misc_feature (1)..(414): n is a, c, g, or t
gtgacagatgatattgttccgatacagccgctccaaattgtattgaagggaaataatacaattatcctcgacgcctataatgcgaatcctacaagcatggaagctgcgctgaagaattttgaaacgatcggttcggaaaataaaattgttttcataggggaaatggcagagttgggagatgaaagtgaaaaggagcacaggcatattgcagagctgcttaaacaaattcattgcgataaaattgtgctggtaggtgaaaaatttgcaggctataaatcaattctgaattatcagcattttgaaaattcccagaaagcttctgaatggctgaagcaaaatccgctaaagaattcttatatactcattaaggggtccagaagtacaaaaatggaaaagattatggaagccctttaa

SEQ ID NO: 6658 - protein, 137 aa, Unknown
  Obtained from environmental sample
  DOMAIN (9)...(95): Mur ligase family, glutamate ligase domain
  misc_feature (1)..(137): Xaa is any amino acid
MTDDIVPIQPLQIVLKGNNTIILDAYNANPTSMEAALKNFETIGSENKIVFIGEMAELGDESEKEHRHIAELLKQIHCDKIVLVGEKFAGYKSILNYQHFENSQKASEWLKQNPLKNSYILIKGSRSTKMEKIMEAL

SEQ ID NO: 6659 - DNA, 915 bp, Unknown
  Obtained from environmental sample
  misc_feature (1)..(915): n is a, c, g, or t
gtgctcgaccgcgctcaacagatcatggatgaatgtaggaaactcggattggaatccaaagcctatcccgctgaccaatacctgctcaccaacatccttgtggatcgtcccgatgtcatcgtgaaccttgtcgatacagtaagaggcaaggacaagctggcaagtacgattccggcgtttctggaatatgccaatattccctatacgggctgtggcatcacgggtatggtgataggaagtaaccgccacatgttcaaggagttattggaacataacggcatccccacgcctcaatataaattcatcaaagatctgcgatccaaaacaccgccggcattcgatccgccgtacatcgttaaactaaatgaaagcggcggcagcatgggtatcgataacaaggctgtgaaggaaacggccaaccaggtgctgaaaaaagtagaggacctgtataactcctataacaagatcccggtgttgatcgaaaaatttgtggatggccttgaattgacgggtgttgtcttcgacgatggcaagacgcgccatgtcttccttgccaataagaagttcaacctcaagccggatggaaaacatgcctataccagcatcgaaagttatgaagacctgaatgcctaccaatatgagcctgtcgaggaagagctggagaaaaaggtttctgaactgtgtgaacgggcattcgatgtccttcgttttacagactatgccaagttcgatatccgtgtggatgagaccgatatgactccctattttattgactgtaacccgaacacggcattggggcccggtgaccagccgatgaccgaggtcatgagtatgtatggaattgagtttccagatattctggccagcctcttgagtagccatgtcaagaaccccacaagacccaaagagatttag

SEQ ID NO: 6660 - protein, 304 aa, Unknown
  Obtained from environmental sample
  DOMAIN (81)...(292): D-ala D-ala ligase C-terminus
  misc_feature (1)..(304): Xaa is any amino acid
MLDRAQQIMDECRKLGLESKAYPADQYLLTNILVDRPDVIVNLVDTVRGKDKLASTIPAFLEYANIPYTGCGITGMVIGSNRHMFKELLEHNGIPTPQYKFIKDLRSKTPPAFDPPYIVKLNESGGSMGIDNKAVKETANQVLKKVEDLYNSYNKIPVLIEKFVDGLELTGVVFDDGKTRHVFLANKKFNLKPDGKHAYTSIESYEDLNAYQYEPVEEELEKKVSELCERAFDVLRFTDYAKFDIRVDETDMTPYFIDCNPNTALGPGDQPMTEVMSMYGIEFPDILASLLSSHVKNPTRPKEI

SEQ ID NO: 6661 - DNA, 303 bp, Unknown
  Obtained from environmental sample
  misc_feature (1)..(303): n is a, c, g, or t
gtgaccgagaaaatcaaactcaacggcggactcgataaaaccgtcacatggatttgggtagaagatgacaaactcaaagtggagtattatgatttcagcgaagaggctcagcgtacttttggcaatgacattgcttatattttgacgatcaatgaaatggagaaattattttcgctttcaaatcaaaatgcaaatacattgattgaatggctcgagaaaaattttcaaagttattttggaatcaaacaatggctggaagagaataaaattggttttgaaaaagaaatagatagttgggcataa

SEQ ID NO: 6662 - protein, 100 aa, Unknown
  Obtained from environmental sample
  misc_feature (1)..(100): Xaa is any amino acid
MTEKIKLNGGLDKTVTWIWVEDDKLKVEYYDFSEEAQRTFGNDIAYILTINEMEKLFSLSNQNANTLIEWLEKNFQSYFGIKQWLEENKIGFEKEIDSWA

SEQ ID NO: 6663 - DNA, 303 bp, Unknown; identical to SEQ ID NO: 6661
  Obtained from environmental sample
  misc_feature (1)..(303): n is a, c, g, or t

SEQ ID NO: 6664 - protein, 100 aa, Unknown; identical to SEQ ID NO: 6662
  Obtained from environmental sample
  misc_feature (1)..(100): Xaa is any amino acid

SEQ ID NO: 6665 - DNA, 441 bp, Unknown
  Obtained from environmental sample
  misc_feature (1)..(441): n is a, c, g, or t
gtgtctgcccgtaaactcgcagagaaagaaggtgtagagatcaagatgtattctatnatctacgaggctatcaacgaaatcaaggccgctattgaaggcatgcttgaacntaccaaagaagagaagatcgtgggacaggtagaagtcagagagatattcaaggtcagcaagattggaacagttgccggctgtatcgtccttgaaggtaaagtagcccgtaactatcacgtccgaatcatcagggatggtattgtaatctatccgacaaaggaaaatgttcatggtgaaatcgcaacactcaagcgatttaaagatgatgtgaaagaagtgaaagccggacttgaatgcggtatcatcatcaagaatttcaatgacatcaaagttggcgatatcattgaagtatacgagatcaatgaaatccggcagaagctcgaaaactaa

SEQ ID NO: 6666 - protein, 146 aa, Unknown
  Obtained from environmental sample
  DOMAIN (59)...(133): Elongation factor Tu domain 2
  misc_feature (1)..(146): Xaa is any amino acid
MSARKLAEKEGVEIKMYSXIYEAINEIKAAIEGMLEXTKEEKIVGQVEVREIFKVSKIGTVAGCIVLEGKVARNYHVRIIRDGIVIYPTKENVHGEIATLKRFKDDVKEVKAGLECGIIIKNFNDIKVGDIIEVYEINEIRQKLEN

SEQ ID NO: 6667 - DNA, 561 bp, Unknown
  Obtained from environmental sample
  misc_feature (1)..(561): n is a, c, g, or t
atgcgaaaaaattttcagatagtattggcttttgccatgacaatagcgacaagcaatacattgtttgcactagaagcaaaaaatcatcgcccaaaaattaaaacagaaaaaatgaacacagcaacattaaccgacaacaaacaagtaattcgaagcatttacgaaaacatacttaacaaacgacatttagagctcttgaatacagttattgacgagaactatattggtacacaaggcgaaaaaggaccggaaggttttaagcaaactgttaaaggtctcttagacgctttccccgatattcaatggcacatacaagatttgttggcagatgaaaataaagtgatacttcgctggacgtggacaggcacatttcaaaatgaatttcgtggctttgcgcctaatcaaaaactatttaccaacgaagggattgttatttatgaattggataatggtaaagcaataaaagtgtggatgcaatctgatatacttggtttttttaagcaggcgggagttatttctgcttcacaacttacaggcggtgcanaccaaaaaancaactga

SEQ ID NO: 6668 - protein, 186 aa, Unknown
  Obtained from environmental sample
  SIGNAL (1)...(18)
  misc_feature (1)..(186): Xaa is any amino acid
MRKNFQIVLAFAMTIATSNTLFALEAKNHRPKIKTEKMNTATLTDNKQVIRSIYENILNKRHLELLNTVIDENYIGTQGEKGPEGFKQTVKGLLDAFPDIQWHIQDLLADENKVILRWTWTGTFQNEFRGFAPNQKLFTNEGIVIYELDNGKAIKVWMQSDILGFFKQAGVISASQLTGGAXQKXN

SEQ ID NO: 6669 - DNA, 528 bp, Unknown
  Obtained from environmental sample
  misc_feature (1)..(528): n is a, c, g, or t
gtgaaagaaatcattagtatattaatagtaagtatgagaactggtttattgtccgtccttttaactatgcttcttttttcttcttgtcaaaaagaaatacattttccctatactgctccccctgctaccagcaagatcaatattcagtacacacctttgaatgccacatcaacaaagtttgaattgataataagcgattcaagtaaaaaggttctttatgataatgaactcgatgtaaataaaacgcatgctattgaaatacctgcaaaacaatacaatttaaccaccatagaatatgataatgcagaaaaaaaatacaagagcaaaacatatctgaatataaaagctacaaattgggtgatacgtcctttagacgataagcaaaatataggaagcttaaacatatctggagggacagacgcaaaattaatgtatgaaaacgtaccggattttacagggtttacattttattccggcagccaataccaacctgggagcacagtatcggtacaccatctgtcttggtaa

SEQ ID NO: 6670 - protein, 175 aa, Unknown
  Obtained from environmental sample
  misc_feature (1)..(175): Xaa is any amino acid
MKEIISILIVSMRTGLLSVLLTMLLFSSCQKEIHFPYTAPPATSKINIQYTPLNATSTKFELIISDSSKKVLYDNELDVNKTHAIEIPAKQYNLTTIEYDNAEKKYKSKTYLNIKATNWVIRPLDDKQNIGSLNISGGTDAKLMYENVPDFTGFTFYSGSQYQPGSTVSVHHLSW

SEQ ID NO: 6671 - DNA, 459 bp, Unknown
  Obtained from environmental sample
  misc_feature (1)..(459): n is a, c, g, or t
atgaattaccaaaaaaacaggttaataaaaatatctaataaggttacaagcaataactctttatcccctgaagagatttcacagctgatgacctttgaaaaaatagaaaaagagataacaccggtaaaaacactaaaaaggctggctgtccccctctctttaatatttggttttttgattgttgtattttccgtggaatttgaaagttttgtaaaccaaatgcctgattggacaaatcttaatccaaagcttcaagcaggtttaaattacttttggaatatcttgggggaaccggttgatgaggcaaatattttatatcatttacctaacattgtgctttattcattcgggatcttaggattgaaaaaactaattgatctcctggaaaagacaacatggctggataaggtttacaccgccaaaactctacttacagaatctttgaaaatggcaggntaa

SEQ ID NO: 6672 - protein, 152 aa, Unknown
  Obtained from environmental sample
  misc_feature (1)..(152): Xaa is any amino acid
MNYQKNRLIKISNKVTSNNSLSPEEISQLMTFEKIEKEITPVKTLKRLAVPLSLIFGFLIVVFSVEFESFVNQMPDWTNLNPKLQAGLNYFWNILGEPVDEANILYHLPNIVLYSFGILGLKKLIDLLEKTTWLDKVYTAKTLLTESLKMAG

SEQ ID NO: 6673 - DNA, 723 bp, Unknown
  Obtained from environmental sample
  misc_feature (1)..(723): n is a, c, g, or t
atgacgttgaatgggactcaaaaattaccaaagtctggcaagcttcatctcgaattgggcggaatgtacctgcacaccaaggaatacgataaggcaataaattattttgagaaaggcattgacgtcgaacctggctacccctcaaattattaccagcttgccaaaatatttctcaactccgaagaagaggtatggggcatgatctatggagaaatattcatgaatcttgagcgaaacagcgcgcgcaccgctgagatcagcaaaatgttgtacgacacctataaaagtgaaatcaaatttacgtcggatacatcgtttaccatcagtttcagcaagagcgcaatcataaataccagctcgaaaaaaatagaattgccattcggagtgggtgtttatgagccgacattgatgatggagatcataccggaaaagcaaattgacctgaattccctggacagaatcagaacaggttttctgaagaattactttagcaataacaggcacaaaaaatatcccaatgtcctgtttgactaccaaaatataattcttaaggaagggcatttagagtcgtacaaccattggatcctgatgaaaggagacgaaggtggatttaacagatggagggagggaaatgccgaaaaatggacgaaattcactgattggttcaatcggaacgccctaaaaataaacgacaaaaacaaattcataaggacacaatactaa

SEQ ID NO: 6674 - protein, 240 aa, Unknown
  Obtained from environmental sample
  DOMAIN (13)...(46): TPR Domain
  misc_feature (1)..(240): Xaa is any amino acid
MTLNGTQKLPKSGKLHLELGGMYLHTKEYDKAINYFEKGIDVEPGYPSNYYQLAKIFLNSEEEVWGMIYGEIFMNLERNSARTAEISKMLYDTYKSEIKFTSDTSFTISFSKSAIINTSSKKIELPFGVGVYEPTLMMEIIPEKQIDLNSLDRIRTGFLKNYFSNNRHKKYPNVLFDYQNIILKEGHLESYNHWILMKGDEGGFNRWREGNAEKWTKFTDWFNRNALKINDKNKFIRTQY

SEQ ID NO: 6675 - DNA, 333 bp, Unknown
  Obtained from environmental sample
  misc_feature (1)..(333): n is a, c, g, or t
gtgctcagcaactccatagagtgcatcgtttacgaagaaaatagggataatttcgtaatagtttctaaatatatagagatatacaacccccagaatgatgctcacgacaagcggaaatacgcagacngagacaagaaggataatcgagggcataatacgaaacatcatactctgtcactatatatgttctcttcctattttccaataatcactaatatcgaggagcangaggaatccgagatcgntgatatgcctgctttttctttcgaatactccactgagccttcgataagtgatcgaggaatcaaaaacaacagaccgcgcaaaaaatag

SEQ ID NO: 6676 - protein, 110 aa, Unknown
  Obtained from environmental sample
  misc_feature (1)..(110): Xaa is any amino acid
MLSNSIECIVYEENRDNFVIVSKYIEIYNPQNDAHDKRKYADXDKKDNRGHNTKHHTLSLYMFSSYFPIITNIEEXEESEIXDMPAFSFEYSTEPSISDRGIKNNRPRKK

SEQ ID NO: 6677 - DNA, 603 bp, Unknown
  Obtained from environmental sample
  misc_feature (1)..(603): n is a, c, g, or t
ttgtatatttgcaacgaaaacaacttcatgatcgattttaacaacaccgaaattgcctttgccggcaaaaacaataaggaacttaaaagtgcttattttttatttaaaattcttagctttcccttactcgttaaaattggaaaagcacttacactttttgcttttaaaatccatttcccaataaaaagacttgttaaaagaaccatatttgcacagttttgcgggggtgaaagcatcgaagaatcgaaaagtaaaattagtgtacttggaaaatacaaaattggaaccattcttgattattctgttgaaggacaagaagacgacagcactttagacaaaacctgtgaagaaataattaaaactgcagaaattgcaaataataatacggatgttcctttttgtgtttttaaagtaacaggtgttgcaaaatttactttactcgaaaaaataagtagcaattcagaattaagttcagaagaaaaacagtcgtatttaaaagtggttaacagagtcgattctatatgtaaaaaagcatttgaatcggaaactcctgtatttattgacgctgaagaatcatggattcaaccggcaatgacggattag

SEQ ID NO: 6678 - protein, 200 aa, Unknown
  Obtained from environmental sample
  misc_feature (1)..(200): Xaa is any amino acid
MYICNENNFMIDFNNTEIAFAGKNNKELKSAYFLFKILSFPLLVKIGKALTLFAFKIHFPIKRLVKRTIFAQFCGGESIEESKSKISVLGKYKIGTILDYSVEGQEDDSTLDKTCEEIIKTAEIANNNTDVPFCVFKVTGVAKFTLLEKISSNSELSSEEKQSYLKVVNRVDSICKKAFESETPVFIDAEESWIQPAMTD

SEQ ID NO: 6679 - DNA, 888 bp, Unknown
  Obtained from environmental sample
  misc_feature (1)..(888): n is a, c, g, or t
ttgaattattgttgtaatgatggatcaaatgataatgtagaaaaagtgataaaaaattttattgataaacatgcggtctggaatataaaattacttacttgtcctcataaaggaccggctgcagccagaaattccggaatcaatatatctcagggagaaattgttttttttaccgatgatgattgtattgttcccgctacatggatggaagaaattatcactatatttatgaatgatgagcatattgcaggggtagggggatggtataagcctccggcggaaaatttaaggaacaatatctatattcaatttcactatcttcttcatagattctcttatggatttgctttagacttatatagaggaaatgcaaaattttttgtcagtaatgaggatcaagaaaagagattttatcctattattactgcaaatgcggcatacaggaaaaaaatacttaaaaaagttggaggatttgacgaaaagtttccttacccggcatacgaagatttggatttaaatgataggattatttcttccggatatgaattatattatcttagttcttatgtgtatgataaccggtttttaaatatgaaaagattttttaaattatgtagcacacgggcaaaagcacactatatttataaaaaaaatcgtacaaaaatgaatcatacctatattatttctccatgggaacaattacgttattttattacttttataaaaaaaagcagaaggtatgttgcagatgattttgtgataaataattaccatatagtactagctgcattatggttttattacggttattttattgctttgctagctactataaaagacgtgtctgctaggttgtcttttttctcccctttaataaaagatatgtaa

SEQ ID NO: 6680 - protein, 295 aa, Unknown
  Obtained from environmental sample
  misc_feature (1)..(295): Xaa is any amino acid
MNYCCNDGSNDNVEKVIKNFIDKHAVWNIKLLTCPHKGPAAARNSGINISQGEIVFFTDDDCIVPATWMEEIITIFMNDEHIAGVGGWYKPPAENLRNNIYIQFHYLLHRFSYGFALDLYRGNAKFFVSNEDQEKRFYPIITANAAYRKKILKKVGGFDEKFPYPAYEDLDLNDRIISSGYELYYLSSYVYDNRFLNMKRFFKLCSTRAKAHYIYKKNRTKMNHTYIISPWEQLRYFITFIKKSRRYVADDFVINNYHIVLAALWFYYGYFIALLATIKDVSARLSFFSPLIKDM

SEQ ID NO: 6681 - DNA, 948 bp, Unknown
  Obtained from environmental sample
  misc_feature (1)..(948): n is a, c, g, or t
gtgaatagaaaattgcaaggtcagaggatggatattccatacatggactactggtttgaattgaccaaaacagaattgccgagggatgaaatatttgacgagaacgataagataagaattagcaagggcagctttgaagcaatcgttacagaattggaagcatataatctttcagatacgtcagatgatgtgaaagggatagcctttgaaaaattcttaggaaccactttcagaggacaattaggtcaattcttcacgccccggacagtagtagactatatggtaagcattctagacccacaggaaggagaaacagtttgcgatccatgttgcggtagtggaggtttcttaattaaagcatttgagtatgtaagaaacaaaattgaattagagattcaggtacaaaaggaaaaaatcaaagagcaattctatacagacaaatttgatatgctacctgagaaaaagcaaacagaaatcgaaatcacgatcaatgaccttttcaacaaactcaatgcagagttggacttgaaaaacaaacacagccgtttgcgcaagctatcttatgactgcattttcggaactgatgcgaaccctcgcatggcacgaacagcaaaaatgaatatgatcatgcatggtgatggtcatggcggggtgcatcatcacgatggattgctgaatgtaaatggaatttatgaggaaaggtttgatattatcctcactaatcctccttttggtgcgagggtagaaaaatctctaaagattacgcaagctgacatgccctctcaagaaaagattgacaaatacaataggcgttatcccggttatgaaaccaatgccttaagccaaataaaaaacaatatcaataaatcgcttttagacttgtatgatgtcggggaaatgacaggtttaacggaagttctcttcattgaaagagccttcaccttctaa

SEQ ID NO: 6682 - protein, 315 aa, Unknown
  Obtained from environmental sample
  misc_feature (1)..(315): Xaa is any amino acid
MNRKLQGQRMDIPYMDYWFELTKTELPRDEIFDENDKIRISKGSFEAIVTELEAYNLSDTSDDVKGIAFEKFLGTTFRGQLGQFFTPRTVVDYMVSILDPQEGETVCDPCCGSGGFLIKAFEYVRNKIELEIQVQKEKIKEQFYTDKFDMLPEKKQTEIEITINDLFNKLNAELDLKNKHSRLRKLSYDCIFGTDANPRMARTAKMNMIMHGDGHGGVHHHDGLLNVNGIYEERFDIILTNPPFGARVEKSLKITQADMPSQEKIDKYNRRYPGYETNALSQIKNNINKSLLDLYDVGEMTGLTEVLFIERAFTF

SEQ ID NO: 6683 - DNA, 909 bp, Unknown
  Obtained from environmental sample
  misc_feature (1)..(909): n is a, c, g, or t
atggaagttaagataaacggcaataaaatttttgctccattaaagggcaaagatttagttcttactccagaagagagggtgaggcaggattttatttgtcggctcgttaatcactttggctatcatttaattcaaatggagcaagaggtcaaagtcaataattcaaaacgagggcagggcaaagcacgtgcagatatcgtcatttggaaaaatgagaaagaaagaattgatgagaaaagtccggtagtagttgtagagtgtaaagccgaacacattaccattcatgaagaagactattaccagggatttaattatgcatcatgggcaggtgcagattttttcattaccaccaacttgaaagaaacaaaagttttcaaagtggtcaaaggcaaaatgccaaaaaagttggacgagattgttgatttaccgaaggcaaaggacataaccaatgaaaagaaaattcaggaattattagcaaagacaaaagcatttacccgtgatgaattttcaaaactgcttttcaaatgccataacataattcgcaacaacgataaactttctcctgaagcagcatttgatgaaatcagcaaaattcttttcatgaaaattcgctatgaacgcaatccagatgaacataccattttcaccttagaggtttttcaaaagcaggaagccaattatgaaaaaaatattcgaccagtgaatagaaaattgcaaggtcagaggatggatattccatacatggactactggtttgaattgaccaanacagaatttgccgaggatganatatttgacgagaacgatnagataagaattaagcaaggcagctttgaaagcatcgttacagaaatggaagcatataatctttcagatacgtcagatgatgtgaaagggatagccttttga

SEQ ID NO: 6684 - protein, 302 aa, Unknown
  Obtained from environmental sample
  DOMAIN (21)...(133): Type I restriction enzyme R protein N terminus (HSDR_N)
  misc_feature (1)..(302): Xaa is any amino acid
MEVKINGNKIFAPLKGKDLVLTPEERVRQDFICRLVNHFGYHLIQMEQEVKVNNSKRGQGKARADIVIWKNEKERIDEKSPVVVVECKAEHITIHEEDYYQGFNYASWAGADFFITTNLKETKVFKVVKGKMPKKLDEIVDLPKAKDITNEKKIQELLAKTKAFTRDEFSKLLFKCHNIIRNNDKLSPEAAFDEISKILFMKIRYERNPDEHTIFTLEVFQKQEANYEKNIRPVNRKLQGQRMDIPYMDYWFELTXTEFAEDXIFDENDXIRIKQGSFESIVTEMEAYNLSDTSDDVKGIAF

SEQ ID NO: 6685 - DNA, 831 bp, Unknown
  Obtained from environmental sample
  misc_feature (1)..(831): n is a, c, g, or t
atgatgatattacttttcgtggtggatcattatttaaacctgaaaatgaaaaacaacttaaaaagcattaaccggaggtcgtttatcggaactactactgctttggcagcgggctggactatacttccgggttctgttataaatggaatgaatagaaaaacttcaggcaataaattagacatagctgtggttgatgcagaaagatggtgggagaaggaacctttaagaattgtagaattggaagagggatatgaatttgcggagaaggcagcattactaaatgacttaggcgccaatatggagcacctcactacatttactggtacttcaccgggtacgtcatttttgtctaaccacgatctttttactggcaaaaatgttgactttgattctttaaaaaattatctctctgaagcgcataataagaacattaaagtaattatttattataatgtacatgccatacaatcttcttatgcgcaccagcatcctgagtggcagcagatccaggatgatggaaaaaccattgagcatgtttacggcatagattcttccttttgtatcaacagcccctggcgggaagaagtcttcgggactttaaaaaaattggctgactataaaattgacggcgttttttatgacgggccgatattcttcgccaacacctgttattgcgagagctgtaaaaaattattcagagaaaaatataaaaaagatcttccttcaaagacgagattatcttccattcgtactggcgctgactggaaagattttattgaatttcagtcagacagcattgcgcgttttttaaaaactctaataaaattttaa

SEQ ID NO: 6686 - protein, 276 aa, Unknown
  Obtained from environmental sample
  misc_feature (1)..(276): Xaa is any amino acid
MMILLFVVDHYLNLKMKNNLKSINRRSFIGTTTALAAGWTILPGSVINGMNRKTSGNKLDIAVVDAERWWEKEPLRIVELEEGYEFAEKAALLNDLGANMEHLTTFTGTSPGTSFLSNHDLFTGKNVDFDSLKNYLSEAHNKNIKVIIYYNVHAIQSSYAHQHPEWQQIQDDGKTIEHVYGIDSSFCINSPWREEVFGTLKKLADYKIDGVFYDGPIFFANTCYCESCKKLFREKYKKDLPSKTRLSSIRTGADWKDFIEFQSDSIARFLKTLIKF

SEQ ID NO: 6687 - DNA, 366 bp, Unknown; identical to SEQ ID NO: 2473
  Obtained from environmental sample
  misc_feature (1)..(366): n is a, c, g, or t

SEQ ID NO: 6688 - protein, 121 aa, Unknown; identical to SEQ ID NO: 2474
  Obtained from environmental sample
  DOMAIN (52)...(120): TrkA-C domain
  misc_feature (1)..(121): Xaa is any amino acid

SEQ ID NO: 6689 - DNA, 762 bp, Unknown
  Obtained from environmental sample
  misc_feature (1)..(762): n is a, c, g, or t
atgctgctttttaaacccttcgaatttgatatacgaaaaatactgtctgataaattaggacggggctcagtcgattgcatgatcaatttaaaagaaaccggaaatgcaaaacctgttactatcaacactgaccttgccaaggcttattataaacccctcgccgcattatcaaaagaccttggcctgagcaccaacgatattcttggaactttgatcaaactgcccgaagtgattacaccaaccagcgatactttaaccgacgcagaatggaagcaatttgaaaaagcaatgcaagtggccattgacaatcttaatcatcaccgtttggatgaaggccggtcactgatgacggacctgatgcttcgcatagctaacattttaaaacaacaagaagaaatcatcaaacttgagcctttgcgtcagcaaaaaataagggaaggcattacacgcctgcttgaagaaaacgtaggtaaagaaaattatgataataaccggcttgaacaggaactgatttactatattgaaaaaatagatattacagaagaacaggttcgattaaaaaaccattgcgaatattttgtaacagttataaccgaaggggaagaatctaaaggcaaaaaattatcctttattctccaggaaattggccgggagataaatactactggagcaaaagcatacgatgccaccattcaaaaatctgtagtgctcatgaaagatgaacttgaaaaggccaaagaacaggttttgaatgttctgtaa

SEQ ID NO: 6690 - protein, 253 aa, Unknown
  Obtained from environmental sample
  DOMAIN (4)...(118): YicC-like family, N-terminal region
  misc_feature (1)..(253): Xaa is any amino acid
MLLFKPFEFDIRKILSDKLGRGSVDCMINLKETGNAKPVTINTDLAKAYYKPLAALSKDLGLSTNDILGTLIKLPEVITPTSDTLTDAEWKQFEKAMQVAIDNLNHHRLDEGRSLMTDLMLRIANILKQQEEIIKLEPLRQQKIREGITRLLEENVGKENYDNNRLEQELIYYIEKIDITEEQVRLKNHCEYFVTVITEGEESKGKKLSFILQEIGREINTTGAKAYDATIQKSVVLMKDELEKAKEQVLNVL

SEQ ID NO: 6691 - DNA, 336 bp, Unknown
  Obtained from environmental sample
  misc_feature (1)..(336): n is a, c, g, or t
atgcctggcagatgccgggcattttggtttcagtatttttgttgctatctaaggcataaaattttctttcaatttagcatggctaaagaaattaaaagattaagctggaaaaatttcattgctacgcctgaatctggtgcaacaacgttcattaactatgatgatgaagaaaatattcttgaaataaaatttgtcagtggcatttatcattatttcgatgtgccgcaaaatgtttggaaagaattaaaagcttatgtagaagcaggtggctcttcaggtaaatttgtcaacttgattataaagccactttataaatataaaaaactcgatgactga

SEQ ID NO: 6692 - protein, 111 aa, Unknown
  Obtained from environmental sample
  misc_feature (1)..(111): Xaa is any amino acid
MPGRCRAFWFQYFCCYLRHKIFFQFSMAKEIKRLSWKNFIATPESGATTFINYDDEENILEIKFVSGIYHYFDVPQNVWKELKAYVEAGGSSGKFVNLIIKPLYKYKKLDD

SEQ ID NO: 6693 - DNA, 1101 bp, Unknown
  Obtained from environmental sample
  misc_feature (1)..(1101): n is a, c, g, or t
atgtttggcgaaaaagtggccaaaatcattgatggattaacaaaaatttcaggagtatttgaccagacttcttcgctgcaggcagaaaatttcaggaaaatgctgcttactctttctgaagatgtgcgtgttattcttattaaactggccgaccgcctgcacaatatgcgtacccttgattcaatggcaagggacaaacaattaaaaattgcatcggaaacactgtatttatatgcccctctggcgcaccggcttggcctgaatgccataaaaacagagatggaagacctgggcttaaaatataccgagccccaggtgtttgaagacattacccaaaaattaagggaaacagaaccggaaagaaaaaaattcgtccataaatttatcgtcccactaaaagagatactggacgaacaagggataaaagccaccattattggccgctcaaaatcaatttattccattcacaataaaatcaaaaccaagggagttccttttgaagagatatacgatctttttgccatccgcgttattatacatacttcagagaaaaaggaaaaatcagactgctggaaagtatactccatcattaccgatttttatcaacccaaccctgacagactccgggactggatatcaacaccgaaagcaaatggctatgagtcgctgcataccactgtaatggggcctgatggcaaatgggtagaagtccagatcaggtcggagcgaatggatganatagcagaaaaaggatatgctgctcattggaaatacaagaattctgccgctgaaaatcaacttgacgattggataaaaagaatacgggaactgcttgaaagtccggaagaaatgccatggacttcattgatgatttcaagctcaatctatttgcagaagaatttttgcngtttacacccaaggcgaaatgcgtaccttacccgtaatgccacccgccttgatttcgcattcaacatcacaccaaattggaaaaaaatgtttcggggcaaaataaatccaaaacttgttcctttagttaccctggaagggggcgaccggttgaaatcctaccatccgaaaaccaagtccccaaaaaaaggctga

SEQ ID NO: 6694 - protein, 366 aa, Unknown
  Obtained from environmental sample
  DOMAIN (147)...(262): Region found in RelA / SpoT proteins
  misc_feature (1)..(366): Xaa is any amino acid
MFGEKVAKIIDGLTKISGVFDQTSSLQAENFRKMLLTLSEDVRVILIKLADRLHNMRTLDSMARDKQLKIASETLYLYAPLAHRLGLNAIKTEMEDLGLKYTEPQVFEDITQKLRETEPERKKFVHKFIVPLKEILDEQGIKATIIGRSKSIYSIHNKIKTKGVPFEEIYDLFAIRVIIHTSEKKEKSDCWKVYSIITDFYQPNPDRLRDWISTPKANGYESLHTTVMGPDGKWVEVQIRSERMDXIAEKGYAAHWKYKNSAAENQLDDWIKRIRELLESPEEMPWTSLMISSSIYLQKNFCXLHPRRNAYLTRNATRLDFAFNITPNWKKMFRGKINPKLVPLVTLEGGDRLKSYHPKTKSPKKG

SEQ ID NO: 6695 - DNA, 489 bp, Unknown; identical to SEQ ID NO: 1435
  Obtained from environmental sample
  misc_feature (1)..(489): n is a, c, g, or t

SEQ ID NO: 6696 - protein, 162 aa, Unknown; identical to SEQ ID NO: 1436
  Obtained from environmental sample
  DOMAIN (37)...(140): AsnC family
  misc_feature (1)..(162): Xaa is any amino acid

SEQ ID NO: 6697 - DNA, 408 bp, Unknown
  Obtained from environmental sample
  misc_feature (1)..(408): n is a, c, g, or t
atgagatcacaaagaaatattgaaagaaatatggacaagaaaaaagtgatgataattgaagatgaaattgatattcttcttctttataaagattatctaaataataaaggtttttcagttctagctacatctactacggctaatgaagcattaaaagattacgaaaacttttatcctaacatgattatattagattataatcttcccggaaaactcagcggattagaagcagctaagcaaatactcgcaagatatcccagcgttcccataatcatagtaacagcttatgagactgttaaaaatgagatgtcaaaagaccacttctttgctgataagaagattgtccttttacttaaacctatcaaattacatatacttgagtataccgttaaaactcttctagaatag

SEQ ID NO: 6698 - protein, 135 aa, Unknown
  Obtained from environmental sample
  DOMAIN (14)...(135): Response regulator receiver domain
  misc_feature (1)..(135): Xaa is any amino acid
MRSQRNIERNMDKKKVMIIEDEIDILLLYKDYLNNKGFSVLATSTTANEALKDYENFYPNMIILDYNLPGKLSGLEAAKQILARYPSVPIIIVTAYETVKNEMSKDHFFADKKIVLLLKPIKLHILEYTVKTLLE

SEQ ID NO: 6699 - DNA, 633 bp, Unknown
  Obtained from environmental sample
  misc_feature (1)..(633): n is a, c, g, or t
atgctctatgagttaatcagaatcttcctgaaatttctttttcctccctactgttgtcactgtcaaaaaaccggttcccttctctgctttaactgctatgaatctttagtatttttacccaaactggatatttgtaaaaacagcttagcttacttagaggacgtctgcggcgtgttggaattttctgaaattactaagtcacttatttactctctaaagtatgcgggagtaaaagatgtgtcaattaatttagcccatctcatctatcactgtgctgatattaaagctgtagactacttaacttttgtaccgatgcatcctgagaagataaatttgagaggcttcaatcaagccgagttaatagccaaagagttagctaaacttagcggcattccgctattagattgtttggaaaaaagagttttcaccaacagccaagcttcagttaaacataaaagtttaagagaaataaattcaaaatacttattcaaattaaagtctgattattctcaactaattgtaggtaanacttttctaatttttgatgatgtctttacaaccggcaacactctcaatgactgtgccagaagctttaaaatggccggagcaaggaagtcagtggcttggtggtga

SEQ ID NO: 6700 - protein, 210 aa, Unknown
  Obtained from environmental sample
  misc_feature (1)..(210): Xaa is any amino acid
MLYELIRIFLKFLFPPYCCHCQKTGSLLCFNCYESLVFLPKLDICKNSLAYLEDVCGVLEFSEITKSLIYSLKYAGVKDVSINLAHLIYHCADIKAVDYLTFVPMHPEKINLRGFNQAELIAKELAKLSGIPLLDCLEKRVFTNSQASVKHKSLREINSKYLFKLKSDYSQLIVGXTFLIFDDVFTTGNTLNDCARSFKMAGARKSVAWW

SEQ ID NO: 6701 - DNA, 678 bp, Unknown
  Obtained from environmental sample
  misc_feature (1)..(678): n is a, c, g, or t
gtgaacaatagcctggtgcattttttaaatcgtaaagtggaagaatacaatacgattgcatttatcgaaaatgatcccatatcaattccccatcgtttttcaaaaaagcaggacatagaaattgctggtttttttgcagccatttttgcctggggtaaccgcaccatcattatcaataaatgcgctgagttattaaagagaatggataatgctccttatgattttattcagcaccaccaaccctccgacttaaaacctttgttacatttcaaacaccgtacatttaatgacacggatcttctttatttgatccagttttttaaatatcattacgagagaaatctttccctggaaacagcttttactcattgcctggcgaaaaaagaaactaccgtagagcacggcctcaatggattttacaactatgtttttactttacccgaagtgccgcaaaggacaaaaaaacatatcgcggcaccacttaagaattccagctgtaagcgtttgaatatgtttcttcgctggatggtgaggaaggataataaaggtgttgattttggtatctggcaaaaaataatcccatcacaactgctctgtccctatgatgtacatgtggcacgtgtagcccgtaagtttaacctccgggaacgaaacaaactgactggcgggctgctttaa

SEQ ID NO: 6702 - protein, 225 aa, Unknown
  Obtained from environmental sample
  misc_feature (1)..(225): Xaa is any amino acid
MNNSLVHFLNRKVEEYNTIAFIENDPISIPHRFSKKQDIEIAGFFAAIFAWGNRTIIINKCAELLKRMDNAPYDFIQHHQPSDLKPLLHFKHRTFNDTDLLYLIQFFKYHYERNLSLETAFTHCLAKKETTVEHGLNGFYNYVFTLPEVPQRTKKHIAAPLKNSSCKRLNMFLRWMVRKDNKGVDFGIWQKIIPSQLLCPYDVHVARVARKFNLRERNKLTGGLL

SEQ ID NO: 6703 - DNA, 417 bp, Unknown; identical to SEQ ID NO: 3473
  Obtained from environmental sample
  misc_feature (1)..(417): n is a, c, g, or t

SEQ ID NO: 6704 - protein, 138 aa, Unknown; identical to SEQ ID NO: 3474
  Obtained from environmental sample
  DOMAIN (3)...(128): PIN domain
  misc_feature (1)..(138): Xaa is any amino acid

SEQ ID NO: 6705 - DNA, 810 bp, Unknown
  Obtained from environmental sample
  misc_feature (1)..(810): n is a, c, g, or t
ttgaatttgccggatccaccatgtttgtttatgaacaatagaaatcttctcgcagaccttaaagcgtcttttggaaattatgttccgattgatctgctaccttttttaggccgggtcaatgaagtttataagcagaaagaggattatgataattatgtttatgatttcttaataaaagacaaaaaaaaaccggcagaattacggagagcaaatgactttggatgcgaacgctccggaaaaagtaatgagcttttattgcaaaacctttttgatccttacgtttcctacgatgtagtaaataagaaaatacttttctcaaatgcttcctttcaagacatattcgctggaattttcggagcccccgcgggcaaaaaattatccttatcagacctggttgtccgtgaagataaaaaaggtgtctttcccgtattacgcaagcttaaacaaggaataccggcctcattcaatttcaggataaccacgataaataatactttaatctggctccagtcccatctggtgccaacagttgaccgtaacggcacactcataaaaattgaacttattgccaatgatgttacccggttaatggaagccgataaaaaaataaatgagaccaggaaactgcttctgtgttcgggagaaattgttttgattctgaacgcanacttctgcatagctcatgtatccgaaaacatcaggcaacttctcgggtatgcgcagcacgaactttatggcctcccttcgctgatgcttacatccgatgatacgaacgctacaaactacttgaagtgtctggcgggagaatag

SEQ ID NO: 6706 - protein, 269 aa, Unknown
  Obtained from environmental sample
  misc_feature (1)..(269): Xaa is any amino acid
MNLPDPPCLFMNNRNLLADLKASFGNYVPIDLLPFLGRVNEVYKQKEDYDNYVYDFLIKDKKKPAELRRANDFGCERSGKSNELLLQNLFDPYVSYDVVNKKILFSNASFQDIFAGIFGAPAGKKLSLSDLVVREDKKGVFPVLRKLKQGIPASFNFRITTINNTLIWLQSHLVPTVDRNGTLIKIELIANDVTRLMEADKKINETRKLLLCSGEIVLILNAXFCIAHVSENIRQLLGYAQHELYGLPSLMLTSDDTNATNYLKCLAGE

SEQ ID NO: 6707 - DNA, 864 bp, Unknown
  Obtained from environmental sample
  misc_feature (1)..(864): n is a, c, g, or t
atgagaaaaacttcgacagccgattttgcccagcaagctgaatatgtcagctatgcactctggaatcttggcctgaagaaagatgataaggttgcagtgatatcgaacaaccgtcctgaatggaatatccttgatatgggaatgctccaggccggaatcgtaaacgtaccgctgtataccacacttagtgcaaatgagacccagtttatcctcaatgacagcggtgcaaaactgatttttgtttcagacaaagcattgtatgaaaaagttctttccgtaaaatcacagttacctgcggtgtcggacgtcatcaccttcgaaaaaattacaggcgtttcaaactggaatgatttcctggagaaaggaaaacagaataaaaatgaaaaggagctgacagattctaagaaatcgattcttccggaagatgtcgcaacgctgatctatacatcaggtaccacaggtaatcccaaaggcgtgatgctcacacataacaatctcgtgagtaatgtttggggaacaagaacactgatacctgcaggatataaagcaaaagcactaagcttccttccactgtgccatgtatatgaacgcatgcttacgtacttatatatgtatgtaggtatttcgatctattatgcgcaaagcatggatacgattgtagataacatcaaggaagtaaagcctgatgtattttctacagtgcctcgtttgctggaaaaagtttacgacaggatcgttgcaaagggcaaagaacttacaggaattaaacgcaaactttttttctgggcattgaacctcggactgaaatataaaatgaacggcgaaaacggattgtattatgaaatccnagttatggcttgctaa

SEQ ID NO: 6708 - protein, 287 aa, Unknown
  Obtained from environmental sample
  DOMAIN (5)...(287): AMP-binding enzyme
  misc_feature (1)..(287): Xaa is any amino acid
MRKTSTADFAQQAEYVSYALWNLGLKKDDKVAVISNNRPEWNILDMGMLQAGIVNVPLYTTLSANETQFILNDSGAKLIFVSDKALYEKVLSVKSQLPAVSDVITFEKITGVSNWNDFLEKGKQNKNEKELTDSKKSILPEDVATLIYTSGTTGNPKGVMLTHNNLVSNVWGTRTLIPAGYKAKALSFLPLCHVYERMLTYLYMYVGISIYYAQSMDTIVDNIKEVKPDVFSTVPRLLEKVYDRIVAKGKELTGIKRKLFFWALNLGLKYKMNGENGLYYEIXVMAC

SEQ ID NO: 6709 - DNA, 561 bp, Unknown
  Obtained from environmental sample
  misc_feature (1)..(561): n is a, c, g, or t
atgaaaaaagccatttacctcatcatatttcatttcctgtgcataggactaagctatgctcaggatgaagtgtttatggctgaaaagggatctatcagcctgaaatccgaggcaccactgnaagtaattgagttcgaaagtaaatccctgagaggagtgatcaaccccgagacaaaatcatttgcttttacggtcagtatcagtagctttcgtggatttaacagcgaaattcagcgaactcacttcatggaaaattatatggagcaaaagaaatttccggaagcaaccttcaccggaaagatcattgaggatatcccctttaatattcccggcacttattcagtgagagccaaaggagaactcgatattcatggcgtgaagaaagaaaggattattaaagggattcttattattaaaaacaatgctgttcagatccagacaaacttttctgtccctgtcgctgatcatggcatagccattccaaaaatcgtgaaacaaaagatcgcggacgagattgaggtcgcagtagacatcgaatttgtccagagatccaagtcatga

SEQ ID NO: 6710 - protein, 186 aa, Unknown
  Obtained from environmental sample
  misc_feature (1)..(186): Xaa is any amino acid
MKKAIYLIIFHFLCIGLSYAQDEVFMAEKGSISLKSEAPLXVIEFESKSLRGVINPETKSFAFTVSISSFRGFNSEIQRTHFMENYMEQKKFPEATFTGKIIEDIPFNIPGTYSVRAKGELDIHGVKKERIIKGILIIKNNAVQIQTNFSVPVADHGIAIPKIVKQKIADEIEVAVDIEFVQRSKS

SEQ ID NO: 6711 - DNA, 633 bp, Unknown
  Obtained from environmental sample
  misc_feature (1)..(633): n is a, c, g, or t
atgatgaaaaataatctgaaaaatctatttttgcgatcaattaatctactgctttttttcgcgcttttatttaattcgatcgaaatttcggcaaatatggctgcgccttcgcagggcggaaatgtttcggctgagccttcgggcttagaaaatatttttattctgcgcgagaacctgactattgattttcgaccgctcggcgcgatgcaaagcgtgatggacgacaaaaatgttctggtcgaagcagtttatgaagtcgaaaataaaggcatagacaaagcattgaggttgatttttaccgtcggcacacgaaaagtcgaggatttcgagatttcgattgacgataaaaagatcgagagaacggaagttttggaaattgccgatttgcctaaaaactggcagccgccaaatgaaactccgtggcaagacgggaaaaaattaatgtataacccgtcgcgaagtctgacgaaatcggtcgtattttcgctgacgattccgagcggcaaacacacgctcaaggcaaaatataaatcggaaagctccgttttatttgaatttgggcaaaatgaaggccgttcagtttgcatatattctccctcccggcgcgtgaatgggcaggttttcgcggattga

SEQ ID NO: 6712 - protein, 210 aa, Unknown
  Obtained from environmental sample
  misc_feature (1)..(210): Xaa is any amino acid
MMKNNLKNLFLRSINLLLFFALLFNSIEISANMAAPSQGGNVSAEPSGLENIFILRENLTIDFRPLGAMQSVMDDKNVLVEAVYEVENKGIDKALRLIFTVGTRKVEDFEISIDDKKIERTEVLEIADLPKNWQPPNETPWQDGKKLMYNPSRSLTKSVVFSLTIPSGKHTLKAKYKSESSVLFEFGQNEGRSVCIYSPSRRVNGQVFAD

SEQ ID NO: 6713 - DNA, 330 bp, Unknown
  Obtained from environmental sample
  misc_feature (1)..(330): n is a, c, g, or t
ttgaattcaaagaaattgcacattcaaagaaattgcacattcaactcatccaactattgtccaaataacatccaaataacgtatataatgacgtccaaatttatgaagcaaaatccaaatccaaccaaatattttccccgctttttttccgccaaaaaggtcgaaagttttgatcaaaacaagaacctttttaacatcttcaccccttcttctcacctttcttctcgcttctcttcctccttgcatctcaaaacttttttgataacttggaaggttccatatgtaaaagttggagtcaaaatcaaggatttatcaccaagaaagaaatag

SEQ ID NO: 6714 - protein, 109 aa, Unknown
  Obtained from environmental sample
  misc_feature (1)..(109): Xaa is any amino acid
MNSKKLHIQRNCTFNSSNYCPNNIQITYIMTSKFMKQNPNPTKYFPRFFSAKKVESFDQNKNLFNIFTPSSHLSSRFSSSLHLKTFLITWKVPYVKVGVKIKDLSPRKK

SEQ ID NO: 6715 - DNA, 312 bp, Unknown
  Obtained from environmental sample
  misc_feature (1)..(312): n is a, c, g, or t
ttgatatccaatggcaactacatcctgcataaggcagatgtaaaaatggtgggggacagagtcgaaactttngaagttatcaagttggatgcctcacctgataaagcaactatgcattacttcaatcaaaaaggcgaagaggggaaaatgtcaggctccatcatcaagaatcaatttgtgatcaaaggggatgggatgaagtttaatggaacaatcgatgaagggaattcgattatcagtggaaagtggtatatgaaaggcgataaggaagaatggaatgagtttattgagttaacacttgaaaaacaataa

SEQ ID NO: 6716 - protein, 103 aa, Unknown
  Obtained from environmental sample
  misc_feature (1)..(103): Xaa is any amino acid
MISNGNYILHKADVKMVGDRVETXEVIKLDASPDKATMHYFNQKGEEGKMSGSIIKNQFVIKGDGMKFNGTIDEGNSIISGKWYMKGDKEEWNEFIELTLEKQ

SEQ ID NO: 6717 - DNA, 495 bp, Unknown
  Obtained from environmental sample
  misc_feature (1)..(495): n is a, c, g, or t
atgaatactcataaaaatttaaataaaaatcccatactcaatcgcctggctcacaatcttttaaacgaagccattgatgcccttaattttgctgtcgattttttacaagagcatggacgcataaaaaatgaaaaaaaattaaagcttgcagtaattcagctccatcgatttatagaatatatattcaaatatctagtatctgaatataaccctcttctcgtattttctaatatcttcagagaaaaaataagcatagacaagagcaaaacaatctcattgcaggaagcaatcaatttctacatcaataacttggcatttggattaactaataatactagcacactagaaccgaaggatttgaagaacaaaattgacacgttaactaaatatagaaataagattaaccactggggtattgaagaacaagagctagaaacatttgaatccatctatcatctgctttacaaatacataccttatcactatggatcataa

SEQ ID NO: 6718 - protein, 164 aa, Unknown
  Obtained from environmental sample
  misc_feature (1)..(164): Xaa is any amino acid
MNTHKNLNKNPILNRLAHNLLNEAIDALNFAVDFLQEHGRIKNEKKLKLAVIQLHRFIEYIFKYLVSEYNPLLVFSNIFREKISIDKSKTISLQEAINFYINNLAFGLTNNTSTLEPKDLKNKIDTLTKYRNKINHWGIEEQELETFESIYHLLYKYIPYHYGS

SEQ ID NO: 6719 - DNA, 432 bp, Unknown
  Obtained from environmental sample
  misc_feature (1)..(432): n is a, c, g, or t
atgagaaaagtacttttgacaatgctgtttttatcatgcttttcgggcaatgcgcaggaatcggatgtcaaagcagcaattatgacattttttgatggactgcagacaaaggatacgctgaagataaacagtgtgatatcgaaagaaatggtattgcattcgattgcggaaatgcctggtggaggaaaattttctgctgaaaaagcgtccgaatttacaaagtcggttttgtcgattccagcaggattaaaaatcgaagagcgtatcttatcatacgacattcatattgatggttcactagcaacagcgtggacaccatacgaattttatgtcaacgataaactgagccatcgtggcgtaaattcctttcagttgtttaaagacaacggtcagtggaagattgtttacatcatcgatacacgaagaaagtaa

SEQ ID NO: 6720 - protein, 143 aa, Unknown
  Obtained from environmental sample
  SIGNAL (1)...(18)
  misc_feature (1)..(143): Xaa is any amino acid
MRKVLLTMLFLSCFSGNAQESDVKAAIMTFFDGLQTKDTLKINSVISKEMVLHSIAEMPGGGKFSAEKASEFTKSVLSIPAGLKIEERILSYDIHIDGSLATAWTPYEFYVNDKLSHRGVNSFQLFKDNGQWKIVYIIDTRRK

SEQ ID NO: 6721 - DNA, 912 bp, Unknown
  Obtained from environmental sample
  misc_feature (1)..(912): n is a, c, g, or t
atgcaggaatataaaattcttgataaatatgccgacatagttacgctctatttcgataaatacggatacctgtggataggcacgttgggagaaggagttgtaagattcaatcccactaccggcaaaaccagaaagatcaccaacgctacagatacggagggatcgagcgtattgtcgataaacggtaaagacaatacagtgtgggtggcgggatttaattccgtaagcaaatttataattagtgaaaacggaaacagcgatgaagcgacaatagaaaaagtccctgtattcaaagggagtgaattattgaatgattatgtatacgccgtatttatcgacagcaaaggactcgtatggttcggcaccgatggaaacggcgtttattgctttgacggcgcgaaattgaaaaactttccggtaaaggacaacgctgtacacggattcacggaagataagaaggggaatatctggttctccacggcggatggaggcttacaatgcatcgggacggataataaaatgagatatttccaaacgaaggacgggttgtctgatcctacgccgacttcggtattgtgtgtgaacaacggaaacataatcattgttcattcaaacggcttcgacgtactcgacccggtcacgaaggatattatatatcattccaccgaggaaaatcttgacaacatcaaatgtgattttgattcgattgtactcggcccggatggcactgtgtggatgggcacggaaatgggcatccttcattaccggccccgaagcgatatgaagatccagccatccaagggtggttttgcatccggttcctgttttccccaaaaggcccatctccgggcaacaataaattccatgccaatgaaaacaaccttcgattcattaagggcggttggggattaa

SEQ ID NO: 6722 - protein, 303 aa, Unknown
  Obtained from environmental sample
  misc_feature (1)..(303): Xaa is any amino acid
MQEYKILDKYADIVTLYFDKYGYLWIGTLGEGVVRFNPTTGKTRKITNATDTEGSSVLSINGKDNTVWVAGFNSVSKFIISENGNSDEATIEKVPVFKGSELLNDYVYAVFIDSKGLVWFGTDGNGVYCFDGAKLKNFPVKDNAVHGFTEDKKGNIWFSTADGGLQCIGTDNKMRYFQTKDGLSDPTPTSVLCVNNGNIIIVHSNGFDVLDPVTKDIIYHSTEENLDNIKCDFDSIVLGPDGTVWMGTEMGILHYRPRSDMKIQPSKGGFASGSCFPQKAHLRATINSMPMKTTFDSLRAVGD

SEQ ID NO: 6723 - DNA, 723 bp, Unknown
  Obtained from environmental sample
  misc_feature (1)..(723): n is a, c, g, or t
atgtttgaaatcctccggcctatctggcaaacatggtgtttcagggtgatagccgcggcgttgattgcgctgatgatattattcatcgtaaaacggagagaaaagagattacgcaatttcgaacgacttgagaaggaaaaaattgaatttcaattcgagacactgaagagccaggtgaatccgcatttcctgtttaacagtttcaatactcttatttccgtgatcgaagataaaccggaacatgcggttgaatacgtagaaaagctctccgaatttttcaggaacatagtcaattacagggataagaacctggtacctttacatgaagaactaaatttacttgacaattatatattcattcagagaaaaagatatggcaacaatctaaagcttgaaatcaatattgatgaagaaagcaggagcaataagtgtgttccgcctctaaccttacagatgcttgcggagaacgctataaagcataacgcggtttcgagagagagtccgcttacgattacaataactgcaaaaggagacaggctttccataaaaaataatctgaatgcaaaaattgccaaagaaaaatcagccgggttcggactgcataatataaagagccggtttcagttattgacgaatgaagaaattgccattactaacgacaaacagaatttcgaagtaataattccattgttacaatacaaaaatgaatatactgatacttga

SEQ ID NO: 6724 - protein, 240 aa, Unknown
  Obtained from environmental sample
  DOMAIN (51)...(134): Histidine kinase
  misc_feature (1)..(240): Xaa is any amino acid
MFEILRPIWQTWCFRVIAAALIALMILFIVKRREKRLRNFERLEKEKIEFQFETLKSQVNPHFLFNSFNTLISVIEDKPEHAVEYVEKLSEFFRNIVNYRDKNLVPLHEELNLLDNYIFIQRKRYGNNLKLEINIDEESRSNKCVPPLTLQMLAENAIKHNAVSRESPLTITITAKGDRLSIKNNLNAKIAKEKSAGFGLHNIKSRFQLLTNEEIAITNDKQNFEVIIPLLQYKNEYTDT

SEQ ID NO: 6725 - DNA, 951 bp, Unknown
  Obtained from environmental sample
  misc_feature (1)..(951): n is a, c, g, or t
ttggctttagatatagtttttacttactcgcaagataagtctcctactgtacattatttgggtatctttggagacaataattctggaaaaagtagtattggcgatgtttttgaagccttagcatatagaacggtgaatacaactgatcccagtccggctaacatatttagatctcttggccctgttgaaccaggtcaaataaccctagtccttgatgaggccgaaaaaattgaccagtcttatgacatgatgacaattctaaagaccggttatgactataggaaaacagtctcaaaggttaatgattttagtcgcaaatcagaaaaattcttcacctattgtcaaaagttgattattggcgaacgtgctccaagtccaattagagcaaaggggttaaacgacaggttattgtcagatatagtttactatggaactcctacatatgatattaaagaaatactaaatactactcattccagcgacgagatatgtcaaaccttatttaaagagattcaagaatttagaaaacttttgtttatttataggctaattcattttgaagatcctatcaaaaatttagatattggtataaaaggaagaaaaaaagaactcgtaaagccgtatatcctattattttcaaatatatcttcagaacgcgataatcaaatattccaagaaattcaaaacacatttgatatattcttaagattaaagtctgaaaagaaagaattcacgttggaggcggcaatggtgccgattgttgtagagttaatggaccaatcctttattaccaaaatnaagtttactgatttttgggataaactccgatnncgtatacgaggtaattttgatgataagagaccccatgaatatcatactgaagattttggaatatttataaaaactcagtatcccaaacttacaaaaataggggtagaactaacgtcgtaa

SEQ ID NO: 6726 - protein, 316 aa, Unknown
  Obtained from environmental sample
  misc_feature (1)..(316): Xaa is any amino acid
MALDIVFTYSQDKSPTVHYLGIFGDNNSGKSSIGDVFEALAYRTVNTTDPSPANIFRSLGPVEPGQITLVLDEAEKIDQSYDMMTILKTGYDYRKTVSKVNDFSRKSEKFFTYCQKLIIGERAPSPIRAKGLNDRLLSDIVYYGTPTYDIKEILNTTHSSDEICQTLFKEIQEFRKLLFIYRLIHFEDPIKNLDIGIKGRKKELVKPYILLFSNISSERDNQIFQEIQNTFDIFLRLKSEKKEFTLEAAMVPIVVELMDQSFITKXKFTDFWDKLRXRIRGNFDDKRPHEYHTEDFGIFIKTQYPKLTKIGVELTS

SEQ ID NO: 6727 - DNA, 468 bp, Unknown; identical to SEQ ID NO: 3387
  Obtained from environmental sample
  misc_feature (1)..(468): n is a, c, g, or t

SEQ ID NO: 6728 - protein, 155 aa, Unknown; identical to SEQ ID NO: 3388
  Obtained from environmental sample
  DOMAIN (33)...(151): RecX family
  misc_feature (1)..(155): Xaa is any amino acid

SEQ ID NO: 6729 - DNA, 945 bp, Unknown
  Obtained from environmental sample
  misc_feature (1)..(945): n is a, c, g, or t
atgggatcannccttgttgaaaaaacaggcgctccactgaattctactttcgagatcacgaaggaaatgtccgaaaagatctatgtaattccaccggaaagaacacgctatttgtctgagatctctgaaaataaccgtgcttatgataaatgggtgaatgatcaggttattgtagcagaaaaattaaacggacttgatacttcaatcaataccttgaaagcttcaagttatgaagacaaagacagacttgttaaaggtcttcaggaagttttcgaaaaagaaaaactgaattttgatccaaaaaactgggatataattcaaaaatggcaagagaaaaaatcactttataaaaatccgaccttcgaatttaaggtaagagataaaattttaaaattagatacacacactgaatcactttcacatttgcagattccaaaagttgcaatgccgaaatatttgggttggggcgatattttacgttggtcacttcaggaaaatgtccctggtgaatttccttatactgccggtttatttcctttcaaacgtgaaggtgaagatccgacacgtatgttcgcaggggagggtggaccagagcgtactaacaaacgttttcattacgtttcccttggaatgcccgctaaaagactttcgacagcttttgattctgtgactttatacgggaatgatccggatctgcgtcctgatatttatggtaagatcggaaatgcgggagtatcaatttgttgtctggacgatgcgaaaaaactctattcaggttttgatctttcacatccaatgacatccgtatccatgacgatcaatggtcctgcgcccatgttgttaggctttttcttaaatgcagcgatcgatcagaatttgcgagaatacattanggaaaancacttagaaaaagagatagaaccaaaaatccaggaaatcctataa

SEQ ID NO: 6730 - protein, 314 aa, Unknown
  Obtained from environmental sample
  misc_feature (1)..(314): Xaa is any amino acid
MGSXLVEKTGAPLNSTFEITKEMSEKIYVIPPERTRYLSEISENNRAYDKWVNDQVIVAEKLNGLDTSINTLKASSYEDKDRLVKGLQEVFEKEKLNFDPKNWDIIQKWQEKKSLYKNPTFEFKVRDKILKLDTHTESLSHLQIPKVAMPKYLGWGDILRWSLQENVPGEFPYTAGLFPFKREGEDPTRMFAGEGGPERTNKRFHYVSLGMPAKRLSTAFDSVTLYGNDPDLRPDIYGKIGNAGVSICCLDDAKKLYSGFDLSHPMTSVSMTINGPAPMLLGFFLNAAIDQNLREYIXEXHLEKEIEPKIQEIL

SEQ ID NO: 6731 - DNA, 615 bp, Unknown
  Obtained from environmental sample
  misc_feature (1)..(615): n is a, c, g, or t
atggttaaaaagctaatatccgggccggacctttccacagagcaaaagattattgaagctgcgcggaaagtttttactcaaaagggttacagtgccacccgcacaagagacattgcggaagaagccggcctgaacctggcgcttttaaactattatttccgcagtaaagagaagttatttgaaattgtaatgctggaaaaaatgctgaaattttttggtgtgatggctcctgtgctgaatgatgcagccactacttttgaaaataaagtgaaggtgattgctgaaaaatataccgacctgcttttagaaaatccggatctgccattattcattctcagtgaaatccgcaacagccccgggcagtttttaagcattgttcaaaaagcaaatttcttaaacgattctgtttttataaagcaaatacgaacgaagcggcccgatctgaaccctttacattttcttatcagtcttttaggaatgtgcgttttcccttacgttatgaagccggttttgcaaatgatgtcaaccctgagtgaaaaagaatttgcaaaaatgatgaaagaaagaaaaacactcataccggcctggacaaaagcgattttaaaaaccaaatga

SEQ ID NO: 6732 - protein, 204 aa, Unknown
  Obtained from environmental sample
  DOMAIN (17)...(63): Bacterial regulatory proteins, tetR family
  misc_feature (1)..(204): Xaa is any amino acid
MVKKLISGPDLSTEQKIIEAARKVFTQKGYSATRTRDIAEEAGLNLALLNYYFRSKEKLFEIVMLEKMLKFFGVMAPVLNDAATTFENKVKVIAEKYTDLLLENPDLPLFILSEIRNSPGQFLSIVQKANFLNDSVFIKQIRTKRPDLNPLHFLISLLGMCVFPYVMKPVLQMMSTLSEKEFAKMMKERKTLIPAWTKAILKTK

SEQ ID NO: 6733 - DNA, 456 bp, Unknown; identical to SEQ ID NO: 5483
  Obtained from environmental sample
  misc_feature (1)..(456): n is a, c, g, or t

SEQ ID NO: 6734 - protein, 151 aa, Unknown; identical to SEQ ID NO: 5484
  Obtained from environmental sample
  misc_feature (1)..(151): Xaa is any amino acid

SEQ ID NO: 6735 - DNA, 399 bp, Unknown
  Obtained from environmental sample
  misc_feature (1)..(399): n is a, c, g, or t
ttgatctataatctatttttcatatatttgctgataatcacaaagattgatggaaactgtaattataaattattaatctcatccctttttatttcgtacggactttttttgaaagaagaatatcataaatggcactctcagtttttggacagggagtttgaaatgctggtttttggggaaagcggatatccggtaattgtttttccaacatcacgggcaaaatattatcaagccaaagattttggattgattgaagcggcagcttacttaattgatactggcaaagttaagatttattgtccggatagcatagataatttaagctggtacaataaaaatattcatcccgctgatagagtaaagactcagattgcttatgaaagaagtatactnnaatga

SEQ ID NO: 6736 - protein, 132 aa, Unknown
  Obtained from environmental sample
  misc_feature (1)..(132): Xaa is any amino acid
MIYNLFFIYLLIITKIDGNCNYKLLISSLFISYGLFLKEEYHKWHSQFLDREFEMLVFGESGYPVIVFPTSRAKYYQAKDFGLIEAAAYLIDTGKVKIYCPDSIDNLSWYNKNIHPADRVKTQIAYERSILX

SEQ ID NO: 6737 - DNA, 357 bp, Unknown
  Obtained from environmental sample
  misc_feature (1)..(357): n is a, c, g, or t
atgaatattcagcaagatcaaatcattggcgaactggtagcaaacgactatcgtactgcttccatctttaaaaaatacggtattgatttttgttgccagggcaacaggaccatacaggatgcatgtgataaaaagaaagtagatgtgaaagaagtgctaaacgatttatcagtggccgttcgtgaatcaccggatacccacacagattttcaatcatggcctgctgatctgctgaccgattatatagagaagaaacatcaccgctatgtacaatcaaagactgctgaaaatacaccttatctcgataaagtttgcgtgtacatggtgacagccatcctgaactatgnagatccgtga

SEQ ID NO: 6738 - protein, 118 aa, Unknown
  Obtained from environmental sample
  DOMAIN (5)...(77): Domain of Unknown function (DUF542)
  misc_feature (1)..(118): Xaa is any amino acid
MNIQQDQIIGELVANDYRTASIFKKYGIDFCCQGNRTIQDACDKKKVDVKEVLNDLSVAVRESPDTHTDFQSWPADLLTDYIEKKHHRYVQSKTAENTPYLDKVCVYMVTAILNYXDP

SEQ ID NO: 6739 - DNA, 861 bp, Unknown
  Obtained from environmental sample
  misc_feature (1)..(861): n is a, c, g, or t
atgcttcctgattgtgaatgttcaatctcacccaatacctgtgttataacagataataagccttcatttatgggggtgagccagatattaaaacattccacggataagacagttgaactgctgaagaccgagctcgagatcagaaaaggcgaacttgaagaggagtggcatatgtcttcactcgaaaagatattcatagagaaaagaatttaccgcgacattgaagaatcagaaacatgggaagctgttatagaggctattgacaaaggactcaaaccttataaaaagctgctcgtaagggaggttacacgagatgacatcattcagctgactgagataaagatcaagagaatttcaaaattcgatgtaaaaaaggctgatgagcacataaaagggattgaaactgagatggatgaggtaaaaaatcatctcaggaacataattcctttcgcaataaattacttccggcagataaagaaaaagtacggtaagggcagagaaagaaaaaccgagttaaggagctttgatactatcgaagcaacaaaagttgttgccaataatgcaaaattatatatcaattataaggaaggctttatcggaaccggtctgaaaaaggatgaatttatttgtgattgttcagatattgacgacgttattgttataaggaaagatggaggataccttattaccaaagtagccgacaaggtatttgtcggcaccgatatcctgtatgcgcagatctttcttaaaaacgatgagcgtaccatatataatattgtttatcaggacggtaaggatggtcctctgctggcaaaacgatgcgccatttcccgactgacccgggataagaatatacactga

SEQ ID NO: 6740 - protein, 286 aa, Unknown
  Obtained from environmental sample
  misc_feature (1)..(286): Xaa is any amino acid
MLPDCECSISPNTCVITDNKPSFMGVSQILKHSTDKTVELLKTELEIRKGELEEEWHMSSLEKIFIEKRIYRDIEESETWEAVIEAIDKGLKPYKKLLVREVTRDDIIQLTEIKIKRISKFDVKKADEHIKGIETEMDEVKNHLRNIIPFAINYFRQIKKKYGKGRERKTELRSFDTIEATKVVANNAKLYINYKEGFIGTGLKKDEFICDCSDIDDVIVIRKDGGYLITKVADKVFVGTDILYAQIFLKNDERTIYNIVYQDGKDGPLLAKRCAISRLTRDKNIH

SEQ ID NO: 6741 - DNA, 306 bp, Unknown
  Obtained from environmental sample
  misc_feature (1)..(306): n is a, c, g, or t
atgaaaaaagtattgcttacgggttgtctcctgatcacaatcattagtacgggattttctcaggctcatatgactcctgaatttctttggaaactcggaagggtgagtgaaccgcagctttcgcaggacgggaaagaatgtatttacaatgtgcgcagctttagtctggagatgaataaaggtaactccgatatttggaaggttaacctgcaaacgggggcggctgtgaagctcgctggagattctgccaatgaaatgtcggcacggtggagcagtgacggcaaaaagattttttactttgcataa

SEQ ID NO: 6742 - protein, 101 aa, Unknown
  Obtained from environmental sample
  SIGNAL (1)...(18)
  misc_feature (1)..(101): Xaa is any amino acid
MKKVLLTGCLLITIISTGFSQAHMTPEFLWKLGRVSEPQLSQDGKECIYNVRSFSLEMNKGNSDIWKVNLQTGAAVKLAGDSANEMSARWSSDGKKIFYFA

SEQ ID NO: 6743 - DNA, 534 bp, Unknown
  Obtained from environmental sample
  misc_feature (1)..(534): n is a, c, g, or t
atgatgaccaaaaaatatgcctttcggataatagctaggtattttttaaatggtctcaccaatggtgaatcatgtattttctttacttcagataatcccgatgaaattgaaaaaagactaaataaggaaggtatcgatgtaagattttataaaaataataacttgttgcgtatctataccatcgaaagatcagatgagaacaaacatgaaactttgaacacgcttagacatataagaaaagatgctactgtaggaatgaagcctccatttagatttgcaggaagaacgataacgaatacagaaacaatggaaggaatgaaactaggaattgttttggaagaagttgggcataaaaactttgatagttttgataattcacaattatgtttttatgatatctctaaaatagaaaaatcgatgagaccaaaatggatacaaaatcttttaaaagctcatcattgcgttatctatgcatccgaacctaataaagcagtagcatttgataccaacttacttgaggatcaagaagtatga

SEQ ID NO: 6744 - protein, 177 aa, Unknown
  Obtained from environmental sample
  misc_feature (1)..(177): Xaa is any amino acid
MMTKKYAFRIIARYFLNGLTNGESCIFFTSDNPDEIEKRLNKEGIDVRFYKNNNLLRIYTIERSDENKHETLNTLRHIRKDATVGMKPPFRFAGRTITNTETMEGMKLGIVLEEVGHKNFDSFDNSQLCFYDISKIEKSMRPKWIQNLLKAHHCVIYASEPNKAVAFDTNLLEDQEV

SEQ ID NO: 6745 - DNA, 495 bp, Unknown
  Obtained from environmental sample
  misc_feature (1)..(495): n is a, c, g, or t
atgctgcagtattatcccctcgcccccggtaacaaatggtcgtacaaacaaaaagacggaagcacctatagcaatgaggtcatcagcatcgatggcaacctcatcacgatgaagaacagcacggtgaccgatcccaccaagatcaaagtcgagaacggatcaatgttcaatgagttgatgactcccggtaattttcagctgtggcttaaagatgatctgaaaaaaggcgatacgtgggacgcgaccttcaccgcgcatggcctggatagcatcatggcatttacggtgaaagaaaccgggatcagtaaggaagtgagcggcaagacatacaacgatgtggtcgtgctggaagccgaaagtaagattaacatgaacggcaacgtgatcagcactaattttctaacgcaatattattatgccaaaggaatagggttgatcatgacgacttcgtcattgggggatgaacatgcgctgtatcaatgcgtattgaattga

SEQ ID NO: 6746 - protein, 164 aa, Unknown
  Obtained from environmental sample
  misc_feature (1)..(164): Xaa is any amino acid
MLQYYPLAPGNKWSYKQKDGSTYSNEVISIDGNLITMKNSTVTDPTKIKVENGSMFNELMTPGNFQLWLKDDLKKGDTWDATFTAHGLDSIMAFTVKETGISKEVSGKTYNDVVVLEAESKINMNGNVISTNFLTQYYYAKGIGLIMTTSSLGDEHALYQCVLN

SEQ ID NO: 6747 - DNA, 306 bp, Unknown
  Obtained from environmental sample
  misc_feature (1)..(306): n is a, c, g, or t
atgttttcgataggcgatatcacgctcaagaaagtcggccttcaaactgtttctgataccgtgcgctatatcatgctcacgaccgacgacacaaacggcaagaatttatacctggcaatgtataagagatttggaattccaaatggtaaagctgaccatattaatagttcatatttgtggaaagggaataaactccacttatctattcaaaagaaaggcaacgagtggcaggctacctatattgatgtgccgttcgaaaagagagtggagaaagaaaaagagaaaaagaaactatcagatttttga

SEQ ID NO: 6748 - protein, 101 aa, Unknown
  Obtained from environmental sample
  misc_feature (1)..(101): Xaa is any amino acid
MFSIGDITLKKVGLQTVSDTVRYIMLTTDDTNGKNLYLAMYKRFGIPNGKADHINSSYLWKGNKLHLSIQKKGNEWQATYIDVPFEKRVEKEKEKKKLSDF

SEQ ID NO: 6749 - DNA, 618 bp, Unknown
  Obtained from environmental sample
  misc_feature (1)..(618): n is a, c, g, or t
ttgaaaaacaagccagaacccttatccatggacgccgggaaggaaactcccctgatgaagcagtacctgaagatcaagagccaacacccggaggctcttctcctcttcagagttggagatttttatgaaacatttggggaagatgctattaaaacatctgagacattaggcatcatacttacccatcgcaataacggtggaaacaatgtggagcttgccggattcccctatcatgccatggacatgtatctgccaaaactggtgcaggcaggatatcgtgtggcaatctgcgagcaacttgagaagccatctaaagaaaaaaagatagttgacaggggtgtgatcgagatgattacaccgggcattactacagaagattctttgttaaacagatcacagaataattttcttgcatccattcattttcacagtggagaacattttggtattgctttcgtggatgtgtctaccggcgaatttgtagtcaatgaaggttcccaaagagagatcgaaaaattgctccctagttttgagcctgctgagattcttttttcaaaatcaaatnagggaaagtttgaaaaatatttcggtactaactattacacttacggtctttga

SEQ ID NO: 6750 - protein, 205 aa, Unknown
  Obtained from environmental sample
  DOMAIN (16)...(127): MutS domain I
  misc_feature (1)..(205): Xaa is any amino acid
MKNKPEPLSMDAGKETPLMKQYLKIKSQHPEALLLFRVGDFYETFGEDAIKTSETLGIILTHRNNGGNNVELAGFPYHAMDMYLPKLVQAGYRVAICEQLEKPSKEKKIVDRGVIEMITPGITTEDSLLNRSQNNFLASIHFHSGEHFGIAFVDVSTGEFVVNEGSQREIEKLLPSFEPAEILFSKSNXGKFEKYFGTNYYTYGL

SEQ ID NO: 6751 - DNA, 687 bp, Unknown
  Obtained from environmental sample
  misc_feature (1)..(687): n is a, c, g, or t
ttgctggaaaagaccggcatcgatcacctggtgatcgtccccttcacagatttttttgccaaccaaaccgctgaagaatatatacaggatttcctggttgagaaattcaggcctcatacgatcatcatcggctacgaccaccgctttggcagggaacgcagcggcgattataaactgatggaagaaaaagcattggtatataattatcaactcaaggaaatacccgagcatattttgaataccatcaaagtaagcagtaccaatatccgcaacgccatcctgcacagccatgtagaagaagccaatggattgctgggctatgattttttctttgaaggagaagtttttcatggtgataagatcggcagggaactgggctaccctaccgccaatttaaaaagtacggatgaggaaaaaatatgtttgggtgatgggatctatgcggtatatgtaactgtggaaggcaaaacttacaaaggcatgatgagcattggcttcaggccaacagtgaatggtaaagtaagggtcaccgaagtcaatatctttgattttgccaaagagatctatggcgaaaagatcagggttacggttaagaaatatttacgcagcgaggagaaatttgatgggctggaggcgctgaaagaacaattacatagggataaggaagatagtttggggtgtttgtag

SEQ ID NO: 6752 - protein, 228 aa, Unknown
  Obtained from environmental sample
  DOMAIN (1)...(88): Riboflavin kinase (Flavokinase)
  misc_feature (1)..(228): Xaa is any amino acid
MLEKTGIDHLVIVPFTDFFANQTAEEYIQDFLVEKFRPHTIIIGYDHRFGRERSGDYKLMEEKALVYNYQLKEIPEHILNTIKVSSTNIRNAILHSHVEEANGLLGYDFFFEGEVFHGDKIGRELGYPTANLKSTDEEKICLGDGIYAVYVTVEGKTYKGMMSIGFRPTVNGKVRVTEVNIFDFAKEIYGEKIRVTVKKYLRSEEKFDGLEALKEQLHRDKEDSLGCL

SEQ ID NO: 6753 - DNA, 1026 bp, Unknown
  Obtained from environmental sample
  misc_feature (1)..(1026): n is a, c, g, or t
atgaataactatgaatcgctttcaaagatttaccgggccttaaaaagaaatgatagtgcctacttatacctacttagatacattacattgaaggattctattcaaaataagcgcttcttatttcagcttgacaaatataaacggaaagcagacgatgaaaagaaacaaggccagattggattattaagcaaagacaacaaaataaaggcacaacagcttaaacaggagggtatcactaaaaattttcttttcggagggctaatacttttttgtttggtcggaatttttattttcagagcattgacactgaagcgcaaaaacgaaaggcttaaaagagaaaaaatagaagatgaaatgaagttacagcaactcgaaaatcaaaaaaaccaggccgatctacagcgaaaggctgccgatctcgaaatgcaagcattgcgggcccagatgaatccgcattttatttttaattgtcttagctctatcaatcgttttattataaaaaatgaaagtaaggcggcctcttcttacctcacacgtttttccaggttgatccgtatggtattaatcaattcacaaaaggctttgatccctttggaagatgaattgcaaatgcttcgcctgtatcttgatatggagcgtttgcgattcanagattcttttaattaccgcattagttttcttaactcaatggaaggtgataatatttttatcccaccattattgcttcagccattttgtgaaaatgcaatttggcacggattgatgcataaagaaggtggaggacatttggatattgaattgagtatagaaaacgatatattnaatttgtacattatcgatgacggcattggcccgcagaaaagcgaagagataaaactanatcggcagaaaagaaaaaatcatgggattaaaatactactgaacgccttgcttgcnttacagaaaaaggcgtcacactttatgaatagagattgctgcatgcatgtgaactgcagaacaataattaaaatcgtacaagagtgctga

SEQ ID NO: 6754 - protein, 341 aa, Unknown
  Obtained from environmental sample
  DOMAIN (141)...(225): Histidine kinase
  misc_feature (1)..(341): Xaa is any amino acid
MNNYESLSKIYRALKRNDSAYLYLLRYITLKDSIQNKRFLFQLDKYKRKADDEKKQGQIGLLSKDNKIKAQQLKQEGITKNFLFGGLILFCLVGIFIFRALTLKRKNERLKREKIEDEMKLQQLENQKNQADLQRKAADLEMQALRAQMNPHFIFNCLSSINRFIIKNESKAASSYLTRFSRLIRMVLINSQKALIPLEDELQMLRLYLDMERLRFXDSFNYRISFLNSMEGDNIFIPPLLLQPFCENAIWHGLMHKEGGGHLDIELSIENDIXNLYIIDDGIGPQKSEEIKLXRQKRKNHGIKILLNALLALQKKASHFMNRDCCMHVNCRTIIKIVQEC

SEQ ID NO: 6755 - DNA, 744 bp, Unknown
  Obtained from environmental sample
  misc_feature (1)..(744): n is a, c, g, or t
atgaaaaagtttcttatattctgtctatttttgttcctgaataaaccgctcatttcgcaggataatatctatgttaaagatttcgtctttttctgggaaacctttagggataattacggatattttgaaaacaaacagaccgactggaacaaagtaaaggagatttaccttcccgaagctcaaaaaatcagtaacaagaatgatttcatttcattgcttgaaaatgttattggcgagctctacgataatcacactcatcttcttactaatctttcatcttcataccggctttcaccttcagggctggatatctggccagagcttgaaaacaacaaatacatagttaaagaagtacgtgccggctcaggtagtgagctatgcggaataaaacccggaatggaaattactcatataaatgatctggcaatcaatgatgcaatattgcagattacggggaaaacaataatcaatccgggcaaagaagttaaggaatgggcaataagaacattgcttgccggtaattataaaactaaaagggtcttggagttgaattataacggtgaggagttaacaaagagccggatacagaaaaagatacttacagttattttacgtacgatttcaatatcagatcaaaaaatctggaaaaacaatatcgggttaaattgcaataaattactcccctgggtgatgaaaacacggtgcaaatgtttgaatagtgtgctgaaactcaatgcggggtaa

SEQ ID NO: 6756 - protein, 247 aa, Unknown
  Obtained from environmental sample
  SIGNAL (1)...(19)
  misc_feature (1)..(247): Xaa is any amino acid
MKKFLIFCLFLFLNKPLISQDNIYVKDFVFFWETFRDNYGYFENKQTDWNKVKEIYLPEAQKISNKNDFISLLENVIGELYDNHTHLLTNLSSSYRLSPSGLDIWPELENNKYIVKEVRAGSGSELCGIKPGMEITHINDLAINDAILQITGKTIINPGKEVKEWAIRTLLAGNYKTKRVLELNYNGEELTKSRIQKKILTVILRTISISDQKIWKNNIGLNCNKLLPWVMKTRCKCLNSVLKLNAG

SEQ ID NO: 6757 - DNA, 636 bp, Unknown; identical to SEQ ID NO: 1363
  Obtained from environmental sample
  misc_feature (1)..(636): n is a, c, g, or t

SEQ ID NO: 6758 - protein, 211 aa, Unknown; identical to SEQ ID NO: 1364
  Obtained from environmental sample
  misc_feature (1)..(211): Xaa is any amino acid

SEQ ID NO: 6759 - DNA, 441 bp, Unknown
  Obtained from environmental sample
  misc_feature (1)..(441): n is a, c, g, or t
ttgggttatgaagttagacctaaaattattcttggaggaagagagaacattaacgaaattgaagacaatgaaattgaaacccttgaagtagtttgggttagaggttttaatgacatcagcaatatatcaaaattcaaaaggctaaaaacgcttttgattgaggacaacattcagcttcctaaagttcactttgaaactgtgttcccaaacctgactgacttgaaaatattgaactgtaaaacgctcaattcgttgacaggtttggaacatctaacttcattggagcaacttaaaatatataaaacaaaccttgactttgacagtgtagcaaatcaaaagttgtcgcaaacattaaaaacatttgctttttacacgacaaggagaaaagttgatgacgaaatccaagcaacactacttaaaaggggatacagcgaatggtaa

SEQ ID NO: 6760 - protein, 146 aa, Unknown
  Obtained from environmental sample
  misc_feature (1)..(146): Xaa is any amino acid
MGYEVRPKIILGGRENINEIEDNEIETLEVVWVRGFNDISNISKFKRLKTLLIEDNIQLPKVHFETVFPNLTDLKILNCKTLNSLTGLEHLTSLEQLKIYKTNLDFDSVANQKLSQTLKTFAFYTTRRKVDDEIQATLLKRGYSEW

SEQ ID NO: 6761 - DNA, 312 bp, Unknown; identical to SEQ ID NO: 2389
  Obtained from environmental sample
  misc_feature (1)..(312): n is a, c, g, or t

SEQ ID NO: 6762 - protein, 103 aa, Unknown; identical to SEQ ID NO: 2390
  Obtained from environmental sample
  misc_feature (1)..(103): Xaa is any amino acid

SEQ ID NO: 6763 - DNA, 510 bp, Unknown
  Obtained from environmental sample
  misc_feature (1)..(510): n is a, c, g, or t
ttgggaagatttatggacagggtaaaaaacaaaacntggtacacanacacggtgtttattttctggggcgatcatggattatcgatgggacatacgtatgaaatgagcctggcctacaatcacattccatgcgccatacaccagccaaaactatttaaacccgacactatttnttcgccctgctatcagcccgatattcccgcaacggtaatgggcattattggagcgaattataccaacaatacgtttggcattgatgttttaaaagagcagcatccttttgtggtgttctctgccgatgataaaataggctgcgtggatgataaaggatactattactacaaaacactggccaacggccaggcttatttgcggaaatataaaaatcttgatcccgtaaattatacgaacattcttaagccaaaagccgacagcatggagcgcagtatgatgcggatttatgaaacggctgagtatttcattcagaaagattattttctgtatgaataa

SEQ ID NO: 6764 - protein, 169 aa, Unknown
  Obtained from environmental sample
  misc_feature (1)..(169): Xaa is any amino acid
MGRFMDRVKNKTWYTXTVFIFWGDHGLSMGHTYEMSLAYNHIPCAIHQPKLFKPDTIXSPCYQPDIPATVMGIIGANYTNNTFGIDVLKEQHPFVVFSADDKIGCVDDKGYYYYKTLANGQAYLRKYKNLDPVNYTNILKPKADSMERSMMRIYETAEYFIQKDYFLYE

SEQ ID NO: 6765 - DNA, 606 bp, Unknown
  Obtained from environmental sample
  misc_feature (1)..(606): n is a, c, g, or t
ttgattagatgtctgcccgcaactttccaaaacctgccgggtgtactttctgtaagtgaaatagattcaatgctgtctctcccggttactgaagataagcttggcttaagggataaggcattgcttgaaatgctttatgcctgcggtacacgggtttcggaattaattaatattaaaatttcagatctgtttttccccgaggaaataataagggtatttggtaagggttctaaagaacggcttatccccataggcagcagtgcaataaactggataaacgagtatcttaaaaaaagccggccgctattagagaaaaaatctaaaagcgaaaattttctttttcttaacaacaggggaacaaaactatcccgtatgggtgtatggaaaatagtagattattactcaaagcatgccggaataacaaaagaagtacatccgcatacattcaggcattcttttgcaacgcatttaattgaaggcggtgcggacctgcgtgcggtacaggaaatgttagggcatgctgatatttcaactacgcaaatttatacgcatattgacagggattatataaaacaggtgcataaacaatttcatccaagaggataa

SEQ ID NO: 6766 - protein, 201 aa, Unknown
  Obtained from environmental sample
  DOMAIN (16)...(192): Phage integrase family
  misc_feature (1)..(201): Xaa is any amino acid
MIRCLPATFQNLPGVLSVSEIDSMLSLPVTEDKLGLRDKALLEMLYACGTRVSELINIKISDLFFPEEIIRVFGKGSKERLIPIGSSAINWINEYLKKSRPLLEKKSKSENFLFLNNRGTKLSRMGVWKIVDYYSKHAGITKEVHPHTFRHSFATHLIEGGADLRAVQEMLGHADISTTQIYTHIDRDYIKQVHKQFHPRG

SEQ ID NO: 6767 - DNA, 519 bp, Unknown
  Obtained from environmental sample
  misc_feature (1)..(519): n is a, c, g, or t
atggatttagcgcaaatttacggaatgatactcaccgaagattttaccagaaagatcatcacgaccaacgaaaagctgaacagcctcctggagaaatggagtgaccagcacgataagatcgtgtttacgaatggctgtttcgatatcgtgcataaaggccatattgattatctctacaaagcctctttgctgggaacaaaattgatgatcggggtaaattcggatagctctgtccaggccatcaaagggccttcccgcccggtccaggatgaaagttcgcggatgtatgtcctggcctccctggaatttgtcaatgctgtggtactctttaatgaccccacgccgctgaatctcattaaaaaagttcgtccggatgtgcttgtaaaaggagctgattataaacccgaagagatcgtgggctaccatgaagtaacctcctggggaggagagatccacaccatcgaattcctggaaggctattcgaccagtaagattatccggaaaatcctggaaggctaa

SEQ ID NO: 6768 - protein, 172 aa, Unknown
  Obtained from environmental sample
  DOMAIN (42)...(168): Cytidylyltransferase
  misc_feature (1)..(172): Xaa is any amino acid
MDLAQIYGMILTEDFTRKIITTNEKLNSLLEKWSDQHDKIVFTNGCFDIVHKGHIDYLYKASLLGTKLMIGVNSDSSVQAIKGPSRPVQDESSRMYVLASLEFVNAVVLFNDPTPLNLIKKVRPDVLVKGADYKPEEIVGYHEVTSWGGEIHTIEFLEGYSTSKIIRKILEG

SEQ ID NO: 6769 - DNA, 633 bp, Unknown
  Obtained from environmental sample
  misc_feature (1)..(633): n is a, c, g, or t
atgagcagcatatattttttgccgtggccggtgatactcaggattctaattgctgataaactattgccttttgtagtttccttactaatactcggtttgcgatttatttccaaactttattattggtggcaagtgagaaaagctcaaaaaaaactcgaattacatccacgtcttattaaaatcggtattaccggaagttttggaaaaagttcaactaaagaatttctggcaactatactttctcaaaaatattctgtggttaaaacacctaaaaatctcaatacagatattgggatagctcaaacaatcttaaaagaagttagctcccaaactgacatctttatcgctgaaatgggcgcatataaaagaggtgaaatacgacatatgtgtacgtttttcaaaccgagtatgggcattgtaacgggaattaatgagcagcatattgagctttttggttcgctttcaaatacacgcttagccaagtatgagctgattgagagtctacctaacaatggagttgccatttttaatggtgacaatgagtataccaggcttatggccaaaagaaccaaacataaaaaagtgattttgtatggagtacacaaaaactgggctgttgggcagatcagatag

SEQ ID NO: 6770 - protein, 210 aa, Unknown
  Obtained from environmental sample
  DOMAIN (8)...(210): Mur ligase family, catalytic domain
  misc_feature (1)..(210): Xaa is any amino acid
MSSIYFLPWPVILRILIADKLLPFVVSLLILGLRFISKLYYWWQVRKAQKKLELHPRLIKIGITGSFGKSSTKEFLATILSQKYSVVKTPKNLNTDIGIAQTILKEVSSQTDIFIAEMGAYKRGEIRHMCTFFKPSMGIVTGINEQHIELFGSLSNTRLAKYELIESLPNNGVAIFNGDNEYTRLMAKRTKHKKVILYGVHKNWAVGQIR

SEQ ID NO: 6771 - DNA, 720 bp, Unknown
  Obtained from environmental sample
  misc_feature (1)..(720): n is a, c, g, or t
atgagcagcatatattttttgccgtggccggtgatactcaggattctaattgctgataaactattgccttttgtagtttccttactaatactcggtttgcgatttatttccaaactttattattggtggcaagtgagaaaagctcaaaaaaaactcgaattacatccacgtcttattaaaatcggtattaccggaagttttggaaaaagttcaactaaagaatttctggcaactatactttctcaaaaatattctgtggttaaaacacctaaaaatctcaatacagatattgggatagctcaaacaatcttaaaagaagttagctcccaaactgacatctttatcgctgaaatgggcgcatataaaagaggtgaaatacgacatatgtgtacgtttttcaaaccgagtatgggcattgtaacgggaattaatgagcagcatattgagctttttggttcgctttcaaatacacgcttagccaagtatgagctgattgagagtctacctaacaatggagttgccatttttaatggtgacaatgagtataccaggcttatggcccaaagaacaaacataaaaagtgatttgtatggagtacacaaaactgggctgtttggccgatcgatagaacaaacaaagatggctgaggtttcaatcaaaagcttctcagatactctaaacggccgcggccctcgattttcaccgggggggtaccggtaa

SEQ ID NO: 6772 - protein, 239 aa, Unknown
  Obtained from environmental sample
  DOMAIN (8)...(213): Mur ligase family, catalytic domain
  misc_feature (1)..(239): Xaa is any amino acid
MSSIYFLPWPVILRILIADKLLPFVVSLLILGLRFISKLYYWWQVRKAQKKLELHPRLIKIGITGSFGKSSTKEFLATILSQKYSVVKTPKNLNTDIGIAQTILKEVSSQTDIFIAEMGAYKRGEIRHMCTFFKPSMGIVTGINEQHIELFGSLSNTRLAKYELIESLPNNGVAIFNGDNEYTRLMAQRTNIKSDLYGVHKTGLFGRSIEQTKMAEVSIKSFSDTLNGRGPRFSPGGYR

SEQ ID NO: 6773 - DNA, 822 bp, Unknown
  Obtained from environmental sample
  misc_feature (1)..(822): n is a, c, g, or t
atgttaaagaaactagaagccattcatgataaatatatgagactacaggagcaattatctgatcctgagatcattaatgatatgaatcgctactctaaaatcaataaagaatataaagatctaacacctataattgaatcatataaagtttatgaccaattaatgggtaatattcagactgcccgtttgatgatcaatgaaagtgatcctgaaatgaaggaaatggcaagagaagaactttcaactcttgaacctgaaaaggaaaagcttgaagagcacattagatttctgctggtacctaaagatcctgacgatgataagaatgtaatcttcgaaataagatcaggtactggaggtgatgaagcctccttatttgctggggatctttatagaatgtatacccggtattttgaaaagcaaaactggaaagtagaagtattaggggtgaatgaaggttcagttggtggctataataaattggtccttgagattagcggtgctgatgtttatggtaagctaaaatttgagtctggtgctcatagagtacaaagggtaccggatacagaatctaaaggcagagtacatacatcggcagcaacagtagtagcaatacctaaatatgaagaggatgagatagatattaataaagctgatttaagaatagatactttccgggcttcaggtgcnagtggtcagcacgtaaataaaactgaatcangtattcgtattacacatatacccaacagagtagtttctgaaagtacagaggacagatcacagcatagaaatagagaaattgctatgggtccgtctactccttga

SEQ ID NO: 6774 - protein, 273 aa, Unknown
  Obtained from environmental sample
  DOMAIN (207)...(272): Peptidyl-tRNA hydrolase domain
  misc_feature (1)..(273): Xaa is any amino acid
MLKKLEAIHDKYMRLQEQLSDPEIINDMNRYSKINKEYKDLTPIIESYKVYDQLMGNIQTARLMINESDPEMKEMAREELSTLEPEKEKLEEHIRFLLVPKDPDDDKNVIFEIRSGTGGDEASLFAGDLYRMYTRYFEKQNWKVEVLGVNEGSVGGYNKLVLEISGADVYGKLKFESGAHRVQRVPDTESKGRVHTSAATVVAIPKYEEDEIDINKADLRIDTFRASGASGQHVNKTESXIRITHIPNRVVSESTEDRSQHRNREIAMGPSTP

SEQ ID NO: 6775 - DNA, 474 bp, Unknown
  Obtained from environmental sample
  misc_feature (1)..(474): n is a, c, g, or t
atgcaggctgtcaatcttcgtcttttcaaaaaagttagcgacgttaataaaaaagccttgcgatattttcttacaaaaactgaaaataatccgccaaaagatttggatactatcgctgaacagattgatgctaaggtgtggcaagaaacggattgccttagctgcgccaactgttgcaaaacaatgacgcctacttatactttccaggatatgaaaagaatagcgggacattttagtatgaagataaaagacttcaaagccaggtggctttatcttgataaaaaatcaaaggactggatgaatgtttcaaagccctgccaatttcttgacaaaaaaaccaacttgtgtacgatttatgaaattcgtcctgcagattgtgccggatttcctcatcttacaaaaaagaaaatgatcgattacattcatatacacaaacaaaatatccagcattgtcccgctacgataaaatggtaa

SEQ ID NO: 6776 - protein, 157 aa, Unknown
  Obtained from environmental sample
  DOMAIN (50)...(156): Uncharacterised protein family (UPF0153)
  misc_feature (1)..(157): Xaa is any amino acid
MQAVNLRLFKKVSDVNKKALRYFLTKTENNPPKDLDTIAEQIDAKVWQETDCLSCANCCKTMTPTYTFQDMKRIAGHFSMKIKDFKARWLYLDKKSKDWMNVSKPCQFLDKKTNLCTIYEIRPADCAGFPHLTKKKMIDYIHIHKQNIQHCPATIKW

SEQ ID NO: 6777 - DNA, 621 bp, Unknown
  Obtained from environmental sample
  misc_feature (1)..(621): n is a, c, g, or t
atgcctatatcaaaaacttccagtgacatacatggcataactaatgaaaaagtaaaagatgcgccaacttttaaagaggtggccaatgagttaaaacagtttatagataacgctgacctttcaggctataactcaaaccgctttgacgttccgcttttaatagaggaatttttgagggttggaattacctttgatatgagcaaaagaaaaatggtagatgttcagcacatttttcacatgatggaacggcgaactttgtcggctgcttatcaattttattgtaagaaagatttacacgaagcccacagtgctgaagcagatgctttggctacctgggagattttagaagcacaaactgtctgttacgagaacttaggttgtacaatcgattctattctaaaatttacgggtgaagaaattattgttgatttcgcccggcgaatagtaatggaaaatgacgtggaggtattcaattttggaaagcataaaggaagagctgtatgtgatgtcttaaaagttgaacctcagtattatgactggatgatgaaaggagattttccgttgcacaccaagcaaaaacttacagagatattaaatcgtaccctgttaaagaaaggataa

SEQ ID NO: 6778 - protein, 206 aa, Unknown
  Obtained from environmental sample
  misc_feature (1)..(206): Xaa is any amino acid
MPISKTSSDIHGITNEKVKDAPTFKEVANELKQFIDNADLSGYNSNRFDVPLLIEEFLRVGITFDMSKRKMVDVQHIFHMMERRTLSAAYQFYCKKDLHEAHSAEADALATWEILEAQTVCYENLGCTIDSILKFTGEEIIVDFARRIVMENDVEVFNFGKHKGRAVCDVLKVEPQYYDWMMKGDFPLHTKQKLTEILNRTLLKKG

SEQ ID NO: 6779 - DNA, 735 bp, Unknown
  Obtained from environmental sample
  misc_feature (1)..(735): n is a, c, g, or t
gtgacccctggctcctataaagtgaagatagttcatggaactttcggcgtggatttagaacataacggaaacgactgggaactgtattcaagtggctcaaaccctggtgctttatcattgtataacaatggcggttttcgaggatcctttaatgctacaacgggtgcttattcatcagtatctgatgaaagattgaaaactaatattaaggatatgcccgcagtcttaactaaggtcaatcaattaaaaccagccacctatcaaatcaaaagcgctatagctagtaatacgattaattccattcaaggcagtattcctgagtcttacggttttctggcccaggatgtaatgaaaatatttcctcacctcgtaatgcacgacgtagatacagaacggggtgaagatgtttattctcttgattacagtggctttggcgttcttgctattaaggcaattcaggaattacaaaaagccatggagcagcagcaggaagagataaaagaattaaaaacaaaattgaatcaactggcaggtacagtaaccgacaaaactgaagtgaatcctaaaattaagcaaacattaattagccctaacaacctctcttttgatagctggcctaatcctgcgcaaaattcaacaagtatccggtataatctctcttccgggtttaaaaatgcacaagtggctatcacagataaaaacggtgtaactctaaaagagacaatatcggagtaa

SEQ ID NO: 6780 - protein, 244 aa, Unknown
  Obtained from environmental sample
  misc_feature (1)..(244): Xaa is any amino acid
MTPGSYKVKIVHGTFGVDLEHNGNDWELYSSGSNPGALSLYNNGGFRGSFNATTGAYSSVSDERLKTNIKDMPAVLTKVNQLKPATYQIKSAIASNTINSIQGSIPESYGFLAQDVMKIFPHLVMHDVDTERGEDVYSLDYSGFGVLAIKAIQELQKAMEQQQEEIKELKTKLNQLAGTVTDKTEVNPKIKQTLISPNNLSFDSWPNPAQNSTSIRYNLSSGFKNAQVAITDKNGVTLKETISE

SEQ ID NO: 6781 - DNA, 531 bp, Unknown
  Obtained from environmental sample
  misc_feature (1)..(531): n is a, c, g, or t
atgcccaacacctacacccaaatacacattcaggcagtttttgctgtacagaaccgacagtcacttattcaaacttcatggaaagttgaactatataaatacattagtggcattctcactagcaacactcataagttaatcattataaacggaatgcccgatcacctgcatgttttatttggaatgagaccagttcaatcactatcagatttgatgcaggatataaaaggaaattcatcaaaatggatcaatgataaaaaattagttaaaggaaagttttcatggcaggaaggttatggagcattttcatatagcaaatctcagttaccttccgtaataaaatatatcgaaaatcangaagaacatcatanaaaaataactttcttagaagaatatatagcgattctaaaaaagcatgagatagaatttgatgagcgatatatatttaaacctgtaataaataaaacagaagatgactcttcatctgntaccggggttgcccatgtatttcagatgcantttcagttgtag

SEQ ID NO: 6782 - protein, 176 aa, Unknown
  Obtained from environmental sample
  DOMAIN (13)...(109): Transposase IS200 like
  misc_feature (1)..(176): Xaa is any amino acid
MPNTYTQIHIQAVFAVQNRQSLIQTSWKVELYKYISGILTSNTHKLIIINGMPDHLHVLFGMRPVQSLSDLMQDIKGNSSKWINDKKLVKGKFSWQEGYGAFSYSKSQLPSVIKYIENXEEHHXKITFLEEYIAILKKHEIEFDERYIFKPVINKTEDDSSSXTGVAHVFQMXFQL

SEQ ID NO: 6783 - DNA, 375 bp, Unknown
  Obtained from environmental sample
  misc_feature (1)..(375): n is a, c, g, or t
ttgcattttaccataggtagaaaaaatggtcagttaatagctaataaaatagtagtgcctgatgttataaaaaccaaacccaaacttgttgtggatatgcatgaagatttatggaaggaaaccggttataaataccctcgtttcatttatcctgtatccaaagatgatgaaacaatgaattatgtgaataacattactcagacgatgccatttttaaaaatatattctccaggtggatcaagcccattatacgttacaaaaccaatctcaaataagggaattcatgccatggtatatgaaacctataaaaaggattcatatgaaaaaaaatattctgatgcaagtcaatttatagatgtgttagataagttatga

SEQ ID NO: 6784 - protein, 124 aa, Unknown
  Obtained from environmental sample
  misc_feature (1)..(124): Xaa is any amino acid
MHFTIGRKNGQLIANKIVVPDVIKTKPKLVVDMHEDLWKETGYKYPRFIYPVSKDDETMNYVNNITQTMPFLKIYSPGGSSPLYVTKPISNKGIHAMVYETYKKDSYEKKYSDASQFIDVLDKL

SEQ ID NO: 6785 - DNA, 441 bp, Unknown; identical to SEQ ID NO: 2005
  Obtained from environmental sample
  misc_feature (1)..(441): n is a, c, g, or t

SEQ ID NO: 6786 - protein, 146 aa, Unknown; identical to SEQ ID NO: 2006
  Obtained from environmental sample
  DOMAIN (3)...(70): SmpB protein
  misc_feature (1)..(146): Xaa is any amino acid

SEQ ID NO: 6787 - DNA, 471 bp, Unknown
  Obtained from environmental sample
  misc_feature (1)..(471): n is a, c, g, or t
atgcactacttcagctcaaacggcgatacaatgaccatgctaaactcatcgaaaatcgatctattanngatnccggaggcgacattttattaccgtaacggttataaggaagtgattgctgagcatgattctttaaagttggcggtggaatcatccattaacctggagtacgagaagatcggcctgtacggtcagtcaaacggtgctcaggatataatacctgtcagctcttacaataccgataccaatatctttaaacttactgttggacaggatgccgtggtcagaaaaaaaacaacttactaccttttctataaatacgagccaccggttatcgccagcaagaaaagctttttgaaaatattcaataagaacaaggccgcgatcaataactatattgaaaactataaggtcaattttaataaacaggaggacttaaaaagcctggtcaaattttgtagtatattatag

SEQ ID NO: 6788 - protein, 156 aa, Unknown
  Obtained from environmental sample
  misc_feature (1)..(156): Xaa is any amino acid
MHYFSSNGDTMTMLNSSKIDLLXXPEATFYYRNGYKEVIAEHDSLKLAVESSINLEYEKIGLYGQSNGAQDIIPVSSYNTDTNIFKLTVGQDAVVRKKTTYYLFYKYEPPVIASKKSFLKIFNKNKAAINNYIENYKVNFNKQEDLKSLVKFCSIL

SEQ ID NO: 6789 - DNA, 621 bp, Unknown
  Obtained from environmental sample
  misc_feature (1)..(621): n is a, c, g, or t
atgagagcatttttgtcaataaccgtatgctttttcctcttcgtgaattttgcttcgtcgcaattcaccgaaacaattcgggtaaaagccggtgatgatatttcaaaaataatatctccttccggggtttatcgttttccttcttttacggccggcacttatgtaaagaacaacaaagtcaccgcttctgccaaacttaactaccatattttaaccggtcaaatgcactacctcagctcaaacggcgatacaatgaccattgctaactcatccgaaatcgatcttattaagatccgggaggcgacattttattaccgtaacggttataaggaagtgattgctgagcatgattctttaaagttggcggtggaatcatccattaacctggagtacgagaagatcggcctgtacggtcagtcaaacggtgctcaggatataatacctgtcagctcttacaataccgataccaatatctttaaacttactgttggacaggatgccgtggtcagaaaaaaaacaacttactaccttttctataaatacgagccaccggttatcgccagcaagaaaagctttttgaaaatattcattagaaacaggccgcgatncatactatattga

SEQ ID NO: 6790 - protein, 206 aa, Unknown
  Obtained from environmental sample
  SIGNAL (1)...(18)
  misc_feature (1)..(206): Xaa is any amino acid
MRAFLSITVCFFLFVNFASSQFTETIRVKAGDDISKIISPSGVYRFPSFTAGTYVKNNKVTASAKLNYHILTGQMHYLSSNGDTMTIANSSEIDLIKIREATFYYRNGYKEVIAEHDSLKLAVESSINLEYEKIGLYGQSNGAQDIIPVSSYNTDTNIFKLTVGQDAVVRKKTTYYLFYKYEPPVIASKKSFLKIFIRNRPRXILY

SEQ ID NO: 6791 - DNA, 720 bp, Unknown
  Obtained from environmental sample
  misc_feature (1)..(720): n is a, c, g, or t
atgatcaactgtatcattgttgatgacgagcagcatgccatcgatatcctggagcattacgtcaaacaaacgccatatttaaatcacctggcgagtttcaccaatccaatagaagcgctgcaatatctaggtgaacaaaaaattgatcttgttttcctcgatattcagatgccggaattatccggtatagattttataaaaaccattcatggaaaagtgaaggtcattctaacaactgcttatagtgaattcgctctcgagggatatgacctgtatgttgtggattatttattaaaaccggtaagattacccaggttcctggtggccgtacaaaaagccattgaacaaattagcgctgccggtaaacccattgttcctgcaacagacacagactacatttttgtcaaaacagaatccaagggaaaactgctcaagatcaatcttgccgacattgattatatcgaaagcatgaaagattatgctgctatttacaggaatggacaaaggaccctggtacttataacgatgaagaagctggaagaaagtttaccaaagacaggattcatacgggtacataagtcctttatcgtgcctatagaaaagatcacgggtatagagggaaatatggtaagacttaagaatgtgaacacagagatcctgatcggtgacaattataaagcggagttgatggagattgtgaggggaaggatgatacagtaa

SEQ ID NO: 6792 - protein, 239 aa, Unknown
  Obtained from environmental sample
  DOMAIN (2)...(118): Response regulator receiver domain
  misc_feature (1)..(239): Xaa is any amino acid
MINCIIVDDEQHAIDILEHYVKQTPYLNHLASFTNPIEALQYLGEQKIDLVFLDIQMPELSGIDFIKTIHGKVKVILTTAYSEFALEGYDLYVVDYLLKPVRLPRFLVAVQKAIEQISAAGKPIVPATDTDYIFVKTESKGKLLKINLADIDYIESMKDYAAIYRNGQRTLVLITMKKLEESLPKTGFIRVHKSFIVPIEKITGIEGNMVRLKNVNTEILIGDNYKAELMEIVRGRMIQ

SEQ ID NO: 6793 - DNA, 867 bp, Unknown
  Obtained from environmental sample
  misc_feature (1)..(867): n is a, c, g, or t
ttgcctgatgacccatatcttcttgaacaaaatatcttgcccattgcttgcattggtgtagattatcgtttcattaaagtaaatcgtgctttttgtgagctaacaggatttactgaacaagaattaaaacatcttaagttgacggatatagtccacgctgcggataagcatagggagaaatatattttatcaaatttatttggtgggcgaattcctgtaaaccgatcggacaagagattaattaaaaaaaatcagcaggttatttgggtgaattgttcttctaccattcaacgcgatagtaggggttatccgcagtttatattctccgcaatggaaaatatcaatcgccgcaagcgatatgagcaaacacttattaaagataaaactactctttcttctgttgttgatcattctgatacgtttatttttagcgttgacaccaatcatacacttatcttcctgaatgaaaaagtaaaagatttctttttcggattaactgatattgtgattgaagccggttttaacctgcaacaaattatcccgccagtctatctttcacaataccaggaaacttttaagcgtggaataaatggagaagctttcagtgtggatattaagcttgaagcaactgggtcatcctttatagaaatttctgtacagccggttgttgatgatttaagcagggtggttagtcttacttttactgcaaaggacattagcgagaggaagaaaaaggagcaagaacttttaaaacaaaaggaagatgcagaagcttcgcgtgaagctaaatcaacatttttagcaacaatgagccatgagatacgcactcccctgaatggagtgattggcatgagcaagcttttctga

SEQ ID NO: 6794 - protein, 288 aa, Unknown
  Obtained from environmental sample
  misc_feature (1)..(288): Xaa is any amino acid
MPDDPYLLEQNILPIACIGVDYRFIKVNRAFCELTGFTEQELKHLKLTDIVHAADKHREKYILSNLFGGRIPVNRSDKRLIKKNQQVIWVNCSSTIQRDSRGYPQFIFSAMENINRRKRYEQTLIKDKTTLSSVVDHSDTFIFSVDTNHTLIFLNEKVKDFFFGLTDIVIEAGFNLQQIIPPVYLSQYQETFKRGINGEAFSVDIKLEATGSSFIEISVQPVVDDLSRVVSLTFTAKDISERKKKEQELLKQKEDAEASREAKSTFLATMSHEIRTPLNGVIGMSKLF

SEQ ID NO: 6795 - DNA, 417 bp, Unknown
  Obtained from environmental sample
  misc_feature (1)..(417): n is a, c, g, or t
atgattcttgtgaaagcttcgaaaaaagagatacttggaatgtacagtccgcgcggggcagtagatgaaactgtcagccaggatgcaatttcatttctgaaaaagggcgggatcctcaaatcaatttatcaattgacaggggataaggatatggatactcagcttcttaaggcttgtgagcaattntccaagacaggggaagagttaagattatcagagttcaaaatacccaacatgacagtatttgattcagagactgtttttctgaacctttctaatgataaaagcataccaaagcacaaacaagcggatttaataatcaagaatccggattatgcagggcatatgagagatttgttcctgaattattgggaaaaatctgtttctttttctgattttaaaaaaagaactaaatag

SEQ ID NO: 6796 - protein, 138 aa, Unknown
  Obtained from environmental sample
  misc_feature (1)..(138): Xaa is any amino acid
MILVKASKKEILGMYSPRGAVDETVSQDAISFLKKGGILKSIYQLTGDKDMDTQLLKACEQXSKTGEELRLSEFKIPNMTVFDSETVFLNLSNDKSIPKHKQADLIIKNPDYAGHMRDLFLNYWEKSVSFSDFKKRTK

SEQ ID NO: 6797 - DNA, 651 bp, Unknown
  Obtained from environmental sample
  misc_feature (1)..(651): n is a, c, g, or t
ttgaataaagaaatattaatagaaagactgaagtcacttgggttcaaggaatatgaatctaaagtccttatagttttattgagcggcaatcctttaagtgcatcagagatagccaaggaagcgaagatcataagaaattcaatttatgatatccttaaatcatttgttgaaaagggatattgtaatgaaattgaaaccaatacgatacttaattaccagataattgacccttctgtaattctggataagataaccagggattacaaaaaaagcttcaataaacgtatggaaagccttgccgaaactttcggtgagcttcaaaatatatataaaacagaatcggcaaaagtagatcttccagataagaatatccagcttatacgcggattcaacaagcacagggaagagaagtatattgatcttgtgaaagcttccgaaaaagagatacttggaatgtacagtccgcgccgggcagtagatgaaactgtcagccaggatgcaatttcatttctgaaaaagggcgggatcctcaaatcaatttatcaattgacaggngataaggatatggatactcagcttcttaaggcttgtgagcaattttccaagacaggngaagagttaagaatatcagaagtcaaataccccacatga

SEQ ID NO: 6798 - protein, 216 aa, Unknown
  Obtained from environmental sample
  DOMAIN (5)...(215): Sugar-specific transcriptional regulator TrmB
  misc_feature (1)..(216): Xaa is any amino acid
MNKEILIERLKSLGFKEYESKVLIVLLSGNPLSASEIAKEAKIIRNSIYDILKSFVEKGYCNEIETNTILNYQIIDPSVILDKITRDYKKSFNKRMESLAETFGELQNIYKTESAKVDLPDKNIQLIRGFNKHREEKYIDLVKASEKEILGMYSPRRAVDETVSQDAISFLKKGGILKSIYQLTGDKDMDTQLLKACEQFSKTGEELRISEVKYPT

SEQ ID NO: 6799 - DNA, 663 bp, Unknown
  Obtained from environmental sample
  misc_feature (1)..(663): n is a, c, g, or t
atgattaacctttcagctatccgcaaatcgtaccggcttgcagaaacttcctttgaagtgctgaaggggatcgatcttcacatcaaagaaggggaatttgtttccatcatgggttcttcaggttccggtaaatcaaccttgctgaatattctggggatcctcgacaattacgattccggagattaccagttaaataaaaccccgattaaaaacctgagccaaaaaaaagcggcgcaactccgtaaccaattcctcggttttgtatttcaatcgtttaatctgctctcatttaaaaacgccgtcgaaaatgtcgccctgccgttatattaccaaagcatatcacgaaaagaacgaaataaacgcgcgcttgagctgctcgatcgcatggggatgaaggattgggccgaacatttgccctcggaattaagtgggggacagaaacaacgtgtggcgattgcacgcgctctcattgcaaatcccaaagtcatcttcgccgatgagccaacaggggcactcgattcacaaacctcgctggaagtgatggagatctttaaggaaataaataaccagggtaaaaccatcgtggtagtcacacacgagaacgacatagcggccatgacccacagaaccattctattaaaagacggtcttatcatgaattga

SEQ ID NO: 6800 - protein, 220 aa, Unknown
  Obtained from environmental sample
  DOMAIN (31)...(216): ABC transporter
  misc_feature (1)..(220): Xaa is any amino acid
MINLSAIRKSYRLAETSFEVLKGIDLHIKEGEFVSIMGSSGSGKSTLLNILGILDNYDSGDYQLNKTPIKNLSQKKAAQLRNQFLGFVFQSFNLLSFKNAVENVALPLYYQSISRKERNKRALELLDRMGMKDWAEHLPSELSGGQKQRVAIARALIANPKVIFADEPTGALDSQTSLEVMEIFKEINNQGKTIVVVTHENDIAAMTHRTILLKDGLIMN

SEQ ID NO: 6801 - DNA, 549 bp, Unknown; identical to SEQ ID NO: 1163
  Obtained from environmental sample
  misc_feature (1)..(549): n is a, c, g, or t

SEQ ID NO: 6802 - protein, 182 aa, Unknown; identical to SEQ ID NO: 1164
  Obtained from environmental sample
  misc_feature (1)..(182): Xaa is any amino acid

SEQ ID NO: 6803 - DNA, 765 bp, Unknown
  Obtained from environmental sample
  misc_feature (1)..(765): n is a, c, g, or t
ttgnaggacagattagaggtaagtgtagaaaaagcacttgaactaaatcacgataaatttacaacaactcttctgataagtcccaaaaaatcgcaagataaattagaaaaaattggaaatgaactctcacataaatataattgtgaatttgttttcaaagattatagaagtggcaatggagttgaacttcaaggattggaagtgaaacaaaacaatctttatagacaaaattattgtgggtgtttatatggactgaatgtccaaagggtctatcaagataaactagctgatgaacttataatgcctataggaagacaagtacaaccagaatctattgaggagagattagaactttacaaacaaagagattgtttggagaattatgaaatagtaaaacaacgatttttaaactatagacttcttaatggaaaaataacaatcaataaagaggtaatcccatcatattttttatgctactcaacattaaaaaacaaaaaaactacaggaagaattgaaaagtcagtcaaaaatatccattatcttaatcgtgatgaagtaaaaatcatctctttagaatattttaatactattgcaaatacaaactatgggtctatttatgaacttatatacaatccactcaattttgaagctgaattaagtttgaggaaccaacttacacacaacccatatgatcttagttgtataatagttatagaaaagattcttgatgaaaaaatagaagtatctgtattcagccagcgataa

SEQ ID NO: 6804 - protein, 254 aa, Unknown
  Obtained from environmental sample
  DOMAIN (1)...(115): Uncharacterized BCR, COG1636
  misc_feature (1)..(254): Xaa is any amino acid
MXDRLEVSVEKALELNHDKFTTTLLISPKKSQDKLEKIGNELSHKYNCEFVFKDYRSGNGVELQGLEVKQNNLYRQNYCGCLYGLNVQRVYQDKLADELIMPIGRQVQPESIEERLELYKQRDCLENYEIVKQRFLNYRLLNGKITINKEVIPSYFLCYSTLKNKKTTGRIEKSVKNIHYLNRDEVKIISLEYFNTIANTNYGSIYELIYNPLNFEAELSLRNQLTHNPYDLSCIIVIEKILDEKIEVSVFSQR

SEQ ID NO: 6805 - DNA, 513 bp, Unknown
  Obtained from environmental sample
  misc_feature (1)..(513): n is a, c, g, or t
ttggcacgaatacttaggtactttatggggaaaactaagaggacaaatagattgaatatagttaatgaacaattttcaaagcatgcaaaagaatataaccattataatatcatacaacagattgtctctaaagcattagtaagggaacttccttttcaacctaaaagaatattagagttaggatgtggttcaggacaggtatttaaaaatattgattttgattttgactactacaaagcgatagatttttctgctagtatgtgtgatattcatcctagagagaaaaacctagagatagtgtgtttagattttgatagtaatgagtttattgacaatattaaaaatgatagttacgatatggtattatcatcatctgcactacaatggtcacaaaacttaactagaattgcagaacacttagccaaaaatacaacaaacataaatcttgtactttttacctcaatacttttaaaactattttttcactcactggaaaaaaatcacctatattag

SEQ ID NO: 6806 - protein, 170 aa, Unknown
  Obtained from environmental sample
  misc_feature (1)..(170): Xaa is any amino acid
MARILRYFMGKTKRTNRLNIVNEQFSKHAKEYNHYNIIQQIVSKALVRELPFQPKRILELGCGSGQVFKNIDFDFDYYKAIDFSASMCDIHPREKNLEIVCLDFDSNEFIDNIKNDSYDMVLSSSALQWSQNLTRIAEHLAKNTTNINLVLFTSILLKLFFHSLEKNHLY

SEQ ID NO: 6807 - DNA, 600 bp, Unknown
  Obtained from environmental sample
  misc_feature (1)..(600): n is a, c, g, or t
atgaaggcaatatttaatcgtttcgaacaggcggatattggagatttaagggcgtttgaaggttcaggattgggtcttaccatatcaaaagcttatgttgaaatgctcggaggtgaaatttttgtagaatctgaagaaggaattgggtcaacgtttacatttacaattccttatgtgaaaacagaaaaaaatgaattgggacaaaagcctgaaaatttcgtcaatgaacccgcaagcctggaaaacctgaatttacttattgtggaggacgatgatgttagttcagagcttatagaagctatgattaaagatacattccgaaaaatcacttttgcaggaaatggaatagaagccatcgaaatatgtagaaataacccggaaattaatttggttttgatggatgttaaaatgcctaaaatgaatgggtatgatgctacacgagaaatcaggaagtttaataaagacctgcttatcatagcacaaacggcctatgccatgctcggtgacgaggacaaagccattgaagccgggtgtaacgattatatctcgaaaccgataaaaaaagaggagcttttaaataaaattggaaattttttttaa

SEQ ID NO: 6808 - protein, 199 aa, Unknown
  Obtained from environmental sample
  DOMAIN (3)...(59): Histidine kinase-, DNA gyrase B-, and HSP90-like ATPase
  misc_feature (1)..(199): Xaa is any amino acid
MKAIFNRFEQADIGDLRAFEGSGLGLTISKAYVEMLGGEIFVESEEGIGSTFTFTIPYVKTEKNELGQKPENFVNEPASLENLNLLIVEDDDVSSELIEAMIKDTFRKITFAGNGIEAIEICRNNPEINLVLMDVKMPKMNGYDATREIRKFNKDLLIIAQTAYAMLGDEDKAIEAGCNDYISKPIKKEELLNKIGNFF

SEQ ID NO: 6809 - DNA, 444 bp, Unknown
  Obtained from environmental sample
  misc_feature (1)..(444): n is a, c, g, or t
atgattggaaaagttttaggttttgatgagggtagtaacagtggcatcataactaatgatcgtggagatagatacaaattcagatcatctgagtggagagatgaactaaaacctgaaaaaaatatgaaaattgattttgttgtaggtgaagatagtgaagcaaaagatatatatattgttacagatttcgcagtagaaaacacaaaaacaatcttagcctttttagcagtagtaatcaccttcttttttgggttcatcggcacttttatctcaagattggctttagctaaacagccacttcctcaaacattagcccctactttcatacatcttgcagctactgtttttgtagttgtcccttttataggatggctggtatatctaatagtttcgatatactatatggttaaaaactatcaaattgtgaataacaaaaaatattag

SEQ ID NO: 6810 - protein, 147 aa, Unknown
  Obtained from environmental sample
  misc_feature (1)..(147): Xaa is any amino acid
MIGKVLGFDEGSNSGIITNDRGDRYKFRSSEWRDELKPEKNMKIDFVVGEDSEAKDIYIVTDFAVENTKTILAFLAVVITFFFGFIGTFISRLALAKQPLPQTLAPTFIHLAATVFVVVPFIGWLVYLIVSIYYMVKNYQIVNNKKY

SEQ ID NO: 6811 - DNA, 399 bp, Unknown
  Obtained from environmental sample
  misc_feature (1)..(399): n is a, c, g, or t
atgattgatttttttaaaagatcactatatcgtaaactactactggctttcatgctggtggggttttttccttacctgatattctttatctacaccatctattttagtgaacaaaagatcgtaaacaagatcatagatgagcagcacattcaagctcaaacgatcgtaaatactatagataatcatctaaaacttctaagtaaaaacataaaattcctctcaaatcctgatctcatggatgacattgtggctgaagatatcgacaaacgtgtatcgagacttctaacacaaaaaaaagatgatttaaaccttgacatagagctatttgctgtgggtgagaactctcaagttatcccatcttcaaatgtaaaaaaattccctaaaaaaattgcaaattaa

SEQ ID NO: 6812 - protein, 132 aa, Unknown
  Obtained from environmental sample
  misc_feature (1)..(132): Xaa is any amino acid
MIDFFKRSLYRKLLLAFMLVGFFPYLIFFIYTIYFSEQKIVNKIIDEQHIQAQTIVNTIDNHLKLLSKNIKFLSNPDLMDDIVAEDIDKRVSRLLTQKKDDLNLDIELFAVGENSQVIPSSNVKKFPKKIAN

SEQ ID NO: 6813 - DNA, 567 bp, Unknown
  Obtained from environmental sample
  misc_feature (1)..(567): n is a, c, g, or t
atggttaattatatttgtgactttttaaaacttattccagaaaaaacttttcatcttatttttgctacatactccccattcatcctttcagatttaccaaaacaaaatgtaatattcttagaaaaatacaaaaaagatgaggatgaaaatcaaaaagagggcaattgtaaagtagtaaacccagatataaatcaaacctttggagcaaatatccatactcttttatctcacggtttttttatggaaaatgggcttatgggtgcgtttgcgaaagataaaataaatacaattatagagtttcataaagaggttgaagaaaataaagagaatgaaataaaaaaagatgaattaaaactaaaatatgaaactatagaagataatcaaaaaacaaaaaaagataatttttggaatatacaatcaataattggagaagattatttaaaacaagtgattaaaaatcatcttacagagatagaaaaaatattgtataaagacgagtatcttgataatgaaatcgaaagagcaaaaaaagaacttgaaagattaaaggcactaaaagatgcttaa

SEQ ID NO: 6814 - protein, 188 aa, Unknown
  Obtained from environmental sample
  misc_feature (1)..(188): Xaa is any amino acid
MVNYICDFLKLIPEKTFHLIFATYSPFILSDLPKQNVIFLEKYKKDEDENQKEGNCKVVNPDINQTFGANIHTLLSHGFFMENGLMGAFAKDKINTIIEFHKEVEENKENEIKKDELKLKYETIEDNQKTKKDNFWNIQSIIGEDYLKQVIKNHLTEIEKILYKDEYLDNEIERAKKELERLKALKDA

SEQ ID NO: 6815 - DNA, 339 bp, Unknown
  Obtained from environmental sample
  misc_feature (1)..(339): n is a, c, g, or t
atgcttaaaattaagtataactctgtttgtgaagatagttattataaactaatttcaaatagaaaaatgcaaaaatttaaaaatattacttttgaatcttactataacagatatgttaaaaataaattgtctgattatagtttaaaagatattatttgtggagattttcaaaagttacaagagataaaaaataatattggaacaaaatatcaatcaaaatcaaatgttgtaaagcaattatttaattatgataaaaaatcaaaaagcttcaaatcaaaaatatcattgtttcaaacacaaatatcaaaatttatagaaaaaaatatagaaagtccatag

SEQ ID NO: 6816 - protein, 112 aa, Unknown
  Obtained from environmental sample
  misc_feature (1)..(112): Xaa is any amino acid
MLKIKYNSVCEDSYYKLISNRKMQKFKNITFESYYNRYVKNKLSDYSLKDIICGDFQKLQEIKNNIGTKYQSKSNVVKQLFNYDKKSKSFKSKISLFQTQISKFIEKNIESP

SEQ ID NO: 6817 - DNA, 513 bp, Unknown
  Obtained from environmental sample
  misc_feature (1)..(513): n is a, c, g, or t
atgagcctgagagagagttattttagcggatctttttatccggataagatgagtgatatagttaactatatagagcagttcgataacatgcataagatcaaaatagaaaaaaatatacgcgccatgattgtaccacatgccggatatgtatattcaggctttagtgcaaatcttgtactttctcagttagcacacattaaaccaaagagggttattgtaatagggccatctcacaaagtagcatttagcggtgctactgtctctctacaagagagttatgaaactccatttgggaaattaaatatagatgttgagtatgccaaagatatctacaataaatttgggctaacttttaatgagtctgttcataaagagcactcaactgaagtgcagatgccatttattaaatactactcacctacctcaaaaattatagagattatctactcctctatcgtcccatcagagctatcagctcttatcacttatctcatacttctcagccgaatctga

SEQ ID NO: 6818 - protein, 170 aa, Unknown
  Obtained from environmental sample
  DOMAIN (5)...(170): Protein of unknown function DUF52
  misc_feature (1)..(170): Xaa is any amino acid
MSLRESYFSGSFYPDKMSDIVNYIEQFDNMHKIKIEKNIRAMIVPHAGYVYSGFSANLVLSQLAHIKPKRVIVIGPSHKVAFSGATVSLQESYETPFGKLNIDVEYAKDIYNKFGLTFNESVHKEHSTEVQMPFIKYYSPTSKIIEIIYSSIVPSELSALITYLILLSRI

SEQ ID NO: 6819 - DNA, 330 bp, Unknown
  Obtained from environmental sample
  misc_feature (1)..(330): n is a, c, g, or t
ttgataaaattaattctgaaattaaatgcggtgacgctgggtactcagaaaattagtacggaaaattaccacgcggtagatagagaagaaaaagaaaatgctcacgaaatgttactttctatattagtaaagcttgaaaattatgtgataaataatgagtttaatgatgagcttatagatgagttgcaggaaactaaaacaaaattcagtcaagaagttaatatgatagtttctgcattaaatgattttgatttcgaattggcatctaataatattagaatgcttattgagcaattaaagtctagcccaaagactagtgtaagtgagtga

SEQ ID NO: 6820 - protein, 109 aa, Unknown
  Obtained from environmental sample
  misc_feature (1)..(109): Xaa is any amino acid
MIKLILKLNAVTLGTQKISTENYHAVDREEKENAHEMLLSILVKLENYVINNEFNDELIDELQETKTKFSQEVNMIVSALNDFDFELASNNIRMLIEQLKSSPKTSVSE

SEQ ID NO: 6821 - DNA, 477 bp, Unknown
  Obtained from environmental sample
  misc_feature (1)..(477): n is a, c, g, or t
ttgttagaaggggtagaaaatgggattacaagattttatttgtggtttcaaggggtgacaatgaatgaattgttaatatcaaaaaatgttgatattaaagaccctgatttaaatgaaattagtaaacaagatcatatacatatgaaaggcgtagaagtttttaagtttgcaacaagaatcttacctaaaactgttaatgatttacttgatagaaataatttaactttagacgacttagattatatggtagctcatcaagctaataagagaattatctcaaaagctgctaaagatcttaagtttagtatggataaaatgtttttgaatattgataaatatggaaatacatctgcggcaagtgttccacttgcaattgatgaggctataagaacaaaagtacttaaaaaaggagataagtttatcacagttgccttcggtggagggttaacttggggtggtgcacttattcaactatag

SEQ ID NO: 6822 - protein, 158 aa, Unknown
  Obtained from environmental sample
  misc_feature (1)..(158): Xaa is any amino acid
MLEGVENGITRFYLWFQGVTMNELLISKNVDIKDPDLNEISKQDHIHMKGVEVFKFATRILPKTVNDLLDRNNLTLDDLDYMVAHQANKRIISKAAKDLKFSMDKMFLNIDKYGNTSAASVPLAIDEAIRTKVLKKGDKFITVAFGGGLTWGGALIQL

SEQ ID NO: 6823 - DNA, 426 bp, Unknown
  Obtained from environmental sample
  misc_feature (1)..(426): n is a, c, g, or t
atgaaaaatatcagtgtaagtcaaaaaataaaagtacttgcatcccttttaatcttaactatttttacagttataagtatcactatatatctaaatcaaaagaatataaaagatgcaacaatagtaaatatagctggtaaacaaagaatgttaacacaaaaaatcacaaaaaatattttttatctttaccaatacaaaactgatgacttttcagaacttgataatgctatatctgaatttaatcatggactgaaaactttaaaagatggaaataaacttttaggtatctcagcagctccaacccaagatattaacaatcaaatatcnaaagtaattattctttgggatagttttgaaaaaaatactaatatttttaaaacttcttttatgcaaaatgacataaatcagttgaactcccatttttga

SEQ ID NO: 6824 - protein, 141 aa, Unknown
  Obtained from environmental sample
  misc_feature (1)..(141): Xaa is any amino acid
MKNISVSQKIKVLASLLILTIFTVISITIYLNQKNIKDATIVNIAGKQRMLTQKITKNIFYLYQYKTDDFSELDNAISEFNHGLKTLKDGNKLLGISAAPTQDINNQISKVIILWDSFEKNTNIFKTSFMQNDINQLNSHF

SEQ ID NO: 6825 - DNA, 603 bp, Unknown
  Obtained from environmental sample
  misc_feature (1)..(603): n is a, c, g, or t
atgcaaaatgacataaatcagttgaactccattttgaaatatatatccaaaacaaacaataaattattagcagaagtggataccattgtgactctttatacaaaacatatagaacaaaaaacaaattttataaagaattttcaatatgtatcattctctttactatttatttttgccttatatgctttgatacaattaagacagatagaagctcatgctagagaatttatcgccaaatctaaaaaaataagttctaatgatttagaaaacattgaacttttagatatgaatggtgaaactgaatttgtagagatggctgataattttaactgttttatacataaagtttcaagtgctatggattactcacaaacagcattagagcaatcaaaattagcatcacaaaaacttgaaagtttgactgatgaatttagtaatataataaatgaacttcaaaatagaccagagattgcaaaacagttagataaaagtgaagatattgttatagaatcaactgaagatttgataaaatctacaaaaaaattacaaaatttaaaagatgaacttgataaactattaacaagttgtaaatcaaatatatag

SEQ ID NO: 6826 - protein, 200 aa, Unknown
  Obtained from environmental sample
  misc_feature (1)..(200): Xaa is any amino acid
MQNDINQLNSILKYISKTNNKLLAEVDTIVTLYTKHIEQKTNFIKNFQYVSFSLLFIFALYALIQLRQIEAHAREFIAKSKKISSNDLENIELLDMNGETEFVEMADNFNCFIHKVSSAMDYSQTALEQSKLASQKLESLTDEFSNIINELQNRPEIAKQLDKSEDIVIESTEDLIKSTKKLQNLKDELDKLLTSCKSNI

SEQ ID NO: 6827 - DNA, 882 bp, Unknown
  Obtained from environmental sample
  misc_feature (1)..(882): n is a, c, g, or t
atgccaaaacaatttgtaaaattatttgaagacaaatcactatttcaacttacagttgaaagaaactctaaagtttgtgatagtcaatttattgtttcaaatgccgagcaatacttcctagctttagatcaactagaagagatgataaaagaagatacaaaggtatcttttggctcatcaaatctaaataaaacaaacaataaatatctccttgaaccaataggaagaaatacagctcctgcaattgcattagcttgtatggatttagcttatgatgagatagtattagtaactccatcagatcatcttatcaaagatgaaacagaatatgaaaaagttttaagtaaagcaaaagagtttacaaaggatgataagttagtaacgtttggaataagacctacatttcctgaaactggatttgggtatattcaggcagtgcctgaaaatgatgaatgtttgattttaaatgttgaattatttaaagaaaaaccaaattttgaaacggctactcaatatatagaagaaaattcaaaattaagcattcaaaatttaccattaaaatactactggaactctggaatgtttatgtttaaagcaggtgtttttctagaagaacttcaaaaatactctcctgaaatatttgatacttctaaacaagctttagaaaatgcctcaaaagagggaatgattagaataaaatatgaagatatgataaatatccctgaagatagtatagactatgcagtgatggaaaaatcttcaaaaagtaaagtgataccatcagatataaattggtcagatgtcggaagttttgattctctttatgatgagttaccaaagatgaaaatggtaatactcaaaaataaaatcatattagtataa

SEQ ID NO: 6828 - protein, 293 aa, Unknown
  Obtained from environmental sample
  DOMAIN (1)...(284): Nucleotidyl transferase
  misc_feature (1)..(293): Xaa is any amino acid
MPKQFVKLFEDKSLFQLTVERNSKVCDSQFIVSNAEQYFLALDQLEEMIKEDTKVSFGSSNLNKTNNKYLLEPIGRNTAPAIALACMDLAYDEIVLVTPSDHLIKDETEYEKVLSKAKEFTKDDKLVTFGIRPTFPETGFGYIQAVPENDECLILNVELFKEKPNFETATQYIEENSKLSIQNLPLKYYWNSGMFMFKAGVFLEELQKYSPEIFDTSKQALENASKEGMIRIKYEDMINIPEDSIDYAVMEKSSKSKVIPSDINWSDVGSFDSLYDELPKMKMVILKNKIILV

SEQ ID NO: 6829 - DNA, 549 bp, Unknown
  Obtained from environmental sample
  misc_feature (1)..(549): n is a, c, g, or t
atggccggggttaccaagagaaatgctccaactgaaaatgacaagttaactgatgagcaagcttctgaaatcaataacgactccacagaggaattaacaaaagaagaacagttagaaatagaagtaaaagaagctaaagataaatatcttagactttattctgattttgaaaatttcagaaaaagaacccaaaaagaaaaactagacttatacaaaaccgctggagaagaaataataaccgccttgctaccagttattgatgactttgaaagagcttcaaaagcaatgcaagatgcaaaagatattgattctgtaaaagatggaatgaaattaattcatgaaaaaatgctttccattttaaaacaaaaaggattagaaccaaccaaatcacaagttggagaaccttttaatgttgaattccacgaagccataacccaaataccagcacctagcaaaaaagaaatagggaaagtaattgatgaagttgaaaaaggctattccctaaatggaaaagtgataagatatacaaaagttgttgtagggcaataa

SEQ ID NO: 6830 - protein, 182 aa, Unknown
  Obtained from environmental sample
  DOMAIN (9)...(182): GrpE
  misc_feature (1)..(182): Xaa is any amino acid
MAGVTKRNAPTENDKLTDEQASEINNDSTEELTKEEQLEIEVKEAKDKYLRLYSDFENFRKRTQKEKLDLYKTAGEEIITALLPVIDDFERASKAMQDAKDIDSVKDGMKLIHEKMLSILKQKGLEPTKSQVGEPFNVEFHEAITQIPAPSKKEIGKVIDEVEKGYSLNGKVIRYTKVVVGQ

SEQ ID NO: 6831 - DNA, 798 bp, Unknown
  Obtained from environmental sample
  misc_feature (1)..(798): n is a, c, g, or t
atgccaacaataaaataccaacaatgtacaagatgtgttatggattccagcgatcctgaaatcatatttaatgaaactggctattgtaaccattgcataaattattttgaaaacctttctaaacttacttaccaagacaaaactagcgataatcaattagctgaaattgtagaaaaaattaaagcttctggaaaaaatcaaacttacgactgtgtaataggggttagtggcggaatagacagtagttatgtggcttatcttacaaaaaaattaggcttaaaaccacttgccgttcacatggataatggatggaatagtgaattagcggtgagcaacattgaaaaattactcaaccaactaaacattgacctttatacccatgtattagattgggaagagtttaaagacttgcagctttcttttttaaaagcatccattcctgaaatagaaactccaactgacatggctataccagcagttttacatcaagttgctgccaagcataatataaaatacattataagtggaggtaattacgctaccgaaggtattttaccaaaaagttggcattatgataggaaagatgttactttcttaaaagccattcaacaacaatttggtactaaaaaattaaaaaccttccctacttttggttatcaaaaagaaatttattacaagtttgtaaaaggaattcgatttgtttatatgctaaattatgttcctttttcaaaaaaagatgctgttgaattgcttgaaaaaggagttgaattggaaatattatggaggaaaacattttga

SEQ ID NO: 6832 - protein, 265 aa, Unknown
  Obtained from environmental sample
  DOMAIN (70)...(237): PP-loop family
  misc_feature (1)..(265): Xaa is any amino acid
MPTIKYQQCTRCVMDSSDPEIIFNETGYCNHCINYFENLSKLTYQDKTSDNQLAEIVEKIKASGKNQTYDCVIGVSGGIDSSYVAYLTKKLGLKPLAVHMDNGWNSELAVSNIEKLLNQLNIDLYTHVLDWEEFKDLQLSFLKASIPEIETPTDMAIPAVLHQVAAKHNIKYIISGGNYATEGILPKSWHYDRKDVTFLKAIQQQFGTKKLKTFPTFGYQKEIYYKFVKGIRFVYMLNYVPFSKKDAVELLEKGVELEILWRKTF

SEQ ID NO: 6833 - DNA, 651 bp, Unknown
  Obtained from environmental sample
  misc_feature (1)..(651): n is a, c, g, or t
ttgttactcaaaatagtgctgctggcctattcacgcgggataactggtagtcgtcggatcgaggcactttgtcgtgaaaatgtactattcatggcgctatcagcagacacacagccacattttaccaccatcgcagatttcatctcctcctccgcagatgagatatccaagctcttcaagcaggtgttgttgatttgtgatgagatggggcttataggcaaagagatgttcgccatcgatggttgcaagctaccgtcaaacgcttcaaaggaatggagcggcacccacgagaacctgaaaaagaagagtaagaagatagatcgagctgtctgctatatgctcactaagcatcgcaacgaagaccagcaaggcgaaaatgatatttcaatccgcaaacgcgaagagaaacaaataaaaacgctgctcaaagctagtgacaaaatcgaccgctttctaaaagaaaataacaaacgcctcggctattccggcaatgaagtccagagcaatatcaccgacaatgaaagtgccaagatgaaaaccagcaatggtgtaattcaaggctactgtggagtgtcagcagttgacaacaaacatcaagtcgttgtcagtgccgaagcctacggacaagggcaagaacatggactgctttga

SEQ ID NO: 6834 - protein, 216 aa, Unknown
  Obtained from environmental sample
  misc_feature (1)..(216): Xaa is any amino acid
MLLKIVLLAYSRGITGSRRIEALCRENVLFMALSADTQPHFTTIADFISSSADEISKLFKQVLLICDEMGLIGKEMFAIDGCKLPSNASKEWSGTHENLKKKSKKIDRAVCYMLTKHRNEDQQGENDISIRKREEKQIKTLLKASDKIDRFLKENNKRLGYSGNEVQSNITDNESAKMKTSNGVIQGYCGVSAVDNKHQVVVSAEAYGQGQEHGLL

SEQ ID NO: 6835 - DNA, 483 bp, Unknown
  Obtained from environmental sample
  misc_feature (1)..(483): n is a, c, g, or t
atgaaaaaaagtatcaaaaaacaattttatatgattgtgggattcacactgaccatcagcagtatattgattgtctacatgctggttctcaataatcgtatgaatacccagatcaataccgtcatccatacagtaaatattgaacggaaaatttcaagagcagtagaagagttccagaatgcccgttatcttcaaagcagaattttatcatcaggccttatcaaagccgaagatgagatagcctatgataataaactgactgccatgcaagagattctgaattcaattcatactgtcttttatggaaacagttcagattcgccggtgatggaagtgatgcaacaaattgatgagaacaaacaacttttcgctgaactggtacagctgaagacaaaagatcgcatcaatcgaacgaaaattgatgaaacctataaaaatattgtttccagcgtactgatgcaatcggatctcgagccaatctga

SEQ ID NO: 6836 - protein, 160 aa, Unknown
  Obtained from environmental sample
  misc_feature (1)..(160): Xaa is any amino acid
MKKSIKKQFYMIVGFTLTISSILIVYMLVLNNRMNTQINTVIHTVNIERKISRAVEEFQNARYLQSRILSSGLIKAEDEIAYDNKLTAMQEILNSIHTVFYGNSSDSPVMEVMQQIDENKQLFAELVQLKTKDRINRTKIDETYKNIVSSVLMQSDLEPI

SEQ ID NO: 6837 - DNA, 708 bp, Unknown
  Obtained from environmental sample
  misc_feature (1)..(708): n is a, c, g, or t
ttgcttttcggatttagggtttggaaaaggagtaattggccatcccccaaattttgtgttcaccccgaaaaatggtttaaaaacaaaacaagaattggtggcactaaaaacctaaaaatggaaaaaataaaggcccttaaccctgatttaattattgccaataaagaagaaaataccgaagcagaaatcaaaacgcttcaacaactttttccggtttggactagcgatatttccacactacaagacagcctgaacatgattaatgccattggcgaaatcactgagaaaaatgaaaatgccagcaggataatcaacactatcgaacaagaatttgaaaaataccaacctcattttactaaacgccatactgctctatacttaatttggaaaaaaccttatatgtgtgtagggaatgacaccattattcatcatttaatggattactgtggttttaataatgtgttgagcgataaaacgcgctaccctgaaattagtgaaaccgagatacaacaactacaacctgaatttattttactttcatcagagccttatccttttaaagaaaaacatatagaggagttacaaaacttatgtcctaacagcaaaattatgctagtggatggcgaaatgttttcgtggtatggctctcgtttacaatatgctccaacctatttttttaacttatggaaagtttacaatttaaaataa

SEQ ID NO: 6838 - protein, 235 aa, Unknown
  Obtained from environmental sample
  DOMAIN (3)...(210): Periplasmic binding protein
  misc_feature (1)..(235): Xaa is any amino acid
MLFGFRVWKRSNWPSPKFCVHPEKWFKNKTRIGGTKNLKMEKIKALNPDLIIANKEENTEAEIKTLQQLFPVWTSDISTLQDSLNMINAIGEITEKNENASRIINTIEQEFEKYQPHFTKRHTALYLIWKKPYMCVGNDTIIHHLMDYCGFNNVLSDKTRYPEISETEIQQLQPEFILLSSEPYPFKEKHIEELQNLCPNSKIMLVDGEMFSWYGSRLQYAPTYFFNLWKVYNLK

SEQ ID NO: 6839 - DNA, 456 bp, Unknown
  Obtained from environmental sample
  misc_feature (1)..(456): n is a, c, g, or t
atgaagcaaatttttacaactttcatattcttgatatttgcaaatattatatgttcccaaaatctgaatctaaaactattagaccaattaaccaaagttccttttgcagatattgacgatgtaatgattaatggctacggtttcgaaaccatggaaacgaaaaaaaatagaaggaaggaatacattaaattttatccagatgctaccgataaatctatttttattgctgtcttagacatggatgattatccaagaaatgctttagaaattacaatagcaaaaggttattctctacgaaaaattaaagatgatttagtagaagatggatatttatataaaggttcaaatgatattgatttatccgtttatcaaaaaaatgaagttcattatttaattgcaaatgaaccaaatgatattggtgcaactcaaatattagttctcttcgaaaaaaattaa

SEQ ID NO: 6840 - protein, 151 aa, Unknown
  Obtained from environmental sample
  misc_feature (1)..(151): Xaa is any amino acid
MKQIFTTFIFLIFANIICSQNLNLKLLDQLTKVPFADIDDVMINGYGFETMETKKNRRKEYIKFYPDATDKSIFIAVLDMDDYPRNALEITIAKGYSLRKIKDDLVEDGYLYKGSNDIDLSVYQKNEVHYLIANEPNDIGATQILVLFEKN

SEQ ID NO: 6841 - DNA, 330 bp, Unknown
  Obtained from environmental sample
  misc_feature (1)..(330): n is a, c, g, or t
atgatggctttgcagttagataggtatataagaaaaccagacgtttataaaactgcttgggtagggcttgatgaaattactgactttataaatttcgttgaaaaaaatgtaatcccaaatttagatatgaaactaaagaaaaaatcatctgaatttatctttaacgctaaagaagtaacattatcatattttgttcatgaaaaaaggagaagattgacaattaaactaaataattatgatgatagtgagattaaaaactacaccttttggacagaaacacaagtagataaattaccaaaccttcttgaggttcttaaattaatcaaataa

SEQ ID NO: 6842 - protein, 109 aa, Unknown
  Obtained from environmental sample
  misc_feature (1)..(109): Xaa is any amino acid
MMALQLDRYIRKPDVYKTAWVGLDEITDFINFVEKNVIPNLDMKLKKKSSEFIFNAKEVTLSYFVHEKRRRLTIKLNNYDDSEIKNYTFWTETQVDKLPNLLEVLKLIK

SEQ ID NO: 6843 - DNA, 630 bp, Unknown
  Obtained from environmental sample
  misc_feature (1)..(630): n is a, c, g, or t
atgtttggcacctttagtgagaatgaaatttatcccgatagtctcagagtagccaatttttacaattcccctgctaaaattacatttggtgaaagtaagatttttacctttgacgcgaaacctgaaattcttgagccagatgatactggatttatctattttccattgaaagagattgataaacaaatgattgggaatatcttagaaaaagtaaatttattctttgaaataggtgaatcccaacagagagggacattggttctagaaggtaagataacagaagatttttcctctttaacagaagaagatattcgtaatgctccccagatagcatctaagaaacagatgatgaattttggtaaagccaaggtgaatcaaaagaatgagtttacggttgatattgagaatcagggaaatagtgacttattaatccgttccatattccccagttatggctttaaattggaatcctttcccaattcaattaaacctggagaatttggcaaaattatactatccttaacgccaaaatataagttaaaaaaattcacgggtaatgtgaaaatatattccaactcaccagccgattcagagctatttatcaggctttacggcaggattattaagtag

SEQ ID NO: 6844 - protein, 209 aa, Unknown
  Obtained from environmental sample
  misc_feature (1)..(209): Xaa is any amino acid
MFGTFSENEIYPDSLRVANFYNSPAKITFGESKIFTFDAKPEILEPDDTGFIYFPLKEIDKQMIGNILEKVNLFFEIGESQQRGTLVLEGKITEDFSSLTEEDIRNAPQIASKKQMMNFGKAKVNQKNEFTVDIENQGNSDLLIRSIFPSYGFKLESFPNSIKPGEFGKIILSLTPKYKLKKFTGNVKIYSNSPADSELFIRLYGRIIK

SEQ ID NO: 6845 - DNA, 330 bp, Unknown
  Obtained from environmental sample
  misc_feature (1)..(330): n is a, c, g, or t
atggtcagatcggctcggaacaaacgaatattttgtttttccaataatgagacaggttttaatcctcttgaaattgatttattaaacccagaaaacacaaatttgattagtctgaatttatttagagtacaaaaattttcaaaagtagaatatggcaattcggcagtaagagaatatgtttttaggcatcatttagaatcattactattagataaaaaagaactaaaagaatatacttttaaaaatattaagagtttacaatggcttgtaggaataataaaagtcagaattaatcatcttggtaaaattgttcatattggagaatattga

SEQ ID NO: 6846 - protein, 109 aa, Unknown
  Obtained from environmental sample
  misc_feature (1)..(109): Xaa is any amino acid
MVRSARNKRIFCFSNNETGFNPLEIDLLNPENTNLISLNLFRVQKFSKVEYGNSAVREYVFRHHLESLLLDKKELKEYTFKNIKSLQWLVGIIKVRINHLGKIVHIGEY

SEQ ID NO: 6847 - DNA, 516 bp, Unknown
  Obtained from environmental sample
  misc_feature (1)..(516): n is a, c, g, or t
atggattttgaaaaaggatatattttccacgtttacaatcaaggaaataatcggcgaaaaatattttttaatagagagaattatttgttttttctgaaaaagataaaaactcacatctcgccttatgccgatattctggcgtggtgcttgatgccaaatcattttcatttgatggttttggttcgggaggtggagcttctggttgcagcaaatagccaaggggtgactcaaagtcaccctttgactaaacgcgtcctaaatgattcgattggcattatgctccgttcttatactcgtgctattaacaaacaaaataaaacatcgggcagcttattcagagaaaatacaaaagcggaatgtgtaaattgtccaaatggtttagctccttcgtttataacaaaaaatggaattacagaattactagttaataatatagaaaaagaatatccccatgtattattcaattatatccaccaaaatcccggaaaaagcaaatttagtccaaaaaagcagtga

SEQ ID NO: 6848 - protein, 171 aa, Unknown
  Obtained from environmental sample
  DOMAIN (47)...(116): Protein of unknown function (DUF1568)
  misc_feature (1)..(171): Xaa is any amino acid
MDFEKGYIFHVYNQGNNRRKIFFNRENYLFFLKKIKTHISPYADILAWCLMPNHFHLMVLVREVELLVAANSQGVTQSHPLTKRVLNDSIGIMLRSYTRAINKQNKTSGSLFRENTKAECVNCPNGLAPSFITKNGITELLVNNIEKEYPHVLFNYIHQNPGKSKFSPKKQ

SEQ ID NO: 6849 - DNA, 708 bp, Unknown
  Obtained from environmental sample
  misc_feature (1)..(708): n is a, c, g, or t
gtgtcttgggatgagatggctggttttgaaaaagataatttagagttatcttttgaggtttttaaaaaagcatgtacaaaatctaaaagatatgaaaacttaaaagatatttgcaccaaagcaaatcagtttgaaatagaaaactcaaaagagttttttactcaatattttacaccttataaattgttggatgaaaataatgcacaagagggattaataacgggatactatgaacccattttaaatggtagtctagtaaaaactgatgtttataaatatccaatatataaaacacctaaggatattttaatagttgattttggtagtttatatcctgaacttaaagattatagacttagaggaaaagttattggaaataaagttgtcccttatgatagtagagaagagattgagtcacaaaataatcttgaagctatttgttatgttgatgataaggtagatctattttttttacatattcaagggagtggaaaagtaaaacttcaagatggaactattatcaatgttggatatgcccaacaaaatggaagaggatactatccagtaggtagaaaacttatagaagagggctatatatcacaagaggatatgtccctacaagctattagaaagtggcttaaggaaaatccaactcaaatagatgagactttaaacctaatgaaattatatattttttacacaaagtga

SEQ ID NO: 6850 - protein, 235 aa, Unknown
  Obtained from environmental sample
  DOMAIN (47)...(234): MltA N-terminal domain
  misc_feature (1)..(235): Xaa is any amino acid
MSWDEMAGFEKDNLELSFEVFKKACTKSKRYENLKDICTKANQFEIENSKEFFTQYFTPYKLLDENNAQEGLITGYYEPILNGSLVKTDVYKYPIYKTPKDILIVDFGSLYPELKDYRLRGKVIGNKVVPYDSREEIESQNNLEAICYVDDKVDLFFLHIQGSGKVKLQDGTIINVGYAQQNGRGYYPVGRKLIEEGYISQEDMSLQAIRKWLKENPTQIDETLNLMKLYIFYTK

SEQ ID NO: 6851 - DNA, 927 bp, Unknown
  Obtained from environmental sample
  misc_feature (1)..(927): n is a, c, g, or t
gtggatttcctccactggggagaaaaagtagttcactctgatgatgaagaatttgacatctatgcagttggactaggagttttaggagttattactaaaatcactttacagtgtgaaccatcttttaaccttgaggtagttgagaaaaagatgagtttagaagagattgagaaaaattttgatcaacttctaaacaacaatgagcattttaaatttatttgggttccccatacggatcattttatggtttggcttggcaatagaacaaaccaagaagaatcaactaattttaaaaagtttatgacatattttgtatatggtgtattaatcaataatctatttcatgagtttttactcttttttgcctcttttaaaagaagtttagtacttacgatcaataaacttatgtcaaaaattcttattccaaaagagaacaaatccatatggaaatcatactggggatttttcttaccacacctactcaaacaagatgtagtagaatacgcttttgatatcaaagatacttttaaagtttttcgtgaagttatagatactattaaagagaaaaacatctatgtagatacccctattgaggtacgatttgtgcaaaaagacagttactggttaagtcctacaggagatactaacagttgttggatagggacaaaaatacattttccttatgggaaaaaaccagagtatttagaatatttcactacaatagatgagatacttctaanatacaacggacgaccacattggggaaaacatttcgaatatctncagaggattttaaaaaagcataccctaagtgggatgatttttggaactttgcagacaaagaagatcccaataaaattttacaaaatgattttgttaaaggntacgaaaaagagaatatccctaaatttaaaatatgctnattaa

SEQ ID NO: 6852 - protein, 308 aa, Unknown
  Obtained from environmental sample
  DOMAIN (34)...(303): D-arabinono-1,4-lactone oxidase
  misc_feature (1)..(308): Xaa is any amino acid
MDFLHWGEKVVHSDDEEFDIYAVGLGVLGVITKITLQCEPSFNLEVVEKKMSLEEIEKNFDQLLNNNEHFKFIWVPHTDHFMVWLGNRTNQEESTNFKKFMTYFVYGVLINNLFHEFLLFFASFKRSLVLTINKLMSKILIPKENKSIWKSYWGFFLPHLLKQDVVEYAFDIKDTFKVFREVIDTIKEKNIYVDTPIEVRFVQKDSYWLSPTGDTNSCWIGTKIHFPYGKKPEYLEYFTTIDEILLXYNGRPHWGKHFEYLQRILKKHTLSGMIFGTLQTKKIPIKFYKMILLKXTKKRISLNLKYAX

SEQ ID NO: 6853 - DNA, 441 bp, Unknown
  Obtained from environmental sample
  misc_feature (1)..(441): n is a, c, g, or t
atgtatgaaacaataatgaaagaaatatctgaacaatcacatgaaaaattaaatattaaagatgaaacaaaagaacaaatatttaaacatttgaaaagtagactagaaaaattatctttagatgattttttgaatgatgataaaattgaaacttacatcttttcaagatatgataagtttgatttaactttggataaaatatcaaatgaactaaataattatatttttaaaacaaatgataatttttttacaattataaataaatttaaatattggcaaatgtcatctgacggtaacagatggcttatttcaaaagatagtttaaataagttaattagcttagaagatgttgaaaagtacataagtgatttaaagcaaaaagatttaagtgataatcaaaaagaattattaaaaatatggaatagaaaaataagggggtaa

SEQ ID NO: 6854 - protein, 146 aa, Unknown
  Obtained from environmental sample
  misc_feature (1)..(146): Xaa is any amino acid
MYETIMKEISEQSHEKLNIKDETKEQIFKHLKSRLEKLSLDDFLNDDKIETYIFSRYDKFDLTLDKISNELNNYIFKTNDNFFTIINKFKYWQMSSDGNRWLISKDSLNKLISLEDVEKYISDLKQKDLSDNQKELLKIWNRKIRG

SEQ ID NO: 6855 - DNA, 435 bp, Unknown
  Obtained from environmental sample
  misc_feature (1)..(435): n is a, c, g, or t
atgcaaaaactaaataagctaacgctaaaacaaagagaagaactttttagacaacttcgtatatcaattacacatcactcaaatgcaatggaaggaactacattatcatttggagaaacaaaagagttacttgaattagggcatacagcaggacataagccactgggtgaacaacttgtaatattaggctttgcaaaagcttatgatgtaattattcgtgaagctacaaatccacataatattattgatagcaattttattaaagatattcatgcaattatgtttgaagatgcttttaaagttgcacctgaatatgtctctaaaccagttggggcatatagattagatgaaagatatataaaaggtgtagatataaaattatcagcccctcatatgatttcaaaagatattgaaaatttattgtatagaaattaa

SEQ ID NO: 6856 - protein, 144 aa, Unknown
  Obtained from environmental sample
  misc_feature (1)..(144): Xaa is any amino acid
MQKLNKLTLKQREELFRQLRISITHHSNAMEGTTLSFGETKELLELGHTAGHKPLGEQLVILGFAKAYDVIIREATNPHNIIDSNFIKDIHAIMFEDAFKVAPEYVSKPVGAYRLDERYIKGVDIKLSAPHMISKDIENLLYRN

SEQ ID NO: 6857 - DNA, 903 bp, Unknown
  Obtained from environmental sample
  misc_feature (1)..(903): n is a, c, g, or t
ttgatgcaaaaacaaagtgtaggaaatttaatcttacaatatacagcaatgaccatatatcaaaatgagtccgccttaaatgcaattaagataatggaaacaaaacatatagactcacttcttattgtagatgatgaacaaaaccctattggtatttttaccacaaaagattttcttacaattattagcaataactctaatttaaaactccctataaaagagtatatgagtacccctttggaaacagtaccaactaatattacaattgcagaagcgataaaatttattcaagagaaacatttcaaaagaattgttataacagatattaaaggaaaagtttctggtgttataacacaaactgaacttttacggttactgaataataaatggatagagataattagacaaagaggaacagaactttcaataataaataaaaaacttatagaaagaaccgcttctttggaagaaaaagcttcaacagactttttaacaagattgtataacagaagaaaatttgattcattgattgaatatgaacttaaacaaatacaaagatatcacgataaagatttgtgtttaatagttctagatatagatggttttaaatatataaatgatacttatggacatgatattggtgatataattcttaaagatcttgcaaaaataatcaaactttcaataagagatagtgatatcgcttgtagatggggtggagaagagtttgctatctctttatcacatactaatctaagcgattctttaatagttgcgcagaaaattccacaaactaaagaatcctatgtatttactgaagaggtaaaaataactttgctcttttggagtaacacaactaccctcccctggaaactaaagttgagcttttttaaaaaagcctga

SEQ ID NO: 6858 - protein, 300 aa, Unknown
  Obtained from environmental sample
  DOMAIN (10)...(63): CBS domain
  misc_feature (1)..(300): Xaa is any amino acid
MMQKQSVGNLILQYTAMTIYQNESALNAIKIMETKHIDSLLIVDDEQNPIGIFTTKDFLTIISNNSNLKLPIKEYMSTPLETVPTNITIAEAIKFIQEKHFKRIVITDIKGKVSGVITQTELLRLLNNKWIEIIRQRGTELSIINKKLIERTASLEEKASTDFLTRLYNRRKFDSLIEYELKQIQRYHDKDLCLIVLDIDGFKYINDTYGHDIGDIILKDLAKIIKLSIRDSDIACRWGGEEFAISLSHTNLSDSLIVAQKIPQTKESYVFTEEVKITLLFWSNTTTLPWKLKLSFFKKA

SEQ ID NO: 6859 - DNA, 375 bp, Unknown
  Obtained from environmental sample
  misc_feature (1)..(375): n is a, c, g, or t
gtggattattctccccaaaattttccccaagatggaaaagtaaaaaaaggaggatataggttgatagctgggatttggaaattaaaaaagaatattgatttgttaaaaaatattgataaaaatgggatatattcaataggttttaaagctgagatggataaagaaagtgcgctacaaaatgaaaaaagtatgcttctcaataaaaatgttgatggagtttgtttaaatattttagatgagactaatcagtttggaagtgatacaaactctatagatcttataacaaaaaacaatattataaaactaactacagcatctaaattagaagtttcaataactcttttagaaagtttaaaaggtgaatttagtgaataa

SEQ ID NO: 6860 - protein, 124 aa, Unknown
  Obtained from environmental sample
  misc_feature (1)..(124): Xaa is any amino acid
MDYSPQNFPQDGKVKKGGYRLIAGIWKLKKNIDLLKNIDKNGIYSIGFKAEMDKESALQNEKSMLLNKNVDGVCLNILDETNQFGSDTNSIDLITKNNIIKLTTASKLEVSITLLESLKGEFSE

SEQ ID NO: 6861 - DNA, 861 bp, Unknown
  Obtained from environmental sample
  misc_feature (1)..(861): n is a, c, g, or t
ttgagctttccaccatattacgaaaaaacaatggttgcagaagaaccggatattaatcatttgtttgatttaaaagggaaattagatgaaaaacaaatattctggcaatcagaaatagatgcttttgctaatatttattttaagtctcgagagaaatttgaaacaaaagaccaatctttcttatattcatatattgaccctgcaattgatagatttaacgcaattgaaactgaagatgaaaaagaagaatttaaaaagagtttaagaacttggacaaatctttatgcttttttgtcccagataatgccatttaaagaaccagaatttgaaaagttttatgcttatgcaaaactgcttcaaacaaagttgcctaaaaaagaattgtcagacagtttacagctttcagacgaaatagcaatggaatattacagattgcaaaaaatcaaagagggtgctattcatttaatcaatgggatagatggcgaattagatggagtaagtgaagcaggaataaaacggtcgaaagaagaaaaagcaaaactttcagagattattgaagttttaaatgatagattcggaactgagtttgaagaagccgataaattattttttgagcaaatagaaacagagttagttcaagatgaaaaattacaatcacaagctaaagcaaataaaattgatacgttcaaatatgcttttgaagaaatgtttttgaagaaacttgttgaaagaatggatcagaatccagaaatatttgataaaataattgaaaataattcttttggtaatttagtcaaagacttaatgctcaaaaaagtatatgataaaattaatgatgattcttcttttactacngtataa

SEQ ID NO: 6862 - protein, 286 aa, Unknown
  Obtained from environmental sample
  misc_feature (1)..(286): Xaa is any amino acid
MSFPPYYEKTMVAEEPDINHLFDLKGKLDEKQIFWQSEIDAFANIYFKSREKFETKDQSFLYSYIDPAIDRFNAIETEDEKEEFKKSLRTWTNLYAFLSQIMPFKEPEFEKFYAYAKLLQTKLPKKELSDSLQLSDEIAMEYYRLQKIKEGAIHLINGIDGELDGVSEAGIKRSKEEKAKLSEIIEVLNDRFGTEFEEADKLFFEQIETELVQDEKLQSQAKANKIDTFKYAFEEMFLKKLVERMDQNPEIFDKIIENNSFGNLVKDLMLKKVYDKINDDSSFTTV

SEQ ID NO: 6863 - DNA, 333 bp, Unknown
  Obtained from environmental sample
  misc_feature (1)..(333): n is a, c, g, or t
ttgaagctaatcaatgaaaaacaaaacggagcatttattcatttgttggataatacaaatagaggaacattgtgcatacccaatgaaacagaaacagaaaaaggaacaggcgtttttaataaactttataaatctttcgtagattatagttctcattggaaaggagacaaatatattgaggtagtaataatgtctntgaaccaaaaaacactaatccatcgaaaaataaatacagatgatttagagaacttaaaatcaatattttttgtagagattggttgtggaaatattaaggaaataatatccaaggattggaatgttgaaacggtataa

SEQ ID NO: 6864 - protein, 110 aa, Unknown
  Obtained from environmental sample
  misc_feature (1)..(110): Xaa is any amino acid
MKLINEKQNGAFIHLLDNTNRGTLCIPNETETEKGTGVFNKLYKSFVDYSSHWKGDKYIEVVIMSXNQKTLIHRKINTDDLENLKSIFFVEIGCGNIKEIISKDWNVETV

SEQ ID NO: 6865 - DNA, 999 bp, Unknown
  Obtained from environmental sample
  misc_feature (1)..(999): n is a, c, g, or t
atggctcagttgtcttcgnatgaaattatactgaaatccgccagaccggttacgcttgacaatcttgaattgcgtgttccgttcaggagtgaagcagccacctatattaccggcatggggaagcgcggcagttaccgcacagaaaacatttactggaaatggggaaagatgaatttgaccaatcaggtatggattggagatgtaaaagccggaatgcaattaaagcttcaggaagacaaagatatatggactttgtggggcaattctgtcaggcccaacgcctggcacaataagggacgcggaggttgcactatcaaagaacagggtaataccgtgatggtgaacgcttactgcggggtcaccaaagtcgctccgggtaagcccgttttgctgaggtttcgcctgcttgttacaccatttaagaaaattaatccagcacattggaattggcgaacaagccatttcagccgtaccgccggaacaaaaatcaggaatatttttcacagtcaatatatgattccgtacataaattatccgtttacacatccagagcgaatgcgcaagaatttcgcacataaaaaatattccaattataacgctgaacttatttatccgcttaataaaaaattctctttggagaacggcgcgattcacataaaaaccgttgtcaatttcaattcatgggatcggaaaccccgtgatgaccgttacaatcactctttggcacatataactttgagcaaagacgcacaactcggtatcttttggagcacggacgatattggtgtccgcacctacttcaagcggcgtattaatggcaagtggcaagtacctctgttgctctccagaaaaaaaatgaatgtaactcctggtgatgatctcagcgtgagcgtgagctggggaaaaaacttcagcttgtatgttaatggcaaaatggccgccagcaaaccctggcgtcagcatattgggggaatgaaactggatgctccgtctctcaaa

SEQ ID NO: 6866 - protein, 333 aa, Unknown
  Obtained from environmental sample
  misc_feature (1)..(333): Xaa is any amino acid
MAQLSSXEIILKSARPVTLDNLELRVPFRSEAATYITGMGKRGSYRTENIYWKWGKMNLTNQVWIGDVKAGMQLKLQEDKDIWTLWGNSVRPNAWHNKGRGGCTIKEQGNTVMVNAYCGVTKVAPGKPVLLRFRLLVTPFKKINPAHWNWRTSHFSRTAGTKIRNIFHSQYMIPYINYPFTHPERMRKNFAHKKYSNYNAELIYPLNKKFSLENGAIHIKTVVNFNSWDRKPRDDRYNHSLAHITLSKDAQLGIFWSTDDIGVRTYFKRRINGKWQVPLLLSRKKMNVTPGDDLSVSVSWGKNFSLYVNGKMAASKPWRQHIGGMKLDAPSLK

SEQ ID NO: 6867 - DNA, 354 bp, Unknown
  Obtained from environmental sample
  misc_feature (1)..(354): n is a, c, g, or t
atgaaaacagaagttataaatgatgtaatagaaaatagtaaaagtaaatttgaaatttctgatatagagatgatgttaaatgatgataatcttttaaaaaaatatgaggatgcttatcctgatgaattatatataataatcctctcatctatcactcatgaacaatatgatagtaatgaatatgcaaaaaaactttttaaaaaaattatatttcaccataaaaatttgaatactcttttaaaaagagatgtaggattagttgtagcttctttagattatttgacaaatatagttaacattttagaagaaccaaaaatcatagaagaagacaaaagtatatattccgagccataa

SEQ ID NO: 6868 - protein, 117 aa, Unknown
  Obtained from environmental sample
  misc_feature (1)..(117): Xaa is any amino acid
MKTEVINDVIENSKSKFEISDIEMMLNDDNLLKKYEDAYPDELYIIILSSITHEQYDSNEYAKKLFKKIIFHHKNLNTLLKRDVGLVVASLDYLTNIVNILEEPKIIEEDKSIYSEP

SEQ ID NO: 6869 - DNA, 546 bp, Unknown
  Obtained from environmental sample
  misc_feature (1)..(546): n is a, c, g, or t
atgttagtaatacttatgcccaacaactggtttcgttttaaacaattcaccattcaacaggagcatgccgccatgaaagtgggtaccgacggtgttctacttggagcatggtcttcggttcccggacccggtagtaaagtgctggatattgggaccggcaccgggttgatcgcacttatgattgctcagcgaaccagggatgtaggggtcgatgccctggagatagacccatcctctgccatgcaggcaaaagagaattttcaagactcaagctggaacaaacgactaaactgtattcactcttcctaccaggattatgcgatccaatgcaaagacaagtatgacctgattatctgtaatccgccttttttcactgcgtcttttaaaacaaaatcgaaagaaaaaaatctcgcaagggacgatgacagccttaacctgaaggatattttcagagactccgtttcactgatgaaaaaaaagggctcaaatcagtctgatcatttcgggcccataaggaggcattgggcatctgaacctggcccttga

SEQ ID NO: 6870 - protein, 181 aa, Unknown
  Obtained from environmental sample
  misc_feature (1)..(181): Xaa is any amino acid
MLVILMPNNWFRFKQFTIQQEHAAMKVGTDGVLLGAWSSVPGPGSKVLDIGTGTGLIALMIAQRTRDVGVDALEIDPSSAMQAKENFQDSSWNKRLNCIHSSYQDYAIQCKDKYDLIICNPPFFTASFKTKSKEKNLARDDDSLNLKDIFRDSVSLMKKKGSNQSDHFGPIRRHWASEPGP

SEQ ID NO: 6871 - DNA, 618 bp, Unknown
  Obtained from environmental sample
  misc_feature (1)..(618): n is a, c, g, or t
ttggatgcacaccgattttttttaattgataaagataaaatgtcaaaatccttaggtaatttcttcacattaaaagacttaatcaagaaaggttatgatcctcttgcaatacgttatgtattaattgcagctcattatagacaacaattaaattttagtgaagaaattataaaatcagctaaaaactcaattgataaaattaataatttcattttagaattaaaagatatttctgaggataaagactcaaaaaaagtagataagttaattactcaaactaaaaataattttacaaaagcgctagataatgatttgtcaatgtctgaagcattagcttcgttatatgaattcataaaatctatttacaaattaaagatctccaaaagtgaagccaaaaaagtaatatcattattaaaagaatttaatttagtcttaggtgtaatgaactttaatgaatcaaaagtcccaaaagaaattttaggtttagctaaaaaaagagatctagcaagaaaaaacaaagactgggcactttcagataaaataagagaccaaataaaagaaaaaggttttgaagtccttgattcaaaagaagaaagtaaaataagaaaattaaattga

SEQ ID NO: 6872 - protein, 205 aa, Unknown
  Obtained from environmental sample
  misc_feature (1)..(205): Xaa is any amino acid
MDAHRFFLIDKDKMSKSLGNFFTLKDLIKKGYDPLAIRYVLIAAHYRQQLNFSEEIIKSAKNSIDKINNFILELKDISEDKDSKKVDKLITQTKNNFTKALDNDLSMSEALASLYEFIKSIYKLKISKSEAKKVISLLKEFNLVLGVMNFNESKVPKEILGLAKKRDLARKNKDWALSDKIRDQIKEKGFEVLDSKEESKIRKLN

SEQ ID NO: 6873 - DNA, 681 bp, Unknown
  Obtained from environmental sample
  misc_feature (1)..(681): n is a, c, g, or t
ttgcgagaattcacagataaatatgtaaaagcatttgaggaggatatgattacattaaacattgaaaaaactacttttacccctcgtgcaacagatcacattaaagaaattgtagatttaattctaaaattaaaaaagaacaatttaacttatgaatccaatggctcaacttattttaaaatttcaaatttctctgattatggaaaactagcaagactagactttcaaaacttaattgataatgctcaaggtagacttgattcagatgaatatgaaaaagaaaatgccagagactttgttttatggaaagcctggactaaaagtgataatgactgctattgggaaacagagctaggtaaaggaaggccaggatggcatattgaatgctctgcaatggcaatgaaatacttaggagaagaaattgatattcacacaggtggaatggacttagtattcccacatcatacaaatgaaatagcacaaagtgaaggagccactaaaaaaaggtttgttaatttttggatgcacaacgaatttttattaattgataaagataaaatgtcaaaatccttaggtaatttcttcacattaaaagacttaatcaagaaagggtatgaccctcttgcaatacgttatgtattaaattgccggctcattatagaacaaccaattaaattttaa

SEQ ID NO: 6874 - protein, 226 aa, Unknown
  Obtained from environmental sample
  DOMAIN (1)...(224): tRNA synthetases class I (C) catalytic domain
  misc_feature (1)..(226): Xaa is any amino acid
MREFTDKYVKAFEEDMITLNIEKTTFTPRATDHIKEIVDLILKLKKNNLTYESNGSTYFKISNFSDYGKLARLDFQNLIDNAQGRLDSDEYEKENARDFVLWKAWTKSDNDCYWETELGKGRPGWHIECSAMAMKYLGEEIDIHTGGMDLVFPHHTNEIAQSEGATKKRFVNFWMHNEFLLIDKDKMSKSLGNFFTLKDLIKKGYDPLAIRYVLNCRLIIEQPIKF

SEQ ID NO: 6875 - DNA, 801 bp, Unknown
  Obtained from environmental sample
  misc_feature (1)..(801): n is a, c, g, or t
gtgggtggtttaaagttctatgaaagagctgaaatcaaagatttaatagcatattttagagttattacaaatgcaaatgacaacttctctataaaaagaattatcaataagccaaaaagaggtattgggaaaacaacaatagataaactagaactagagtcgcacgataaggcaaaatctatctttagtattataaaagagtacactcctgaggagctaggggtgattgttgggaagaaaaatagccgaacacttaaagtatttatggcatcagtggaagatttacaagatgttctttctgaagctaaaatgcgatttattgatctttttgaagaaacttttgattttaaatcaacctatgcaaaagtgatagatgcagatgatagactagcaaatatagatgagttttatggatatttgcgagacttttttatccaaaatgtagagttaaacttagaagactttttaaatgaaatctcacttgaaagtgctgctgatacaatcaatgatgagtatatctcattaatgagtatccatgcaagtaaaggtttagagtttaaacatgtatttatcgttggacttgaagagggattttttccaatagttggagatggaagtgatatagaagaggagagacgacttggatatgttgctataactcgagcaaaagacaatcttacatttgagtttgtacatagtagattttacaaagggcgacgaacaccacttacaaaaagtaggtttttacagaatcagatcttatcaaagggagtcttactattgaaaaaaacatgcctataa

SEQ ID NO: 6876 - protein, 266 aa, Unknown
  Obtained from environmental sample
  misc_feature (1)..(266): Xaa is any amino acid
MGGLKFYERAEIKDLIAYFRVITNANDNFSIKRIINKPKRGIGKTTIDKLELESHDKAKSIFSIIKEYTPEELGVIVGKKNSRTLKVFMASVEDLQDVLSEAKMRFIDLFEETFDFKSTYAKVIDADDRLANIDEFYGYLRDFFIQNVELNLEDFLNEISLESAADTINDEYISLMSIHASKGLEFKHVFIVGLEEGFFPIVGDGSDIEEERRLGYVAITRAKDNLTFEFVHSRFYKGRRTPLTKSRFLQNQILSKGVLLLKKTCL

SEQ ID NO: 6877 - DNA, 627 bp, Unknown
  Obtained from environmental sample
  misc_feature (1)..(627): n is a, c, g, or t
ttgatctttttgaaagaaacttttgattttaaatcaacctatgcaaaagtgatagatgcagatgatagactagcaaatatagatgagttttatggatatttgcgagacttttttatccaaaatgtagagttaaacttagaagactttttaaatgaaatctcacttgaaagtgctgctgatacaatcaatgatgagtatatctcattaatgagtatccatgcaagtaaaggtttagagtttaaacatgtatttatcgttggacttgaagagggattttttccaatagttggagatggaagtgatatagaagaggagagacgacttggatatgttgctataactcgagcaaaagacaatcttacattgagttttgtacatagtagattttacaaagggcgacgaacacaacttacaaaaagtaggtttttaacagaatcagatcttatcaaagggagtcttactattgaaaaaaacaatgcttataaaaaagatgacttagtaaagcataaaatttttggtatgggtagagttgagagtgtgcaaaaagctggaaaagatttgaaattgaagattaattttggtggaaatagacgagatatcttatcttcatttgtggagaagatatag

SEQ ID NO: 6878 - protein, 208 aa, Unknown
  Obtained from environmental sample
  misc_feature (1)..(208): Xaa is any amino acid
MIFLKETFDFKSTYAKVIDADDRLANIDEFYGYLRDFFIQNVELNLEDFLNEISLESAADTINDEYISLMSIHASKGLEFKHVFIVGLEEGFFPIVGDGSDIEEERRLGYVAITRAKDNLTLSFVHSRFYKGRRTQLTKSRFLTESDLIKGSLTIEKNNAYKKDDLVKHKIFGMGRVESVQKAGKDLKLKINFGGNRRDILSSFVEKI

SEQ ID NO: 6879 - DNA, 306 bp, Unknown
  Obtained from environmental sample
  misc_feature (1)..(306): n is a, c, g, or t
atgattagattaatagcagtacaacttctcttagtaacttttttgctaagtgaagatttagatataaaaaaacttcaaaatgagtttattaaaaatgtgattgaacttaatgtttataaaaaaagatattctcaatttcttgacaaaaagtgtcaaacagattatatctgtttgcaagaacagatacaaagactcaaaacttgggaaagtgttcaaaatgataatatactaaaaaaaactcttaaagaaaaaacttttaaaaaacacttttatgatanaagagtattggggaaaaaagttttttaa

SEQ ID NO: 6880 - protein, 101 aa, Unknown
  Obtained from environmental sample
  misc_feature (1)..(101): Xaa is any amino acid
MIRLIAVQLLLVTFLLSEDLDIKKLQNEFIKNVIELNVYKKRYSQFLDKKCQTDYICLQEQIQRLKTWESVQNDNILKKTLKEKTFKKHFYDXRVLGKKVF

SEQ ID NO: 6881 - DNA, 534 bp, Unknown
  Obtained from environmental sample
  misc_feature (1)..(534): n is a, c, g, or t
atgaatattcacgaatatcaggggaaacaaatcctcaaaagttttggtgttagaattcaggaaggtattgttgctgccacacctgatgaagccgttgaagctgcaaaagaattacaaaaacaaacaggaactagctggtgggttgtaaaggctcaaattcatgcaggcggtcgtggaaaaggtggtggagttaaactagccagaagccttgatgaaataaaagctttagctgaccaaattttgggtatgcaattggttacacatcanacagggcctgaagggaaacttgtgagtaaagtcttaattgcacaagatgtttattatcctggcgaaagtgaaacagacgagttctatatgggtgttttattaaaccgagaaacaggaagaaatatcatcatgtattctaccgaaggtggagttgatattgaaacggtacctgaaaacacccctcatctaattcataaagaaaaatttgacctaaagttggattacaacttttcaagcccgaaaaatcccattcaatccaagtcttaa

SEQ ID NO: 6882 - protein, 177 aa, Unknown
  Obtained from environmental sample
  misc_feature (1)..(177): Xaa is any amino acid
MNIHEYQGKQILKSFGVRIQEGIVAATPDEAVEAAKELQKQTGTSWWVVKAQIHAGGRGKGGGVKLARSLDEIKALADQILGMQLVTHXTGPEGKLVSKVLIAQDVYYPGESETDEFYMGVLLNRETGRNIIMYSTEGGVDIETVPENTPHLIHKEKFDLKLDYNFSSPKNPIQSKS

SEQ ID NO: 6883 - DNA, 669 bp, Unknown
  Obtained from environmental sample
  misc_feature (1)..(669): n is a, c, g, or t
atgggaaaaaaattgataatactttttgatttagacggaacacttattgattctacagaggcaattttagagacttttcaccactcttttaaggcacataattatccaaatccaaaggatgaggatatcacatctcttattggttatccacttgacgtgatgtatgaagaacttggtgtgagcaaagatgtagtgtgggattttgtgcatacatataaagagtattatagagtaatttctacaaaaagaactactcttttacttaacgcgaaagaagcggtgactaaggcaagtgagtttgcggtacttggtatagtaacaaccaaaacaggcaagtactcaagggtgctaatggaatatttcgagctaatgcattactttgaagttttaataggaagagaagatgtcgataaaccaaaaccggatgctcagcctatactaagagccttggaagttctagatgcagacaacaaagaaatttggatgataggggatacaaaacttgaccttatatcagcaaaaaatgcaggtgttaattctataggtgttttaagcggatatgataattgtgaaaccctaaaacaacatacaaacgttatatttagtgacgctcttgaagccgtgaattatctccaaaataggaaaaaagcacacatttcctttagttga

SEQ ID NO: 6884 - protein, 222 aa, Unknown
  Obtained from environmental sample
  DOMAIN (4)...(186): haloacid dehalogenase-like hydrolase
  misc_feature (1)..(222): Xaa is any amino acid
MGKKLIILFDLDGTLIDSTEAILETFHHSFKAHNYPNPKDEDITSLIGYPLDVMYEELGVSKDVVWDFVHTYKEYYRVISTKRTTLLLNAKEAVTKASEFAVLGIVTTKTGKYSRVLMEYFELMHYFEVLIGREDVDKPKPDAQPILRALEVLDADNKEIWMIGDTKLDLISAKNAGVNSIGVLSGYDNCETLKQHTNVIFSDALEAVNYLQNRKKAHISFS

SEQ ID NO: 6885 - DNA, 549 bp, Unknown
  Obtained from environmental sample
  misc_feature (1)..(549): n is a, c, g, or t
ttgaagatattaaagctgttttttttattatttatattgcccataactacgttacaagcagctgattttgagaaagtttcacttcagcttatctggaaatatcagtttgagtttgccggctttattgcagcaaaagagaagggtttttatgaagatgcaggattaaatgtagagttaaaagagtatgatccaaacatagatgttgtaggtgatgtcttaaatggcataagtaattatggaatctctaatacacctatatttataaaggataaaaaagttgttcctgccatactgcttgcaacatattttaagcagtctcctcttgttttagtagcttctaaagatataaaatcaccaaatgattttaaacataaaagaatcatgtcaaatattaatgatttagactcaggtactatagctctgctttttaatcattttgatattacaagtgaaaatgccacttttttagatccaacatttaatatagatacttttataaataaagaggtagatgttactacngcatttacatcaaatgagctattttaa

SEQ ID NO: 6886 - protein, 182 aa, Unknown
  Obtained from environmental sample
  SIGNAL (1)...(19)
  misc_feature (1)..(182): Xaa is any amino acid
MKILKLFFLLFILPITTLQAADFEKVSLQLIWKYQFEFAGFIAAKEKGFYEDAGLNVELKEYDPNIDVVGDVLNGISNYGISNTPIFIKDKKVVPAILLATYFKQSPLVLVASKDIKSPNDFKHKRIMSNINDLDSGTIALLFNHFDITSENATFLDPTFNIDTFINKEVDVTTAFTSNELF

SEQ ID NO: 6887 - DNA, 603 bp, Unknown
  Obtained from environmental sample
  misc_feature (1)..(603): n is a, c, g, or t
atgaaaataggtgtatcgtcttgtttacttgggaatcaatgtcgttatgatggagctggtagtaaatttgaatttgttgttgatgtactttcaaaatattttgaactaatcccttattgtccagaagagatggtgtttggaacacctagggaatctatccgacttgtagatatagatggagagataaaggttatctcaaataaaattcaaaaagatgtaactaatgagttaagtgctatatcaaaaacattggcacaaaaagcatttgatgacaagttatgtggatttatttttaaagcaaagtctccatcttgtggagtagaaagagttaaactatatcaaaacaatagtaacatgtgtgaaaaaaaagccacgggcttgtttgcacaagcagtacaagagaaacagccatttctaccaattgaagaagatggaagattgaatgacccttggttaaaagaaaattttttaatgcaagtatttgcctataaggatttaggggagtttttagattcaaatcctacatttaaaaatcttgtagagtttcatactagttataaatatcttatctacgcaaaatcccaggaatctttaaaaatttag

SEQ ID NO: 6888 - protein, 200 aa, Unknown
  Obtained from environmental sample
  DOMAIN (2)...(138): Protein of unknown function (DUF523)
  misc_feature (1)..(200): Xaa is any amino acid
MKIGVSSCLLGNQCRYDGAGSKFEFVVDVLSKYFELIPYCPEEMVFGTPRESIRLVDIDGEIKVISNKIQKDVTNELSAISKTLAQKAFDDKLCGFIFKAKSPSCGVERVKLYQNNSNMCEKKATGLFAQAVQEKQPFLPIEEDGRLNDPWLKENFLMQVFAYKDLGEFLDSNPTFKNLVEFHTSYKYLIYAKSQESLKI

SEQ ID NO: 6889 - DNA, 636 bp, Unknown
  Obtained from environmental sample
  misc_feature (1)..(636): n is a, c, g, or t
atgcatgacatctcggagattgtacatctaaatgacgaaatagaagagacgcaaaaagaagttgtctttaaaatgggtgccataggtgaaacaagatctaaagagacaggattacatgtaaaaagagttgcacaatactcataccttttagcaaagctctcaggtctaagtgaagaagaagctgtacttttaaaacaggcttctcctatgcatgatataggtaaagtcggtatctcagacagtatattaaataaaccaggaaaattaactacagaagagtttgatgtcatgaaaacacatgcacaaatagggtatgagatgctaaaagattcacaaagagacatattaagagcttctgccgaagtcgcatatactcatcatgagaagtacaacggtagtggttatccaagaggtttaaaaggtgaaaggatacctatatatgggcgtattaccgctatagcagatgtatttgatgctctagggcatgacagagtttataaaaaagcgtgggagctggataaaattttagatccttttaaagaggagagaggcaatcattttgattccaacttaggtgatctattttttaataatttaaataaatttttacagatcaaagatagccctgaaagatga

SEQ ID NO: 6890 - protein, 211 aa, Unknown
  Obtained from environmental sample
  DOMAIN (36)...(160): HD domain
  misc_feature (1)..(211): Xaa is any amino acid
MHDISEIVHLNDEIEETQKEVVFKMGAIGETRSKETGLHVKRVAQYSYLLAKLSGLSEEEAVLLKQASPMHDIGKVGISDSILNKPGKLTTEEFDVMKTHAQIGYEMLKDSQRDILRASAEVAYTHHEKYNGSGYPRGLKGERIPIYGRITAIADVFDALGHDRVYKKAWELDKILDPFKEERGNHFDSNLGDLFFNNLNKFLQIKDSPER

SEQ ID NO: 6891 - DNA, 363 bp, Unknown
  Obtained from environmental sample
  misc_feature (1)..(363): n is a, c, g, or t
ttggtctacaccactaactctgataatgcactcataaagtttaatgagacaaanctccaaagagtaatagataataccatcacaaatgcaattaaatatacatcctcgcacaagagtatatatgtctatctgaaaaaaactcctaaacatctatactttataatatccagccaatcttctcaaattgtagatacaaaaagaatctttgatgagtactatagagaaaaaacacaacagcagggttttggtttaggtcttaacttggtaaaatccatttgtgatgaggaaaatgtcgatatagagacactctcagatgatagtgagacgaagtttatctataggtttaggttgaaagagtcatga

SEQ ID NO: 6892 - protein, 120 aa, Unknown
  Obtained from environmental sample
  DOMAIN (14)...(118): Histidine kinase-, DNA gyrase B-, and HSP90-like ATPase
  misc_feature (1)..(120): Xaa is any amino acid
MVYTTNSDNALIKFNETXLQRVIDNTITNAIKYTSSHKSIYVYLKKTPKHLYFIISSQSSQIVDTKRIFDEYYREKTQQQGFGLGLNLVKSICDEENVDIETLSDDSETKFIYRFRLKES

SEQ ID NO: 6893 - DNA, 447 bp, Unknown
  Obtained from environmental sample
  misc_feature (1)..(447): n is a, c, g, or t
atgaaatatttaatcttaataatagcactatgtacactaactttttcagacaactacacaataattatagagactaaatttgaaagttctctttttgatattacagaagatttcgatggtgaaattagtgctgtaggtttttccaataacttctcatcacaccctgttagcagtgaaaagtactacgacccatttgaatatctatcttcactcaacagctcatcttctcagcagataagattaattaaactaaatgaagccggtgatcttactttagactataaagcaacccttcaaaactttaataaagctgtttcacttataaaaacacctgaaaatggctattttgttggtggctatatgcaaaatggtcagatgattttactgaagttagataccaacgcaaatccaatatttaaaaaaggtgtttggaacaaaaaattatga

SEQ ID NO: 6894 - protein, 148 aa, Unknown
  Obtained from environmental sample
  SIGNAL (1)...(16)
  misc_feature (1)..(148): Xaa is any amino acid
MKYLILIIALCTLTFSDNYTIIIETKFESSLFDITEDFDGEISAVGFSNNFSSHPVSSEKYYDPFEYLSSLNSSSSQQIRLIKLNEAGDLTLDYKATLQNFNKAVSLIKTPENGYFVGGYMQNGQMILLKLDTNANPIFKKGVWNKKL

SEQ ID NO: 6895 - DNA, 450 bp, Unknown
  Obtained from environmental sample
  misc_feature (1)..(450): n is a, c, g, or t
ttgggcatttccttaggcatgatattggtaaaagtggaatttcctgatagcatactcaaaaacctttcaggtctttcaactgaagagtgggaaattatgaagactcattcagagatcggatataatattttaaatacctcttcaagacctatattaaaagctgcggcaatagtctcatatgagcaccatgagaagtttgacggaagtggttatcctagagggctaaaaggttacgaaatacatatttttggacgtattactgctattgcagatgtatttgatgctttaggaactgaccgtgcatataaaacagcttgggaacttgataaaatactaaatcttctaaaagaggagagttcaaaacattttgatccaaagttaatagatatttttttaaaaaatttagataagtttttagagataagagatagatttaatgagattgattaa

SEQ ID NO: 6896 - protein, 149 aa, Unknown
  Obtained from environmental sample
  DOMAIN (2)...(96): HD domain
  misc_feature (1)..(149): Xaa is any amino acid
MGISLGMILVKVEFPDSILKNLSGLSTEEWEIMKTHSEIGYNILNTSSRPILKAAAIVSYEHHEKFDGSGYPRGLKGYEIHIFGRITAIADVFDALGTDRAYKTAWELDKILNLLKEESSKHFDPKLIDIFLKNLDKFLEIRDRFNEID

SEQ ID NO: 6897 - DNA, 705 bp, Unknown
  Obtained from environmental sample
  misc_feature (1)..(705): n is a, c, g, or t
gtggagagcacaataattccgataaaaaatgatatcggagatattgtagagtatttggggataagtcataatattactgaaataattgaacttcacaatgagctagaagatacccaaaaagagatagtgtataagatgggtgagataggtgagagcagatcaaaagagacaggtcatcatgtaaaaagagttgctcactactccagactactagcttcactacatggactgagtgaagatgagtgtagaacactatatttggcatctcctatgcatgatattggtaaagttggaattcctgatagcatactcaaaaaaccttcacgtcttacaactgaagagtgggaaattatgaagactcattcagagatcggatataatattttaaatacctcttcaagacctatattaaaagctgcggcaatagtctcatatgagcaccatgagaagtttgacggaagtggttatcctagagggctaaaaggttacgaaatacatatttttggacgtattactgctattgcagatgtatttgatgctttaggaactgaccgtgcatataaaacagcttgggaacttgataaaatactaaatcttctaaaagaggagagttcaaaacattttgatccaaagttaatagatatttttttaaaaaatttagataagtttttagagataagagatagatttaatgagattgattaa

SEQ ID NO: 6898 - protein, 234 aa, Unknown
  Obtained from environmental sample
  DOMAIN (57)...(181): HD domain
  misc_feature (1)..(234): Xaa is any amino acid
MESTIIPIKNDIGDIVEYLGISHNITEIIELHNELEDTQKEIVYKMGEIGESRSKETGHHVKRVAHYSRLLASLHGLSEDECRTLYLASPMHDIGKVGIPDSILKKPSRLTTEEWEIMKTHSEIGYNILNTSSRPILKAAAIVSYEHHEKFDGSGYPRGLKGYEIHIFGRITAIADVFDALGTDRAYKTAWELDKILNLLKEESSKHFDPKLIDIFLKNLDKFLEIRDRFNEID

SEQ ID NO: 6899 - DNA, 609 bp, Unknown
  Obtained from environmental sample
  misc_feature (1)..(609): n is a, c, g, or t
gtgcaacacacaaatatcagtacaaataaaaacagctttaatgaaccatctttagatgataaaataagagaaaaatttgtagattcacttatgaactattttaaaatagcagaagatgaatttttacgggcacacataaatgatcttataaaaaaaatcaaattagatgattatgaagaattttttagacgtctatctgatggaacgcatgaatttaaaaacgcatttgagagaatatctttagtagctacatctatgctaaaaaaagaggaacaaaaactatttacagatgtagatagaagagttaaaaaactatatgatgtttgctatgagctctatatgaaattttcaaatcatgatgatgctcagggtaaatttacaaacatctcatttatgagtatgaaactaggtgaatatggagaaaaaatttttgatcatcttgatgagatagtaattagaaaaataacaaaagagtggctatataaaaatgtaaattttgataaatcattatttattactcgtgcagagactgaatataaaaacactattttagaattaaatcaagaaaaagagccatccaaaatatctataatacaaatgccgtcttaa

SEQ ID NO: 6900 - protein, 202 aa, Unknown
  Obtained from environmental sample
  misc_feature (1)..(202): Xaa is any amino acid
MQHTNISTNKNSFNEPSLDDKIREKFVDSLMNYFKIAEDEFLRAHINDLIKKIKLDDYEEFFRRLSDGTHEFKNAFERISLVATSMLKKEEQKLFTDVDRRVKKLYDVCYELYMKFSNHDDAQGKFTNISFMSMKLGEYGEKIFDHLDEIVIRKITKEWLYKNVNFDKSLFITRAETEYKNTILELNQEKEPSKISIIQMPS

SEQ ID NO: 6901 - DNA, 720 bp, Unknown
  Obtained from environmental sample
  misc_feature (1)..(720): n is a, c, g, or t
ttgccacactcaatatttctaggagatatagaaacattaaatagtgatgaaaaaatagtacaaagtaattttcaatcagatgactacaatatcgcaccttgtccgaaatgtttagaactcatacaagacccaagtagtcaatactacttagatgaatctttgcaatgtacacactataataataaaggcaagatatatcaagactttacaatttattctccacactatagtaaaaatagtgccgtacttgttacaaacagtgaaaaaatagatgaactttttatacttactgatgatgagataaaagcgttatttagtatagaaaagccaactataaaggcaacaataaaagatgaaatactcaaaagtttagtagataaaaattatatctttattaaagccccctataacaatagaagtcttttagcttctactaatgctaaagagagtggtgttgactatcttttttttgaggatacaaatgatttaaaagttatcgttgtacaacaaaacaaaactatcatcaaagcctcaagaattgctaaagagttagaggctttaaatgatgatagtgtacttaatcgatttttaaatatctcaaaagaagccggttttaatcaaagtgctataggtgcaaatctaagcctagatggtatctcatttattgtatcaaatgaagttggtattaaagaggttattcaatttcaagaattaatttag

SEQ ID NO: 6902 - protein, 239 aa, Unknown
  Obtained from environmental sample
  misc_feature (1)..(239): Xaa is any amino acid
MPHSIFLGDIETLNSDEKIVQSNFQSDDYNIAPCPKCLELIQDPSSQYYLDESLQCTHYNNKGKIYQDFTIYSPHYSKNSAVLVTNSEKIDELFILTDDEIKALFSIEKPTIKATIKDEILKSLVDKNYIFIKAPYNNRSLLASTNAKESGVDYLFFEDTNDLKVIVVQQNKTIIKASRIAKELEALNDDSVLNRFLNISKEAGFNQSAIGANLSLDGISFIVSNEVGIKEVIQFQELI

SEQ ID NO: 6903 - DNA, 675 bp, Unknown
  Obtained from environmental sample
  misc_feature (1)..(675): n is a, c, g, or t
atgagtgaaaatattaaaaaagagtacggtgctagtaatattaaggtccttaaaggattagaagctgttagaaaaagaccaggtatgtatattggtgataccaatatgaatggtcttcatcatatggtttatgaagttgttgataactctatagatgaagcaatggctggattttgtgatactataaatgtaacaattacaaaagataatggtgtaatagtatctgataatgctagagggataccaacaggtatgcacgatggtgaaaaaataagtgctgcaactgttgcacttacagttttacatgctggtggtaaatttgataaagatacttatcaagtatctggtgggcttcatggggttggtgtttctgttgtaaatgcactttcaagtcaacttaaaatgactattcatagagaaggagagattcattatcaagaattttcaaaaggaaaatatgaaaaacctcttgaagttataggaactacaaaaaaaactggtactactattgaatttcaacctgatgatagtatatttgaagttattgaatattcttttgaaatattatcaaaaagatttagagaagtagcatatttgaatccatttattactattaatttagaagataaaagatcaaataaaaaagaaacttatcattttgaaggtggaatttaa

SEQ ID NO: 6904 - protein, 224 aa, Unknown
  Obtained from environmental sample
  DOMAIN (34)...(177): Histidine kinase-, DNA gyrase B-, and HSP90-like ATPase
  misc_feature (1)..(224): Xaa is any amino acid
MSENIKKEYGASNIKVLKGLEAVRKRPGMYIGDTNMNGLHHMVYEVVDNSIDEAMAGFCDTINVTITKDNGVIVSDNARGIPTGMHDGEKISAATVALTVLHAGGKFDKDTYQVSGGLHGVGVSVVNALSSQLKMTIHREGEIHYQEFSKGKYEKPLEVIGTTKKTGTTIEFQPDDSIFEVIEYSFEILSKRFREVAYLNPFITINLEDKRSNKKETYHFEGGI

SEQ ID NO: 6905 - DNA, 663 bp, Unknown
  Obtained from environmental sample
  misc_feature (1)..(663): n is a, c, g, or t
atggatagagaatcttttaaagagctttgggatacagtaaaatcaaaaaaaccatggacgggtattgtaacaaatatggcaaaagatgggagttcttatgttgttgatacaacagttattcctatacttgatgttgatggagatattgtagagtttattgcagtaagacatgacataacggatttcgagaaaacaaaagagcagttgcaaaatattaataaagtgatgaaaaataaagttgatgaactgtatagcgtaacatcttcactagaagaaaaagctacaagagatgaactcactggactttataatagagcaaaatttgaagagatattttcttatgagataaataaagcgaaacactataataatcaattgagtgttatactctttgatattgatcactttaaaaatatcaatgatacttatgggcatcaagctggagatgtgactttaaaagagctttcaagtttaattacaaaaaatattaaaacaagtgatatatttgctagatggggtggagaagagtttattatacttttaccagatacaaatagagatggagcaatgcaatttgcccaaaaattacgaaaaataataaaagaaaataaattttcagatatagaatatatgacagctagttttggagtagcacaaatttga

SEQ ID NO: 6906 - protein, 220 aa, Unknown
  Obtained from environmental sample
  DOMAIN (20)...(62): PAC motif
  misc_feature (1)..(220): Xaa is any amino acid
MDRESFKELWDTVKSKKPWTGIVTNMAKDGSSYVVDTTVIPILDVDGDIVEFIAVRHDITDFEKTKEQLQNINKVMKNKVDELYSVTSSLEEKATRDELTGLYNRAKFEEIFSYEINKAKHYNNQLSVILFDIDHFKNINDTYGHQAGDVTLKELSSLITKNIKTSDIFARWGGEEFIILLPDTNRDGAMQFAQKLRKIIKENKFSDIEYMTASFGVAQI

SEQ ID NO: 6907 - DNA, 552 bp, Unknown
  Obtained from environmental sample
  misc_feature (1)..(552): n is a, c, g, or t
atgaaaaataaccatatagcattaaaatatatgtttgccctttcatttattttggcagtgatgtttttatttagggtttattatgatgtgaaacattatgatagtatgttagaggtacaaaagcaaacattaacaaataatatggttagtttatttcaaagttctgagaaaagccttgttgataaatataatatacttaatacacatttcataaattcaaatttaatcgcacactattttaaaacaaaacagagagaaaaactttataaactattaaaaaaagattatgaagatataaaagagatagattcaaatttctttgtaatgcattttatagatactaataatattacagttttaagaatgcataagccagagtcttatgatgatgaccttacaataaaaagaccaattattgctagtgtaaataagatgttaaaaacacaaactggatttgaagttggaaaaaatggtatggtatatagagttacagttcctttcatacacaatggtgagcatcttggagtgttagaatttggtataaagccgtga

SEQ ID NO: 6908 - protein, 183 aa, Unknown
  Obtained from environmental sample
  misc_feature (1)..(183): Xaa is any amino acid
MKNNHIALKYMFALSFILAVMFLFRVYYDVKHYDSMLEVQKQTLTNNMVSLFQSSEKSLVDKYNILNTHFINSNLIAHYFKTKQREKLYKLLKKDYEDIKEIDSNFFVMHFIDTNNITVLRMHKPESYDDDLTIKRPIIASVNKMLKTQTGFEVGKNGMVYRVTVPFIHNGEHLGVLEFGIKP

SEQ ID NO: 6909 - DNA, 318 bp, Unknown
  Obtained from environmental sample
  misc_feature (1)..(318): n is a, c, g, or t
atgagttttgatgcacttttacagataaacagtgcaaacgaatctacaaaagcaggtgtaaatagcctcgaagcaaaagatatttttgagcagataagtgagagctgtccaaacatagacctaaaaggtgttatgagcataggcgctcacagtgatgataaaaaactgattagaaaaagttttgaagatactcacaaagtgtttgaatcactacaaggtgccactatctgttctatgggtatgagcggtgattttgaagaggctataagatgtggctcaaatatgattagactcggctctattatttttaataaatag

SEQ ID NO: 6910 - protein, 105 aa, Unknown
  Obtained from environmental sample
  misc_feature (1)..(105): Xaa is any amino acid
MSFDALLQINSANESTKAGVNSLEAKDIFEQISESCPNIDLKGVMSIGAHSDDKKLIRKSFEDTHKVFESLQGATICSMGMSGDFEEAIRCGSNMIRLGSIIFNK

SEQ ID NO: 6911 - DNA, 348 bp, Unknown
  Obtained from environmental sample
  misc_feature (1)..(348): n is a, c, g, or t
atgatacaaaaaagtatcaatatcaagagttcaaaagttttaatacttggagttacatttaaagaaaactgcccagatattagaaacagtagagttgttgatattatagaagaacttaatgattatgggtgtgaggtagagattagtgattattgggctgatgaagttgaggtaaaaaatgagtatggatttgacttgactaatcattctaagcttgatttggaatcttatgaagcagtagttgtagcggtagctcatgataaatataaaactttaaagtttgacaatgaaaaccaagttgtttttgatattaaatctattttagacaatagtgatggaagattataa

SEQ ID NO: 6912 - protein, 115 aa, Unknown
  Obtained from environmental sample
  DOMAIN (14)...(110): UDP-glucose/GDP-mannose dehydrogenase family, UDP binding domain
  misc_feature (1)..(115): Xaa is any amino acid
MIQKSINIKSSKVLILGVTFKENCPDIRNSRVVDIIEELNDYGCEVEISDYWADEVEVKNEYGFDLTNHSKLDLESYEAVVVAVAHDKYKTLKFDNENQVVFDIKSILDNSDGRL

SEQ ID NO: 6913 - DNA, 348 bp, Unknown
  Obtained from environmental sample
  misc_feature (1)..(348): n is a, c, g, or t
ttggcatgtagaaaagcaggcgactcaccacgtagtggtatgtgggaatttcggggagggactttggagcgatatgaaaatccacaacagtgtctcaagagagagttacaggaagagctatgtattgatgcgaaagtgggaaataaatttgcagataaaattcatcactaccccgacaaaagcatccaactcatcgctttcgagatcacaaattacaaaggcgaaatcaatcttatcagtcatcaggattcggcatgggtactacccggggagatggacaaatacaatatttcggaggcagatctcttcattgtggagtatttacaaaaaaaacacccggaagaataa

SEQ ID NO: 6914 - protein, 115 aa, Unknown
  Obtained from environmental sample
  misc_feature (1)..(115): Xaa is any amino acid
MACRKAGDSPRSGMWEFRGGTLERYENPQQCLKRELQEELCIDAKVGNKFADKIHHYPDKSIQLIAFEITNYKGEINLISHQDSAWVLPGEMDKYNISEADLFIVEYLQKKHPEE

SEQ ID NO: 6915 - DNA, 324 bp, Unknown
  Obtained from environmental sample
  misc_feature (1)..(324): n is a, c, g, or t
gtgaaagattttttaggtactgatataaagaaagagattaaaagcagtaagtttagcgctttaagaatttcaatagcatctcctgaagagattagagaaaaatctaatggagaggttaaaaaaccggaaacaataaactatagaactcataagccagaaacttatggtcttttttgtactaaaatttttggtccagttaaagactttacttgtttatgtggtagatataaaaaaaagaaatatcaaggtttaacttgtgaaaagtgtggtgttaaaatacatcatcatcagttagacgtaaatggatgggacacattgaattag

SEQ ID NO: 6916 - protein, 107 aa, Unknown
  Obtained from environmental sample
  misc_feature (1)..(107): Xaa is any amino acid
MKDFLGTDIKKEIKSSKFSALRISIASPEEIREKSNGEVKKPETINYRTHKPETYGLFCTKIFGPVKDFTCLCGRYKKKKYQGLTCEKCGVKIHHHQLDVNGWDTLN

SEQ ID NO: 6917 - DNA, 1032 bp, Unknown
  Obtained from environmental sample
  misc_feature (1)..(1032): n is a, c, g, or t
atggccngatatgtaactttttatgatttagaagaggggatatcaaaagcatatagaggtgatttttctcatcatgtgcagactgtactctcagatgaagctggaaaagtagctcatagacttaatgagctttctgaaatatttagatttaaaaagactatcgagttagatgcagataaagatacaatctataacagaatagcctttattcttcaagaacattttaagatagaaacttttgttttaatagaggcaattagctcatcaaaagagcgtgaagtagtttataagacaacaaaaaaagatcttcttcccgacgcactttttaaaagtgatgctctctcatgtcgtgcttttaggaccggtgatgaagttatctctacagattttcataaaatttgtgaaacttgtcataaagagggctgtgaatttatatgtctgccgtttgcaattagtgatgaacattcactaatcttacatatcagaagttcagatcagagtgagatagatagaataagagatcttattccggttattactaactattttgatcttgcagaaccagttctagagagtaagtatctgcttaaaaaattagaagagacttctcttcgtgatgcaccgacaggactatacaacaggagatatttagataaatttgttgagacctcattaaataataaagatctaaattttacggtacttatgatagatattgacttctttaaacaggtgaatgatcaacacggacatgatattggtgataaggttatcgtgggattagcagatgtgcttaaaactactataaaaggttctgatctgatatttagatttggaggagagggaggtctagntatcttatatgatatatccaaagataaatgcaataaaatagctcaaaatattcgtatcacattttctaaaaaagttttacaacatcaagtaaaaatatttcaaaaaccctccggtaagggtttatcgtcctttcctacggaagcaaacaacccttggcaaggcgattattttgccgac

SEQ ID NO: 6918 - protein, 344 aa, Unknown
  Obtained from environmental sample
  DOMAIN (199)...(335): GGDEF domain
  misc_feature (1)..(344): Xaa is any amino acid
MAXYVTFYDLEEGISKAYRGDFSHHVQTVLSDEAGKVAHRLNELSEIFRFKKTIELDADKDTIYNRIAFILQEHFKIETFVLIEAISSSKEREVVYKTTKKDLLPDALFKSDALSCRAFRTGDEVISTDFHKICETCHKEGCEFICLPFAISDEHSLILHIRSSDQSEIDRIRDLIPVITNYFDLAEPVLESKYLLKKLEETSLRDAPTGLYNRRYLDKFVETSLNNKDLNFTVLMIDIDFFKQVNDQHGHDIGDKVIVGLADVLKTTIKGSDLIFRFGGEGGLXILYDISKDKCNKIAQNIRITFSKKVLQHQVKIFQKPSGKGLSSFPTEANNPWQGDYFAD

SEQ ID NO: 6919 - DNA, 468 bp, Unknown
  Obtained from environmental sample
  misc_feature (1)..(468): n is a, c, g, or t
atgcccggtatttacgaatatataattcagatgcaggatagagcttccggtacgcttcaaaagcttaccggaagttggtttgaaaccatgcagaaacttaccggcttgcaggaaaaggtaaaggcgctcgaccgcaatacaaaagactttggcggttctatttacaacctgaaacaaaaggttgatatccttcagcaagaaagggatttgatagaccctagcaacctgaccaaaatacgccaatacaacaaagaaattaagggcttaactactaatattaaccggcttgaaaatacatcgggcagcaagtttagcaagtggacaaaagacgctgttagccagatacccggaggtagtttattaacaaatccaattgtaatggcaggggcaggtatagcagctgttggtaaattgggtgttagctggtctgacggtatggctaaaattaatacctcgagccgattctga

SEQ ID NO: 6920 - protein, 155 aa, Unknown
  Obtained from environmental sample
  misc_feature (1)..(155): Xaa is any amino acid
MPGIYEYIIQMQDRASGTLQKLTGSWFETMQKLTGLQEKVKALDRNTKDFGGSIYNLKQKVDILQQERDLIDPSNLTKIRQYNKEIKGLTTNINRLENTSGSKFSKWTKDAVSQIPGGSLLTNPIVMAGAGIAAVGKLGVSWSDGMAKINTSSRF

SEQ ID NO: 6921 - DNA, 597 bp, Unknown
  Obtained from environmental sample
  misc_feature (1)..(597): n is a, c, g, or t
atgagcattaaatacaaagtaattatctctcttactatatttgttttatctattttatcaactactgcttatatctatatccacttcacagaaaaaaatattaaagaactttccattgaacatttggaatctttgaatcacatagttcacgatagagtgttagagtatgttgcacaaagcgaagagaaacttatgctctttaacagtcgtgttcatttaaaagaagagatgcttaattatgaagctgatcacaatgcaaagagtctaaaaatcatagataaaataattcaaaaatcaaaaaattcttttctaaatgtaatcgatataatcatcttagataattacggcaaattaattatatccatgaacaaatctgatacattgaatgattactcaaaaaaacttatgttcaaaaaagcttctaaaaaaacatatgcccatctacagtttgaaaaagagagtaaaaccccatttttatgtatttcaggtccacttaccatggataataaatttataggtatcagcatattaaaaatagatcttgaatctttaaataacattttaactcanagagaaggtttagggggagagtggtga

SEQ ID NO: 6922 - protein, 198 aa, Unknown
  Obtained from environmental sample
  misc_feature (1)..(198): Xaa is any amino acid
MSIKYKVIISLTIFVLSILSTTAYIYIHFTEKNIKELSIEHLESLNHIVHDRVLEYVAQSEEKLMLFNSRVHLKEEMLNYEADHNAKSLKIIDKIIQKSKNSFLNVIDIIILDNYGKLIISMNKSDTLNDYSKKLMFKKASKKTYAHLQFEKESKTPFLCISGPLTMDNKFIGISILKIDLESLNNILTXREGLGGEW

SEQ ID NO: 6923 - DNA, 348 bp, Unknown
  Obtained from environmental sample
  misc_feature (1)..(348): n is a, c, g, or t
atgaaagatttatcagacagacttctcaggttttcgattgatacaataaaactccttcgaaaacttccaaatacagaggagtgtaaaataatcagacggcaactcataagatctgcaacatcatcgggggctaattacgaggagtcacaaggcggatcttcaaaggcagactttaaaaacaaagtctttatttcacttaaggaaatgcgcgaatcaaattactggctcaaggttataaatgggattagtgaagacacgaaaataaaagaagaaataaatatattaacaaaagagtccgaggagttgaaaaatatcctcggttcaatagtagccaaagtgaataagtaa

SEQ ID NO: 6924 - protein, 115 aa, Unknown
  Obtained from environmental sample
  misc_feature (1)..(115): Xaa is any amino acid
MKDLSDRLLRFSIDTIKLLRKLPNTEECKIIRRQLIRSATSSGANYEESQGGSSKADFKNKVFISLKEMRESNYWLKVINGISEDTKIKEEINILTKESEELKNILGSIVAKVNK

SEQ ID NO: 6925 - DNA, 354 bp, Unknown
  Obtained from environmental sample
  misc_feature (1)..(354): n is a, c, g, or t
ttgataaatattccagaagttgggtttaaaaagatagatgatcttttttattcaataaaagatttgaaagacggtaccattgctttcacattggtcaacccttatttaatgagaaattatgagtttgatcttcttagctccataaaagtacttcttgatattaacgagaattcagagataaatgtatataatgtcgcagttgtaaaagatcctctcgatgagtcttcaattaactttttagcaccacttgtatttaacaaagataatcaaactatggctcaagtagcacttaaagcaagagaatatccagagtatggatttgcagaaccattaaaattatatagtcaaaaatag

SEQ ID NO: 6926 - protein, 117 aa, Unknown
  Obtained from environmental sample
  DOMAIN (1)...(111): Uncharacterized BCR, COG1699
  misc_feature (1)..(117): Xaa is any amino acid
MINIPEVGFKKIDDLFYSIKDLKDGTIAFTLVNPYLMRNYEFDLLSSIKVLLDINENSEINVYNVAVVKDPLDESSINFLAPLVFNKDNQTMAQVALKAREYPEYGFAEPLKLYSQK

SEQ ID NO: 6927 - DNA, 879 bp, Unknown
  Obtained from environmental sample
  misc_feature (1)..(879): n is a, c, g, or t
gtgtatcagcacgattttacttttattataaaccccaagattaaagtgcttaccggcttggatttttaccagcgtgacggtatccatattgatgagcataaaagggcatttctttacaatcctgataacccggattttaatattggagaattggtgtatgacgggccacaggatacgacaatcgataattcgtaccagcgcagtcttgggttttttgtacaggcaaactattctttatccgaaaatttatctctaaacggcggcttgcgctggaataagtttaacacacaggctaatttaataaagactacttatgccggtccaccatacgattattccaaaaatatatacgaaacaaaaacaaaatcggacgaagcatttagtgggaattttggagtttcatacatgccaacagaatatctaaatattaccggaaatattgggcaggcatttcgtgtgccatccaccaaagagctatttatcaatactatgaccccgggcggcatgaacttttgcaatcccgacttagtacccgaaaaaagttttaacctcgattttggaataaaactaaaagataaaaaacagaatagtatttcgttcgcattgttcaggaataaaataaataatatgataattcttgattgggattcgttgcatgcaagtgggcagtttaataacaaaaatgccttagtttatggcggtgaaattacttttgattacaaagtattaaagcatctatttgttacccggaacatgagttatgtaaaaggatatgatgataaggacgaaatattgatggatatcccaccactacaaataaatttgaaaacaggatatttctttaacccccagaaattgtttgttgctttggtagggtaa

SEQ ID NO: 6928 - protein, 292 aa, Unknown
  Obtained from environmental sample
  misc_feature (1)..(292): Xaa is any amino acid
MYQHDFTFIINPKIKVLTGLDFYQRDGIHIDEHKRAFLYNPDNPDFNIGELVYDGPQDTTIDNSYQRSLGFFVQANYSLSENLSLNGGLRWNKFNTQANLIKTTYAGPPYDYSKNIYETKTKSDEAFSGNFGVSYMPTEYLNITGNIGQAFRVPSTKELFINTMTPGGMNFCNPDLVPEKSFNLDFGIKLKDKKQNSISFALFRNKINNMIILDWDSLHASGQFNNKNALVYGGEITFDYKVLKHLFVTRNMSYVKGYDDKDEILMDIPPLQINLKTGYFFNPQKLFVALVG

SEQ ID NO: 6929 - DNA, 870 bp, Unknown
  Obtained from environmental sample
  misc_feature (1)..(870): n is a, c, g, or t
atgatggctgagacgactaagcgccatatgcttgaagatattttatttattgccattgcttcggtgcttagcggcggtgaatcatggaatgatatggaacagtacgggaaaacgaaaatagaatggctcagtagctttctggagctccccaatggcatcccctctcatgatacatttaaccgcttttttgcggcattggatgccgaggagtttgaaaaatgttttctgttgtggataaaatcgatacataaaaaaacggagggggaaattatcagtattgacggcaaaacaatgcgaggttcccgtgaacagggctgtaaaaccgctactcacattgttagtgcatgggctgaccaaaacgagttggtattggggcaaatcaaggtagaagaaaagtcaaatgaaatatcggcaattccaaaactattagatgctcttttaattgatggatgtattgtgacgatcgatgctatgggatgccagagaaagattgcaaaaaagattataaaaaagaaagcagactatattcttgctgtcaaggagaaccaaaaggatttatatgaggacatcaaagacagttttaggattttacccgtaaatgacttttctgaagagcttgattatggacatggaagaattgagacaaggaaatgcagtgtaataacagatcttagcctagttgaaacagcaaaaaagtgggatgggctggtttcaattgttaggatagaacgagagcgatattttaaggccacagcgaaaatagaaaatgaaaccagctattatataagtaccttaaacagggctgatcatatcaaccacgnagtgcgaaaacattggggtatcgagaataaagtccattggggttcttga

SEQ ID NO: 6930 - protein, 289 aa, Unknown
  Obtained from environmental sample
  DOMAIN (90)...(249): Transposase DDE domain
  misc_feature (1)..(289): Xaa is any amino acid
MMAETTKRHMLEDILFIAIASVLSGGESWNDMEQYGKTKIEWLSSFLELPNGIPSHDTFNRFFAALDAEEFEKCFLLWIKSIHKKTEGEIISIDGKTMRGSREQGCKTATHIVSAWADQNELVLGQIKVEEKSNEISAIPKLLDALLIDGCIVTIDAMGCQRKIAKKIIKKKADYILAVKENQKDLYEDIKDSFRILPVNDFSEELDYGHGRIETRKCSVITDLSLVETAKKWDGLVSIVRIERERYFKATAKIENETSYYISTLNRADHINHXVRKHWGIENKVHWGS

SEQ ID NO: 6931 - DNA, 501 bp, Unknown
  Obtained from environmental sample
  misc_feature (1)..(501): n is a, c, g, or t
atgaacttagaaaattattataatatggtaaatgtagaagaaatttataaaaccattttagatttagaaggtccaaaatatcctttggataattgggatgaattagataacgcagcatcgtacatcatagataagttagaatcatataatataaaaacagaagtacaagagttttatttagaagggtttaagaaaccattcaaaaacatccttggatacataggtgaccaaagtaagcctgctgttttattaggatctcactatgatacggtaagattttcaccaggagcaaatgataatctttctgctgtagcagtatctcttgaaatggctagagtcttaagcggaattaaaaaccctccaacagtaataatagctgtcttcacattggaagaagggcatccttcaaaagcaaaaagaataagagaaacacttcaaaaagagggatactttgatgaaaaaggtagnattcacgacagccgaaatatatcatttcaataa

SEQ ID NO: 6932 - protein, 166 aa, Unknown
  Obtained from environmental sample
  DOMAIN (81)...(147): Peptidase family M20/M25/M40
  misc_feature (1)..(166): Xaa is any amino acid
MNLENYYNMVNVEEIYKTILDLEGPKYPLDNWDELDNAASYIIDKLESYNIKTEVQEFYLEGFKKPFKNILGYIGDQSKPAVLLGSHYDTVRFSPGANDNLSAVAVSLEMARVLSGIKNPPTVIIAVFTLEEGHPSKAKRIRETLQKEGYFDEKGXIHDSRNISFQ

SEQ ID NO: 6933 - DNA, 537 bp, Unknown
  Obtained from environmental sample
  misc_feature (1)..(537): n is a, c, g, or t
atgaagacatacattattgaaccgacaaaaaaagaggttgaagagattaatttaaatcagggtatgcagttaatatatactcttttaggatctattttagttgatgacaactacctgataaatgatcatgtaatatacagtgacgtacaaaaaacatactcaatagatgaagcttatatgataggtaatgagttgttttttggtaaaagtgtactatgtggcagtaaagatggagtcgatgctcctgctagcattaacagtgatgaactagaagctttaatatcatatgagataagtgatttttatagagatgtactttcacaattaaagagagatagtttgaatataaaagagacttttatgattacacataacaatcagagtattccattaaattacgagtgggttttatatacatttaacatagcagataatgcaacaaaagattattttttaaatggactgaagagtgaaaatgatcacaaaggttattttcaaaaaatggctgatttagcttttaaagcaggtaataaataa

SEQ ID NO: 6934 - protein, 178 aa, Unknown
  Obtained from environmental sample
  misc_feature (1)..(178): Xaa is any amino acid
MKTYIIEPTKKEVEEINLNQGMQLIYTLLGSILVDDNYLINDHVIYSDVQKTYSIDEAYMIGNELFFGKSVLCGSKDGVDAPASINSDELEALISYEISDFYRDVLSQLKRDSLNIKETFMITHNNQSIPLNYEWVLYTFNIADNATKDYFLNGLKSENDHKGYFQKMADLAFKAGNK

SEQ ID NO: 6935 - DNA, 420 bp, Unknown
  Obtained from environmental sample
  misc_feature (1)..(420): n is a, c, g, or t
ttggataataaaatgcaaaaaatagaagctttacaagtaaataaatacttaacacaaatggagatagaatctcaccttcttggtgtagaatacattattatggcagcaccttctgtaagagaaaatccaaaatatcccatacattttacaatctttttaaatacaaaagatatattaacccaagatattaaagatgcaatattagataaattttgtgagcagtataagataacatctattgtagatctattaagtgaattaagtgctgttgcatttgcgttaacatcaaatgagacaccaatgccacttcacctttttaaagaagatgatagaaaggtactgcaacacacatacatgcatgttatcgactttgagggcaactcttcagagttaaagagccaaaagctcgagccgatctga

SEQ ID NO: 6936 - protein, 139 aa, Unknown
  Obtained from environmental sample
  misc_feature (1)..(139): Xaa is any amino acid
MDNKMQKIEALQVNKYLTQMEIESHLLGVEYIIMAAPSVRENPKYPIHFTIFLNTKDILTQDIKDAILDKFCEQYKITSIVDLLSELSAVAFALTSNETPMPLHLFKEDDRKVLQHTYMHVIDFEGNSSELKSQKLEPI

SEQ ID NO: 6937 - DNA, 627 bp, Unknown
  Obtained from environmental sample
  misc_feature (1)..(627): n is a, c, g, or t
atgtatgatttttttaaaaaaaacaatattgaactataccgtgcatcatacacctggtatgacctagataaaaaaatattttctcatgcgtggacctttgacggtacatcctggatcagatgtcatgacattatacctgatgctatttttgacaaaacatcaacaaaaacaaaacataatcctatcatacaaaacatagctaccgttattccatttgtaaatcctttacatttttctgggttagtagataataaacgatttcttccccttctattttctcaacacacaaaaaatcaaatcaatatactagacaaaaaaaatatagcagacatacttttgttatctagtgatcacgtggtgataaaacccgcagaatcaagtggtggtaaagatgtcagtatcatgtcaaaacaagatgcatatgcatttatgttggaacaagcagatccatacagttggattgttcaagaatttattgattcaaaaaatggtatacctgaaataatggaaggaacccatgatctaagagtagtcatggtaaacaaaaaaatttcatatacatactacaggcaaccacccaaaaatagtttactcgctaatttagcattaggcggaataaaaaaataa

SEQ ID NO: 6938 - protein, 208 aa, Unknown
  Obtained from environmental sample
  misc_feature (1)..(208): Xaa is any amino acid
MYDFFKKNNIELYRASYTWYDLDKKIFSHAWTFDGTSWIRCHDIIPDAIFDKTSTKTKHNPIIQNIATVIPFVNPLHFSGLVDNKRFLPLLFSQHTKNQINILDKKNIADILLLSSDHVVIKPAESSGGKDVSIMSKQDAYAFMLEQADPYSWIVQEFIDSKNGIPEIMEGTHDLRVVMVNKKISYTYYRQPPKNSLLANLALGGIKK

SEQ ID NO: 6939 - DNA, 573 bp, Unknown
  Obtained from environmental sample
  misc_feature (1)..(573): n is a, c, g, or t
atgcaactatctaaccatatatattgtgatactctttttgaaaacatcacaatagaaaatcttctattaccaaatccatacaaagagtatccatatttgataatagagaattttttcacccctgaactactcaaagagatagtagactattcaaaacaaaaagatgatatagcacaagctaaaataaaagcaactgttgtagatggaattgtacaaccaaagctgaatataaaacaaagaaaaacaaatatcctcaaactcaacaaacagtttacaaatatctataatactcagtttcaaaactttcaaccacaaatagaggagtttttcaacacaccacttacttttagtacaaaagtacagatgcttcaatataagaaaggttttttctacaaaaagcatgctgatgattcaagtgaacttatagatgaaaataacaatactgtaggctttataaatgtagctagtcaaagaaaagttactactgttctttttgctacaacttgtcaagatgaaaatgatggctatagttttagtggtggagagttaatatttaactatctttacgaataa

SEQ ID NO: 6940 - protein, 190 aa, Unknown
  Obtained from environmental sample
  misc_feature (1)..(190): Xaa is any amino acid
MQLSNHIYCDTLFENITIENLLLPNPYKEYPYLIIENFFTPELLKEIVDYSKQKDDIAQAKIKATVVDGIVQPKLNIKQRKTNILKLNKQFTNIYNTQFQNFQPQIEEFFNTPLTFSTKVQMLQYKKGFFYKKHADDSSELIDENNNTVGFINVASQRKVTTVLFATTCQDENDGYSFSGGELIFNYLYE

SEQ ID NO: 6941 - DNA, 309 bp, Unknown
  Obtained from environmental sample
  misc_feature (1)..(309): n is a, c, g, or t
atgaatatgttacaaaaaaatgaaatcatatcaaaacttaaagagttaaagcctctctatgaagaagagggattgatacttcttggagtatttggaagttacgcaaaaaatacacaaaataattttagtgatattgatatagcctataaacttgattatgataagttttctctcaaatataaagatggtttttccaagattttaagaatagatgatataaaagaggaactagaaaaaacttttaaaacaaaaattgactttgtacctgataacaataaatcaatattaagtgatattgtctatgtctaa

SEQ ID NO: 6942 - protein, 102 aa, Unknown
  Obtained from environmental sample
  misc_feature (1)..(102): Xaa is any amino acid
MNMLQKNEIISKLKELKPLYEEEGLILLGVFGSYAKNTQNNFSDIDIAYKLDYDKFSLKYKDGFSKILRIDDIKEELEKTFKTKIDFVPDNNKSILSDIVYV

SEQ ID NO: 6943 - DNA, 423 bp, Unknown
  Obtained from environmental sample
  misc_feature (1)..(423): n is a, c, g, or t
atgaaaaaactaatattatccttatttattttgatctccctaaacgtatttgctcaaaaagctgagcaaaaaatgtattatataacagaaggtagtgatcagatgatgacccaagatgagtttgacgaggcaaaaacaaaaattcttgccaaaatgcaaaccattgcaaaagatgttaagctaaatgtcattattcaggatataaaaaccaccaaagattccatcatccatacttttaaacttgatttccaattatcgacaatagaagaggatgagaccgttgttaaaaaagaaaaaatttatacctatctcaataataaattacctgcacatcttctaaagaccatcaatgacgttgaactgaatcttaaagatttagaagggaaacctaccgtttctaaaatttggggttaccacctgtaa

SEQ ID NO: 6944 - protein, 140 aa, Unknown
  Obtained from environmental sample
  SIGNAL (1)...(18)
  misc_feature (1)..(140): Xaa is any amino acid
MKKLILSLFILISLNVFAQKAEQKMYYITEGSDQMMTQDEFDEAKTKILAKMQTIAKDVKLNVIIQDIKTTKDSIIHTFKLDFQLSTIEEDETVVKKEKIYTYLNNKLPAHLLKTINDVELNLKDLEGKPTVSKIWGYHL

SEQ ID NO: 6945 - DNA, 579 bp, Unknown
  Obtained from environmental sample
  misc_feature (1)..(579): n is a, c, g, or t
ttgaaatttattgcaaaagtgttactttataatttatctttagttccattatatgtattattcataataaaaaaatttgatatcactggttttgaatgtattattcaagaatatgaaaacttagaattatataaaattttgttattaaataatatctcatcacttgcattattattattaattttactttcaatttttgcatttaagaaattaattgctgaagtaaacagtggatacggtttacctgaaatatttaatgaaattaaaaatattgattttaatcatctgacattcattgcaacatacattttacctttactagcttttactctagacagtataagagacacggtatttatggttgtattattaatctttattggagcaatttacataaaaactaatttatattatttaagccctgtttttatactttttgacataagaatttacagtgcgattagtaaaaatggtgaagagaaaattttcatgactaaagaaaaaaatataaaaacaaaagagacaatgcactataccaagataggtgatatatattttgcaaaaaggactacgacatga

SEQ ID NO: 6946 - protein, 192 aa, Unknown
  Obtained from environmental sample
  misc_feature (1)..(192): Xaa is any amino acid
MKFIAKVLLYNLSLVPLYVLFIIKKFDITGFECIIQEYENLELYKILLLNNISSLALLLLILLSIFAFKKLIAEVNSGYGLPEIFNEIKNIDFNHLTFIATYILPLLAFTLDSIRDTVFMVVLLIFIGAIYIKTNLYYLSPVFILFDIRIYSAISKNGEEKIFMTKEKNIKTKETMHYTKIGDIYFAKRTTT

SEQ ID NO: 6947 - DNA, 696 bp, Unknown
  Obtained from environmental sample
  misc_feature (1)..(696): n is a, c, g, or t
atgacaaaagaaaacttactaataaaactcgatgtattgacacaatctgatattggctntgaactttattttttaatgaattctggaaatatagaaaaagtcgatttggatattggcttatcaaataatttacaatctgaatttgtaaagaaagtttgtgatacatttaatgaagttactagctttacacttcgcagcataaatgaattatcaagtgaacagcttgtttcagaatatttttattttgacagtgaaaatatgtatgaaaacttacagtttatacttgatttcgcaattaatcaagaagaaatttcttttagcttagatgattcaaaatataaaaatattaatgctattttaatgaaaatcggtacacatacagatcatataattttatataaacatcattatccgattaatgtcttaaaaaaacaatctactatcaatatttttaaagaaggtgatacatttaaagagatcattgatgatatttttaaaattgatataaattttgatctaatacttgttggagagcatttaataataaataagttaaaaactttagaaagcaagcttggttatactgatgtaatttatgcaaaagcatataaaaacattgaaataattaacacattaaacttcatagaaaatttagatattttgaaagaagctataaaacaaatagctggcaactga

SEQ ID NO: 6948 - protein, 231 aa, Unknown
  Obtained from environmental sample
  misc_feature (1)..(231): Xaa is any amino acid
MTKENLLIKLDVLTQSDIGXELYFLMNSGNIEKVDLDIGLSNNLQSEFVKKVCDTFNEVTSFTLRSINELSSEQLVSEYFYFDSENMYENLQFILDFAINQEEISFSLDDSKYKNINAILMKIGTHTDHIILYKHHYPINVLKKQSTINIFKEGDTFKEIIDDIFKIDINFDLILVGEHLIINKLKTLESKLGYTDVIYAKAYKNIEIINTLNFIENLDILKEAIKQIAGN

SEQ ID NO: 6949 - DNA, 870 bp, Unknown
  Obtained from environmental sample
  misc_feature (1)..(870): n is a, c, g, or t
atggttccaaaggttataaagaaaaaaactgaatttacctctataaagctttatactactattgtgcaatcacttcgttcatacagagatttaactattattgaaagaaataaaaagggtttacaaaaaattattttagcttctaagtctatttttcaactaagctctttagttatatttacggaaggtgtattagaacaacttgtatctattttaaatataggtgatagttttatccaatcaaaagcaagtgatgctttttttgccacattaaaaaatcaagattttgagttattagcaactgctggtaaatttaaagatagtgataacttcaatattattacaccgagatcacttgaatatcttaataaagcttatgaaaatgaaaaaagctattttgaagatgatatttatgtggggtattttaaagcacttaataataaaactatctttttgtatctagaaggatgtaaaaacctagaaaaatgtgacaaagattttcttaatattttttctaataacatatctattgcttttgaaaacatatgtcttaatgacgaagttatagaaacacaaaaagagatagtagaaagacttggtggagtgatagaaaatagatgtagttcaactgctgaacatgttcatagagtagcacaactctcttatttactagctaaagagtatggtcttagtgaagatgaagcatacaaactaaaacttgcaagtccaatgcatgatattggaaaaatcggtatcccagataaagttttactaaaaccagagcaactgacccctgatgaatttaaaatcattcaaaaacatgtagatataggtgaagagattttagcaaacacaaatagagaaatataa

SEQ ID NO: 6950 - protein, 289 aa, Unknown
  Obtained from environmental sample
  DOMAIN (210)...(289): HD domain
  misc_feature (1)..(289): Xaa is any amino acid
MVPKVIKKKTEFTSIKLYTTIVQSLRSYRDLTIIERNKKGLQKIILASKSIFQLSSLVIFTEGVLEQLVSILNIGDSFIQSKASDAFFATLKNQDFELLATAGKFKDSDNFNIITPRSLEYLNKAYENEKSYFEDDIYVGYFKALNNKTIFLYLEGCKNLEKCDKDFLNIFSNNISIAFENICLNDEVIETQKEIVERLGGVIENRCSSTAEHVHRVAQLSYLLAKEYGLSEDEAYKLKLASPMHDIGKIGIPDKVLLKPEQLTPDEFKIIQKHVDIGEEILANTNREI

SEQ ID NO: 6951 - DNA, 438 bp, Unknown
  Obtained from environmental sample
  misc_feature (1)..(438): n is a, c, g, or t
ttgttattcatgaagaaaattattttattattgatagtgactgcagttgtggtttcttgtggttcgaacaaaagtggcgaaaagaaagttgaaagtaatgtgattacggtaagtattttgcctcagcaaacttttgtggaaaaaattgccggcgatgattttgaaatcaacttgttaattccttcgggatcaagtccggcagcctatacgctgttgccttcgcagttaaaagatattgcccgatcggaggtttggttccgaattggatatattggtttcgagtattcgtggaaagataaaattgcccaggcaaataccaatatgaaagttgtaaatatttcggaagggatcgatttaattgccgataaaaaggagcaacatggcgaccatgttcatattgatggggttgatccgcatgtttggttgtcgccggtttaa

SEQ ID NO: 6952 - protein, 145 aa, Unknown
  Obtained from environmental sample
  SIGNAL (1)...(19)
  misc_feature (1)..(145): Xaa is any amino acid
MLFMKKIILLLIVTAVVVSCGSNKSGEKKVESNVITVSILPQQTFVEKIAGDDFEINLLIPSGSSPAAYTLLPSQLKDIARSEVWFRIGYIGFEYSWKDKIAQANTNMKVVNISEGIDLIADKKEQHGDHVHIDGVDPHVWLSPV

SEQ ID NO: 6953 - DNA, 492 bp, Unknown
  Obtained from environmental sample
  misc_feature (1)..(492): n is a, c, g, or t
ttgcaaaatagatatgatgaacttgattatntgataaaaaaacagatgaaaaaagagcttgtcgaggagattgagctatcttctttatttataagcagagtggatgtctttaaatcactctatccacaactaaagtttattttgaatttaaaagagtattgtgtcganatagacaaaattggtctctccaaagtgatagataatattttagataatgctattaaatattcatcactaaactctaaaatcagagtctctcttgtaggtggagttttagaaatttcagatgagggagttggcatggatgagatggagttgattcatatttttgatagatactatcaagccgatgataattcaagcggttttggaatagggatgaatatgataaaaagtttttgtgatcaaaatagaataggacttttggtaaagtctgaaaaaaacatggggacagatataaatttaaattttttaggggttaaacatggataa

SEQ ID NO: 6954 - protein, 163 aa, Unknown
  Obtained from environmental sample
  DOMAIN (57)...(160): Histidine kinase-, DNA gyrase B-, and HSP90-like ATPase
  misc_feature (1)..(163): Xaa is any amino acid
MQNRYDELDYXIKKQMKKELVEEIELSSLFISRVDVFKSLYPQLKFILNLKEYCVXIDKIGLSKVIDNILDNAIKYSSLNSKIRVSLVGGVLEISDEGVGMDEMELIHIFDRYYQADDNSSGFGIGMNMIKSFCDQNRIGLLVKSEKNMGTDINLNFLGVKHG

SEQ ID NO: 6955 - DNA, 303 bp, Unknown
  Obtained from environmental sample
  misc_feature (1)..(303): n is a, c, g, or t
ttgaaaagagcatatcctaatagagctgggtggaaacactggtcttgccggagatataataggaagattattcttctagaaaaaaaacaggaggtgggtgataaaattatattagaggatgggatacattatactatggtaaaacctactacatttaatggtattaatttaccatcaatagctattaaaaaacctgatggtagttttaaaattataagaacctatgataccaaagctataaagatagattgtcataaatatatttttataaaacatctatatatacagtataccctgctataa

SEQ ID NO: 6956 - protein, 100 aa, Unknown
  Obtained from environmental sample
  misc_feature (1)..(100): Xaa is any amino acid
MKRAYPNRAGWKHWSCRRYNRKIILLEKKQEVGDKIILEDGIHYTMVKPTTFNGINLPSIAIKKPDGSFKIIRTYDTKAIKIDCHKYIFIKHLYIQYTLL

SEQ ID NO: 6957 - DNA, 582 bp, Unknown
  Obtained from environmental sample
  misc_feature (1)..(582): n is a, c, g, or t
atggttattagtgtaatgaatttaaaaggtggcgttggtaaaagttctataagttacaatgttgctaaatatttcagccttaaaatggttacaaatgataaatacagtgcactaaataatataaaacagatgatcagcggaacacaaatcagtgtgaatgatggctcactttatgattttggcggttttgacgataagcgtattaatacaattatagaaaaatcagatgtaatcatagtgcctacactatactcacgtgctgatttgcaaaatactgtaattagtgtaaaaaaaataacagatataaataaaaatgctaaagtagttgttgtaataaacagagtcagaagcggtgatactaaaatacttgatgagacaaaagagatactgtttaagtatattaaacatggagtagaatattgcactataagagattctaaagctatgcttncatcgataaatagtaacagatcagtttttgacatacataaagagtcaggtttaaataggcatatttattctggaatagtaaatgatttttataatttagtaactattatagaaaattatattgataactag

SEQ ID NO: 6958 - protein, 193 aa, Unknown
  Obtained from environmental sample
  misc_feature (1)..(193): Xaa is any amino acid
MVISVMNLKGGVGKSSISYNVAKYFSLKMVTNDKYSALNNIKQMISGTQISVNDGSLYDFGGFDDKRINTIIEKSDVIIVPTLYSRADLQNTVISVKKITDINKNAKVVVVINRVRSGDTKILDETKEILFKYIKHGVEYCTIRDSKAMLXSINSNRSVFDIHKESGLNRHIYSGIVNDFYNLVTIIENYIDN

SEQ ID NO: 6959 - DNA, 789 bp, Unknown
  Obtained from environmental sample
  misc_feature (1)..(789): n is a, c, g, or t
ttgcatgtttatcaagaaggtctttatggaatattactgaatactgttccgaaaaccatctgtaaatcaatagaaaagcttgcgggtataaacaaaatatatgtaattgacctagcaaagaaggaacaattctttggaagtgttatcatatttttaaaaggaaaagcaggcgaacttaagaataagcaattaatagaaacatttgtgaaacaggcatcaattgcaattctaaaaaggcaagctgaagaagcgttgcgtctgagtgaagagcacttaaatctcgttatcaataccgctccctttggaatttgtacggttgactcgcttggcaactttttaacaacaaatcagacctatgaaataatgctaggttattcaaaagaagaactcaagagtctttccttttttgatgtgacgcatccagatgatcgcccaaaaaacaaagaactatttcactctatgttttctttaaaagaagcaggcttttccatggagaaaagatatcttcgtaaggatgagactgaaatagatgtagcggttcatgctgttggaattaaggatgatgcagggaacatcatgtttggcacagcattcatagatgacatcacggaaaaaaagaaattcgaaaattctatgcaaagagctcacaaattagaatctctcggagttcttgcaggtggcattgcccacgatttcaacaaccttctaagtggcatttttggctatacagaaatggcaattgcaaaaacaacagaagaggaagtctcaaactatctttcagaatcataa

SEQ ID NO: 6960 - protein, 262 aa, Unknown
  Obtained from environmental sample
  DOMAIN (163)...(205): PAC motif
  misc_feature (1)..(262): Xaa is any amino acid
MHVYQEGLYGILLNTVPKTICKSIEKLAGINKIYVIDLAKKEQFFGSVIIFLKGKAGELKNKQLIETFVKQASIAILKRQAEEALRLSEEHLNLVINTAPFGICTVDSLGNFLTTNQTYEIMLGYSKEELKSLSFFDVTHPDDRPKNKELFHSMFSLKEAGFSMEKRYLRKDETEIDVAVHAVGIKDDAGNIMFGTAFIDDITEKKKFENSMQRAHKLESLGVLAGGIAHDFNNLLSGIFGYTEMAIAKTTEEEVSNYLSES

SEQ ID NO: 6961 - DNA, 354 bp, Unknown
  Obtained from environmental sample
  misc_feature (1)..(354): n is a, c, g, or t
gtggagagtggtgcaaatgagaggtgtaaaaacattctaaacccgggctacagtgtaatcagacaatttgtaagagagctttacggttttgagacccaaataaaacatcaagcctgcacaaaagagattgcccaaatcgacgaaaaaaaaaatgatgtaacaaagcaagagagtcaatcaggctcaaccatagaagatatagaaactggtgtgggaagttgtgtcggcggttgtaaagaagatgaaaatgcgccgcgcgaagtaaacggaacggacattttaaatgaacctatggtcataaaagcgcgtgagctttttgaagctacaaagatcactattcagtctaaagtttaa

SEQ ID NO: 6962 - protein, 117 aa, Unknown
  Obtained from environmental sample
  misc_feature (1)..(117): Xaa is any amino acid
MESGANERCKNILNPGYSVIRQFVRELYGFETQIKHQACTKEIAQIDEKKNDVTKQESQSGSTIEDIETGVGSCVGGCKEDENAPREVNGTDILNEPMVIKARELFEATKITIQSKV

SEQ ID NO: 6963 - DNA, 417 bp, Unknown
  Obtained from environmental sample
  misc_feature (1)..(417): n is a, c, g, or t
atgaaaattatattgagattcggcaaaagtgtcacagcttataaaaacccgcggatgcgtaaattttcgtacaataaattacttcatgaaaattttatttcacagccagccgttttctttcaaaaaaaactattactaattacaggttttgtggataaagatttaagctatactatggactatgacttatggcttagattagcaaaagttagtaagccaacatttatcccactctatttagccggattcagaagacataatgattcgaaaagtgaaaataattacaaaaatcaatttcaagagcaatttatagttatgaaaaaaaactccgataatatatatcacaaaattctccataaagttttaaatttcaggacagtagctgcctataactgtttaaatatctttaaaaaataa

SEQ ID NO: 6964 - protein, 138 aa, Unknown
  Obtained from environmental sample
  misc_feature (1)..(138): Xaa is any amino acid
MKIILRFGKSVTAYKNPRMRKFSYNKLLHENFISQPAVFFQKKLLLITGFVDKDLSYTMDYDLWLRLAKVSKPTFIPLYLAGFRRHNDSKSENNYKNQFQEQFIVMKKNSDNIYHKILHKVLNFRTVAAYNCLNIFKK

SEQ ID NO: 6965 - DNA, 402 bp, Unknown
  Obtained from environmental sample
  misc_feature (1)..(402): n is a, c, g, or t
ttggcttttcaatcgaaagagagagctaaaatgactactaaaaatttaaatagagaagagtatattgactcagtagcaaatatagaacactcagcatcacaagagtttgctcaacaatcccttgattggtgggacagttactacagctggaacaaatttccatgtttgtgtttagaagatgatgaggggaaagatgttgttatcttttttatcatatctcaagaaataatcaatatcttactattcataatattctcacaccttttcattcaagatttaatgggtatgcaaaaaaaactattgacacttctttttaataagatactcttcatgccgaatttggaaaggtggaaaaaggatgggggttccctcatcactaaaggtttaaatgaaactagggaa

SEQ ID NO: 6966 - protein, 134 aa, Unknown
  Obtained from environmental sample
  misc_feature (1)..(134): Xaa is any amino acid
MAFQSKERAKMTTKNLNREEYIDSVANIEHSASQEFAQQSLDWWDSYYSWNKFPCLCLEDDEGKDVVIFFIISQEIINILLFIIFSHLFIQDLMGMQKKLLTLLFNKILFMPNLERWKKDGGSLITKGLNETRE

SEQ ID NO: 6967 - DNA, 717 bp, Unknown
  Obtained from environmental sample
  misc_feature (1)..(717): n is a, c, g, or t
atgactcaaaaaaattttaaaacggtttttacaatttattttatactctttggagtcattgtatctattttaggcggtgttattagttacaatatacaattaagaagtctaaaaaatgatttagatactaaagctaatgatgtaatgattactaaaaaattcactattttgaaagaaaaaattagagatattgataatatagtaaaaagtattagtaaaaatcctactatgaaaatttatctacaaacaaaagatcaacataaactttatgaacttaacaatatatttttatcaattgcagggattaatacaaaaatcatgcaacttcgttatatagataaaaatgggatggaggttgtaagagttgatagaacaaatgaacaagatgagccttttttagtaaaagactctcaactacaaaataaaaagaatagagattattttcaaagtgttgctcagatacaagaccaaaaaatatggcattctaaatttaatttaaatatagaacatgggaaaattgagattccttatcgaccaacactaagagttgcacaacctctttttaataaaaacaatgaatttaatggaataattatagtaaatatgttaacaacaaatttatttgattcaattcgtagttcatcagcttttgaacattttattattgataaaaatggaaactatataatgcatcctgatgactcgagccgattctga

SEQ ID NO: 6968 - protein, 238 aa, Unknown
  Obtained from environmental sample
  misc_feature (1)..(238): Xaa is any amino acid
MTQKNFKTVFTIYFILFGVIVSILGGVISYNIQLRSLKNDLDTKANDVMITKKFTILKEKIRDIDNIVKSISKNPTMKIYLQTKDQHKLYELNNIFLSIAGINTKIMQLRYIDKNGMEVVRVDRTNEQDEPFLVKDSQLQNKKNRDYFQSVAQIQDQKIWHSKFNLNIEHGKIEIPYRPTLRVAQPLFNKNNEFNGIIIVNMLTTNLFDSIRSSSAFEHFIIDKNGNYIMHPDDSSRF

SEQ ID NO: 6969 - DNA, 753 bp, Unknown
  Obtained from environmental sample
  misc_feature (1)..(753): n is a, c, g, or t
ttgtcgaaaaaactatttatagaaactttagggtgtgctatgaatgttcgagatacagaacatatcatagcagagctcaataaacatcaatcatactcacaaacgcaaaacttagaagatgccgatctcattattatcaatacttgttctgtaagagaaaaacctgttgcaaaactattttcagaacttggtgtatttaataaaaagaaaaaaactggtgcaaaaataggtgtgtgtggatgtactgcaagtcacttgggtgatgagattatcaaaaaagcgccctatgtggattttgttgttggggcgagaaatgtttctaaaatcgccgatgcagttctaaaaaaaggaactgttgagattgatataaataatgatgagacgaactatgattttgcagattatagaaactcactttatagagcaagtatcaatatctctttaggatgtgacaaaagctgtactttttgtattgttcctgcaacaagaggtgatgagataagtattcctagtgaacttatcttaaaagagatacaaaagtctgttgactctggggctgttgaagtatttcttttgggacaaaatgtcaacaactatgggaaacactttagcgataaaactgaaaaaacaaactttacacaacttttacaaatgattagtaaaattgaggggctaaaaaggattccatttacctcccacctccttttactagggatgaagaattttattgaaaagtttgcttccaatccctaa

SEQ ID NO: 6970 - protein, 250 aa, Unknown
  Obtained from environmental sample
  DOMAIN (4)...(102): Uncharacterized protein family UPF0004
  misc_feature (1)..(250): Xaa is any amino acid
MSKKLFIETLGCAMNVRDTEHIIAELNKHQSYSQTQNLEDADLIIINTCSVREKPVAKLFSELGVFNKKKKTGAKIGVCGCTASHLGDEIIKKAPYVDFVVGARNVSKIADAVLKKGTVEIDINNDETNYDFADYRNSLYRASINISLGCDKSCTFCIVPATRGDEISIPSELILKEIQKSVDSGAVEVFLLGQNVNNYGKHFSDKTEKTNFTQLLQMISKIEGLKRIPFTSHLLLLGMKNFIEKFASNP

SEQ ID NO: 6971 - DNA, 555 bp, Unknown
  Obtained from environmental sample
  misc_feature (1)..(555): n is a, c, g, or t
ttgggacaaaatgtcaacaactatgggaaacactttagcgataaaactgaaaaaacaaactttacacaacttttacaaatgattagtaaaattgaggggctaaaaaggattcgatttacctcaccacatcctttacatatggatgatgagtttattgaagagtttgcttcaaatcctaaaatctctaaacagattcatgttccacttcaagctggtaatacaagagttctaaaagagatgaaaagaggatacacaaaagagtggttcttaaatcgttgtgaaaaaatacgaacacttgtaccagatgtaagaatctctacagatattattgtcgcatttccaggggaaagtgatgaggagtttttagatactcttgatgtgatggagaaggtaaaatttgatgctgtttttaacttcaaatattccccaagaccattaacaccagcgcaaaatatgccaaatcaaatagatgatgcaactgctacaaaaaggttacaaagagtgattgaacttcacaaagaacatcaagatgaacatatggcaaaacgttgttga

SEQ ID NO: 6972 - protein, 184 aa, Unknown
  Obtained from environmental sample
  misc_feature (1)..(184): Xaa is any amino acid
MGQNVNNYGKHFSDKTEKTNFTQLLQMISKIEGLKRIRFTSPHPLHMDDEFIEEFASNPKISKQIHVPLQAGNTRVLKEMKRGYTKEWFLNRCEKIRTLVPDVRISTDIIVAFPGESDEEFLDTLDVMEKVKFDAVFNFKYSPRPLTPAQNMPNQIDDATATKRLQRVIELHKEHQDEHMAKRC

SEQ ID NO: 6973 - DNA, 885 bp, Unknown
  Obtained from environmental sample
  misc_feature (1)..(885): n is a, c, g, or t
atgaaaaaaagtaatgtgttaatttttggaaataatgaatatgggttagaaattgcaaaaaatgttactaatgaacataatgatattacaattttcagtcttgataatgtgaattctaatgtagataaaaaacatggttttaagatggaaaactttgatttaagtgatgattgggatgattttaaaaataaattcgatacagagaactctataatattttgtgcattaagtgatgaggcagaaaatatatttttaacactctcattaagatcatcgtttaaggatatcgcaatagtagctttggcaaagaataacgaagatgcaaataagttacgtatggcaggggctagtaaagttatcccgatcatagagactacagctgacataataactgatatgcttaaaaaaccagttattacagaggtgttgcataatattttgtatgaaaccagtgatttgaagattgaacagataaaagtaagtgataatggtcactttgaaggtaaatgccctgcagatattgagtggagcagagatcatggaattatagttttatctattatccatgaagatatgagtagtgattttatctactcatcaaagtcaaaacatcacttaatcaaagatggggatattcttgttgcagtaggatatgaagcagatttaagagagtttgaaaaattggttaaagggattgatatgaaaaatagggataattgggagctggtaaatggggaaatgcactccttttttgcactttctcaaaataactcaaatgtatatattacatcaagaaaagagttagatattccacagttttaccttcttgataaaattttagaagggggatatctggttattgcagttccccccaccaaagaatga

SEQ ID NO: 6974 - protein, 294 aa, Unknown
  Obtained from environmental sample
  DOMAIN (5)...(122): TrkA-N domain
  misc_feature (1)..(294): Xaa is any amino acid
MKKSNVLIFGNNEYGLEIAKNVTNEHNDITIFSLDNVNSNVDKKHGFKMENFDLSDDWDDFKNKFDTENSIIFCALSDEAENIFLTLSLRSSFKDIAIVALAKNNEDANKLRMAGASKVIPIIETTADIITDMLKKPVITEVLHNILYETSDLKIEQIKVSDNGHFEGKCPADIEWSRDHGIIVLSIIHEDMSSDFIYSSKSKHHLIKDGDILVAVGYEADLREFEKLVKGIDMKNRDNWELVNGEMHSFFALSQNNSNVYITSRKELDIPQFYLLDKILEGGYLVIAVPPTKE

SEQ ID NO: 6975 - DNA, 744 bp, Unknown
  Obtained from environmental sample
  misc_feature (1)..(744): n is a, c, g, or t
gtgggcgatgtaaaaactttacaaaatagtgatgtagatagaaacttggtaaaaaatgaatttttacatagtgccatatataaacaaaatcttgtaagcgatgattttaaaaccactgctattatgattaatttaaaaagagatgaaaagtatgcttctcttatagataatgaaaacaaatatatcaaactaaaacaaacaaaaaaacttgatgaacaagagttgtttaactacagtaaagcaaaggaagagttaaaagagtatagagatattttacgagtagaaaatcacaacttaatactaaatgtaagagaaatacttcttaagtatgaagaaactacaaacgcaaaacttcatcttggtggagcaaatatggttgcggatgatatggtagagtttgttaaaaatgatctagagatatttagtattatgattgttgtattactcattgtgatattatatattttatttaaagagatgcgatgggtatttttgcctttatttatatcaacagtatctattatcattacaagtggtttatttggagcaattggatgggagataacagtagtttcatctaattttatatcgctaccacttattatgaatatgtcattagtagtacatcttattataaaatataaagaagtaccttacattacatcccactcctactccagaagttataagttacaaataccgctttacctatggaaaaacccttcatttttttggaggaaataa

SEQ ID NO: 6976 - protein, 247 aa, Unknown
  Obtained from environmental sample
  misc_feature (1)..(247): Xaa is any amino acid
MGDVKTLQNSDVDRNLVKNEFLHSAIYKQNLVSDDFKTTAIMINLKRDEKYASLIDNENKYIKLKQTKKLDEQELFNYSKAKEELKEYRDILRVENHNLILNVREILLKYEETTNAKLHLGGANMVADDMVEFVKNDLEIFSIMIVVLLIVILYILFKEMRWVFLPLFISTVSIIITSGLFGAIGWEITVVSSNFISLPLIMNMSLVVHLIIKYKEVPYITSHSYSRSYKLQIPLYLWKNPSFFWRK

SEQ ID NO: 6977 - DNA, 873 bp, Unknown
  Obtained from environmental sample
  misc_feature (1)..(873): n is a, c, g, or t
atggggcgaaattgtagtggaaaatctgcaaaacctattgtattaaaagtaccacctggaactattgtaattgatgaagaaacagaagaagttttatttgatcttactgaagataaacaaaaagttttatttttagaaggtggaaagggtggccttggaaatacacactttaaaaattcaagaaaccaaacaccaacatatgcacaaccaggacttatgggtgaaaaaagacttgtaagattagagttaaaacttattgcggatgttggtgttgttggatatccaaatgttggaaaatcaacacttatctcaacaatatcaaatgcaaaacctcaagtggcaaattatgagtttacaacacttactccaaagcttggggttgttgaagttggagattataactcttttgtggcagctgatattcctggaattatagagggtgctgcagaagggcgaggtttagggattgagtttttaaaacatattgaaagaacaaaaacacttctttatatgatagatatggcaaatcatagagagatgttagatcaatataatgtattacaagaggaagttgagaagttctcaccggaattagctagtagaaaatttgcaattgcgttaacaaaaatagatgcaataccacaagaagaactcaatgaaaaagttgaaggttttataaaatcaataggcttagagacaacaaaagaaaatagttttgcttttgacaaagacaaaagttattttcttcaagatttgacatataatagatatgatgaaaaattaccatattttgtattaccaatatcatcggctactaaacaaaatattgaacctattaaatttgcaatatatgatttaataagtagggactaa

SEQ ID NO: 6978 - protein, 290 aa, Unknown
  Obtained from environmental sample
  DOMAIN (1)...(213): GTP1/OBG family
  misc_feature (1)..(290): Xaa is any amino acid
MGRNCSGKSAKPIVLKVPPGTIVIDEETEEVLFDLTEDKQKVLFLEGGKGGLGNTHFKNSRNQTPTYAQPGLMGEKRLVRLELKLIADVGVVGYPNVGKSTLISTISNAKPQVANYEFTTLTPKLGVVEVGDYNSFVAADIPGIIEGAAEGRGLGIEFLKHIERTKTLLYMIDMANHREMLDQYNVLQEEVEKFSPELASRKFAIALTKIDAIPQEELNEKVEGFIKSIGLETTKENSFAFDKDKSYFLQDLTYNRYDEKLPYFVLPISSATKQNIEPIKFAIYDLISRD

SEQ ID NO: 6979 - DNA, 819 bp, Unknown
  Obtained from environmental sample
  misc_feature (1)..(819): n is a, c, g, or t
gtggacaatatgattaaaaaaattgatattatagatggtgttagttatatcgagattgctgatgcaaatctatttattcagtgtggttcacctgttgagagtgtaaaacatcttataaagaaaggtattattcgtacgatcactgaaaatgatgtatcttttgaagttggaccaaatgcaattttactctccgatgtaacaatacaaaacggtgaattctctaatatgtctgaattctcagtacttcagatgctctacaaacagggtttgattattccaggacacccaaataacacaggtataaaacctcttctaatcggtttaaactctcaagttgattctcaaatgaagtatatatacagaggcaattacggacttgtctctaaagaagagattgaagattgcggtatagatagcacatacgcaaatgatatgtttagattgaagttgaaatttgcatttggaaaacttcaattaccgactaatttgttagatagctgtattgttgataaaagtatagttgagattcgtaacggtgtattcattgagagaaaagggataaatatatttgaaatctcttataaaggtgaaaaagttacagttgatttaaatcttaaaaaaggtcaaatatatgactctccttacactcttcctctgtacaaaacaaaaagagactactttttcataatacactcaggtcaaggtgatggctgggatataaatagagcttctatgaactctattattacatttccaggaaaagctttatttgggtggatgttgtttccaaaaattaaacatatactgaacttcccttag

SEQ ID NO: 6980 - protein, 272 aa, Unknown
  Obtained from environmental sample
  misc_feature (1)..(272): Xaa is any amino acid
MDNMIKKIDIIDGVSYIEIADANLFIQCGSPVESVKHLIKKGIIRTITENDVSFEVGPNAILLSDVTIQNGEFSNMSEFSVLQMLYKQGLIIPGHPNNTGIKPLLIGLNSQVDSQMKYIYRGNYGLVSKEEIEDCGIDSTYANDMFRLKLKFAFGKLQLPTNLLDSCIVDKSIVEIRNGVFIERKGINIFEISYKGEKVTVDLNLKKGQIYDSPYTLPLYKTKRDYFFIIHSGQGDGWDINRASMNSIITFPGKALFGWMLFPKIKHILNFP

SEQ ID NO: 6981 - DNA, 882 bp, Unknown
  Obtained from environmental sample
  misc_feature (1)..(882): n is a, c, g, or t
atgatgaatattatgcaaattacatctgaaaaaacattggaagcagcaatagtggaatcgttaacagaaacaggtggatattcacaagggaattcagaacagtattttcccaaactcggaatgttcaaatatgagattttatctttcttacaggaatctcaacccaaaaaatgggaaaaaattattgcagttcacggtgcagataatgttggagacagaattatcggtcgcatcaataaagagatggatttacgaggaagcctcgatgttatccgcaacggcttcacagattacggagttcgcttcaaacttgccttcttccaacccgaaacaggcttaaatcccgaaaccgaaattctttataacaagaatcaattaaaggtttaccgtcaggtttattacagcgataagaacaaaaattcagttgatctggtaatttcattgaacggaattcccattgctacaattgaactgaaaaatcgctttactggacaaagcacagccaatgccaaaaaacaatataacacaaccagagattctagagaactgctttttaaattcaaaaaaagagcattagttcattttgcagttgatgatgaagaagtttttatgacaaccaaaatagcgggagacaaaactttctggttacctttcaataaaggaaacaataaaggaaaagggaatccgataaacccagatggatataaaaccgattacctttggaaagatattttggcaaaagatagttttctggaaataattcagcgtttcattcatctgcaaaaagaagagatcgaaattgatggtagaactttcattaaagaaaaaatgatctttcctcgttatcatcaacttgatgtgaaaaaaaatcnccggccataa

SEQ ID NO: 6982 - protein, 293 aa, Unknown
  Obtained from environmental sample
  DOMAIN (112)...(213): Type I restriction enzyme R protein N terminus (HSDR_N)
  misc_feature (1)..(293): Xaa is any amino acid
MMNIMQITSEKTLEAAIVESLTETGGYSQGNSEQYFPKLGMFKYEILSFLQESQPKKWEKIIAVHGADNVGDRIIGRINKEMDLRGSLDVIRNGFTDYGVRFKLAFFQPETGLNPETEILYNKNQLKVYRQVYYSDKNKNSVDLVISLNGIPIATIELKNRFTGQSTANAKKQYNTTRDSRELLFKFKKRALVHFAVDDEEVFMTTKIAGDKTFWLPFNKGNNKGKGNPINPDGYKTDYLWKDILAKDSFLEIIQRFIHLQKEEIEIDGRTFIKEKMIFPRYHQLDVKKNXRP

SEQ ID NO: 6983 - DNA, 432 bp, Unknown
  Obtained from environmental sample
  misc_feature (1)..(432): n is a, c, g, or t
atgtcaaatagtaaggtcttatttggtgatgttttattaaatatcacaggagcttcaattggcagatgtttttatattaagagaagtttaggtgcagcaaatgtaaatcaacacgtttgcataatacgtccaaagaataatttatgtagcaagtttctctatttcgttttaagatcatatattggtcaggaacaaattaattttgaacaaactggaagtggtcgagaaggactaaattttgaagctttaaaaagtttcattattcctgatattccaattgaagagcaaacacaaattatccaacacatccaaaccgaaacagacagaataaattccaaaataaccaaaaccgaaaaattaattgaattattgaaagaatataaaatcgctttaatcagtgaagttgtaacagggaagataaaaataccgtag

SEQ ID NO: 6984 - protein, 143 aa, Unknown
  Obtained from environmental sample
  DOMAIN (3)...(108): Type I restriction modification DNA specificity domain
  misc_feature (1)..(143): Xaa is any amino acid
MSNSKVLFGDVLLNITGASIGRCFYIKRSLGAANVNQHVCIIRPKNNLCSKFLYFVLRSYIGQEQINFEQTGSGREGLNFEALKSFIIPDIPIEEQTQIIQHIQTETDRINSKITKTEKLIELLKEYKIALISEVVTGKIKIP

SEQ ID NO: 6985 - DNA, 378 bp, Unknown
  Obtained from environmental sample
  misc_feature (1)..(378): n is a, c, g, or t
atgaacgataaatttcataataaatatcgcatacaaaccaccaggttaccgaattgggattatggatggaacggtttttattatgtaactatttgcacaaagcatagggaatttttttttggtgaaatttgcaaaggtgtaatgcaattatccgaaataggagatatagcaaacaaatattggttaggaataccaaatcattttccatttgtgaaattggaatcgtttattgtaatgccaaatcatattcacgggatcattgaaatagataaaaatgatgacgtagagacgcaagattttgcgtctctaccgaaaaataaattcggtcggcaatccaagaatctggcatcaataatcgtggtttcaaaattggggtaa

SEQ ID NO: 6986 - protein, 125 aa, Unknown
  Obtained from environmental sample
  misc_feature (1)..(125): Xaa is any amino acid
MNDKFHNKYRIQTTRLPNWDYGWNGFYYVTICTKHREFFFGEICKGVMQLSEIGDIANKYWLGIPNHFPFVKLESFIVMPNHIHGIIEIDKNDDVETQDFASLPKNKFGRQSKNLASIIVVSKLG

SEQ ID NO: 6987 - DNA, 708 bp, Unknown
  Obtained from environmental sample
  misc_feature (1)..(708): n is a, c, g, or t
atgacaatagcatttttggatagaaaaactttaggtaatgatgtaagtttagaacaatttaatgaacttggaaaagttattatttatgaaactacaaccccagaacaaactcttcaaagagttcaaaatgtagatatcgttgtaacaaataaagtagtaatagataaaaatattatggaaaatagtaatataaaacttgtctgtattgcagcaactgggatgaataatattgatttaaaatttgcagaacaaaaaagtattgaagttaaaaatgtggtcggatattcaacatctagcgtagtacaactcacattatcattcgtattacagtttgtacagaaaattgacttttatgacaaatttggaaagtgtgactggagatatagtgatatatttacaaatttaagtaagccattttatgagcttgaaaataaaaaatgggggattatagggcttggtactattggtcttggcgttgcaaaagtagctgatgcctttggctgtgatgtacaatacttttctacaagtggtaaaaacaaaaatggacaatataaacaagtatctttagatgaactattacaaacatctgatattatatctatccattgtgctttaaatgagcaaacactcaatctactgaatagttctaatcttacagtgataaaaaatggtggagttttagtaaatctaggtagaggtggtatgtaa

SEQ ID NO: 6988 - protein, 235 aa, Unknown
  Obtained from environmental sample
  DOMAIN (100)...(234): D-isomer specific 2-hydroxyacid dehydrogenase, NAD binding domain
  misc_feature (1)..(235): Xaa is any amino acid
MTIAFLDRKTLGNDVSLEQFNELGKVIIYETTTPEQTLQRVQNVDIVVTNKVVIDKNIMENSNIKLVCIAATGMNNIDLKFAEQKSIEVKNVVGYSTSSVVQLTLSFVLQFVQKIDFYDKFGKCDWRYSDIFTNLSKPFYELENKKWGIIGLGTIGLGVAKVADAFGCDVQYFSTSGKNKNGQYKQVSLDELLQTSDIISIHCALNEQTLNLLNSSNLTVIKNGGVLVNLGRGGM

SEQ ID NO: 6989 - DNA, 636 bp, Unknown
  Obtained from environmental sample
  misc_feature (1)..(636): n is a, c, g, or t
ttggaattaacagatttatggaaaatctatctacctgcaatgatcgctggtgtattagctatgggtccagctgcagttatggcagaaaaaaaagggaaatttaaagaggtacttttagttggtattgtattttttgcactttcattttcttttattggatatgctaatacacaaatcttatttttaattggtattatcatattttttatcggttttaatatgcatgaacctattatgcaaagtttaactactagatatatcaaagtacatgaaaaagggaaagtattaggagtatttaactcttttggatatcttgggacctttataggtggttttgtaggtgggatgtatcttaaagagatagatggaagttttatcgaaagtttacacaatatctctatggtagttgtagctatatctgttgcatggttatttttaatatttacattaccaaatcctttaaaaaagaaaaatatttacattgatatagagcaatgtgatgaaaacaaatatacagtattagatactttagatggagtagatgagtggtatttaaacaatacagaaaaacttttaatcgtaaaatacgaccatgatataaccaatgaagatactgttaaaaaagcactaaaatag

SEQ ID NO: 6990 - protein, 211 aa, Unknown
  Obtained from environmental sample
  misc_feature (1)..(211): Xaa is any amino acid
MELTDLWKIYLPAMIAGVLAMGPAAVMAEKKGKFKEVLLVGIVFFALSFSFIGYANTQILFLIGIIIFFIGFNMHEPIMQSLTTRYIKVHEKGKVLGVFNSFGYLGTFIGGFVGGMYLKEIDGSFIESLHNISMVVVAISVAWLFLIFTLPNPLKKKNIYIDIEQCDENKYTVLDTLDGVDEWYLNNTEKLLIVKYDHDITNEDTVKKALK

SEQ ID NO: 6991 - DNA, 660 bp, Unknown
  Obtained from environmental sample
  misc_feature (1)..(660): n is a, c, g, or t
atggctattgctaaatttgtgggagttacaggaacaccttctgagctgaatttcgatatttacaacaataacgataaagctaaaaatgtgaaaactacggcaagtatttcacaagataaacttgctgtaaaagcgggaaaagaagaaacaattaagattaaaaacaacaccaaacaaaccttgtttattagtcttactttaaaaggaattccattagaaggagacaatagttctgccgaaaatgacctaaaaatgaatgtgaaatacctcgacatgaatgaaaatgaaataagtgttgaccaattgaaacaaggcatggactttatcgctgaggttactttccaacatcctggaataagaacccattacagagaaatggcattgcatcaaatttttccatcaggttgggaaattagaaatacccgtatggatttagtagagaccaataaaattgctgatgttcccacttatcaggatattcgtgatgacagagtttacctctattttgatattgataaaaataaaaccaaacgatttagggtattgttaaatgcttcgtacttaggtaggttctatttgccgacagtctattgtgaagccatgtacgacaatgaaatcaatgccaaaaaaggtggtaaatgggtggaagtagtgcagtaa

SEQ ID NO: 6992 - protein, 219 aa, Unknown
  Obtained from environmental sample
  misc_feature (1)..(219): Xaa is any amino acid
MAIAKFVGVTGTPSELNFDIYNNNDKAKNVKTTASISQDKLAVKAGKEETIKIKNNTKQTLFISLTLKGIPLEGDNSSAENDLKMNVKYLDMNENEISVDQLKQGMDFIAEVTFQHPGIRTHYREMALHQIFPSGWEIRNTRMDLVETNKIADVPTYQDIRDDRVYLYFDIDKNKTKRFRVLLNASYLGRFYLPTVYCEAMYDNEINAKKGGKWVEVVQ

SEQ ID NO: 6993 - DNA, 363 bp, Unknown
  Obtained from environmental sample
  misc_feature (1)..(363): n is a, c, g, or t
atgtctaaagaatctataagtaaaatatacttaataatagaaaagatagagtatattgaaaaaatagttactaatgcaggaaatataacaaaagccttagaagatgttatgacaatcagacctgcaatcttaatgcacttaacagctatagctgaacaatttgataaattaaaaaagtcacatgcagatgaaatattaaatgaatttgataaagatgatttaaaaggactatatgatgttagaacatatatcgctcacgattatgaaggtataaatttagcaattatagaatggattataagaaatggtctccctaaatttaaaatgcaatgtcaaaaagttatcgataaagaaattaattaa

SEQ ID NO: 6994 - protein, 120 aa, Unknown
  Obtained from environmental sample
  misc_feature (1)..(120): Xaa is any amino acid
MSKESISKIYLIIEKIEYIEKIVTNAGNITKALEDVMTIRPAILMHLTAIAEQFDKLKKSHADEILNEFDKDDLKGLYDVRTYIAHDYEGINLAIIEWIIRNGLPKFKMQCQKVIDKEIN

SEQ ID NO: 6995 - DNA, 483 bp, Unknown
  Obtained from environmental sample
  misc_feature (1)..(483): n is a, c, g, or t
atgaaatcaaatatctttttatttgtagatggaagtatgcatcctcaaagaggtattggttttggtgggtatttactcctaaatgaatctgaattatcttcatctacattagataaaaaagttaaaattaaaaagtttgaaaatacctcctcaacaaaattggagttggagacacttttatgggctttggatgatacaaatttaaaaaactttaacatagtagtttatacagattgccaaaatattataggattacaagatagacgagaaggttttgagaaaaaaaactatattacctctaaaaacaaacagataaaaaatcatgagttatataaagaattttttaagatgctagatattttagattgtgagtttgtgaaagtaaaagggcacaaaaaaacatctataaaaaatgagatagatgagctttttactcttgtggatagggctactagaaaagctttgagggaaactattttataa

SEQ ID NO: 6996 - protein, 160 aa, Unknown
  Obtained from environmental sample
  DOMAIN (2)...(156): RNase H
  misc_feature (1)..(160): Xaa is any amino acid
MKSNIFLFVDGSMHPQRGIGFGGYLLLNESELSSSTLDKKVKIKKFENTSSTKLELETLLWALDDTNLKNFNIVVYTDCQNIIGLQDRREGFEKKNYITSKNKQIKNHELYKEFFKMLDILDCEFVKVKGHKKTSIKNEIDELFTLVDRATRKALRETIL

SEQ ID NO: 6997 - DNA, 324 bp, Unknown
  Obtained from environmental sample
  misc_feature (1)..(324): n is a, c, g, or t
atgaaatcaaatatctttttatttgtagatggaagtatgcatcctcaaagaggtattggttttggtgggtatttactcctaaatgaatctgaattatcttcatctacattagataaaaaagttaaaattaaaaagtttgaaaatacctcctcaacaaaattggagttggagacacttttatgggctttggatgatacaaatttaaaaaactttaacatagtagtttatacagattgccaaaatattataggattacaagatagacgagaaggttttgagaaaaaaactatattacctctaaaaacaacagatnaaaaatcatga

SEQ ID NO: 6998 - protein, 107 aa, Unknown
  Obtained from environmental sample
  misc_feature (1)..(107): Xaa is any amino acid
MKSNIFLFVDGSMHPQRGIGFGGYLLLNESELSSSTLDKKVKIKKFENTSSTKLELETLLWALDDTNLKNFNIVVYTDCQNIIGLQDRREGFEKKTILPLKTTDXKS

SEQ ID NO: 6999 - DNA, 408 bp, Unknown
  Obtained from environmental sample
  misc_feature (1)..(408): n is a, c, g, or t
atggactacaggaccgtacttacaatctgcacccattgtggctgtggatgtaatttttatcttgaggtgctggatggtcaaattatcgacacgattccctgtaagaccagccctgtaaatgaaggaaaactctgtataaaggggtggaatgttcacgagttcatccaaagcgaaaaaagacttacaaaaccccttgtacgaaaaaatggtgaacttgtcgaagcctcctgggatgaggcactggattatacggtttccaaacttaaggagatcaaggaggccaatggccctgacagcattgcctttttaacatccgccaaggttacccatgaggagaattatctgctccagaagtttgcgcgagctggggtggggcaccacaacgtggatcactgcgcacgcctctga

SEQ ID NO: 7000 - protein, 135 aa, Unknown
  Obtained from environmental sample
  DOMAIN (3)...(57): Molybdopterin oxidoreductase Fe4S4 domain
  misc_feature (1)..(135): Xaa is any amino acid
MDYRTVLTICTHCGCGCNFYLEVLDGQIIDTIPCKTSPVNEGKLCIKGWNVHEFIQSEKRLTKPLVRKNGELVEASWDEALDYTVSKLKEIKEANGPDSIAFLTSAKVTHEENYLLQKFARAGVGHHNVDHCARL

SEQ ID NO: 7001 - DNA, 528 bp, Unknown
  Obtained from environmental sample
  misc_feature (1)..(528): n is a, c, g, or t
atgacagctaaccaaagttctaagaaattaggcatcaactatgtaactgttaaaaaaagttttcatctttttagaggactcatcgcaaaccatctcgaagaggagtataaagacacaactgtcttagaatatgatgaatatatatacttgcagcaaagcaaaaaaaagataaaagaaaatatctttgatgcacaaaactttctaagctttcactatgaaaacagaatctacaatctcctcatgcctaacctgagcagatacaaacaagaattcctagatgcaggagcacaagaagcttacttcaaagagttttcaaagtttatgatgcttaataaaatctcaaagactcaaaaaagagaaaatataattacaaagttttggattttttttgaagaagaaattttaaagtacaaaggagtaagtgatgaaaactttttttactatctaaaagaaatagagtttaagttcaactacacaaaagaagaacaaactcagatattaaaagcttctctttacaaatatttttga

SEQ ID NO: 7002 - protein, 175 aa, Unknown
  Obtained from environmental sample
  misc_feature (1)..(175): Xaa is any amino acid
MTANQSSKKLGINYVTVKKSFHLFRGLIANHLEEEYKDTTVLEYDEYIYLQQSKKKIKENIFDAQNFLSFHYENRIYNLLMPNLSRYKQEFLDAGAQEAYFKEFSKFMMLNKISKTQKRENIITKFWIFFEEEILKYKGVSDENFFYYLKEIEFKFNYTKEEQTQILKASLYKYF

SEQ ID NO: 7003 - DNA, 798 bp, Unknown
  Obtained from environmental sample
  misc_feature (1)..(798): n is a, c, g, or t
atgtcaaaaacagcacttattacaggtggttcgtctggtttgggctttgaaatggctaaaagattaggttctttgggttattcatcggtgattctggggcgcgataaagaaaaattagaaagagcagttgatgatattaaaacacaaggttatgaaattacgggatttcaatgtgacattacagatgaagcacgtttgaaaaaatcctttgatgaaataaaaaataaatatggtgaaatagatcttttaattttaaatgctggcgtggttacatgtaaattgcttgcggattttaacaatgtaactgaacttgaacatgatttgagaaataatttatgggggacaatactatcaacttatacttttttacccttggtaaataaaggtggaagaattttaatgatctcatcggcatttggccttatgggaccggctgcatattctgtttattccgcatcaaaagcaggaatcataaattttgctgaatccttgcgacgtgaattattgtgtaagcaaatatccgtccatgttgcatgtccgggagatatagatactccgcaattgcatgaggaacataaaacaatgccagagtggtttaagcagggagatcctagatctgtaatgtctgctgaattggcaacaactagaattctgaaaaaatgttttaaaaataagtttttaataattatcagctttgaaatatgggctcttgtaatgcttaataaactcctgcccagaagattacgagattattgttttgataagatgtttcctctgcctagtgactcaacccattaa

SEQ ID NO: 7004 - protein, 265 aa, Unknown
  Obtained from environmental sample
  DOMAIN (5)...(239): short chain dehydrogenase
  misc_feature (1)..(265): Xaa is any amino acid
MSKTALITGGSSGLGFEMAKRLGSLGYSSVILGRDKEKLERAVDDIKTQGYEITGFQCDITDEARLKKSFDEIKNKYGEIDLLILNAGVVTCKLLADFNNVTELEHDLRNNLWGTILSTYTFLPLVNKGGRILMISSAFGLMGPAAYSVYSASKAGIINFAESLRRELLCKQISVHVACPGDIDTPQLHEEHKTMPEWFKQGDPRSVMSAELATTRILKKCFKNKFLIIISFEIWALVMLNKLLPRRLRDYCFDKMFPLPSDSTH

SEQ ID NO: 7005 - DNA, 588 bp, Unknown
  Obtained from environmental sample
  misc_feature (1)..(588): n is a, c, g, or t
atgagtataaaaataggaatagcaggaccagtaggaagtggaaaaacttctataatagaacaacttacaaattgtcttaaagataaatatagtttaggaatcgtgacaaatgatatatatacaacagaagatgccaactatttaaagtcacatcttgatatagaggatgagagaataatcggggttgaaacaggtggttgtccacatacagctataagagatgatatatctgcaaatcaaaaagcagtagaaaagttggagtcaaaatttagtccggatattatttttgtagagagtggtggggataatcttagtgctactttttcttatgagttgattgattattatatgtatgtgatagatgtggcacaaggtgcagatataccaagaaaaaaaggtgctggacttttatttagtgatcttttagttgtaaacaaaattgaccttgccccttatgttgatgttgagttaaattctatgcaaaatgatgtaaaagaaaatagaaaaaacaaaccatttatatttatctcgaaaaanaataatagtattgttaaattagaagagtggatacttgctttagtagattaa

SEQ ID NO: 7006 - protein, 195 aa, Unknown
  Obtained from environmental sample
  DOMAIN (3)...(175): CobW/HypB/UreG, nucleotide-binding domain
  misc_feature (1)..(195): Xaa is any amino acid
MSIKIGIAGPVGSGKTSIIEQLTNCLKDKYSLGIVTNDIYTTEDANYLKSHLDIEDERIIGVETGGCPHTAIRDDISANQKAVEKLESKFSPDIIFVESGGDNLSATFSYELIDYYMYVIDVAQGADIPRKKGAGLLFSDLLVVNKIDLAPYVDVELNSMQNDVKENRKNKPFIFISKXNNSIVKLEEWILALVD

SEQ ID NO: 7007 - DNA, 516 bp, Unknown
  Obtained from environmental sample
  misc_feature (1)..(516): n is a, c, g, or t
ttggtaataattatcaggtacaagataaacaaaagggcatttgatattttaaatgaagcaaaatcgaaaaaagaaatacaagttctacccatatatagcttgtttatttatctgaatttggcggttttgtattttgatttaggaaaattcaatgaggcaaaatcaagccttgttaaattaaaacaacaagacaattttaagaatttggacattgttctacagtttaaaatttgtatagtggagttaatgatcatccacgaattaaacgacattgatttgtttgactatcagcttaaaaacttgaagaaagattttttcagcttgaagcagatcgatattgatagagatatagattttgttaacctacttgaaaaaatgcaattgtttaatggcaaagaattaaaggaggctattacatcttttattgagaaatataaaactaatagtgaggatgatgcagatataattaattataatcattggttaatgagtaaacaaaaaagaggagtgaaataa

SEQ ID NO: 7008 - protein, 171 aa, Unknown
  Obtained from environmental sample
  misc_feature (1)..(171): Xaa is any amino acid
MVIIIRYKINKRAFDILNEAKSKKEIQVLPIYSLFIYLNLAVLYFDLGKFNEAKSSLVKLKQQDNFKNLDIVLQFKICIVELMIIHELNDIDLFDYQLKNLKKDFFSLKQIDIDRDIDFVNLLEKMQLFNGKELKEAITSFIEKYKTNSEDDADIINYNHWLMSKQKRGVK

SEQ ID NO: 7009 - DNA, 546 bp, Unknown
  Obtained from environmental sample
  misc_feature (1)..(546): n is a, c, g, or t
atgaattccaaaggaaaaatgagcgattttatctgtacaatgtgtggagaatgctgtcagggtgaaggctcggcctttctttatcctgatgatgtgaaaaaaatatccaaagaacttaatatgacgatccaggaattcgtggataaatataccaactacattcttttcgaggttatcgaaggtaaaggctcttacctatatatcccatatcttactcttaaaaaagataaaaatgacatctgtgtgttcagtgatgataaagtatgtaccattcacaaatttaaaccctttcactgtgatcatacaccctttgtttctgaatttttctcagatgaagagtggcgcaaagaagtttcactgaaatgtccagccttaataaaaatggaagaaaaagacttggacaaatacaaatacaaagctgaagaagctgatcagaatgaacgggaatactattatattttaagagagaacaattttaatcttgaaaagatcctgaacataacccttcctgctcctcagataataatttcagacgattctaattga

SEQ ID NO: 7010 - protein, 181 aa, Unknown
  Obtained from environmental sample
  DOMAIN (10)...(127): Uncharacterised protein family (UPF0153)
  misc_feature (1)..(181): Xaa is any amino acid
MNSKGKMSDFICTMCGECCQGEGSAFLYPDDVKKISKELNMTIQEFVDKYTNYILFEVIEGKGSYLYIPYLTLKKDKNDICVFSDDKVCTIHKFKPFHCDHTPFVSEFFSDEEWRKEVSLKCPALIKMEEKDLDKYKYKAEEADQNEREYYYILRENNFNLEKILNITLPAPQIIISDDSN

SEQ ID NO: 7011 - DNA, 822 bp, Unknown
  Obtained from environmental sample
  misc_feature (1)..(822): n is a, c, g, or t
atgaataagtttaaaatagatataaatactcaaaataatcttttagcttttagtgctggagttgattctacagcattattttatcttttagtagagaaaaatataccatttgatattgctattgtggattatgctcaaagagaacagtcaaaagatgaagttatatatgcaacacagcttgctcataaatataataagaaatgttttatatctaattatcctagtgaagctaagtttagtgaaaaagaagcacgggattatcgatacaatttttttgatgcaattatgcttgaaaatagttatgaatcacttcttacagctcaccagctcaatgataagtgtgagtggtttttgatgcaatttacaaaaggagcaggacttagtgaacttctaggtatgcaaatgcagagttataaaaatggatataatattgtaaaaccacttttagaacacacaaaacaatctctcaaagagtaccttcttactaacaactataagttttttgaagatataagtaatagggatgaaaaatacaaaagaaattattttagacataactttagtgataaacttcttgaacaatatcaaagtgggatatctcatagttttgaatatttggaaaaagattttcactctttatttgataactttacaaaacaggtttttgagcagttgacaatctatgaatacaataaagatttaaatattgctatgagaattattgataaagatttaaaaataagaggtataatcatatcaaaagctancagagatgaaatagtgcaaaaaaaagagtttgtatttcacacaaaattgcagtag

SEQ ID NO: 7012 - protein, 273 aa, Unknown
  Obtained from environmental sample
  DOMAIN (12)...(205): PP-loop family
  misc_feature (1)..(273): Xaa is any amino acid
MNKFKIDINTQNNLLAFSAGVDSTALFYLLVEKNIPFDIAIVDYAQREQSKDEVIYATQLAHKYNKKCFISNYPSEAKFSEKEARDYRYNFFDAIMLENSYESLLTAHQLNDKCEWFLMQFTKGAGLSELLGMQMQSYKNGYNIVKPLLEHTKQSLKEYLLTNNYKFFEDISNRDEKYKRNYFRHNFSDKLLEQYQSGISHSFEYLEKDFHSLFDNFTKQVFEQLTIYEYNKDLNIAMRIIDKDLKIRGIIISKAXRDEIVQKKEFVFHTKLQ

SEQ ID NO: 7013 - DNA, 843 bp, Unknown
  Obtained from environmental sample
  misc_feature (1)..(843): n is a, c, g, or t
gtgctgatttataataatgttgtctatgttctaattttaaatgatctaaaacttatagtacaatgtggtgtaaaatcattaactccatttgatcaaattgcagataaaagtttttcagatgatgagattgttgaccaaaaactgtatgaagaggtacacttcttagagatacaacaatttttaagtgatatggtacaaacttactatacacaaaatagtgatgtagagttcttagagcaggtaaaaatattatatacccttaaacctttatctgatgaacaagtaaattcattgtatgaaactattatggtagatatagattatgaagctatcaatatagaacaataccttttaaaaataactcaaaaagaggatgctataaaacactcatttatagatcctcgaataaaaaaacaaaacaaaagtgctatgacttggattgtttttgctgctgttagtgtacttattgtacttggattaatttacacacaatatagttcatctcaagagagtagtaagcaaaaagtagaacaacaaaaacagatgcaaaaagttgcaaaaaaagaacctgtaacaccaaaggttattgagtttccaaatcatattcttacaaataaccatctattacaagatgtttatatgctatttgatatagttccttatgatgctgttttaaaagatttagagataacacaaaatagttcaacttatgtttgtatgttcacatcacaaagcccatcatttgaagatatgaggataaaacttctaaatctttacaaagattcaaaaatacttttaaaacatgaaaataaatctattctaaatattattcttggaaaatga

SEQ ID NO: 7014 - protein, 280 aa, Unknown
  Obtained from environmental sample
  misc_feature (1)..(280): Xaa is any amino acid
MLIYNNVVYVLILNDLKLIVQCGVKSLTPFDQIADKSFSDDEIVDQKLYEEVHFLEIQQFLSDMVQTYYTQNSDVEFLEQVKILYTLKPLSDEQVNSLYETIMVDIDYEAINIEQYLLKITQKEDAIKHSFIDPRIKKQNKSAMTWIVFAAVSVLIVLGLIYTQYSSSQESSKQKVEQQKQMQKVAKKEPVTPKVIEFPNHILTNNHLLQDVYMLFDIVPYDAVLKDLEITQNSSTYVCMFTSQSPSFEDMRIKLLNLYKDSKILLKHENKSILNIILGK

SEQ ID NO: 7015 - DNA, 582 bp, Unknown
  Obtained from environmental sample
  misc_feature (1)..(582): n is a, c, g, or t
atgaggaatttgtactatcttatcttattagtagttgcaatgttttttcaattaaatttatttgcaaatcaagaagttaaaataaattttaaaaatcttgatacggaaaatcttattaaaataacatcaaaaattgttcaaaaagatattcttattacatcaaaagttgaaggtaaggttcaatatatttcaagtaaacctattaataaaaaaaatattttagatattttgagatatgatttacaatcaaaaggcttttctcttttaattagagatgatatttttttggttgtaaaagatgggaatttattaaaatatgataagaaattgtctctaaatactccaagagtagaggtgcttcctattaaaaatgtagattcaaaattgattgttcaaattgtaaaagatattattacaaatcaaaaaactaaagataaaccttatttgtcngtggatgagcaaaataatagagttgtaatttatggtttagaggaagatattgataccataacacaaataattaanacacttgatactccctcaacacagtttatgttgaagcaaaaatatcgagataggtga

SEQ ID NO: 7016 - protein, 193 aa, Unknown
  Obtained from environmental sample
  DOMAIN (117)...(183): Bacterial type II/III secretion system short domain
  misc_feature (1)..(193): Xaa is any amino acid
MRNLYYLILLVVAMFFQLNLFANQEVKINFKNLDTENLIKITSKIVQKDILITSKVEGKVQYISSKPINKKNILDILRYDLQSKGFSLLIRDDIFLVVKDGNLLKYDKKLSLNTPRVEVLPIKNVDSKLIVQIVKDIITNQKTKDKPYLSVDEQNNRVVIYGLEEDIDTITQIIXTLDTPSTQFMLKQKYRDR

SEQ ID NO: 7017 - DNA, 855 bp, Unknown
  Obtained from environmental sample
  misc_feature (1)..(855): n is a, c, g, or t
atgcaagagaagcaaaaaaaacagatgaatagacttaatcagtcgctagaagataaagttaaatcccgtacccacgaacttgctatcaaaaacagttacttcaagactatcttcaatctagaacaaaatcttatttttactctagatagtcaatggaagctaatagattataacagagcatgtgcagagtttttcggatatagtaaaatagagaagttgtgcagtgaacataagtgtatgtgtgactcttttgaactctatgaacaagaaaatagtgaaagagtatcatcaggtttaaaaggtatttcactattagaacatatgttaaaagatccagatcagcatcataatatcattcttaagtgggaagataaacagtatattttcgagttgtttttacgtaagattgaacatctagatggagaacatattcttgttgttatgagtgatgtaacaagacgacaacaaaaaattgaattacttactgaagcgtcattgactgatcctctaacaggaatcggaaatagaatgaaatttgacatacatctagatcacttttttaaaacttcacaacgttataacaaagagttctctcttgttttattagatattgatttttttaaaaagattaacgatacatatggtcatgacagaggagatgaggtcattatagccataactaatatcgtaacaaatcgtattcgaagttctgatatattttgtcgatggggaggtgaagagtttgttgttttaatgccgatgactaagctggatgaagcaaatataatttcagaaaagataaaagagattgtttcaacagaatgttttgggagaggtaaagcatgtgacatgtag

SEQ ID NO: 7018 - protein, 284 aa, Unknown
  Obtained from environmental sample
  DOMAIN (161)...(280): GGDEF domain
  misc_feature (1)..(284): Xaa is any amino acid
MQEKQKKQMNRLNQSLEDKVKSRTHELAIKNSYFKTIFNLEQNLIFTLDSQWKLIDYNRACAEFFGYSKIEKLCSEHKCMCDSFELYEQENSERVSSGLKGISLLEHMLKDPDQHHNIILKWEDKQYIFELFLRKIEHLDGEHILVVMSDVTRRQQKIELLTEASLTDPLTGIGNRMKFDIHLDHFFKTSQRYNKEFSLVLLDIDFFKKINDTYGHDRGDEVIIAITNIVTNRIRSSDIFCRWGGEEFVVLMPMTKLDEANIISEKIKEIVSTECFGRGKACDM

SEQ ID NO: 7019 - DNA, 465 bp, Unknown
  Obtained from environmental sample
  misc_feature (1)..(465): n is a, c, g, or t
ttgcatggacataggaaagatgaagttttatctttgcaatggaaagataagggtaaaacaatgattgattttgataatatggtatataaaataccatatataaaaaataagataaaaaaaaataagatacacccaattactcaagagctgtatgagatattgataaatatagatgatagaactgattatgtttttaaaaatccaaaaacaggtactcgttttcatgatgtacgaaaagtatggaatagaataaaaattaaggctaatataaataaaccttttagaatccatgatataagacatttgataggatatacaactttgaatgagctaggattatcttctaatatcgggagtagtataattggaaatagtcctaaagtttttgaagatagatatagtggtattaaagttgagactgttagaaaaactatgaatttaatgttggaacattttaaaaattaa

SEQ ID NO: 7020 - protein, 154 aa, Unknown
  Obtained from environmental sample
  misc_feature (1)..(154): Xaa is any amino acid
MHGHRKDEVLSLQWKDKGKTMIDFDNMVYKIPYIKNKIKKNKIHPITQELYEILINIDDRTDYVFKNPKTGTRFHDVRKVWNRIKIKANINKPFRIHDIRHLIGYTTLNELGLSSNIGSSIIGNSPKVFEDRYSGIKVETVRKTMNLMLEHFKN

SEQ ID NO: 7021 - DNA, 357 bp, Unknown
  Obtained from environmental sample
  misc_feature (1)..(357): n is a, c, g, or t
ttggcttcaaaagtttctcttttcacaaaagaagacttttatttaaatatcgatgctttggaagatagtattttgatttatattaatttggagggatataggaatttaatagatactaacatagaatttaaaaacttttatataaattatttggaaaaaaatggggttatagtaaaggagaaaaatgaaatatctttgatacttgatgatgcaaaaacaagatatgaaaactttatacaaaataatccagatattgaaaaaagaataccattacatcatattgcaaatcatttaggtattacacctactcagttaagtagaataagaaaaaagtgtaaaatcaacatatgtaaatga

SEQ ID NO: 7022 - protein, 118 aa, Unknown
  Obtained from environmental sample
  misc_feature (1)..(118): Xaa is any amino acid
MASKVSLFTKEDFYLNIDALEDSILIYINLEGYRNLIDTNIEFKNFYINYLEKNGVIVKEKNEISLILDDAKTRYENFIQNNPDIEKRIPLHHIANHLGITPTQLSRIRKKCKINICK

SEQ ID NO: 7023 - DNA, 546 bp, Unknown
  Obtained from environmental sample
  misc_feature (1)..(546): n is a, c, g, or t
atgttagaaacagagatttattatcaacagttaagagaggtttgtaaagaatattatgactttagtgataaaagttttgatgcttttaagaaaatatgttttgtgaaaaatataaaaaaaggggagattctccaagatagttattctcctgcaaaatatatctattttatctataaaggtattttacgaacatattttttaaatgaaaaaggggcaatttatacaaaaaatctttttagtgaaaattatttttctgcttcaaaagtttctcttatcacaaaagaagactcttatttaaatatcgatgctttagaagatagtattttgatttatattaattttgatggatataagaatttaatagatactaacatagaatttaaaaacttttatataaattatttggaaaaaaattgggttatagtaaaggagaaaaatgaaatatctttgatacttgatgatgcaaaaacagatatgaaaactttataccaaataatccagatattgaaaaaagaataccattacatcataatgcaaatcatttag

SEQ ID NO: 7024 - protein, 181 aa, Unknown
  Obtained from environmental sample
  misc_feature (1)..(181): Xaa is any amino acid
MLETEIYYQQLREVCKEYYDFSDKSFDAFKKICFVKNIKKGEILQDSYSPAKYIYFIYKGILRTYFLNEKGAIYTKNLFSENYFSASKVSLITKEDSYLNIDALEDSILIYINFDGYKNLIDTNIEFKNFYINYLEKNWVIVKEKNEISLILDDAKTDMKTLYQIIQILKKEYHYIIMQII

SEQ ID NO: 7025 - DNA, 321 bp, Unknown
  Obtained from environmental sample
  misc_feature (1)..(321): n is a, c, g, or t
ttgagagaggaaattaagatggatacgcaatcatttgatatacctattcatgatattaaacctctagtagaagttcctgataactcatttgctatttttataacagtagttgttttaggtgtgatcttgttagcggttgttatctattttttatatagacacttcttaaaagctaaaaaaatcaacttgagaaaagtaaactttgaagcactgaaaaatatcgatttcacagagcctaaaaaagcagcgtatgagattacaaaatatggacttatttttgaaaatgattcagagcgaatctatgaggcatatcataattaa

SEQ ID NO: 7026 - protein, 106 aa, Unknown
  Obtained from environmental sample
  misc_feature (1)..(106): Xaa is any amino acid
MREEIKMDTQSFDIPIHDIKPLVEVPDNSFAIFITVVVLGVILLAVVIYFLYRHFLKAKKINLRKVNFEALKNIDFTEPKKAAYEITKYGLIFENDSERIYEAYHN

SEQ ID NO: 7027 - DNA, 666 bp, Unknown
  Obtained from environmental sample
  misc_feature (1)..(666): n is a, c, g, or t
atgcagactccttacattaagtttnttgtgaagagcgtgaacttanatgtggcagtagtaagtatgttaacgggcagtgtacatttnggctcaaagagattaaaacaagatctgatctctgaaatagttgcaatactcagtttttcggtagtgagaaacggcgatctgctaactaacttaatctttgcagacaaactatactcacaatctaaaccctcaaagaagatattttctgttcatgagagtgttgagaatgttttaaattttgagtctgtcggaaaaaaagctgattataccattatggcagacacactatataaacgtcttaaaagacgatcccttgttattattgtggcagacttttttgactctgcatcactgaaacttttagcaaaaaagcatgaagtgttagcagtaattgtgcgtgataggtatgaagagaatcctccagaatttggattttccactcttgtcgatcctgaaagcggtaccattttagagggtgactttaactctcacacaacaaaaacatactcagatagagtaaatgcacatgatagtgaactctataaaaaccttagaaaagagggcataagattttctaaaatatatacagacgaaaaccctgcaatcggtcttcgtcgtctttttgagagaggaaattaa

SEQ ID NO: 7028 - protein, 221 aa, Unknown
  Obtained from environmental sample
  misc_feature (1)..(221): Xaa is any amino acid
MQTPYIKFXVKSVNLXVAVVSMLTGSVHXGSKRLKQDLISEIVAILSFSVVRNGDLLTNLIFADKLYSQSKPSKKIFSVHESVENVLNFESVGKKADYTIMADTLYKRLKRRSLVIIVADFFDSASLKLLAKKHEVLAVIVRDRYEENPPEFGFSTLVDPESGTILEGDFNSHTTKTYSDRVNAHDSELYKNLRKEGIRFSKIYTDENPAIGLRRLFERGN

SEQ ID NO: 7029 - DNA, 306 bp, Unknown
  Obtained from environmental sample
  misc_feature (1)..(306): n is a, c, g, or t
atgaaaaaaatattcctattaatatttacctttatctatctaaatgcaggaacactgggtacagatattaatgctgtaaataaagagatcaataaattaatacctcaagctgcaccaacatctaagaactttaaatggtcctgtgaaacagtatcaaatgtacgctttccagttggtttttatcaaggcaatcatataactgataaatgtatcgtaaatacagatattgatatttcttttaaagtaacatgtgaatattcaatcttacctacaggtggttctactatttgcagattaggttggtaa

SEQ ID NO: 7030 - protein, 101 aa, Unknown
  Obtained from environmental sample
  SIGNAL (1)...(16)
  misc_feature (1)..(101): Xaa is any amino acid
MKKIFLLIFTFIYLNAGTLGTDINAVNKEINKLIPQAAPTSKNFKWSCETVSNVRFPVGFYQGNHITDKCIVNTDIDISFKVTCEYSILPTGGSTICRLGW

SEQ ID NO: 7031 - DNA, 363 bp, Unknown
  Obtained from environmental sample
  misc_feature (1)..(363): n is a, c, g, or t
atgaaagggaaaaagatgaaaaataaaattaaaattgatacatttgatatgatacttaactgtcaaactaaaatcaacacatacgcaagaatatttgaaaaatatggtttagatatagaagaacaagaacaaagagatttctttttaacatattcgatggatctattccatattacagcagaattacaagaagtattagatgaattagattcacctaatgaaattaatttatctgataaagaggtagaaatgtttcgattttttaaagagttggatgatgattatcaaacaaaacttcgtggtgaaatagtaagtgcagcagcagagaaaagaatacttaaaagggagcaagaaaatgagtag

SEQ ID NO: 7032 - protein, 120 aa, Unknown
  Obtained from environmental sample
  misc_feature (1)..(120): Xaa is any amino acid
MKGKKMKNKIKIDTFDMILNCQTKINTYARIFEKYGLDIEEQEQRDFFLTYSMDLFHITAELQEVLDELDSPNEINLSDKEVEMFRFFKELDDDYQTKLRGEIVSAAAEKRILKREQENE

SEQ ID NO: 7033 - DNA, 492 bp, Unknown
  Obtained from environmental sample
  misc_feature (1)..(492): n is a, c, g, or t
atgagtaactctgaaaatggatatagttatttctactatttaaagaatggtaaaattgataacgaaagaggaattcaaagaattactaattttatgttaaataatttttcagagataaataaagaggaaatcaaaaaagccaattggtttcaaaaactattttactggaaagatttagacgaaacaaaagctgttcaatacaaagaacgtgagaaagttaattttggaaatcaagtaagttgggtagaaagtccaatactaagaacatcgaaaattcactatgaattactacttaaaacacagacaccaaattcatatttttcatttattgggtataaatggagtgatttaaaagatgtgcctcttcataaaagatttggatatatgtatcatattgatagtgaaaagaaatcatctttgtattatgatgtcttaaagctaattattggtgcaatcataggttctttgtttacatattttataaaagattaa

SEQ ID NO: 7034 - protein, 163 aa, Unknown
  Obtained from environmental sample
  misc_feature (1)..(163): Xaa is any amino acid
MSNSENGYSYFYYLKNGKIDNERGIQRITNFMLNNFSEINKEEIKKANWFQKLFYWKDLDETKAVQYKEREKVNFGNQVSWVESPILRTSKIHYELLLKTQTPNSYFSFIGYKWSDLKDVPLHKRFGYMYHIDSEKKSSLYYDVLKLIIGAIIGSLFTYFIKD

SEQ ID NO: 7035 - DNA, 840 bp, Unknown
  Obtained from environmental sample
  misc_feature (1)..(840): n is a, c, g, or t
atgaaaaagtctgttaaagaagagcaaataaaacagacaactctaatagaaacagttacgggattagagattatcaagagtgtaaaagcacaaaacagaatgagaacaaactgggatcatagtgttggaaaaacagtacactatgcagataaaggacaatttttatctcaaagtataagtttttttactgcttttctttcgcagttttcaaacatagcaatagttgcaggtggagtttatttggcaagtaaaggtgatattacaatgggtgcaattattgctgccatgatgttaaacggaagaacaattgctcctgtttctcagttagtatctttaatagttagatatgacaaaacaatgctttccttgaataatttagatgaaattatgagaatgccagttgaaaaagataagaaaaattatattagtagaccagatttaaatggagatatagagtttaagaatgtagattttgcatataaagagagtaattatcaaattctaaaaaatctaaatttgacaataaaaagaggggaaagaattgcaattttaggaaaaattggaactgggaaatccactcttttaaaacttattatgaatttatatgagcccaaaaatggttcagttttagttgatggagttgatgtacgacaaatagaccctattgatttaagaagctctattggagttgtacctcaagagccatttttgtttatgggaacaataaaagacaatatcacaattggtgaacaatatgtatctgatgaagagttattgcaagtatcaaaagtagctggactagatgagttcttaggaaaacatgaggctggtttgatttaa

SEQ ID NO: 7036 - protein, 279 aa, Unknown
  Obtained from environmental sample
  DOMAIN (178)...(278): ABC transporter
  misc_feature (1)..(279): Xaa is any amino acid
MKKSVKEEQIKQTTLIETVTGLEIIKSVKAQNRMRTNWDHSVGKTVHYADKGQFLSQSISFFTAFLSQFSNIAIVAGGVYLASKGDITMGAIIAAMMLNGRTIAPVSQLVSLIVRYDKTMLSLNNLDEIMRMPVEKDKKNYISRPDLNGDIEFKNVDFAYKESNYQILKNLNLTIKRGERIAILGKIGTGKSTLLKLIMNLYEPKNGSVLVDGVDVRQIDPIDLRSSIGVVPQEPFLFMGTIKDNITIGEQYVSDEELLQVSKVAGLDEFLGKHEAGLI

SEQ ID NO: 7037 - DNA, 501 bp, Unknown
  Obtained from environmental sample
  misc_feature (1)..(501): n is a, c, g, or t
atgccttataaaaaagtgaaaacattgatacctgcatatattaggtatattccagctcttttacttatagcgttattttcattatttgtatatataaatgttgaacaaataatcaaatcaatgcaagatgatgctaatgttataaacactagtggtcgtcaaagaatgctttctcaaaacttagtactgcaaggattgaaatatttagataatccaactgacataaataaatcacgtttaaaaaaaagtatggaacttatgagaatttctcataaacatctaataagctatcataagagtgataaactaaacattatttattatgaaaaaaaactatctttaaaagtaaatgattttttagcaaaatttgatgattttctgaataataggaaagatcttattatagagttgtcttatgatgctcaagtcttacttccactactatcagaagctgttacagaatatgaaaatataaataaaatgaaagttaaaccactttag

SEQ ID NO: 7038 - protein, 166 aa, Unknown
  Obtained from environmental sample
  misc_feature (1)..(166): Xaa is any amino acid
MPYKKVKTLIPAYIRYIPALLLIALFSLFVYINVEQIIKSMQDDANVINTSGRQRMLSQNLVLQGLKYLDNPTDINKSRLKKSMELMRISHKHLISYHKSDKLNIIYYEKKLSLKVNDFLAKFDDFLNNRKDLIIELSYDAQVLLPLLSEAVTEYENINKMKVKPL

SEQ ID NO: 7039 - DNA, 909 bp, Unknown
  Obtained from environmental sample
  misc_feature (1)..(909): n is a, c, g, or t
atggccggggggagactcgtactagctgtgacagctgtgcttacgcagcgaatgtcgaaaaagccgaagccgcttttcgatacacaaaaaaatggcgacgaacttttatcactcgagattctggatacgcctgatgcaaagaccatggaagatcttgagaagcttgatttgcctaagcgtcttggtatgaagagcattctctatatggtggattctgacccagtagcggtttttattcgtggtgatcttgatgtaaatgaaataaaattgggcaatattcttccggcagacacactttttcgtccaatgaccgaagccgaagtggttgagtttactggctcggaacgtggctctatcgggccacacgagctcaatgacaaaatcaaaatttactatgatctttcgacgcgtgatcttacaaatttcactattggtgcgaatgcgatcgataagcacaagatcaacgtcaactgggagcgcgacctgccacgtccggaaaaatactatgatttgcgtactgtgaaagccggagattgttgttcacactgtgctgacggcaagtttgtcgaagcgcgcgggattgaagttgggcatatttttcagcttggcacgaagtattcggaaatcatgaattgcacttttaccgacgaagacggtaaagaaaaactctgccacatgggaacttatggtattggtatttcacgtctagcacaggccgtgatcgaagctagccacgatgagaatggtattatttggccagaagaaatcgcaccattttcagtgcacctggtcggtttaaagcttgaccaagaagacacaaaaaccgctgtccataaatttataatgagctttgttctgcagggattgaagttctttacgatgaccgccccccccccttggtccgggtga

SEQ ID NO: 7040 - protein, 302 aa, Unknown
  Obtained from environmental sample
  DOMAIN (45)...(191): YbaK / prolyl-tRNA synthetases associated domain
  misc_feature (1)..(302): Xaa is any amino acid
MAGGRLVLAVTAVLTQRMSKKPKPLFDTQKNGDELLSLEILDTPDAKTMEDLEKLDLPKRLGMKSILYMVDSDPVAVFIRGDLDVNEIKLGNILPADTLFRPMTEAEVVEFTGSERGSIGPHELNDKIKIYYDLSTRDLTNFTIGANAIDKHKINVNWERDLPRPEKYYDLRTVKAGDCCSHCADGKFVEARGIEVGHIFQLGTKYSEIMNCTFTDEDGKEKLCHMGTYGIGISRLAQAVIEASHDENGIIWPEEIAPFSVHLVGLKLDQEDTKTAVHKFIMSFVLQGLKFFTMTAPPPWSG

SEQ ID NO: 7041 - DNA, 957 bp, Unknown
  Obtained from environmental sample
  misc_feature (1)..(957): n is a, c, g, or t
ttgttttnnnnnnnggattatggccgaggaccttgctgttttgcatgtatgaatgcaagtgcaaagagtttagtatctacaaatagtgattgtattgcagcaggactaaatttaaaaaaagcattaacattaactcctttagaacttaactcaattatattaaagcttgaggataaatatccccttttagcaaaagagctaaaagttataaactcccctatcccctttacaaagcttgtttcatcttcaaaagatataatttatgatttatatttaaatgcaataaatagttttttatatgataaattaaattatagattacctaataaaactattcaaaaaataaaagatgacaaaaggtttgaaaagcttttatctttagttatctctaatgcaagacttaattttttacaatcaagttttttagactttgatgattctggttatagttataatatttcatttaaattggctttaaatagagttttaaacaaaaaacttgatgaacaaacgacaaaatactttcaaaatgccctctcaaaagcactttttcaatatgaaaaagacaaagttaacttttggctttatttactaaataaagattctattagtttgaacgctttaaaagaatctactgattcaaatatttataccttatatacaaaacagctattaaaagaagctattcaaatagatgatagttttaagactttaaattatgattttttaaagaaatgttcaaatgagaaaaaaatactcattaattcatatgccaaaaccttaagttcttttgatgaaaataaaatctctttagagtttgagttaggattaatgcaaatagatttaagaaaagctgatctaatttctatatntaataatcttgatgcanaaagagatgaattatttaattccaagganaaatnatctttattaaatctatatttttcaatgaattaa

SEQ ID NO: 7042 - protein, 318 aa, Unknown
  Obtained from environmental sample
  misc_feature (1)..(318): Xaa is any amino acid
MFXXXDYGRGPCCFACMNASAKSLVSTNSDCIAAGLNLKKALTLTPLELNSIILKLEDKYPLLAKELKVINSPIPFTKLVSSSKDIIYDLYLNAINSFLYDKLNYRLPNKTIQKIKDDKRFEKLLSLVISNARLNFLQSSFLDFDDSGYSYNISFKLALNRVLNKKLDEQTTKYFQNALSKALFQYEKDKVNFWLYLLNKDSISLNALKESTDSNIYTLYTKQLLKEAIQIDDSFKTLNYDFLKKCSNEKKILINSYAKTLSSFDENKISLEFELGLMQIDLRKADLISIXNNLDAXRDELFNSKXKXSLLNLYFSMN

SEQ ID NO: 7043 - DNA, 519 bp, Unknown
  Obtained from environmental sample
  misc_feature (1)..(519): n is a, c, g, or t
atggagatctatgaacaatttttatcaattattttatttacttttttatttttattaagtggctgtagttcttattctataactaaatattttgataaagatgacttttatttaaactctttacaatacacaaaaaaagctgatatcataaaagatgaagaagtagtcgcgctatttacggcaacttatttaaatgaagttgaagagaagtatgataataattatgaaaactttatagtttctgtttatgtagcaaataataaaaaaagtgaaacaccaaacataactattgataaacaaagttatacgcaagaagaattagaagatgagaaaaactatgaaaaaaattatatagagataaaagaaatagaaaaagagtcaaaactaatagaatctatacctcttaaaaatccatgggcaaaatattatttaatcaaatttgaaaagaatgatgatttagaaaacttcttattaagatatagacttaatcaaaatctaaaggctgaaataagtttttaa

SEQ ID NO: 7044 - protein, 172 aa, Unknown
  Obtained from environmental sample
  misc_feature (1)..(172): Xaa is any amino acid
MEIYEQFLSIILFTFLFLLSGCSSYSITKYFDKDDFYLNSLQYTKKADIIKDEEVVALFTATYLNEVEEKYDNNYENFIVSVYVANNKKSETPNITIDKQSYTQEELEDEKNYEKNYIEIKEIEKESKLIESIPLKNPWAKYYLIKFEKNDDLENFLLRYRLNQNLKAEISF

SEQ ID NO: 7045 - DNA, 858 bp, Unknown
  Obtained from environmental sample
  misc_feature (1)..(858): n is a, c, g, or t
ttggagttgaagaagagttgggggatgtttttttcaatacatcaaagcagtctatacgagtcatttttaaatatattaaataactttcaagacgaaaattatcaactgtttataaataagatttntgaggtaaaagatattaaaaatcttttacagatttatcatgtcactatttcaaatgatagaaaagaagttttaaaaactaaaatattaaactttgattttaaaagtgcggaatttcataattatcatgatttgcaaactagtataaactttgcactaaaccataattttaatgaaatagcaaacaccttagttgaaaaatacaaagaagcattagaagatgagaaacatgagttattaaaaagagaaagtcttaaaaaagaagactcaaagattgatgaaaaaaaagatgccaacacgattaggataaatctaaaagatgtattaaaatcaaagatacaagcatttgaacaactcaaatataaaaaagatttagtagatatttaccatgatggatctaaaaccttagaagaaaaactagaagcaataaacagattaaatttaccatcaataaatacaaaaagttttagagacaatgaacttcaactagagctatcaggctataaaggtttcataacagcattgattcatttagatgaaaagcagcctttagttgcatatgagattttaagaagattaaaccaaaacaaacctaatcatcaatatttaatcaatatgctaagagcttattatgaagctcataaagatgatgcaaataaaaaagagaaattgaacatattattgcagagtataaaaagcttgaagaaaaatagaaaatataatagccagcgataa

SEQ ID NO: 7046 - protein, 285 aa, Unknown
  Obtained from environmental sample
  misc_feature (1)..(285): Xaa is any amino acid
MELKKSWGMFFSIHQSSLYESFLNILNNFQDENYQLFINKIXEVKDIKNLLQIYHVTISNDRKEVLKTKILNFDFKSAEFHNYHDLQTSINFALNHNFNEIANTLVEKYKEALEDEKHELLKRESLKKEDSKIDEKKDANTIRINLKDVLKSKIQAFEQLKYKKDLVDIYHDGSKTLEEKLEAINRLNLPSINTKSFRDNELQLELSGYKGFITALIHLDEKQPLVAYEILRRLNQNKPNHQYLINMLRAYYEAHKDDANKKEKLNILLQSIKSLKKNRKYNSQR

SEQ ID NO: 7047 - DNA, 876 bp, Unknown
  Obtained from environmental sample
  misc_feature (1)..(876): n is a, c, g, or t
ttgaagaatatgaaactaataaacncctcttatcataggtattttgacataactagaattccagaaagctttgataaatattttgatatttacaaatttttcaaagagaaaagaagtgaaggttttttatttgaaatatttagtgagaacataaaatcttcatttatttggtatttgataaagcaggaagtatctcggtcatattattataacaatgactcttactcaagaataaataagcttttaaatgaactaaaagaagattatttagtaattggagagatattaagtagtgaagatataaggtttaatacttatttgttatcaaattcacagtattgctattatggttttttaaatatagttactatgcatattcatctaaataatttaagcgacgaatacgcaactgattataatgaacaatggcttgaactaatatctaatcaaactgtagatatatttatttcaactttgctacataatgataaaaatggcataataaaaatagttttttgtgtaattgattttttggttcatgagtatttcaaaaaaaaacaaaagtttgtaactttatctttagagaagtttttaaataagctaagttcattagtcttaaaagataatacattcctttttaattctattattgataagttagttgaaggacaaataaagatattagagcaagatgatagtattcaagaagattcttattttattttgaattggtatttaaaaaatcttgatagaagagaaaaaattgatgatataggttataataatttaaaaggaaagattacaagtagcatctatgaaaatataaaaaaagtgtttataaaaagtatagagaataaaatattttcatgttattag

SEQ ID NO: 7048 - protein, 291 aa, Unknown
  Obtained from environmental sample
  misc_feature (1)..(291): Xaa is any amino acid
MKNMKLINXSYHRYFDITRIPESFDKYFDIYKFFKEKRSEGFLFEIFSENIKSSFIWYLIKQEVSRSYYYNNDSYSRINKLLNELKEDYLVIGEILSSEDIRFNTYLLSNSQYCYYGFLNIVTMHIHLNNLSDEYATDYNEQWLELISNQTVDIFISTLLHNDKNGIIKIVFCVIDFLVHEYFKKKQKFVTLSLEKFLNKLSSLVLKDNTFLFNSIIDKLVEGQIKILEQDDSIQEDSYFILNWYLKNLDRREKIDDIGYNNLKGKITSSIYENIKKVFIKSIENKIFSCY

SEQ ID NO: 7049 - DNA, 549 bp, Unknown
  Obtained from environmental sample
  misc_feature (1)..(549): n is a, c, g, or t
ttgaacaacatggcaaaagaagaacaagataaaatattggacgaggtaacacagagcgactataagtacggctttgttaccgatattgaaaatgatgatataggcaaaggtcttaatgaggatgttattcgtttgatatcgtctaaaaagaatgaacctgaatttatgcttgaatatagattgaaagcatatcgtcattggttaacgatgaaaatgccagagtgggcatacttgaagatacctccaatcgattaccaggatattatttactattcagctccaaagcaaaaagcgaagctagatagcatggatgatgtggacccagagattagagctactttcgataaattaggaattcctttggatgaacagaaactattgtcgaatgttgcagtagatgtggtgatggattcatcatcagtaaaaacgacttttaaagaagctttggctganaaaggagttattttctgctcctttagtgatgcagttcaggagcatccagatttgattncagaatatatggggaacagttgtttctattcaagataa

SEQ ID NO: 7050 - protein, 182 aa, Unknown
  Obtained from environmental sample
  misc_feature (1)..(182): Xaa is any amino acid
MNNMAKEEQDKILDEVTQSDYKYGFVTDIENDDIGKGLNEDVIRLISSKKNEPEFMLEYRLKAYRHWLTMKMPEWAYLKIPPIDYQDIIYYSAPKQKAKLDSMDDVDPEIRATFDKLGIPLDEQKLLSNVAVDVVMDSSSVKTTFKEALAXKGVIFCSFSDAVQEHPDLIXEYMGNSCFYSR

SEQ ID NO: 7051 - DNA, 351 bp, Unknown
  Obtained from environmental sample
  misc_feature (1)..(351): n is a, c, g, or t
atgtgtgatctttcagtaattatcccggtacataacgatgagaataaccttaaaaaattgtatgctcagttagaacgagagctgcttaacctcacatctaaatatgaaatagtgtttgtggaaaatggaagcaaggatgctacatttaaaatccttagcgagatacgagattctaataagagagttaaacttcttaaactaacttcaaattttggtttatcgaaagctattacagctggaatggaacatagctgcggtgatgctatcgtcattatggatgcaggtatgtattatcttcccaaagatatttcggctctattggaaccattcaagcttacgatgttcctatga

SEQ ID NO: 7052 - protein, 116 aa, Unknown
  Obtained from environmental sample
  misc_feature (1)..(116): Xaa is any amino acid
MCDLSVIIPVHNDENNLKKLYAQLERELLNLTSKYEIVFVENGSKDATFKILSEIRDSNKRVKLLKLTSNFGLSKAITAGMEHSCGDAIVIMDAGMYYLPKDISALLEPFKLTMFL

SEQ ID NO: 7053 - DNA, 855 bp, Unknown
  Obtained from environmental sample
  misc_feature (1)..(855): n is a, c, g, or t
atgacttttaatgagaagattccgggtgtaacagctttgatttcgataacctccgcctgcatttataactgcgaacactgctaccagaaacttgataaaggaaaagacagcgatatcgacattttggtttctgtagttaaaaaactacaagatatgggaattgccttcttcaacttggaaggtggtgaaccatttatggtattcgagcgtctactgaaagtatgcagtgtgattgatgagcgctccgagatttggataaactctaccggttatggcataactctggataaattacaacagcttaaaaagctgaatgtaacagctatcatgttctctctccattctgacaaacccgatgatatgaacagcttcttgaaatcggaaacggcctggcagacgatggaaaaggccatagctctttgccatcaggttggaattgccgtagccttcaatacctgcttgttccgtgaagatttttataacggcaagcttgaaaaggtgcttgaaaagatgaaagattttggtgcttctattgtgcaggtgataaaacctaaaccggctggaggctggctggaaagtggagtcgaacagtttagtaaaaaagatatagcgcaggttaataaaaaagttaatatgtacaatctggataagaagtaccaggattatcccgctatttctgcccaaattatggaagaaaataaaaatatgttcggctgtactgccggtggaacagatcgtttttaccttaatgccaaaggtgatattcaaccttgtgaattcgtttatgtctctttcggtaatatccataatgaggattttctagcaatttatgaaagaatgcgtatacatttttga

SEQ ID NO: 7054 - protein, 284 aa, Unknown
  Obtained from environmental sample
  DOMAIN (14)...(171): Radical SAM superfamily
  misc_feature (1)..(284): Xaa is any amino acid
MTFNEKIPGVTALISITSACIYNCEHCYQKLDKGKDSDIDILVSVVKKLQDMGIAFFNLEGGEPFMVFERLLKVCSVIDERSEIWINSTGYGITLDKLQQLKKLNVTAIMFSLHSDKPDDMNSFLKSETAWQTMEKAIALCHQVGIAVAFNTCLFREDFYNGKLEKVLEKMKDFGASIVQVIKPKPAGGWLESGVEQFSKKDIAQVNKKVNMYNLDKKYQDYPAISAQIMEENKNMFGCTAGGTDRFYLNAKGDIQPCEFVYVSFGNIHNEDFLAIYERMRIHF

SEQ ID NO: 7055 - DNA, 558 bp, Unknown
  Obtained from environmental sample
  misc_feature (1)..(558): n is a, c, g, or t
atgcgcgccatggaaaaggttcttgtttccgccaggcccgtcatctgtccccacgatgttaaaggcatgagggtaaggatttatgactccgagacccttgcccaattctgggaaaccatgggggctattccagtaaagataccctggtcaggggttagggacgccttaaaacacaatatagtggatatagtccccaccatgaaagccctggtttaccataacgattattgcaaatatgcacgatatattaccctgttgggtgatatgcccagcattttgggggttttcatttcagaagaaaaatatcaatctttttctcctgatattcaaaaatccttaaaaaaagcctgtgacaatgcaggtgaaatgttttctcataatgtggttttatgggaaacgaaaaatgaagtattaaacctgaagcattatggggtggcttaccttaaagtggataaacttccctggcgtcttaaaatgcttgaaataaaaaaaacaatgatggaccaggggaaattgtgcaaacaggcctggcaggagattgaaacggcctgttcataa

SEQ ID NO: 7056 - protein, 185 aa, Unknown
  Obtained from environmental sample
  misc_feature (1)..(185): Xaa is any amino acid
MRAMEKVLVSARPVICPHDVKGMRVRIYDSETLAQFWETMGAIPVKIPWSGVRDALKHNIVDIVPTMKALVYHNDYCKYARYITLLGDMPSILGVFISEEKYQSFSPDIQKSLKKACDNAGEMFSHNVVLWETKNEVLNLKHYGVAYLKVDKLPWRLKMLEIKKTMMDQGKLCKQAWQEIETACS

SEQ ID NO: 7057 - DNA, 489 bp, Unknown
  Obtained from environmental sample
  misc_feature (1)..(489): n is a, c, g, or t
atgcgcttttggttcgcatttatctctccatactttaaaggaatcaaagagggcgattacaaagaggtattggctaattacactaatcgtaaaggtgaattttcagatcttatattccagcagttatcacaagagctactaaaacagagcttcaaagatgaccctattacagaggtaggaagctactgggataaaaatgcagagatagatattttggctaaaaccgcatctggcaaactaatcgcaggctcatgcaaatactcaaatgcaaaagtaaaaaagagtgaactcacaaaactaaaagagaacgctgaacgtgcagaactagaaccagacatcttcgtcatatttgccaaaaacggcttctcaaatgagctaaaaactctaaaaggtgaagagttaaaactatttacacttaaaaacttcaaaagcttcatggaagatctaagtcaaaaagatttgattaaaagttttggtaagaagtactaa

SEQ ID NO: 7058 - protein, 162 aa, Unknown
  Obtained from environmental sample
  DOMAIN (4)...(95): Archaea bacterial proteins of unknown function
  misc_feature (1)..(162): Xaa is any amino acid
MRFWFAFISPYFKGIKEGDYKEVLANYTNRKGEFSDLIFQQLSQELLKQSFKDDPITEVGSYWDKNAEIDILAKTASGKLIAGSCKYSNAKVKKSELTKLKENAERAELEPDIFVIFAKNGFSNELKTLKGEELKLFTLKNFKSFMEDLSQKDLIKSFGKKY

SEQ ID NO: 7059 - DNA, 951 bp, Unknown
  Obtained from environmental sample
  misc_feature (1)..(951): n is a, c, g, or t
atgaaaacatttgaagttgtaactgagactactactaaacttataaatcaaaaaagtgtaaaggctgttttggagtacttgaagtatctttactttggtgaagatatttatagacataacttttttgctcttataaatcaagaaatcagagatataccaaaaatcaatctgacaaaaacaaagctacttagacttataaaaaatgttatagctgaatatagactttttagtgatgattttcatcttatacgttttttagatgttgtaggaaaatatgaagatattgaagcacttttgtttgagtatgaaagactagatgccagtggtgctgcatctgaccttaacggtgtaagagttcttactattcataagtcaaaaggtttggaatatggacatgttatagttatggacagactcaaaaaagctccacctgcaagagatgccataatctacgagtacgagggtataaaactacaagatgtttaccttcgtataaaaggcagagatgccatagatgccgagtatgatgaagcacttggtaaagagaagtatttggctaaggaagattctctcaatgctctgtatgttgcttttacaagagcgagagaaaacctgtttgtaatagtaaaatctaaagattctacctttgagatgctaaatttagtaccgcaaagcagtggagaacttgtctgtaaaagtcataacaaaactcttcaaccgagtctggcatctaaggcttttgagtacaaagaattagcttacggaattcagagtgatattttaaaacttgaagaaaatgatgatgaagatttaaaagctataaactttggtttggcacttcactatatgttggagatgcttgggagttttaagactcaaagtatttcaaacgctaaagacataatgataaacaaatatggatattcttacaagcccaagactcagccataa

SEQ ID NO: 7060 - protein, 316 aa, Unknown
  Obtained from environmental sample
  misc_feature (1)..(316): Xaa is any amino acid
MKTFEVVTETTTKLINQKSVKAVLEYLKYLYFGEDIYRHNFFALINQEIRDIPKINLTKTKLLRLIKNVIAEYRLFSDDFHLIRFLDVVGKYEDIEALLFEYERLDASGAASDLNGVRVLTIHKSKGLEYGHVIVMDRLKKAPPARDAIIYEYEGIKLQDVYLRIKGRDAIDAEYDEALGKEKYLAKEDSLNALYVAFTRARENLFVIVKSKDSTFEMLNLVPQSSGELVCKSHNKTLQPSLASKAFEYKELAYGIQSDILKLEENDDEDLKAINFGLALHYMLEMLGSFKTQSISNAKDIMINKYGYSYKPKTQP

SEQ ID NO: 7061 - DNA, 318 bp, Unknown
  Obtained from environmental sample
  misc_feature (1)..(318): n is a, c, g, or t
atgagtgattttttaaaaagtaaagataataatttatatgaactaatagcatttgctatcatgcctaatcatattcatatacttataaaaccaatggacaaattggcgttagttttacaaaatataaaaggttcaagtgcaaagataattaatgatattctcaaaagaagaggtaagttctgggctaatgattattatgataaaactataagagatgaaaaacattttcagacagtgtataattacattaaaaataatcctgtgaagttgggcgaggctgaagcctcacttccaaggttctacggaatatatgaatga

SEQ ID NO: 7062 - protein, 105 aa, Unknown
  Obtained from environmental sample
  DOMAIN (17)...(65): Protein of unknown function (DUF1568)
  misc_feature (1)..(105): Xaa is any amino acid
MSDFLKSKDNNLYELIAFAIMPNHIHILIKPMDKLALVLQNIKGSSAKIINDILKRRGKFWANDYYDKTIRDEKHFQTVYNYIKNNPVKLGEAEASLPRFYGIYE

SEQ ID NO: 7063 - DNA, 306 bp, Unknown
  Obtained from environmental sample
  misc_feature (1)..(306): n is a, c, g, or t
atgaattattacataactatacttacacattactattgtagggtgaatatgaataaaaaaattaatgatttaactgctgatgaattgcataaattaattggtgccaatgttgcaaaactgcgaaaaaaagctaatttaagtcaattagctctgtcattagagatgggaaataaatctccaagtcttgttagttctgctgaactatatacaaataaaagacattttaatattgtgcaacttcaaaagattgcaaagattttagatattgatatttgtgagttttttgatgatagtacaataggctaa

SEQ ID NO: 7064 - protein, 101 aa, Unknown
  Obtained from environmental sample
  DOMAIN (37)...(94): Helix-turn-helix
  misc_feature (1)..(101): Xaa is any amino acid
MNYYITILTHYYCRVNMNKKINDLTADELHKLIGANVAKLRKKANLSQLALSLEMGNKSPSLVSSAELYTNKRHFNIVQLQKIAKILDIDICEFFDDSTIG

SEQ ID NO: 7065 - DNA, 315 bp, Unknown
  Obtained from environmental sample
  misc_feature (1)..(315): n is a, c, g, or t
atgattaaaatagaaaagattatcgattattctttgattaaaaataaagatatttttaatcaattaataaaacaaagagaaaagaaaatagatgttactattggatttgaacaatttaatattgaggatagtcataaagaagaatatattaaaaatttaaactatttaccagaactatatgaagatataaaagccaaaaagagaaataatgttgagaactttatatttatattaaaagagtatctatcagctagagaaatattagtagagaaaaaagatatcaaaacttcagaatatatttatagattattttag

SEQ ID NO: 7066 - protein, 104 aa, Unknown
  Obtained from environmental sample
  misc_feature (1)..(104): Xaa is any amino acid
MIKIEKIIDYSLIKNKDIFNQLIKQREKKIDVTIGFEQFNIEDSHKEEYIKNLNYLPELYEDIKAKKRNNVENFIFILKEYLSAREILVEKKDIKTSEYIYRLF

SEQ ID NO: 7067 - DNA, 393 bp, Unknown
  Obtained from environmental sample
  misc_feature (1)..(393): n is a, c, g, or t
atgtcagatgaatttacggagatgttaactaggtattatttatatgcatgtgaggaatctaaaatgacctgctatatttcaaaaaacaattataatttcaaaaatctgctaaaaaaagattcgaattttaaagagatatatctattggggaaaggtgaagtaggactacaactaaaaaaatttttagccgataaaaacataccgataaaaggttttattgatgatatcaaaaatggtaaaaatataatcagccttgatactttaggtaatatacaaacaaaagatactatggttattatttgctcttacaaaagccaacatatacataatatatacaaaaaacttatatctattaataaaaaagattgtttgatatacgaacttgtgaactaa

SEQ ID NO: 7068 - protein, 130 aa, Unknown
  Obtained from environmental sample
  misc_feature (1)..(130): Xaa is any amino acid
MSDEFTEMLTRYYLYACEESKMTCYISKNNYNFKNLLKKDSNFKEIYLLGKGEVGLQLKKFLADKNIPIKGFIDDIKNGKNIISLDTLGNIQTKDTMVIICSYKSQHIHNIYKKLISINKKDCLIYELVN

SEQ ID NO: 7069 - DNA, 858 bp, Unknown
  Obtained from environmental sample
  misc_feature (1)..(858): n is a, c, g, or t
gtgattgatggtcataaaagtgcagcaggtggtactgtaccatttctaaaaatcacaaatgatattgcaattgcagttgaccaactaggaactagaaaaggggcaattgctgtttatctagagccctggcatatggatattgaagatttcattgacctaaagaaaaactcaggggaagagagacgaagagcacacgatctatttccagcactttggataaatgacctttttatgaaaagagttattgcagatgaacattggacactttttgatccttatgaagtgaaagatttagcagagcttacaggtgaagcttttgaaaaaagatatgaagagtatgaaaatgatgattctataacaaaagagcagatgaaagcaaaaagcttatggaaaaaagttcttacctcttattttgaatcgggaagcccatttttatgttttaaagataatgcaaatagagcaaacccaaatgaccacacaggatttatacgaagtagtaacctttgtacagagatattccaaaacacaaatccaaatcactatttagtaaaaatagaactagaagatggagagattctaacttatgaagaagatgatacagttactgtagatagtggtatggtaaaaaaagcaaacaaaatcacagcgcttgatagcttaaatggtaaaaaaatctttattgtagaaaaagagaaaattgatggagatacagctgtttgtaacttagctagtgtaaacttaagtaaaatcaatacaaatgaagatattcaaagagttcttcctacagcaattagaatgcttgacaatgtaattgacctaaacttctacccacttagaaaagtaaaagcaacaatctaa

SEQ ID NO: 7070 - protein, 285 aa, Unknown
  Obtained from environmental sample
  DOMAIN (1)...(283): Ribonucleotide reductase, barrel domain
  misc_feature (1)..(285): Xaa is any amino acid
MIDGHKSAAGGTVPFLKITNDIAIAVDQLGTRKGAIAVYLEPWHMDIEDFIDLKKNSGEERRRAHDLFPALWINDLFMKRVIADEHWTLFDPYEVKDLAELTGEAFEKRYEEYENDDSITKEQMKAKSLWKKVLTSYFESGSPFLCFKDNANRANPNDHTGFIRSSNLCTEIFQNTNPNHYLVKIELEDGEILTYEEDDTVTVDSGMVKKANKITALDSLNGKKIFIVEKEKIDGDTAVCNLASVNLSKINTNEDIQRVLPTAIRMLDNVIDLNFYPLRKVKATI

SEQ ID NO: 7071 - DNA, 531 bp, Unknown
  Obtained from environmental sample
  misc_feature (1)..(531): n is a, c, g, or t
atgctccatggaataagttctaaaaatttccctgaatttaatttctgcgggtatgaacagaaggtcgtcgttgccttttcttttggtgtttttctttccggaattattcctttaaacgctgatgaaaactttgcttttaatggaactttaaaaccagttgacaacaagcacggaatcagagaaattatctttaaaaaaactctcgagaacctaagtcctgaaacctacagacggtttattagcaatatgtttgaaaatgatgaagactccctccgattctttggaaacagatcagaccccgacatcgcagaactaaagcaagagcttgtatttattgacaaattgtcgcaaaaccataatgttgaaaaaacatttaacaaagcatttatttcaaagaacgacagaatatttacatataataatcaggttaaattctggtcagatacaaaaaccgagatagttgactgcggacacttccccttttacaatttttcaagctgggatgagatagttaagcaatgcagaaaatag

SEQ ID NO: 7072 - protein, 176 aa, Unknown
  Obtained from environmental sample
  DOMAIN (1)...(170): Protein of unknown function (DUF452)
  misc_feature (1)..(176): Xaa is any amino acid
MLHGISSKNFPEFNFCGYEQKVVVAFSFGVFLSGIIPLNADENFAFNGTLKPVDNKHGIREIIFKKTLENLSPETYRRFISNMFENDEDSLRFFGNRSDPDIAELKQELVFIDKLSQNHNVEKTFNKAFISKNDRIFTYNNQVKFWSDTKTEIVDCGHFPFYNFSSWDEIVKQCRK

SEQ ID NO: 7073 - DNA, 429 bp, Unknown
  Obtained from environmental sample
  misc_feature (1)..(429): n is a, c, g, or t
atgcagaaaatagataaggaactggtaaaaaatagattcaaaaattcactgaaagattataattcttcggctcatgttcagaaaattatggcttttgaacttgtaaacaaactcaacgaaacaaattcctcatttcaaagagttttcgagattggttgcgggacaggaattctgacaaaagagatttataaaaacctgaatttttctgaatttttctgcaacgatctttccgaggaaacttttgattttatcaaacctttctgcaaaattgagaatttcctaacctttgatggggaagataccgaaatgtatcctaagaataatgatcttattatttcaagtgctgtttttcagtgggttgaggatctgccaaactttttaaacagagtttcagaccatcttaaaaaaatgggcctgatcgctttttca

SEQ ID NO: 7074 - protein, 143 aa, Unknown
  Obtained from environmental sample
  misc_feature (1)..(143): Xaa is any amino acid
MQKIDKELVKNRFKNSLKDYNSSAHVQKIMAFELVNKLNETNSSFQRVFEIGCGTGILTKEIYKNLNFSEFFCNDLSEETFDFIKPFCKIENFLTFDGEDTEMYPKNNDLIISSAVFQWVEDLPNFLNRVSDHLKKMGLIAFS

SEQ ID NO: 7075 - DNA, 669 bp, Unknown
  Obtained from environmental sample
  misc_feature (1)..(669): n is a, c, g, or t
atggcttttgaacttgtaaacaaattcaacgaaacaaattcctcatttcaaagagttttcgagattggttgcgggacaggaattctgacaaaagagatttataaaaacctgaatttttctgaatttttctgcaacgatctttccgaggaaacttttgattttatcaaacctttctgcaaaattgagaatttcctaacctttgatggtgaagataccgaaatgtatcctaagaatattgatcttattatttcaagtgctgtttttcagtggtttgaggatctgccaaactttttaaacagagtttcagacaatcttaaaaataatggcctgatcgctttttcaacttttggaggagatcaatactctgagattagagaaattactggaaattgcctcaaatactacacaaaagaagaactccttaactctatcagctcgaaatacgaacttttgctttttactcagtggaaagaagtgatggattttagctcagtaaaagagatcatgtctcatattaaggcaacaggcgtttcaggagtcggattaaaaaccaccaaaaaaatgcctcttaccgagtttcgcaaaaaatatcgtgagaaattcctaaaaaacgatgtgctaccacttacatataatccacaggtctggatattaaggagaaaagcatga

SEQ ID NO: 7076 - protein, 222 aa, Unknown
  Obtained from environmental sample
  misc_feature (1)..(222): Xaa is any amino acid
MAFELVNKFNETNSSFQRVFEIGCGTGILTKEIYKNLNFSEFFCNDLSEETFDFIKPFCKIENFLTFDGEDTEMYPKNIDLIISSAVFQWFEDLPNFLNRVSDNLKNNGLIAFSTFGGDQYSEIREITGNCLKYYTKEELLNSISSKYELLLFTQWKEVMDFSSVKEIMSHIKATGVSGVGLKTTKKMPLTEFRKKYREKFLKNDVLPLTYNPQVWILRRKA

SEQ ID NO: 7077 - DNA, 804 bp, Unknown
  Obtained from environmental sample
  misc_feature (1)..(804): n is a, c, g, or t
ttgcttggaagtagtcgtgcgacatatattaatacaaaaagtctgcatgataaagtttttaactttgctgttaacgcaatatctgttgacgaatatgataatataatacaaaattttattcaaataacaggcaatatccctaaaaaaatttatataggtgttgatcctttttctttcggtagtgtacaaaatgttcaggtcaaaaaagctttaaaaaacacagaagatatattttatccttataaaagtttaatttctctggatatatttacagtgtcattaaagaatctcgtgtttacatataaattcaatcgaaatatgtatgacagaaaacaaaggttttatgataaaaacatgctaaaaggtattcaagttaaaaataatatttcaaacgaacgatatattttagcttcacaaggatacattttaaaaatacaaaataatattaatttaaaagttcttcaaaatctaaaaaaaaagtatagaaaaagtaaatttgtaatttttacaatgcccgttcataatgtgatatataaagatataaaagatcaaaaaaattattctttatggcttgaaagtttggttgaaatttttggtaaagtttatcacttcatgtatgaaaatgaaatttcaaaaagtaattatactttttttgacgcttttcatttttatcctattattggaaataaaatgttaaatgtaatatctgatgatgctaaaacagatataaatgataattttggtattatactgaataagacaaatattgatgactatctccaaacattacaatctaaggaataa

SEQ ID NO: 7078 - protein, 267 aa, Unknown
  Obtained from environmental sample
  misc_feature (1)..(267): Xaa is any amino acid
MLGSSRATYINTKSLHDKVFNFAVNAISVDEYDNIIQNFIQITGNIPKKIYIGVDPFSFGSVQNVQVKKALKNTEDIFYPYKSLISLDIFTVSLKNLVFTYKFNRNMYDRKQRFYDKNMLKGIQVKNNISNERYILASQGYILKIQNNINLKVLQNLKKKYRKSKFVIFTMPVHNVIYKDIKDQKNYSLWLESLVEIFGKVYHFMYENEISKSNYTFFDAFHFYPIIGNKMLNVISDDAKTDINDNFGIILNKTNIDDYLQTLQSKE

SEQ ID NO: 7079 - DNA, 303 bp, Unknown
  Obtained from environmental sample
  misc_feature (1)..(303): n is a, c, g, or t
ttgactgaattcaatatttatcaatctgatgatggattagacgcgattgataaaatgaaaaataaagatatcaatattatatttttagactggaatatgccaaatatggatggtgaggaagttgttgatgtgattcgttctaataaagaatggaataatacacgtatagttatggctaccacagaaggcaccaaagacaaggtacttaagataatgaagaagggtgtaaatggctaccttcgaaagccgatcacgcaaaggagtagttttaaaatattacaaacacttaccggaagaatgtaa

SEQ ID NO: 7080 - protein, 100 aa, Unknown
  Obtained from environmental sample
  DOMAIN (1)...(100): Response regulator receiver domain
  misc_feature (1)..(100): Xaa is any amino acid
MTEFNIYQSDDGLDAIDKMKNKDINIIFLDWNMPNMDGEEVVDVIRSNKEWNNTRIVMATTEGTKDKVLKIMKKGVNGYLRKPITQRSSFKILQTLTGRM

SEQ ID NO: 7081 - DNA, 414 bp, Unknown
  Obtained from environmental sample
  misc_feature (1)..(414): n is a, c, g, or t
ttgactggcactctaaagcntatcctttcatataaaatttctaactcaatggatgcaacacttgcaactgatgtacttgaagaagctcttgcaaagtatcctaagcctcaaatatttaattctgatcaaggtagtcagtacaccagctacgagcatactcagctactgaaaaagcatgatattcaaatatcaatgaacggaaaagcaagaagtatccataatatagtcattgaaaggtttttcagaactctaaaacacggcaatatctatatcaatgattatcaaacaattagagatttaaaagaaggagttaaagcatatatttacaaatacaattttaaaagatttcactcaagtttagattatagaaaatctatgaatgtttatcttgaatatctaaaaagcgtaggataa

SEQ ID NO: 7082 - protein, 137 aa, Unknown
  Obtained from environmental sample
  DOMAIN (2)...(130): Integrase core domain
  misc_feature (1)..(137): Xaa is any amino acid
MTGTLKXILSYKISNSMDATLATDVLEEALAKYPKPQIFNSDQGSQYTSYEHTQLLKKHDIQISMNGKARSIHNIVIERFFRTLKHGNIYINDYQTIRDLKEGVKAYIYKYNFKRFHSSLDYRKSMNVYLEYLKSVG

SEQ ID NO: 7083 - DNA, 504 bp, Unknown
  Obtained from environmental sample
  misc_feature (1)..(504): n is a, c, g, or t
atgcaacatacaaaacacatagcgtttaaggttttattggtactgtttttagcaagtccttttattggattggcacaatatgatattcctgacaaaccagaatttcaaactagtgtttatgatgatgagataaagttattgtcttcatcagaaaaaagcaacttagaacgtaaacttattcgttattctgattctacctcaacgcaaatagttattgcaataattagctcaaccaaaggagaatacattaactacttaggagcacaatggggagaaaaatggggaataggacaagcagacaaagacaacggtatttttatactactagctagagaccatagaaaaataaatatcagtacaggaaaaggtgttgaacctttactcacagatgctatgagtaaacttataattaatacagacgttattccatattttaaacaaaatgattattaccgaggattaaatcgtgctacagaatccatttttggaggttataaatggtga

SEQ ID NO: 7084 - protein, 167 aa, Unknown
  Obtained from environmental sample
  DOMAIN (45)...(164): Domain of unknown function (DUF477)
  misc_feature (1)..(167): Xaa is any amino acid
MQHTKHIAFKVLLVLFLASPFIGLAQYDIPDKPEFQTSVYDDEIKLLSSSEKSNLERKLIRYSDSTSTQIVIAIISSTKGEYINYLGAQWGEKWGIGQADKDNGIFILLARDHRKINISTGKGVEPLLTDAMSKLIINTDVIPYFKQNDYYRGLNRATESIFGGYKW

SEQ ID NO: 7085 - DNA, 717 bp, Unknown
  Obtained from environmental sample
  misc_feature (1)..(717): n is a, c, g, or t
ttgaaaaattatcctccgctaaaaaaccaattgcttcattatggcaaaaagcatatagctattgggttagttaactatttttctgatttatctcttggtgatggctatactagatatgaagaatggctaaataatttaacaaaaaaagggactaactttaatgatatttataaagaatgtgttattgcctctccttgttggatggtttataaagaagattttgaaagttgtgaaggatttaattcaaacatatatcctgaagactacgaccttgcttttaggttttacaaaaacaaattaaaatgtattccctcaactaaagtgcttcactattggagagattatcccgaaagaacatctagaaatgataaaaattatgctgatagtagttttattaatctaaaaacacatcattttattaacattgactataaacaacaacagccattaattctttggggagctggaaaaaaaggtaaaaaagtagccgagttacttttaaatacgagcataccttttgtatggatatgtgataaccctaaaaaaataggtaaagaaatttatgggcagcaaatgatagattataaaaccattaatgattttaatctataccaaagtattataaccattgccaatccagttgcacaacaagaggtgagatctttattaaccaagcaaaacttaactttaggaaaagattttttctttttttgttaa

SEQ ID NO: 7086 - protein, 238 aa, Unknown
  Obtained from environmental sample
  misc_feature (1)..(238): Xaa is any amino acid
MKNYPPLKNQLLHYGKKHIAIGLVNYFSDLSLGDGYTRYEEWLNNLTKKGTNFNDIYKECVIASPCWMVYKEDFESCEGFNSNIYPEDYDLAFRFYKNKLKCIPSTKVLHYWRDYPERTSRNDKNYADSSFINLKTHHFINIDYKQQQPLILWGAGKKGKKVAELLLNTSIPFVWICDNPKKIGKEIYGQQMIDYKTINDFNLYQSIITIANPVAQQEVRSLLTKQNLTLGKDFFFFC

SEQ ID NO: 7087 - DNA, 612 bp, Unknown
  Obtained from environmental sample
  misc_feature (1)..(612): n is a, c, g, or t
atgaatgaagcagaattttgcatagtagatattgagacaaatggttctaaaatagaaaagcaccagattatagaaattgcaggactgaaaattaaaaatggcaaagttattgatagctttgagtctcttgtaatgtgttctgaaataaataaatatattactgacataacaggaataagcgtaaaggacactttaaatgcacctctacttaaagatgttttatataaatttaaactttttttaggggatgctatatttatagcacatgatgtaaaatttgactataaattcatttcacaatcaatgcagaaaattggactagagcctcttttaaataggagtttatgttctcttgctcttgctgaaagaacggtagaatcttacagatacgctttatcttatttaaacgatacatttgcattaaacccagatgcaaatcatcatagagcaatgagtgatgtaatgacaacgtatggactttttaaactatcgctagagaatattaatgaaaatataaataatgtggaagatttgataaaattttctaaagaagcaaaaaggttgaaacgacctaaatttgaccctctactagagagtcaaaaagaagaatag

SEQ ID NO: 7088 - protein, 203 aa, Unknown
  Obtained from environmental sample
  DOMAIN (6)...(161): Exonuclease
  misc_feature (1)..(203): Xaa is any amino acid
MNEAEFCIVDIETNGSKIEKHQIIEIAGLKIKNGKVIDSFESLVMCSEINKYITDITGISVKDTLNAPLLKDVLYKFKLFLGDAIFIAHDVKFDYKFISQSMQKIGLEPLLNRSLCSLALAERTVESYRYALSYLNDTFALNPDANHHRAMSDVMTTYGLFKLSLENINENINNVEDLIKFSKEAKRLKRPKFDPLLESQKEE

SEQ ID NO: 7089 - DNA, 843 bp, Unknown
  Obtained from environmental sample
  misc_feature (1)..(843): n is a, c, g, or t
atggatcagaatcggctcgagaggaagtccactatagcatctatgatgcaagctcaatttagacgatacaaaaacaataaaatatttgtctttgataaaggtggctctgctcaacctatatgtcttgcaactggaggtaaacattatgaaattggggcagacgatgatccgttagaattttatcctttaggaaatgtagatggaaccaaaaaggattttcttttttgtgttgaatttatcgaaacactagtaattctccagggcgaaaaagtaacaacagaagatagaacggaaataactaatagtttaaaattattgaaagatggagaaaggattcaaccaaaaaccataactgatttccgaaataccacaacgaatcaaaaaataaaaaatgctcttgcttattatgaccaagatggcccttttcctttgttgtcaggagataaaagtagtctagattttaaaggaatgacagtctttgaaatgggagagcttatggatatgggtgaaaaagcattattaccaactctaatttatattttccatgaaattaaaaaaagtcttgatggatctcccgcatatatacacatagcggaagcctggacatttttctctcacccagtgtttcgggataagctggtttcgtttctgaaagaattgaggaaattgaattgtgttgttgggcttgacacacaatctttagcagatgctagagattcgggaatattaccggttttaatagaatcatgtcctacaaaaatatacttgggaaatcctgaagcattttcccagggtactccctcagaaccaggagtttacgaaacttacaaagttttggcttaa

SEQ ID NO: 7090 - protein, 280 aa, Unknown
  Obtained from environmental sample
  misc_feature (1)..(280): Xaa is any amino acid
MDQNRLERKSTIASMMQAQFRRYKNNKIFVFDKGGSAQPICLATGGKHYEIGADDDPLEFYPLGNVDGTKKDFLFCVEFIETLVILQGEKVTTEDRTEITNSLKLLKDGERIQPKTITDFRNTTTNQKIKNALAYYDQDGPFPLLSGDKSSLDFKGMTVFEMGELMDMGEKALLPTLIYIFHEIKKSLDGSPAYIHIAEAWTFFSHPVFRDKLVSFLKELRKLNCVVGLDTQSLADARDSGILPVLIESCPTKIYLGNPEAFSQGTPSEPGVYETYKVLA

SEQ ID NO: 7091 - DNA, 633 bp, Unknown
  Obtained from environmental sample
  misc_feature (1)..(633): n is a, c, g, or t
atgaaaaaattacaagtattagataatttaaggattaaaggaatatttacaattcttggattgttctttacaatgttgatttcatctcttttaatatttgtcgcctatgatacaagccaaattattggtcatgtcactcttgtactattttttattccccatttctttgttttcaaaaatatgaattttgctaatggacgtatagattttattgatttggataataatgctttttatatagttaaaagtggaatcttatcgattaaacatgagaaagttagttttgaaaatattaaaaacctacaagccaagatgtttgtacaaaaaattggaaaactttggtcaacacgttatgaaatcactgctgatattgatggtgagtgtaagatgttatgtaaaacaacaagtagagcaaagtgtaatgaaattattgatagtttgactgagcattattcattgtcatgtgattttaagatcgaaggaaaagtttctgaacttcataaaagagtttttcaagatacaatgtataaatataagtatgctcctcaattttatttatatgggggactgtttatgttgtttgcaagtgtttgtttttttggtggattgaaaaaaaaactggcctacttttaa

SEQ ID NO: 7092 - protein, 210 aa, Unknown
  Obtained from environmental sample
  misc_feature (1)..(210): Xaa is any amino acid
MKKLQVLDNLRIKGIFTILGLFFTMLISSLLIFVAYDTSQIIGHVTLVLFFIPHFFVFKNMNFANGRIDFIDLDNNAFYIVKSGILSIKHEKVSFENIKNLQAKMFVQKIGKLWSTRYEITADIDGECKMLCKTTSRAKCNEIIDSLTEHYSLSCDFKIEGKVSELHKRVFQDTMYKYKYAPQFYLYGGLFMLFASVCFFGGLKKKLAYF

SEQ ID NO: 7093 - DNA, 792 bp, Unknown
  Obtained from environmental sample
  misc_feature (1)..(792): n is a, c, g, or t
gtgataaaaatgtgtaataaccatgactttgccccaatagagtttgtaaatgagtttattgaaaatggtacacaaaataatcataaagttgatgggatagcaattgatgtgataaaatctttagaaactatacttgatatcaaatttgagcatgttcatacatctagttggattgaatcgttacaatatttaaaagagaaaaaatgtgatattttaccagctgctgcaaaaacaaaagagagagtagcttatgcaaattttacaacaccatttctctctttagatttagcaattattacaacaaaagataaaccttttataaacagtattgaggagatacttgataaaaaaattgttagaaaaaaaggttcaggacttattagtctgttagagagtagatataaaaatataaacatagtagaagaaaagacagcaaaagatgtgtttttaagcgttgcaaaaggtgaaaattatgccaccatagcatctttacctattacctcttatatgataagtaaatatggattacaagatttacaaatagcaggatatttgaatattaaatatgatttatcaattgcagttagagatgataatgaacaattattaaagatattaaataaagctttacagcaaataccaaaagagaaatacaagcagttttttaataattggacctcattggtggtggagcaaaagtcagattacacatttttttataaaattatagctcttgttgttngtttattgtttgttgcaggatatttaaactataaactcaattcaaggtaa

SEQ ID NO: 7094 - protein, 263 aa, Unknown
  Obtained from environmental sample
  DOMAIN (2)...(228): Bacterial extracellular solute-binding proteins, family 3
  misc_feature (1)..(263): Xaa is any amino acid
MIKMCNNHDFAPIEFVNEFIENGTQNNHKVDGIAIDVIKSLETILDIKFEHVHTSSWIESLQYLKEKKCDILPAAAKTKERVAYANFTTPFLSLDLAIITTKDKPFINSIEEILDKKIVRKKGSGLISLLESRYKNINIVEEKTAKDVFLSVAKGENYATIASLPITSYMISKYGLQDLQIAGYLNIKYDLSIAVRDDNEQLLKILNKALQQIPKEKYKQFFNNWTSLVVEQKSDYTFFYKIIALVVXLLFVAGYLNYKLNSR

SEQ ID NO: 7095 - DNA, 819 bp, Unknown
  Obtained from environmental sample
  misc_feature (1)..(819): n is a, c, g, or t
atgaaaacagaaagaaaaaaagagctattagaggctttaaagaatatcccagattatagagtagatgtaggtaaaatagagtatcccctatacgaagtattatttatgacactatttgcattacttaaaggcaatacaacttttaaagatatttttgtttggatgacatttaacaaagagaatgaaatactcaaagaagtatttgaaaaagagaagataaatgtaccttctcgttctacattgcataccttacttattaacacagataacaatgccttagaagctgtttttagagaatatttttttgagtatattcttcaaaagagtattgcaattgatgggaaatggctcagaggaagtgatgttaatggacaatatacacaagagtcccataaagccatacttaatattttagataaagatatcaaaattgtttttgcacataaatttttagataaaaataaaaagagtgagataagagcacttcaagagatacttgatgataaactttttagtggtgagggtcaaatcttctcatttgatgcactattaacacaatcaaacattctcaatactatcaattcccaaggaaatagatatattgctaaactcaaagataatcaagataacctaaaacaaaaagctgttgagacagttgaagcgtttgaaactccaaatgatagttatgatgacaaagatgggtatcttaatgaaaaacataaaagagttactagaacagtagaggtatatcaaaataaaaattgtaacttagtgatgcatcatgagagatttgataataatcaatcgctaaataaagtc

SEQ ID NO: 7096 - protein, 273 aa, Unknown
  Obtained from environmental sample
  misc_feature (1)..(273): Xaa is any amino acid
MKTERKKELLEALKNIPDYRVDVGKIEYPLYEVLFMTLFALLKGNTTFKDIFVWMTFNKENEILKEVFEKEKINVPSRSTLHTLLINTDNNALEAVFREYFFEYILQKSIAIDGKWLRGSDVNGQYTQESHKAILNILDKDIKIVFAHKFLDKNKKSEIRALQEILDDKLFSGEGQIFSFDALLTQSNILNTINSQGNRYIAKLKDNQDNLKQKAVETVEAFETPNDSYDDKDGYLNEKHKRVTRTVEVYQNKNCNLVMHHERFDNNQSLNKV

SEQ ID NO: 7097 - DNA, 507 bp, Unknown
  Obtained from environmental sample
  misc_feature (1)..(507): n is a, c, g, or t
atgattagttatgatgacaaagatgggtatcttaatgaaaacaataaaagagttactagaccagtagaggtatatcaaaataaaaattgtaacttagtgatgcatcatgagagatttgataatattcaatcgctaattaaagtcactaagcaattaacgaatcctatcactggagaacatacacaaacagtgcaatacttaatggctaatttcaaaactacagcagaagatttctaccaaaagatactgcaacattggcggatagaaacttaccactatcatttggatatgttagtagaagaagatcaacatattgcatacaaagagcctttctctatggcaatactcagaagttttgcaattaatctttatcagttatttttgaatgctaacaaagataaaaaaattctaccaactggaaaaacaacaatggcagagattaaaagaaattgcctatatcgcgatgattttactgctgatctgtttgagcaggaaggtgttaattaa

SEQ ID NO: 7098 - protein, 168 aa, Unknown
  Obtained from environmental sample
  misc_feature (1)..(168): Xaa is any amino acid
MISYDDKDGYLNENNKRVTRPVEVYQNKNCNLVMHHERFDNIQSLIKVTKQLTNPITGEHTQTVQYLMANFKTTAEDFYQKILQHWRIETYHYHLDMLVEEDQHIAYKEPFSMAILRSFAINLYQLFLNANKDKKILPTGKTTMAEIKRNCLYRDDFTADLFEQEGVN

SEQ ID NO: 7099 - DNA, 642 bp, Unknown
  Obtained from environmental sample
  misc_feature (1)..(642): n is a, c, g, or t
atggttgtagcaaataagatggatgaacttaactctatgttttcaaatcctcagccttttatcccttttgttattgattatataacacaaaaatataatttagaaaatccacaagataagcaacaagcattaaaagaatcaaatgagtttttaaaaacactagatccaattttgcaagaggaatatcaaaatttagttgcacggaaattgaatgtcaattctcaacttgtgcaagtacaacactttaataatcaaagagttaatcaagtaaatctaacctctgtgaatatatcagaattaagtattattaaaacgattcttgacaatccaatgttattagaagtggtaaaaaatgagctacaacctgatatgtttgaaacacatgcacatgaatataatatgttattagaagatattaatgatccaaacttacatggactgatgctaaatgaacatataatttcatatacacaagaggagttagataatcaattaaaaatacttcttgttccttattataaaaaaagattacaacaattaaaatttgatgaaaccatagattttaaaataaaagctagaaaaactgttgaacttaaacataaactaattgaactaaatcaaaaaaaactcatagcggtttaa

SEQ ID NO: 7100 - protein, 213 aa, Unknown
  Obtained from environmental sample
  misc_feature (1)..(213): Xaa is any amino acid
MVVANKMDELNSMFSNPQPFIPFVIDYITQKYNLENPQDKQQALKESNEFLKTLDPILQEEYQNLVARKLNVNSQLVQVQHFNNQRVNQVNLTSVNISELSIIKTILDNPMLLEVVKNELQPDMFETHAHEYNMLLEDINDPNLHGLMLNEHIISYTQEELDNQLKILLVPYYKKRLQQLKFDETIDFKIKARKTVELKHKLIELNQKKLIAV

SEQ ID NO: 7101 - DNA, 510 bp, Unknown
  Obtained from environmental sample
  misc_feature (1)..(510): n is a, c, g, or t
ttgaatagactttttgtagtaaaaaagcctgtatttattagttcaaatttttatcttaatagaataaaacgaaaatataaaacaaaaaaagctggctttagtgggactttggatccttttgcttgtggttgtttgatagttgcttttgggcagtattctaagctttttcgatatttgaaaaaaacaccaaaatcatatcgtgctactatttttttaggagcagaaagtagttctttagatattgaaaatgtagaagtgacaaatcataattcaaaagtatttacagaagatgatattaaagaaaaactagaaagtttaaaaggtactttagaatatctaccaccaaaatacagtgcaaaaaagatagatggtcaaagagcttataatctagctcgtgagggtatagagtttgatatgaagaaaatcacttcgcaagtatttgatgtgaagtttatcaactactctcatccttttataacatttgatataactgtaagtgaaggaagctaa

SEQ ID NO: 7102 - protein, 169 aa, Unknown
  Obtained from environmental sample
  DOMAIN (20)...(168): TruB family pseudouridylate synthase (N terminal domain)
  misc_feature (1)..(169): Xaa is any amino acid
MNRLFVVKKPVFISSNFYLNRIKRKYKTKKAGFSGTLDPFACGCLIVAFGQYSKLFRYLKKTPKSYRATIFLGAESSSLDIENVEVTNHNSKVFTEDDIKEKLESLKGTLEYLPPKYSAKKIDGQRAYNLAREGIEFDMKKITSQVFDVKFINYSHPFITFDITVSEGS

SEQ ID NO: 7103 - DNA, 840 bp, Unknown
  Obtained from environmental sample
  misc_feature (1)..(840): n is a, c, g, or t
gtgagtgtagaggaagcaaaagcaacagcacaagatagaaactataagcaaatagcagatgtatatgagaaatatgaaaactatttagagcaaaacaatcttgtggattttgatgatttattactcctaacatataagatacttcaaaaaaaccctcaactatcaaaagatacaagtgatagatataaatatattatggtagatgagtatcaagataccaacgagttacaatataaacttttaaaacaactttgtagtgaacacaataatatttgtgtagttggagatgatgatcagtctatatatggttggagaggtgcaactattaaaaatatccttacatttagtgatacttttaatgatacactagttataaaactagaagaaaattatcgttcaactcataaaatactttttcatgcaaatgctttaatagaacacaatagagacagactagggaaaaagcttgtagggactagagaagagggtaactctataaaaatttacgaatcaaacgatgaaaatgatgaaacaagaaaaatcgttgatgatattaaaaaacttatcgaacaaggtgaatcagcaaaagatattgcagtcttatttagggtaaatgctttaagtagggcgttagaagaggggctcaatagatcaaatatcaactataaactagtgggtggtttaaagttctatgaaagagctgaaatcaaagatttaatagcatattttagagttataacaaatgcaaatgaacacttctctataaaaagaattatcaataagccaaaaagaggtattgggaaaaccaccatagataacctagaacttggggtcgcacga

SEQ ID NO: 7104 - protein, 280 aa, Unknown
  Obtained from environmental sample
  DOMAIN (1)...(280): UvrD/REP helicase
  misc_feature (1)..(280): Xaa is any amino acid
MSVEEAKATAQDRNYKQIADVYEKYENYLEQNNLVDFDDLLLLTYKILQKNPQLSKDTSDRYKYIMVDEYQDTNELQYKLLKQLCSEHNNICVVGDDDQSIYGWRGATIKNILTFSDTFNDTLVIKLEENYRSTHKILFHANALIEHNRDRLGKKLVGTREEGNSIKIYESNDENDETRKIVDDIKKLIEQGESAKDIAVLFRVNALSRALEEGLNRSNINYKLVGGLKFYERAEIKDLIAYFRVITNANEHFSIKRIINKPKRGIGKTTIDNLELGVAR

SEQ ID NO: 7105 - DNA, 546 bp, Unknown
  Obtained from environmental sample
  misc_feature (1)..(546): n is a, c, g, or t
ttgtattttgatgagatgaataaacccttgtcactactagaagcttgtaaaatggctggtaacaatagttttaaaaactgtttggtactaaactcaatctcaaaaagaagtagtgctccagggcttagaagtggttttattgcaggtgataaagagatattaaagcagtacttgaaatacagaacttatgtaggatgtgcattgcctttaccattacaaaaaactgctgcagttgcttggaatgatgaaaaacatgtagaagagtttagaaagttatataaagaaaattttgaaatagctagtgaaatattaggtattagtgcaccagaagccaccttttatatttggcttgaagttgaggatgagttacaatttacaaaagagctttatgaaactaaaaatatcaaagtattaccaggaagttttcttggacgaaatggaatagggaaaaattttgtgcgaattgcacttgttgaaagcccacaaaaaactaaagaagtgctaacaagattaaaagagttcattactttatataaagcacaataa

SEQ ID NO: 7106 - protein, 181 aa, Unknown
  Obtained from environmental sample
  misc_feature (1)..(181): Xaa is any amino acid
MYFDEMNKPLSLLEACKMAGNNSFKNCLVLNSISKRSSAPGLRSGFIAGDKEILKQYLKYRTYVGCALPLPLQKTAAVAWNDEKHVEEFRKLYKENFEIASEILGISAPEATFYIWLEVEDELQFTKELYETKNIKVLPGSFLGRNGIGKNFVRIALVESPQKTKEVLTRLKEFITLYKAQ

SEQ ID NO: 7107 - DNA, 870 bp, Unknown
  Obtained from environmental sample
  misc_feature (1)..(870): n is a, c, g, or t
gtggtgctggctactcctgtagtggaaaagctcaaggatttttaccccgatgcaaaaattgatttccttgtaaaaaatggaatccatagcctgctaatatctcacccgaaaataaaaagggtgctggtttgggataaatcaactgacaagtacaaacacatcaagcaactgatagccgtgattagggagcgcaaatatgatgttgtggttaatttgcagcgctttgcttcaagcggattaattactgccttatcaggagcacaaatcaaactgggctttaataaaaatcctttctctgttttttataccaagtctgtaaaacatcaaatttcagcagacccgggaaaaagtgagcatgaggtttccagaaacctatcggttattgattcgattactgacacatcgcgaaactatcccttaaaactctaccccagtcaagatgattttgccaaagtgtcgcaattcaaaaccaagaaatacatttgtgtcgctccgacttctttatggtttacgaaacaatttcctgcagaaaaatggattgaatttctgaaagaaattgatgaggatttgcttgtttattttttaggagcaaaaaacgatcgggcaatttgcgaagagattatcgaaggatccgcccacaaaaattcattgaacctttcaggaaaactttcgtttttggaatcggcagcattgatgaaagatgctgccatgaattttgtaaacgattcggcaccacaacattttgcctctgcaatgaatgctccgctgacttccatattttgttcaacggtgccttcttttggttttgggccactctccgataattctgttgtaataaaaactgatgaagagctttcgtgccgccttgtg

SEQ ID NO: 7108 - protein, 290 aa, Unknown
  Obtained from environmental sample
  DOMAIN (54)...(289): Glycosyltransferase family 9 (heptosyltransferase)
  misc_feature (1)..(290): Xaa is any amino acid
MVLATPVVEKLKDFYPDAKIDFLVKNGIHSLLISHPKIKRVLVWDKSTDKYKHIKQLIAVIRERKYDVVVNLQRFASSGLITALSGAQIKLGFNKNPFSVFYTKSVKHQISADPGKSEHEVSRNLSVIDSITDTSRNYPLKLYPSQDDFAKVSQFKTKKYICVAPTSLWFTKQFPAEKWIEFLKEIDEDLLVYFLGAKNDRAICEEIIEGSAHKNSLNLSGKLSFLESAALMKDAAMNFVNDSAPQHFASAMNAPLTSIFCSTVPSFGFGPLSDNSVVIKTDEELSCRLV

SEQ ID NO: 7109 - DNA, 816 bp, Unknown
  Obtained from environmental sample
  misc_feature (1)..(816): n is a, c, g, or t
atggtttaccaaatcaagcagtatttaaaagttattaaaaatactgataaagctactggtaagaccaataggaatactggttatagtttaatgaaagctatggactatttagctagagatactgatgagtttacagaagatggttttaaaaaagatatggaacaccaggaaaaagaaaacgagaatattcttaactctttagatgaaacaatccctttatatacaagtgatggaagaacactatcaacaaaagaggatagatataaattatatgaagagtggaaagaaacttttacagatagaaaagatggtaaagattttgaacatgtgatattttcaactgatgaagcaccaggtacaaatgatgaaaaagttttaaaaagtgctagagatacattacaaaagcaatttggaaatgatggatatgattatgtttttaatttacataacgatacagaacatactcatgttcatgcaataattagagttcacaatacaaaaacaaacaaaagattagatattagaaaagatgatatttggaaaacaaaaatgacttttgcaaatgaacttaaaaaaaatggattacattatgaagcttccatacaatatgatagaatcaaaaaactagaagataaacttacctatatacaaaaaaatgatttaacctggtttcaatcaaatgtagaaaaaataaaaaatgttaatatagaagaaaaacttaatacaataaaagaacttgatgaaaatttagctgctttaatagaaaaaagaaaagatatcgattataaattagattctaaaaaatctactgattaa

SEQ ID NO: 7110 - protein, 271 aa, Unknown
  Obtained from environmental sample
  misc_feature (1)..(271): Xaa is any amino acid
MVYQIKQYLKVIKNTDKATGKTNRNTGYSLMKAMDYLARDTDEFTEDGFKKDMEHQEKENENILNSLDETIPLYTSDGRTLSTKEDRYKLYEEWKETFTDRKDGKDFEHVIFSTDEAPGTNDEKVLKSARDTLQKQFGNDGYDYVFNLHNDTEHTHVHAIIRVHNTKTNKRLDIRKDDIWKTKMTFANELKKNGLHYEASIQYDRIKKLEDKLTYIQKNDLTWFQSNVEKIKNVNIEEKLNTIKELDENLAALIEKRKDIDYKLDSKKSTD

SEQ ID NO: 7111 - DNA, 387 bp, Unknown
  Obtained from environmental sample
  misc_feature (1)..(387): n is a, c, g, or t
gtgaaaaaagctattgtcactggtattacaggacaagacggtgcatatttagcagagttccttttacaaaagggatatacggtatatggaacttatagacgattatcgtctacacttttttggagaatagaggaacttaagatattaaatcatccaaatttacacctaatagaacttgatataatggaccaatcaaatatgattaaaatgattaaagatattaaacctaatgaaatttataatttggcagctcaaagttttgttagagactcttttgaaaagccaattgaaagtggacatgtctcaggaattggatgtttacatatattagaagcaataagaattatagatttaaaaattaaattttatcaagccaagtacttctga

SEQ ID NO: 7112 - protein, 128 aa, Unknown
  Obtained from environmental sample
  misc_feature (1)..(128): Xaa is any amino acid
MKKAIVTGITGQDGAYLAEFLLQKGYTVYGTYRRLSSTLFWRIEELKILNHPNLHLIELDIMDQSNMIKMIKDIKPNEIYNLAAQSFVRDSFEKPIESGHVSGIGCLHILEAIRIIDLKIKFYQAKYF

SEQ ID NO: 7113 - DNA, 396 bp, Unknown
  Obtained from environmental sample
  misc_feature (1)..(396): n is a, c, g, or t
atgaaaagtttcataagttatacttttgaagagctgtcaaatcttcttctagtcaaattatacaaaaaacatattattgaatcagggagctattgggatagaaaagtagagattgatgttttagctttcagtgaagagggtgatgtcatagcaggtgaatgcaaatggaaaaatcataaaataaataaaaatgagttaacaaaactacaagataagtgtagaaaaatagatctaaaggcagatgttttcgtacttttcagtaagcggggcttttccaaagagttgttaaaaatggctaatgagaagttacttttatatactcctgaagattttgaaatcttagttaaagatgtaaataaaagtgaactgttagatactcaatttaacatatcttaa

SEQ ID NO: 7114 - protein, 131 aa, Unknown
  Obtained from environmental sample
  misc_feature (1)..(131): Xaa is any amino acid
MKSFISYTFEELSNLLLVKLYKKHIIESGSYWDRKVEIDVLAFSEEGDVIAGECKWKNHKINKNELTKLQDKCRKIDLKADVFVLFSKRGFSKELLKMANEKLLLYTPEDFEILVKDVNKSELLDTQFNIS

SEQ ID NO: 7115 - DNA, 561 bp, Unknown
  Obtained from environmental sample
  misc_feature (1)..(561): n is a, c, g, or t
atgaaaaacaataaacttcacatagtctctcttggctgtactaaaaatcttgtcgataccgaagtgatgatgggaaaactacaaaacttcgaactaactgacgcccaagaagaggctgatgtaataatagtaaacacttgtggtttcatagatgccgcaaaagaagagtcaataaacactgttcttagtcttcacgatgcgagaaaagaggattctgttttagttatggcaggatgtctcagtgaacgttataaaggagacctagctattcagatgccagaagtagatatctttaccggtgttggtgattatgaccacattgatgagcttttagctgagaagaaaagtcgtttcagcgatgaagtttttcttatagatggatgtgagagagttgtaactggttcaacttaccatgcttacataaaactatctgagggttgtaaccaaacttgtagtttctgtgctattccatcttttaaaggaaaactaaactctcgtaatcttgattcaattgctaaagaagttgaaggtcttgttaataaaggttanttacgattttag

SEQ ID NO: 7116 - protein, 186 aa, Unknown
  Obtained from environmental sample
  DOMAIN (5)...(100): Uncharacterized protein family UPF0004
  misc_feature (1)..(186): Xaa is any amino acid
MKNNKLHIVSLGCTKNLVDTEVMMGKLQNFELTDAQEEADVIIVNTCGFIDAAKEESINTVLSLHDARKEDSVLVMAGCLSERYKGDLAIQMPEVDIFTGVGDYDHIDELLAEKKSRFSDEVFLIDGCERVVTGSTYHAYIKLSEGCNQTCSFCAIPSFKGKLNSRNLDSIAKEVEGLVNKGXLRF

SEQ ID NO: 7117 - DNA, 354 bp, Unknown
  Obtained from environmental sample
  misc_feature (1)..(354): n is a, c, g, or t
ttgcattttgacagtaatcattggtggctacaattagcgagttggtttacccaattttcttggcgtgcttgcagaggtggcgaccagagtcagtttataaccaaaacactgtttaatgacattggaggatatgacgaaaactacattatttatgaagacaacatcttaatcaatgaactctacgctcgaaatgaatatgtggtcatcaataaaaaaattaaaacctcagcaagactgtaccgaaaacatggagtttggacattgcaatatcacttctggaccatttatgtaaagaaatggtttggcgcttcggctgatgagttattggcttattataagaagtatatatattaa

SEQ ID NO: 7118 - protein, 117 aa, Unknown
  Obtained from environmental sample
  misc_feature (1)..(117): Xaa is any amino acid
MHFDSNHWWLQLASWFTQFSWRACRGGDQSQFITKTLFNDIGGYDENYIIYEDNILINELYARNEYVVINKKIKTSARLYRKHGVWTLQYHFWTIYVKKWFGASADELLAYYKKYIY

SEQ ID NO: 7119 - DNA, 633 bp, Unknown
  Obtained from environmental sample
  misc_feature (1)..(633): n is a, c, g, or t
atgcacaatagatggcattccattttacaaaagcatgttaccattaatggaaatgtgaattatgaagccataaaaaacgattcagaatttgacgtctacatcgattatataagtgaaacattacctgatgacacatggtctaaaaatgaaaaactagcctattggataaatgcttataacgcgcttaccatagatttaattcttagaaattaccctgtaaaaagtattaaagacatcaaagatccttgggatcaacgcctttggcaatttggcggcacttggcaaaatcttaataatattgagcacaagattttaagagaaatgaacgaacctcgtattcattttgcgatagtttgtgcctctatttcctgtccgaaattacagaacgaagcctttactgcttcaaatttagaaacacaattaacaaaagcgactaaagaattcttaaacgatgcttctaaaaatgaaatttcagaagaccacattaaactgtctaaaatctttaaatggtttaaaaaagattttgaacatgatggcgatttaatagacttcttaaatcaatattcggaagtaaaaatttcacgtgcagctaaaaaaagctttaaagattacaactgggatttaaatgattaa

SEQ ID NO: 7120 - protein, 210 aa, Unknown
  Obtained from environmental sample
  DOMAIN (39)...(149): Protein of unknown function, DUF547
  misc_feature (1)..(210): Xaa is any amino acid
MHNRWHSILQKHVTINGNVNYEAIKNDSEFDVYIDYISETLPDDTWSKNEKLAYWINAYNALTIDLILRNYPVKSIKDIKDPWDQRLWQFGGTWQNLNNIEHKILREMNEPRIHFAIVCASISCPKLQNEAFTASNLETQLTKATKEFLNDASKNEISEDHIKLSKIFKWFKKDFEHDGDLIDFLNQYSEVKISRAAKKSFKDYNWDLND

SEQ ID NO: 7121 - DNA, 462 bp, Unknown
  Obtained from environmental sample
  misc_feature (1)..(462): n is a, c, g, or t
atgataaaaaaacaagctgtcgttttaatttttataagaggtcaatggtgtccggtatgtaacagacatatgagtcaactacaagacagcctgcaagccgtttacaaaaaaagtgctaatgtagtggtaatatctcctgaaaaaccagaatacattgaaaaaactattgaaaaaactaaagctgaatttaccatactttacgatgaaaatcagaaaatatccgatgcttttgatgtaacttttgaacctagcggaaaaaccaaagtaatttacaatacggtacttggtgccaaattaaaagaagctcataccgatgattctgagcgtttgcctattcctgccacttttattatagatacgaataaagtaattgtttggagacactttgacccagactacaaaaacagatctaccataaaagaaattatagaaaatatccccgaaaaaaaggttaaaaattaa

SEQ ID NO: 7122 - protein, 153 aa, Unknown
  Obtained from environmental sample
  misc_feature (1)..(153): Xaa is any amino acid
MIKKQAVVLIFIRGQWCPVCNRHMSQLQDSLQAVYKKSANVVVISPEKPEYIEKTIEKTKAEFTILYDENQKISDAFDVTFEPSGKTKVIYNTVLGAKLKEAHTDDSERLPIPATFIIDTNKVIVWRHFDPDYKNRSTIKEIIENIPEKKVKN

SEQ ID NO: 7123 - DNA, 702 bp, Unknown
  Obtained from environmental sample
  misc_feature (1)..(702): n is a, c, g, or t
atgatagaaataaaagatcttcataaatcctataaaatgggaagcaattcccttcacgtattaaaaggtattaacttttctgttgaagaaggtgaacttgtagccataatgggatcttcagggtccggtaaatccactctcctgaatatattgggtatgttggatgtgcttgatgaggggtcctataccctggacggagtaccaattaaaaacctgaacgaaactaaggctgcccaatacaggaacaagtttttgggttttgttttccaatcctttaatttgatcaattataaaagtgccatggagaatgtagcacttcccctgtattaccaaaaagttgggcggaaagaaaggcaggaaaaagccttaaaatatttggagcaagtaggtttgcgggagtgggcggatcatttgcccagtgaattgtccggagggcaaaagcaaagggtggctatagccagggccatggcagcggagcccaaagttctattggcagatgaacctaccggagccttggatagcacaacctcctacgaggttatggaccttattcaaaaaattaacgatgctggcaatacgatacttatagttacccatgagcctgacatagcggacatgtgcaaaaggattgtgcatttaaaggatggggttattgttgaggacaagaaaataactcagattagggcctcccagtatgtttag

SEQ ID NO: 7124 - protein, 233 aa, Unknown
  Obtained from environmental sample
  DOMAIN (31)...(216): ABC transporter
  misc_feature (1)..(233): Xaa is any amino acid
MIEIKDLHKSYKMGSNSLHVLKGINFSVEEGELVAIMGSSGSGKSTLLNILGMLDVLDEGSYTLDGVPIKNLNETKAAQYRNKFLGFVFQSFNLINYKSAMENVALPLYYQKVGRKERQEKALKYLEQVGLREWADHLPSELSGGQKQRVAIARAMAAEPKVLLADEPTGALDSTTSYEVMDLIQKINDAGNTILIVTHEPDIADMCKRIVHLKDGVIVEDKKITQIRASQYV

SEQ ID NO: 7125 - DNA, 381 bp, Unknown
  Obtained from environmental sample
  misc_feature (1)..(381): n is a, c, g, or t
ttgaagaggaatgggttgaattatttaaagttaaatgtaaaggataaggttatgtggattttatatcggttaatgggtgataagggatttgaaagttatatcagatacgagcatataatttcacatcttaattggaaagatagttattattataataagatacgattcttatattggtttaaacgtaaaacatatagacgttttatcactaaccttgagagtggtatgaaactcggtgatgcgtatacaagagctctcaattataataagaaattgataactggtataactgttggtgagtcacaagagaaggctcaaaagattctagatgaggtggttatcccaatgaataaaaaatatgatgaaaaaaacaacaaatag

SEQ ID NO: 7126 - protein, 126 aa, Unknown
  Obtained from environmental sample
  misc_feature (1)..(126): Xaa is any amino acid
MKRNGLNYLKLNVKDKVMWILYRLMGDKGFESYIRYEHIISHLNWKDSYYYNKIRFLYWFKRKTYRRFITNLESGMKLGDAYTRALNYNKKLITGITVGESQEKAQKILDEVVIPMNKKYDEKNNK

SEQ ID NO: 7127 - DNA, 477 bp, Unknown
  Obtained from environmental sample
  misc_feature (1)..(477): n is a, c, g, or t
atggtccaactttttcaacttgtatttgcttcaaaagatgaaggggtaaaatacttctcaaatgaacatggggaatttatccaacaagatccattactacttaatagttgtggaaagataaactcaactgctggaaaagcaagtgaatttactactgaacataaagcacttttagatagctttttcaatgaagggtatagattaagagtgagtaactctctttgtcttgatacccatcaaattttatttaaaaaaggtggaatttattcaagtccagcaactgtatcaaatgaagatggaactttggaagttatttttgaagcgtttcctatctcatttataatcgaacttgcaaacggtgaagcaatagatggaaaaaatagaatcttagatataaaatctccctctttacatcaaaaaacaccgatttattttggttcaaaagaagagatagcaagagttaaatctactttctaa

SEQ ID NO: 7128 - protein, 158 aa, Unknown
  Obtained from environmental sample
  DOMAIN (2)...(158): Fructose-1-6-bisphosphatase
  misc_feature (1)..(158): Xaa is any amino acid
MVQLFQLVFASKDEGVKYFSNEHGEFIQQDPLLLNSCGKINSTAGKASEFTTEHKALLDSFFNEGYRLRVSNSLCLDTHQILFKKGGIYSSPATVSNEDGTLEVIFEAFPISFIIELANGEAIDGKNRILDIKSPSLHQKTPIYFGSKEEIARVKSTF

SEQ ID NO: 7129 - DNA, 363 bp, Unknown
  Obtained from environmental sample
  misc_feature (1)..(363): n is a, c, g, or t
ttgtcaattcaaaaaaattttatcctaaaaaacatgaataaattaatcttatcgcttttaaccatcctttttatactaggatgtaaaaccactgaaaccattacgcttcctgagcaagtaattgaaattgagaacccgtttaaaaccgagcgacctatctatcaggctgcttacactaaaaaatttgatttaattcacactaaattagcagtaagttttaattgggaaaaagctcacctttatggtaaagccgacattacgttacgtccgtatttttactccactcagcaattagaattaaatgcacgaggaatggatattcataaagtagcattagtagaaaatggcaacaaaaagccttaa

SEQ ID NO: 7130 - protein, 120 aa, Unknown
  Obtained from environmental sample
  misc_feature (1)..(120): Xaa is any amino acid
MSIQKNFILKNMNKLILSLLTILFILGCKTTETITLPEQVIEIENPFKTERPIYQAAYTKKFDLIHTKLAVSFNWEKAHLYGKADITLRPYFYSTQQLELNARGMDIHKVALVENGNKKP

SEQ ID NO: 7131 - DNA, 804 bp, Unknown
  Obtained from environmental sample
  misc_feature (1)..(804): n is a, c, g, or t
ttggctcgagccgttagcatccaaactcagataaaaagtttcacccggaaacggaagctatttttcccctatgcgatcactctgacggtgaccggtgatggtgccacattcgtccccaacccaactcccgaatccccgtatcatgacagcgactacctcaaaaaaaaccaaacctccgaaacggtaatcccaaatttaacctgctataccggcaaatggaaactcgatcccggacattatacggttcaagcaaaatatgtgatgacaaagaagcctgaaaaaatacttggaatggaagaagatccagacgctgaactccaaatatggatggggtcgcttgagtcgaatgctatcaagattatcgtcgaaccggaccggtcgcaagaatacatgaaattagatatgattctttcaaaatggaatagcaaaattagagcagaagacgttgaaaagaaaataaaggaatcttccgagaaccccgaagatattctcatcacaatggttgaagacgatacggctcggaatcgtcatgctgcggtccgtgcattggggttactccggtcgaagaaatcggttgaaccgttgttaaaactttttgccaaagagtctaacaagttggcggttacagcaacgtatgcattaaaagacatcggcgataagcgggcggtgtatggattgttgacggtgctcgaaaagcggcggaaaggagatatccggcgcgtacccgcaatgaatacgatacgccgtctcgcagataaaacgacagtcaaccggcttaaacgtttgtcgacgatgacgaactaa

SEQ ID NO: 7132 - protein, 267 aa, Unknown
  Obtained from environmental sample
  misc_feature (1)..(267): Xaa is any amino acid
MARAVSIQTQIKSFTRKRKLFFPYAITLTVTGDGATFVPNPTPESPYHDSDYLKKNQTSETVIPNLTCYTGKWKLDPGHYTVQAKYVMTKKPEKILGMEEDPDAELQIWMGSLESNAIKIIVEPDRSQEYMKLDMILSKWNSKIRAEDVEKKIKESSENPEDILITMVEDDTARNRHAAVRALGLLRSKKSVEPLLKLFAKESNKLAVTATYALKDIGDKRAVYGLLTVLEKRRKGDIRRVPAMNTIRRLADKTTVNRLKRLSTMTN

SEQ ID NO: 7133 - DNA, 945 bp, Unknown
  Obtained from environmental sample
  misc_feature (1)..(945): n is a, c, g, or t
gtggaagaacatcaaaaattattaatggaaaacactactcttcgcacaagatttgatgatgagatcaaaactgaaacagctttgattaatgataaactaaaaaaactgcagtatgcttatgcggaagttataggaattggtaaagttgggattttttctgaagagatgatacagatagctgaaatggccaaaaaacttcacggagacccttcaatacccgttttgattcaaggtgattctggaactggcaaagagataatcgccagaatggtccattatggtgatagtgatttcaaccgaccttttatctctttaaactgtgcagcaatcacacctacgttattcgaaagtgagttgtttggatatgaagccggagccttcaccggatccagcaaaaaagggcagataggcaagatggaactggcaaaaggtggaaccttatttttggatgagatcggagaaatgccgctggagatgcagccaaaattattaaaagctctgcaggatagagaactttatcgagtaggtggaacaagaaaaattcctctgacctttcggttgatatgtgcaacaaattgtgaactggaaaaaagaatggaagaaaatcgttttcgattggatcttttttaccggatcaataccgcaaaaatattaattcctgccctgcagcaacgcanaaaagacatcattcctttagccagaatgttcctgaaagaatttgccagatcaagaaaacaacctgtcaatatcctaaccaaagaagctgctatggttctatcaaattacgactggcccgggaatgtgcgacaacttcaaaatataatggaacaagccgcattttctttctatggtactaaattgaatgcagatcagatcaaatctctgctacataaaaaaacggattcaactggatcttctggaagtttttgtattaatttttcccac

SEQ ID NO: 7134 - protein, 315 aa, Unknown
  Obtained from environmental sample
  DOMAIN (49)...(272): Sigma-54 interaction domain
  misc_feature (1)..(315): Xaa is any amino acid
MEEHQKLLMENTTLRTRFDDEIKTETALINDKLKKLQYAYAEVIGIGKVGIFSEEMIQIAEMAKKLHGDPSIPVLIQGDSGTGKEIIARMVHYGDSDFNRPFISLNCAAITPTLFESELFGYEAGAFTGSSKKGQIGKMELAKGGTLFLDEIGEMPLEMQPKLLKALQDRELYRVGGTRKIPLTFRLICATNCELEKRMEENRFRLDLFYRINTAKILIPALQQRXKDIIPLARMFLKEFARSRKQPVNILTKEAAMVLSNYDWPGNVRQLQNIMEQAAFSFYGTKLNADQIKSLLHKKTDSTGSSGSFCINFSH

SEQ ID NO: 7135 - DNA, 348 bp, Unknown
  Obtained from environmental sample
  misc_feature (1)..(348): n is a, c, g, or t
atgcggagatgtttccaagttgtttacattttagaaaatcaaaatatagttaaaagcattagctttatattctatgacgaatatttaaaatttgaattagagccagacttcaaagaatatatcgaatctgaaaaagaaaaaaacaaaaaaggaattattggtaattcaaattttatctggggctaccaattttcaagttcaaaatatcaagggtatttaccagttagaaataattttggttttactgagaaacattggtatcactatccttacaatgaaaaagcttcgcaatcagaatttgcgattcaaaatagtaaatacttacataataagacaatgaatgattaa

SEQ ID NO: 7136 - protein, 115 aa, Unknown
  Obtained from environmental sample
  misc_feature (1)..(115): Xaa is any amino acid
MRRCFQVVYILENQNIVKSISFIFYDEYLKFELEPDFKEYIESEKEKNKKGIIGNSNFIWGYQFSSSKYQGYLPVRNNFGFTEKHWYHYPYNEKASQSEFAIQNSKYLHNKTMND

SEQ ID NO: 7137 - DNA, 942 bp, Unknown
  Obtained from environmental sample
  misc_feature (1)..(942): n is a, c, g, or t
atggctgagttaacagactttagctttgcagtaaaagagggagataaagagctactggcttttttaaatgagggtttagcgatagtcatggcagatggcacatacaaaaaactatatgataagtggttcgcttttttagataaaaaatatgaactatatgagagtatgatctcaaatctttacattgcactctctattttagctctaatcattataatcgcaattttttggcatattagtctgaaaaagcaggtcaacaaaaagacaaatgagatcaaagagagtcaaaaacgttatagtgacttttttgataatagtagaagtgcaaatattatttataacagtgacgataatggagagacatttagaattgttgatgttaatactatttttgaagagctagaagagttaaaaaaagaggatattgtaggtaaaaaagtagatgaaattttctcaggcgttgaaacaacaggtatttttgagatttttaaaaatgtatttcaaagcggagagacatatcatctgccattaacacgttttacatatggaaataaagaagtatggagagataactatattttcaaactctctacaggagaggtagttgcctcttacatcgacaagtcagttgaaagaaatatggaaattgaacgtattgataactatgaacaaactcttgtttcacttgttgaacttatagagcaacgtgattcttacacaggtggtcactctttgcgtgtggctacgtactctaaaatgattgctgaggcacttaattactcaaaagaggattgtgatttaatatatcgcgcaggtattttacatgatatcggcaaagtaattactccagaatgcattcttttaaaaccaggtgcacttaatgataatgagtataaattaattaaatatcatgcagcaagcggtgctcaaatgcttgaaaag

SEQ ID NO: 7138 - protein, 314 aa, Unknown
  Obtained from environmental sample
  DOMAIN (240)...(312): HD domain
  misc_feature (1)..(314): Xaa is any amino acid
MAELTDFSFAVKEGDKELLAFLNEGLAIVMADGTYKKLYDKWFAFLDKKYELYESMISNLYIALSILALIIIIAIFWHISLKKQVNKKTNEIKESQKRYSDFFDNSRSANIIYNSDDNGETFRIVDVNTIFEELEELKKEDIVGKKVDEIFSGVETTGIFEIFKNVFQSGETYHLPLTRFTYGNKEVWRDNYIFKLSTGEVVASYIDKSVERNMEIERIDNYEQTLVSLVELIEQRDSYTGGHSLRVATYSKMIAEALNYSKEDCDLIYRAGILHDIGKVITPECILLKPGALNDNEYKLIKYHAASGAQMLEK

SEQ ID NO: 7139 - DNA, 606 bp, Unknown
  Obtained from environmental sample
  misc_feature (1)..(606): n is a, c, g, or t
atgtgtgaacatggaattactgtaggcataagcagatataacgatgaattttttatgaagatgaaagttgtgggtaagttacagcatagtgattatgatgttattgtacctatgttagaaaaagccattgcaggtattgatgagccgaagattagtgttttggttgatatccttgaatttgatggatatgaactcagagcgatctgggatgatttgaaatttggattaaaatatgacagtgagtttaaaaaaattgcagttgtaggtaacaagcgctgggaagagtacggtattaggatatcgaagtggtttatgagtggagatctgaaattttttgataatatggatgatgcttttaagtggttaagtagagaaaacaaaaaggtagaaaatatgaaagatgcagtaaataaagagttagacagcagaaaaaatgagataagaggtgaattagaagcactttttaaattaaatatgaagattacggattgggatgttcctgaagcagatgatcaaaaagctgcagagatgttagtagagatattacaagagaagttagatgaaataaacgatgatgttaaaaacggaaagtataaaaattattaa

SEQ ID NO: 7140 - protein, 201 aa, Unknown
  Obtained from environmental sample
  misc_feature (1)..(201): Xaa is any amino acid
MCEHGITVGISRYNDEFFMKMKVVGKLQHSDYDVIVPMLEKAIAGIDEPKISVLVDILEFDGYELRAIWDDLKFGLKYDSEFKKIAVVGNKRWEEYGIRISKWFMSGDLKFFDNMDDAFKWLSRENKKVENMKDAVNKELDSRKNEIRGELEALFKLNMKITDWDVPEADDQKAAEMLVEILQEKLDEINDDVKNGKYKNY

SEQ ID NO: 7141 - DNA, 462 bp, Unknown
  Obtained from environmental sample
  misc_feature (1)..(462): n is a, c, g, or t
ttgaaatttgaagagcttacaaaatcaatatttactcaactaggtttcaatgttgatgaacaacttaaaaagcaacttaatactaaaaaagacaaaatagacatccttcttaatctggaaaataatgaattaatactcattgaatgtaaaacagtaaaagaaagcggctataataaatttagtgctgtttccagacaaatgaaagcatatatgaacctagccaaagcaaacgatttcaaaattataaaatcacttctaattgcgccagattttagcgacgattttgtaaatgatactgagctagaatatgatttaaacctttcattaataacggcaaactcattattaaagattcttgatggttttaaaaatactaaaaaacataaattattcccgtacaaactactaatgcgtgatgtactaattgatgaagacagaataataaaggccataaggaaataa

SEQ ID NO: 7142 - protein, 153 aa, Unknown
  Obtained from environmental sample
  misc_feature (1)..(153): Xaa is any amino acid
MKFEELTKSIFTQLGFNVDEQLKKQLNTKKDKIDILLNLENNELILIECKTVKESGYNKFSAVSRQMKAYMNLAKANDFKIIKSLLIAPDFSDDFVNDTELEYDLNLSLITANSLLKILDGFKNTKKHKLFPYKLLMRDVLIDEDRIIKAIRK

SEQ ID NO: 7143 - DNA, 639 bp, Unknown
  Obtained from environmental sample
  misc_feature (1)..(639): n is a, c, g, or t
ttgaaaaaccttggtgtaatattctattctaaaaagctaagcactatatatgtagctgatgaaatagttagggtactacgaaaaattagagaaaaagaaattgcagataaattcttccgtcgaattttacgactatttcgtgaacctcaattaaatctcatctgtagaaaacacaacatcgacagaaaactttcgtctgatcttaaaataaaagagattattaaagagggtatctctttctcaaatgttctttctaatgatgtttataaagaagacactaacctatcggaaaagaaaaagttccttaatgacttctggagcaaagacttaaatctctcccctgccttgaaaggaacaacccttgaggaaaaaattgcaaatattataacttattttgaagccattgaaaaggatgaaaaagtaggaatatcaattgatggttatgagaaattattatcagatttgggagaaaccttacctaaactaaatcaacaaattaaggaagaattcgaattacaggaagataatgtcttaaaaagctatctactacttgatttcaatataaaacctcgagatattatagaaattatataccccatagatttattagcattttgcaaagcaagaagaatattcact

SEQ ID NO: 7144 - protein, 213 aa, Unknown
  Obtained from environmental sample
  misc_feature (1)..(213): Xaa is any amino acid
MKNLGVIFYSKKLSTIYVADEIVRVLRKIREKEIADKFFRRILRLFREPQLNLICRKHNIDRKLSSDLKIKEIIKEGISFSNVLSNDVYKEDTNLSEKKKFLNDFWSKDLNLSPALKGTTLEEKIANIITYFEAIEKDEKVGISIDGYEKLLSDLGETLPKLNQQIKEEFELQEDNVLKSYLLLDFNIKPRDIIEIIYPIDLLAFCKARRIFT

SEQ ID NO: 7145 - DNA, 402 bp, Unknown
  Obtained from environmental sample
  misc_feature (1)..(402): n is a, c, g, or t
atggagccgctatgggataatttaaaattcattaaaaatcaatttgggttaaaagaaaaacgtcataaaaatattgatgaaatgcaggagcaaggaaaaattgtaattactccgttggcatatatcagaggaagaagcttgagtgatgtttattttattgtagatgaagctcaaaaccttacgccacatgaaataaaaactattattactcgtgctggagaaaatactaaaattgttttcacaggagatgttaaccaaattgattctccttatttagatgaacaaagtaacgggctttcttacctaatagataaactaaaaggacatcacttatttgcacacattaaactagaaaaaggcgaacgttctgaactagcgaacttggctaatgaaatgttgtag

SEQ ID NO: 7146 - protein, 133 aa, Unknown
  Obtained from environmental sample
  DOMAIN (5)...(131): PhoH-like protein
  misc_feature (1)..(133): Xaa is any amino acid
MEPLWDNLKFIKNQFGLKEKRHKNIDEMQEQGKIVITPLAYIRGRSLSDVYFIVDEAQNLTPHEIKTIITRAGENTKIVFTGDVNQIDSPYLDEQSNGLSYLIDKLKGHHLFAHIKLEKGERSELANLANEML

SEQ ID NO: 7147 - DNA, 903 bp, Unknown
  Obtained from environmental sample
  misc_feature (1)..(903): n is a, c, g, or t
ttgccttttgagattgatggagtagttataaaagttgatgattacggtcagcagcaagatcttggttttactgcgaaatctcctcgctgggccatagcttataaattcaaaactgaacaagtaagctctaaactagaagccgtgacatatcaagtgggtaggactggagcagttactcctgttgctaatctaactcctgttccgttgggcggaactattgtaaaacgtgcttcacttcacaatcaagatcaaatcaataaactggatttacacgaagaggataccgtttatgtggagaagggtggagagattattccaaaaattgtaggagtagatttaacagaaagaaagagtaatgctcaaaaggtcgagtttatcgagaattgcccagaatgcgatacaccattgaagcgtttagaaggagaagcgcatcactattgtccaaatgacatgggttgcccacctcaaatcacagggagaatgattcatttcatctctcgaaaagcaatggatattgatggattaggatcggagaccattgatcagttatttcgtgaaggattggttaagaacagtgcagatctgtatgatttgacctttgaacaagttgaaaacttggagcgtatgggtaaaaaatctgctgagaacctatttgaaggcttaaaagaatctaaaacagttccttttgaacgtgttttatttgccctgggaattcgatatgtaggggaaacagtagccaagaaaatagccaaagccaagaaaaatattgatgctataatgttagcttcgtatgacgatttaatcgcaattgatgaggtaggagagaagatagccattagtatttcagcacattttagtaacgaagagaatagagatattgttgaacgacttaaagggcacgga

SEQ ID NO: 7148 - protein, 301 aa, Unknown
  Obtained from environmental sample
  DOMAIN (127)...(155): NAD-dependent DNA ligase C4 zinc finger domain
  misc_feature (1)..(301): Xaa is any amino acid
MPFEIDGVVIKVDDYGQQQDLGFTAKSPRWAIAYKFKTEQVSSKLEAVTYQVGRTGAVTPVANLTPVPLGGTIVKRASLHNQDQINKLDLHEEDTVYVEKGGEIIPKIVGVDLTERKSNAQKVEFIENCPECDTPLKRLEGEAHHYCPNDMGCPPQITGRMIHFISRKAMDIDGLGSETIDQLFREGLVKNSADLYDLTFEQVENLERMGKKSAENLFEGLKESKTVPFERVLFALGIRYVGETVAKKIAKAKKNIDAIMLASYDDLIAIDEVGEKIAISISAHFSNEENRDIVERLKGHG

SEQ ID NO: 7149 - DNA, 723 bp, Unknown
  Obtained from environmental sample
  misc_feature (1)..(723): n is a, c, g, or t
atgggttgcccacctcaaatcacagggagaatgattcatttcatctctcgaaaagcaatggatattgatggattaggatcggagaccattgatcagttatttcgtgaaggattggttaagaacagtgcagatctgtatgatttgacctttgaacaagttgaaaacttggagcgtatgggtaaaaaatctgctgagaacctatttgaaggcttaaaagaatctaaaacagttccttttgaacgtgttttatttgccctgggaattcgatatgtaggggaaacagtagccaagaaaatagccaaagccaagaaaaatattgatgctataatgttagcttcgtatgacgatttaatcgcaattgatgaggtaggagagaagatagccattagtattcaagcacattttagtaacgaagagaatagagatattgttgaacgacttaaagggcacggattgaaatttgaaattgaagaggaagaattggatagttcggtcttagacggcaaatcaattgtagtctctggagtttttaatcatttttcaagaacggatttaaagaaaacaattgagaagaatggaggtaagaatgtgagtagtctctcttcaaagacagactacttaatcgcaggagaaaatatggggccagcaaaattggaaaaagcgaaaaaactcgagataccaatgctgtctgaagatgaatttataaagttgattgaaggatga

SEQ ID NO: 7150 - protein, 240 aa, Unknown
  Obtained from environmental sample
  DOMAIN (161)...(238): BRCA1 C Terminus (BRCT) domain
  misc_feature (1)..(240): Xaa is any amino acid
MGCPPQITGRMIHFISRKAMDIDGLGSETIDQLFREGLVKNSADLYDLTFEQVENLERMGKKSAENLFEGLKESKTVPFERVLFALGIRYVGETVAKKIAKAKKNIDAIMLASYDDLIAIDEVGEKIAISIQAHFSNEENRDIVERLKGHGLKFEIEEEELDSSVLDGKSIVVSGVFNHFSRTDLKKTIEKNGGKNVSSLSSKTDYLIAGENMGPAKLEKAKKLEIPMLSEDEFIKLIEG

SEQ ID NO: 7151 - DNA, 339 bp, Unknown
  Obtained from environmental sample
  misc_feature (1)..(339): n is a, c, g, or t
gtgaaaaagtttgaaatagtaattcttgagactgtaagaacgtttctgaaaaccttagataaaaaggctggtactaaaatagtatttaatttaaggaaatctcaggtgactgttgaccccgaattatttaagaaactgactgatgaaatttgggaacttagaacaaagtacaataataattactataggctcttagcgttttgggataaatcgaacaaaaaggaaactcttgttgtttgtgcacatggcttcattaagaaaaccaagaagactcctaaagcggatattgaaaaggctaaattgataatgaaaaagtattttgaaaatgaaagcaaataa

SEQ ID NO: 7152 - protein, 112 aa, Unknown
  Obtained from environmental sample
  misc_feature (1)..(112): Xaa is any amino acid
MKKFEIVILETVRTFLKTLDKKAGTKIVFNLRKSQVTVDPELFKKLTDEIWELRTKYNNNYYRLLAFWDKSNKKETLVVCAHGFIKKTKKTPKADIEKAKLIMKKYFENESK

SEQ ID NO: 7153 - DNA, 732 bp, Unknown
  Obtained from environmental sample
  misc_feature (1)..(732): n is a, c, g, or t
atgcgtgcaggaccgggattgggtaatattggacctgaacaaggggattataatcaggttgtaaagggtggcggcaatggcaattacaaaaatattgtccttgcacctgatagcgttcaggaaatgtgcgatatgactataaaagcctttgaattagcttttaagtaccgtaatcccgtttttgtgctggctgatgcggttttaggtcaaatgattgagcctttgaattttccggaaactgctatcgagcctactattgatacaagctgggcagtgtcggggacaaaagatacgatgaaaaatctgataacatcaattgttttggattttgatgagcttgaagaattaaataataagcttcagaaaaaatatgctgaagttgaagctaacgaagttgattttgatacatataaaatagatgatgctgacataatattagtagcttatggtattagtgcaagaatttcccgttcaacagttgatattgctcggaaagagggtaaaaaagttggtcttttcaggcctaaaacgctatttcctttcccaaagaatgaactgaaagcctttgctaaaaaaggagttaggttcatttcagttgagatgagcaatggtcaaatgattgatgatgtcaagcttgctatagagtgcaagtgccctgttgagttggtcagcagaatgggtggtgtgatgatgaccaacgaagaaattatgaaaaaaatcaatagtatataa

SEQ ID NO: 7154 - protein, 243 aa, Unknown
  Obtained from environmental sample
  DOMAIN (1)...(132): Pyruvate flavodoxin/ferredoxin oxidoreductase, thiamine diP-binding domain
  misc_feature (1)..(243): Xaa is any amino acid
MRAGPGLGNIGPEQGDYNQVVKGGGNGNYKNIVLAPDSVQEMCDMTIKAFELAFKYRNPVFVLADAVLGQMIEPLNFPETAIEPTIDTSWAVSGTKDTMKNLITSIVLDFDELEELNNKLQKKYAEVEANEVDFDTYKIDDADIILVAYGISARISRSTVDIARKEGKKVGLFRPKTLFPFPKNELKAFAKKGVRFISVEMSNGQMIDDVKLAIECKCPVELVSRMGGVMMTNEEIMKKINSI

SEQ ID NO: 7155 - DNA, 510 bp, Unknown
  Obtained from environmental sample
  misc_feature (1)..(510): n is a, c, g, or t
atgaaattaaaaatagcccaattaagtgatatagatggtattttaaaactacataataaataccaaatagatagtataaatgaagaggataaaaaagatggttttgttactacatcttttgaccgtgaacagttagcagatattattacacaagagcaaggtatatttatagcaaaagatgataataatgaagttttaggatatgttatgtctgcatcatggcagtattggtcaaagtgggctatgtttgcttttatgataaaagatttaccaaacttaacatatcaaaatcttactctatctatagataattcatatcaatatggacctgtttgtatagataaaagtgtaagaggaagtggtttactagaaaaattatttgattttgccttagaatctatgtctaaaagatatccgatacttgtaacctttgtaaataaaataaatccaagatcatatgaagctcataaaagaaaaataggacttgaagtgatacaagagttttcattt

SEQ ID NO: 7156 - protein, 170 aa, Unknown
  Obtained from environmental sample
  misc_feature (1)..(170): Xaa is any amino acid
MKLKIAQLSDIDGILKLHNKYQIDSINEEDKKDGFVTTSFDREQLADIITQEQGIFIAKDDNNEVLGYVMSASWQYWSKWAMFAFMIKDLPNLTYQNLTLSIDNSYQYGPVCIDKSVRGSGLLEKLFDFALESMSKRYPILVTFVNKINPRSYEAHKRKIGLEVIQEFSF

SEQ ID NO: 7157 - DNA, 351 bp, Unknown
  Obtained from environmental sample
  misc_feature (1)..(351): n is a, c, g, or t
atgtattgtaaaaatagtgatgagtatttaaaaaacgatataccaaaaacacaaaaagcacaaatagctgtattatctccaaaagaagagacagattttttagtaagaaaaatcaaaatagaagagggtggtagtatgccaaatcatacaaaccttatccaacatcaacaatatgttttaagtggtgaagcaaaagttgtagttggagatgaaactatcaatgctaaagcaggggactttatctatattccagcaggtgtaaaacattattatgaagcctattatggtaaagagtatcaatttttatgtatgataacaactacacctgatactattactatggttgaataa

SEQ ID NO: 7158 - protein, 116 aa, Unknown
  Obtained from environmental sample
  misc_feature (1)..(116): Xaa is any amino acid
MYCKNSDEYLKNDIPKTQKAQIAVLSPKEETDFLVRKIKIEEGGSMPNHTNLIQHQQYVLSGEAKVVVGDETINAKAGDFIYIPAGVKHYYEAYYGKEYQFLCMITTTPDTITMVE

SEQ ID NO: 7159 - DNA, 411 bp, Unknown
  Obtained from environmental sample
  misc_feature (1)..(411): n is a, c, g, or t
ttgagtatatttatccagttaaataatatgtcagaagaacaaagcataaactatcttgctagtctatttacacataaaaatatctctttagacacccaaacagattcattccaaaaaggggcattgttacgcaaaagtattattgagatgattgatgacccagatataaaagctcaacaagaaaaactagaaaaagagtttgcagcttctatgatgaaatttgatattatgagtcattttaattcaatgttagattttgggagaaatgaaaaagataaaaataaaaattctgaatatagttttttatacaataatttttacgaacaatacgatacattgttcagtgattataaaaataacaaatcactaaatgatattatgattaatcaatatagaaaagtaaacttgtag

SEQ ID NO: 7160 - protein, 136 aa, Unknown
  Obtained from environmental sample
  misc_feature (1)..(136): Xaa is any amino acid
MSIFIQLNNMSEEQSINYLASLFTHKNISLDTQTDSFQKGALLRKSIIEMIDDPDIKAQQEKLEKEFAASMMKFDIMSHFNSMLDFGRNEKDKNKNSEYSFLYNNFYEQYDTLFSDYKNNKSLNDIMINQYRKVNL

SEQ ID NO: 7161 - DNA, 888 bp, Unknown
  Obtained from environmental sample
  misc_feature (1)..(888): n is a, c, g, or t
ttgaaaaagagtaaagattttgattcaattgagaaacattttctaaaaatatttcaaaattgtaaattgctatttgttaaaggtgatattgctagcattactaaagctaaagagagtctaaaagagtatgcaacaatcagatcaaaagcagttctaatcaacaatttattaacaaaatataaactgttcgtctctgctgaaaaattgatcaaagagagaaactttaaaaactattttctacttgtaaaacagaataaatttttagaagatgaggagatatacaacagagttatcttaattgcaaatcaaacattttcaaaattaaatctctatgaacaagagggaaattatgaaaaagctattgaagttgcagagtatatgaaagactttttgccattcaagcaaaaagctgaagataaaattgttgatattaaaaaaatgcagctaatattgaaaaatattgaagataaaaaagttgaagaactttataaacttatcgataaagagtcaaagttccaaactttcaaaccgtttattgaatttcatgaaaattttttactcttgattaaaaaagcgcataatgcagcaaaaaatgctgacgtaaaaagtgtatctaagattttaaatagatatataaatatagattacactatccacatagtggctcaagagtttaaaacagcttacatggcacaaatagaaaaagagataactgaacctggtgagcaaaaaattgactgggtcaagagtattaaactatatgattcaatgtttggattagatgatgaactgaactatttattggagaaatttggcttccatgagattctttcaaatattgaaaacaaaaataaatttgacggctacaccaacagtaaagttttttga

SEQ ID NO: 7162 - protein, 295 aa, Unknown
  Obtained from environmental sample
  misc_feature (1)..(295): Xaa is any amino acid
MKKSKDFDSIEKHFLKIFQNCKLLFVKGDIASITKAKESLKEYATIRSKAVLINNLLTKYKLFVSAEKLIKERNFKNYFLLVKQNKFLEDEEIYNRVILIANQTFSKLNLYEQEGNYEKAIEVAEYMKDFLPFKQKAEDKIVDIKKMQLILKNIEDKKVEELYKLIDKESKFQTFKPFIEFHENFLLLIKKAHNAAKNADVKSVSKILNRYINIDYTIHIVAQEFKTAYMAQIEKEITEPGEQKIDWVKSIKLYDSMFGLDDELNYLLEKFGFHEILSNIENKNKFDGYTNSKVF

SEQ ID NO: 7163 - DNA, 414 bp, Unknown
  Obtained from environmental sample
  misc_feature (1)..(414): n is a, c, g, or t
ttggcaatatctgctattttacatgacttgggaaaaagtaaaatagagatagaaattataaataaaaatggaaaattgacaaatcaagagtttgaaaaaataaaagagcatccagaatatgggtatgaattagctaaaaaagctggaatcacaaatgagaaggtactttcaggaatcagacatcatcatgagaggctcgatggaagtggatatccagataaattattatctgaggagataaaactttttccaaaaataattgctatatgtgatatgtttgatgcattaactacaaaaagaccatacaaagaacccatgagtacatttgattcatttaaacttatgaagagtgccagtaatcacttagatacaactctattaattaaatttatgcaaatgatggtgaaaaagtag

SEQ ID NO: 7164 - protein, 137 aa, Unknown
  Obtained from environmental sample
  DOMAIN (1)...(96): HD domain
  misc_feature (1)..(137): Xaa is any amino acid
MAISAILHDLGKSKIEIEIINKNGKLTNQEFEKIKEHPEYGYELAKKAGITNEKVLSGIRHHHERLDGSGYPDKLLSEEIKLFPKIIAICDMFDALTTKRPYKEPMSTFDSFKLMKSASNHLDTTLLIKFMQMMVKK

SEQ ID NO: 7165 - DNA, 681 bp, Unknown
  Obtained from environmental sample
  misc_feature (1)..(681): n is a, c, g, or t
atggcagatttagatgggcgaattttttatatattttataatgcaaatatgngctatggcgcagggcataatgttgctataataaaatcaatagaatcaggcatagattatcatgttgttttgaatccagatctcttttttgagggtaaagtcatagatgatatttatgagtatatgcaaaaaaatatggatgttgcaaatgtaatgccaaagattctttatccaaatggagagaatcagtacttagcaaaactactaccaaccccacttgattggattttgagaagattcttaccagctagatttacacaagatataactgataagtttgaacttagatacacaaattatacagacattatgaatgttccttttctctcaggatgttttatgtttttaagagtatcttcattaaaagaagttggtctctttgatgaaaatatttttatgtatatggaagatatagatttaaacagaagacttcatgcaaaatacaaaacactctactaccctgaagtcagcgtatatcatgagtatgaaagaggctcacataaaaactggaagctgcttcgtatatctatagagagttccataaagtactttaacaaatggggttggatttttgacaaagagcgaaagatgatgaatgagaaactacttaaagagacaaactatgagtag

SEQ ID NO: 7166 - protein, 226 aa, Unknown
  Obtained from environmental sample
  misc_feature (1)..(226): Xaa is any amino acid
MADLDGRIFYIFYNANMXYGAGHNVAIIKSIESGIDYHVVLNPDLFFEGKVIDDIYEYMQKNMDVANVMPKILYPNGENQYLAKLLPTPLDWILRRFLPARFTQDITDKFELRYTNYTDIMNVPFLSGCFMFLRVSSLKEVGLFDENIFMYMEDIDLNRRLHAKYKTLYYPEVSVYHEYERGSHKNWKLLRISIESSIKYFNKWGWIFDKERKMMNEKLLKETNYE

SEQ ID NO: 7167 - DNA, 351 bp, Unknown
  Obtained from environmental sample
  misc_feature (1)..(351): n is a, c, g, or t
ttgaactttctttcatattctattggtacaactttatctgatttacaagtagatgcaataaacggaagcttatggacactaaaaaatgaagtagtattttatattcttgttccatttttgtttattctatataaaaaatttggaaaatttgtatttgtagtcttttatatattttctgtaatatggatgtttataatcgattatattgcatctttaaatcccatactatcttttgtatctttatttatgattatcttagtcttaagttgtttgtcggaaattttcatagaaaagaagtttatagccataggaaaaaagataataaagaaggataaaaatgcaacaacttaa

SEQ ID NO: 7168 - protein, 116 aa, Unknown
  Obtained from environmental sample
  misc_feature (1)..(116): Xaa is any amino acid
MNFLSYSIGTTLSDLQVDAINGSLWTLKNEVVFYILVPFLFILYKKFGKFVFVVFYIFSVIWMFIIDYIASLNPILSFVSLFMIILVLSCLSEIFIEKKFIAIGKKIIKKDKNATT

SEQ ID NO: 7169 - DNA, 459 bp, Unknown
  Obtained from environmental sample
  misc_feature (1)..(459): n is a, c, g, or t
atgtcaaaagagatatataaaagtgcaaaagatacttttttagatctcgtagatgatgataattttattaagcttgataaagcagtagaggtttatgaatctctgaagatatctgtaaaaaaacctttaaaattggtacttttatacggtgaaccaggaaccggaaaaagtatgctgttaaacagactctacaaagagttaaaaaatgattcagatatttttttatattctattccaattcttgacgaaaatgagttcttctcaacacttgcacaagatatatataaacaaaatacaggtgaaacttttaacttttcaaagtttaacaaactgctatataatgtagatttgcagagagtttccattatccctctagatgagtcacaactttacagtaacacactcatggaaaagatacgtctgcttgcagatagcagaaaaatcaaatttgtaaataac

SEQ ID NO: 7170 - protein, 153 aa, Unknown
  Obtained from environmental sample
  misc_feature (1)..(153): Xaa is any amino acid
MSKEIYKSAKDTFLDLVDDDNFIKLDKAVEVYESLKISVKKPLKLVLLYGEPGTGKSMLLNRLYKELKNDSDIFLYSIPILDENEFFSTLAQDIYKQNTGETFNFSKFNKLLYNVDLQRVSIIPLDESQLYSNTLMEKIRLLADSRKIKFVNN

SEQ ID NO: 7171 - DNA, 324 bp, Unknown
  Obtained from environmental sample
  misc_feature (1)..(324): n is a, c, g, or t
atgcaaaaggggcatttcaaaacacgtatttggcagagtgttatcttaaaaaatgctacattaaatgagctaagtctatacatacaaaaaaaacttctaaataatcatctcttagaggtctcttctatgtttaataaaaaaagtacaagactgatacatcaattaacaaatggaaattacagagacactaacaagcttttatacactctatttggcatatacgagtactacgaaagtacaaagcctagtataattaataactcatccatcaaaacaaaatttattgaaatggcagcaatagagtcaggatttataaatgcataa

SEQ ID NO: 7172 - protein, 107 aa, Unknown
  Obtained from environmental sample
  misc_feature (1)..(107): Xaa is any amino acid
MQKGHFKTRIWQSVILKNATLNELSLYIQKKLLNNHLLEVSSMFNKKSTRLIHQLTNGNYRDTNKLLYTLFGIYEYYESTKPSIINNSSIKTKFIEMAAIESGFINA

SEQ ID NO: 7173 - DNA, 690 bp, Unknown
  Obtained from environmental sample
  misc_feature (1)..(690): n is a, c, g, or t
gtgaactactacattatagctggagaagcttcaggagatttacaagcctctttacttatcagggaattaaaaaatactgataaaactgctcaatttcgttgttttggtggtgatttaatggaagctgaaggtgctgaaattgttaagcattacaaagaactagcgtttatgggcgtggaagatgtgttgatgaacttaagaaccattttcagaaacattgctttttgcaaagaagacataaaagcctaccaaccagatgtgttaattttagtagattacccaggttttaatatgaagattgccaaatgggcaaaagcaaataacattaaggttttttattatatctcccctaaaatttgggcatggaaccaaaagcgtgttcatcaaattaaaaaagtggttgacagaatgtttgttatccttccttttgaaaaagatttttataaaaaatttgattacagtgttgattttgtaggacatccacttattgattgcatttctgaatatcccaatattactttagaaaattttaaaaaaaaatatcaactttctgataaaccaattattgccttactaccaggaagcagaaaacaagaaattactgccatgctcaacatcatgctctctgtatgtaataacttcccaagaatatcatttgtaattgcggggagctccctcacaaccctttaa

SEQ ID NO: 7174 - protein, 229 aa, Unknown
  Obtained from environmental sample
  DOMAIN (3)...(229): Lipid-A-disaccharide synthetase
  misc_feature (1)..(229): Xaa is any amino acid
MNYYIIAGEASGDLQASLLIRELKNTDKTAQFRCFGGDLMEAEGAEIVKHYKELAFMGVEDVLMNLRTIFRNIAFCKEDIKAYQPDVLILVDYPGFNMKIAKWAKANNIKVFYYISPKIWAWNQKRVHQIKKVVDRMFVILPFEKDFYKKFDYSVDFVGHPLIDCISEYPNITLENFKKKYQLSDKPIIALLPGSRKQEITAMLNIMLSVCNNFPRISFVIAGSSLTTL

SEQ ID NO: 7175 - DNA, 315 bp, Unknown
  Obtained from environmental sample
  misc_feature (1)..(315): n is a, c, g, or t
atgttaattgatatttttaataaatttgaatttgaatttgcaatggatgatttctttaaagaagattctatggtttcaatttttttacttaataaaacaaactacataaaacttgacaaggatatacttacagcagttaaatcaaataattcttttattcatattgtaaatgggatagttgactttgcacattctcaaaagcaaaaagtgattttagaagggattgaaacttatgaggatttagagatagcaagagatacaaaggtagattttatacaaggatttttatatgataacctctttattaataaataa

SEQ ID NO: 7176 - protein, 104 aa, Unknown
  Obtained from environmental sample
  misc_feature (1)..(104): Xaa is any amino acid
MLIDIFNKFEFEFAMDDFFKEDSMVSIFLLNKTNYIKLDKDILTAVKSNNSFIHIVNGIVDFAHSQKQKVILEGIETYEDLEIARDTKVDFIQGFLYDNLFINK

SEQ ID NO: 7177 - DNA, 906 bp, Unknown
  Obtained from environmental sample
  misc_feature (1)..(906): n is a, c, g, or t
gtgggcacgtcctattataagcgtgtcaaagccccaaccatagcaggccattttaatgaaatcttggtacaatggaacatggagaccattaagcaagaccatggtaaagaccatttaagtaaaatatctaagtatgatggcttcacttgtattcctaatcacattaattttcaacaggaacacctgggcttttacaatatctactcccctttgggtaaaatacccgaagaaggagacacggcattgtccctcaaattcgtcaagcacatatttggaaaacactacgaactgggtttggactatttacaattactatatctcaagcctatccaggtactgcccattctatgcttggtttccaaagaacgctccacaggaaaaagcaccttcttaaaatggctcaaagagatcttcgggaacaacatgacctacctcactaacgacagtttcgccagccagttcaatgcggactgggccaacaagctattggtttgcatcgacgaggtgctgttcaacaaggaggagctcaccgagcgcatcaagtacctaagcactaccaacatcaacaaactagaggccaagggcaaagataaacgtgaagtagaattctttgggaagtttattctatgtagcaataatgaagaaagctttataaagattgatgcccaagagactcggttctgggtactcaagattccgtctgtccatctcgaggtgactgattacctaaagaggctcaccgatgagattccagcgttcctttactatttgtccaatcgggagatgagcacaaggcacagcacccggatgtggttttcaccagagcaaatacgaaccaaagcccttgaacgcttggtgcgcaacaaccgtggtcatctgaaaaaagaatggcccagcctctggtag

SEQ ID NO: 7178 - protein, 301 aa, Unknown
  Obtained from environmental sample
  misc_feature (1)..(301): Xaa is any amino acid
MGTSYYKRVKAPTIAGHFNEILVQWNMETIKQDHGKDHLSKISKYDGFTCIPNHINFQQEHLGFYNIYSPLGKIPEEGDTALSLKFVKHIFGKHYELGLDYLQLLYLKPIQVLPILCLVSKERSTGKSTFLKWLKEIFGNNMTYLTNDSFASQFNADWANKLLVCIDEVLFNKEELTERIKYLSTTNINKLEAKGKDKREVEFFGKFILCSNNEESFIKIDAQETRFWVLKIPSVHLEVTDYLKRLTDEIPAFLYYLSNREMSTRHSTRMWFSPEQIRTKALERLVRNNRGHLKKEWPSLW

SEQ ID NO: 7179 - DNA, 444 bp, Unknown
  Obtained from environmental sample
  misc_feature (1)..(444): n is a, c, g, or t
atgcaccttgtttctagtgttatacataaccgtatcaacaaaggtatgaaacttcaaatggatggaacattaaattatggaaaaaattcacatattactgttacaccacagatgatcaaaaatgatacttcacaatataatacctacaaaagaaaaggggtaccagataatccaatttgtgctattgagtttgaagcaattcgctcagcaatttttccaacaaaaacaagttatctctattttatgagatctacagatggaaatagtcataatttttcctcgtcttacaaagagcatatagcaaatattagaaatgtacaaaagaacaatagaagtcctaaaaagaaacaaactagtataaatcaaacaaaaaaaatcaaacagaaacaacaaacagttgaaaagtcagtttttaaaagggatttaaaagcattatggaaataa

SEQ ID NO: 7180 - protein, 147 aa, Unknown
  Obtained from environmental sample
  DOMAIN (1)...(109): Aminodeoxychorismate lyase
  misc_feature (1)..(147): Xaa is any amino acid
MHLVSSVIHNRINKGMKLQMDGTLNYGKNSHITVTPQMIKNDTSQYNTYKRKGVPDNPICAIEFEAIRSAIFPTKTSYLYFMRSTDGNSHNFSSSYKEHIANIRNVQKNNRSPKKKQTSINQTKKIKQKQQTVEKSVFKRDLKALWK

SEQ ID NO: 7181 - DNA, 594 bp, Unknown
  Obtained from environmental sample
  misc_feature (1)..(594): n is a, c, g, or t
ttgtctcttttgggggagaatatgcatacctatagcagccatccggcacgccggagcggagagcagaactttaactatattggtggtcaccgactgcatagccaaaggataaatccggcacgcagatggggcgaggagaactattttgcctggaaatgttttcaggcattggggcttgtctcgccatcggatgacgatgatcttgctgataacagcgagaccaatttttatgaaaatcaatccaatacgatcatcaaggcgttaagtgacagtatttcgattgtcaaatcggttatcgagatcaagcctgttcttgaaggtctgatcgaagcgtcccgttcaaaagggcagttcgcagataaatcggccaaagacaaaatgggggcgccggaggtaaaggcatctaatgatacggatgtcgatgatctgaaatggtcgcccgaaaaaatgatcgaaattcacaatatctgcacggaaagccgtcttgcaaatcgggtcagcccgaataccagcaaaaaatacaaagacaatgtggatggcgaccgcaaaccggaacgtccggttgtccggcggtatgatccgcataagaactag

SEQ ID NO: 7182 - protein, 197 aa, Unknown
  Obtained from environmental sample
  misc_feature (1)..(197): Xaa is any amino acid
MSLLGENMHTYSSHPARRSGEQNFNYIGGHRLHSQRINPARRWGEENYFAWKCFQALGLVSPSDDDDLADNSETNFYENQSNTIIKALSDSISIVKSVIEIKPVLEGLIEASRSKGQFADKSAKDKMGAPEVKASNDTDVDDLKWSPEKMIEIHNICTESRLANRVSPNTSKKYKDNVDGDRKPERPVVRRYDPHKN

SEQ ID NO: 7183 - DNA, 396 bp, Unknown
  Obtained from environmental sample
  misc_feature (1)..(396): n is a, c, g, or t
gtgactactgacatgacaaaaatgctcaccgacataatgaacaataactaccaactgttaggaaagcttgtcaagtcagagttgagcaaggaagatttgaaacaggaatgcaagtcattagtcgaaaagaacaagttcatatctggatttttaagagatgtttctattggaatctgcatgacaactgttaaagacaggtcagcgaaggcaagtgataaagagcagttttcaaaattaactcaaaaagaaagggatgaaattaatgaactcttaattgagaagttcggaaaagatataaaaacaacgagcaaggagaacacagatacaccatttgaatattcatgtgttgcaatttatgagttcctaaacatgccctggaaatttgaaaaagaataa

SEQ ID NO: 7184 - protein, 131 aa, Unknown
  Obtained from environmental sample
  misc_feature (1)..(131): Xaa is any amino acid
MTTDMTKMLTDIMNNNYQLLGKLVKSELSKEDLKQECKSLVEKNKFISGFLRDVSIGICMTTVKDRSAKASDKEQFSKLTQKERDEINELLIEKFGKDIKTTSKENTDTPFEYSCVAIYEFLNMPWKFEKE

SEQ ID NO: 7185 - DNA, 525 bp, Unknown
  Obtained from environmental sample
  misc_feature (1)..(525): n is a, c, g, or t
gtgatgtataatgattttgtaataattggaccaaaaaaagatcctgcacatataaaaggtatgacaccaagtacagctttaaaaactattaaagataaagaggagaagttttttagccgtggtgatatttcagggacaaataaaaaagagctttctttatggaaaaatgcaaatgttgatgcaaaatctgcttcaagttggtatgttcaaacaggacaaggtatgttaagaacaataaacatggctgctgaaaaaggtggatacactatgacagatagaggaacttggattaaatatatgtctcaaaaaggtgatagtaatactttagaagtcgtagttgagggtgataaaacattatttaaccaatactctgtagtgtctatcaataaagagaaatgtgcaaatgtgaaacctcaattagcagaacaatttacacagtgggttattaaccctcaaacacaacaaacaattgctgattttagattattggggcaagcattatttatacctaatgctggaaaatag

SEQ ID NO: 7186 - protein, 174 aa, Unknown
  Obtained from environmental sample
  misc_feature (1)..(174): Xaa is any amino acid
MMYNDFVIIGPKKDPAHIKGMTPSTALKTIKDKEEKFFSRGDISGTNKKELSLWKNANVDAKSASSWYVQTGQGMLRTINMAAEKGGYTMTDRGTWIKYMSQKGDSNTLEVVVEGDKTLFNQYSVVSINKEKCANVKPQLAEQFTQWVINPQTQQTIADFRLLGQALFIPNAGK

SEQ ID NO: 7187 - DNA, 873 bp, Unknown
  Obtained from environmental sample
  misc_feature (1)..(873): n is a, c, g, or t
ttgtatggtagaatacgcgatatttataacaaaagggtaacaatggcaattacaagatttgcacctagtcctacaggatatttacatattggaggtttacgaactgcactttatagttatttgtgggcaaaaaaaaccaatggtgaatttaaacttagaattgaagatactgataatgcaagaaataatgaggatgctgtaagagcaatacttgaagcttttgagtgggttggaatgccaagtgactgtgagattgagtatcaatcaaaaagatttgatatttataaaaaatatatcgataaacttttagaagagggaaacgcatacaaatgttatatgagtcgtgaagaacttgatgcactccgtgcaaaacaagagagcaacaaagaaactccaagatatgatggaacttggagaccagaagatggaaaaactctgccagctattccagatagcgtagagccagttattagaataaaagcacccacaactggaactatagagtttacagatggagtaaaaggtactatgagatttgatgctaaccaagtggatgattttgttattgcgagaagtaatggtgctccaacatataattttgtagttgcagttgatgatgctttaatgggtatgactgatgtactaagaggggatgatcacctttcaaatacaccaaaacaaattgtagtatacaatgcacttggatttggtatacctaaattttttcatatccctatgataaacaatccatctggaaaaaaactctctaaaagagatggtgctatggatggtatgggatataaaagactaggatttctaccagaagcactttttaaattttcttgtaaggacttgggttggtccaaagggaaa

SEQ ID NO: 7188 - protein, 291 aa, Unknown
  Obtained from environmental sample
  DOMAIN (15)...(289): tRNA synthetases class I (E and Q), catalytic domain
  misc_feature (1)..(291): Xaa is any amino acid
MYGRIRDIYNKRVTMAITRFAPSPTGYLHIGGLRTALYSYLWAKKTNGEFKLRIEDTDNARNNEDAVRAILEAFEWVGMPSDCEIEYQSKRFDIYKKYIDKLLEEGNAYKCYMSREELDALRAKQESNKETPRYDGTWRPEDGKTLPAIPDSVEPVIRIKAPTTGTIEFTDGVKGTMRFDANQVDDFVIARSNGAPTYNFVVAVDDALMGMTDVLRGDDHLSNTPKQIVVYNALGFGIPKFFHIPMINNPSGKKLSKRDGAMDGMGYKRLGFLPEALFKFSCKDLGWSKGK

SEQ ID NO: 7189 - DNA, 801 bp, Unknown
  Obtained from environmental sample
  misc_feature (1)..(801): n is a, c, g, or t
gtggtaataacccttaatactattgcttattcagtaacagatgctattgccaacaaagatgtttttgtggtaatgggggatgctaaaacaggaattggaacagctaatcctaccgcccaattagatataattacagaaaataatacagggttagttgtaactacaaatcatactaataattttggttatgggattcatagtaaagtagcaaaaaataaaactaaagcgtttgcagtttataatgctgaggaaaataaggaaagttttattgttcatggagatggagaaacgcatattgttgggaaaactccaaatataaagttaatagatgatgaaatagaaactggcaccacagcaacatctgatttttatataagtgctgctaatggagctggtaggttaatttcagacaatagcattgtaatgtttattgattctgataacaatcagagtgatgcagtgtttgaaatagtttctaataatggtttttacagttctaacattacccaattatttaaagtaaaagaagttggtggtgtgttttgttctgaaattacggtacaggttgctccgtttcctgattatgtttttcatactgattatgagttaatgactttgcaagaattagaaaaatacatagcagaaaataaacatttacccaacataccaacagctaaagaagtggaagagaaaggattaagtttaggtgatatgcaagtgaaacaaatggaaaaaatagaagaattaaccctatacattattgctctagaaaaaagaattaaggaattggaaagcaaataa

SEQ ID NO: 7190 - protein, 266 aa, Unknown
  Obtained from environmental sample
  misc_feature (1)..(266): Xaa is any amino acid
MVITLNTIAYSVTDAIANKDVFVVMGDAKTGIGTANPTAQLDIITENNTGLVVTTNHTNNFGYGIHSKVAKNKTKAFAVYNAEENKESFIVHGDGETHIVGKTPNIKLIDDEIETGTTATSDFYISAANGAGRLISDNSIVMFIDSDNNQSDAVFEIVSNNGFYSSNITQLFKVKEVGGVFCSEITVQVAPFPDYVFHTDYELMTLQELEKYIAENKHLPNIPTAKEVEEKGLSLGDMQVKQMEKIEELTLYIIALEKRIKELESK

SEQ ID NO: 7191 - DNA, 798 bp, Unknown
  Obtained from environmental sample
  misc_feature (1)..(798): n is a, c, g, or t
atgtatgagtttacaagtataatttctgaaattagtaatcaaaaagaatctaaagaaatccaatttgaagatttaaaaattaaagatcttagttttaggtttccgggcagaaagagaatattagaaaatatcaatatctcaattaaaaaaggagagttgatatccttaattggtgaaagtggatgtgggaaaagtacatttggatatttgttacagaaattttataaacctgaatcaggtgggattattattaatagtaatcttattttgcaagattttaatacaagtgtatggcgtaacatacttggtgttgttccacaagacattcacatatttaatggtaatgtaattgataatatttgtattgatgattcgcaaaaagaagcagaaagtgttttaaagttttttgccgaatttggttttggaaaatatatagatacactgccacaagggtatatgaccatccttggcgaagaaggtattaacttatcgggtggacaaaaacagattattgctttagcgcgagccctttataaaaagcctcagttgcttattcttgatgaagcaacagcggcaatggatcgagaaacagaaaaattcactattgagctattgcaaaaaatgaaacaggatattgcaatattctatatatcacatcgacttcatgttctaaagaacattagtgataaaatttatattcttcaagatggaaaggtgcaagatgagggtacgcattttgaattgcttattagagaaaatatttatagtagttattggaaagatttaattgataattaa

SEQ ID NO: 7192 - protein, 265 aa, Unknown
  Obtained from environmental sample
  DOMAIN (51)...(237): ABC transporter
  misc_feature (1)..(265): Xaa is any amino acid
MYEFTSIISEISNQKESKEIQFEDLKIKDLSFRFPGRKRILENINISIKKGELISLIGESGCGKSTFGYLLQKFYKPESGGIIINSNLILQDFNTSVWRNILGVVPQDIHIFNGNVIDNICIDDSQKEAESVLKFFAEFGFGKYIDTLPQGYMTILGEEGINLSGGQKQIIALARALYKKPQLLILDEATAAMDRETEKFTIELLQKMKQDIAIFYISHRLHVLKNISDKIYILQDGKVQDEGTHFELLIRENIYSSYWKDLIDN

SEQ ID NO: 7193 - DNA, 726 bp, Unknown
  Obtained from environmental sample
  misc_feature (1)..(726): n is a, c, g, or t
ttggattatcgctcggagattaacgatgcgcgtgaattgcagctatcgttacttcctcattgtgctaataatattggcaatcttgaaatttgttttgacatgagaacggcatcagaagttggtggtgactattatgattatgaactttctgaagatggagaactttctattgttattggtgatgcaaccgaccatggaatgaaagccggaatgatggtatccatagtgaaaagcttatttcttgcaagagataaaaacattaaaattaaagagttttttaacaattgctctaaaacaattaagcagatgaagctaaaaaatctctttatggcgttaatgttcgttatagtaaaagaaggaaaactaatttcatcttcagctggaataccaccgtttttggtttacagaaagaaaaccaatgagattgaagaattgaaaactaagggaatgcctctcggtgccgtaaatagttttccttatcaaaccatagaaactgagcttggtgtcggagatgttgttcttttaatgacagatggattaatagaattgtttaatgaagaaaaaatccaatttggtgagcaaagaataaaggatatttttttgttgaatgcgcaattacctgtaactaaaataatagaaaaattattgcaggctggggaagaatggattggcaataataatcaaaatgacgatattacacttgttgcgtttagaatgacgaagtaa

SEQ ID NO: 7194 - protein, 241 aa, Unknown
  Obtained from environmental sample
  DOMAIN (51)...(240): Stage II sporulation protein E (SpoIIE)
  misc_feature (1)..(241): Xaa is any amino acid
MDYRSEINDARELQLSLLPHCANNIGNLEICFDMRTASEVGGDYYDYELSEDGELSIVIGDATDHGMKAGMMVSIVKSLFLARDKNIKIKEFFNNCSKTIKQMKLKNLFMALMFVIVKEGKLISSSAGIPPFLVYRKKTNEIEELKTKGMPLGAVNSFPYQTIETELGVGDVVLLMTDGLIELFNEEKIQFGEQRIKDIFLLNAQLPVTKIIEKLLQAGEEWIGNNNQNDDITLVAFRMTK

SEQ ID NO: 7195 - DNA, 762 bp, Unknown
  Obtained from environmental sample
  misc_feature (1)..(762): n is a, c, g, or t
gtgccggcaagaatctcaacgtatcatccattaatcatgacttcaaagaaactcctggaaaaaatagacaatagcgagaaaagacttagatactgggaagtagcaaatgaaaacgacttattacccattcatacagacttgaaacatagagacagagcattacggtttatggacactttaataaaaatcgtggaagccatgggatgtaaaattgtattttattgtaatagtgcacacgttgagatgtttggtcaaaaaacagaaataaacctaaggcagaaggtatatagaataagaaataaagatgaaagcggatggagcagagaatcttgggaaaagtctgataaacttgaatttcaggctggcccttcattcaatcaaaaaaaatggattgacaatacaaaacgaaaacttgaagaatgtctacccgaaataatagtctggatagaaaaggactgcaaatattggcatgacctaaggacagaacaggccattgaagagaataagagattgctacaggaacaaaaactagaggccctaaaaaaagccaaagaatcagagcaggcaaaagtgaaccaattatttattgatgcagaaaattggaataaagcaaaagtagctgagcactatataagcgcaatggaagaaaaagctgtacaaaaaaacgagatgaattcgaataccaaggactacatatcctgggcaagagaagtcattaaaaaattaaatccgctaagtgatagtaattggtcagagcaataa

SEQ ID NO: 7196 - protein, 253 aa, Unknown
  Obtained from environmental sample
  misc_feature (1)..(253): Xaa is any amino acid
MPARISTYHPLIMTSKKLLEKIDNSEKRLRYWEVANENDLLPIHTDLKHRDRALRFMDTLIKIVEAMGCKIVFYCNSAHVEMFGQKTEINLRQKVYRIRNKDESGWSRESWEKSDKLEFQAGPSFNQKKWIDNTKRKLEECLPEIIVWIEKDCKYWHDLRTEQAIEENKRLLQEQKLEALKKAKESEQAKVNQLFIDAENWNKAKVAEHYISAMEEKAVQKNEMNSNTKDYISWAREVIKKLNPLSDSNWSEQ

SEQ ID NO: 7197 - DNA, 765 bp, Unknown
  Obtained from environmental sample
  misc_feature (1)..(765): n is a, c, g, or t
atgttgctaaaaatatatccaataggaagtatagataaaaatagagttataactatagcagaggattttgttcaactggaatttgtgaaaattggctttagtgataatatagatgactttattttttcgtatcgttcagctcttaatttgaatgaagaagagtttaaatatctaaaaaataaaaaaataattactatgtgtgttgaccctgattggatgccgttggaaaaaatcgagaattcaaaacacatagggatcgcagccgattatatgcagatagtttcaaaaaagatcaataccccaattgttcttgtgcctacaagtagctggatggagtccatgaataaggcaaaaaatcgtgagtgtgatattttttctatagcttctgagacaaatgatcgaaaaaaatatatggattttacaaaatcgtatttagcacttcctttagtattagcaacacgcctagataagacctttatcggatcattaagtgaaataaggggaaagagtgtagctattgttgagggctactccattgcacaaaaaatagaaaaatattatccagagataaaaattgagtatgttaaatcaatcacagagggattggaagttgtagagagtggaaaagtttatgcgtatatagataatttgatggtaacctcatataacatacaaaagtattttacaggaaattttaaagtctctggcagattagataaagatctatatttatctgtagctacaagaaatgatgagactatttaa

SEQ ID NO: 7198 - protein, 254 aa, Unknown
  Obtained from environmental sample
  DOMAIN (64)...(253): Bacterial extracellular solute-binding proteins, family 3
  misc_feature (1)..(254): Xaa is any amino acid
MLLKIYPIGSIDKNRVITIAEDFVQLEFVKIGFSDNIDDFIFSYRSALNLNEEEFKYLKNKKIITMCVDPDWMPLEKIENSKHIGIAADYMQIVSKKINTPIVLVPTSSWMESMNKAKNRECDIFSIASETNDRKKYMDFTKSYLALPLVLATRLDKTFIGSLSEIRGKSVAIVEGYSIAQKIEKYYPEIKIEYVKSITEGLEVVESGKVYAYIDNLMVTSYNIQKYFTGNFKVSGRLDKDLYLSVATRNDETI

SEQ ID NO: 7199 - DNA, 666 bp, Unknown
  Obtained from environmental sample
  misc_feature (1)..(666): n is a, c, g, or t
atgataaaagtttaccaaaaacagtttcatggagactcactaaggatcaatcagattctcactaatttagtctcaaatgcaattaagttcacagaaaaaggatttgtgaagattatcgtaagaggtgttaaaaatgagatctatagatttgaagtacaggataacggcataggattaactcatgaacatcagaaaaaactttttaaatcttttgctcaggcagatggctcaattactagaaaatatggtggtacaggattaggcttagctatatctaaagagttggtagaacttatgggtggtaaaatttgggtagagtccaaagagggtgtcggcagtagctttattttcgagatagagttacaagaagcaaaagatatgttagtggatgattatattgatacaaaaaatgtaggcgaaatttctaatgatgagtcgaatattgagaaaaaaaggatttcaaaagagcgtattaaagaactttttgaagagcttaaaattgcggtgaaaaagagaagaccaatcttgtgtgagccaattttgaaagagttgtcagaatctattttagatgaatctcaaacgatatatgtagagagaataacgtctatgataaaaaaatataagtttaatgaggtagttgaatttatggagactttccatgaatag

SEQ ID NO: 7200 - protein, 221 aa, Unknown
  Obtained from environmental sample
  DOMAIN (11)...(122): Histidine kinase-, DNA gyrase B-, and HSP90-like ATPase
  misc_feature (1)..(221): Xaa is any amino acid
MIKVYQKQFHGDSLRINQILTNLVSNAIKFTEKGFVKIIVRGVKNEIYRFEVQDNGIGLTHEHQKKLFKSFAQADGSITRKYGGTGLGLAISKELVELMGGKIWVESKEGVGSSFIFEIELQEAKDMLVDDYIDTKNVGEISNDESNIEKKRISKERIKELFEELKIAVKKRRPILCEPILKELSESILDESQTIYVERITSMIKKYKFNEVVEFMETFHE

SEQ ID NO: 7201 - DNA, 762 bp, Unknown
  Obtained from environmental sample
  misc_feature (1)..(762): n is a, c, g, or t
atggaacttgatccgggacaatataagatcgaggtctcaaaatcagactactccacaaagacagaggcattcactattattgccggaaaagatttggagctaaaagtggagcttgaagaagaatcgtttttgacaagttcaaggggggatgaagaaccatcagaagaagttatggcagcccttgccgatgcaaaaaaaaacgggataccaagacctcaaaccaatgccgttgttgggagaaaactgaattacaaaggaaccatgaaaacggattcaaaggatacaacatttaaggtaatagaagagataaccaaaatatataataatggtaattataaggtaaaacatagatacacttccaaagtaatttctatgaattgtatttacatattggatccccatgggcagatgatatcaaatattgaaacacgcattgacggtaagaaaacaaggggtaaatttaacatttccaataccggtcatgattggtcaacccgggatagaatcaggatcggagatcgatggtctaaatccactaataaactaacgacaagccttgaaaggcatgtggtcgggtttgaaagttttaaaggcagggcctgtgtcgtattggaagaaaaatttgaaatgaattttaaaaaattccctgactataaacaaaatagcagtaaaaaatcgtaccatgatttcagggaaaacatccttgttgccattgaagagatttatacagataaaggaatagaaacaatacgtatttcctaa

SEQ ID NO: 7202 - protein, 253 aa, Unknown
  Obtained from environmental sample
  misc_feature (1)..(253): Xaa is any amino acid
MELDPGQYKIEVSKSDYSTKTEAFTIIAGKDLELKVELEEESFLTSSRGDEEPSEEVMAALADAKKNGIPRPQTNAVVGRKLNYKGTMKTDSKDTTFKVIEEITKIYNNGNYKVKHRYTSKVISMNCIYILDPHGQMISNIETRIDGKKTRGKFNISNTGHDWSTRDRIRIGDRWSKSTNKLTTSLERHVVGFESFKGRACVVLEEKFEMNFKKFPDYKQNSSKKSYHDFRENILVAIEEIYTDKGIETIRIS

SEQ ID NO: 7203 - DNA, 525 bp, Unknown
  Obtained from environmental sample
  misc_feature (1)..(525): n is a, c, g, or t
atggataattatgaatatacacaacttttaaaaatattaaatcaaaaaatacaaaatattgaatctatattaaagccaaatgagatagaaaaaagacttgaagagattacaactttagagcaagaaccggaattttggaccaatcaagagaatgctacaaaaatagcacaagagaagaatagacttttaagtaaattatcaaaatttgaaaaagcaaatagtgcaataacagatgccaatgaactttatgagatggcagttgaagagaaagatgaagatactataaatacactttttgaagaatcaaatgttttggaagatattgtacaaaaaacagagatagaggttatgcttagtaatccagaagatggaaataatgcaattgtatctatccaccctggtgctggaggtactgagtcttgtgattgggctagtatgttatatcgtatgtatttacgatgggcagagagaaagggatttaaagtagaggttttagatcatcaagctggagatgaagctggttaa

SEQ ID NO: 7204 - protein, 174 aa, Unknown
  Obtained from environmental sample
  DOMAIN (84)...(174): PCRF domain
  misc_feature (1)..(174): Xaa is any amino acid
MDNYEYTQLLKILNQKIQNIESILKPNEIEKRLEEITTLEQEPEFWTNQENATKIAQEKNRLLSKLSKFEKANSAITDANELYEMAVEEKDEDTINTLFEESNVLEDIVQKTEIEVMLSNPEDGNNAIVSIHPGAGGTESCDWASMLYRMYLRWAERKGFKVEVLDHQAGDEAG

SEQ ID NO: 7205 - DNA, 303 bp, Unknown
  Obtained from environmental sample
  misc_feature (1)..(303): n is a, c, g, or t
ttggaatttatttatgtagaaaattatttaacaatatcaagagatgaaaaaagagaatttcttgttttattgggttcatttaccaactttagagttacaaatcaaaagattgttcttaatgacaattcgcttattttagaatttgctaaaaattcagatgtaggttttgctaaagaggcaatagaaaaattctttgaggtaaataagcaagtaaatataaaaatagtttcttgtatagagcaaaataatcatgagattattttgacttttgaagataaaaaacaaaaaaaagtgaagttataa

SEQ ID NO: 7206 - protein, 100 aa, Unknown
  Obtained from environmental sample
  misc_feature (1)..(100): Xaa is any amino acid
MEFIYVENYLTISRDEKREFLVLLGSFTNFRVTNQKIVLNDNSLILEFAKNSDVGFAKEAIEKFFEVNKQVNIKIVSCIEQNNHEIILTFEDKKQKKVKL

SEQ ID NO: 7207 - DNA, 411 bp, Unknown
  Obtained from environmental sample
  misc_feature (1)..(411): n is a, c, g, or t
atgagacttttagcttataatattgataataaaattattgaaaaactagaatctgatgaacattatattgtggatagaacctatgagttagatgatgctttgtatcatctacaggtaaggttttacaatctagtcataatgtatgaagatgatttaaaaaattgtatgacacttttaaaagcaactgataacacccatacagcatttgttgtattaacgcatagtgatgataaaaaatttcatttaaagtgttttagaaatggtgcattgtgtgttatcaatccttttgatggtgaaatgttatgggcaaaaatagaatcaatccatagggaaaattttgaaaaaaagatttatcatgaaaactattttggtatcgataaagaagcaaaagagatagtggattatgaataa

SEQ ID NO: 7208 - protein, 136 aa, Unknown
  Obtained from environmental sample
  misc_feature (1)..(136): Xaa is any amino acid
MRLLAYNIDNKIIEKLESDEHYIVDRTYELDDALYHLQVRFYNLVIMYEDDLKNCMTLLKATDNTHTAFVVLTHSDDKKFHLKCFRNGALCVINPFDGEMLWAKIESIHRENFEKKIYHENYFGIDKEAKEIVDYE

SEQ ID NO: 7209 - DNA, 564 bp, Unknown
  Obtained from environmental sample
  misc_feature (1)..(564): n is a, c, g, or t
atgatccaaaaacgtcttaaaacaataatagatgcctgttttgatgaaggtgtggaatcagggaagtggtctggtaaagctagcggaaaatacagtgttgaagtgccaaaacgtgatggtcaaggtgacttttcaaccaatatggccatggttatggccggtattgaaaagaaaaatcctcgtgaaattgcggctcttgttgtcgagttgcttgaaaaaaaggatattgtagagaaacttgagattgcaggcccaggctttgttaatattttcctaaaaacgaaagtatggcatgatattttacagcctgttcttgctgcaggtactgactttggcaagtctactatggggaatggccaaaaggtgatggttgaatttgtcagtgctaatcccaccggccctttgagtattggccatgggcggcaggccattcttggtgattctatagcaagactccttgagactacaggatacgatgtctaccgtgaatattattttaatgatgcgngtaggcaaatgcgagtattgggagaatctaccaggccaggtaccttgaattattag

SEQ ID NO: 7210 - protein, 187 aa, Unknown
  Obtained from environmental sample
  DOMAIN (1)...(92): Arginyl tRNA synthetase N terminal domain
  misc_feature (1)..(187): Xaa is any amino acid
MIQKRLKTIIDACFDEGVESGKWSGKASGKYSVEVPKRDGQGDFSTNMAMVMAGIEKKNPREIAALVVELLEKKDIVEKLEIAGPGFVNIFLKTKVWHDILQPVLAAGTDFGKSTMGNGQKVMVEFVSANPTGPLSIGHGRQAILGDSIARLLETTGYDVYREYYFNDAXRQMRVLGESTRPGTLNY

SEQ ID NO: 7211 - DNA, 300 bp, Unknown
  Obtained from environmental sample
  misc_feature (1)..(300): n is a, c, g, or t
atggcaaatattcaaagcctaagaggtatgaaagatattatagacaatgaaagtgaactgtttacatattttgtagaaaactgttcaagaattgcaaaaaaatatggatatagttatatagaaacaccaattttagaagagacagcacttttcaaaagaagtgttggtgaaagtagtgatatcgtttcaaaagagatgtatcagtttatagataaaggtgaaaatgatgtctgtttgcgacctgaaggtactgctggagttgtaagatggtttgtacaaaacaaaaaagatagagctggt

SEQ ID NO: 7212 - protein, 100 aa, Unknown
  Obtained from environmental sample
  misc_feature (1)..(100): Xaa is any amino acid
MANIQSLRGMKDIIDNESELFTYFVENCSRIAKKYGYSYIETPILEETALFKRSVGESSDIVSKEMYQFIDKGENDVCLRPEGTAGVVRWFVQNKKDRAG

SEQ ID NO: 7213 - DNA, 474 bp, Unknown
  Obtained from environmental sample
  misc_feature (1)..(474): n is a, c, g, or t
atgttttttatgacgaaaaaagtctcatatatattaattttagttttaagcatttctttgtttagctgtaaagaagttatggttaatgaatctaagctgcctcgtcctgtaaaaaaagatttaaaggagattagagctgacggtaaaattaaggctttaattaattatagtgcaacaagttattttatttatcgaggacaacctatgggttttgagtacgagttgttaaatcaatatgctaaaagtcaaggagtagagctagaagttattccaataaaaaatatggatagtgtgtttattcacctgaataatggtgtaggtgaccttgttgccgctaatttaacggttactttagacagaaaaaagcaagttgatttttcgcagccaattttatttacaaaacaggtactagttcagcgtaagcccgaaactggagaaaactttctaaaaaatcgcttaagactctttgaataa

SEQ ID NO: 7214 - protein, 157 aa, Unknown
  Obtained from environmental sample
  misc_feature (1)..(157): Xaa is any amino acid
MFFMTKKVSYILILVLSISLFSCKEVMVNESKLPRPVKKDLKEIRADGKIKALINYSATSYFIYRGQPMGFEYELLNQYAKSQGVELEVIPIKNMDSVFIHLNNGVGDLVAANLTVTLDRKKQVDFSQPILFTKQVLVQRKPETGENFLKNRLRLFE

SEQ ID NO: 7215 - DNA, 882 bp, Unknown
  Obtained from environmental sample
  misc_feature (1)..(882): n is a, c, g, or t
gtgcaacaagttattttattatcgaggacaacctatggttttgagtacgagttgttaaatcaatatgctaaaagtcaaggagtagagctagaagttattccaataaaaaatatggatagtgtgtttattcacctgaataatggtgtaggtgaccttgttgccgctaatttaacggttactttagacagaaaaaagcaagttgatttttcgcagccaattttatttacaaaacaggtactagttcagcgtaagcccgaaaactggagaaaactttctaaaaaatcgcttaaagactctttgataaactctcctttagagttaggtggaaaaacaatttatgtaagaagagagtcatctttttatgaacgtttgaatagcttatcaaaagaaattggcgagaaaattaaagttgaagtagttcctggtgaagtttctatggaacaactaattgaacaagtagctcaaggaacaatagattacacggttgctgataaaaatattgctttagtaaacgaatggcaataccctaatattgatgcaagggtagaggtaagtaacgaacaacaaatagcctttgctcttagaaaaaatagtgatagcttaacggcttctattaataactggctaaaagcttatcaaaagactgttgcttttaagctgttatataaaaaatattatgataaccgatcacaacatggtaaacgaattaatgatgagtcgtttacattgagtagcggacagcttactccatatgatgaaacattaaaaaaatatgcgccacaaataccttgggattgggagttagtggcagcattaatttatcaagaatctaggtttaataataatgcgttaggctctcagccgaattctgaccttgggtaa

SEQ ID NO: 7216 - protein, 293 aa, Unknown
  Obtained from environmental sample
  DOMAIN (4)...(228): Bacterial extracellular solute-binding proteins, family 3
  misc_feature (1)..(293): Xaa is any amino acid
MQQVILLSRTTYGFEYELLNQYAKSQGVELEVIPIKNMDSVFIHLNNGVGDLVAANLTVTLDRKKQVDFSQPILFTKQVLVQRKPENWRKLSKKSLKDSLINSPLELGGKTIYVRRESSFYERLNSLSKEIGEKIKVEVVPGEVSMEQLIEQVAQGTIDYTVADKNIALVNEWQYPNIDARVEVSNEQQIAFALRKNSDSLTASINNWLKAYQKTVAFKLLYKKYYDNRSQHGKRINDESFTLSSGQLTPYDETLKKYAPQIPWDWELVAALIYQESRFNNNALGSQPNSDLG

SEQ ID NO: 7217 - DNA, 699 bp, Unknown
  Obtained from environmental sample
  misc_feature (1)..(699): n is a, c, g, or t
atggatcaaaatagttctgaagaaatttataagcaaacactactcgatcatttgctcaattttgtcactgaaaaaaggaatgcgctatttgaaaaggtattaagtaaccgaacaaaacatgtaactgtagttcttgaagacatttaccaatctcaaaatgccagtgctgtgctaagatcgtgtgatataacaggtgttcagaatattcatataatagagaataattataaatactctatcaatccggatgtagctttaggatcttttaaatggctcaacctgattaaatacaatgagcatgactccaatacaattgctgcttttgataaactccgatcggaaggatacagaattgttgcaacaactccgcataaaaatgatcaaaacctcgacgagattttactggataaaaaagtagcattagttttcggtaccgaattaacaggtttatcaaaaattgctattgataatgcagatgaatatttaaaaatacctatgtatggttttacagaaagtttcaatatttcagtttcagctgctttagtactctataacctcactaacaagcttcgaaaatcagctattaactggcatttaacaaatgaagagaaacttgacattaagcttgaatgggcgaaaagatcgattgacaggtcggatgtaattgtcaggcatttttttaagaattacaattcatga

SEQ ID NO: 7218 - protein, 232 aa, Unknown
  Obtained from environmental sample
  DOMAIN (40)...(184): SpoU rRNA Methylase family
  misc_feature (1)..(232): Xaa is any amino acid
MDQNSSEEIYKQTLLDHLLNFVTEKRNALFEKVLSNRTKHVTVVLEDIYQSQNASAVLRSCDITGVQNIHIIENNYKYSINPDVALGSFKWLNLIKYNEHDSNTIAAFDKLRSEGYRIVATTPHKNDQNLDEILLDKKVALVFGTELTGLSKIAIDNADEYLKIPMYGFTESFNISVSAALVLYNLTNKLRKSAINWHLTNEEKLDIKLEWAKRSIDRSDVIVRHFFKNYNS

SEQ ID NO: 7219 - DNA, 750 bp, Unknown
  Obtained from environmental sample
  misc_feature (1)..(750): n is a, c, g, or t
ttgttcaaatcaacgatggaaagcaatggaacaattttcgttaataatgatgacccaatagttagaaaaaatactagaagaattgagaataaagttacattcggatttaaaggaaagtgtgatgttaaagggaagctagtcggttatactgttgatggtagaactaaactgagtgttgtatatagtaatacgagttatgaaattactttgccaatctatggtaagtcaaatgcccggaatgtattggcagctattacaattgcgcaacatctaaaattatcagttaaacagattaaaactggtatagctaaattaaaccaagtgaatggaagattattcactgagttttcaaagagcattatgcttattgatgatacttataattctaatccagcctcaatggaatctgcaattgatttactcaaaaatatcaagtcgtataaagttaaaactcttataattggtgatatgtttgagcttggtaaaaaagcatctgattcacataaaaatttagctgcaattattctgaaaaataagatcaataatgttctgatgattggaaagttgatgagtacacttgataatgcattgaagaaaacgaaagtgaatagagtttatttcaaaaatagaagagcgttaaattcatttattaaaaagaatgatttttctggtcaagttgttttggtcaaaggttcacgtggaatgaaaatggaagagtttgtagaacaaattagaaataaggctgcctaa

SEQ ID NO: 7220 - protein, 249 aa, Unknown
  Obtained from environmental sample
  DOMAIN (108)...(201): Mur ligase family, glutamate ligase domain
  misc_feature (1)..(249): Xaa is any amino acid
MFKSTMESNGTIFVNNDDPIVRKNTRRIENKVTFGFKGKCDVKGKLVGYTVDGRTKLSVVYSNTSYEITLPIYGKSNARNVLAAITIAQHLKLSVKQIKTGIAKLNQVNGRLFTEFSKSIMLIDDTYNSNPASMESAIDLLKNIKSYKVKTLIIGDMFELGKKASDSHKNLAAIILKNKINNVLMIGKLMSTLDNALKKTKVNRVYFKNRRALNSFIKKNDFSGQVVLVKGSRGMKMEEFVEQIRNKAA

SEQ ID NO: 7221 - DNA, 432 bp, Unknown
  Obtained from environmental sample
  misc_feature (1)..(432): n is a, c, g, or t
atgttaaaagaaaatacaaaacttccacaagatattatcaacgatatagcctatacaaaactcaaaatggtaggacttgatgcagatgttggaaaactgtatccagaggagcttagtggtggtatgaaaaaaagggttgcaatagctagaagtttagcacttgaccccaagatactttttcttgatgaaccaacctctggacttgatccatatagtgcaaaagcttttgatgaacttattttagaacttcgagatatgttaggtttaactgttgttattatcacccatgagctagatactatagaaaatgttttagataggtttactattatctcagaagcaagtcttgtatttacaggcacttatgacgaagcattaaaagaaaataatggtacaataaataaatttttgaaccaaaacagaaaagggtaa

SEQ ID NO: 7222 - protein, 143 aa, Unknown
  Obtained from environmental sample
  DOMAIN (1)...(114): ABC transporter
  misc_feature (1)..(143): Xaa is any amino acid
MLKENTKLPQDIINDIAYTKLKMVGLDADVGKLYPEELSGGMKKRVAIARSLALDPKILFLDEPTSGLDPYSAKAFDELILELRDMLGLTVVIITHELDTIENVLDRFTIISEASLVFTGTYDEALKENNGTINKFLNQNRKG

SEQ ID NO: 7223 - DNA, 696 bp, Unknown
  Obtained from environmental sample
  misc_feature (1)..(696): n is a, c, g, or t
atgtggtatgtaaaagagattagaatagatccaaaaacttacacaaatagagataattttaaaatagacaacccatctatgataaaagaaaatagctttgcaactatccaatcacaaggtataactggaaataaaaatattgagattggtgggggaactgctgatgcaaaagatttacttccagtaaaagatagctttgagaaactcccattagaacaatcattttttgacaacctaacagcaagtgctcaagatataacacaaaatatcaatctcactttatatcaaataaataaacttctaaaagacagtaatataaaaaacatagatagcctactctcaaacctagaaaaaaattcaaataatttcaataaaacccttgataagcttaatactattttggatacaaatgcaccaaatactttagcaaatattgatactcttactaaagagtggagtggattatctcaagatattaaagagtttataaatgatgatataggtgaacttgtaaaaaaagcaaatgtaactttagatagtacttcaaatttagaagatatttttttaaatattgacaatactattgaaaaaattgatgaaactctagataatatcaatgaaaatggtggtgatattattttcaaaacaagagatattaaatatggaccacaggagatgcaaaatgaaaataaatag

SEQ ID NO: 7224 - protein, 231 aa, Unknown
  Obtained from environmental sample
  misc_feature (1)..(231): Xaa is any amino acid
MWYVKEIRIDPKTYTNRDNFKIDNPSMIKENSFATIQSQGITGNKNIEIGGGTADAKDLLPVKDSFEKLPLEQSFFDNLTASAQDITQNINLTLYQINKLLKDSNIKNIDSLLSNLEKNSNNFNKTLDKLNTILDTNAPNTLANIDTLTKEWSGLSQDIKEFINDDIGELVKKANVTLDSTSNLEDIFLNIDNTIEKIDETLDNINENGGDIIFKTRDIKYGPQEMQNENK

SEQ ID NO: 7225 - DNA, 555 bp, Unknown
  Obtained from environmental sample
  misc_feature (1)..(555): n is a, c, g, or t
gtgacttataaaataagtaaaaataatgcacaaaataactttgatttaaaagaactatcaaataagcatgaagaaaaattagttcaattacaaaataattttgatagaacaaataaaatctatgtacaaaaacaagattttttactcgaaatagcaacagatatttctgaaatatatgctatatccgacgaatatcttagtaagcttttaacaaagaaacatattgaaaacagaggtaaggaggaaaacgaaagaataaataaaaatgtaatagttttatactcaaaatctttagatacaaaaaagaaattatttaataaaatcaattccctatcattattattaaatgataaagagcttataaatgctattggtgcttttgaaaagttcttaattaatttacatgcagaatgttcttttagctgtactcatacttttaaggaactgatgccatataatactaatctaacaaaattaagagatgccatctttgctgtattaagtaatatctttcattctgttgaagaaaaagcatctagagttacacccttgtga

SEQ ID NO: 7226 - protein, 184 aa, Unknown
  Obtained from environmental sample
  misc_feature (1)..(184): Xaa is any amino acid
MTYKISKNNAQNNFDLKELSNKHEEKLVQLQNNFDRTNKIYVQKQDFLLEIATDISEIYAISDEYLSKLLTKKHIENRGKEENERINKNVIVLYSKSLDTKKKLFNKINSLSLLLNDKELINAIGAFEKFLINLHAECSFSCTHTFKELMPYNTNLTKLRDAIFAVLSNIFHSVEEKASRVTPL

SEQ ID NO: 7227 - DNA, 345 bp, Unknown
  Obtained from environmental sample
  misc_feature (1)..(345): n is a, c, g, or t
ttgaaggagctacgaataaagtttcaatccgacaagactgtgctcgactctctttctggtctgaaaattcgtttgtatccggagcagtcctcatgtttgatctgcggcaagaaaacaaatttgcttaaaaccgactggaagacttgttattccttcgatttgggaaaattcaccttgatttcaggttccaatttttgtgatgagcacaaatacttctctaacaaacagaatcaaatcataaaatatcagtctgatttggctactttgatcgtggataaaggctataaagtgacattcgatcttgtggttaaagtgggacgtctgcgatacgacgatcaccgctag

SEQ ID NO: 7228 - protein, 114 aa, Unknown
  Obtained from environmental sample
  misc_feature (1)..(114): Xaa is any amino acid
MKELRIKFQSDKTVLDSLSGLKIRLYPEQSSCLICGKKTNLLKTDWKTCYSFDLGKFTLISGSNFCDEHKYFSNKQNQIIKYQSDLATLIVDKGYKVTFDLVVKVGRLRYDDHR

SEQ ID NO: 7229 - DNA, 870 bp, Unknown
  Obtained from environmental sample
  misc_feature (1)..(870): n is a, c, g, or t
ttgtatttaaagtatgataaaaaattaataatagatactagaaatatatcaataggctaccagggtaatacaaaaagtgttgatatgaaagttaaattttcaattgaaagcttttttgataattattttattgaggtctatgagtatgttttatttgaaccatacctaaaagcatcaggaaaatttatagttaacttagatgatttgtcacttgagtcaataataaaagatacaaatataaatgattttgcattacaatttaataacaaccttaagtttataacagcccagagttgttttgtaacttttaaggataataatttttattttagttttaaaaaacctatgtatgaaggggttaatttagaggggagtaaagctacaatccttgatttggatagattaaaactagagcttacttctggggataaattaaaaaaaccactattggaacttttgagtaactataaaatcaatcttcctttagttcaagaatatggttcaaatacaatttttacagaacttttaataccctttaatatacaaaaagaacttacagttcaatcaaaaattgcattagaaaatgctaaagtatatctttataatattccattatatactaaaaaatttgatatttttttagataataatatcttaacagggagtgggaaacttcataaaacagatgatgacaatagcactttagcatatgattctgatgttgtatttgatatagactttaaaaagaatagtgtcaaaggtaattttataacacaaagtataaattttaaagatattaatataaccaatattgagggtgattttaatcttgattttaataatagctttttttcagatattagaatacaa

SEQ ID NO: 7230 - protein, 290 aa, Unknown
  Obtained from environmental sample
  misc_feature (1)..(290): Xaa is any amino acid
MYLKYDKKLIIDTRNISIGYQGNTKSVDMKVKFSIESFFDNYFIEVYEYVLFEPYLKASGKFIVNLDDLSLESIIKDTNINDFALQFNNNLKFITAQSCFVTFKDNNFYFSFKKPMYEGVNLEGSKATILDLDRLKLELTSGDKLKKPLLELLSNYKINLPLVQEYGSNTIFTELLIPFNIQKELTVQSKIALENAKVYLYNIPLYTKKFDIFLDNNILTGSGKLHKTDDDNSTLAYDSDVVFDIDFKKNSVKGNFITQSINFKDINITNIEGDFNLDFNNSFFSDIRIQ

SEQ ID NO: 7231 - DNA, 363 bp, Unknown
  Obtained from environmental sample
  misc_feature (1)..(363): n is a, c, g, or t
atgactcaaagccttcacgacagaatcccccatcggataatgcttcgaaacgttccgcaacctaataacctccttcttcgatatcaccatataccaatcatacaaataacatatttaaacattgccaaaccaaaaacttataaaccaaaatctcgctccataaacatgataatcccaataagatgcttcagctgcggaaaaccaatcgcacacctctacgcacaatacaaagacctagtggaaaacggcatgacccaaaaggaagccctagacaaactaggaatcaaaagatactgctgccgagcacaaattctaggacaaacagacacattagagttagttaacaaattcaagaagttctaa

SEQ ID NO: 7232 - protein, 120 aa, Unknown
  Obtained from environmental sample
  DOMAIN (56)...(118): RNA polymerases N / 8 kDa subunit
  misc_feature (1)..(120): Xaa is any amino acid
MTQSLHDRIPHRIMLRNVPQPNNLLLRYHHIPIIQITYLNIAKPKTYKPKSRSINMIIPIRCFSCGKPIAHLYAQYKDLVENGMTQKEALDKLGIKRYCCRAQILGQTDTLELVNKFKKF

SEQ ID NO: 7233 - DNA, 510 bp, Unknown
  Obtained from environmental sample
  misc_feature (1)..(510): n is a, c, g, or t
ttgttttttagtcttatgaaaaatttgattttgggctgtgttggtgctggaaaaactactcttgctgaaaaactttttaaaaaatttaaacttccttttatttcttcggatgatattatttttgatgaaaaatggcaaaggcggaatttagatgatgtcaatttgcaattaaaattttttaataaaaataattcttggacttttgaaggagttaaatctaaatattttattaggaagaaaaatatttcttttgatattttggttttgcttaattgtccgaaaaaggttattttaagaagaattattaggaggtttaaagagggaaaaagagggaaaaatagttatgggaaattaaaaagttttatcccccttcttttttggacgatactttattctcctaaaaaaaactttgagttcattaaaagttttaaagggagtgttttcgtcttgggaaatgaagctgatgagaagacctttttaaaaaaattggaatcgaaagcttttatatag

SEQ ID NO: 7234 - protein, 169 aa, Unknown
  Obtained from environmental sample
  misc_feature (1)..(169): Xaa is any amino acid
MFFSLMKNLILGCVGAGKTTLAEKLFKKFKLPFISSDDIIFDEKWQRRNLDDVNLQLKFFNKNNSWTFEGVKSKYFIRKKNISFDILVLLNCPKKVILRRIIRRFKEGKRGKNSYGKLKSFIPLLFWTILYSPKKNFEFIKSFKGSVFVLGNEADEKTFLKKLESKAFI

SEQ ID NO: 7235 - DNA, 816 bp, Unknown
  Obtained from environmental sample
  misc_feature (1)..(816): n is a, c, g, or t
atgattaatgatattttagatagttcaaaaatagagatagaaaagcttaatattgtaaaaaatactttcatatgggatcaagtattaaacaatgttaaagcagttgcaacatctaatattgaagctaaagatatagattttgagattcattatgacaaaattttaccaaaatactttaatggagatagtttacgattagagcaagttttaataaaccttgtgagtaatgctacaaaatttacacaaagaggctcagtacaattatctatagaaaatataaactacaataggtatagatttagtgtaagtgatacaggtattggagtaacacaagaacaaatagaaaatatttttgagccatttactcaagcagatgacacaattacaagagaatatggtggtactggacttggtctatctatatcaaaacaacttgtagagttaatgggtggaatacttagaattgaaagtaaggtaaaagagggtacacaaatatattttgatattgagttaagagaaataaaacaagaggattacattaacgagaaagggttagaaaaaacaaagaaaaaaatagagtttaatttgtataataagagagagacaatagtttttgaaaaagagaaagagttacttgaacaattagaagaggcagtattgagaaaaagaccaaatgtggtatatcctattattgatgaattagataaatataatttacaaatactaagtagtgtagattttaagaatataaaaacatatattaagagatatatgtttcatgaagcaagcgagatactaaataaatatgaaaaataa

SEQ ID NO: 7236 - protein, 271 aa, Unknown
  Obtained from environmental sample
  DOMAIN (61)...(172): Histidine kinase-, DNA gyrase B-, and HSP90-like ATPase
  misc_feature (1)..(271): Xaa is any amino acid
MINDILDSSKIEIEKLNIVKNTFIWDQVLNNVKAVATSNIEAKDIDFEIHYDKILPKYFNGDSLRLEQVLINLVSNATKFTQRGSVQLSIENINYNRYRFSVSDTGIGVTQEQIENIFEPFTQADDTITREYGGTGLGLSISKQLVELMGGILRIESKVKEGTQIYFDIELREIKQEDYINEKGLEKTKKKIEFNLYNKRETIVFEKEKELLEQLEEAVLRKRPNVVYPIIDELDKYNLQILSSVDFKNIKTYIKRYMFHEASEILNKYEK

SEQ ID NO: 7237 - DNA, 792 bp, Unknown
  Obtained from environmental sample
  misc_feature (1)..(792): n is a, c, g, or t
ttgaaaaaagacaattcatatgtgggactagagagcttaaaagggaaaaaggtaggtataagtagaaatattttttataaagatattttagagaagcaagggattgagattgttgagtttgtaggcagtgatgaaaaggttgaagctttagtattaaataaaatagattattttttatcctcatatacttcagctcaaaaatcaattaatactaaaggaataactagtattaaaccactaggggaatttaaagagataaaaaaagaagatttacggtttggaataaataaagagaacaaactattatatagtattataaaaaagtcaatgaagaagataacagaagatcaatactcaaaaattatcaataaatggatgatgaatctatatatacaagataaaagagaagccagtagagtatacctaacaataaaagagaaagaatatttagaaaataaaaaagagataaagttttgtgctgatccctcatggatgcctttagaggggattaaaaacggtaaaattgatgggataacttctgattatataaaaatatttagtaaagctattggtataccatttcgtcttgtagaaactaactcttggagccaaagtttacagtatgccaaaatgagaaaatgcgatattttatcatttctaacaatggaaacaaaaaagagaaaagagtatttgaattttacaacaccatacataaatataccacttgtaatagctactaaatatgatgtaacatttattaccgatcttgctagtttagacaagaaaaaatag

SEQ ID NO: 7238 - protein, 263 aa, Unknown
  Obtained from environmental sample
  misc_feature (1)..(263): Xaa is any amino acid
MKKDNSYVGLESLKGKKVGISRNIFYKDILEKQGIEIVEFVGSDEKVEALVLNKIDYFLSSYTSAQKSINTKGITSIKPLGEFKEIKKEDLRFGINKENKLLYSIIKKSMKKITEDQYSKIINKWMMNLYIQDKREASRVYLTIKEKEYLENKKEIKFCADPSWMPLEGIKNGKIDGITSDYIKIFSKAIGIPFRLVETNSWSQSLQYAKMRKCDILSFLTMETKKRKEYLNFTTPYINIPLVIATKYDVTFITDLASLDKKK

SEQ ID NO: 7239 - DNA, 405 bp, Unknown
  Obtained from environmental sample
  misc_feature (1)..(405): n is a, c, g, or t
ttgaaagagacaactttagtagtactttgtgcaggtaattcatctagattcgagcttaaagccaaaaaacagtggttacgagtagaagatgaacctctgtggctatatgtaacaaaaaggatagctagcttccataattttgataaaatcattgtagtttcacatcaaaatgagctaaattatatgaaatcctttagcgataactttgattttgttgcaggtggtagcactcgacaacaatctattaaaaatgctttgcaaaaagtaacatctgcttatgtaatgattacagatgttgctagatgttgtatccctaaaaatgttatacaaagagcttatacactcacaagatatagcctcctgtatcggttctgttttagatgtatcaaatactgtaaattataa

SEQ ID NO: 7240 - protein, 134 aa, Unknown
  Obtained from environmental sample
  misc_feature (1)..(134): Xaa is any amino acid
MKETTLVVLCAGNSSRFELKAKKQWLRVEDEPLWLYVTKRIASFHNFDKIIVVSHQNELNYMKSFSDNFDFVAGGSTRQQSIKNALQKVTSAYVMITDVARCCIPKNVIQRAYTLTRYSLLYRFCFRCIKYCKL

SEQ ID NO: 7241 - DNA, 414 bp, Unknown
  Obtained from environmental sample
  misc_feature (1)..(414): n is a, c, g, or t
gtgttgagcatggtattaaaaccattcaagaaaattgatgcaaaaggagataattcagctattataatgcctgtttacagtgatgaggaagatgatattgaatttgtaaaaacactttttagggaaaccataaaaaacgaagctgaaaatgctcaactaattgccaataaaaccaaaaattgggaaattgaaagaattgccatggtagatatcttgttaatgaaaatggcactgacagaattaactgaattcaaatctattccggtaaaagttacgctaaacgaatacatcgatttatctaaagcttatagtactcctaaaagtaaaattttcgttaacggaattcttgataaactaattgatgaccttacaacaagcggagaaataaagaaaactggtagagggttgatgtaa

SEQ ID NO: 7242 - protein, 137 aa, Unknown
  Obtained from environmental sample
  DOMAIN (1)...(123): NusB family
  misc_feature (1)..(137): Xaa is any amino acid
MLSMVLKPFKKIDAKGDNSAIIMPVYSDEEDDIEFVKTLFRETIKNEAENAQLIANKTKNWEIERIAMVDILLMKMALTELTEFKSIPVKVTLNEYIDLSKAYSTPKSKIFVNGILDKLIDDLTTSGEIKKTGRGLM

SEQ ID NO: 7243 - DNA, 654 bp, Unknown
  Obtained from environmental sample
  misc_feature (1)..(654): n is a, c, g, or t
atgacttgtcaatactacaccacgcctatttactatgtgaatgccaaaccccatctcggccatgcctatacctccattgcagcagatgtcgccacccgttttaaaaaaatgaaaggggcagacaccttttttttaacaggaacggatgagcacggggataaaatcgtccaggctgcggaaaaagaaaacaccacgcccaaggcttacgcagataagatcagcaaactattccaggatgtcctgcccctgctcaatataggaaacgaccattttatccggacaacggaccctaagcatattgaggttgtagaatctattctatcaacgatttacgacaaaggggacatctatttttcaagttatgagggcatttactgtttcggatgtgaaagattctaccaggagcgcgagcttgtgaacggcaaatgcccggatcacggtacggtacccgaaaccatcaaggaatcaaactatttctttaaaatgagcaagtaccaggagtggctcattgagcacatcgaaacccacccggactttatccggcccgaacagtacagaaaggaacttctctcttttcttaaggagcctttggaagactctgtgcatctcccggcccaaaacccggctgacctggggtatcaccctgccctttga

SEQ ID NO: 7244 - protein, 217 aa, Unknown
  Obtained from environmental sample
  misc_feature (1)..(217): Xaa is any amino acid
MTCQYYTTPIYYVNAKPHLGHAYTSIAADVATRFKKMKGADTFFLTGTDEHGDKIVQAAEKENTTPKAYADKISKLFQDVLPLLNIGNDHFIRTTDPKHIEVVESILSTIYDKGDIYFSSYEGIYCFGCERFYQERELVNGKCPDHGTVPETIKESNYFFKMSKYQEWLIEHIETHPDFIRPEQYRKELLSFLKEPLEDSVHLPAQNPADLGYHPAL

SEQ ID NO: 7245 - DNA, 729 bp, Unknown
  Obtained from environmental sample
  misc_feature (1)..(729): n is a, c, g, or t
ttgatctctgacatcaaccggctcttgagcatcctttattcggacagaaggcttttcgaatccctttntgaaaaacgcaaccggcttgtaggcgttcatgaggtcacaaatgagatcggcgaggataaactcgagtaccttctgagtgcagagatactcagtaatacggatgagagcatcgagcttgacgaacgcgttttgagcttttttgaagagttccttgagacgaatgaagatgttgagatcggtgacgtagatgagcttcttatcaacttgaagtacaatatcgaactttatcagaacgagacagacaatgaacactccagagagcgttatcttgccaagatcaagcgtatacttaaaaagatccccaatcttatcttgaaaaacctctcacttcttcagctgcatatcggtcttacctataagacgcagagctcgcacaagaacaaggtgcttgagctgcagcactacaagagcaaactggaaaaactgatgaacatcgaagcgaaggtacaaaaggcccttgtgcacgagagccatttctttacagtcgtctcctcacatgagaccgttctgctgtcgcttaggctgaaggtcaggctgcgtgagctgcgcgtctctctgatcgaactgcaaaagcaggttatcgagtacatcaacaagacccttcacaagcagcacttctttgagcatatcatcaagctcaaagagatgaagtcggcatga

SEQ ID NO: 7246 - protein, 242 aa, Unknown
  Obtained from environmental sample
  misc_feature (1)..(242): Xaa is any amino acid
MISDINRLLSILYSDRRLFESLXEKRNRLVGVHEVTNEIGEDKLEYLLSAEILSNTDESIELDERVLSFFEEFLETNEDVEIGDVDELLINLKYNIELYQNETDNEHSRERYLAKIKRILKKIPNLILKNLSLLQLHIGLTYKTQSSHKNKVLELQHYKSKLEKLMNIEAKVQKALVHESHFFTVVSSHETVLLSLRLKVRLRELRVSLIELQKQVIEYINKTLHKQHFFEHIIKLKEMKSA

SEQ ID NO: 7247 - DNA, 444 bp, Unknown
  Obtained from environmental sample
  misc_feature (1)..(444): n is a, c, g, or t
gtgttcattgtctgtctcgttctgataaagttcgatattgtacttcaagttgataagaagctcatctacgtcaccgatctcaacatcttcattcgtctcaaggaactcttcaaaaaagctcaaaacgcgttcgtcaagctcgatgctctcatccgtattactgagtatctctgcactcagaaggtactcgagtttatcctcgccgatctcatttgtgacctcatgaacgcctacaagccggttgcgtttttcanaaagggattcgaaaagccttctgtccgaataaaggatgctcaagagccggttgatgtcagagatcaaaagaaggttccggtgttggggtatgtgcagatatcaatactgttctttatatatttttatcttattttatccaatagatttaaatctaaggtaaatacccttttaaaatcggctcagacctga

SEQ ID NO: 7248 - protein, 147 aa, Unknown
  Obtained from environmental sample
  misc_feature (1)..(147): Xaa is any amino acid
MFIVCLVLIKFDIVLQVDKKLIYVTDLNIFIRLKELFKKAQNAFVKLDALIRITEYLCTQKVLEFILADLICDLMNAYKPVAFFXKGFEKPSVRIKDAQEPVDVRDQKKVPVLGYVQISILFFIYFYLILSNRFKSKVNTLLKSAQT

SEQ ID NO: 7249 - DNA, 795 bp, Unknown
  Obtained from environmental sample
  misc_feature (1)..(795): n is a, c, g, or t
atgattacagaatttttaataaaagttgttattgcattagcgatattttttataggaaaaaaagtagctagatggataactgattttagtttacaaagtttaaataaaacaggacaaatagataaaacgcttgaaacatttttatcaagtgtaatatatggaatattacttgttgtagtgatattatcagcattggggcaactaggggttcaaactacctcatttatagctattttaggtgcagttggtttagcggttggtttagcatttcaaagtaccttatcaaatattagtgctggtgttatgattattatatttaagcctataaaagttggagaatttgttgaagctggtggtgcatctggtgttgttgaagagataaatatttttaatacaatgatgaagacaggtgataataaaatcatcattgttgcaaactcaagagttattggtgggaatattaccaattactcaagaaaagagacaagacgggttgatacagtatttggtattggatatgatgatgatttaaaattagcaaaagagacattgattgagatattaaataatgatgaaagaattttaaaagagcctgaaccatttgttgctgtttcagaactggcagatagtagtgtaaattttcttacaagagcttgnngtaaaagtgaagattattgggcagtgaaatttgatacaattgaaaaagtaaaattaacatttgatgaaaaaaacatctctataccatatccacaaatggatattcacatgaataaaagcggaaatgatggaaaatag

SEQ ID NO: 7250 - protein, 264 aa, Unknown
  Obtained from environmental sample
  DOMAIN (50)...(248): Mechanosensitive ion channel
  misc_feature (1)..(264): Xaa is any amino acid
MITEFLIKVVIALAIFFIGKKVARWITDFSLQSLNKTGQIDKTLETFLSSVIYGILLVVVILSALGQLGVQTTSFIAILGAVGLAVGLAFQSTLSNISAGVMIIIFKPIKVGEFVEAGGASGVVEEINIFNTMMKTGDNKIIIVANSRVIGGNITNYSRKETRRVDTVFGIGYDDDLKLAKETLIEILNNDERILKEPEPFVAVSELADSSVNFLTRAXXKSEDYWAVKFDTIEKVKLTFDEKNISIPYPQMDIHMNKSGNDGK

SEQ ID NO: 7251 - DNA, 600 bp, Unknown
  Obtained from environmental sample
  misc_feature (1)..(600): n is a, c, g, or t
atgatggaaaatagtttccctaaaaattttaaaaaaggtatttctacttttcaaataattatattattaattgttggatattatgtttggggctatgttgaggataattacctttataaagacaccccaaagtatttagtaaagtttaaagatgcaataaaagatttttcagaacaaaaagatacagtaaaaaaaacatataaagatgcgattgaagcaaaagatgaagcaaaaaaagtaaaatatgtttttaaaaatgaatcaactaaagattttattagaaaatgggaaactactcaaagtgaagtagttacattaaaagagaaatttgaagtgtataaagaggaaactgaaaactttgtagataaacttgatgaaaatttagatcaaattaaagatgatgaagccctaaaagatagaatgagagagtttagtaagaaaaaagcgaaactaatggcaaaaaatattatcaaaatagaacaaaatattgaaaaattagacagatcaataacaaaaggaaataaccttattgtcgcacttaaaactgtaagttcatttaatgttttatccgatgatgcaaaagagtttgattctatataa

SEQ ID NO: 7252 - protein, 199 aa, Unknown
  Obtained from environmental sample
  misc_feature (1)..(199): Xaa is any amino acid
MMENSFPKNFKKGISTFQIIILLIVGYYVWGYVEDNYLYKDTPKYLVKFKDAIKDFSEQKDTVKKTYKDAIEAKDEAKKVKYVFKNESTKDFIRKWETTQSEVVTLKEKFEVYKEETENFVDKLDENLDQIKDDEALKDRMREFSKKKAKLMAKNIIKIEQNIEKLDRSITKGNNLIVALKTVSSFNVLSDDAKEFDSI

SEQ ID NO: 7253 - DNA, 795 bp, Unknown
  Obtained from environmental sample
  misc_feature (1)..(795): n is a, c, g, or t
ttgaatgctgatggaaccaagaatagagcttatggcaaaaagaaggatggaatactaagagaattcaatccggattgtatcgcgatagacaatcaggggaatatatttataggacagggaggcaataacacaataactgtattaaacgctgatggggtcaggaataccaatttcgggaaagaaaaggacggaataatacaaaaagaggaaggatcttttgctacacctaatggtatagctatagacagtatgggcaatataattgttttaaattggagttatgattcagtaagcgtcctaaaaacagaagagattcgggaggaagttctcgttgatgggcataagatgaaaatgtatgaagagcaggagaaaatacttgcggaagtgatcgatgcggttgaagccggggatcgggatacggggaccggggaccgggagggggaacagttatcagtgatcggtgatcagttagcagttgtagaagcaaaaattaaagggaaatatttaaaattgcgagatatagaaccgtggcttgaagcgaataaaatcaagattatgatggaaattgacgcgttagagaaagagaaaaacaatttaaagaaacagctaaaaggattagacgcaggtaaaactgacgagcaaatgatggaagatgtaagaaaacttgaaaactncagggtatggactaggttgcatctttatcttgaaaaagagataaaaaacattcttaatgcaaaagaagttagtgtaagagaagatgaaattaaatatatcactaatgagagtattttttga

SEQ ID NO: 7254 - protein, 264 aa, Unknown
  Obtained from environmental sample
  misc_feature (1)..(264): Xaa is any amino acid
MNADGTKNRAYGKKKDGILREFNPDCIAIDNQGNIFIGQGGNNTITVLNADGVRNTNFGKEKDGIIQKEEGSFATPNGIAIDSMGNIIVLNWSYDSVSVLKTEEIREEVLVDGHKMKMYEEQEKILAEVIDAVEAGDRDTGTGDREGEQLSVIGDQLAVVEAKIKGKYLKLRDIEPWLEANKIKIMMEIDALEKEKNNLKKQLKGLDAGKTDEQMMEDVRKLENXRVWTRLHLYLEKEIKNILNAKEVSVREDEIKYITNESIF

SEQ ID NO: 7255 - DNA, 408 bp, Unknown
  Obtained from environmental sample
  misc_feature (1)..(408): n is a, c, g, or t
gtgaaactagatataccgccacttattgagagaaaagaggatttagaagagctcattaaactctatttaaaagaggcaaaagagatttacgaaatagagattgattcaaaagatattgatattgatttatcctcaaatggtgtttctcttaaaaaatctatatttaaaaactctattttaaaatcactaaaagatgatgatatggattatagtttagaacaatttatcttgaataaactaaaaaaagaatatagctataaagatttattagaatgttttgaaatccctcttttaaaagctgctaaaaaagagtataagtctcaattacaaatggcaaataaactacaaataaatagaattactttacgaaaaaagatagatcagtattctactcagttagaagattag

SEQ ID NO: 7256 - protein, 135 aa, Unknown
  Obtained from environmental sample
  misc_feature (1)..(135): Xaa is any amino acid
MKLDIPPLIERKEDLEELIKLYLKEAKEIYEIEIDSKDIDIDLSSNGVSLKKSIFKNSILKSLKDDDMDYSLEQFILNKLKKEYSYKDLLECFEIPLLKAAKKEYKSQLQMANKLQINRITLRKKIDQYSTQLED

SEQ ID NO: 7257 - DNA, 723 bp, Unknown
  Obtained from environmental sample
  misc_feature (1)..(723): n is a, c, g, or t
gtgtttgttgggaagaaaaatagccgaacacttaaagtatttatggcatcagtggaagatttacaagatgttctttctgaagctaaaatgcgatttattgatctttttgaagaaacttttgattttaaatcaacctatgcaaaagtgatagatgcagatgatagactagcaaatatagatgagttttatggatatttgcgagacttttttatccaaaatgtagagttaaacttagaagactttttaaatgaaatctcacttgaaagtgctgctgatacaatcaatgatgagtatatctcattaatgagtatccatgcaagtaaaggtttagagtttaaacatgtatttatcgttggacttgaagagggattttttccaatagttggagatggaagtgatatagaagaggagagacgacttggatatgttgctataactcgagcaaaagacaatcttacattgagttttgtacatagtagattttacaaagggcgacgaacacaacttacaaaaagtaggtttttaacagaatcagatcttatcaaagggagtcttactattgaaaaaaacaatgcttataaaaaagatgacttagtaaagcataaaatttttggtatgggtagagttgagagtgtgcaaaaagctggaaaagatttgaaattgaagattaattttggtggaaatagacgagatatcttatcttcatttgtggagaagatatag

SEQ ID NO: 7258 - protein, 240 aa, Unknown
  Obtained from environmental sample
  misc_feature (1)..(240): Xaa is any amino acid
MFVGKKNSRTLKVFMASVEDLQDVLSEAKMRFIDLFEETFDFKSTYAKVIDADDRLANIDEFYGYLRDFFIQNVELNLEDFLNEISLESAADTINDEYISLMSIHASKGLEFKHVFIVGLEEGFFPIVGDGSDIEEERRLGYVAITRAKDNLTLSFVHSRFYKGRRTQLTKSRFLTESDLIKGSLTIEKNNAYKKDDLVKHKIFGMGRVESVQKAGKDLKLKINFGGNRRDILSSFVEKI

SEQ ID NO: 7259 - DNA, 531 bp, Unknown
  Obtained from environmental sample
  misc_feature (1)..(531): n is a, c, g, or t
atgttatctgactttacaaaattaaatacatttttaactgtggtaaaagagaagtcattctcaaaagcttcagcaaaacttggtatttcacaaccagcggttactcaacaaatgcgatttttagaaaactatctggacgcacctattgttgatagaaagaaaaatggaattagacttactaaagagggtgaaaagctttatcatatagcccaaaaaattgaaaaagttatttctaatagtgaaaaagaacttcttaaaataataaacaaagatatcacatttgtttttggtgcatctaatgcaattggaaactatatcttaccaacatttctaaatgatattaaacaaaaaattgataatgatgtaagtgtaactgtttcaaatagtgctgaagctatagaaaaactaaaagacaaaaaaattgatatggcacttatagaatcacctatttttgaagatggtattatctatagagagtggctagaggatgagattgtaatattctcaaaccaaaagcttccaagacgataa

SEQ ID NO: 7260 - protein, 176 aa, Unknown
  Obtained from environmental sample
  DOMAIN (5)...(64): Bacterial regulatory helix-turn-helix protein, lysR family
  misc_feature (1)..(176): Xaa is any amino acid
MLSDFTKLNTFLTVVKEKSFSKASAKLGISQPAVTQQMRFLENYLDAPIVDRKKNGIRLTKEGEKLYHIAQKIEKVISNSEKELLKIINKDITFVFGASNAIGNYILPTFLNDIKQKIDNDVSVTVSNSAEAIEKLKDKKIDMALIESPIFEDGIIYREWLEDEIVIFSNQKLPRR

SEQ ID NO: 7261 - DNA, 627 bp, Unknown
  Obtained from environmental sample
  misc_feature (1)..(627): n is a, c, g, or t
atgattgcaaattctaaagagttatctgcagatagtgttattaaaagattaaatagtgggataaatgcaaaaaatatagagttgctaaaacttacacttccaaaattttataagttaaatcttgaatactatccaagtcctaagcagataaaaaaactaagaaaagatttattaaaaaacaaaacaataaccaaggttgaagatttttcgcacaatcatgacacaacatataaacttttattactttttaaaaaggtagtttcactatttgcagtagttgtttttgtagttacgacgctccttatctttaaagaacttcgtatatggcagtttaaacatagtgaacgcatgagcataatgggtttattcggtgcaccaatatggcttcgttcggctgtactctttagactagctattgtagatgctattattgcaagtttattggcgttcagcctttttgtatatatatcatcatcatcttgggttaaagaacagtttggtaatattggaatagatgtgcttatatatgacatagtaaatgattcggcactactttttggtgcagcaatgatattgtcaattttacttgcttcttttatagttttaggacataaagaagaggtatga

SEQ ID NO: 7262 - protein, 208 aa, Unknown
  Obtained from environmental sample
  misc_feature (1)..(208): Xaa is any amino acid
MIANSKELSADSVIKRLNSGINAKNIELLKLTLPKFYKLNLEYYPSPKQIKKLRKDLLKNKTITKVEDFSHNHDTTYKLLLLFKKVVSLFAVVVFVVTTLLIFKELRIWQFKHSERMSIMGLFGAPIWLRSAVLFRLAIVDAIIASLLAFSLFVYISSSSWVKEQFGNIGIDVLIYDIVNDSALLFGAAMILSILLASFIVLGHKEEV

SEQ ID NO: 7263 - DNA, 459 bp, Unknown
  Obtained from environmental sample
  misc_feature (1)..(459): n is a, c, g, or t
ttggagacaatgaataataaatatctaaatgatgaactagataagacaagaactaaaaacaatactcaaatgctttcaaaagatgaagccggacgaggacttataaaagctttaaaaaatgatagaatagttggtttggttattgatcaacataattcagcagggatagatgtgaattttttaggacatagagtaaaacaaactgattcctcttctaaactttcagtaaaatttaatgccattattttacctctattttttactatggatagttttggaaaatacactgcaaagttttatgagccacttgagccatctaagtatgaaggtgaagatcaaatacttaagcttacacaagcccaagctgatatcatggagaaacacatcctcgaaaaacctgaacaatggttttggcaacataaaagatttaaacaatacaatagtgaaatttatgaataa

SEQ ID NO: 7264 - protein, 152 aa, Unknown
  Obtained from environmental sample
  misc_feature (1)..(152): Xaa is any amino acid
METMNNKYLNDELDKTRTKNNTQMLSKDEAGRGLIKALKNDRIVGLVIDQHNSAGIDVNFLGHRVKQTDSSSKLSVKFNAIILPLFFTMDSFGKYTAKFYEPLEPSKYEGEDQILKLTQAQADIMEKHILEKPEQWFWQHKRFKQYNSEIYE

SEQ ID NO: 7265 - DNA, 627 bp, Unknown
  Obtained from environmental sample
  misc_feature (1)..(627): n is a, c, g, or t
atgccattattttacctctattttttactatggatagttttggaaaatacactgcaaagttttatgagccacttgagccatctaagtatgaaggtgaagatcaaatacttaagcttacacaagcccaagctgatatcatggagaaacacatcctcgaaaaacctgaacaatggttttggcaacataaaagatttaaacaatacaatagtgaaatttatgaataatcagaaaaaaattttaataataagtgatggcaaagctggtcattttaatcaatctgttgctttttgtaaactaaaaaatatagattttgatgtttttgaaattgatccaaaagataaagtcaaaaagatactatcttacatattggattttttccatttatatattaatctgaataactataaaattcaaacaaaaaactatgatgcagttctctcaacaggatcagctacatattatacaaataaatacattgcaaaaaaacttcanactaaatctatagctataatgttacctagtggatttagatatagtgattttgactatatactagctcaagagcatgacaattcaccttctctaaacaataatatcataacaatgccatttaaatttgtctattaa

SEQ ID NO: 7266 - protein, 208 aa, Unknown
  Obtained from environmental sample
  misc_feature (1)..(208): Xaa is any amino acid
MPLFYLYFLLWIVLENTLQSFMSHLSHLSMKVKIKYLSLHKPKLISWRNTSSKNLNNGFGNIKDLNNTIVKFMNNQKKILIISDGKAGHFNQSVAFCKLKNIDFDVFEIDPKDKVKKILSYILDFFHLYINLNNYKIQTKNYDAVLSTGSATYYTNKYIAKKLXTKSIAIMLPSGFRYSDFDYILAQEHDNSPSLNNNIITMPFKFVY

SEQ ID NO: 7267 - DNA, 726 bp, Unknown
  Obtained from environmental sample
  misc_feature (1)..(726): n is a, c, g, or t
ttggattttttccatttatatattaatctgaataactataaaatcnaaacaaaaaactatgatgcagttctctcaacaggatcagctacatatattacaaataaatacattgcaaaaaaacttcaaactaaatctatagctataatgttacctagtggatttagatatagtgattttgactatatactagctcaagagcatgacaattcaccttctctaaacaataatatcataacaatgccattaaatttgtctattaatacccctaagggctatattaaaaagaaagagcaaaaatctttaggtataattttgggtggagataatacagtctttacaatgagtgtagaaaatatcaaaatagtattagatgaaatttataaaaattatccaagtcacttaaaatatatcaccacctcaagaagaacaccaattgtaatagataaattacttaaaaattataagtttgattatgaagttatatattcacaggaatctactataaatccaataccagactttatagaggtgtgtgatgagctttttatcactatagattcaacttcaatgctcagtgaagcaaaagcaaatagtgatgcaaatattcatataatatctttagaaagtaaacaagaaaatacaaaatatcatcgtttagcacaagctgttgaaaacttaaaaggtcgatttgattatatgcaatacttagataaggttttggtttga

SEQ ID NO: 7268 - protein, 241 aa, Unknown
  Obtained from environmental sample
  misc_feature (1)..(241): Xaa is any amino acid
MDFFHLYINLNNYKIXTKNYDAVLSTGSATYITNKYIAKKLQTKSIAIMLPSGFRYSDFDYILAQEHDNSPSLNNNIITMPLNLSINTPKGYIKKKEQKSLGIILGGDNTVFTMSVENIKIVLDEIYKNYPSHLKYITTSRRTPIVIDKLLKNYKFDYEVIYSQESTINPIPDFIEVCDELFITIDSTSMLSEAKANSDANIHIISLESKQENTKYHRLAQAVENLKGRFDYMQYLDKVLV

SEQ ID NO: 7269 - DNA, 534 bp, Unknown
  Obtained from environmental sample
  misc_feature (1)..(534): n is a, c, g, or t
atgattgagataaactggaacatatttgaaaccaagtttaacggtaagcaacaagctgctttcgagcgaatggcttatgcattattttgttctaggtttaatcaagaacatggaattttttcgcacaaaaatcaggtaggaattgaaaccgaaccaattacaataaacgataaacaaattggttttcaggcaaaatatttagaaccaacggtatctttttcatcaaagaaaaatacttttatacaatcgcttgaaaaagcaaaacagaaaaactttggcttaaaagagatttatttttttgtaaacaagtctttttcagagtccaataaaaaagaattaaaaagaccaaagtatattattgatattgaaaaaaaagcaaaggaattagatgtaacaattatttggcaagtaccaagtcaaattgaaatacaattatctaaactaaataatattagggttgctaaagaattttttcctcaattaattgaaaaagaaaatcatactcaatcaatactaaataagaatgatttatag

SEQ ID NO: 7270 - protein, 177 aa, Unknown
  Obtained from environmental sample
  misc_feature (1)..(177): Xaa is any amino acid
MIEINWNIFETKFNGKQQAAFERMAYALFCSRFNQEHGIFSHKNQVGIETEPITINDKQIGFQAKYLEPTVSFSSKKNTFIQSLEKAKQKNFGLKEIYFFVNKSFSESNKKELKRPKYIIDIEKKAKELDVTIIWQVPSQIEIQLSKLNNIRVAKEFFPQLIEKENHTQSILNKNDL

SEQ ID NO: 7271 - DNA, 807 bp, Unknown
  Obtained from environmental sample
  misc_feature (1)..(807): n is a, c, g, or t
atgacaaaaaattttatagaacaaaataaacaaatggtttatgataaagttcatcaaacagttttagatattgattatcatagagaacaaaatttgaacttatctaaatctgatatgaaagaaaaggtcgatcttctaattaatgcactaaataataattataaatataataaaaatagaaaaactaccaaagagttaaaacaagaacttttacatttaattaatagtcaaaatattgaaaatagtaataattatatttttgtacttgatatacaaaatggaaatgttttagttcataatataaaagagtttattggtgtaagtttaagagataaaaaagatataaatgagatatcaacttttcaatcaaaagttgatatcttaaaaacaaaagatagtgcatttcaaagattattttttgaaaaaccaaatgaaccaaataaacaatttgaaaagatagtttactttaaaaaatttaaaccgtataattggattataggaactggaagatatctcgatgaaaatgataagaaaataaaagataattttataaaaaaactaaacactattcaaacagatttacaaaattatctttttatatcaagaattgataattttgctggtggagatgagttttcaactatgttagtgatgccaaataaaaaagaactcataggaaaaaaaatatctgacaaacaacaagacattaaaggaaaatattatagaaaagaatattttgaagcacttaaaaaaaataatgaaacttatgtagaatattggtataaaaagtcaaatgtaacgaaatag

SEQ ID NO: 7272 - protein, 268 aa, Unknown
  Obtained from environmental sample
  misc_feature (1)..(268): Xaa is any amino acid
MTKNFIEQNKQMVYDKVHQTVLDIDYHREQNLNLSKSDMKEKVDLLINALNNNYKYNKNRKTTKELKQELLHLINSQNIENSNNYIFVLDIQNGNVLVHNIKEFIGVSLRDKKDINEISTFQSKVDILKTKDSAFQRLFFEKPNEPNKQFEKIVYFKKFKPYNWIIGTGRYLDENDKKIKDNFIKKLNTIQTDLQNYLFISRIDNFAGGDEFSTMLVMPNKKELIGKKISDKQQDIKGKYYRKEYFEALKKNNETYVEYWYKKSNVTK

SEQ ID NO: 7273 - DNA, 810 bp, Unknown
  Obtained from environmental sample
  misc_feature (1)..(810): n is a, c, g, or t
ttgggacgaaagggaactccatctgctaaagttattaaaatagtaggtcatgcacaaacttactcaattgctttggtaaaagtagttgatgggaaaaaagctctggttaatctgcacacttctcatccatcaggtgtagagataactacacaagagctaaacagttatgaagaaggcactctatttaaaatagataatattcaaaatattatcttagatactcttggaaatatctctgatccaaaagttgatgagaagatagttttagcaaaatacaacaaacacgatgaatttgatcaagatattttagatcttgcatcaacatttggtgaagttgatgcaacaaaatatcctaaaagaaaagatctaagagattatccattttgtacgatcgatcctgtaactgctaaagattttgatgatgctatatactatgatgagaaaaactcaacactctatgtagccatagcggatgttagtgagtatgtaaaaccatttggaccgatcgatgctgaggctatatatagaggtttttctatctatctgcctcatcgctctatccctatgttaccccgtcagcttagtgaaacactctgttcacttcaacctcataaagatagactctcttatgtttttgagatgaaactagctgatttagaagtagtagagtcaaagtttatgaggcaattattcactcaaaaagacgttttaactatgaagagggagatcaatatttcaatgttgaacctaaacccgcaaaatgaagatgagagaggagttttcgctaatctaaaacctctaaaaccttaa

SEQ ID NO: 7274 - protein, 269 aa, Unknown
  Obtained from environmental sample
  DOMAIN (52)...(269): RNB-like protein
  misc_feature (1)..(269): Xaa is any amino acid
MGRKGTPSAKVIKIVGHAQTYSIALVKVVDGKKALVNLHTSHPSGVEITTQELNSYEEGTLFKIDNIQNIILDTLGNISDPKVDEKIVLAKYNKHDEFDQDILDLASTFGEVDATKYPKRKDLRDYPFCTIDPVTAKDFDDAIYYDEKNSTLYVAIADVSEYVKPFGPIDAEAIYRGFSIYLPHRSIPMLPRQLSETLCSLQPHKDRLSYVFEMKLADLEVVESKFMRQLFTQKDVLTMKREINISMLNLNPQNEDERGVFANLKPLKP

SEQ ID NO: 7275 - DNA, 630 bp, Unknown
  Obtained from environmental sample
  misc_feature (1)..(630): n is a, c, g, or t
atggcacaagagtttcaaggtaaaactttagaagaagcatatgaaaaagcaacttctactttaaaatgttccataactgatcttcaaatagatataatacaagctccaagcaaaggatttttaggattctttgcaaaagaagctatcataagtgccattctgcacaaagaaaaaaaacaccaaaaaaaacatcatcaagaacaacacaatgaaagaaaaaataaaaatactgaaacattaacctcaaaattaaatgctttaagagatgatgaaccaactatcagaagtacaaatgttaaacagatcgaaaaagaggaaatttttagtgatttttataataatgaagcacaaaaacttcataaaacacctgttataaataaagcanatcaagaaaacattcaagagataaaagaacaagttgaaaacctatttttcaaaacttgctacccaattgatgatatacaagttgatataatagatgaagggaaaactgtttatattgaatttaatggtggagatagtgccttactaatagggaaagaagatataggtataaagctttatcatatatccttttttactggatcaatgataataataaatgatgttacgacctcgaagttgctcaat

SEQ ID NO: 7276 - protein, 210 aa, Unknown
  Obtained from environmental sample
  misc_feature (1)..(210): Xaa is any amino acid
MAQEFQGKTLEEAYEKATSTLKCSITDLQIDIIQAPSKGFLGFFAKEAIISAILHKEKKHQKKHHQEQHNERKNKNTETLTSKLNALRDDEPTIRSTNVKQIEKEEIFSDFYNNEAQKLHKTPVINKAXQENIQEIKEQVENLFFKTCYPIDDIQVDIIDEGKTVYIEFNGGDSALLIGKEDIGIKLYHISFFTGSMIIINDVTTSKLLN

SEQ ID NO: 7277 - DNA, 339 bp, Unknown
  Obtained from environmental sample
  misc_feature (1)..(339): n is a, c, g, or t
ttgctttcggaaataggcgaaaatattattgttattttatcaacacatattgttgaagacgtaagtgatttgtgcagcaatatggcgattatcaatcgtggcgagttgaaattagccggaaaaccaggccagctaatcgagaatttgaatgggaaaatttgggaaaaacgaattgagaaatcatccatacaagactacaaaacaaagcataatgttatttcatcgcgattatttgctggaaaaaaacttgttagagtgcttgcagatgaaattccggattctgaattcgcctctgtagcaccaaacctagaagatgtgtatttttcaacaattaattaa

SEQ ID NO: 7278 - protein, 112 aa, Unknown
  Obtained from environmental sample
  misc_feature (1)..(112): Xaa is any amino acid
MLSEIGENIIVILSTHIVEDVSDLCSNMAIINRGELKLAGKPGQLIENLNGKIWEKRIEKSSIQDYKTKHNVISSRLFAGKKLVRVLADEIPDSEFASVAPNLEDVYFSTIN

SEQ ID NO: 7279 - DNA, 810 bp, Unknown
  Obtained from environmental sample
  misc_feature (1)..(810): n is a, c, g, or t
ttgtataaatattttgataagttagataatagcgattcttcttttgtgtatttacaaaatgccttcctgcttgcggaacaggaaaatcagaaaaatatgctgcaggagtgttatagcgccttatctgaatattatgaaaaaaaagatgattttaaaaaagccctgctttattcggaaaaatacatcgcccttcatgacactatttatggaaaagtttctgaagatatagcacgtattcaaagcagttacgaaaatattgagaaaaaaattgaaatagaagcgttaactaaagagaaggagatgcaggataaattacgatattaccttatctttctgattatcgttttatttgttttagctctactgtttttcagcttattcaaacagaaacagacagaagtttcaataaaagaggaaatgcaaaagcacaaagaacaagaaacctcgcttcgcagtatcatctacaatatatcgaaagttgcagatgaaacaaatgatttggatagagtctatcatgcgattcagatgaatttcaataaggttattgataccacaaatttctttatagccttttataaagaagaagatgatacctttagctgtccgctctctaatgacagcaaagacagcttcatagattaccctgccggaaaaactttgagtgcatatatcctgaaaaaacgtcaaggatttttgggtagcagtaaggatattcaagatcttgttcggaaggggaagataacccagctcggaacggctagtaaaaggttggttgggcgtacctctatttggggggtggtaatgccttag

SEQ ID NO: 7280 - protein, 269 aa, Unknown
  Obtained from environmental sample
  misc_feature (1)..(269): Xaa is any amino acid
MYKYFDKLDNSDSSFVYLQNAFLLAEQENQKNMLQECYSALSEYYEKKDDFKKALLYSEKYIALHDTIYGKVSEDIARIQSSYENIEKKIEIEALTKEKEMQDKLRYYLIFLIIVLFVLALLFFSLFKQKQTEVSIKEEMQKHKEQETSLRSIIYNISKVADETNDLDRVYHAIQMNFNKVIDTTNFFIAFYKEEDDTFSCPLSNDSKDSFIDYPAGKTLSAYILKKRQGFLGSSKDIQDLVRKGKITQLGTASKRLVGRTSIWGVVMP

SEQ ID NO: 7281 - DNA, 345 bp, Unknown
  Obtained from environmental sample
  misc_feature (1)..(345): n is a, c, g, or t
atgcgatattttatgatgattattttatctttaatgcttatgccaagcaagccagcaattgcggttgaaaaaaacattataaaaacaaaaatatctgatgaaaaaaagcttgcaatagaagaacttatgaagctttctggcgtttttacaattgttgaatctttacatgcctctatttctctagatgcaacatctaanatcacagaaactaatccagagctagatgaactttctataaaaaaagaagccgatgatttttttaaagattctaataaaatctttatagatttaatgacacccatttataataagaatttctcaattaaagagattaaagaaatatag

SEQ ID NO: 7282 - protein, 114 aa, Unknown
  Obtained from environmental sample
  misc_feature (1)..(114): Xaa is any amino acid
MRYFMMIILSLMLMPSKPAIAVEKNIIKTKISDEKKLAIEELMKLSGVFTIVESLHASISLDATSXITETNPELDELSIKKEADDFFKDSNKIFIDLMTPIYNKNFSIKEIKEI

SEQ ID NO: 7283 - DNA, 735 bp, Unknown
  Obtained from environmental sample
  misc_feature (1)..(735): n is a, c, g, or t
ttgtgtaataattatttagtcgattctgattgttctgaagcattattagaagataaagaaaaactagaagctaatttatataatctacctcttgataaatattgttccatgtttccatttagtgtttcagcgtttgattatatagatcagaatagtctggttattatggacaatgatatgcgtgcacttaataagttagatcatatattaagtgaatatggcgttatgatggaaaagctgttaataggcaaaaaaatattacatagtggtatgactttgttgacggacttttttgaagcagctaagacgcataccgtctcactagttttaccagacattttaggatatgacataaattttcgtcctgcaattgagtttaattttctaacaagagaaaatacagcttatagaggacggatggaattattactagaggatattaataaatggcgggtacatgatcgtactattgtattatttacaccaactaaaaaaagcggaaaaatattaaatgagtatttaaatgaccataacatttatgcggaccatgtcagtgatttaaatgaaaaagatgaattaagtaatatcacaattgttgataaaggaatctttgaaggatttgaatttttagatgcaaaactatgtattgtgggaagcggaaaaatattccgtaaatctgctaaagaaagtagtaacgaaaaagtggccgtgatattgacttatttgccacattaa

SEQ ID NO: 7284 - protein, 244 aa, Unknown
  Obtained from environmental sample
  misc_feature (1)..(244): Xaa is any amino acid
MCNNYLVDSDCSEALLEDKEKLEANLYNLPLDKYCSMFPFSVSAFDYIDQNSLVIMDNDMRALNKLDHILSEYGVMMEKLLIGKKILHSGMTLLTDFFEAAKTHTVSLVLPDILGYDINFRPAIEFNFLTRENTAYRGRMELLLEDINKWRVHDRTIVLFTPTKKSGKILNEYLNDHNIYADHVSDLNEKDELSNITIVDKGIFEGFEFLDAKLCIVGSGKIFRKSAKESSNEKVAVILTYLPH

SEQ ID NO: 7285 - DNA, 651 bp, Unknown
  Obtained from environmental sample
  misc_feature (1)..(651): n is a, c, g, or t
atgggaagtactgcaaaatttaaagatttaggctgggaaacaaagtttttaaataactcaattttgaaacatccaaaactcactttagagggtgggatatttttatatgacttctatactttgttaaaagagttaaaaaggatacaaaatccaaataatatgataaaacatatccaaaatcacaagttttttaaaactattctagatacaataacaactgctcgtgcaaaacaaaaagatggaacgatcaacgaaactataaaacaaagtgcctcttttaaagccaatcgaagagtagaaacactaaagcaattatcagctagacacaacaatcttggcaattttataaatgctatgatattaggtggtggagagatgagtgagggtggtggtgttaacctactctcagttcatgctagtaaaggtttagaatttaatgaggtttatgtggttgatttgatggatgggagatttccaaaccgaactttgatgagtaagggtggaagtttagaggaagaaaggcgacttttttatgttgcggtaacacgagcaaaggatattttatatttaagttatgcaacttacgatagaataaagaaattagattttatacatagtccttttttagtggaagctggacttgtacaatag

SEQ ID NO: 7286 - protein, 216 aa, Unknown
  Obtained from environmental sample
  misc_feature (1)..(216): Xaa is any amino acid
MGSTAKFKDLGWETKFLNNSILKHPKLTLEGGIFLYDFYTLLKELKRIQNPNNMIKHIQNHKFFKTILDTITTARAKQKDGTINETIKQSASFKANRRVETLKQLSARHNNLGNFINAMILGGGEMSEGGGVNLLSVHASKGLEFNEVYVVDLMDGRFPNRTLMSKGGSLEEERRLFYVAVTRAKDILYLSYATYDRIKKLDFIHSPFLVEAGLVQ

SEQ ID NO: 7287 - DNA, 894 bp, Unknown
  Obtained from environmental sample
  misc_feature (1)..(894): n is a, c, g, or t
ttggatggtttaacgggtatccctgaaattaatggggcagtagtcaggccgcttttactgttttcaacacaagatattgagacttatgctaaagaacatcaagtaacatggcgagacgacagcagtaatgcatcaacaaaatatttacgaaataaacttcgtcacgatgtaattcctgtcttgaaagaaatcaatccacagttgctgcaaaattttcaaacaactttaagtaatttaaatgacacaaccgatattgttgatgatagcttaaatgcggttttgaaacgagctattgttaccatagatgacagcactttaaagtttaaaatatcagaattcaaaacactaaaaaatccgaaagcgtaccttcacgaatttttaaaagattttggatttacagaatggaatgatgttgttaatttattggatgctcagtctggtaagcaagtgttttcttctactcatcgcttgttgaaagacagagattatttaatactgactgatataacatcaaatgaagattctcaagtaatttcaataactgaaaacgataccaatattcaaatcccatctgggatattacattttaatcaagttgatgccatgtcgactaccaagtccggtattctctatgtagataaagcacttttaaactatccgttgtttgttagaaaatggcatgaaggcgactttttttatccattaggaatgaacggtaaaaagaaattgagtaaatatttaaaagatgaaaaattatctttaattngaaaagaaaatatctggctattaacatctgaagataacatagtttgggttattggtaaacgagccgataatcgatataaagttactgaggcaacgaaacagattttaaaaatgaatttacataaatga

SEQ ID NO: 7288 - protein, 297 aa, Unknown
  Obtained from environmental sample
  misc_feature (1)..(297): Xaa is any amino acid
MDGLTGIPEINGAVVRPLLLFSTQDIETYAKEHQVTWRDDSSNASTKYLRNKLRHDVIPVLKEINPQLLQNFQTTLSNLNDTTDIVDDSLNAVLKRAIVTIDDSTLKFKISEFKTLKNPKAYLHEFLKDFGFTEWNDVVNLLDAQSGKQVFSSTHRLLKDRDYLILTDITSNEDSQVISITENDTNIQIPSGILHFNQVDAMSTTKSGILYVDKALLNYPLFVRKWHEGDFFYPLGMNGKKKLSKYLKDEKLSLIXKENIWLLTSEDNIVWVIGKRADNRYKVTEATKQILKMNLHK

SEQ ID NO: 7289 - DNA, 765 bp, Unknown
  Obtained from environmental sample
  misc_feature (1)..(765): n is a, c, g, or t
ttgagattactccgtatatttattctgtttagagtatttaaactatttagatatgcgaagagtattcaaacatttacctctgtaatatcagctaaaaaatttgaatttttaacacttcttatttttgcatctatcattatctttgtttcatcagttttgatttatgttatggaagcaaataatcctgagtctcctattgatacactttttgaagctgtctattggtctatagtaactatctcaactgtaggttttggagatattactcctgttactcaagagggtagaacagtcgctatgttcgtgattgtagcaggaataggtgtattttcatttactacttcgctaatagttacttcatttacagaaaaactagacgagataaaagatacaaaagttatagatgacatagcaaagataaaagagttttatcttatttgtggatatgaaaatgtagcaaaagaagttgctaaaaaacttagcataaacaacaaagtgattattttagaagaagattataaaaaagcagaacaagccaaaaaagatggttttattgcattaaattatgctcctggttctatagaaagttataaaaaacttcgtattaacatagctactcaagtaaaagctattttatgtttgagccatagtgatgttgagaatgtatataccgctttaacggttcgctcattttacaaagatgtgtttattctttctattttagaaaacaaaatgaataaaagtaagttgaattttgccgagtaa

SEQ ID NO: 7290 - protein, 254 aa, Unknown
  Obtained from environmental sample
  DOMAIN (143)...(254): TrkA-N domain
  misc_feature (1)..(254): Xaa is any amino acid
MRLLRIFILFRVFKLFRYAKSIQTFTSVISAKKFEFLTLLIFASIIIFVSSVLIYVMEANNPESPIDTLFEAVYWSIVTISTVGFGDITPVTQEGRTVAMFVIVAGIGVFSFTTSLIVTSFTEKLDEIKDTKVIDDIAKIKEFYLICGYENVAKEVAKKLSINNKVIILEEDYKKAEQAKKDGFIALNYAPGSIESYKKLRINIATQVKAILCLSHSDVENVYTALTVRSFYKDVFILSILENKMNKSKLNFAE

SEQ ID NO: 7291 - DNA, 333 bp, Unknown
  Obtained from environmental sample
  misc_feature (1)..(333): n is a, c, g, or t
ttgggttggtataatagcaaaaagagttgttgggacaacgggttgcttttgaagcaatttcacgcatttcgttctaactataacggtatcgacgttcaagagattatgattacagatagagttttagaaagctatgttactgttggacagttagcaaataaaaagtatagaatagttctgctcggtgttcataaaaagaataaaaaaagattcttctttaatccaattgatagtacagtcctcgaagtaggagattacatcttagttataggaaacacacagtttttgaaagagtttagtgtttatctgcaaaaaaagggctctaatgcttga

SEQ ID NO: 7292 - protein, 110 aa, Unknown
  Obtained from environmental sample
  misc_feature (1)..(110): Xaa is any amino acid
MGWYNSKKSCWDNGLLLKQFHAFRSNYNGIDVQEIMITDRVLESYVTVGQLANKKYRIVLLGVHKKNKKRFFFNPIDSTVLEVGDYILVIGNTQFLKEFSVYLQKKGSNA

SEQ ID NO: 7293 - DNA, 597 bp, Unknown
  Obtained from environmental sample
  misc_feature (1)..(597): n is a, c, g, or t
atgtatgcccttactggaatacaaatacatatctataacataaaatattcaaaaaaaagaacaagtgagctggatcatttttacccttctaataaatatccattttttgctatctctttttataacttaataccatcctgtacagtatgcaataaaataaagctcgataacgatgatccagagtatataaacccttatgatacaagatttgattttaataaaaatatgaaatttgatctaaaaattgaagattcaacattttatcattcactagatgggtttaatttacattataaatttagtagaaatatggcagctgaagagattagaagaataaataataatttagaagacctagagttaaaagatttatatactaatcacgaagacatagttctagaactaatccacaaagcagaaatttacaatgaaagctacatagatgaactcatgacacaatatgacggtagcttatttaaaaacagagaagatctgcttaggcttatcacacgcggttatgtgagtgatgatgatgtacacaagcgtccgctgagcgaactaataaaagatatcagtgaagagttagagcttttataa

SEQ ID NO: 7294 - protein, 198 aa, Unknown
  Obtained from environmental sample
  misc_feature (1)..(198): Xaa is any amino acid
MYALTGIQIHIYNIKYSKKRTSELDHFYPSNKYPFFAISFYNLIPSCTVCNKIKLDNDDPEYINPYDTRFDFNKNMKFDLKIEDSTFYHSLDGFNLHYKFSRNMAAEEIRRINNNLEDLELKDLYTNHEDIVLELIHKAEIYNESYIDELMTQYDGSLFKNREDLLRLITRGYVSDDDVHKRPLSELIKDISEELELL

SEQ ID NO: 7295 - DNA, 849 bp, Unknown
  Obtained from environmental sample
  misc_feature (1)..(849): n is a, c, g, or t
atgagtaaactaaatccgaaaaagtatagtttgatcgaaatgaagggggtaaccaaagcatacactccccggaaacagtttttttctaaatcccagaacaaggtgctggccttaaacagcattgacctttccattgaaaagggagaaatattcggattggtcggccagagcggcagcggcaagaccacaaccggccgccttctggtccggctggaatcgcccacctcgggaagtatctatttgaacggcagtcccataaaccgcttaacgggcgcgtccctgaaagcctaccggtcaaaggtgcagatgatttttcaggacccctaccagtcattgaacccccatttatcaatttcagatacgattttagaacccctggtggtccatggggttggcaatgcagcggcccaaagggagaaggtgctgcataccctggaaattgtggggttaacgcctggtattgatttttacgaccggtatccccaccagctttccgggggccagcgtcagcgggtcgccgttgcaagagccattgtgctggatccggactttatcgtggcagatgaacccacctccatgctggatgccaccattgccatccaattgttcaaattgctcaccgatatccggaaatcctttgatatgacttttttgtttatcacccataatctggccgctgccaactatttgtgtgacaagattgccgtgatccatgaaggacatattgtggaggtgaatacggccgacaagattattcagcacccggaacacccctataccaaaaaactctccgggtccgcccgaattaaatttggaggggaccggaacaaacgatgggccgggcattaa

SEQ ID NO: 7296 - protein, 282 aa, Unknown
  Obtained from environmental sample
  DOMAIN (48)...(240): ABC transporter
  misc_feature (1)..(282): Xaa is any amino acid
MSKLNPKKYSLIEMKGVTKAYTPRKQFFSKSQNKVLALNSIDLSIEKGEIFGLVGQSGSGKTTTGRLLVRLESPTSGSIYLNGSPINRLTGASLKAYRSKVQMIFQDPYQSLNPHLSISDTILEPLVVHGVGNAAAQREKVLHTLEIVGLTPGIDFYDRYPHQLSGGQRQRVAVARAIVLDPDFIVADEPTSMLDATIAIQLFKLLTDIRKSFDMTFLFITHNLAAANYLCDKIAVIHEGHIVEVNTADKIIQHPEHPYTKKLSGSARIKFGGDRNKRWAGH

SEQ ID NO: 7297 - DNA, 615 bp, Unknown
  Obtained from environmental sample
  misc_feature (1)..(615): n is a, c, g, or t
gtgggtgcttctactgcaataggtaactatattctaccatcatatcttggtaagataaaagatctaattgataatgaagtacatgtaatagtaaatagttctgaacacgtgattgatgaattagaagatagaaaagtggatgttgcacttattgaatctcctgtatttcgtgatggaattatatatagagagtgggttgaagatgaattggtttttttctctaacaagccacttccaaagacactgaaggctgaagacctttatgattttgattgggtatgtcgtgatgaaaaatctcatactagaaaattagctgctgaagtttttgaagagattggtgtagagtgttcatcttttaacgttattggtgttgtttctggtacaaccgcaattaaagagtctattttatacgcaaataaagatacagagcgtcctactgtttcagtcatatcacgtcatgtaattgaaaaagatatagaagcaggtacactttttgaatctagaattaaaaatttcaaaattacaagaaagttctatatagcttacacgaaagatcgtaaacatgatgcttttgtagataatgtagtaaattttttactaaatcttaaaatataa

SEQ ID NO: 7298 - protein, 204 aa, Unknown
  Obtained from environmental sample
  DOMAIN (1)...(204): LysR substrate binding domain
  misc_feature (1)..(204): Xaa is any amino acid
MGASTAIGNYILPSYLGKIKDLIDNEVHVIVNSSEHVIDELEDRKVDVALIESPVFRDGIIYREWVEDELVFFSNKPLPKTLKAEDLYDFDWVCRDEKSHTRKLAAEVFEEIGVECSSFNVIGVVSGTTAIKESILYANKDTERPTVSVISRHVIEKDIEAGTLFESRIKNFKITRKFYIAYTKDRKHDAFVDNVVNFLLNLKI

SEQ ID NO: 7299 - DNA, 564 bp, Unknown
  Obtained from environmental sample
  misc_feature (1)..(564): n is a, c, g, or t
atggtttttattcaacataccctttttagatttaaaaaaccttttgtaaaataccttgataactccatagaactcgggagaagttttgtacaaccaaaatattggggaactcgtgctttagattatctttggtatggaattggtgcatatttaaaacacaatccagaagtaaaatatatgtttggaccagtaagccttagtggaaactatccacaatatgcaaaagagttgatagttgatttttatagtaactattttggtagtgctgacaaacttgttgaggcacaattagaatttgaatttgaaactagtgatatagcacttgacaacccttttagctacaaagagtataaggatgattttaaacttctaaaaaacaaacttaaaagtatggacttaactattcctacactttataaacaatatagtgaattgtgtgaagaaggtggtataaaattttatgattttaacatcgatccagatttttctaactgtatcgatagttttatcgttgttgagattgcaaaaatcaaacaatcaaaacttgataggtatatggggtaa

SEQ ID NO: 7300 - protein, 187 aa, Unknown
  Obtained from environmental sample
  misc_feature (1)..(187): Xaa is any amino acid
MVFIQHTLFRFKKPFVKYLDNSIELGRSFVQPKYWGTRALDYLWYGIGAYLKHNPEVKYMFGPVSLSGNYPQYAKELIVDFYSNYFGSADKLVEAQLEFEFETSDIALDNPFSYKEYKDDFKLLKNKLKSMDLTIPTLYKQYSELCEEGGIKFYDFNIDPDFSNCIDSFIVVEIAKIKQSKLDRYMG

SEQ ID NO: 7301 - DNA, 630 bp, Unknown
  Obtained from environmental sample
  misc_feature (1)..(630): n is a, c, g, or t
ttgaaagtccctgaagattttaaaggtgaatgtgatgatatattaacttctttaaaagtatatacatatagtattgacgaaactttggaatttattgatagtatatgtgataaagttcaaaaagctgaattagaagtaataatagagagtattagattatataaaatagaaagtccttttgtagctaatgcttcaaattatggtgtgcctcaaaacagagaacgtgttttgtttattggctgtcgaaaagaccagaaatttatttctgaaatacctccaacagtaaacgatggtcaaaaagtaacaatttttgaagctttgtacgatttagattttattgggaataatcaagaagcacatcattacgaattaattgacattttaaaacaatataatgggacttcaaaaacaatgcaaggcttactgaaaactcgttctattgatggtaaaccaaatgttaaatcaggaaaaacatttgctgaatggagtaaacaaggaaggttgattgaaaggtatcaaaatgcaaataaacctttttatgtaagaaatataaaaggttacaagaaggtgagaaaacttatgatattttgnataatcataagacaaggtaccaaaacccaactgttgtga

SEQ ID NO: 7302 - protein, 209 aa, Unknown
  Obtained from environmental sample
  misc_feature (1)..(209): Xaa is any amino acid
MKVPEDFKGECDDILTSLKVYTYSIDETLEFIDSICDKVQKAELEVIIESIRLYKIESPFVANASNYGVPQNRERVLFIGCRKDQKFISEIPPTVNDGQKVTIFEALYDLDFIGNNQEAHHYELIDILKQYNGTSKTMQGLLKTRSIDGKPNVKSGKTFAEWSKQGRLIERYQNANKPFYVRNIKGYKKVRKLMIFXIIIRQGTKTQLL

SEQ ID NO: 7303 - DNA, 324 bp, Unknown
  Obtained from environmental sample
  misc_feature (1)..(324): n is a, c, g, or t
atgccttcacactntgagccttgtggattaaatcagcttattgctatgaattatggtgctatgcctatagtaaatcatgtaggtggtttggttgatacggttcaaaattttgaaaagttcgattcagcttcaaaaaaaggttatggactctattttaaaaaaattaaaagcagatcatttctgcacactctcaagaaagcttttgagatatatgaagataaaaaagagtttaataaaatcattaaacacaacatgaaatgcgatttttcttgggagtttagtgcaaaagagtatattaaactgtataaaagtattgcaaagtga

SEQ ID NO: 7304 - protein, 107 aa, Unknown
  Obtained from environmental sample
  misc_feature (1)..(107): Xaa is any amino acid
MPSHXEPCGLNQLIAMNYGAMPIVNHVGGLVDTVQNFEKFDSASKKGYGLYFKKIKSRSFLHTLKKAFEIYEDKKEFNKIIKHNMKCDFSWEFSAKEYIKLYKSIAK

SEQ ID NO: 7305 - DNA, 387 bp, Unknown
  Obtained from environmental sample
  misc_feature (1)..(387): n is a, c, g, or t
atgtccagctatagtagatcgttaatattactttttatattactctttagttctgttggttgtgcaaatcaaaatgagataactaaaaataacccagaagaagacttatatattatgttagcacttgatagtgaaaaaaactcagactatcaaaatagttttaaattttataaaaaactctattctcttaccaaaaaagaggattatcttaaaaaatcaattgaatatagttttaaaaataaacaatttgaagatatgaataaattatcaagaattgcattagaaaagtttccaaaaaataaagagtattattggcatcaaatagttatctctctacactcgataggtaaaactgaagaagctatcactgaagcaaaagagttataa

SEQ ID NO: 7306 - protein, 128 aa, Unknown
  Obtained from environmental sample
  misc_feature (1)..(128): Xaa is any amino acid
MSSYSRSLILLFILLFSSVGCANQNEITKNNPEEDLYIMLALDSEKNSDYQNSFKFYKKLYSLTKKEDYLKKSIEYSFKNKQFEDMNKLSRIALEKFPKNKEYYWHQIVISLHSIGKTEEAITEAKEL

SEQ ID NO: 7307 - DNA, 375 bp, Unknown
  Obtained from environmental sample
  misc_feature (1)..(375): n is a, c, g, or t
gtgatagagcatacagagtatccatataagtttgatgaaaatagatgtaatagttgtgaaggtaactgttgtattggtgaatcaggttacatatggattacaaaaaacgaatgtgaaaagctagcaaaccatctcaatataacacttgatgaacttggtgtaaactatcttttaaaagttggatataaatactctataaaagagaaacaactttcacagaataattatgcttgtatattttttgatttagagaaaaaacagtgtagtgtctatgaagcaagacctaatcaatgcaaaactttccctttttgggaatattttaaaagtaatataagtgaggtaaaagaagaatgtccagctatagtagatcgttaa

SEQ ID NO: 7308 - protein, 124 aa, Unknown
  Obtained from environmental sample
  DOMAIN (14)...(123): Uncharacterised protein family (UPF0153)
  misc_feature (1)..(124): Xaa is any amino acid
MIEHTEYPYKFDENRCNSCEGNCCIGESGYIWITKNECEKLANHLNITLDELGVNYLLKVGYKYSIKEKQLSQNNYACIFFDLEKKQCSVYEARPNQCKTFPFWEYFKSNISEVKEECPAIVDR

SEQ ID NO: 7309 - DNA, 735 bp, Unknown
  Obtained from environmental sample
  misc_feature (1)..(735): n is a, c, g, or t
atgacgagttacactaaaactcttcttttatatcaaccacaaaatgggtattgctataacagcgatacccattttttatataattttatacaaattaatctagcacattataaaaatattcaaggagaacttctagatattggaagtggaagtggaatattaggacttcttgtagctagaaactatcctaaactacagttaaatcaatgtgaaatacaaaatagttttcagtttttatcacaaaaaaatagtgagataaatagtattcaaaacatcctgtataaagagagttttatagcgtgtgattttaataaagagtttgattatattgtatcaaatcccccattttatcacagtgatgtgataaaaagtgaaaatgaaaatttaaaaattgcaagatattgtgatagtttacccctagttactcttctgtcaaaagcaacaaaactactcaaaccacaagggaaatttttcttttgttatgatgcaaaacaattggataacattatccttatagcaaaagaaaataaactcaatattgaatcaattcagtttttacatccaaattcaaaaaaagaggcaagcttagttatgataatgggaagaaaaaactcaaaatcaaaacttaaaatacttcctcctcttattatgtttgaaaataatggagagtttaaatctgaaataaatcaaatatatcaaaactgtaatacccatagtataaaatgtgagatataa

SEQ ID NO: 7310 - protein, 244 aa, Unknown
  Obtained from environmental sample
  misc_feature (1)..(244): Xaa is any amino acid
MTSYTKTLLLYQPQNGYCYNSDTHFLYNFIQINLAHYKNIQGELLDIGSGSGILGLLVARNYPKLQLNQCEIQNSFQFLSQKNSEINSIQNILYKESFIACDFNKEFDYIVSNPPFYHSDVIKSENENLKIARYCDSLPLVTLLSKATKLLKPQGKFFFCYDAKQLDNIILIAKENKLNIESIQFLHPNSKKEASLVMIMGRKNSKSKLKILPPLIMFENNGEFKSEINQIYQNCNTHSIKCEI

SEQ ID NO: 7311 - DNA, 495 bp, Unknown
  Obtained from environmental sample
  misc_feature (1)..(495): n is a, c, g, or t
atgggagaaatttgggaggttgtatatgattttggtggtgtaagtggacgcatggagattgttagtgaagatcccttagtaattgttgattttgctcatacaccagatggaatggcacagatactaaatgcattaaaagagaaagagatattagtagtttttggtgcgggtggtaatcgagataaaagtaaacgtcctctcatgggaaaagttgcagcttcattagcaaaacatctctatattacaagtgataatccaagacatgaagatcctgaattgataatagaggatattctaagcggtatagaagatagatcatcagttagtgtaaatgtaaacagaaaagaggcaataaaaaaagctcttaaagatcaaaaaaagaatgaaactgttttgatactaggtaagggtgatgaaacttatcagatcatttatgataagagattcccttttgatgacagagaagttgcaaaagagcttctgcttttaaaatag

SEQ ID NO: 7312 - protein, 164 aa, Unknown
  Obtained from environmental sample
  DOMAIN (14)...(97): Mur ligase family, glutamate ligase domain
  misc_feature (1)..(164): Xaa is any amino acid
MGEIWEVVYDFGGVSGRMEIVSEDPLVIVDFAHTPDGMAQILNALKEKEILVVFGAGGNRDKSKRPLMGKVAASLAKHLYITSDNPRHEDPELIIEDILSGIEDRSSVSVNVNRKEAIKKALKDQKKNETVLILGKGDETYQIIYDKRFPFDDREVAKELLLLK

SEQ ID NO: 7313 - DNA, 768 bp, Unknown
  Obtained from environmental sample
  misc_feature (1)..(768): n is a, c, g, or t
gtgaacgcattagagttagtagatgttagtgaagatgaacttagtgatttagatttcgttgcaggatttatgggacctcttgatgtagagagtgtaaaagtaatttatgacatagatacaaaagatgctgcgaatatgatatgtggtgcaaatgagctagattatcacttttgtggagtagatttcagtgttgtaaaagatgctgtatttgctgatttaacagaggtgaaagagggtgataactgtcctcactgtgctaaaaagttatcatatacaaaaggtatagaagtagggcatatttttaaacttggaactacatattctcaagccctgaaagcagagtatttagatgaaaatggaaaagcaaaaccatttatcatgggaacttacggtatgggtgtttcacgtcttgtagcagctgtaatagagcagcaccatgatgaaaagggttgcatctggactaaagagtgtacgccgtatatggttaatattatggtctcaaatattaaagatgaagagcaactaaactttggcgaagagctttataaaaaacttcaagatcaaaatgtagatgttatcatagatgatagaaaagagcgttttggatttaagatgaaagatgcagagttgatcggttttccatatactgttattgttggaaaagagcttgttaacggtaatgttcagatatttgatcgtaaagcagacttaaaaacagatgtaagtacgactgaagtctatttaagaatattggaacttattaaatga

SEQ ID NO: 7314 - protein, 255 aa, Unknown
  Obtained from environmental sample
  DOMAIN (161)...(253): Anticodon binding domain
  misc_feature (1)..(255): Xaa is any amino acid
MNALELVDVSEDELSDLDFVAGFMGPLDVESVKVIYDIDTKDAANMICGANELDYHFCGVDFSVVKDAVFADLTEVKEGDNCPHCAKKLSYTKGIEVGHIFKLGTTYSQALKAEYLDENGKAKPFIMGTYGMGVSRLVAAVIEQHHDEKGCIWTKECTPYMVNIMVSNIKDEEQLNFGEELYKKLQDQNVDVIIDDRKERFGFKMKDAELIGFPYTVIVGKELVNGNVQIFDRKADLKTDVSTTEVYLRILELIK

SEQ ID NO: 7315 - DNA, 858 bp, Unknown
  Obtained from environmental sample
  misc_feature (1)..(858): n is a, c, g, or t
atgggagaggatacagatcttggaatccggtttgcgcaaggtggaatgcggttcttttacaatgaaaaagccgttgcttatcattatcatccaataatcgaatctgataacttccacagaactgttttcctgggtgaaatgattattttgcaggaagaaatttggcccaggcttcaccaactagtttatggactcccatttagccgccgttttgtttttaagtttttcatgtggatgtctcaaggattctcaagaaagtgcgtcaacgctctgcctgataaattaaagtggagcattttgagcatgtgtttcaaagcatctgatcttcttggtaaagatgctggaaatagacggggatttcaggcaaaaatccaaaagaatttaaagaagcctgaaaaaggtaaagtggttttgctcgttgctgaccctgatcaaaacaatttctacaagcacttgaaaaaagttaaacaggacgcaggttcaaaagccataacacttttagatgctgcaaattttggagcagaattaaggacatgccatccagatgttgaatggttcatattaataccaaggcacattaatccaataactctctcatcagaaatcttcaaagaaatccgcgctttggaatgcacagatgctgcaatagttgggattgaatcaaaaatagacctgtcactttatagatttcttaaacgatgtggatgtaagcaaatcaggatctataatgataagttctcaagagacgtcattacaaaacgagaaattctcattgaaacgaataacttacaatcctactccaagccaaatgtttgggggatctcaacattttgtcgatctgccatcatggatatcaat

SEQ ID NO: 7316 - protein, 286 aa, Unknown
  Obtained from environmental sample
  misc_feature (1)..(286): Xaa is any amino acid
MGEDTDLGIRFAQGGMRFFYNEKAVAYHYHPIIESDNFHRTVFLGEMIILQEEIWPRLHQLVYGLPFSRRFVFKFFMWMSQGFSRKCVNALPDKLKWSILSMCFKASDLLGKDAGNRRGFQAKIQKNLKKPEKGKVVLLVADPDQNNFYKHLKKVKQDAGSKAITLLDAANFGAELRTCHPDVEWFILIPRHINPITLSSEIFKEIRALECTDAAIVGIESKIDLSLYRFLKRCGCKQIRIYNDKFSRDVITKREILIETNNLQSYSKPNVWGISTFCRSAIMDIN

SEQ ID NO: 7317 - DNA, 861 bp, Unknown
  Obtained from environmental sample
  misc_feature (1)..(861): n is a, c, g, or t
atgtttaaaattaatttaacactaaatgggaagcacttcaaaacactagcttactcaaagccaatatcaattaaggaactagttagttccgacggaattgccgagcttgatgttataacctgcaaagtagattatcaatatacaacgttagaccatatagttgataaagattgctcattggattgcatctcttatgattctttaactggtcatctaatgtatcaagacaccgcaatctttattctcatgatggcctataaaaaactgtttccagagagaaaagacctggttatcgaacactctgttggtgatggagtattctgtgaagtttttgatgaggacttaatttctcaggaagatgttgaagatcttaaaaatgaaatgcgagagatagtaaagagtgctcttagtattgaaaagcaagtggtgtcaaatcttacagctatgcgactttttgatgaacagaatagagaagatgtaatcaagaatcttactatgaataatgtaaccatatataattgtggagatttttgcgattattatttgcgaaatcttgcagaaaacacctctattatcaaagaatttgatataatttaccactctccgggtctgattctacgtttccctcgaaggagtaatcataagattattgatgagtttattctccctaaaaaactctttgaaacacatcaggagcatgataaatggttgaacattctaaacgttcacaatataagttccttaaatcgtaaaattaaaaattacaaagtaactaacataatccaagtagaagaagcgcttcacgagaaggagataatagatattgcaaatagtatttcctggaataaaaatgcaaaataa

SEQ ID NO: 7318 - protein, 286 aa, Unknown
  Obtained from environmental sample
  misc_feature (1)..(286): Xaa is any amino acid
MFKINLTLNGKHFKTLAYSKPISIKELVSSDGIAELDVITCKVDYQYTTLDHIVDKDCSLDCISYDSLTGHLMYQDTAIFILMMAYKKLFPERKDLVIEHSVGDGVFCEVFDEDLISQEDVEDLKNEMREIVKSALSIEKQVVSNLTAMRLFDEQNREDVIKNLTMNNVTIYNCGDFCDYYLRNLAENTSIIKEFDIIYHSPGLILRFPRRSNHKIIDEFILPKKLFETHQEHDKWLNILNVHNISSLNRKIKNYKVTNIIQVEEALHEKEIIDIANSISWNKNAK

SEQ ID NO: 7319 - DNA, 840 bp, Unknown
  Obtained from environmental sample
  misc_feature (1)..(840): n is a, c, g, or t
gtggatgacgagaggagcgttactgaataccttgatacacttttgcaatctggtcaagaagcagaccgaagggatgttttttcaaaggtaaaattgtacgatgagcttgaatacttgattagcagtaatggtggacttaaaaagttaattgcttctgtaatacaccttgttgaaaatatcgaataccggtcaataattgagtcacatgttcagttaaaatctcttaaggccttagcgattgagttaataaaaaggctttgggaaaagtcaagtgatgacagaagtaaaatatatgtaaattcaatagtcaaggacgtgcaagatagactccgattacggacatctgctacacatgttgaaagtatcaatttgtatgatatttcaataaacaagaaaaaggtttcaaggttcaatgaaatagttaaagcaattcaaaaagaggaaaaaatttttgatgaatcagtgcagggttttaggattgttgcttcaaaaggaggcttcacacaagcctcacagatgtcctcaaccattaagaggaaagctgcttttaaggaagcgttaagtgtatataacgatccttattcctttttgcaagtactcaaggaccacccaaaacttgatgattcagatattcatcgaatatttgtaaaaattacatacagaattattaacagagataatactgatgtatctgggggagagcgctcagaattcaggttactacaagaaattaaagatgctcaaaattatgatattcttttgctggatgaaccagagtcctcatttgacaataagttttttgaacagcgatgtaaattcaattatcaaaagcatttctag

SEQ ID NO: 7320 - protein, 279 aa, Unknown
  Obtained from environmental sample
  misc_feature (1)..(279): Xaa is any amino acid
MDDERSVTEYLDTLLQSGQEADRRDVFSKVKLYDELEYLISSNGGLKKLIASVIHLVENIEYRSIIESHVQLKSLKALAIELIKRLWEKSSDDRSKIYVNSIVKDVQDRLRLRTSATHVESINLYDISINKKKVSRFNEIVKAIQKEEKIFDESVQGFRIVASKGGFTQASQMSSTIKRKAAFKEALSVYNDPYSFLQVLKDHPKLDDSDIHRIFVKITYRIINRDNTDVSGGERSEFRLLQEIKDAQNYDILLLDEPESSFDNKFFEQRCKFNYQKHF

SEQ ID NO: 7321 - DNA, 318 bp, Unknown
  Obtained from environmental sample
  misc_feature (1)..(318): n is a, c, g, or t
atgtatctgggggagagcgctcagaattcaggttactacaagaaattaaagatgctcaaaattatgatattcttttgctggatgaaccagagtcctcatttgacaataagttttttgaacagcgatgtaaattcaattatcaaaagcatttctagtcagatgccagttgttgtagttactcacaataataacgttggtgcctcaataaatccagactatattctgtatgcacacaaatccactgataacgggaaaaaatctattgaattgtttcgngatatcctaaccgacaaacaatcaatccggtcgatgaaaccc

SEQ ID NO: 7322 - protein, 106 aa, Unknown
  Obtained from environmental sample
  misc_feature (1)..(106): Xaa is any amino acid
MYLGESAQNSGYYKKLKMLKIMIFFCWMNQSPHLTISFLNSDVNSIIKSISSQMPVVVVTHNNNVGASINPDYILYAHKSTDNGKKSIELFRDILTDKQSIRSMKP

SEQ ID NO: 7323 - DNA, 453 bp, Unknown
  Obtained from environmental sample
  misc_feature (1)..(453): n is a, c, g, or t
ttgattaatgccttccctaaatatgttgattatgattttacaagattattagaagccgatttagatcaaatagcaaatcataaaattgaaaaacaaactttattagaatcattttacctaggtgaaaatggattaaaagagaaggtaaaacttcaaaaaagtaaagatgataaagttcttgcaaaaactttaaatttacctcaaataagtgaagataatccaattagaattggtccttatggtccctatgtattaggtaaaacagtagatgaaaaacaagaatatattaatttaccaaaagaactgcttcccggtacaataactgatcgagagatcaaagaactaataaaaaaaggtaaagttaaaaatgaaccaattttattaggtaatgatgaagagactaatgaaatttatttatgcacgggaagatttnggacctttattggcaaatag

SEQ ID NO: 7324 - protein, 150 aa, Unknown
  Obtained from environmental sample
  misc_feature (1)..(150): Xaa is any amino acid
MINAFPKYVDYDFTRLLEADLDQIANHKIEKQTLLESFYLGENGLKEKVKLQKSKDDKVLAKTLNLPQISEDNPIRIGPYGPYVLGKTVDEKQEYINLPKELLPGTITDREIKELIKKGKVKNEPILLGNDEETNEIYLCTGRFXTFIGK

SEQ ID NO: 7325 - DNA, 759 bp, Unknown
  Obtained from environmental sample
  misc_feature (1)..(759): n is a, c, g, or t
atgacagatttgaaaaatcaaaataatgaaaaaagtgataaaattactttattaaaaaaattatctaatgatttaaaacttggagaatataaaattaaattatgttttaacaagttagctttagatgtaaacgataaatattttgaagataattattttctaagtaaagaacttgtttgttcttactatgggatattggataattatataagagatgatgaagcaataaaagaatttgatatccaaataaaacggtttgatgaagtgtatattgatactgctccattaatccacgaagattggtttttgtattttattgcaaatgcaagtttaactttgcgtagaagaagaaagaaattagttattttagaaaaaactatggaagagcttttcggaattgcaagaaatgaggaaaaagattttgctgttagattaagagcaagagtaagaccttatttaattgagaacctagcaaaaagtggattagttaagaaaatggatactggaagtgaaggtattgctgatgatcatttagtttctctttttaagaaaagaggaaagaataataatattttattaattacccaagatagatatttgagcgaaagagttgttcaactaggggaaaatctaaataaaaatattgatttaccgcagcattcatttttagaaagatttactcataaagaattcgttgatgaagatatagtaaaaaaagtagttgtttgtgagttgatgaaaaatnnggtgatttattaa

SEQ ID NO: 7326 - protein, 252 aa, Unknown
  Obtained from environmental sample
  misc_feature (1)..(252): Xaa is any amino acid
MTDLKNQNNEKSDKITLLKKLSNDLKLGEYKIKLCFNKLALDVNDKYFEDNYFLSKELVCSYYGILDNYIRDDEAIKEFDIQIKRFDEVYIDTAPLIHEDWFLYFIANASLTLRRRRKKLVILEKTMEELFGIARNEEKDFAVRLRARVRPYLIENLAKSGLVKKMDTGSEGIADDHLVSLFKKRGKNNNILLITQDRYLSERVVQLGENLNKNIDLPQHSFLERFTHKEFVDEDIVKKVVVCELMKNXVIY

SEQ ID NO: 7327 - DNA, 846 bp, Unknown
  Obtained from environmental sample
  misc_feature (1)..(846): n is a, c, g, or t
ttggatgaaagtgcacaatatattgataatatatttttaacacattctcatttagaccatataaatgatatcccttttttaattgatgcattttttgaaaaaagaacaaagccaataaaaatatatggtatagaaaaaactataaatgatttggaaaaacacatttttaattgggagatttggcctgatttttgtgagattgatttaatatatcaaaatttcaaagcaatagagttaatcccaataaaacttaatgaaacaattactttagaagatgatacaaaattaactccaatagaaaataaccacacaaaatcaagttgtggttatattattagtaaaaacaacaatgccacactttttacttcagatacatatatatgtgactctatttgggaaaatataaatagagatttaactatacactctgtaatcatagatgtatctttcccctcaaagtttgaaaagcttgcttttgatagtaagcatttaactcctgctttattaaaacaagaacttaagaaattaaaaagagatgatgtaagagtttacattgaccatattaaacctagctatgaaaaaatactaagagaagagattcatcaagaaaagttacttttaaatgaaggtaaaatattagatgatggggatgtaatttctttatcaaatgagtacttatcatantatacaaaaagatcaaatataagaaaaaaagaggtgaaaaagctaattgatattggaaagtcacttactactgaaaagaattttgatgttcttatggaaaaaatactttcttggagcaaaaagagttcttccaatgcaaatgcaggggacactatactttag

SEQ ID NO: 7328 - protein, 281 aa, Unknown
  Obtained from environmental sample
  misc_feature (1)..(281): Xaa is any amino acid
MDESAQYIDNIFLTHSHLDHINDIPFLIDAFFEKRTKPIKIYGIEKTINDLEKHIFNWEIWPDFCEIDLIYQNFKAIELIPIKLNETITLEDDTKLTPIENNHTKSSCGYIISKNNNATLFTSDTYICDSIWENINRDLTIHSVIIDVSFPSKFEKLAFDSKHLTPALLKQELKKLKRDDVRVYIDHIKPSYEKILREEIHQEKLLLNEGKILDDGDVISLSNEYLSXYTKRSNIRKKEVKKLIDIGKSLTTEKNFDVLMEKILSWSKKSSSNANAGDTIL

SEQ ID NO: 7329 - DNA, 639 bp, Unknown
  Obtained from environmental sample
  misc_feature (1)..(639): n is a, c, g, or t
atgttaaacatagacttgcatatgcataccaattgctcagatggtatgttgtcccctaaagaaatattatctttagctcaagagagaaatctgaatgtgatttctattaccgatcatgatacgttagaaggtttttgtgcagcgaaagagataatttctgattataatattaaattgattcctggagtggaaatcagtacaaattttcaaggtaaagatgtacatcttctggcttacaatattgattatcatgacaaaaaattaataacaatgcttcattcaattaaagaaggtagaataactagggcaaaaaaaataattgataagctggaaacactcggaataaaaattgattttgaagaagtgaaaaaaaaggcaggtcataataatataatcggtcggcctcacattgcacgtgttatggtagaaaatggattttgtgaaagtaagaaggcagcatttaatgattacatctcccatgatgctccgggcctattttgccaaaaccaacaccagatcctttccgaaatcatagatgtttgtgaagaagcaggtgggaattcctataattgctcatcctttttactaatcaaagaggaatacgttttaaaaaaatcctcctggattttaggccattga

SEQ ID NO: 7330 - protein, 212 aa, Unknown
  Obtained from environmental sample
  DOMAIN (4)...(67): PHP domain N-terminal region
  misc_feature (1)..(212): Xaa is any amino acid
MLNIDLHMHTNCSDGMLSPKEILSLAQERNLNVISITDHDTLEGFCAAKEIISDYNIKLIPGVEISTNFQGKDVHLLAYNIDYHDKKLITMLHSIKEGRITRAKKIIDKLETLGIKIDFEEVKKKAGHNNIIGRPHIARVMVENGFCESKKAAFNDYISHDAPGLFCQNQHQILSEIIDVCEEAGGNSYNCSSFLLIKEEYVLKKSSWILGH

SEQ ID NO: 7331 - DNA, 876 bp, Unknown
  Obtained from environmental sample
  misc_feature (1)..(876): n is a, c, g, or t
atggctcggaccatgcccaaaagagtcattgaagaaaaacacaaagaaattaccgacagtatccaatatgccaaacgcattcaaaatgctatattgccacctcaaaaattagtaaaagaatacctgcctgaaagttttatcctttacaaacctaaagatgtagtagctggtgatttttactggatggaatacaaaaataacaacattctttttgcagctgctgattgtactggacatggagtgccaggggctatggtaagtgtggtctgtaataatggattaaatcgtagtgtgcgtgaacatggtattacagaccctggaaaactgttagataaaactcgtgaaatagttatcgctgaatttgaaaaaagtgaagaagatgtaaaagatgggatggacatagctctttgcagtctacaactttccgaaagttcggaactttctgaaagttatgctacactactatatgctggagctaataatccactttggataattcgttccatctcaaaaaacctcgaacctcaaacctctagctttgaacttattgaaattaaacccaacaaacaacccgtgggtaaatactttaggaatgagctttttgtcactcacacaattgaactccaaaaaggagatactatttatatttttaccgatggttttgccgaccaatttggaggagaaaaaggtaaaaagttaatgtataaaccttttaagaacttattactttctatacaagataaaactatgaatgagcagaaagaaattttagatcaacattttgaaaactggaaaagggatttagaacaaagtgatgatgtctgtgttataggtgttagatttaatatcccatcctattctaaaacaggctgctaa

SEQ ID NO: 7332 - protein, 291 aa, Unknown
  Obtained from environmental sample
  DOMAIN (65)...(282): Stage II sporulation protein E (SpoIIE)
  misc_feature (1)..(291): Xaa is any amino acid
MARTMPKRVIEEKHKEITDSIQYAKRIQNAILPPQKLVKEYLPESFILYKPKDVVAGDFYWMEYKNNNILFAAADCTGHGVPGAMVSVVCNNGLNRSVREHGITDPGKLLDKTREIVIAEFEKSEEDVKDGMDIALCSLQLSESSELSESYATLLYAGANNPLWIIRSISKNLEPQTSSFELIEIKPNKQPVGKYFRNELFVTHTIELQKGDTIYIFTDGFADQFGGEKGKKLMYKPFKNLLLSIQDKTMNEQKEILDQHFENWKRDLEQSDDVCVIGVRFNIPSYSKTGC

SEQ ID NO: 7333 - DNA, 789 bp, Unknown
  Obtained from environmental sample
  misc_feature (1)..(789): n is a, c, g, or t
gtgaagacttctttccgtttcccagcccaaacccctgagcaagccgctgattggattgagatcttcctcctcattcgcatacccaaaaaatttgacttagatcctcatgaagacatccaagtcctcgtacccatgtatcgtggtgctgcaggggtggatgccctcaatcttcgtctacaaggagccttaaatccgaaaagcatccacaaaaatgagaagaaaatgtataacaccatcttcagagaaggtgacaaaattatgcagattcgcaatgactatgaaaagaaagttttcaacggcgacatcggcagaattgaagaaatctcaaaacgggaacagaccttcctcatcaattacgaaggcaacaaaatcacctataactggagcgaagcggatcaatttgtcttggcctatgccatctccattcacaaatcccaaggatcagaattccccgcagtggtcattcccatcctcaccgaacactacatgatgctccaacgcaacttgctctatacggccgtcacacgcgccaaacagctctgtgtgcttgtctccaacaaaagagcactccaaatagcggtttcaactgaaacagtttccaaaagattcacaggtcttcgatggcgattggaagacttaatcggcaaggccccccaaaaattggtcaaagatcttccaatcatgcaagactttatagcaaacaaagatcaaattgagctaaatggattgagcctaaaaaaggtgaagaaaagtgaacccaaaaatccacgtaagccccgcacaaaataa

SEQ ID NO: 7334 - protein, 262 aa, Unknown
  Obtained from environmental sample
  misc_feature (1)..(262): Xaa is any amino acid
MKTSFRFPAQTPEQAADWIEIFLLIRIPKKFDLDPHEDIQVLVPMYRGAAGVDALNLRLQGALNPKSIHKNEKKMYNTIFREGDKIMQIRNDYEKKVFNGDIGRIEEISKREQTFLINYEGNKITYNWSEADQFVLAYAISIHKSQGSEFPAVVIPILTEHYMMLQRNLLYTAVTRAKQLCVLVSNKRALQIAVSTETVSKRFTGLRWRLEDLIGKAPQKLVKDLPIMQDFIANKDQIELNGLSLKKVKKSEPKNPRKPRTK

SEQ ID NO: 7335 - DNA, 522 bp, Unknown
  Obtained from environmental sample
  misc_feature (1)..(522): n is a, c, g, or t
gtggataaaagaataagagtattaaatcttggagtcaatagtggagaagagtttgaaactatcaaacaatattcaaaaaactttgcaaacttggagcttgtgggaattgattattgtaaaactgctatacaaaaagccaaagagatatttaaagatgattcaaatacactttttttagaaggtgatatcaatagattagaagaattaaatcttggtaaatttgatttaattatcactatagggacactgcaaagtaccaatatagattttaataaaacttttatgaatattgtacaaaactatctgaacaaagatggtgctatgattatggggtttccaaactgtcgttggattgatggagagatgatatatggtgcaatggtaaaaaactacaactattcagaactctcaaacctctacaaagatgtaaacttttgtaaaaaatacctccaacaaaagaagtttcgagtaacaatcacaggaaaagattatatatttctaacggctacttctattaggtaa

SEQ ID NO: 7336 - protein, 173 aa, Unknown
  Obtained from environmental sample
  misc_feature (1)..(173): Xaa is any amino acid
MDKRIRVLNLGVNSGEEFETIKQYSKNFANLELVGIDYCKTAIQKAKEIFKDDSNTLFLEGDINRLEELNLGKFDLIITIGTLQSTNIDFNKTFMNIVQNYLNKDGAMIMGFPNCRWIDGEMIYGAMVKNYNYSELSNLYKDVNFCKKYLQQKKFRVTITGKDYIFLTATSIR

SEQ ID NO: 7337 - DNA, 411 bp, Unknown
  Obtained from environmental sample
  misc_feature (1)..(411): n is a, c, g, or t
gtgttagcagtagaaaagccatctttaggtttatctagatttgtttcaaattactcaaatatcaaagaaccatatttattaattaacatcgatagagatggtattgatttcgtattagccgataataaaaaaattcttttctatgattntgatgattggtcagaaataactcaagctaatgtacagcaatttttaaacacacaagagttgtctcattactatacaagaaagatcaaccaaatccttagttatcacaataataaaagtaaagtagagataagaaacttttatttctttagcttaatacctaatattaagaattattctatctcatttattcaaaatacatttaaattgctatatattaagaataatctgcctcctaatatcaaaaacatatcagaagagtga

SEQ ID NO: 7338 - protein, 136 aa, Unknown
  Obtained from environmental sample
  misc_feature (1)..(136): Xaa is any amino acid
MLAVEKPSLGLSRFVSNYSNIKEPYLLINIDRDGIDFVLADNKKILFYDXDDWSEITQANVQQFLNTQELSHYYTRKINQILSYHNNKSKVEIRNFYFFSLIPNIKNYSISFIQNTFKLLYIKNNLPPNIKNISEE

SEQ ID NO: 7339 - DNA, 819 bp, Unknown
  Obtained from environmental sample
  misc_feature (1)..(819): n is a, c, g, or t
ttgtttaacaatcaggaatatacccttacagcaaataaaacagaaaaatcaggatctgccctacttgttgaattttcatggaaatctaattcaacaaactctgatacaattactttcagcgatgttctggaaacaggtggcattactcctatcccaccctatttgaatcgaaaatcagaaatttcagacaaaaaaaattatcaaacaatttattcaaaacacaaaggatcggttgcagctcctacatcgggtttgcatttcacacaaagtgtttttaatagtttgcaaaacaaaaatattgaaactgccgaactaactctgcatattggtgcaggaactttcagaccagtaacaagcgaaaaaattggcggacacgagatgcacaccgaacatttttttataaataaacaattgataaaaaaaataattgataaatatcaacatattattgctgttggaacaacttcggtacgaactttggaaagtatttattggcttggtgtgaaaatgcttgatcaaaatattattgctaatgaaattaaaatttcgcaatgggaaatttataatttaccgcaaaatattgctacaaaaaaagcattagaagtagttttgaatttcatgattgacaataatttagatatattaagtgcagcaactcaaattattattgttccaggatataaatttaaaatagtaaatggattgattacaaattttcacatgccaaaaagcacattgcttttattagtttcggcttttgttaataataattgggaaaaaatatacaattatgctcttaaaaataaattccgattttaa

SEQ ID NO: 7340 - protein, 272 aa, Unknown
  Obtained from environmental sample
  DOMAIN (1)...(119): Queuosine biosynthesis protein
  misc_feature (1)..(272): Xaa is any amino acid
MFNNQEYTLTANKTEKSGSALLVEFSWKSNSTNSDTITFSDVLETGGITPIPPYLNRKSEISDKKNYQTIYSKHKGSVAAPTSGLHFTQSVFNSLQNKNIETAELTLHIGAGTFRPVTSEKIGGHEMHTEHFFINKQLIKKIIDKYQHIIAVGTTSVRTLESIYWLGVKMLDQNIIANEIKISQWEIYNLPQNIATKKALEVVLNFMIDNNLDILSAATQIIIVPGYKFKIVNGLITNFHMPKSTLLLLVSAFVNNNWEKIYNYALKNKFRF

SEQ ID NO: 7341 - DNA, 576 bp, Unknown
  Obtained from environmental sample
  misc_feature (1)..(576): n is a, c, g, or t
atgaaaaatataaacaatatcttattaattatttcaattattgcaatgccaattgtagcttctgcacaatactgtaacaattttcactctaaatattgtcctccatcagaaagtggaatgtatagcttaaatggacaatctaaaagtgccttgtttagtaaaggacaaacctcagaactaaatgtaatcgtttataaaggtcaggattatagaatttctctttgttttgatgaaactttaggttctcaaattacatataaagtttacgaaactaaaaaggctaaagtagaaaaagttattgaaactaaaaccatggaagatgagtaccagaaagatgaaaatggagagctagtagttgatgaatggggtgaatatattctaacagngaaccaagtcgaagtaataagtaaagaaacggtaacagtagtaaaacaacaaaaaaacttactttatgataatagtcaagaaggttttgctactggaataaaagttttcgggttgaaacttcccagaaggattaatcataagaaagtttcctatttccagaaaatgggagggaagtgggaaaatacttaa

SEQ ID NO: 7342 - protein, 191 aa, Unknown
  Obtained from environmental sample
  misc_feature (1)..(191): Xaa is any amino acid
MKNINNILLIISIIAMPIVASAQYCNNFHSKYCPPSESGMYSLNGQSKSALFSKGQTSELNVIVYKGQDYRISLCFDETLGSQITYKVYETKKAKVEKVIETKTMEDEYQKDENGELVVDEWGEYILTXNQVEVISKETVTVVKQQKNLLYDNSQEGFATGIKVFGLKLPRRINHKKVSYFQKMGGKWENT

SEQ ID NO: 7343 - DNA, 546 bp, Unknown
  Obtained from environmental sample
  misc_feature (1)..(546): n is a, c, g, or t
ttgagatgcttacatttaagtagtgattatagagctgaagagatagatgaacttccattttttaaagatattgatctagaaattttaaaagatgctattttgcaaagaagatcgattagagcttttagagagaactccttgacgagtgcagagtttgattttatttttaaagatattttcgcttttgctaaagtctataaaatagatatttactatacagttcacaatattgtagataaaaaagtaggactttacaaaaatgaagaacttatcaaagagggtgagttctcaagcaattcaggttacctctccctagagcaaaagataggaagctctagtgctatgactatctactttacatcaaatgaggttgaaaagtatcagcaggtaaatatacttagcgggtttttagctcatgttatatacttgaaatctactattaaaatgattggctgcagcggtataggcgcgtactatgatgatgatgtaaaaaactttttaaacacaaaaaacaatattctatatcttttagcagtaggtagataa

SEQ ID NO: 7344 - protein, 181 aa, Unknown
  Obtained from environmental sample
  misc_feature (1)..(181): Xaa is any amino acid
MRCLHLSSDYRAEEIDELPFFKDIDLEILKDAILQRRSIRAFRENSLTSAEFDFIFKDIFAFAKVYKIDIYYTVHNIVDKKVGLYKNEELIKEGEFSSNSGYLSLEQKIGSSSAMTIYFTSNEVEKYQQVNILSGFLAHVIYLKSTIKMIGCSGIGAYYDDDVKNFLNTKNNILYLLAVGR

SEQ ID NO: 7345 - DNA, 711 bp, Unknown
  Obtained from environmental sample
  misc_feature (1)..(711): n is a, c, g, or t
atgggaaaaaagtgtgtagaagagtttaatccttggccaccttttgttgatatattttcatcaacaattttggtgctattactatttatgttaatcttaatagtgaacctaggatattatgcacaatttaaatttaaagtttcatatacaggaactattgcaacaagtcaacttattacagaacaggtaccagaaataaataaaattaatgaacctaaagaaaaacaaataccaatagagcaaaaagagattgttgaacaaaaagttataaaaacaagtattattagtgaagttcaagagaaaaaagagttagagagagctgggcaagatttagtacaagctaatgatacaaatagtacattgcaagcaacagtacaaaaagatgattatcttatagttacatttgctgacaaggagatactcttggatgaccccactatagttcaagtaaaacaatttattcaacaaatgaaaaataaatttccaaagcataaggttataatatcttcagtggaaccaacaaatcanataagttcaacaattgcaaaacaaatatcacttgcaagaactttaaatactcgaaatttaataagaaagcaagggtataataaaagcgatgttcgaattaggttgttagatgatactattagaagtaagcttcctgaaaatgaagctggatttgtttatataacagtaaaggtaaataagtag

SEQ ID NO: 7346 - protein, 236 aa, Unknown
  Obtained from environmental sample
  misc_feature (1)..(236): Xaa is any amino acid
MGKKCVEEFNPWPPFVDIFSSTILVLLLFMLILIVNLGYYAQFKFKVSYTGTIATSQLITEQVPEINKINEPKEKQIPIEQKEIVEQKVIKTSIISEVQEKKELERAGQDLVQANDTNSTLQATVQKDDYLIVTFADKEILLDDPTIVQVKQFIQQMKNKFPKHKVIISSVEPTNXISSTIAKQISLARTLNTRNLIRKQGYNKSDVRIRLLDDTIRSKLPENEAGFVYITVKVNK

SEQ ID NO: 7347 - DNA, 600 bp, Unknown
  Obtained from environmental sample
  misc_feature (1)..(600): n is a, c, g, or t
gtggatgaaaacttaacaaagatagaagatagcaatacagcagtggtcgccgataataacacaacagctacaaaaaatagtttagatgatttattagagtttgagagtaaatttttagaaagtgacgataataaatggacggttagaatctactattttgataaagtgtatcaagctttagattttggaaatgaaaagaaaatttcaaaagatatttttgtatttgatactcttgataaaaataaaataaaaacaaatattgcatataatatatttgatacagagcaactagcgcaagctacttcagatgatttaaatgttacaaatttaaataaaaaagtatttagtataaaagatataaaagagctttataatggttttaaaaataaaaaacttcaaacaaaacaaaaagtaaaaaaagtaaaaccatttcaaacaaatcaaaaatttaaaaaggtatttttaaatgcaccaaaagatctttatacaataaatataacctctttctcttcaatagctcaagcaaaagagcttttagataaagagaaaatttatgataatagttttgtatttacttacggagaagagaatgagtggtaa

SEQ ID NO: 7348 - protein, 199 aa, Unknown
  Obtained from environmental sample
  misc_feature (1)..(199): Xaa is any amino acid
MDENLTKIEDSNTAVVADNNTTATKNSLDDLLEFESKFLESDDNKWTVRIYYFDKVYQALDFGNEKKISKDIFVFDTLDKNKIKTNIAYNIFDTEQLAQATSDDLNVTNLNKKVFSIKDIKELYNGFKNKKLQTKQKVKKVKPFQTNQKFKKVFLNAPKDLYTINITSFSSIAQAKELLDKEKIYDNSFVFTYGEENEW

SEQ ID NO: 7349 - DNA, 675 bp, Unknown
  Obtained from environmental sample
  misc_feature (1)..(675): n is a, c, g, or t
atgatttcaaatgactccattgaggcacttaaaagccgactagatatcgttgatgttgttggctcttatttggaactcaaaaaaaatggagcaaatttcaaagcaccttgtccttttcatgacgagaaatcaccctcttttgtagtctctccctcaaagcagatttatcactgtttcggttgcggtgccggtggtgatagcattaaatttgtcatggagtatgagaagctaaactaccctgaagcgattgagaagttagcacaagatagtaatttttcacttgagtacacaaaaaatgcaccctcacaaaacagctcaaaactcatggagaaggtaaatgattggtttatctctttgttaaatcaaaatcccactgcaaaaaagtatcttcatgatcgtggtatctacgagtcttccattgagaagtttggcatcggctatgcaccaagttctaacgagagtgtaaactatctgcaaagccacctttttaacatgagtgaagctgttgagttaggtgtgttagggtttgataacaatcgttacttcgctcgttttatcgagagaatcacatttccaatctactcaacaaatggctctacggtaggttttggcggaagaaccatcacaggtcatcaagcaaaatatgtaaactctccacaaacaaaacttttttaa

SEQ ID NO: 7350 - protein, 224 aa, Unknown
  Obtained from environmental sample
  DOMAIN (2)...(99): CHC2 zinc finger
  misc_feature (1)..(224): Xaa is any amino acid
MISNDSIEALKSRLDIVDVVGSYLELKKNGANFKAPCPFHDEKSPSFVVSPSKQIYHCFGCGAGGDSIKFVMEYEKLNYPEAIEKLAQDSNFSLEYTKNAPSQNSSKLMEKVNDWFISLLNQNPTAKKYLHDRGIYESSIEKFGIGYAPSSNESVNYLQSHLFNMSEAVELGVLGFDNNRYFARFIERITFPIYSTNGSTVGFGGRTITGHQAKYVNSPQTKLF

SEQ ID NO: 7351 - DNA, 615 bp, Unknown
  Obtained from environmental sample
  misc_feature (1)..(615): n is a, c, g, or t
atgaacagaatcggctcngaatatttgaccctgcggctcaatatttctcaactcaaccgttatacaaaggaagaaatagtattggcaaaatataatgattttacaggaaacaatgcatttactaaagatgataaaaataatacaatttatatcaaaggtaataacttttatatagttaatgatattgataaacaaaataaattaaaagatattgaaggttatagatattttttttacaatggaataaaaccacctgtgttatttatatcaataatttttataggtatccccttaagtggttttcttcaatatttctattttccaaatttagatgagagaggtactccttttcttattggatttccattatatttaatatcattatttttgtacaataaaaaaattaaaaatatcattaaaaattgtgaaataattacaaaagatgctttatctgaacatatactattaaaagaaaaaaagacaagccaagaagttcccttatcattaaaaataaaatcaagtctcccagatatgaatatttttcatattataatttttctactaattgcttcaccttttttatattttgtatttgcagttttaactatgcaataa

SEQ ID NO: 7352 - protein, 204 aa, Unknown
  Obtained from environmental sample
  misc_feature (1)..(204): Xaa is any amino acid
MNRIGSEYLTLRLNISQLNRYTKEEIVLAKYNDFTGNNAFTKDDKNNTIYIKGNNFYIVNDIDKQNKLKDIEGYRYFFYNGIKPPVLFISIIFIGIPLSGFLQYFYFPNLDERGTPFLIGFPLYLISLFLYNKKIKNIIKNCEIITKDALSEHILLKEKKTSQEVPLSLKIKSSLPDMNIFHIIIFLLIASPFLYFVFAVLTMQ

SEQ ID NO: 7353 - DNA, 894 bp, Unknown
  Obtained from environmental sample
  misc_feature (1)..(894): n is a, c, g, or t
atgatggctcagaagatacagtggttttataagttttatctctatgcaacacaatacttaagtacacaatttgaacaattagaatttattaagtcttttgataaaaaatataatgaagatttaataaataactatccaaatcctttatggatataccctcccctctcttctaaaaataaaaaaaacactcaagagagcgaagaggaggagttacaaagagctaaagagaaagaaagaacagatactttagagatgaaaaaacaaacaaatcaaatagatgacacaaaagagacaaatggctttttggcttttttaccagaatctttgatgagtatttttgaacaagtaaatgttgatagaatggaagatgatagttttgatgacaatgctttgtatcatgctgaagatttagatgagataactttagggaaaaaacaagccaacttagcttctagaattaagatggatttggatttacaacctgatatgagagaaatatatcctttaggtaaaggacatttgattgatgaatgggattatagaataaataattatttgataaattatgttcgtataaaaccacaagttacgataaatgttataccaacagagttaccaaaacgattgaaaaagactgtaaaaaaaatccaatcagaacttgatttactagaacttgatagaatcaaaaatgataggttgccttatggtgatgagatcaatataaatacatggatagattataaagggcatcaaaataaatccacacatcatcaaaatttttatancacatatgagagaaaaacaagagatatggctacacttattttagctgatgtttccctctctacagaaggtgggataactcaagatatgcgaataatagatgttatttaa

SEQ ID NO: 7354 - protein, 297 aa, Unknown
  Obtained from environmental sample
  misc_feature (1)..(297): Xaa is any amino acid
MMAQKIQWFYKFYLYATQYLSTQFEQLEFIKSFDKKYNEDLINNYPNPLWIYPPLSSKNKKNTQESEEEELQRAKEKERTDTLEMKKQTNQIDDTKETNGFLAFLPESLMSIFEQVNVDRMEDDSFDDNALYHAEDLDEITLGKKQANLASRIKMDLDLQPDMREIYPLGKGHLIDEWDYRINNYLINYVRIKPQVTINVIPTELPKRLKKTVKKIQSELDLLELDRIKNDRLPYGDEININTWIDYKGHQNKSTHHQNFYXTYERKTRDMATLILADVSLSTEGGITQDMRIIDVI

SEQ ID NO: 7355 - DNA, 336 bp, Unknown
  Obtained from environmental sample
  misc_feature (1)..(336): n is a, c, g, or t
atgcaaccattttattatacagatttaggggctgccatacgagagtctacgaaaatcttagataaacaacaatcacaaaataaattattgttaattattagtgatgggaaaccaaatgatgaagatagatatgatggacgatatgggatagaagatacaaaaaaagctattgaagaggtgaaaaaaaaagggattacccctttttgtatcactatcgatttagaagcaaaagaataccttagttatctctttggtagaaacggttttaccatagtaaaagatggtcaaaacttgccaaaagttataccagaagtatatataaacttaacaaaataa

SEQ ID NO: 7356 - protein, 111 aa, Unknown
  Obtained from environmental sample
  misc_feature (1)..(111): Xaa is any amino acid
MQPFYYTDLGAAIRESTKILDKQQSQNKLLLIISDGKPNDEDRYDGRYGIEDTKKAIEEVKKKGITPFCITIDLEAKEYLSYLFGRNGFTIVKDGQNLPKVIPEVYINLTK

SEQ ID NO: 7357 - DNA, 468 bp, Unknown
  Obtained from environmental sample
  misc_feature (1)..(468): n is a, c, g, or t
atgttaagagttatcttaatatctatttttgtacttaatatatatgctcaaactcttttaactgatgacaaagagcagattttaaaactgaaaaaagagaaagctcttcatgacagagacgcttcaaaaaatagctggatttctccgctaaatctctctacatctattaaaaagtcaaaagattcaagctctactaacagttctacaactaaagatgcatcactaactctgaatcaagatatcttccgctcaggagggatttacgatcagattaatatctctaaatctacatataaaagcacaatttactccatagatttgcaaaacagtacctatctgaagagtctctttacatctttagccgagtataaaaaaaactctctgcttatcaaacagagcagactctatatcaaaaatcatgagataaatcttcttatcaataagaccgatatgaagctggtgagatag

SEQ ID NO: 7358 - protein, 155 aa, Unknown
  Obtained from environmental sample
  SIGNAL (1)...(16)
  misc_feature (1)..(155): Xaa is any amino acid
MLRVILISIFVLNIYAQTLLTDDKEQILKLKKEKALHDRDASKNSWISPLNLSTSIKKSKDSSSTNSSTTKDASLTLNQDIFRSGGIYDQINISKSTYKSTIYSIDLQNSTYLKSLFTSLAEYKKNSLLIKQSRLYIKNHEINLLINKTDMKLVR

SEQ ID NO: 7359 - DNA, 405 bp, Unknown
  Obtained from environmental sample
  misc_feature (1)..(405): n is a, c, g, or t
atgatgcgcgcagcgatcttacagataccttcggtaggtatgtctacggcaaagtttgattattatctgcgtatagccaaaagcaaggggtgcaaggtcgtccttcttggagagtatctgctcaaccgctttttcaaagaactcgaaaacacacctatctctatgatcaaagagcagagtgatcaccatcttaaaacacttaaagctttggccaaagagtatgatgtgaacatcatcgcacccttggtcatcgtcaaaaagaaaaaaccctacaagaccatcgtgaagttctctcctacttctacttcgtactaccaccagcagatccttatcaactataaacactgggacgaagagaagttttttgcgaacgagannctanctgcattgaagcccctcctatga

SEQ ID NO: 7360 - protein, 134 aa, Unknown
  Obtained from environmental sample
  misc_feature (1)..(134): Xaa is any amino acid
MMRAAILQIPSVGMSTAKFDYYLRIAKSKGCKVVLLGEYLLNRFFKELENTPISMIKEQSDHHLKTLKALAKEYDVNIIAPLVIVKKKKPYKTIVKFSPTSTSYYHQQILINYKHWDEEKFFANEXLXALKPLL

SEQ ID NO: 7361 - DNA, 345 bp, Unknown
  Obtained from environmental sample
  misc_feature (1)..(345): n is a, c, g, or t
ttggaatacaacagttacaactttacgaaatgtttggatcccctttcgtatctttacatcactaaagcgatcaatatctttgatctgagcagaggtcatgactctcttgaagagcctttggacaatgtcaaatcggatgtccatcttatcagttttcaaagtgatatgctttttgaaccaaaagagtcaaaagagatctatgatatcatgcagaagcttcatcccaaagagcagtcttattatctcaatgtagagagttcttacggacatgatgcatttttggtggagatagagaagttcgaacattatatcaaggaggcattggatggccgaaaagaaaagtag

SEQ ID NO: 7362 - protein, 114 aa, Unknown
  Obtained from environmental sample
  misc_feature (1)..(114): Xaa is any amino acid
MEYNSYNFTKCLDPLSYLYITKAINIFDLSRGHDSLEEPLDNVKSDVHLISFQSDMLFEPKESKEIYDIMQKLHPKEQSYYLNVESSYGHDAFLVEIEKFEHYIKEALDGRKEK

SEQ ID NO: 7363 - DNA, 699 bp, Unknown
  Obtained from environmental sample
  misc_feature (1)..(699): n is a, c, g, or t
atgttacaaatgttacaaaaaatacaaaatcaaagagttcatgtaattaatttaggttttaaatccgaatggataatagattcttttaaaaaaactcgcccagataaagtttacttagtaaaaaaaactaatgaatcaaaagatgcaaaagatgcagaaaaagaaattaaaaaatttgttaagaaattagatattgaacttataattattgaaaataatgaagaggtatatcagttaattaggcaattaaaagtagtatttgaagaagagaaaggtaatgtggtttatttagcaatttcttctggtccaagatataatactagtgcatttattatttcttcaatgttattcggaaaatattctaaagaagtttatctttattctttaaaagaaggagagtttattccattacctcattttgaaacaaaactcccaaaattagaagtaatagaagcaataaaatttatctctaaggaaggtaaatgtaaaaagaaagacttaagagattttatatttaatgaaagcattttgaaagtaggaaaagaatgtaaagataaggaacattcaatgtatgttaaattaaatagatctattttagagtctgctttagattggaaattaataaagatagatggaaagaaaaaaggatgcttaatttctctaacggaagaaggagaaaaatgggtgaaaatattttag

SEQ ID NO: 7364 - protein, 232 aa, Unknown
  Obtained from environmental sample
  misc_feature (1)..(232): Xaa is any amino acid
MLQMLQKIQNQRVHVINLGFKSEWIIDSFKKTRPDKVYLVKKTNESKDAKDAEKEIKKFVKKLDIELIIIENNEEVYQLIRQLKVVFEEEKGNVVYLAISSGPRYNTSAFIISSMLFGKYSKEVYLYSLKEGEFIPLPHFETKLPKLEVIEAIKFISKEGKCKKKDLRDFIFNESILKVGKECKDKEHSMYVKLNRSILESALDWKLIKIDGKKKGCLISLTEEGEKWVKIF

SEQ ID NO: 7365 - DNA, 957 bp, Unknown
  Obtained from environmental sample
  misc_feature (1)..(957): n is a, c, g, or t
ttgattgatcaaatatatgatgatatagataaaagaaatggaaacttaaacaaagtctcaaaagatataaaagaattacatagaaaaattattgatctaacaactttacatttagacgaaatatataattatagtgatgataatgaagtcttaaggattgcaaagcaaataaaagaatttatcattgataacaaagtggaaatatataaagaacaattaacaacttattataaaggaacacttcgaaaaataactaaagatattgatggactatttgatgaaagaaatagtattcgttcaaatgtaaatggtataaagagagaactgagaaatatcaaaaatattggcgtaattaaaagtattgatattaaatttgatgatgaagatattgaaaatgtaattttaaataaaatgataaaacttaaaggattgatcgaaaaagaagatacaaatttttcagaaggtttatggggagttaataatgataataaaaaagctaaaaataatactctttcaaatttctatgatttacttatttctattcaatcaactaatataaaaaaaataactctagaagattgttttgaacttgaatttaaagttacagaaaataataatgaaggtggatggaaaaaatctcttcatggtataggttcggagggaacagatattttgataaaaaacttaatatatgtatctttattgtctttatcaaaaaaagaatctcttaaaaataatgatattccaatacattgtattttagatgaaatagggaaattacatcctttatattttaaagaacttttatcatttgcaaatgaaagaaatatatattttataaatggtatgccaactgtcatgttagtacatttatataataacttttacaatatttataaaaatacaagtaatttatcttatgcaaaaaaagtcctaagaaaaaaaaaggattattga

SEQ ID NO: 7366 - protein, 318 aa, Unknown
  Obtained from environmental sample
  misc_feature (1)..(318): Xaa is any amino acid
MIDQIYDDIDKRNGNLNKVSKDIKELHRKIIDLTTLHLDEIYNYSDDNEVLRIAKQIKEFIIDNKVEIYKEQLTTYYKGTLRKITKDIDGLFDERNSIRSNVNGIKRELRNIKNIGVIKSIDIKFDDEDIENVILNKMIKLKGLIEKEDTNFSEGLWGVNNDNKKAKNNTLSNFYDLLISIQSTNIKKITLEDCFELEFKVTENNNEGGWKKSLHGIGSEGTDILIKNLIYVSLLSLSKKESLKNNDIPIHCILDEIGKLHPLYFKELLSFANERNIYFINGMPTVMLVHLYNNFYNIYKNTSNLSYAKKVLRKKKDY

SEQ ID NO: 7367 - DNA, 720 bp, Unknown
  Obtained from environmental sample
  misc_feature (1)..(720): n is a, c, g, or t
atgaaaaatggtattgttaatagaacatttataacaaaaataagatatacaattaaattaatagataaaataaaattagatttatttctagaaaaagagtatcaaattatatctttagaaaaatatattgttttacttggagataaaaatataactagggcacatatattatcagcttcgaatgatgacaaattgaaaatagtcaatacactgtatggatattactttgcaagttatgataatgttgagattcaaattaataatgaaccatacaatataaatacacctagtggatcatcattatttattagtacgtctgcaaagattcaaatccctgaaagtgtgttagtagtgggtgttgaaaatgctgaaaatttaaattttattaaaaaacagtcttatcttttttctcaataccctaagcaaaaactatttgtatttagaagtcctataatgcttgagtggataaaggaaataaaaaatgaatatttgcactatggggattttgattttgcagggataagtatttatattcatcaaatcggtccaagattgagtaataaatcatcattttttattcctaagaatattgagttttatttaacacaaggtaataccaatctttatgacaatcaaataatttataaagaatcaataattggatttgataataagattgattatttagttcaaaagatttcagattctcaaaaaggctag

SEQ ID NO: 7368 - protein, 239 aa, Unknown
  Obtained from environmental sample
  misc_feature (1)..(239): Xaa is any amino acid
MKNGIVNRTFITKIRYTIKLIDKIKLDLFLEKEYQIISLEKYIVLLGDKNITRAHILSASNDDKLKIVNTLYGYYFASYDNVEIQINNEPYNINTPSGSSLFISTSAKIQIPESVLVVGVENAENLNFIKKQSYLFSQYPKQKLFVFRSPIMLEWIKEIKNEYLHYGDFDFAGISIYIHQIGPRLSNKSSFFIPKNIEFYLTQGNTNLYDNQIIYKESIIGFDNKIDYLVQKISDSQKG

SEQ ID NO: 7369 - DNA, 345 bp, Unknown
  Obtained from environmental sample
  misc_feature (1)..(345): n is a, c, g, or t
ttgcctaaggctaacaacatcggaatagctatgggaataaagagccagcttccaaagtataagggtagaataatttcactgcaacaagaggatttacaaatgcgcaaatggtacagtttaatcgacaaagtttattcacgtccgaaccttttagaggcttttgacaaggtcaggagaaacaaagggaaaaagacaagtgggatagatgggataagtgttaaaggattcaagaaacacttaggcgaaaacctgagccagctccacgatgaactgaaaagtgggactnntataaaccancaagcagtaaaanncgtgtttancgtgaaanctcgngccgaattctga

SEQ ID NO: 7370 - protein, 114 aa, Unknown
  Obtained from environmental sample
  misc_feature (1)..(114): Xaa is any amino acid
MPKANNIGIAMGIKSQLPKYKGRIISLQQEDLQMRKWYSLIDKVYSRPNLLEAFDKVRRNKGKKTSGIDGISVKGFKKHLGENLSQLHDELKSGTXINXQAVKXVFXVKXRAEF

SEQ ID NO: 7371 - DNA, 405 bp, Unknown
  Obtained from environmental sample
  misc_feature (1)..(405): n is a, c, g, or t
atggaaaattctacaaaattattaaaagagtttaatttgaaagtaacacctcaaagagtagctatagttgacgaactttattataaagggcatctaaatattgatgaactttatgcaagcatgttaagtaaatttccatcaatttcactagcaacgatttataaaaatgtaaattcgatggtagagaagttatttatatctgaggttaaaatacctagtgaaaaatctgtttatgagctaataaaagaagaacattctcatttagtttgtgaagagtgtaaaaaaatcgaagatatagttatagatacttcaagtgttttagacgaattaaaatctcaaagtaaatttaatatcaaacatgcaaatgtaatttttacaggtgtatgttcagagtgttcaaaatag

SEQ ID NO: 7372 - protein, 134 aa, Unknown
  Obtained from environmental sample
  DOMAIN (10)...(126): Ferric uptake regulator family
  misc_feature (1)..(134): Xaa is any amino acid
MENSTKLLKEFNLKVTPQRVAIVDELYYKGHLNIDELYASMLSKFPSISLATIYKNVNSMVEKLFISEVKIPSEKSVYELIKEEHSHLVCEECKKIEDIVIDTSSVLDELKSQSKFNIKHANVIFTGVCSECSK

SEQ ID NO: 7373 - DNA, 555 bp, Unknown
  Obtained from environmental sample
  misc_feature (1)..(555): n is a, c, g, or t
ttggttgaacgtaaggggtttgatattaaagaatttgaacaggctggttttaaaatggatgttcccgagtatttatataactatggagaaatacacaacttatcagttagaaaagggactcttacaacagaagagcggtttaagatcaacgaacatattattatgagcattaaaatgctaaaccagctccctttccccgaacatcttcagaatgtgaccgaatacgctgtttctcatcacgaaaccatgatcggtacaggttatccgcgaaagcttaaaaaagaggatatgagtatccctgccagaataatggctgtcgccgatatctttgaagctctcaccgcatcagaccggccatataagaaacctaacaccctttcggaatctatacgtatcctcagttttatggcaaaagatcagcatattgacgaagatatcttcaaactttttctgaaatctggggtttatagggagtatgcaaggaaatttttacaggatgagcagatagatgaggttgatatagaccaatacttgtcagcaggggcttgcgtataa

SEQ ID NO: 7374 - protein, 184 aa, Unknown
  Obtained from environmental sample
  DOMAIN (25)...(113): HD domain
  misc_feature (1)..(184): Xaa is any amino acid
MVERKGFDIKEFEQAGFKMDVPEYLYNYGEIHNLSVRKGTLTTEERFKINEHIIMSIKMLNQLPFPEHLQNVTEYAVSHHETMIGTGYPRKLKKEDMSIPARIMAVADIFEALTASDRPYKKPNTLSESIRILSFMAKDQHIDEDIFKLFLKSGVYREYARKFLQDEQIDEVDIDQYLSAGACV

SEQ ID NO: 7375 - DNA, 849 bp, Unknown
  Obtained from environmental sample
  misc_feature (1)..(849): n is a, c, g, or t
atgttcagaccaggttatgctatagaatacgattttttccaacctacacaacttaaaaacacacttgaaactaagctagtagagaatctatattttgctggacaaataaatggaactacaggttacgaagaagccgctggacaaggtttaatggctggaataaatgctcatttaaaaacaaatgaaaaagaagcttttattttaaatagagacgaagcttatattggtgttttaatagacgatttaattaataaaggcacaaacgaaccttatagaatgtttacgtcaagagcggagtatagaattcttttaagacaagataatgcagatattcgtttaacagaaagaggctttaatcttggtttagcttctgaattaagaatgaaaaaagttgaagagaagaaacaaaatattgaaaaaataatcaaaagatttgaagaagtttctgtacttccaaaagaagtaaacagctatttagaacaacaaaattcttctcctttaaaacaaaaagtaaaagcaatttctgttattactagaccaaatattgctataagagaatttagttcttgtaatactaaattaacagatgaagtaaatttatatactggagatgttttggaaagtgcggaaattttaatgaagtatgatggctatattaaaagagaaaaagaggttgctgataaaatttctagactagatgatattaaaattcacgatacaattgactacactaaacttggatctttatctgctgaagcagtagataagcttactaaaataaaaccatcaacccatcgaacaagcatcaagaaattagtggagtttctcccttcaaatgttctgttttga

SEQ ID NO: 7376 - protein, 282 aa, Unknown
  Obtained from environmental sample
  misc_feature (1)..(282): Xaa is any amino acid
MFRPGYAIEYDFFQPTQLKNTLETKLVENLYFAGQINGTTGYEEAAGQGLMAGINAHLKTNEKEAFILNRDEAYIGVLIDDLINKGTNEPYRMFTSRAEYRILLRQDNADIRLTERGFNLGLASELRMKKVEEKKQNIEKIIKRFEEVSVLPKEVNSYLEQQNSSPLKQKVKAISVITRPNIAIREFSSCNTKLTDEVNLYTGDVLESAEILMKYDGYIKREKEVADKISRLDDIKIHDTIDYTKLGSLSAEAVDKLTKIKPSTHRTSIKKLVEFLPSNVLF

SEQ ID NO: 7377 - DNA, 939 bp, Unknown
  Obtained from environmental sample
  misc_feature (1)..(939): n is a, c, g, or t
ttggaatttaaaaanatagagattacannaatcgttcacngtttttacccncttttctcaaaaggaatttccacagacaaaaaacacaaacacctggcagtaacgcctttgttttggcatttcaaaaaaccaaatagcaccagaagcattctgtttcccatttattgggcaaaacgaaacgcagatgttaataataaaatcctttttccagtaatttggagtttaaaaaacaaaaattacaaatcgtttacatttttgcccattttctcaaagggaatttccacagaccaaaaatacaaacacttggcagtaacgcctttgttttggcatttcaaaaaaccaaatagcaccaggagcatcctgtttccaatttattgggcaaagcgaaatagtgaggtcaacaacaaaatactatttccgattatgtggagtttaaaaaacaaaaattacaaatcatttacatttttgcccattttctcaaagggaatttccacagaccagaaacacaaacatttggtagtaactcctctgttttggcatttcaaaaaaacaggtgccagcagaaacatcctatttccaatttggtggaataaaaaatatggagaaggtgaaaatgaaagtgtttcaaatgtaattttccctctttattggtcgaagcgaaacgctgaaatcaacaataaaatactctttcctatattcttgagtttaaaaaacaaaaattataaatcgtttacatttttgcccattttctcaaagggaatttccacagaccagaatgacaaacatttagtagtaactcctctgttttggcatttcaaaaaaacagatgccagcagaaacatcctattcccaatttggtggaataagagatctggggaaagtgaaaaagaaagtgtttcaaatgtaattttcccctctttatgggccgaagcgaaatag

SEQ ID NO: 7378 - protein, 312 aa, Unknown
  Obtained from environmental sample
  misc_feature (1)..(312): Xaa is any amino acid
MEFKXIEITXIVHXFYPLFSKGISTDKKHKHLAVTPLFWHFKKPNSTRSILFPIYWAKRNADVNNKILFPVIWSLKNKNYKSFTFLPIFSKGISTDQKYKHLAVTPLFWHFKKPNSTRSILFPIYWAKRNSEVNNKILFPIMWSLKNKNYKSFTFLPIFSKGISTDQKHKHLVVTPLFWHFKKTGASRNILFPIWWNKKYGEGENESVSNVIFPLYWSKRNAEINNKILFPIFLSLKNKNYKSFTFLPIFSKGISTDQNDKHLVVTPLFWHFKKTDASRNILFPIWWNKRSGESEKESVSNVIFPSLWAEAK

SEQ ID NO: 7379 - DNA, 441 bp, Unknown
  Obtained from environmental sample
  misc_feature (1)..(441): n is a, c, g, or t
atggccgagtgctcgcagnttccnttgatacgaccttttctttacctgaagccgttacctcgtctttgcgaatcccgattcttcggggtgaagcaatctactccactaaaaatctacattataaaaatgttggaattctaccattctcccttcgggatcttttgtgaagaagtgatagataggatattttggattatctctaggttctccatccgctttaccggcaaatactttataatatctatcaacatcttccttatcctcgaaaaagaaagtaataattccgtttgtatcagcttcttccctttcacaaaatccaaacatgaatccaccaaaattataaataaggcaatccccttgatccatccatatctggcagccaatttcaccttcataaaacactctaatcttttcaatatccactgttttaaaaaatattaa

SEQ ID NO: 7380 - protein, 146 aa, Unknown
  Obtained from environmental sample
  misc_feature (1)..(146): Xaa is any amino acid
MAECSQXPLIRPFLYLKPLPRLCESRFFGVKQSTPLKIYIIKMLEFYHSPFGIFCEEVIDRIFWIISRFSIRFTGKYFIISINIFLILEKESNNSVCISFFPFTKSKHESTKIINKAIPLIHPYLAANFTFIKHSNLFNIHCFKKY

SEQ ID NO: 7381 - DNA, 747 bp, Unknown
  Obtained from environmental sample
  misc_feature (1)..(747): n is a, c, g, or t
ttggttgatttattcccggaatacagaacaaaatacgacatctatttaacaatttgtggtttcggaatgggtaactacaaagacgacagaatggaagaaatcagcacgcagggaaacggaaactatttctacattgatagcgaaaaagaagctgagaaagtattcgttaaagacctgagagccaatatgtttactattgcaaaagacgttaaaattcaagtagaatttaatccagcagaagtaaaagcttatcgtttaattggttacgaaaacagaatgcttgcaaacgaagattttgaagatgacaaaaaagatgctggcgaacttggagcaggtcatacagttacagctatttacgaaataatcccagctaattcagacgaagaaattccacaaacaggagaattaaaatatcaacaaactggtttaacaaaatatgcaagtacaggagaaattatgactttaaaacttcgctacaaaccaattcaatctgacaaaagtattttgatagaacaaataatttacaaaaagaatgttcttactcttagcaaaacttctgatgctttcaggttttcagcttcagttgctgcatttgggatgcttcttcgtggttcaaaatttatagaaaattacggatacgataaagttcttgaacttgcaaaaaattcctataattcaaaagatgaatatcaatcagaatttttgacacttatcactaaagcaaaaaatttatctgaaattaaataa

SEQ ID NO: 7382 - protein, 248 aa, Unknown
  Obtained from environmental sample
  misc_feature (1)..(248): Xaa is any amino acid
MVDLFPEYRTKYDIYLTICGFGMGNYKDDRMEEISTQGNGNYFYIDSEKEAEKVFVKDLRANMFTIAKDVKIQVEFNPAEVKAYRLIGYENRMLANEDFEDDKKDAGELGAGHTVTAIYEIIPANSDEEIPQTGELKYQQTGLTKYASTGEIMTLKLRYKPIQSDKSILIEQIIYKKNVLTLSKTSDAFRFSASVAAFGMLLRGSKFIENYGYDKVLELAKNSYNSKDEYQSEFLTLITKAKNLSEIK

SEQ ID NO: 7383 - DNA, 966 bp, Unknown
  Obtained from environmental sample
  misc_feature (1)..(966): n is a, c, g, or t
ttgattatgctgtattgggagaaattagggtgtgattggatatttatatatgcgatttttggtcaccctttattacccacaaattatattacaagtcataatgttgtaaaaaatgctcgacaatacgttgtagaagctcagttttcttcaaactctatnttagttggaaaaacaattgaagaggcaaaactgagaaatcttgaaggactgtttttatttcaaataattcgtgatggaactgagtattcagctgttcctaatgacactattttaatgcaagaagatattctaatgtttgcaggtgaaaccgaatcaattgcggtgcttttggagcaaaataaagggcttcgacttccttcggttggaatgtttgctcgtaaaaaagaattagatattgtagaaattgtagttgcagataattcttcgctttcaaacaaaacattaaaagatcaaaatttcagagcaaaatatgatgcaactgtaatagctgttcatagaaatggcgaaaaaattcaaggaaaacttggtatggtaaaacttaaatctggtgatactttacttcttctaactggtgttactttttccgaattatcaaacaatactaaagatttttatctaatttcaaaagttaaagaaattagaaaattaacaccatttcaatcttggtcactggttattggtacatttttagcaatatttttatcgtcaattggtttgattaaattgtttttagcacttattgttcttattagcatacttttagtcttaaaagttacaaatcccaaagaattagctaaaagtattgattatgatttggcatttattattgcaatggcattggcgcttggcgttgcgatgcagaaaacgggagttgctgaaattttagcaaatgtgatgattgaaatatttaaaccgtggggtaatgttggtttacttacaggactatatattattacagctatntag

SEQ ID NO: 7384 - protein, 321 aa, Unknown
  Obtained from environmental sample
  DOMAIN (132)...(198): TrkA-C domain
  misc_feature (1)..(321): Xaa is any amino acid
MIMLYWEKLGCDWIFIYAIFGHPLLPTNYITSHNVVKNARQYVVEAQFSSNSXLVGKTIEEAKLRNLEGLFLFQIIRDGTEYSAVPNDTILMQEDILMFAGETESIAVLLEQNKGLRLPSVGMFARKKELDIVEIVVADNSSLSNKTLKDQNFRAKYDATVIAVHRNGEKIQGKLGMVKLKSGDTLLLLTGVTFSELSNNTKDFYLISKVKEIRKLTPFQSWSLVIGTFLAIFLSSIGLIKLFLALIVLISILLVLKVTNPKELAKSIDYDLAFIIAMALALGVAMQKTGVAEILANVMIEIFKPWGNVGLLTGLYIITAX

SEQ ID NO: 7385 - DNA, 876 bp, Unknown
  Obtained from environmental sample
  misc_feature (1)..(876): n is a, c, g, or t
atggctnggtattgctcatcattttctccttcttttcggtcttgtgccttttttcctattaaccctttttctgattttatcagctttttgatgcacagcatatttggctatcgcaaaaaagtgatcgaagaaaatttaaaacgatctttcccaaacctggatgatcaaaaacgaaaaacgatgcttgtgcaggtttataaaaacctgaccgacattattatcgaagggatcaaatccttcactatgtgcaagaagcaaatcattcgacgccacaaaatcatcaaccctgagctcatgctcccatatattgaaaaaggacaaaacgtaattggcataacggcccattacaataattgggaatggggaagtctatcggcctccttacaaatagatatggatgtggttggtttttacaaacccctgagcaatccactggtaaatcgttttatgaaatggagccgttcgcgctatggtactatcctagcccctatttacgaaacttcagccacttttgaccgtcattcgggcaaacccacaattttcctgatggctgctgatcaaaacccaggaaatcctgaaaaagccatctgggttgatttcctgagccaggacactgcttttctgcacggcccggaaaagcatgcgcaaagatgtaacctgcctattgtttatattgatatcaggaggaaaaaacgcggctattacacaattcaactttcagaacttattaaaaacccattggattatcctgaaggggaaatcaccagcatttatgctaaaaaaatcgaggaaatcatccgagacgccccttctaactggttgtggtcacatcggcgatggaaacatcaacgaccaacttcaagccaggaggcttga

SEQ ID NO: 7386 - protein, 291 aa, Unknown
  Obtained from environmental sample
  DOMAIN (5)...(282): Bacterial lipid A biosynthesis acyltransferase
  misc_feature (1)..(291): Xaa is any amino acid
MAXYCSSFSPSFRSCAFFPINPFSDFISFLMHSIFGYRKKVIEENLKRSFPNLDDQKRKTMLVQVYKNLTDIIIEGIKSFTMCKKQIIRRHKIINPELMLPYIEKGQNVIGITAHYNNWEWGSLSASLQIDMDVVGFYKPLSNPLVNRFMKWSRSRYGTILAPIYETSATFDRHSGKPTIFLMAADQNPGNPEKAIWVDFLSQDTAFLHGPEKHAQRCNLPIVYIDIRRKKRGYYTIQLSELIKNPLDYPEGEITSIYAKKIEEIIRDAPSNWLWSHRRWKHQRPTSSQEA

SEQ ID NO: 7387 - DNA, 711 bp, Unknown
  Obtained from environmental sample
  misc_feature (1)..(711): n is a, c, g, or t
atgacaaaaaaggcaaaagagaaacttgcttatgagaataaacttagatttgccatacaaaataatgaactagaactctactaccaaccacaagttcacttccaaactaataatattgtctccgcagaagttctactccgctggcacgacaaagaagaaggtcttatatctccaacaatttttatcccgattgcggaagaaacagggctaataaacagcatcggagaatgggttataaatgaggcatgtaagcaaggaaaaatctggttggataaaggatatcatttaactctggctgttaatatatctgccaaccaagttaaataccaaaacttaccagaaatagtaagccaagctctttctaatagcgggtacagtgctgataagctggagctagaaatcacagaaagtgccttaatgcaaagagaagaggaagtagtttctatacttcattcactaaaagcaaaaggtattcgactagctattgatgattttggaacaggctattcatctttgtcatacctaaaacgatttccaattgatgtgctcaaaatcgacaaaagtttcatagatgatataccttatgaaaaagacgacatggctatagttatcgccattatagaaatgggtaaagccttagggtataaggttttggctgagggaacagaacagcaagaacaacttgattttctaaaagaaaaagnggtgtaa

SEQ ID NO: 7388 - protein, 236 aa, Unknown
  Obtained from environmental sample
  DOMAIN (7)...(236): EAL domain
  misc_feature (1)..(236): Xaa is any amino acid
MTKKAKEKLAYENKLRFAIQNNELELYYQPQVHFQTNNIVSAEVLLRWHDKEEGLISPTIFIPIAEETGLINSIGEWVINEACKQGKIWLDKGYHLTLAVNISANQVKYQNLPEIVSQALSNSGYSADKLELEITESALMQREEEVVSILHSLKAKGIRLAIDDFGTGYSSLSYLKRFPIDVLKIDKSFIDDIPYEKDDMAIVIAIIEMGKALGYKVLAEGTEQQEQLDFLKEKXV

SEQ ID NO: 7389 - DNA, 438 bp, Unknown
  Obtained from environmental sample
  misc_feature (1)..(438): n is a, c, g, or t
atgaaatattttactttaatatttttatttacttatttatccctttcgtcatttggacaaatgtctatatgcgatagtctgaaaaaggaatttgaactatgcgaaacagatagttgcaaatcacaagaaactataaatatttttgattattggcttgaaataaatcaagactccgcaaaattttatatgcaagaatatttagaatattttacgtctaaaaaatacgatttaggaatagttattacatcacaaaatttagctcagattgaaaaaacaaatggaaattatgaaaaaagttttagaattttaaatgatgcttacaatagtatttcagacgatttttctaaaataattttattattaaatttagcagaaaataatcggataacagaagattttgagacttcagaagaacaactaaaagatgctgtaaactaa

SEQ ID NO: 7390 - protein, 145 aa, Unknown
  Obtained from environmental sample
  SIGNAL (1)...(19)
  misc_feature (1)..(145): Xaa is any amino acid
MKYFTLIFLFTYLSLSSFGQMSICDSLKKEFELCETDSCKSQETINIFDYWLEINQDSAKFYMQEYLEYFTSKKYDLGIVITSQNLAQIEKTNGNYEKSFRILNDAYNSISDDFSKIILLLNLAENNRITEDFETSEEQLKDAVN

SEQ ID NO: 7391 - DNA, 567 bp, Unknown
  Obtained from environmental sample
  misc_feature (1)..(567): n is a, c, g, or t
gtgacaaatcataattcaaaagtatttacagaagatgatattaaagaaaaactagaaagtttaaaaggtactttagaatatctaccaccaaaatacagtgcaaaaaagatagatggtcaaagagcttataatctagctcgtgagggtatagagtttgatatgaagaaaatcacttcgcaagtatttgatgtgaagtttatcaactactctcatccttttataacatttgatataactgtaagtgaaggaagctatataagaagtatggctcaaattcttttagagagacttggggaggtgggaactttatcttatcttgaaagattgcacgaggggcagttttattttgataatgaaaaagctttaaaccctttggagtatttggacttacctttgaatatttacacaggtacaaaagagtggtttgacttgggtaaaaaactaaacatcgagtattttgagcaaaaagaggatggggaatatctgattgtttttgataccttttttgcggttattggtatagaaaataatgaaccaaaatatatcttaaataaggtacttttatga

SEQ ID NO: 7392 - protein, 188 aa, Unknown
  Obtained from environmental sample
  DOMAIN (6)...(86): TruB family pseudouridylate synthase (N terminal domain)
  misc_feature (1)..(188): Xaa is any amino acid
MTNHNSKVFTEDDIKEKLESLKGTLEYLPPKYSAKKIDGQRAYNLAREGIEFDMKKITSQVFDVKFINYSHPFITFDITVSEGSYIRSMAQILLERLGEVGTLSYLERLHEGQFYFDNEKALNPLEYLDLPLNIYTGTKEWFDLGKKLNIEYFEQKEDGEYLIVFDTFFAVIGIENNEPKYILNKVLL

SEQ ID NO: 7393 - DNA, 369 bp, Unknown
  Obtained from environmental sample
  misc_feature (1)..(369): n is a, c, g, or t
atgatagaaaaaaaatcttatgcgaaagtaaatatctttttaaaaatagctggtaagagagacaactatcacgagatagtatcaagatttgtacgagtgcatagtctttatgatgttgtacgatttgaaaaaggtgagtttgataaatttactttagagggtgtttttggttgtgagacagaaaaaaacactatttataaagcatacttagaattatacagtatgtttaagaatatagaagaaatatttaaggattttaaaggtgtagtagagaagaaatataccaaatttgcaggtcttggtgggggaattaataactgggcaatttttatgctcagggtaaatatacttgggaacttaaaaacttaa

SEQ ID NO: 7394 - protein, 122 aa, Unknown
  Obtained from environmental sample
  misc_feature (1)..(122): Xaa is any amino acid
MIEKKSYAKVNIFLKIAGKRDNYHEIVSRFVRVHSLYDVVRFEKGEFDKFTLEGVFGCETEKNTIYKAYLELYSMFKNIEEIFKDFKGVVEKKYTKFAGLGGGINNWAIFMLRVNILGNLKT

SEQ ID NO: 7395 - DNA, 597 bp, Unknown
  Obtained from environmental sample
  misc_feature (1)..(597): n is a, c, g, or t
atgcaaaaccagagagttgatgaaattgtcttacagattaaaaatctagaagatgaactgatagagacgctaaaagagaaagagagtgagtttttctataaaatagaaaatgagaagattaaatttgaaaaaagagtcatagctgagggtcgatcaaaaattatcagctcaattaaatatttgtcatctttttctgttttagcaatcttaacaatcccttttatttgggccatgattataccgattatgtttgctgatattttagtaaccatctaccaaagcatctgttttcccatctacaaaataccaaaagtcaaacgaagtgaatatgttattttggatagatataacctattttatctagatcaagttgagaagacaaactgcctatattgtgaatattttaatggtgttattgcatatgtaagagaggtagctgcgagaacagagcagttttggtgtcctataaaacactctaaacctctaaaagacaaacactccagatatgataacttttttgattttggagactaccttaaatacagagatgagttagagaaaaaaagatctaattttaaagatttgcaagagaagtag

SEQ ID NO: 7396 - protein, 198 aa, Unknown
  Obtained from environmental sample
  misc_feature (1)..(198): Xaa is any amino acid
MQNQRVDEIVLQIKNLEDELIETLKEKESEFFYKIENEKIKFEKRVIAEGRSKIISSIKYLSSFSVLAILTIPFIWAMIIPIMFADILVTIYQSICFPIYKIPKVKRSEYVILDRYNLFYLDQVEKTNCLYCEYFNGVIAYVREVAARTEQFWCPIKHSKPLKDKHSRYDNFFDFGDYLKYRDELEKKRSNFKDLQEK

SEQ ID NO: 7397 - DNA, 900 bp, Unknown
  Obtained from environmental sample
  misc_feature (1)..(900): n is a, c, g, or t
ttgcagatgtccttaaactttaaaaatagtattggtaaacgaataatgaggagcccaatgtttatagttaaagcaagtatatattctgtttatacacttacattcattaatctaatcttacaggtagttgtatatggtatttatgtaacatctgtttacattagagatctccttttgatttcaataaccgttagacctgaatggatggtattcggaacttatcttaaatcagcatttataaggcttgatttggggccaataaaggtatttatatcatctgcaaatttcagggataaagaagggtcttgcggtataatccgttttcccgggatttcagaatgtagaattatcaagtcagaacggataaagaaacttcagtcagtaattattaaaaaactcttaggctcatggtttggaatagtctgcagtagggatgatttgaaagtactctcaagctatggaaacacaggatggcttacacgtaatctactcctggcatcaggaatcaggaaaaagagtgaagtgattattgatagagacagcagaagaaaagtccagacagttttcaagccctttgtcagcagtcttgccctctacctaaaacttgaggatgggataagaaatggcggggcagaaattccggaaataagttttgtaggaaaaataggatgtctatttaagcgaagcagtactaatggggtagtaacaaaaaatatgtatcccaattctatagaggtacagattttaaaaataaaaaaagagaatattctttactacaagcttgaagctgtaagacagataaaaacgaatagtgaatacatgggctttgagaaatatcttaagacacagtccttaatatggaaggaaggatccacaacagggaaaacacagagatgctga

SEQ ID NO: 7398 - protein, 299 aa, Unknown
  Obtained from environmental sample
  misc_feature (1)..(299): Xaa is any amino acid
MQMSLNFKNSIGKRIMRSPMFIVKASIYSVYTLTFINLILQVVVYGIYVTSVYIRDLLLISITVRPEWMVFGTYLKSAFIRLDLGPIKVFISSANFRDKEGSCGIIRFPGISECRIIKSERIKKLQSVIIKKLLGSWFGIVCSRDDLKVLSSYGNTGWLTRNLLLASGIRKKSEVIIDRDSRRKVQTVFKPFVSSLALYLKLEDGIRNGGAEIPEISFVGKIGCLFKRSSTNGVVTKNMYPNSIEVQILKIKKENILYYKLEAVRQIKTNSEYMGFEKYLKTQSLIWKEGSTTGKTQRC

SEQ ID NO: 7399 - DNA, 603 bp, Unknown
  Obtained from environmental sample
  misc_feature (1)..(603): n is a, c, g, or t
atgacatatgaagttttagcaagaaaatggagaccgcaaaggtttgaagatgttgtagggcaggagcatgtaaccaaaacattgctaaatgctgttaatacagacaggattgcacacgcctatctttttgttgggtcgcgtggtattggtaagacttctattgcaagaatttttgcaaagacattaaattgtcaagccactgaaggaccaaagccttgttgtaaatgtgactcatgtaaagagattgcggaaggtaacagtttagatgtgtacgaaattgatggtgcatcaaacaatggagtagagcaggttagagagttacgagagaccgtggtttacgcaccttctcgtggtccatataagatttatatcattgatgaagttcataagctcagcgcaggggcttttaatggcactcctaaaaacattggaaagaccctcccccgcatggggaggtttattgtttgcaaccacctgaaacctgaaaaaaattcctcccacacaatttatttccccgtttggccagcgaattttgaattggcgggtagaaaatgtcaacctcccaaaaaattttgtggaacgaaatttacacggtttgaatag

SEQ ID NO: 7400 - protein, 200 aa, Unknown
  Obtained from environmental sample
  misc_feature (1)..(200): Xaa is any amino acid
MTYEVLARKWRPQRFEDVVGQEHVTKTLLNAVNTDRIAHAYLFVGSRGIGKTSIARIFAKTLNCQATEGPKPCCKCDSCKEIAEGNSLDVYEIDGASNNGVEQVRELRETVVYAPSRGPYKIYIIDEVHKLSAGAFNGTPKNIGKTLPRMGRFIVCNHLKPEKNSSHTIYFPVWPANFELAGRKCQPPKKFCGTKFTRFE

SEQ ID NO: 7401 - DNA, 705 bp, Unknown
  Obtained from environmental sample
  misc_feature (1)..(705): n is a, c, g, or t
atgaaatttaccatatcgaaaagtatcattgaaaatataatatcttcaatgcaaccatttctaaataaaaaagattctagttctattacatctcatatatatctagaaatattaaatgcaaatttaattataaaatctacagattatgagatgggttgtgaagcaattgtatctgatataaaaaatatcatagatggaaaagctacaattaatggtggaaattttttaaatattataagaagattaaaagatgaagatattgattttgaagtatcagggaataatttaaatattaaacaaaaaagatctaattttaaacttcctatgtatgatgcaaatgaatatccatcttttccaaagttagaaaatttacattcattagaaataaatacaattaatttaataaatagtattaaaaaaataacaccttcaatagataacaataaccctaaatttgaattaaatggtgcattaatagatataaaatcacaaaaaataaattttgttgcaacagatacacgtagattagcaatatctaatttagaaaatatatcaaataaagaatctcaaataataataccaaaaaaagctattattgaaatacaaaaactttttttagatgaagcaagtattaaatatgatgatacaaatttagtagtatcaaacaacaattatacactcagccgatctgtcttggctnnntaa

SEQ ID NO: 7402 - protein, 234 aa, Unknown
  Obtained from environmental sample
  DOMAIN (128)...(232): DNA polymerase III beta subunit, central domain
  misc_feature (1)..(234): Xaa is any amino acid
MKFTISKSIIENIISSMQPFLNKKDSSSITSHIYLEILNANLIIKSTDYEMGCEAIVSDIKNIIDGKATINGGNFLNIIRRLKDEDIDFEVSGNNLNIKQKRSNFKLPMYDANEYPSFPKLENLHSLEINTINLINSIKKITPSIDNNNPKFELNGALIDIKSQKINFVATDTRRLAISNLENISNKESQIIIPKKAIIEIQKLFLDEASIKYDDTNLVVSNNNYTLSRSVLAX

SEQ ID NO: 7403 - DNA, 408 bp, Unknown
  Obtained from environmental sample
  misc_feature (1)..(408): n is a, c, g, or t
atgcttaaacaacatgaggattctggcgtttcttgtactgttttaacagcttttatggatgatcctctagcctatggccggattattagaaaggctgatggaaatgtagatagaattgttgaattcaaggatgctactgatgctgagaagtctgttaaggagataaatacaggaatctattgttataataacaaagatcttttcgaagcattgaatgaagtcggaaacaataataatcaaggtgaatattatcttaccgatacattagagatactgaatcgcaaaggtaagattgtgaaatccattgtattggaagatatgattgaagcatctggagttaacagcagagaacaattagcatatctggaaacaaaatacatggcaaataaaactcattttgataattag

SEQ ID NO: 7404 - protein, 135 aa, Unknown
  Obtained from environmental sample
  misc_feature (1)..(135): Xaa is any amino acid
MLKQHEDSGVSCTVLTAFMDDPLAYGRIIRKADGNVDRIVEFKDATDAEKSVKEINTGIYCYNNKDLFEALNEVGNNNNQGEYYLTDTLEILNRKGKIVKSIVLEDMIEASGVNSREQLAYLETKYMANKTHFDN

SEQ ID NO: 7405 - DNA, 585 bp, Unknown
  Obtained from environmental sample
  misc_feature (1)..(585): n is a, c, g, or t
ttgcaaaatgagaaatcaaatcagaaaatcaataagttgtccgataaactaaatgatgaagtcttatcgaatgctaaaacaaattatttatttaagaaaacagacaaaatgtatacaattgtttttaatggtaggaagtgtatttatcacgaggctaaggggatggactatatagcatttttattgcacaatccgagaaaattagtgagttacgctgatttggccggtacacaaataaaaccgaagaatgcatacaatggtcaaaaactaatggatagtaatttttctaatgatataaggaaagaaattctcaggctaaaagagcgtaaggctaatagtatgcatgaggatcaaactgacttgaacaatgaaatattaacattggaaaagactctaaaaaataataagggtaaagtaaaatcaaaggaatatgataagattagaaaacaagtacaaaataacctatctagagcattgaagaaatttaatggaacaatggatgagctaaagacgtacctggaaaaaaatataaaaataaagaagggattaatatatgatcctgaagagnanattgactggagttag

SEQ ID NO: 7406 - protein, 194 aa, Unknown
  Obtained from environmental sample
  misc_feature (1)..(194): Xaa is any amino acid
MQNEKSNQKINKLSDKLNDEVLSNAKTNYLFKKTDKMYTIVFNGRKCIYHEAKGMDYIAFLLHNPRKLVSYADLAGTQIKPKNAYNGQKLMDSNFSNDIRKEILRLKERKANSMHEDQTDLNNEILTLEKTLKNNKGKVKSKEYDKIRKQVQNNLSRALKKFNGTMDELKTYLEKNIKIKKGLIYDPEEXIDWS

SEQ ID NO: 7407 - DNA, 366 bp, Unknown
  Obtained from environmental sample
  misc_feature (1)..(366): n is a, c, g, or t
atgaaaatcgcatttgcatcaaaagataatattcatgtaaaccaacattttggttggtgtgagatgttttatatttatgaaatttctgaagacgattatgaacttgttagtgaagttgactcttcattgaagtttgatgatgagatagataaattagagtataaaatcaattgtcttgaagatagtgatatagtttatgtatcacaaatagggcccaaagctgccaatatggtacaaaagtgtggtatctatccnatgaagtcatctcatgaggctgagagaatagaagatgtgataaaatcattacaaaagatgatgcaagatagtgctccactttggttaaaaagaatacttttaaaaaaataa

SEQ ID NO: 7408 - protein, 121 aa, Unknown
  Obtained from environmental sample
  DOMAIN (9)...(104): Dinitrogenase iron-molybdenum cofactor
  misc_feature (1)..(121): Xaa is any amino acid
MKIAFASKDNIHVNQHFGWCEMFYIYEISEDDYELVSEVDSSLKFDDEIDKLEYKINCLEDSDIVYVSQIGPKAANMVQKCGIYPMKSSHEAERIEDVIKSLQKMMQDSAPLWLKRILLKK

SEQ ID NO: 7409 - DNA, 777 bp, Unknown
  Obtained from environmental sample
  misc_feature (1)..(777): n is a, c, g, or t
atgttatttgtcgattttcaggctatcttgtatataatgtatgttcaattacagagggtagctatgcaacatttagacattccaattaatcattatgacagtgataaattaaaatttaaaccatttgcaaaaaaagttgctacaagtatattaaattataatcaaaatgagactttgatattttcgattgaaggaaggtggggaagtggtaaaacatcattaataaacctaatagaaaatgaaataaaaggtaatgttgaagtattacattttaatccttggttattaacagatattagtcaagttattaaacttttttttgatgaacttataaaaatattatcatatggttcgtttaaagtaaaattaaatgaagatatcaaaaaagatttaaaaaatttagcaaatattttgttacctgaaagcatgacaataaaggtgtcttttatgaatataggctataagccaaaagatgttttattatcaagtagtgaagatagtttaaaaaaaatcaaattgaaaattaataaatatttaaaaaacttagataaaaagatagttatagttattgatgacatagatagactgacagacaatgagacagaatttatttttagactcacaaaaggtatagctgattttgataatttgatttatatcttattgtatgacanaacaattgtatctaaatcgcttcaaacatttaaacaagaaaatggagaaaaatatcttgaaaaaatagtacagtactctttatctgtaccaaaaccacaataa

SEQ ID NO: 7410 - protein, 258 aa, Unknown
  Obtained from environmental sample
  DOMAIN (39)...(258): KAP family P-loop domain
  misc_feature (1)..(258): Xaa is any amino acid
MLFVDFQAILYIMYVQLQRVAMQHLDIPINHYDSDKLKFKPFAKKVATSILNYNQNETLIFSIEGRWGSGKTSLINLIENEIKGNVEVLHFNPWLLTDISQVIKLFFDELIKILSYGSFKVKLNEDIKKDLKNLANILLPESMTIKVSFMNIGYKPKDVLLSSSEDSLKKIKLKINKYLKNLDKKIVIVIDDIDRLTDNETEFIFRLTKGIADFDNLIYILLYDXTIVSKSLQTFKQENGEKYLEKIVQYSLSVPKPQ

SEQ ID NO: 7411 - DNA, 750 bp, Unknown
  Obtained from environmental sample
  misc_feature (1)..(750): n is a, c, g, or t
atgcttagtaaaattggtagattggataatgatgctaaaaaggaattagctgagattgtacaatcaatttacaaatcactggataacaacaaaaaagcaaaggcagagaaagatttaatcaaattatcatcgactcctaattacttcataagagagtttgtgggaaaggatcttgtaaaatatgcagatcaagatgtgattttttcaatatctgagaacatgatcaagcaccgtatttatggtgttagagcaactgctctattctattttttcacctattacagagatgaaccagagaagttgattgatatcttggaagaatcatttgaggctgttccgtgggaatcagaaagtattgtgaatgatctctggaaacgttatcctgagcttatgaaagagcgaatgagttcttgggttgattctaaaaattctaagaaaagagcattatctttccatggaatggaaaacatagctcattctgatcctggatttattatgcacttcatagggaaggcaatagatgatgataccatggaagttcagaagaaaataactcatattctcactcaggttgcaagagcaaacccgattatagtttttccatatattcgtgaatggctctctgaagctactgaaaaaagagtggaaactatttgggtttctatgaagaaattggcaaacattggagttcaaaaaaaccgtagagagcgttcccatgaatttgttatgtttaccccgcagacaatttag

SEQ ID NO: 7412 - protein, 249 aa, Unknown
  Obtained from environmental sample
  misc_feature (1)..(249): Xaa is any amino acid
MLSKIGRLDNDAKKELAEIVQSIYKSLDNNKKAKAEKDLIKLSSTPNYFIREFVGKDLVKYADQDVIFSISENMIKHRIYGVRATALFYFFTYYRDEPEKLIDILEESFEAVPWESESIVNDLWKRYPELMKERMSSWVDSKNSKKRALSFHGMENIAHSDPGFIMHFIGKAIDDDTMEVQKKITHILTQVARANPIIVFPYIREWLSEATEKRVETIWVSMKKLANIGVQKNRRERSHEFVMFTPQTI

SEQ ID NO: 7413 - DNA, 591 bp, Unknown
  Obtained from environmental sample
  misc_feature (1)..(591): n is a, c, g, or t
atgggaaaaattatatatacaattaccctactatttatagtactttttagtggatgtagtgtcaaaaatgcagatgaaacagttattacagttaacgggaaagatgggttgttaaaagataacggtgaagtttcaatcaaacctatttataaaaaaatcaatagatttgaaggtactcaatcaaagtatcctcatcctaattatcttaatattcactggactgaaaatcaatggggaaaaacctatgcgattgttgaaaatatagatggtaagtatggtattatcaataaaaatgggaaactattgttaaaagttgtttatgattctattggaagattttataatggatatgcaaagattgaagttaataataaatttggtttaattaatgaaaattttgaagttgtagtaaaacctatctatgatgaagctttggagtttgtttataattctattattgtgaaaaaatttgggaaatatggatgtatcaacaaaaacttagagcttaaaatcgcaccagaaatggatatgatctatttacaacaagagggattaaaagatttgaaccaaacaacaaatggggatttttaa

SEQ ID NO: 7414 - protein, 196 aa, Unknown
  Obtained from environmental sample
  misc_feature (1)..(196): Xaa is any amino acid
MGKIIYTITLLFIVLFSGCSVKNADETVITVNGKDGLLKDNGEVSIKPIYKKINRFEGTQSKYPHPNYLNIHWTENQWGKTYAIVENIDGKYGIINKNGKLLLKVVYDSIGRFYNGYAKIEVNNKFGLINENFEVVVKPIYDEALEFVYNSIIVKKFGKYGCINKNLELKIAPEMDMIYLQQEGLKDLNQTTNGDF

SEQ ID NO: 7415 - DNA, 753 bp, Unknown
  Obtained from environmental sample
  misc_feature (1)..(753): n is a, c, g, or t
atggacaaacaactcattttcaattttaaaacggatatatctaggatcaatatcaacacaaaactcaacaatccatttgctgcatctattcctgaaattgccatagtagcgacaacagaatttcaagaacatattgccaccgaatctaagaagtggaatcatgactttcatattcagaaaggtaaaatgtttggaattctggtgattcaaaaagaagactatacttatggttatttaggaacatactcaggtaaatttcctaaaaacataaaagaccacaaattcgttccttccgtctttgatgattctgttggtgattttttcattaataaaggcatgactgagctgagtgaaattggcagtcaaattaaaaattccgatagtccatctgaaatcacatcactaatagaaacaagaaaacaaaaatcgatttccttgcaacaacggctttttgagaattataattttctgaatctttcaggaaaggagaaaagtctattggaaatcttcaagagttcatctcatgggaaacccccagtagcagctggtgaatgtgcagcccctaaactgctgcaatatgccattgaacatcaattaaagcccatcgctttatctgagttttggtggggaaaatcgattaagaataaagaaagagaacacagggcattctacccagcctgcaaagatagatgtcgtccaattttagaatacatgctagaagatacggaattgtttaacagacgtgcacaataa

SEQ ID NO: 7416 - protein, 250 aa, Unknown
  Obtained from environmental sample
  misc_feature (1)..(250): Xaa is any amino acid
MDKQLIFNFKTDISRININTKLNNPFAASIPEIAIVATTEFQEHIATESKKWNHDFHIQKGKMFGILVIQKEDYTYGYLGTYSGKFPKNIKDHKFVPSVFDDSVGDFFINKGMTELSEIGSQIKNSDSPSEITSLIETRKQKSISLQQRLFENYNFLNLSGKEKSLLEIFKSSSHGKPPVAAGECAAPKLLQYAIEHQLKPIALSEFWWGKSIKNKEREHRAFYPACKDRCRPILEYMLEDTELFNRRAQ

SEQ ID NO: 7417 - DNA, 405 bp, Unknown
  Obtained from environmental sample
  misc_feature (1)..(405): n is a, c, g, or t
ttgtctaaaatctcagatgcatctagcaagagcttaaatgaatttattattaagaatattgacaagtcatctgaaataattactgacggttggaaaggatataatggaataacaaaaataggctattcacatgtaatacatgagtcattgatcaaaaaaagtgataatgaagaaatattgcctaacgtacatagagtagcctcattattaaaaagatggttgcttgggactcatcaaagttatctaaacaaaaataagttagaatactatctggatgaatatgtatttagatataacagacgaacagcaaagagtagagggctgttgttcttgagattaattgagcaggcagtcgtaacaaaccctgtttcatacaaagagattattctacgaagtcacgggtaa

SEQ ID NO: 7418 - protein, 134 aa, Unknown
  Obtained from environmental sample
  misc_feature (1)..(134): Xaa is any amino acid
MSKISDASSKSLNEFIIKNIDKSSEIITDGWKGYNGITKIGYSHVIHESLIKKSDNEEILPNVHRVASLLKRWLLGTHQSYLNKNKLEYYLDEYVFRYNRRTAKSRGLLFLRLIEQAVVTNPVSYKEIILRSHG

SEQ ID NO: 7419 - DNA, 756 bp, Unknown
  Obtained from environmental sample
  misc_feature (1)..(756): n is a, c, g, or t
atggagcatttaattaaagaccaacaacttacgtttaaggatttttctacagatcaagatgttagatggtgtccgggttgtggagattatgctattttgagtgctatgcaaaaagccttgcctcaaataggaaaagagaaaaaagatattgtttttatttctggaataggctgttcatctcgtttcccatattatgtagaaacgtatggctttcattctattcacggtagagcacctgcaattgctacaggtgttaagctaggaaaccctagtttgagtgtttggcaaattacaggagatggagatgctttagctattggtggaaatcattacatacatgtgttaagaagaaatgtagatatcaatatgattctttttaataacgaaatttatgggctaaccaaaggacaattttctccgacatctaaaacaggtattcaaactaagtcatctccacacggtacggtggataaagcttttaatccaggaaaattagctataggagctggagcaactttttttgcaagggtagtagatgtagatccgaaaaaaatggttgatgtttttgttgaagcagaaaaacatagaggaacatccttagttgaaatattacaaaattgtgttatttttaatgataaagtgttttctgctataactgataaagaagtaaaattagataatcagttatgggtggaacatggtaagccaatgatttttggtaaagaaaataacaaagggattcgtttaaatggataa

SEQ ID NO: 7420 - protein, 251 aa, Unknown
  Obtained from environmental sample
  DOMAIN (22)...(210): Thiamine pyrophosphate enzyme, C-terminal TPP binding domain
  misc_feature (1)..(251): Xaa is any amino acid
MEHLIKDQQLTFKDFSTDQDVRWCPGCGDYAILSAMQKALPQIGKEKKDIVFISGIGCSSRFPYYVETYGFHSIHGRAPAIATGVKLGNPSLSVWQITGDGDALAIGGNHYIHVLRRNVDINMILFNNEIYGLTKGQFSPTSKTGIQTKSSPHGTVDKAFNPGKLAIGAGATFFARVVDVDPKKMVDVFVEAEKHRGTSLVEILQNCVIFNDKVFSAITDKEVKLDNQLWVEHGKPMIFGKENNKGIRLNG

SEQ ID NO: 7421 - DNA, 390 bp, Unknown
  Obtained from environmental sample
  misc_feature (1)..(390): n is a, c, g, or t
gtgtctatttntgctatacaatctttagttggtggattcctagatgaggatttaaatcatttcaataaaattttcgatgattggtgtgttcaatttgagagttatgatgatgctatgattatattacaaactcttgaaaatcaaaaatctatggttgttgttgaaataacaccattgagttatccaaaatatttttttccatctttacaaggtactgtttatttaacacgacagattaaagataaaattatatgttccgtagaaccatttatgggagctagctttaaaattgctatttgtgatcttaaaacaaaaaaagtaagatttacaaaaacaaactataaaaatatctctagtgttgaagctgcttttagtaattttagtgaataa

SEQ ID NO: 7422 - protein, 129 aa, Unknown
  Obtained from environmental sample
  misc_feature (1)..(129): Xaa is any amino acid
MSIXAIQSLVGGFLDEDLNHFNKIFDDWCVQFESYDDAMIILQTLENQKSMVVVEITPLSYPKYFFPSLQGTVYLTRQIKDKIICSVEPFMGASFKIAICDLKTKKVRFTKTNYKNISSVEAAFSNFSE

SEQ ID NO: 7423 - DNA, 798 bp, Unknown
  Obtained from environmental sample
  misc_feature (1)..(798): n is a, c, g, or t
gtgaaacgtgctttaaaagtagggattaaaccatataagattattttttctggtgtgggaaaaattgatgatgagattagagaggctttagagttaaatatcttaatgataaatgttgagagtgaagcagaacttcatagggttgagattatagcaaaagagttaaataaagaggctagaatttctgtaagagttaatccaaatattgacccacaaacgcacccttatatttcaactggattacatgaaaacaaatttggtgtagatattgatacagctaaaagaatgtatatcaaatgtaaaaactctgaacatcttgatgctgttgggattcactgtcatataggttctcaacttacacaattagagccaataaaagagtctattaaaatagttgctgatttagtaagaaatttaaaagctatcaatatggagatatcattttttgatattggtggaggtcttgggattgtttatgacaatgaaatacttattgatacaaaagagtatgcccaatctgtattggaaaatctatttggattagatataacagttgtttgtgagcctggaagatttttagtaggaaactgtggaacatttgtaacaaaagttttatatgaaaaaatcaatggaagtaaaagatttgtaatcgttgatggggctatgaatgatttaattagaccatctttatatgatgcatatcacaaaattgaagttattggaaaaagtgaaaatgctagtgaatgtaatttagtaggtcctgtttgtgaaagntggagacttttttgcaaaaaatag

SEQ ID NO: 7424 - protein, 265 aa, Unknown
  Obtained from environmental sample
  DOMAIN (199)...(265): Pyridoxal-dependent decarboxylase, C-terminal sheet domain
  misc_feature (1)..(265): Xaa is any amino acid
MKRALKVGIKPYKIIFSGVGKIDDEIREALELNILMINVESEAELHRVEIIAKELNKEARISVRVNPNIDPQTHPYISTGLHENKFGVDIDTAKRMYIKCKNSEHLDAVGIHCHIGSQLTQLEPIKESIKIVADLVRNLKAINMEISFFDIGGGLGIVYDNEILIDTKEYAQSVLENLFGLDITVVCEPGRFLVGNCGTFVTKVLYEKINGSKRFVIVDGAMNDLIRPSLYDAYHKIEVIGKSENASECNLVGPVCEXWRLFCKK

SEQ ID NO: 7425 - DNA, 876 bp, Unknown
  Obtained from environmental sample
  misc_feature (1)..(876): n is a, c, g, or t
atgccagatataaaagatattgatggttttatagttcaaagtttaggaacttcaactcaaaccaatataattaatggtgtacgaagtgataaactaatcaaaaattatacttttagaccaacaaaagatataacaataccttcttttgaaataactgtgaatggaaaaatagaaaaaacacaaccacaaaaaataagtatgcaaaaagtggaaaaaacagtctcagctgattatgacttaactatacaagtagataaaaaagaggtttatgtgggggagagtatccatttaactcttttgtttaaatataaaaaagatcttaatattattggattagagtttgaaaagcccaagtttgaaagtttttgggttaaagagttaaaatcaaatgaaaatctaccaatagataatcaatatacctttcaaaagttagaatatatcctcttcccacaaaaaagtggaaagctagaaataggacctttaaaaattgaagcagttactactcaaaatagatacaacaccggtttttttgtaacagcaccaactaaaagaacaaaagtgtattcaaataaaattgaactagatgtgaaaccaataccacaaaatgtaaaactaataggtgatttttctatagatgctacaattgataaaaatagtgtaaaagagggggaagctgtatcttataaaataactataaatggtcgtggaaatgttgatgatatcgatgaggtaaaaattaatattccnaaatgcactgtgtatgaaaatccttctgaaaaaaatatgatattcaaaataatatttacggggggagtatataccaaaagctttctcaatagtttcctacaaaagcttttcacaaatcctgaaaattaa

SEQ ID NO: 7426 - protein, 291 aa, Unknown
  Obtained from environmental sample
  misc_feature (1)..(291): Xaa is any amino acid
MPDIKDIDGFIVQSLGTSTQTNIINGVRSDKLIKNYTFRPTKDITIPSFEITVNGKIEKTQPQKISMQKVEKTVSADYDLTIQVDKKEVYVGESIHLTLLFKYKKDLNIIGLEFEKPKFESFWVKELKSNENLPIDNQYTFQKLEYILFPQKSGKLEIGPLKIEAVTTQNRYNTGFFVTAPTKRTKVYSNKIELDVKPIPQNVKLIGDFSIDATIDKNSVKEGEAVSYKITINGRGNVDDIDEVKINIPKCTVYENPSEKNMIFKIIFTGGVYTKSFLNSFLQKLFTNPEN

SEQ ID NO: 7427 - DNA, 837 bp, Unknown
  Obtained from environmental sample
  misc_feature (1)..(837): n is a, c, g, or t
ttgatagatatttattttacagttaataatagattccttaatgattttttggtattatatcaaattaaatttttaactcttattttaaaaggaatttatataaaaaatcaaattacaagtatcgcaataggtggttttgatggtatgcatatggcacatcaacagcttttttcaaaactagataagaatggtgcgattgtagtaatatctactcaatatgctaatttatcacccgatacacatagggctaaacataccacctatccacttttttactatcctttggaaaatattaaacacttaagcggcgaagagtttataaagttattatatgaagagtttccaaatttaaaaaaaatagtagtgggatatgactttcattttggacatcaagcaaaatctaatattgagaatttaaaaaagatatttaaaggtgttgtagttgtagttgatgagtataaggtttcaaatattgcagtacattcaagagttataagagagtatttaagagatggtaatatagaagttgcacaaaaacttttaggttatgactatagcttacaaggaaatcctattagaggacaaggattaggttcaaagcagtttgttccaacaataaatattgatgtagaagattttttaataccacaagagggtatttatgttactaaaactattttaaatcataactcttacaaatcagtttcttttataggacatagagcttctactgatgggaagttcgctgtagagacacatattttagaagatatctcatccctagagatccccaaaaaggtgaagatgtatttttttaaaaatttaggagaaaaataa

SEQ ID NO: 7428 - protein, 278 aa, Unknown
  Obtained from environmental sample
  DOMAIN (180)...(273): Riboflavin kinase / FAD synthetase
  misc_feature (1)..(278): Xaa is any amino acid
MIDIYFTVNNRFLNDFLVLYQIKFLTLILKGIYIKNQITSIAIGGFDGMHMAHQQLFSKLDKNGAIVVISTQYANLSPDTHRAKHTTYPLFYYPLENIKHLSGEEFIKLLYEEFPNLKKIVVGYDFHFGHQAKSNIENLKKIFKGVVVVVDEYKVSNIAVHSRVIREYLRDGNIEVAQKLLGYDYSLQGNPIRGQGLGSKQFVPTINIDVEDFLIPQEGIYVTKTILNHNSYKSVSFIGHRASTDGKFAVETHILEDISSLEIPKKVKMYFFKNLGEK

SEQ ID NO: 7429 - DNA, 468 bp, Unknown
  Obtained from environmental sample
  misc_feature (1)..(468): n is a, c, g, or t
ttgaatgaactcaaaggctcaaaagggacggttattatgtttatctgtaatcattgtccgttcgtgattcatatcaattccgaattggtaaaaatggcaaattcatatcttaaaaaaggcattcaatgtatcgcaatttccagtaatgatgtggttaattatccgcaagatgggccaaataaaatgaaaattcatgcagacactgagcactatccgtttccttatttatacgacgaaactcaggaagttgccaaagcttatgatgcggcttgtacaccagatttatatctttttgacgctgacttaaaattaatataccgaggccagttggatgattctcgtccaggaaatggcatacccgttacaggtcatgacttgagacatgccatagattgtttaattgaaggtaaagaaaatacttctccgcaaaaaccaagtattggttgtaatattaaatggaaacagtaa

SEQ ID NO: 7430 - protein, 155 aa, Unknown
  Obtained from environmental sample
  misc_feature (1)..(155): Xaa is any amino acid
MNELKGSKGTVIMFICNHCPFVIHINSELVKMANSYLKKGIQCIAISSNDVVNYPQDGPNKMKIHADTEHYPFPYLYDETQEVAKAYDAACTPDLYLFDADLKLIYRGQLDDSRPGNGIPVTGHDLRHAIDCLIEGKENTSPQKPSIGCNIKWKQ

SEQ ID NO: 7431 - DNA, 435 bp, Unknown
  Obtained from environmental sample
  misc_feature (1)..(435): n is a, c, g, or t
ttggttatctatcttaaaatcattaatgagttgttgaaaattagtgataacagcagatactatgcaaagagaatgaaagattttctaattaatgagtctgatatatattatgaagatgcgactattattaagatgcaaaaaacagtaattaaatcactgaattatctttacaaatgtatctcaaatacaaattgtgatgtagataacacatatgtaaaagttctctcagaagatagtaagattgatgatctctactctgttttagaaaaaaatattttaaataaagttgttcatgatagagatatttcaatggaatatgtaaatattataggaacgcttcataaatttgagagaatctctgagcgttgtgtagagattgcgaacttactctgttttgcaaaagatggtaaagcgagtgagatatataagagctaa

SEQ ID NO: 7432 - protein, 144 aa, Unknown
  Obtained from environmental sample
  misc_feature (1)..(144): Xaa is any amino acid
MVIYLKIINELLKISDNSRYYAKRMKDFLINESDIYYEDATIIKMQKTVIKSLNYLYKCISNTNCDVDNTYVKVLSEDSKIDDLYSVLEKNILNKVVHDRDISMEYVNIIGTLHKFERISERCVEIANLLCFAKDGKASEIYKS

SEQ ID NO: 7433 - DNA, 393 bp, Unknown
  Obtained from environmental sample
  misc_feature (1)..(393): n is a, c, g, or t
gtgattgataagtcgattccctaccagatcttatatcggtttatttacaaagaggatattgcctttggaataactttaaaaaataacaacaaagttgaaaactactatttttctgaatggaatgaaagtatcgattttgattttacaggaataactcttgaaaaagtctatcagaagatagttaaggcttttattaaaaatgatgtattgagtgaaagaccatttgatgaattgataaatcgggacagcaggataaaggctttggaaaaggaacttgcccagctgttaattaaaatgaagaatgaaaagcagtttaatcgacagattgaaatccataaggttttgctggagaaagaagcagagctgaaacagattagagaggatgggaattaa

SEQ ID NO: 7434 - protein, 130 aa, Unknown
  Obtained from environmental sample
  misc_feature (1)..(130): Xaa is any amino acid
MIDKSIPYQILYRFIYKEDIAFGITLKNNNKVENYYFSEWNESIDFDFTGITLEKVYQKIVKAFIKNDVLSERPFDELINRDSRIKALEKELAQLLIKMKNEKQFNRQIEIHKVLLEKEAELKQIREDGN

SEQ ID NO: 7435 - DNA, 474 bp, Unknown
  Obtained from environmental sample
  misc_feature (1)..(474): n is a, c, g, or t
atggataaactgaacatgcagacaccgaatttgtcatataaatatgctgtttctactaattccctggatataaataataaaatatttgtttttcgtgatctgcaggtaatggttgataaagatttagcagaactttatggagtagaaactaaaagattaaatcaggctgttaagagaaatcttgaaagatttccagaagaatttcgctttcaactgacaaaggaagaaaaagatgaactggtcacaaattgtgaccggttcgagaatctgaaacactcaagttcacccccctatgtttttactgaacagggggttgccatgctttcagctgttttacatagtaagacagctattgatataagcattaagataatgaaagcttttgttgagatgagaaagtttctgataaataacgtccaaattttcccaaaaataaacagcattgaattgacccggattaaacttttaaagaag

SEQ ID NO: 7436 - protein, 158 aa, Unknown
  Obtained from environmental sample
  misc_feature (1)..(158): Xaa is any amino acid
MDKLNMQTPNLSYKYAVSTNSLDINNKIFVFRDLQVMVDKDLAELYGVETKRLNQAVKRNLERFPEEFRFQLTKEEKDELVTNCDRFENLKHSSSPPYVFTEQGVAMLSAVLHSKTAIDISIKIMKAFVEMRKFLINNVQIFPKINSIELTRIKLLKK

SEQ ID NO: 7437 - DNA, 771 bp, Unknown
  Obtained from environmental sample
  misc_feature (1)..(771): n is a, c, g, or t
atgagtaaattacatgaacaaaaatgggaagcttgtcttaaagtcataaaagacaatattcctttgcaagcgtttaaaacttggttcagcccgattgttccagttaaattggaagatgaaattttaacaattcaggtaccctctcattttttctatgaatggttagaggaacactatataggtctacttaagaaagtaattaagaaagaattaggtgctaatggtcgattagagtacagcattattatggaaaaaaatgcgactaactctacaccatatacagttaaacttccaacttcaggcaagagttcattaaaaaattcacccgttacagttcctttaagcgtaaatgaaaatcaaattcgtaacccatttgtaattcctggcttaaagaaagtaaatgttgattcaaatctgaatccatcttattcctttgagaattttgttgaaggtgattgtaacagattagctagatcagcaggttatgcagtagcaaacaaaccaggtggaactgctttcaatcctttattgatttatggaggagttggtttaggtaaaacacatttagctcattcaattggaattggtataaaaaatcaatttcctaataaaactgtactttacgtaggctctgaaaagtttgcacatcaatttatagattcaataaaaaacggaacgacaaatgatttcattcatttttatcaaatgatggatgtactcattattgatgatgttcaggttttctcaggtaaagaaagacacaaaatgttt

SEQ ID NO: 7438 - protein, 257 aa, Unknown
  Obtained from environmental sample
  DOMAIN (139)...(256): Bacterial  dnaA  protein
  misc_feature (1)..(257): Xaa is any amino acid
MSKLHEQKWEACLKVIKDNIPLQAFKTWFSPIVPVKLEDEILTIQVPSHFFYEWLEEHYIGLLKKVIKKELGANGRLEYSIIMEKNATNSTPYTVKLPTSGKSSLKNSPVTVPLSVNENQIRNPFVIPGLKKVNVDSNLNPSYSFENFVEGDCNRLARSAGYAVANKPGGTAFNPLLIYGGVGLGKTHLAHSIGIGIKNQFPNKTVLYVGSEKFAHQFIDSIKNGTTNDFIHFYQMMDVLIIDDVQVFSGKERHKMF

SEQ ID NO: 7439 - DNA, 726 bp, Unknown
  Obtained from environmental sample
  misc_feature (1)..(726): n is a, c, g, or t
atgagggagggactccttattgatgatgtcaggtttttttcaggtaaagaaaagacacaagatgttttctcccatatttttaatcacttgcaccaaaacgggaagcaaatcattctaacatcagataagcctccagttgaaatgcaaggtatggagcagcgtctattaagtagattcaaatggggattatctgcagatctacagtctccagatttagaaactagaattgctattcttgaaaagaagatgtatggcaatggaatcgaattacctaatgaagtcgttgaatatctagcttatagtatcaatacaaatataagagagatggaaggtgctttaacgtctcttcttgctcaagcttcattaaataagaaagcaatcacattggatcttgctaaacaaatgattgacaaattcgtcaaaaatactgcacgagaagtatccattgagtacatacaaaaagttgtttgtgactattttgatttagcaattgaaatactgaaatcaaaaacacgtaagcgtgaagttgttcaggcacgtcaaattgcaatgtatttctctaaaaagatgacaaaatcatctctagcgaatattggagctcattgtggtggtaaagatcacgcaactgttctacatgcatgcagaacggttaacaatctatctgaaactgacaaacaatttaaaacataccttactgatttagagaagaaattatctatgcagtaa

SEQ ID NO: 7440 - protein, 241 aa, Unknown
  Obtained from environmental sample
  DOMAIN (1)...(217): Bacterial  dnaA  protein
  misc_feature (1)..(241): Xaa is any amino acid
MREGLLIDDVRFFSGKEKTQDVFSHIFNHLHQNGKQIILTSDKPPVEMQGMEQRLLSRFKWGLSADLQSPDLETRIAILEKKMYGNGIELPNEVVEYLAYSINTNIREMEGALTSLLAQASLNKKAITLDLAKQMIDKFVKNTAREVSIEYIQKVVCDYFDLAIEILKSKTRKREVVQARQIAMYFSKKMTKSSLANIGAHCGGKDHATVLHACRTVNNLSETDKQFKTYLTDLEKKLSMQ

SEQ ID NO: 7441 - DNA, 732 bp, Unknown
  Obtained from environmental sample
  misc_feature (1)..(732): n is a, c, g, or t
ttggtcgtaaacttgtcgcaaaagaaagagttgaattgttgtataatttgttttatgaaaaacaatcaaaaaatagttatcgtagaagatgatatctttgctcaagagtttttagctcaaacattaaatactcttggatacagcagtattttagtagtaagcaaagcagatgatgcgataaacttttgtaaaaaagaaaaaatagacattatatttatggatataaatattgaaggtactatggatggaatacagtgtgctagagagatatcactatattataatatacctattatatttacaactgcatatgcagatagtgttactatcgatgaagcaagctataccaacctatatggatatctcatcaaaccttttactcaaaaagaggtagaaatagctttgaaaataattcaaaaacaacttttttcaaaaaataaacttcctaataaaatttcattattcaaagactctttttataattttgatactaaagctttaactattgataatcaaaaagtgcttttaagtaaaaatgagactttgattattgaactattgattcaaaacagaggctcaattgtatcttttagtaaactacgagctagtatatggaaaaaagatatttctgattctggtattcgtgatgcttttgcaaggattagaaaaaaagcacccaacttatctattgctactcattttgggagtgggtattctttggatttggagtaa

SEQ ID NO: 7442 - protein, 243 aa, Unknown
  Obtained from environmental sample
  DOMAIN (171)...(240): Transcriptional regulatory protein, C terminal
  misc_feature (1)..(243): Xaa is any amino acid
MVVNLSQKKELNCCIICFMKNNQKIVIVEDDIFAQEFLAQTLNTLGYSSILVVSKADDAINFCKKEKIDIIFMDINIEGTMDGIQCAREISLYYNIPIIFTTAYADSVTIDEASYTNLYGYLIKPFTQKEVEIALKIIQKQLFSKNKLPNKISLFKDSFYNFDTKALTIDNQKVLLSKNETLIIELLIQNRGSIVSFSKLRASIWKKDISDSGIRDAFARIRKKAPNLSIATHFGSGYSLDLE

SEQ ID NO: 7443 - DNA, 729 bp, Unknown
  Obtained from environmental sample
  misc_feature (1)..(729): n is a, c, g, or t
gtgcttgatttttatgagatgctggctcccggtaagaaagctgaggacgaaagaaaaatgggcatgctcctttggatgctggaaggcgaccgtcacctgcatagcgttgatgatatcatgtcgtggataacacgggataaatcaatgtacgacctggaagttgaaagaattcctttgaaaacggtaaaacattgggtgaccggaagcgatgagatttaccatgaagaaaagaagtatttttcggtgattggggtaaacgtggagattggcaaccgcgaagttcaatcttgggaccagcccttgattaaagcagcccaggagggcatcatcgctttcatcgtgaaaaagataaatggtatttaccacttccttgtgcaggccaaactcgaagccggtaatttcgatattatcgaactggcgcccaccgttcaatgcctcacgggcaactatcgcaagggtcagaacgaatacgatgtgatgtttttggatgaagtgatcaatgccaaaccggaacaaatctggtattcgacttaccagagtgaagagggcgggcgcttttttaaagagcaaaacaaaaatatgatcatcgaggtgggtgaagaatttccgatggaactccctcaaaattacatttggatgaccctaaaccaactaaagatttttattaagtacaacaactaccttaacattgccgcccgaagtttgatagcagcaatcaggtttgtgtag

SEQ ID NO: 7444 - protein, 242 aa, Unknown
  Obtained from environmental sample
  DOMAIN (34)...(242): NDP-hexose 2,3-dehydratase
  misc_feature (1)..(242): Xaa is any amino acid
MLDFYEMLAPGKKAEDERKMGMLLWMLEGDRHLHSVDDIMSWITRDKSMYDLEVERIPLKTVKHWVTGSDEIYHEEKKYFSVIGVNVEIGNREVQSWDQPLIKAAQEGIIAFIVKKINGIYHFLVQAKLEAGNFDIIELAPTVQCLTGNYRKGQNEYDVMFLDEVINAKPEQIWYSTYQSEEGGRFFKEQNKNMIIEVGEEFPMELPQNYIWMTLNQLKIFIKYNNYLNIAARSLIAAIRFV

SEQ ID NO: 7445 - DNA, 411 bp, Unknown
  Obtained from environmental sample
  misc_feature (1)..(411): n is a, c, g, or t
atgataaatttcactttgacagttataataccaactatgaaatttattctaagcttattaatcctaatttttttcgcaggttgttctaaagtagcttttattcagagtgaaatagcaccaaaattgactcttatcccatcttccatagataaacttgatggttacgagagtgtagattttgactcaatgtttttactctttgaaaataactgtcgtactcaaaaagctaaaaatatatacggtgaactatgtagtaacctaaatcaaataacagataaaagagagttcttcaagaacaacttcagaccatacaaaattttaaaaaaagatggaaaagatgaagggcttttgacaggatactatgaaacctctttctttatggaagtagagaaaaaaagtgaaccgttttaa

SEQ ID NO: 7446 - protein, 136 aa, Unknown
  Obtained from environmental sample
  misc_feature (1)..(136): Xaa is any amino acid
MINFTLTVIIPTMKFILSLLILIFFAGCSKVAFIQSEIAPKLTLIPSSIDKLDGYESVDFDSMFLLFENNCRTQKAKNIYGELCSNLNQITDKREFFKNNFRPYKILKKDGKDEGLLTGYYETSFFMEVEKKSEPF

SEQ ID NO: 7447 - DNA, 963 bp, Unknown
  Obtained from environmental sample
  misc_feature (1)..(963): n is a, c, g, or t
ttgctgattggaacaaaaggcgtaaactggcttggtttggacgagcgtaaaaagggccggtgctttataaaatggaaattcaagatttttctgacttcaaaggagcagcatgaaaagtatgttaaaaaacgagtggaatatttaagttcaggcgtagcaaaacataaagctgaaattatcgataatctaatcaaaacagacaatatctatgtcaattttgctgaaacaattatgcagggcgctcttacactgcataaaagaaaccatgtaaaactagatgataaacaggtttcaattggtctagtacggatggctaacatcaacccaatggttgctgtggctaaggctctattaaacttacccgcacctgaaaatacacacatacatttatgtgtatatcacagccgttaccctttagcagtgcgttcttatttagaaaataaattagatcaaatactgaatcgtaaaaagaactggccacctaaaaatctacagaatctagttaataaaaaagcagaaaaaaatcagctatttattgtattagcatcaccagtagcggaggtcgggcgtgaccacgattatgattgggctgttattgaacctagctctatgcgttctattattcagatagcagggcgggtattaagacatagagagaacgttccaaagcaagaaaatattttattaatcaaccaaaatatcaaacaacttaaagataatgagcgttgctttaatcagccaggttttgaggtggaaaacttaaagctcaagcttaataagcataggttaagagaagtattagcagagtcacaatatcaacccattaactcggtagaacgagtgattaaaagcaagcagaaaccgctagaaaacttggttgcactggagcaccaggctttgctggaaaaattatttaaaagctcaaactcagccaaactttggtggaaagaacaagtcatctga

SEQ ID NO: 7448 - protein, 320 aa, Unknown
  Obtained from environmental sample
  misc_feature (1)..(320): Xaa is any amino acid
MLIGTKGVNWLGLDERKKGRCFIKWKFKIFLTSKEQHEKYVKKRVEYLSSGVAKHKAEIIDNLIKTDNIYVNFAETIMQGALTLHKRNHVKLDDKQVSIGLVRMANINPMVAVAKALLNLPAPENTHIHLCVYHSRYPLAVRSYLENKLDQILNRKKNWPPKNLQNLVNKKAEKNQLFIVLASPVAEVGRDHDYDWAVIEPSSMRSIIQIAGRVLRHRENVPKQENILLINQNIKQLKDNERCFNQPGFEVENLKLKLNKHRLREVLAESQYQPINSVERVIKSKQKPLENLVALEHQALLEKLFKSSNSAKLWWKEQVI

SEQ ID NO: 7449 - DNA, 672 bp, Unknown
  Obtained from environmental sample
  misc_feature (1)..(672): n is a, c, g, or t
atgaatatagcttgtaaaaagtttgaaacacctgtgactggaggaaatgttagtttttataatcaaactgttttgggaaataaaacggaacctatttatccaactccagtaataggaatgcttggtgtcgtccaagataaaaacaacattatgactcttgggtttaaagacaaaggcgatgtgatttttattttaggagaaacgaaaaatgaaatttcttcttcggaatatttgaatttttatcacgcagtaaaatattcgccagttccacattttgatcttgatgtagaacataaattacaacaaataacaaaacaacttatcaaacataaacttattcgttcagcacatgatattgccgatggtggtttatttataacacttgttgaatctgctttggttcataatgtcggatttgatattactacggatgccgaaatgagaattgattcatttttatttggcgaatctcaaagtaggattgttgtttcggttactccaaataaaatgaatgtttttattgattttatgagaaaacaagattttccgttcttatctcttggacatgtcacaaaaggagaacttagaattgatgatgtttcatttggttttatccaagatgtcaagaaaaaatatatggatactttaggtgaattgattgaaaaaaaataa

SEQ ID NO: 7450 - protein, 223 aa, Unknown
  Obtained from environmental sample
  DOMAIN (57)...(198): AIR synthase related protein, C-terminal domain
  misc_feature (1)..(223): Xaa is any amino acid
MNIACKKFETPVTGGNVSFYNQTVLGNKTEPIYPTPVIGMLGVVQDKNNIMTLGFKDKGDVIFILGETKNEISSSEYLNFYHAVKYSPVPHFDLDVEHKLQQITKQLIKHKLIRSAHDIADGGLFITLVESALVHNVGFDITTDAEMRIDSFLFGESQSRIVVSVTPNKMNVFIDFMRKQDFPFLSLGHVTKGELRIDDVSFGFIQDVKKKYMDTLGELIEKK

SEQ ID NO: 7451 - DNA, 573 bp, Unknown
  Obtained from environmental sample
  misc_feature (1)..(573): n is a, c, g, or t
atgtgggtggaaaaagcaccgcagtctcgttttgcccgtttgttaaaagccgatcctgttttaggtgtcgatatgtcatcaaccggagagtggggatgtattggtgaaaactactacgaagcaattctgaaagcgatgctttcggtgggttataatttcccgaaaaagaatattcttatttcatcaggtccttcgcgtggtaaagttgagttgctgaacagtgcgaaaatgctaaaagaaagagactacaatatttttgcgacagaaggcacccataaattcttccgcgataatggcgtagaaaatactttggtacactggcccgatgaaaatgatcgttcgccaaatacgattgacatgataaagaataagaaaattgatttggtgattaatatcccgaaagatcataccaatcgcgaattgaaaaatgggtataatattcgacgaagttcaatcgactataacattccgcttattacaaatgctcgtgttgcaagtgcattcttgtacggggtttgtaagtatactatcaacgatattgagattaaaagttgggatgaatacaaggcatag

SEQ ID NO: 7452 - protein, 190 aa, Unknown
  Obtained from environmental sample
  DOMAIN (70)...(160): MGS-like domain
  misc_feature (1)..(190): Xaa is any amino acid
MWVEKAPQSRFARLLKADPVLGVDMSSTGEWGCIGENYYEAILKAMLSVGYNFPKKNILISSGPSRGKVELLNSAKMLKERDYNIFATEGTHKFFRDNGVENTLVHWPDENDRSPNTIDMIKNKKIDLVINIPKDHTNRELKNGYNIRRSSIDYNIPLITNARVASAFLYGVCKYTINDIEIKSWDEYKA

SEQ ID NO: 7453 - DNA, 396 bp, Unknown
  Obtained from environmental sample
  misc_feature (1)..(396): n is a, c, g, or t
atgaaacaacaattcaatatggacgaggcacttgaactcgtaaaacaaggtgccagaatagatggcaaagatggagtacttgctccacttattaaacaacttactgaagcagttcttgaagctgaaattgaatctcatttgtctacagagattaataatcgtaaaaatggtaaatcttcaaagactatgaaaagtagtgttggtacatttgatttagatgtaccacgtgatagaaacagttcatttgagcctgagatagttaaaaagcatcagacacatatatcagaacagttagagcagaagatattatcattatatgctttgggcaatagctatagtcaaatatctgaacatattgatgaaatgtacggcgtagagtttttngagccgatctga

SEQ ID NO: 7454 - protein, 131 aa, Unknown
  Obtained from environmental sample
  misc_feature (1)..(131): Xaa is any amino acid
MKQQFNMDEALELVKQGARIDGKDGVLAPLIKQLTEAVLEAEIESHLSTEINNRKNGKSSKTMKSSVGTFDLDVPRDRNSSFEPEIVKKHQTHISEQLEQKILSLYALGNSYSQISEHIDEMYGVEFXEPI

SEQ ID NO: 7455 - DNA, 726 bp, Unknown
  Obtained from environmental sample
  misc_feature (1)..(726): n is a, c, g, or t
atggatcaaggggagttagcacttggtattaatgccatggttgcctttatgccttggaatggttataacttcgaggatgctattgttattagtgatcgtatgattaaagaagatgcttttacatctgtacatatttatgaaaaagagtgtgaagcacgtgaactaaaacatggtgtagaagagattactcgtgatattccaaatatacgtgatgaagcactatctcaccttgatgagagtggaatcgttaaaatcggtacatacataaaaggtggaatgattttagtaggtaaagtaactccaaaaggtgaagttaaacctacaccagaagagagacttttacgcgctatttttggtgaaaaagctggtcatgtaatagataagtcactatattgtcctccaactatggaaggtgttattgttgacattaaagttttcactaaaaaaggttatgaaaaagatagctgtgcattagagattgaaaaaattgaacgtgatgagttagagcgtgagcactatgatagacttcttatgattgataaagaggagatgatgagaatctctgctctgcttactaaagaacctctgcaaagagatgttagtgttaatgataatgattataaaaagggtgagctattaagagttgaagatttagctgaagttattcgttttgccatgaacaatggtgtggaaatcattttcagaagaatttccagcaaaatataa

SEQ ID NO: 7456 - protein, 241 aa, Unknown
  Obtained from environmental sample
  DOMAIN (1)...(240): RNA polymerase Rpb2, domain 6
  misc_feature (1)..(241): Xaa is any amino acid
MDQGELALGINAMVAFMPWNGYNFEDAIVISDRMIKEDAFTSVHIYEKECEARELKHGVEEITRDIPNIRDEALSHLDESGIVKIGTYIKGGMILVGKVTPKGEVKPTPEERLLRAIFGEKAGHVIDKSLYCPPTMEGVIVDIKVFTKKGYEKDSCALEIEKIERDELEREHYDRLLMIDKEEMMRISALLTKEPLQRDVSVNDNDYKKGELLRVEDLAEVIRFAMNNGVEIIFRRISSKI

SEQ ID NO: 7457 - DNA, 492 bp, Unknown
  Obtained from environmental sample
  misc_feature (1)..(492): n is a, c, g, or t
gtgaaaaaacaactttaccaatggaactttgtaattaatggtcttattcctgatcaagctaaactcaaaagaaaggtgtggttgaaaaaaggggaattattgcttgaacaaaagggcgacaaactctatgcctaccttttaggtgacaataagtttgaattctctagaggggacaaaatagcttcatatttaaagttttcttgccttatttcaaacaactcgcctgatcttgaaagttgctccgggataggtcttaaatcaaaagaagatcttggaaaagttgaattaatatcatgttcaataaaaagcatcctccctaaagaatctatcgaagacattgaaaaatatgcacataaattcatttcatttatagacaaacttcacgataaatacattcaagtagtttgtgaaaatgaattcatggaaatagcactcgactatttttacgaagcaaaaaaaaagtttccccacggtgacgaaaggctttattag

SEQ ID NO: 7458 - protein, 163 aa, Unknown
  Obtained from environmental sample
  misc_feature (1)..(163): Xaa is any amino acid
MKKQLYQWNFVINGLIPDQAKLKRKVWLKKGELLLEQKGDKLYAYLLGDNKFEFSRGDKIASYLKFSCLISNNSPDLESCSGIGLKSKEDLGKVELISCSIKSILPKESIEDIEKYAHKFISFIDKLHDKYIQVVCENEFMEIALDYFYEAKKKFPHGDERLY

SEQ ID NO: 7459 - DNA, 435 bp, Unknown
  Obtained from environmental sample
  misc_feature (1)..(435): n is a, c, g, or t
atgaagactatagcaatcatgcttgtgatttttgcagttacttgttctgggtgctgcactcaccaaaacatttacagcgataaagggaaaaagtatcgtttcatcttaacaacaaagattaaaaactttaagcctttaaacagtcatgagtcagcacaaatagatgagggtggaaaaatttactatattgcaaaactatttgatctaaaaccaaatgctatacataaatatcgttgtcgcataattgaccaagctggaaacatagttacaaacataaataatgagttcattcctaaagcttcgtattatattcaaaagtgtggaacaaccccgaatccgcacacagacgagtctggtatctggaaattcgaaggttatataaatgaaaaactagttgtcaatgaatcaagaactataacattaagaaaaaaataa

SEQ ID NO: 7460 - protein, 144 aa, Unknown
  Obtained from environmental sample
  misc_feature (1)..(144): Xaa is any amino acid
MKTIAIMLVIFAVTCSGCCTHQNIYSDKGKKYRFILTTKIKNFKPLNSHESAQIDEGGKIYYIAKLFDLKPNAIHKYRCRIIDQAGNIVTNINNEFIPKASYYIQKCGTTPNPHTDESGIWKFEGYINEKLVVNESRTITLRKK

SEQ ID NO: 7461 - DNA, 606 bp, Unknown
  Obtained from environmental sample
  misc_feature (1)..(606): n is a, c, g, or t
gtgacaaaaaattctaaaagtatagactggaaacgttgcatatatatggaatgtgcagagatggtagatagttttgcatggaaacactggaagtcaattgatgctgagccaaattgggataatcataagatagaagttgtagatgtttggcactttgtcatgagtctagcactgcaagagtataaaatgaataatataggcacaatgcaagaggtacaaaaattaatagaaaattctgagaacttcaaattaattaatactactgatgaggctaatgcagacatcgtatcagttatagctcaggtagaggagttgatgttagattcattaattcgtgaaggttttaagattgaacatctaattgaaaactttttaaaactatcatcgatgagttctctgaatttagactctttatataagctatatgttggaaaaaatatactcaatcagtttcgtcaagatcacggatataaagatggttcatatataaaagagtggaatggtgtggaagataatgtagttatgaaaaagttttgggatgaaaataactctttagcaccggaagaactttatagtaagctagaagaggtatacagcacattatag

SEQ ID NO: 7462 - protein, 201 aa, Unknown
  Obtained from environmental sample
  misc_feature (1)..(201): Xaa is any amino acid
MTKNSKSIDWKRCIYMECAEMVDSFAWKHWKSIDAEPNWDNHKIEVVDVWHFVMSLALQEYKMNNIGTMQEVQKLIENSENFKLINTTDEANADIVSVIAQVEELMLDSLIREGFKIEHLIENFLKLSSMSSLNLDSLYKLYVGKNILNQFRQDHGYKDGSYIKEWNGVEDNVVMKKFWDENNSLAPEELYSKLEEVYSTL

SEQ ID NO: 7463 - DNA, 651 bp, Unknown
  Obtained from environmental sample
  misc_feature (1)..(651): n is a, c, g, or t
ttgggnncccaagacagaatggccgagtatagtttattagctataaatttaagtgctagaatgaatccttttgagccaactgatacttttattgaacaacaaaaagagtatgagatgaaacaaaagcaagaggaacaaaagcaaattgagctagaacagcaaagaaaaatagcactattagctcaacaagaagcagaagaaaaagctgagcagttgcgattagaacaagagcaagcagctcaactagaaaaacaacgacgacttcaagcggaaaaaacagctcaaatgattaaagttgttgaaaaaaaagaggaaatagtagtacctaaagatagttacaaaattttaccttttgtaaatataaaagtctcagatgaagagatagagatatttattgataaaagatataaacttgtaaatcaagatattttagaagaacaaaaaaagtttttgtttgattttagagcaacagagagtttttatactataagaaaagctctcaataataatagttttaaatcatttgctgtgggaacacatatggataagaagttttttcgagttgtggttgagttaactgacactgtttcaaaatataaagaacatatcaatagcaatacaagttatataaaaatcaaaaaaatcaaataa

SEQ ID NO: 7464 - protein, 216 aa, Unknown
  Obtained from environmental sample
  misc_feature (1)..(216): Xaa is any amino acid
MGXQDRMAEYSLLAINLSARMNPFEPTDTFIEQQKEYEMKQKQEEQKQIELEQQRKIALLAQQEAEEKAEQLRLEQEQAAQLEKQRRLQAEKTAQMIKVVEKKEEIVVPKDSYKILPFVNIKVSDEEIEIFIDKRYKLVNQDILEEQKKFLFDFRATESFYTIRKALNNNSFKSFAVGTHMDKKFFRVVVELTDTVSKYKEHINSNTSYIKIKKIK

SEQ ID NO: 7465 - DNA, 882 bp, Unknown
  Obtained from environmental sample
  misc_feature (1)..(882): n is a, c, g, or t
atgtgtgtaagttctgtgcctattccgcaagccgtaaaaatcccaangccttatacattaaaacatgaagagatcatggatatcgtcgatgatatcgcttcacgcggtatcacggaagtgcacatcgtctctgcgcataaccctgaaacaggactggactggtacacgacggtcttctcaaagatcaaggcaaaatatccgaagatgcatatcaaggctctgacagcagcagaaatacacttcttgtccgaagagtacgacaagagctatgacgagatcatcgacatcatgatcgccaacggggtcgattcacttccgggcggtggtgcggagatctttgatgaaaaggtgcgtgactacatctgtaagggcaaggtcacctcggatcaatggctgcagatccatgagaaatggcacagtcgaggacgcaagtcaaacgtcactatgttatttggacatgtcgaagagcgcaaagacagaatagaccatatgatgcgtatccgagaccttcaggacaagaccggcggattcaactgttttatcccccttgtctaccagacggagaacaacttcttgaatgtcaaagaggatatcacgggacaagaaatactcaagacctacgctatagcacgacttttacttgacaatgtagcaaacctcaaagcctactgggtgacatcaacggtcaacctcgcgcttgtcgctcaagagttcggctgtaacgaccttgacgggaccatcgaaaaagagtcgatcaactcggcagccggcgccaagtctgccttcggtgtcgaccttaaagagtttgtcggtctgatcagaaataccggctttactcccgtagagcgtgacagtctgtataatgagatcaagagctggtag

SEQ ID NO: 7466 - protein, 293 aa, Unknown
  Obtained from environmental sample
  misc_feature (1)..(293): Xaa is any amino acid
MCVSSVPIPQAVKIPXPYTLKHEEIMDIVDDIASRGITEVHIVSAHNPETGLDWYTTVFSKIKAKYPKMHIKALTAAEIHFLSEEYDKSYDEIIDIMIANGVDSLPGGGAEIFDEKVRDYICKGKVTSDQWLQIHEKWHSRGRKSNVTMLFGHVEERKDRIDHMMRIRDLQDKTGGFNCFIPLVYQTENNFLNVKEDITGQEILKTYAIARLLLDNVANLKAYWVTSTVNLALVAQEFGCNDLDGTIEKESINSAAGAKSAFGVDLKEFVGLIRNTGFTPVERDSLYNEIKSW

SEQ ID NO: 7467 - DNA, 390 bp, Unknown
  Obtained from environmental sample
  misc_feature (1)..(390): n is a, c, g, or t
atgcataaaaatcaagataaatactcaaatgatgaattcaatttggaagagttgaattttatcgaccagatgctgaaagaaagtttggaagaggattttaatgtttctattccaaatgaatttgctgatcaagtaactgagttggttgaaaaacgtaaggccattagagaagctatactgaaacatctaattatgagtttaggtttattcgtcattctagcatctaccgtgattttcctttattactttaaaagtgaacaagcaaatgtcatctttgaatttaccttaaaatttaaatacccaatagcatttgttctatttacaatcctttcaatacaacttgccgactcagtactcttaagtagaacaaaagagcaactcggaaaataa

SEQ ID NO: 7468 - protein, 129 aa, Unknown
  Obtained from environmental sample
  misc_feature (1)..(129): Xaa is any amino acid
MHKNQDKYSNDEFNLEELNFIDQMLKESLEEDFNVSIPNEFADQVTELVEKRKAIREAILKHLIMSLGLFVILASTVIFLYYFKSEQANVIFEFTLKFKYPIAFVLFTILSIQLADSVLLSRTKEQLGK

SEQ ID NO: 7469 - DNA, 993 bp, Unknown
  Obtained from environmental sample
  misc_feature (1)..(993): n is a, c, g, or t
atgttaattaaattaaggacatatcagattgatgttattaaaaaagtaagagatgagctcataaacggcaataagcgtccgattgttgccatgccgaccggaagcgggaaaagccccacaatgtgtgagataataaaaagagctgtagacaaagggactcgcgttctttttcttgtacataggcggaatcttgtaacccagataaacgacatgctggaaaaacattatggaataacgcccggtataattatgagcggccatgagcttgatcttgataattcggttcagcttgcatcaattcaaacattttcaagaagggttaagttagaaaaaccggaatataataaattcgttgtagcagctgatttaattttgatcgatgaaagccaccgcgccgtaagtaagacgtatcaagacgttataaatttatatgaggataaaataataataggatttacggccactccaataaaagcaaacggatgcggcatggggatggtatttgatagccttgttgttgggcctgaagtcagagaattgacagaactcgggtatctttcgcctgtcagatacttcgttcctggcaagatcgatcttaacggcgtgaaggagcttggaggtgattatcaggcggggtctcttgagaaaaagataaacaagaaaaagctcataggcgatattgtagaaaattggctgaaacttgcagagaatcgaaaaactttagtctatgccgtaaacgtgaagcactcaatatcattatgcgaggcttttcaatcagccgggataaaaacagctaggcttgacgcaaaaagttcagacgaagagcgggatgatgtatttcacgcaatggaacgcggtgatattcaggttttgataaatgtttttattgtatgtcgaaaggctgggacgtacccttccatttcttgtggtagtatttgcaaggaccgacccaaaagcccttggatttatacagggcaagcaaggcgggtcgcc

SEQ ID NO: 7470 - protein, 331 aa, Unknown
  Obtained from environmental sample
  DOMAIN (5)...(164): DEAD/DEAH box helicase
  misc_feature (1)..(331): Xaa is any amino acid
MLIKLRTYQIDVIKKVRDELINGNKRPIVAMPTGSGKSPTMCEIIKRAVDKGTRVLFLVHRRNLVTQINDMLEKHYGITPGIIMSGHELDLDNSVQLASIQTFSRRVKLEKPEYNKFVVAADLILIDESHRAVSKTYQDVINLYEDKIIIGFTATPIKANGCGMGMVFDSLVVGPEVRELTELGYLSPVRYFVPGKIDLNGVKELGGDYQAGSLEKKINKKKLIGDIVENWLKLAENRKTLVYAVNVKHSISLCEAFQSAGIKTARLDAKSSDEERDDVFHAMERGDIQVLINVFIVCRKAGTYPSISCGSICKDRPKSPWIYTGQARRVA

SEQ ID NO: 7471 - DNA, 360 bp, Unknown
  Obtained from environmental sample
  misc_feature (1)..(360): n is a, c, g, or t
atggatcttcattttagagatgtatcaagtcatgatgagttacaaaactttataaaaaaagcaaaagaaaacaatcaaaaactatatttagaaataggttatggatctggtattgtcttaaaaaaaagagtattaaaagaaaaagatgtaatgcatatcggatttgaaattaaaggaaaatttgtctatagattaaaagattttataactaaatggaaagttgaaaatttttatgtagaaaaagctgatgcaaaatatgttattcctaggtttngtgaagataatagttttgataaaatatttatctattatccagatccttggtnggaagaaaaaactaaaaaatatatttctttttga

SEQ ID NO: 7472 - protein, 119 aa, Unknown
  Obtained from environmental sample
  misc_feature (1)..(119): Xaa is any amino acid
MDLHFRDVSSHDELQNFIKKAKENNQKLYLEIGYGSGIVLKKRVLKEKDVMHIGFEIKGKFVYRLKDFITKWKVENFYVEKADAKYVIPRFXEDNSFDKIFIYYPDPWXEEKTKKYISF

SEQ ID NO: 7473 - DNA, 429 bp, Unknown
  Obtained from environmental sample
  misc_feature (1)..(429): n is a, c, g, or t
ttgtcttttcgtttaggcgctctttcgttggtagtaatattagcgtcctgtaatttcctccctaattcatcatctttcgcaagtagtaagaaatctttctctaagcctaagacttgtaatactaataaatatgaaccaatacttactgtaggtttacctttttcaatagaggataaggttggtctactaatatttgcgcgctcagccacttgttcagaactaaattttcttctcaagcgagcaagcttaatattttctcccatttctgctaaaattcttctctttttaggcaatattataattttcttttttgtcataatattaaatatattttacaaatatagcattttttgtaaactattttttacattaaagaaaccatttttagtaaatattgtaaaacatctaataaataagctttgccattaa

SEQ ID NO: 7474 - protein, 142 aa, Unknown
  Obtained from environmental sample
  misc_feature (1)..(142): Xaa is any amino acid
MSFRLGALSLVVILASCNFLPNSSSFASSKKSFSKPKTCNTNKYEPILTVGLPFSIEDKVGLLIFARSATCSELNFLLKRASLIFSPISAKILLFLGNIIIFFFVIILNIFYKYSIFCKLFFTLKKPFLVNIVKHLINKLCH

SEQ ID NO: 7475 - DNA, 573 bp, Unknown
  Obtained from environmental sample
  misc_feature (1)..(573): n is a, c, g, or t
atgtatatcatctgttcggatctggaaggcgtttttgtgcctgaaatatggattaatgtggcaaaaaaaaccggtattgaagaactgaagctgaccactcgcgacatctctgactatgatgtattaatgaaaaagagactggccatcttagatgaacacaaactgaaactaagcgatatccaggcagtgattaaaaagattgatcccatggagggtgctgtcgaattcttgaactggatccgggaaaattatcagatcattattgtttcagatacatttgtagaatttgccagtccgctgatggaaaagctgggacaccccactctgctgtgccactccctgattgttgaaccggacggcgctatttccggctacacattaagacagccggacgccaagcgaaaagttgtccaggcaatgaaaggcctgagctaccaggtgcttgcgtttggtgactcatacaacgacattaacatgctcaaagaagcagacacatccttttttttcagaccgccgtcaaatgtcatcgaagactttccgaaaattcagccgactgaagattacaaccagtaa

SEQ ID NO: 7476 - protein, 190 aa, Unknown
  Obtained from environmental sample
  DOMAIN (1)...(173): haloacid dehalogenase-like hydrolase
  misc_feature (1)..(190): Xaa is any amino acid
MYIICSDLEGVFVPEIWINVAKKTGIEELKLTTRDISDYDVLMKKRLAILDEHKLKLSDIQAVIKKIDPMEGAVEFLNWIRENYQIIIVSDTFVEFASPLMEKLGHPTLLCHSLIVEPDGAISGYTLRQPDAKRKVVQAMKGLSYQVLAFGDSYNDINMLKEADTSFFFRPPSNVIEDFPKIQPTEDYNQ

SEQ ID NO: 7477 - DNA, 639 bp, Unknown
  Obtained from environmental sample
  misc_feature (1)..(639): n is a, c, g, or t
atggctggttattttactactgctggtggagagtttattgaagacctcaagcagtacaacaaagaggtgttttttttaccaaatttagtagatgaaaatattgagaaatataaagggtatgaaaatactacttttcaaagtgatgttgtgtttacagggcgtgctgataaagaaagaggagctttaatagattatttaacttctaatttagattcaactatagaaacaaaatttataggttttgataaacagtctgttgttataggggataaatatttacaagctttagcaaactctaaaatagctataaatcataatagagattttacattaaaatatgaatggtatacttcggatagacttgtgcatatcttaggaaatggttcttttgctttaagtacaaacattataaacggtgaagagttttttgaagataaattagaatattataactcttatgatgaattgatttttaaaatagattattttttagataatgagaaagaaagaattcataaagccgtttggttacgacaaaggatacatgccctttttaattctcaaagagttgcacagtatattttaagcttatataaccaaaatacaaaagatttacaaacatatgagtggtacaaatga

SEQ ID NO: 7478 - protein, 212 aa, Unknown
  Obtained from environmental sample
  misc_feature (1)..(212): Xaa is any amino acid
MAGYFTTAGGEFIEDLKQYNKEVFFLPNLVDENIEKYKGYENTTFQSDVVFTGRADKERGALIDYLTSNLDSTIETKFIGFDKQSVVIGDKYLQALANSKIAINHNRDFTLKYEWYTSDRLVHILGNGSFALSTNIINGEEFFEDKLEYYNSYDELIFKIDYFLDNEKERIHKAVWLRQRIHALFNSQRVAQYILSLYNQNTKDLQTYEWYK

SEQ ID NO: 7479 - DNA, 846 bp, Unknown
  Obtained from environmental sample
  misc_feature (1)..(846): n is a, c, g, or t
gtggtacaaatgataaaatatctctatagacataataaagattattcacgatttaatattatgaagcaatttaccaaagatttagaattaaaaagtgatatttatatactacttcctttctcgaaaaatcagttttttaaaaactttttaaaaagagatcgaattataaatgatttttttatatcaaattatgatacttatgtacatgatagaaaaaagataactaataaaaatccaagagcatggtggaaatattttcaagattggtttaattttaagttctcaaaataccttcttagtgatacacaagctcattttgaatattgggaaaagttatttggaaagtttgatggaaaacactttgtatttcctgtacttgctgatagaaatatttattatccaaatgaacaaaaaagtgaaaatgaaaaagtgaaaattcttttttacggctcttttatccctttacatgggattgatgtgattttaaaagcttttagtttgatggaaaaagatggtttggaatttgaagccaatattattggttgtgggcaaatttattctcagatgaaagagctatttgatactttgggattaaaacaagtaactatgaatggtgaaattattgaagagattgaattagcctcaagaataagagaacatgatattatccttggtatctttggagatagtacaaaagcaaaaagtgttgtaccaaataaattgtaccaagctgttgcaactgcaaaaactattgttacaatggaatcaaaagctatcgaagagttttttgataaggacgatttaattgtttgtaacaatacaccagaacaactctcttggaattaa

SEQ ID NO: 7480 - protein, 281 aa, Unknown
  Obtained from environmental sample
  misc_feature (1)..(281): Xaa is any amino acid
MVQMIKYLYRHNKDYSRFNIMKQFTKDLELKSDIYILLPFSKNQFFKNFLKRDRIINDFFISNYDTYVHDRKKITNKNPRAWWKYFQDWFNFKFSKYLLSDTQAHFEYWEKLFGKFDGKHFVFPVLADRNIYYPNEQKSENEKVKILFYGSFIPLHGIDVILKAFSLMEKDGLEFEANIIGCGQIYSQMKELFDTLGLKQVTMNGEIIEEIELASRIREHDIILGIFGDSTKAKSVVPNKLYQAVATAKTIVTMESKAIEEFFDKDDLIVCNNTPEQLSWN

SEQ ID NO: 7481 - DNA, 879 bp, Unknown
  Obtained from environmental sample
  misc_feature (1)..(879): n is a, c, g, or t
atggctattttagcaagtactattggaaatttattaactggaattattttgcttacattgttggttattggaataatttttactttccaaatctcactaagcgatttagttaaaaaaacatatattctagattggggatggggagcaattgtttggtttattgttgcgattagtaatttctttaaaaatattggagtatttcttcgttctttcttttctgctagaaaggaaaagaaattaggagatgcaaaatttatggaatctttagaaaaaatggataaaggaaaaaccgaggacattattacagataaagtaaatttaaaagaagatgaaagtgatttagataagttcgctgcaattgatatacaagaagaaaatgatgaagtaattaatgtccctgtttttgaggcaaataaagaacaaaataagatttatgatgaaagtgatttagttaaagcagccaatatagagacagaagaaggagagagtttatttccttatcaaacagaagatattttatcttataattatgatttatctagtgaactattagaaaagaaaagtacaaaaccacaaggtggtgatgtaaaatttaaagcagagcaaattaaaaaaactttaaagaattttggtattagggtagaaatgaaagatgttcaggttggtccagtggtaacacaattttcatttaagccagctgaaggaacaaaattatcgcgaattacagctttgcatgatgatttgtctttggctttagcagctcatccaattcggattgaagcgccaattccagggaaaccttacgttggtttagaagttcctaataaacagtctgcaattgttaggattaaaactttggtagattcaaaagtcttttaa

SEQ ID NO: 7482 - protein, 292 aa, Unknown
  Obtained from environmental sample
  misc_feature (1)..(292): Xaa is any amino acid
MAILASTIGNLLTGIILLTLLVIGIIFTFQISLSDLVKKTYILDWGWGAIVWFIVAISNFFKNIGVFLRSFFSARKEKKLGDAKFMESLEKMDKGKTEDIITDKVNLKEDESDLDKFAAIDIQEENDEVINVPVFEANKEQNKIYDESDLVKAANIETEEGESLFPYQTEDILSYNYDLSSELLEKKSTKPQGGDVKFKAEQIKKTLKNFGIRVEMKDVQVGPVVTQFSFKPAEGTKLSRITALHDDLSLALAAHPIRIEAPIPGKPYVGLEVPNKQSAIVRIKTLVDSKVF

SEQ ID NO: 7483 - DNA, 366 bp, Unknown
  Obtained from environmental sample
  misc_feature (1)..(366): n is a, c, g, or t
atggaaaaattatttattgaaggaacaaaacaaacacctgaaattgattttgatggagcaaaaggcaaatttaaagtatctggaaaatcatatcccgaaaatgtaaataccttctttgaacctgtttttagatatattgatgaatataaaaacaatcctgctcccaaaactaaacttgaatttacttggctatactacaatactgcaactattaaaatgattatgagaataattatgtttcttaaagaatcaaatacaaacttcaaactcggctggtattataaagaaggttttgagatgattaaggaaaaaggtgaagaaattaaagatattttaggcatatctgtagatatcaaacaaatataa

SEQ ID NO: 7484 - protein, 121 aa, Unknown
  Obtained from environmental sample
  misc_feature (1)..(121): Xaa is any amino acid
MEKLFIEGTKQTPEIDFDGAKGKFKVSGKSYPENVNTFFEPVFRYIDEYKNNPAPKTKLEFTWLYYNTATIKMIMRIIMFLKESNTNFKLGWYYKEGFEMIKEKGEEIKDILGISVDIKQI

SEQ ID NO: 7485 - DNA, 705 bp, Unknown
  Obtained from environmental sample
  misc_feature (1)..(705): n is a, c, g, or t
atgacttatgatgagtttgattttgtatataaaataatagcacccaaaggaatacatgtttcaagattaaaaaattatcgttcgtcgaaacactacagaatgagtattaatactcgatgtggaaaacattttgatattcatatttcgatcgacaataaattaaattcagagtcgaaactcgaaacaatatataaaaacatagcattatctggttatccgaatgatagtcctgcgattgcacaatttggatatgcgaatccaaatgacagtatttacaccacaagatatataagtcaattgtctgcttgggataaaattcgttctcttgctgaaatacagagaattggatacataaatgacaaaaatttctggcgaaaaatatttattcgttcaataagtgcattttataaagcatggaataacttaaatcgtgaagttttacctggatttatttctcccgaaaatgttgttgttccagaagtagatttttctgataatgtgagaattttatcattatctgtaaataaagaaagcacttctgttactgaatttatatcaatactatataagaatttctatcagaaaacaaccgtccactacccttctttgaggaaattattgaaaaaaacttggttgtttcatgcacttgtcgaaacttttgggaaaaaggaaagctttgtcaatactggatttatttatcaatga

SEQ ID NO: 7486 - protein, 234 aa, Unknown
  Obtained from environmental sample
  misc_feature (1)..(234): Xaa is any amino acid
MTYDEFDFVYKIIAPKGIHVSRLKNYRSSKHYRMSINTRCGKHFDIHISIDNKLNSESKLETIYKNIALSGYPNDSPAIAQFGYANPNDSIYTTRYISQLSAWDKIRSLAEIQRIGYINDKNFWRKIFIRSISAFYKAWNNLNREVLPGFISPENVVVPEVDFSDNVRILSLSVNKESTSVTEFISILYKNFYQKTTVHYPSLRKLLKKTWLFHALVETFGKKESFVNTGFIYQ

SEQ ID NO: 7487 - DNA, 810 bp, Unknown
  Obtained from environmental sample
  misc_feature (1)..(810): n is a, c, g, or t
atgatagatgaaaagtatgatacaaaagcttacgagtattataatttagctttaacatatgctcaaatatatgattataataatgcatataaatattttaaaaaagcatatagtttagatcatggaaataagctgtattctattatgacatttattacttctaaaaagttaagtttaaatgaagataaagtattttgggaaatattagtaagaaatatacaatcaaataaaggaagttttaattattttgcaaaatatatttataaaatatttgaaaatccagaacaagtattagatgaaaaaacattaagctttaaacaaaaaaaatcaatattttttcgagcattatattttatagataatatagagaaaaatggaattatgaaaacagaaccgctacttgtagagttttcaaaagatccgctagtatatcttttaagtttaatagcaaaagataaagatgaaaatgagtatatttatatttcaagaattcaagatgaattacctaaagtttataataatacatttttaaaaggaagtctagttattacagacttttatttagatactttaaaagcattaggactttttgattatacagattatgatataccaaatcacaatgaaccaagctatttaagaaccaaagctatagtgaatctttatcaaaataatcctataaaaagtatagagataattgaaagtttacaaaaaatatataatttacaaagtgttgatagttattatatattagccgcatcacaattagctgcaaataaagatcaatttgcatatgcaactttaaagtga

SEQ ID NO: 7488 - protein, 269 aa, Unknown
  Obtained from environmental sample
  misc_feature (1)..(269): Xaa is any amino acid
MIDEKYDTKAYEYYNLALTYAQIYDYNNAYKYFKKAYSLDHGNKLYSIMTFITSKKLSLNEDKVFWEILVRNIQSNKGSFNYFAKYIYKIFENPEQVLDEKTLSFKQKKSIFFRALYFIDNIEKNGIMKTEPLLVEFSKDPLVYLLSLIAKDKDENEYIYISRIQDELPKVYNNTFLKGSLVITDFYLDTLKALGLFDYTDYDIPNHNEPSYLRTKAIVNLYQNNPIKSIEIIESLQKIYNLQSVDSYYILAASQLAANKDQFAYATLK

SEQ ID NO: 7489 - DNA, 897 bp, Unknown
  Obtained from environmental sample
  misc_feature (1)..(897): n is a, c, g, or t
ttggaacgtattaaaacagttgttaatgtgaatgaggctcttaaaaaagagtatttagcaactcatatcaataacctaaatgactttttaaataaaaattatgaaaaaaatattctaatagagaagatcataatgacatcactctttgttattgcggttattattttgtttgtactgtttattatctatcaacgctctttaaaaattaaagatgatctttttggatttaaatcagcaattgaaaacagtgataactccatagttataactgatgcacagaagaatattacatatgtaaatgaagtgtttgaaaaagagacgggatacaaaaaagaggatattattggtaaaaatcctagaatactaaaatcaggtgaaatgtctcagtcacattatgatcgactcaataaactcattgatagtgggcaaaaatgggaaggtgaatttataaatcttagaaaagatagatcaatattttatgaaaaagcctctattataccaatatacaagaacgataaactggtaaattatttagcgattaaattgaatataactgagtatattgagaaaaaacgtgaaatagaatttcttgcatatcatgatgcactaacatcacttccaaatcgcagtagcattgaacaacatattgaacgagagatgttgcttgcaaaacgtaatgagagtagaattgctgtactgtttattgatctagatcgctttaaaatcattaatgatacattaggacatgatgtaggggatgaaattttaatacagagtgctaagcgtattaaggaatcactaagaaaatctgacatgcctgcacgtaatggcggtgatgagtttattggtgttctagataatataaatgatgagtattgtgcctgcacaattttgtga

SEQ ID NO: 7490 - protein, 298 aa, Unknown
  Obtained from environmental sample
  DOMAIN (146)...(187): PAC motif
  misc_feature (1)..(298): Xaa is any amino acid
MERIKTVVNVNEALKKEYLATHINNLNDFLNKNYEKNILIEKIIMTSLFVIAVIILFVLFIIYQRSLKIKDDLFGFKSAIENSDNSIVITDAQKNITYVNEVFEKETGYKKEDIIGKNPRILKSGEMSQSHYDRLNKLIDSGQKWEGEFINLRKDRSIFYEKASIIPIYKNDKLVNYLAIKLNITEYIEKKREIEFLAYHDALTSLPNRSSIEQHIEREMLLAKRNESRIAVLFIDLDRFKIINDTLGHDVGDEILIQSAKRIKESLRKSDMPARNGGDEFIGVLDNINDEYCACTIL

SEQ ID NO: 7491 - DNA, 579 bp, Unknown
  Obtained from environmental sample
  misc_feature (1)..(579): n is a, c, g, or t
gtgaaatccatgcgcactatatttatctcatttttaataatcttgcttttgcaaggttgtgcaaaaaacaactcctcatataacactcttcttatagataaactacatgaagaacaacaactgctctccaaagagatagctgaaataaaatcaaattattccgaagcaaatgccacaaaaaataacgaaatttatatactaaagctgaaaaaaagcatcgattttcatgaaaatatacttttacaattagtaagagatgtagaagatattaaaaatcaaaaaaagggaatagagaagaagagtgttaaaaaaccttttaaaaaagagataactagtgaagagagttcaaaaaaaggtttaatagataaatttcctgcttccacttttaaaacattagaaaattcacatatatatgatgacagtggtgaagttattgatagttgggctaataatgtatcttttacatcttatatgagcagaggtgatctatacttaattacaggatactttaaagagaaaaattgggttgcttcaaataggtctatgtggatcaaaaagagcagttgtgagatacgttaa

SEQ ID NO: 7492 - protein, 192 aa, Unknown
  Obtained from environmental sample
  SIGNAL (1)...(19)
  misc_feature (1)..(192): Xaa is any amino acid
MKSMRTIFISFLIILLLQGCAKNNSSYNTLLIDKLHEEQQLLSKEIAEIKSNYSEANATKNNEIYILKLKKSIDFHENILLQLVRDVEDIKNQKKGIEKKSVKKPFKKEITSEESSKKGLIDKFPASTFKTLENSHIYDDSGEVIDSWANNVSFTSYMSRGDLYLITGYFKEKNWVASNRSMWIKKSSCEIR

SEQ ID NO: 7493 - DNA, 558 bp, Unknown
  Obtained from environmental sample
  misc_feature (1)..(558): n is a, c, g, or t
ttgaaaccgaatagtccatattctgcaacaaaagccgcaggggatcttttagcactttcatattttacgacctatgacgttcctgtcacagttgtgagaagttccaacaatttcggaccatttcaatatcctgaaaaggcaatcccgcttttcattacaaatttacttacagagaaaaaaatcccactttacggagatgggggcaatgtcagagactggttgtatgttggagataattgcgcgggtattgatgttatcgctaattatggagaaaaaggaaaaatatataaccttggtggaaataattgtctgtcgaatcttgaattaacagcagcaatactttctaaacttgataaaggaaaagagtctatagaatttgtaaacgacaggcccggacatgacaggcggtatgctttaaattcagaaaaagctcgagagcttggttgggaaactggcagcacattcgaggcgcgattaaaagagaccatttcttggtataaagaaaacgtgtcttggtggaaatcgattaaagataatgcggaaattatagaatggtag

SEQ ID NO: 7494 - protein, 185 aa, Unknown
  Obtained from environmental sample
  DOMAIN (1)...(170): NAD dependent epimerase/dehydratase family
  misc_feature (1)..(185): Xaa is any amino acid
MKPNSPYSATKAAGDLLALSYFTTYDVPVTVVRSSNNFGPFQYPEKAIPLFITNLLTEKKIPLYGDGGNVRDWLYVGDNCAGIDVIANYGEKGKIYNLGGNNCLSNLELTAAILSKLDKGKESIEFVNDRPGHDRRYALNSEKARELGWETGSTFEARLKETISWYKENVSWWKSIKDNAEIIEW

SEQ ID NO: 7495 - DNA, 804 bp, Unknown
  Obtained from environmental sample
  misc_feature (1)..(804): n is a, c, g, or t
gtgtttgctgcccttaaattaatagaaaacaacattaaacccattgttattgaacgtggcaaatccattagagacagacgaagagatttagccaatatcactaaaaaccaaattgtaaaccctgaatctaactattgctttggcgaaggtggtgcaggaactttttctgatggtaaactttatactcgttctaccaaaagaggtgatgtaaaagaagtgttacaactcttggttcaacatggagctgacgaaaatattctgattgatgctcatccacatatcggcaccaacaaattacctaaagtggtagaagcgataagaaataccattttagaaaatggcggagaaattcattttgaaagtaaacttaccgacttactaatagaaaataacgccattaaaagtattgaaattaatggcgaaacaatcattaaaacttctaatgtaattctagctaccggtcattcagcaagagatattttttatttgttggataagaaaaaaattaagttagaagccaaaccttttgctattggggttcgagttgaacacccacaagagttgattgataaaattcaataccattgtgaaagtagaaatgagtacttacctcctgcttcatacaaattagttactcaggttaagaatcgaggtgttttctctttttgtatgtgtccgggtggaattatagccccttgtgctactgctccaggagaaatagttaccaacggttggtcaccatccaaaagaaataatccttttgctaactcaggaattgtggtagctgtagaagctgaagattaa

SEQ ID NO: 7496 - protein, 267 aa, Unknown
  Obtained from environmental sample
  misc_feature (1)..(267): Xaa is any amino acid
MFAALKLIENNIKPIVIERGKSIRDRRRDLANITKNQIVNPESNYCFGEGGAGTFSDGKLYTRSTKRGDVKEVLQLLVQHGADENILIDAHPHIGTNKLPKVVEAIRNTILENGGEIHFESKLTDLLIENNAIKSIEINGETIIKTSNVILATGHSARDIFYLLDKKKIKLEAKPFAIGVRVEHPQELIDKIQYHCESRNEYLPPASYKLVTQVKNRGVFSFCMCPGGIIAPCATAPGEIVTNGWSPSKRNNPFANSGIVVAVEAED

SEQ ID NO: 7497 - DNA, 495 bp, Unknown
  Obtained from environmental sample
  misc_feature (1)..(495): n is a, c, g, or t
gtggaagttgcaatggagatgaaaaaggatcgtggaacgcctgatactgatgttttctgggttgtttatgacagagaatctactgtcaagtacacgaataatctccatcaacaggcaatagacaaagcccaaaggaacaaaatcaatgtggcaatatccaatgtttgttttgaaatctggatacttcttcattttacaaattctgtagctcagtattcaaactgcgatgatttgctaaagaaaagtaaattgaaacaggaactgaaggaaataggctttaatgactatgataaagcgaacagtcatatttttgaacaagtactgacttctgtcaccaaagctaaggacagagcagagaaaatgaataatgccacaattagtggggcaaagtcaggcataacagagcaaaaaccatatttgctaaacccgtatacaactgtttataagctactcaacgcaattgatgattttatctgtcccaaaaaacattcatag

SEQ ID NO: 7498 - protein, 164 aa, Unknown
  Obtained from environmental sample
  misc_feature (1)..(164): Xaa is any amino acid
MEVAMEMKKDRGTPDTDVFWVVYDRESTVKYTNNLHQQAIDKAQRNKINVAISNVCFEIWILLHFTNSVAQYSNCDDLLKKSKLKQELKEIGFNDYDKANSHIFEQVLTSVTKAKDRAEKMNNATISGAKSGITEQKPYLLNPYTTVYKLLNAIDDFICPKKHS

SEQ ID NO: 7499 - DNA, 453 bp, Unknown
  Obtained from environmental sample
  misc_feature (1)..(453): n is a, c, g, or t
atgccaaggaacagaaaaaaatcgaataaaaagatgtcacctgttttccatattttctgcgaaggtgagaaaacagaaccagggtatctgaatgagtatctgaggaagtttttccgaaataatcctaattctcgcttcatcaaaatagaaaagactaagaagaacacacctaagcagcttgtggaagttgcaatggagatgaaaaaggatcgtggaacgcctgatactgatgttttctgggttgtttatgacagagaatctactgtcaagtacacgaataatctccatcaacaggcaatagacaaagcccaaaggaacaaaatcaatgtgggcatatccaatgtttgttttgaaatctggatacttcttcattttacaaattctgtacctcagtattcaaactgcgatgatttgctaaagaaaagtaaattgaaaacagnactgaagggaata

SEQ ID NO: 7500 - protein, 151 aa, Unknown
  Obtained from environmental sample
  misc_feature (1)..(151): Xaa is any amino acid
MPRNRKKSNKKMSPVFHIFCEGEKTEPGYLNEYLRKFFRNNPNSRFIKIEKTKKNTPKQLVEVAMEMKKDRGTPDTDVFWVVYDRESTVKYTNNLHQQAIDKAQRNKINVGISNVCFEIWILLHFTNSVPQYSNCDDLLKKSKLKTXLKGI

SEQ ID NO: 7501 - DNA, 567 bp, Unknown
  Obtained from environmental sample
  misc_feature (1)..(567): n is a, c, g, or t
gtggatttttttattggtttagaaaggagttttttaaaccccgttttccttttggtcaaggacaggttgggaaagaaatttttggccccaaggaaaaggaatgtttccctccctttcttcggggattgttttgaaataataaagggatttttgttttattgggacattccggaggtgggaaattcaactgcagcggttaatgatgaaaaaatattgccaaaatttctgtgtgatgatagaaatattttaattaaagaaaataaaaatggtgaatattttatgaaacatggagccaggggcagcttgaattttgtaaataatggatctgcgcctttgaagggaatcttttttttaaacaaatcatctaagaattgccttgaaccgttgaaaaacaaaacgcaaattgttgagaaattactctcgtatattatcaccccttttgttacaaaagactggtggaattatatgtttgatcttattgaacatattgcagacaatattccctgctggataatgcaatttgataaaagcggtgatattgtgaatgaaattgaggcggcagaataa

SEQ ID NO: 7502 - protein, 188 aa, Unknown
  Obtained from environmental sample
  misc_feature (1)..(188): Xaa is any amino acid
MDFFIGLERSFLNPVFLLVKDRLGKKFLAPRKRNVSLPFFGDCFEIIKGFLFYWDIPEVGNSTAAVNDEKILPKFLCDDRNILIKENKNGEYFMKHGARGSLNFVNNGSAPLKGIFFLNKSSKNCLEPLKNKTQIVEKLLSYIITPFVTKDWWNYMFDLIEHIADNIPCWIMQFDKSGDIVNEIEAAE

SEQ ID NO: 7503 - DNA, 546 bp, Unknown
  Obtained from environmental sample
  misc_feature (1)..(546): n is a, c, g, or t
ttgaaggtaaaaaatttaagagaagttgaatctcttaaaggagtagtaaacaatatacttcaagatataattgattcggcaaaaaataaaaaagcagttttatacgaagcaggagaatatttcttttttatcttggctccaacacttacaaaaactttcaagaatgaaagaacagcaatcgatgtcgcaagaataataaaaagtagtttagtaaattacaacaacaaagttgaaaagaaaatcgaattcggaatttcaataaatcacggaacaataatagctaagaaagaagacgaaggattgaaattcatgagtttgaagacttttgttccaaaagcaaaaaagatcgcaacaatgtctgaccaagaaattttattgactggagaaatgaatgatagattgttaacagttggtggagttagaacagataagattattagaagcggagtaaaattttatgtaataaaagaattgcgagatgcttctggagataaaacctttattagtggttttatgaaacgaatggaaaaagaaaagaaagaataa

SEQ ID NO: 7504 - protein, 181 aa, Unknown
  Obtained from environmental sample
  misc_feature (1)..(181): Xaa is any amino acid
MKVKNLREVESLKGVVNNILQDIIDSAKNKKAVLYEAGEYFFFILAPTLTKTFKNERTAIDVARIIKSSLVNYNNKVEKKIEFGISINHGTIIAKKEDEGLKFMSLKTFVPKAKKIATMSDQEILLTGEMNDRLLTVGGVRTDKIIRSGVKFYVIKELRDASGDKTFISGFMKRMEKEKKE

SEQ ID NO: 7505 - DNA, 321 bp, Unknown
  Obtained from environmental sample
  misc_feature (1)..(321): n is a, c, g, or t
atgaggagattaatattagcattaatgtgtgtgattctactaagttcatttgtagtagcagaagaaagttctgtatctataatcataaatcaacaaccaacaggaacttacaaccttggagattcttttacaattcctttgactttgaaaagtttaactganatagccggaaatttagagatggatttaatttgcggaggaaaagaaacaaatttctataaaaatggtgtgaaacttggtgcaggcgaagaacagcgaatgagtccagttcttgtattaacaaagaaaatatcgggttcacaaaaggaacttgcaaagtaa

SEQ ID NO: 7506 - protein, 106 aa, Unknown
  Obtained from environmental sample
  SIGNAL (1)...(19)
  misc_feature (1)..(106): Xaa is any amino acid
MRRLILALMCVILLSSFVVAEESSVSIIINQQPTGTYNLGDSFTIPLTLKSLTXIAGNLEMDLICGGKETNFYKNGVKLGAGEEQRMSPVLVLTKKISGSQKELAK

SEQ ID NO: 7507 - DNA, 393 bp, Unknown
  Obtained from environmental sample
  misc_feature (1)..(393): n is a, c, g, or t
gtggttcgtggtacagcaacagctacgggtttttattattcttcagatcgtaggcttaaaaaagatataaaagatttagaagtttctgcgatagaaaaagtattaagtttaaaaccagtagagtttaggtggaaaaagaacgatgagttaaattttggttttattgctcaagatatggagaaagttttccccgaacttgttaaggcggacgaaatagaaggaaagatgaaagcaattaattatgttggactaattgctcctatggtggaaactattcaagagcaacagaaaataattgaagtacaaaatgaaagaattaatgagttagaaagtttgtataatgatcaagaaaaaagaataaatttaattgaaaagcaattatatgaaaaataa

SEQ ID NO: 7508 - protein, 130 aa, Unknown
  Obtained from environmental sample
  misc_feature (1)..(130): Xaa is any amino acid
MVRGTATATGFYYSSDRRLKKDIKDLEVSAIEKVLSLKPVEFRWKKNDELNFGFIAQDMEKVFPELVKADEIEGKMKAINYVGLIAPMVETIQEQQKIIEVQNERINELESLYNDQEKRINLIEKQLYEK

SEQ ID NO: 7509 - DNA, 810 bp, Unknown
  Obtained from environmental sample
  misc_feature (1)..(810): n is a, c, g, or t
atgtatatagaaactactcgtaaaataaataaaacaggtaaacaagttgtaaagcatttattaagagaaagttatagagaagacaaaaaagtaaaaaaaagaactcttgctaatttatcagcttattctgaatcagagataattttaattaaacaaattttatctgtaaaacgtaacaaaaaagggaaaaatgttgattatttacttggagatattgaaacagaacaaggatattcaattggagcattttatcttttatctgaacttttatctgatttgggaatcgttaaagctcttggtaaaagcagaaatggaattttagcaatctttcaaataattttcagaattattcatcaagcatcacgaacctcttcaatgaggttagcaaattcatatccagttaaagaagttttaggattagaaaatattaaactagctgaactttataataatctagagtggctatatgaaaatcaagaaagaatagaaaagctgttatttgattttaaatataaggatggtaaggttcctgaaaacatatatctttatgatataacaagtagttattttgagggaacagaaaatgagttatctgcttttggttacaatagagataaaaagaaagggaaaaaacagatagttattggagctttaacagatcaaaatggttatttaatcagtattaaagtttttaaaggaaatactttagattttaaaacagtttcagaacaacttaatgatatagaaaatcgttttaatggggtttctatcacttttgtggagatagaggtatatctcgagccaatctga

SEQ ID NO: 7510 - protein, 269 aa, Unknown
  Obtained from environmental sample
  misc_feature (1)..(269): Xaa is any amino acid
MYIETTRKINKTGKQVVKHLLRESYREDKKVKKRTLANLSAYSESEIILIKQILSVKRNKKGKNVDYLLGDIETEQGYSIGAFYLLSELLSDLGIVKALGKSRNGILAIFQIIFRIIHQASRTSSMRLANSYPVKEVLGLENIKLAELYNNLEWLYENQERIEKLLFDFKYKDGKVPENIYLYDITSSYFEGTENELSAFGYNRDKKKGKKQIVIGALTDQNGYLISIKVFKGNTLDFKTVSEQLNDIENRFNGVSITFVEIEVYLEPI

SEQ ID NO: 7511 - DNA, 477 bp, Unknown
  Obtained from environmental sample
  misc_feature (1)..(477): n is a, c, g, or t
atgtcaaaatttagaaaaaaaggtaaaaaaagtcagcctgctgttaatacagctgcacttcctgatatcgtttttatgttgcttttcttctttatggtaaccactactatgagagaaactactttaaaagtggaaaataaaattccatttgcaactgaaatagaaaagttagaaagaaaatcattggtaagttatatttatattggtaaaccaattaaagaacttcaaccagtttttggtacagcaccaagaatccagttaaatgatgcttttaaaaccaaagaagacatctttcagtttgtagaaatggaaagagatgaaagagatgaagccgaaagaaatttgattacttggtctttaaaagtagatcaaaaaacagaaatgggtatagttacagatgtaaagcaagaacttataaaagctaatgctttaaagattaactactcaactaagaaaacagacaagatacttaattaa

SEQ ID NO: 7512 - protein, 158 aa, Unknown
  Obtained from environmental sample
  misc_feature (1)..(158): Xaa is any amino acid
MSKFRKKGKKSQPAVNTAALPDIVFMLLFFFMVTTTMRETTLKVENKIPFATEIEKLERKSLVSYIYIGKPIKELQPVFGTAPRIQLNDAFKTKEDIFQFVEMERDERDEAERNLITWSLKVDQKTEMGIVTDVKQELIKANALKINYSTKKTDKILN

SEQ ID NO: 7513 - DNA, 384 bp, Unknown
  Obtained from environmental sample
  misc_feature (1)..(384): n is a, c, g, or t
ttgacctttgctccaaattgtagagtaaaaattgactttaggccgtttatccatattgaaggagtatcagcaaaagattttagaagtcaacgagtaaatattcctgactttaatgcagtaatatttacaagtagaaatgcagtagattattgctttaaaacagctgaagagataaggtataatgtgccggagtcactaaaatatttttgtatatctgaggcaattgctttttatcttcaaaagtatattgtttatagaaaaagaaaagtatttactggtaaacaaacttttcaggacttaatgcctcttttgaaaaaaagtaaagattgtaagtttttattgccttgctcagacattattagtccgaacataaaagacacgtga

SEQ ID NO: 7514 - protein, 127 aa, Unknown
  Obtained from environmental sample
  misc_feature (1)..(127): Xaa is any amino acid
MTFAPNCRVKIDFRPFIHIEGVSAKDFRSQRVNIPDFNAVIFTSRNAVDYCFKTAEEIRYNVPESLKYFCISEAIAFYLQKYIVYRKRKVFTGKQTFQDLMPLLKKSKDCKFLLPCSDIISPNIKDT

SEQ ID NO: 7515 - DNA, 882 bp, Unknown
  Obtained from environmental sample
  misc_feature (1)..(882): n is a, c, g, or t
atggagaacttttatcaagagataggacgagctggaagagatggacttgattctcatacactattactttatacaaaagcagaccaaataagtaagttagcacaaatagatgatagtattagtggtgagtatagaactgtattagaagataaattacaaaaaatctatcagtttagtgcttcaactggctgtcgtcatcaaattattgcaaaatattttgatgatgcaatagagccatgtaaaacaatgtgtgataactgtactaaagagaaagttgaacaattagatataagtgtagaggcgcaaaaatttttatcagctgtttataggtcaaatcaaagttttggacaaaatcatattatagatatattacgaggttcaaataatcaaaaagtatttcagtttaatcacaatgagttaagtgtttacggtataggaaaaagcaaaagtaaaaatgagtggaatgctatagttgatagactttttgatattgaagccattgaagttggtgagtatagagctattaagattacaccttatggtatggaagttttaaaagggaaagataaagtagttatagatagtgataaaataggaagagttgaagaggttaaggaggatactccactctctaaagaatattctcagttttttgaacaatttagaagtttaagaacagcaattgctaaggaggagcaggttgctccatatattgtatttagcgataaggtcttagtagagttaagtgataagctccctcaaacaaaagaggattttctttctataaatggggtaggggaagtaaagtatgaaaaatatggagaggagtttttaaacctttgtatagagtgcaaacccagtcaaaagaaaaagcttttctaa

SEQ ID NO: 7516 - protein, 293 aa, Unknown
  Obtained from environmental sample
  DOMAIN (212)...(289): HRDC domain
  misc_feature (1)..(293): Xaa is any amino acid
MENFYQEIGRAGRDGLDSHTLLLYTKADQISKLAQIDDSISGEYRTVLEDKLQKIYQFSASTGCRHQIIAKYFDDAIEPCKTMCDNCTKEKVEQLDISVEAQKFLSAVYRSNQSFGQNHIIDILRGSNNQKVFQFNHNELSVYGIGKSKSKNEWNAIVDRLFDIEAIEVGEYRAIKITPYGMEVLKGKDKVVIDSDKIGRVEEVKEDTPLSKEYSQFFEQFRSLRTAIAKEEQVAPYIVFSDKVLVELSDKLPQTKEDFLSINGVGEVKYEKYGEEFLNLCIECKPSQKKKLF

SEQ ID NO: 7517 - DNA, 678 bp, Unknown
  Obtained from environmental sample
  misc_feature (1)..(678): n is a, c, g, or t
ttggaagaaaactcaatcaatgaatcagggaaggtctttgctcaggtaaagattatatatattgaccccctacctataaagtttgcgaacgaagagagacaagagctattcataaataaagtaaatctaatgcttgtggattctgaaggttttggaagaaggtcaagtaaatttcaaaaatacatccaatctcaatatccaatagaaaaactatctaagaagctccaaaaatggtacgacttagagtttggcgattttataaaagaactaaacaaagccaataaggccatcaaggggacatgtccccttggcagatctcttgacaaatcccttgacaaatcccttgacaaaactcttgacaaatcccttgacaaatcccttgacaaaactcttgacaaatcccttgacaaatcccttgacaaaactcttgacaaatcctttgacaatactcttgacaaatcccttggcaaaactcttgacaaaactcttgacaaagcccttggcagaccccttgacaaaaaagaggagtttgaatggatggaactttttgaagagaaaaaagcagaagcacaaaaattaaaagctgaaattgataaaaccgataaggaaatagatcaaatggtttatgagctttatggcttaacagatgaggaaatacaaatagtagaaacggcctag

SEQ ID NO: 7518 - protein, 225 aa, Unknown
  Obtained from environmental sample
  misc_feature (1)..(225): Xaa is any amino acid
MEENSINESGKVFAQVKIIYIDPLPIKFANEERQELFINKVNLMLVDSEGFGRRSSKFQKYIQSQYPIEKLSKKLQKWYDLEFGDFIKELNKANKAIKGTCPLGRSLDKSLDKSLDKTLDKSLDKSLDKTLDKSLDKSLDKTLDKSFDNTLDKSLGKTLDKTLDKALGRPLDKKEEFEWMELFEEKKAEAQKLKAEIDKTDKEIDQMVYELYGLTDEEIQIVETA

SEQ ID NO: 7519 - DNA, 969 bp, Unknown
  Obtained from environmental sample
  misc_feature (1)..(969): n is a, c, g, or t
ttgaattgccaactctcactttggttgcgaactgcacaaccccgacgaaagctgaataatttaagtagcaatataaagtgtggtaactcccttatcgatagcaaagccgttgcaggcgataaagcttttaaatgggaagacgagtttgctcatatttttaaagaaaaagataaaagagcatttcatataactacggctacgcataattcgagatattcgcaacgcatgttcgataatcatgtaaaactagacgaagcagtatatatcgacgaaaaagacgaaatagtaataacagaaacgatagccgaaatagtaaaaaaagataatctgaatgtaatagagtataatatatgtggcgatcatatgcacttgctactggtatgtgatgaaaatgaactgactaaaatagtagggaaaataaaagcgatgagctctcgtgctgcgaatattgctgcgggaagaactatccctgaaagcaaaacaaggggacatgtccccttatccagtaccggaaagaaaaaatataattccctatggacgcaaaaattcgggaaaagcgaaataaaagatgagaactatctaaataatgcgatagagtatatacggaacaaccgaataaaacacgaactacctaaaagtaaaggaatagaaaaactaaaaaaggaatttatatgctctaaagaacatgcctttcgtaaagaagttagtggtggtttcgatgtggtgattgggaatccgccttatgttcctactgaatttatttcagaagaagataaagtctatttagaaaagacatatgattcggcttttgggcgaataaatttatatcctgtattttatgagaagggaattaaaatattaaaaaataaaggattattgtcgttcataacaccatatacgattctcaaaaataaatattataaggaagccagaagatccatttttgaaatactcctattgatgcattaa

SEQ ID NO: 7520 - protein, 322 aa, Unknown
  Obtained from environmental sample
  misc_feature (1)..(322): Xaa is any amino acid
MNCQLSLWLRTAQPRRKLNNLSSNIKCGNSLIDSKAVAGDKAFKWEDEFAHIFKEKDKRAFHITTATHNSRYSQRMFDNHVKLDEAVYIDEKDEIVITETIAEIVKKDNLNVIEYNICGDHMHLLLVCDENELTKIVGKIKAMSSRAANIAAGRTIPESKTRGHVPLSSTGKKKYNSLWTQKFGKSEIKDENYLNNAIEYIRNNRIKHELPKSKGIEKLKKEFICSKEHAFRKEVSGGFDVVIGNPPYVPTEFISEEDKVYLEKTYDSAFGRINLYPVFYEKGIKILKNKGLLSFITPYTILKNKYYKEARRSIFEILLLMH

SEQ ID NO: 7521 - DNA, 426 bp, Unknown
  Obtained from environmental sample
  misc_feature (1)..(426): n is a, c, g, or t
atgtataaaaaagtattcttagatgcaaatatatttatagataaagaagatgaaactagagatttagacaataatagtttaaaagttttatcctctctacttagcaatgatgtggaactttttacaagttgtgatttaataactactatttactatatactcgcaaaaaaagataaacaaaaagctcttgaagcaattgaaaatataaataaaatctgcaaaattatagattttacaaatattgaagtgaatcaaacttgcgcacttatgaaagaaaatccaaaatttaaagaccttgaagatacgattcaatatatcttagctaaaaaagaaaggtgcgagttgattatctcaaatgataaagagtttgctagtgatgagatagagttagtaacgactaaagagtttttagaaaaaatcagttaa

SEQ ID NO: 7522 - protein, 141 aa, Unknown
  Obtained from environmental sample
  DOMAIN (5)...(133): PIN domain
  misc_feature (1)..(141): Xaa is any amino acid
MYKKVFLDANIFIDKEDETRDLDNNSLKVLSSLLSNDVELFTSCDLITTIYYILAKKDKQKALEAIENINKICKIIDFTNIEVNQTCALMKENPKFKDLEDTIQYILAKKERCELIISNDKEFASDEIELVTTKEFLEKIS

SEQ ID NO: 7523 - DNA, 837 bp, Unknown
  Obtained from environmental sample
  misc_feature (1)..(837): n is a, c, g, or t
atgcaagttgaaaaagttgaagatgataccattgacttaaaactaataaaaaagcttgatactcaacaatctaaaaaattatctcgtttatatcttcaagaaaacggtttaaaatcaggaactataaattatattttaaataacaataaaccactttacaaatatgttacctcaatcctaaataagaaagataaaaatattggaaagcaaatgaaaacaaaaaatataatgctctatggtgctcctggggttggtaaaactcataactacaaaagattaatctctatgattgaaaatggagataatgaaaaaactatatttgatactatttcaaataatgatacgacagaaggatttaatgacacaacctttgaaactataaaaaatgaaaaaagaatagagtttgtaacttttcatcaaagctactcttatgaagattttattgagggatttagaccaaatgaaaatggagatattgaacttgataaaaaaggtggtatctttaaacgaattgcagataaagcaaaagcgaatttagaagaatcaaaaaaagaaactcctgaattaaaaacagagataacatttcagcaaaagttagataaatttattgagaaacttgaaaatgaaatagaaactaatggatactatcaaataacagatgctgcttatattagtagtattgataatgatgcctttagatataatattagaagagaaaatccaacttataaatatgatttaagaatgaagtttgaagatttatttgaatttgaaaaaaataaagtatcttctagacaagatataaagaaacttgaaacaatctcgagccgattctga

SEQ ID NO: 7524 - protein, 278 aa, Unknown
  Obtained from environmental sample
  misc_feature (1)..(278): Xaa is any amino acid
MQVEKVEDDTIDLKLIKKLDTQQSKKLSRLYLQENGLKSGTINYILNNNKPLYKYVTSILNKKDKNIGKQMKTKNIMLYGAPGVGKTHNYKRLISMIENGDNEKTIFDTISNNDTTEGFNDTTFETIKNEKRIEFVTFHQSYSYEDFIEGFRPNENGDIELDKKGGIFKRIADKAKANLEESKKETPELKTEITFQQKLDKFIEKLENEIETNGYYQITDAAYISSIDNDAFRYNIRRENPTYKYDLRMKFEDLFEFEKNKVSSRQDIKKLETISSRF

SEQ ID NO: 7525 - DNA, 969 bp, Unknown
  Obtained from environmental sample
  misc_feature (1)..(969): n is a, c, g, or t
atggacgctcaatctactgatattgaaatctactccaaagaggttttaaatgctttaatagctgataacctccctccaactccaaataatttttcactctactttgatagacttttagaagataagagtgaaaaccttcgtaaacagattcttgcacttcttgaactagaagaggcaaatagtgatgagaatacaatagcgttagagcagagtttgaaaaaaggctttgtttcgatgaaaagtatgttgggtgctactgccagcttgtacaaaaatatgtctttgatgactaaaattttagaaaaaagaaaaaaagagttagaagcacaaccaaaaactgaagaagtgatgagtattgttcatgctttagagggtgatgtatctaagttgaactctatagtaaaaacgcaaagctcccagatgaaaggtatctacgatgatactgctgcaatagttaaaaatgtagagaatgaaacaatctttgataatcaatttggaatctataataaacgatatcttttaacaaaaatagagcaagaggtaggtctgataaaagagtttggacataagagctctctaattatgatagaactctcacgtgatctaagaaaaagcattaaaagtgataaagcgatacttcttatgacaagaactatcgcgagacttcttcttaagacatcaagaagaagtgatattgttgctcactatggaaatggtgttttctcaatgcttctgcaacatacagatattgagagtgctaaaaaagcaagtgaaagactttgtgatctggtttcaaactcaaacttctttttagcagatcgtgagattcagctaaaaatatctataggggttacaaaccttgactctctgcactcagtagaagagatagtagtaagtgctatagatgggatagagaaagcttatgagaagaagaatatagactttgcagtattcactgagaaccaataa

SEQ ID NO: 7526 - protein, 322 aa, Unknown
  Obtained from environmental sample
  DOMAIN (155)...(313): GGDEF domain
  misc_feature (1)..(322): Xaa is any amino acid
MDAQSTDIEIYSKEVLNALIADNLPPTPNNFSLYFDRLLEDKSENLRKQILALLELEEANSDENTIALEQSLKKGFVSMKSMLGATASLYKNMSLMTKILEKRKKELEAQPKTEEVMSIVHALEGDVSKLNSIVKTQSSQMKGIYDDTAAIVKNVENETIFDNQFGIYNKRYLLTKIEQEVGLIKEFGHKSSLIMIELSRDLRKSIKSDKAILLMTRTIARLLLKTSRRSDIVAHYGNGVFSMLLQHTDIESAKKASERLCDLVSNSNFFLADREIQLKISIGVTNLDSLHSVEEIVVSAIDGIEKAYEKKNIDFAVFTENQ

SEQ ID NO: 7527 - DNA, 441 bp, Unknown
  Obtained from environmental sample
  misc_feature (1)..(441): n is a, c, g, or t
gtgattaatactctagttacaactaatatagaaataccaaaaatattagaatcttatttaatgagggagacgcttgcaaaatatagactacttcctaaaattttacaaacattagagttatattttgaaggtgatatcgcaattatatatcaaaaacaagagtggctagatattacaggagctacttttaatgagtgtgatgaagtagttaatgagatattaaaaatagcgatagtaaaaatagctatttatttacgcgaagataacaataatataagaatatctttacgagggaaagatgatattaagatagatttatccaaagttgcaaatacactcaatggtggtggtcacaaaaatgcagcaggagctacactctcaggtgtgagtatccaacaagctactacgagattattagatactttcaaaaattacatttag

SEQ ID NO: 7528 - protein, 146 aa, Unknown
  Obtained from environmental sample
  DOMAIN (79)...(140): DHHA1 domain
  misc_feature (1)..(146): Xaa is any amino acid
MINTLVTTNIEIPKILESYLMRETLAKYRLLPKILQTLELYFEGDIAIIYQKQEWLDITGATFNECDEVVNEILKIAIVKIAIYLREDNNNIRISLRGKDDIKIDLSKVANTLNGGGHKNAAGATLSGVSIQQATTRLLDTFKNYI

SEQ ID NO: 7529 - DNA, 915 bp, Unknown
  Obtained from environmental sample
  misc_feature (1)..(915): n is a, c, g, or t
gtggctgggcgattttgtactgctattgcatttaataaaagtggttcttgggttgccactggtagctatgacagtaaagtcagagtgacaaacatatacgcagcaaataaaacagttgatttagtcggtggtcatacgggatatgttaaatttattaactttatctcagacaatagattagttaccattgataaaaatggtggtgcggttgtttgggactatgttaatggaaaaatgataaaacagctaaagggaattgactctgatcctacatctgttacatttatttatgatgacaactttatgcttgtctctactatactaaaaacaattgctctttttaatctaaagaactatgaatatttgacaagaaacttcatcaaagttggtgatgttgttacagatttcagttacctacctgaactagaactattagtagttgcaacagctttaaatgatttgagaacttacgatcttaaatcagatgagagtattttacaacagctggttattgagaaaaattttgtccaggcatataaacttttggatgaaaatccaacactatatatttcacctatttataaaactttagaagccatatgggataaaatttacaaagaagcttatgtacagttagagaaattaaatattcaaggtgctaaagatctatttgaaccatataaaggtatccctgcgaaaacaaactatatacaaaatttactgaacgattttgcagaatttcaaaaatttgtaaactttgtagagacaaaaaagtttgcattagcatatcagcttgcatttaaatatccaacatacaaagagtcaaaatattacactgttatggaagaagagtggaatacacaaatggataaagtcaaagtacttattacaaacatggagattctacagaactag

SEQ ID NO: 7530 - protein, 304 aa, Unknown
  Obtained from environmental sample
  misc_feature (1)..(304): Xaa is any amino acid
MAGRFCTAIAFNKSGSWVATGSYDSKVRVTNIYAANKTVDLVGGHTGYVKFINFISDNRLVTIDKNGGAVVWDYVNGKMIKQLKGIDSDPTSVTFIYDDNFMLVSTILKTIALFNLKNYEYLTRNFIKVGDVVTDFSYLPELELLVVATALNDLRTYDLKSDESILQQLVIEKNFVQAYKLLDENPTLYISPIYKTLEAIWDKIYKEAYVQLEKLNIQGAKDLFEPYKGIPAKTNYIQNLLNDFAEFQKFVNFVETKKFALAYQLAFKYPTYKESKYYTVMEEEWNTQMDKVKVLITNMEILQN

SEQ ID NO: 7531 - DNA, 711 bp, Unknown
  Obtained from environmental sample
  misc_feature (1)..(711): n is a, c, g, or t
atgaaagacaaagacttagcaattgtttttaaatttatagttcaatatccatttctaaaagagttagatgactactataaattagaacaaatggaagctattttatatgataaagcagttgcatcatcaataacaaaaaactatgcaacaacaagaaaacttgccaaagagttattagactttccaaatttcaaagaagaggccaaacatatatatgaaaatgtttctaagacaatcctttttatgaaacacttcaaagctaaagactacactaagatgctagaggtgattgaaaaagcaccattcttagaagatacaaaagagtttatctcatttaataaaacatggcttgaagctctctcaaatgctgaaaaatacgctgcaaaaggtgttattagcggtattttagactcttttaaagagtttattgatattgaagagagaataaataaaattggatcgataatatctatggtatatctgcaacagctgaagatgatatctaaaaagtatcatccaaagcctaaattgattctaaaattcataaacagatatatagatatatttggcaatgatgactccatagactctttgttaaaatataacgagacggagtactctatcgcttatgataaatcagagatcaaccagttagagccaagcttcaaaagatggagagagatagaattacctgaaaaaatatatgaataa

SEQ ID NO: 7532 - protein, 236 aa, Unknown
  Obtained from environmental sample
  misc_feature (1)..(236): Xaa is any amino acid
MKDKDLAIVFKFIVQYPFLKELDDYYKLEQMEAILYDKAVASSITKNYATTRKLAKELLDFPNFKEEAKHIYENVSKTILFMKHFKAKDYTKMLEVIEKAPFLEDTKEFISFNKTWLEALSNAEKYAAKGVISGILDSFKEFIDIEERINKIGSIISMVYLQQLKMISKKYHPKPKLILKFINRYIDIFGNDDSIDSLLKYNETEYSIAYDKSEINQLEPSFKRWREIELPEKIYE

SEQ ID NO: 7533 - DNA, 807 bp, Unknown
  Obtained from environmental sample
  misc_feature (1)..(807): n is a, c, g, or t
ttgcacgtatttctgctgagggtgtcattaaaggaagataaagtgaagataaatacaataatcaaaagtgctatcagccgtcttaacagagagggtaaacttattactccggagtactatgcagaggctttttgtatagaggctaagaaacagggtgtaatgactgatgattgctctcaacttgaaaaaaatctaaatgctttagataaaagatatcaagatgagataaagcagtataatctgaaaacttcaaatgaactgatgcgttttttagtctccaaactaaatcgcatggaacctaaaagatgcacacaaacccttgatgttcaaacaaaactgacaaaagcaatactagaagctacaaaaattcttcataataaaaatgcctcatcattagcatcaaaaactattgctcaattagatgataatattatgattgaacagtatgagcagatacgtcaagcatggcttaattttacggcagtttatgatgactcttttttagaaaaacttgaaccctatacaaaactcaacttttcagatttagaagagacgctaaacagttttgaacatgtagcatcaccaagagaagcaattgttgaactgagctctgttgtagaggtaattacagcatcactactgccttccatcgcaccatcaatcaatgatgagatctctactctgggagtaaatctaaagagtgatccgaaaacccttttagatccagatattcagtttcagataaaacatgcaatatcactgcgcatcccactagataaaaccacctttaaaaagatggtaattccc

SEQ ID NO: 7534 - protein, 269 aa, Unknown
  Obtained from environmental sample
  misc_feature (1)..(269): Xaa is any amino acid
MHVFLLRVSLKEDKVKINTIIKSAISRLNREGKLITPEYYAEAFCIEAKKQGVMTDDCSQLEKNLNALDKRYQDEIKQYNLKTSNELMRFLVSKLNRMEPKRCTQTLDVQTKLTKAILEATKILHNKNASSLASKTIAQLDDNIMIEQYEQIRQAWLNFTAVYDDSFLEKLEPYTKLNFSDLEETLNSFEHVASPREAIVELSSVVEVITASLLPSIAPSINDEISTLGVNLKSDPKTLLDPDIQFQIKHAISLRIPLDKTTFKKMVIP

SEQ ID NO: 7535 - DNA, 360 bp, Unknown
  Obtained from environmental sample
  misc_feature (1)..(360): n is a, c, g, or t
atgcagttagagacatttttagagagcaaaccactcttttacgacaagatagattatgatcgttttccaaaagcttatgagagtattaaaaatttattacatattccgagagtcgtccatttagtcggtacaaatggtaagggaagtacaggtagattcttggcacaacttttaaaaagtaactcttttaaagtcggacactacagctctccacatatacttaaatttaacgaacgcatatggttaaatggttcagacatatcagataaagctcttgaaaattcacataaagaacttttgaaaattctaaagccagagattgttgaggcacttagctattttgagtacactactctttag

SEQ ID NO: 7536 - protein, 119 aa, Unknown
  Obtained from environmental sample
  misc_feature (1)..(119): Xaa is any amino acid
MQLETFLESKPLFYDKIDYDRFPKAYESIKNLLHIPRVVHLVGTNGKGSTGRFLAQLLKSNSFKVGHYSSPHILKFNERIWLNGSDISDKALENSHKELLKILKPEIVEALSYFEYTTL

SEQ ID NO: 7537 - DNA, 792 bp, Unknown
  Obtained from environmental sample
  misc_feature (1)..(792): n is a, c, g, or t
ttgggtcctacatcaaaacttattaatgagcttgttaaatctatggaaacagctattaagagtgatgatggatttgataaagagttaagacgtcttgagtataaacttccacttttcaatgatactttaagagaaaaccatgaaaagcttataatacaaatttgtgatatcaacaaagatcaaatatcaaatatggttccagaagctaccatggttagtacatacatggagattaaaaaacttttccaaacaaaagaggcttcaaaagatagtttcaacatggaaccagaacagttgtatgccattttagaacagataaaacgtggtaaagcgatctctgaaatagcaaaaactcgtatggcaaagagtaatttacgtcttgttgtatcgattgcaaaacgttatacaaatagaggcttacctttccttgatcttattcaagaaggtaacattggtcttatgaaagctgttgataaatttgagtaccaaaaaggttataaattttcaacttatgctacatggtggattcgtcaggcaatcagtcgtgctattgccgatcaagctagaacgatccgtattcctattcatatgattgagactattaaccgtattaataaaatcatgcgtaaacatcttcaagagcatggtaaagagccagatgttgagacaattgcattagaagttgaactctctgttgagaaagtaaaaatgttatttagattacaaaagagcctatatcttttagaagcccctatcggtagtgaagaggatggtcgtttggtgattttatga

SEQ ID NO: 7538 - protein, 263 aa, Unknown
  Obtained from environmental sample
  DOMAIN (120)...(190): Sigma-70 region 2
  misc_feature (1)..(263): Xaa is any amino acid
MGPTSKLINELVKSMETAIKSDDGFDKELRRLEYKLPLFNDTLRENHEKLIIQICDINKDQISNMVPEATMVSTYMEIKKLFQTKEASKDSFNMEPEQLYAILEQIKRGKAISEIAKTRMAKSNLRLVVSIAKRYTNRGLPFLDLIQEGNIGLMKAVDKFEYQKGYKFSTYATWWIRQAISRAIADQARTIRIPIHMIETINRINKIMRKHLQEHGKEPDVETIALEVELSVEKVKMLFRLQKSLYLLEAPIGSEEDGRLVIL

SEQ ID NO: 7539 - DNA, 612 bp, Unknown
  Obtained from environmental sample
  misc_feature (1)..(612): n is a, c, g, or t
atgagcttactcaatatttttgttgtaaatgagttgagcggtatctacattgatgtgacaaaagatagactatattgtgatggcttaaacgctgaacaccgccgttcatctcaaagtgctatggctatgattactaaaactatgttgacacttgttgcaccgattntgacatatactgctgatgagattgttgaagttgctcctacagtgattaaaggtgataaaaaagatatttttgagtatgtttacgagccattagaaaaaatagagttaaatttcaatgaagagtacatgattaaagcaagagatgctttttatgagatcgttgactctttgaaaaaagagaaaaaaataaaaagtacgttagaacttaatattgttacaagttctgaaattttgtcaaaaattgatccgcttgaggtggaagattggtttgttatatctactattagcagtgatgactctgtagaggagttagctaactttaaagtagagggagatgagtttataattacactttcaactagtcataaatgtcctagatgttggaaatttcatgcccaaagtgaagatagtacgtgtaaacgttgtggagatgtactaagtgcctga

SEQ ID NO: 7540 - protein, 203 aa, Unknown
  Obtained from environmental sample
  misc_feature (1)..(203): Xaa is any amino acid
MSLLNIFVVNELSGIYIDVTKDRLYCDGLNAEHRRSSQSAMAMITKTMLTLVAPIXTYTADEIVEVAPTVIKGDKKDIFEYVYEPLEKIELNFNEEYMIKARDAFYEIVDSLKKEKKIKSTLELNIVTSSEILSKIDPLEVEDWFVISTISSDDSVEELANFKVEGDEFIITLSTSHKCPRCWKFHAQSEDSTCKRCGDVLSA

SEQ ID NO: 7541 - DNA, 867 bp, Unknown
  Obtained from environmental sample
  misc_feature (1)..(867): n is a, c, g, or t
ttgnnnnnggtttatggctggggactgagccagcgcagtgcattggaaaatttagcctctcgcatctctgttaaaatctcttcagagatcgaactacatgaggagtcatacagagattttcgtgagtatgtaacaaaaaactcatctcagagcataaaaagcgaagttgaaaagattgctatcttaggttatgagactattcagagccaagagctttcatatagtcgtttggctcttcttattagagtacaaaaacgtaatgtagtagattcgatgagaggcgaagttgagagagtccatgaaagaatagtagagaaaaaccttatagtaaataactctaatccactctcaaaatacaccttttacaaagagtcgattaactcacttcaaaatgctataccaaaacttactcttcttaaaactttagatttcagttttgatgaggctccatattttgagagtttatcgaagatgcagtgtaatttagagagattaaaaaactccatgacattctccataaacacaaataaaaaatcacgtcttttttcaaatatcataggtacaactctacatagagatggatttaaaattgttgaagatggtatcgagtcgccatcaaatcttaaaatagaaattgaactggatattgttcctactaatccttatggaattaatattgccatgattgcactcacactaaaaatagttgataataatttaaaaagtttaggtgggagtagctttcagataaaaggcgcatcatcgcaaggttacgaagctgcggtgcaaaatggtgctaaaaagttcggtgatcttttaaaaaatgaagatataaatatattgtttggagtagatagaggcagatag

SEQ ID NO: 7542 - protein, 288 aa, Unknown
  Obtained from environmental sample
  misc_feature (1)..(288): Xaa is any amino acid
MXXVYGWGLSQRSALENLASRISVKISSEIELHEESYRDFREYVTKNSSQSIKSEVEKIAILGYETIQSQELSYSRLALLIRVQKRNVVDSMRGEVERVHERIVEKNLIVNNSNPLSKYTFYKESINSLQNAIPKLTLLKTLDFSFDEAPYFESLSKMQCNLERLKNSMTFSINTNKKSRLFSNIIGTTLHRDGFKIVEDGIESPSNLKIEIELDIVPTNPYGINIAMIALTLKIVDNNLKSLGGSSFQIKGASSQGYEAAVQNGAKKFGDLLKNEDINILFGVDRGR

SEQ ID NO: 7543 - DNA, 333 bp, Unknown
  Obtained from environmental sample
  misc_feature (1)..(333): n is a, c, g, or t
atgttaattaaaaatattgtgattttaagttttttatttgtgctatttgcacaaggggcagagaaaaaagtatcaatacaattattatggaaacatcagtttgaatttgctggatattatatggcaaaagagaaaggtttttataaagatgcaggacttgatgtagagataaaagagtataattttggaactaatattgctcaagatgtaagtactggaattagtgattttggagttgatagctcatcactaattttagataaaaattcaggattggatgtttatttattaatgccattnatgcaaaaatctccttttgtattaatggcntaa

SEQ ID NO: 7544 - protein, 110 aa, Unknown
  Obtained from environmental sample
  SIGNAL (1)...(19)
  misc_feature (1)..(110): Xaa is any amino acid
MLIKNIVILSFLFVLFAQGAEKKVSIQLLWKHQFEFAGYYMAKEKGFYKDAGLDVEIKEYNFGTNIAQDVSTGISDFGVDSSSLILDKNSGLDVYLLMPXMQKSPFVLMA

SEQ ID NO: 7545 - DNA, 381 bp, Unknown
  Obtained from environmental sample
  misc_feature (1)..(381): n is a, c, g, or t
atgccgttaaggaaggatctaataatggatttcaacaccctgaaaagctacctgctggaaaagtccggtgctgttgaggagtttccttttgatgctgtcactctggtgctcaaagtcagcggcaagatgttcgctctggtcggtataaacgatgatccgctacgcttgaaccttaagtgtgatccgggtaaagctgagattttgcgtgaaatcaacccagctatcctgccggggtaccatatgaataagcgccactggaacactgtccttctcgatggctctcttgccgacaccgagattcagtcgatgattgatgactcctatgctctggtggttaaaggattacctaaaaccaagcgaccaattgactcggtctgctga

SEQ ID NO: 7546 - protein, 126 aa, Unknown
  Obtained from environmental sample
  DOMAIN (18)...(112): Protein of unknown function (DUF419)
  misc_feature (1)..(126): Xaa is any amino acid
MPLRKDLIMDFNTLKSYLLEKSGAVEEFPFDAVTLVLKVSGKMFALVGINDDPLRLNLKCDPGKAEILREINPAILPGYHMNKRHWNTVLLDGSLADTEIQSMIDDSYALVVKGLPKTKRPIDSVC

SEQ ID NO: 7547 - DNA, 603 bp, Unknown
  Obtained from environmental sample
  misc_feature (1)..(603): n is a, c, g, or t
atggatgatgagtttatagaggagtttgcaactaatcctaaaatttgtaaatctatgcacatgccgcttcaaagtggatctagtgaaattttaaaacagatgaagagaggttatacaaaagagaacttcttaaacagagtaaaaatacttcgttctaaaattccaaatgtatctatctctacagatgtaattgtcgcttttcctggtgaaagtgataaagattttgaagatacaatggatgttgtaaatagtgtaaaatttgatcaaatgtttagttttaaatattcacctcgtcctcttacggaagctgctaagtataccaacatcgttgaaccagaagttgcttctcaaagacttacagcactccaaaacagacaagatgagataacagatgaaattacatcttctttactatcccaagtacacaaagtatattttgaagagcttagaagtgaaggttatgttgcaggaagaagtgataataatatctctattaaagtcaaaggaagtgaagaacttttaggacaaattttagatgttaaaataacaaagattgcacgttcatctcaaataggagagctcgtaggagaggagggtgcgtaa

SEQ ID NO: 7548 - protein, 200 aa, Unknown
  Obtained from environmental sample
  DOMAIN (135)...(196): TRAM domain
  misc_feature (1)..(200): Xaa is any amino acid
MDDEFIEEFATNPKICKSMHMPLQSGSSEILKQMKRGYTKENFLNRVKILRSKIPNVSISTDVIVAFPGESDKDFEDTMDVVNSVKFDQMFSFKYSPRPLTEAAKYTNIVEPEVASQRLTALQNRQDEITDEITSSLLSQVHKVYFEELRSEGYVAGRSDNNISIKVKGSEELLGQILDVKITKIARSSQIGELVGEEGA

SEQ ID NO: 7549 - DNA, 510 bp, Unknown
  Obtained from environmental sample
  misc_feature (1)..(510): n is a, c, g, or t
gtgcgtaaaaaaattttacgcgccctctcacttatatttcttccactcataggctctttgcttatacgttttatctacttaacttcaataaaaagatttcatctgcctgaaaatatttctaatgaaccatttattgctgcactatggcatggagatcttcttttacaagcttttccttatcacaagatccgtaaaactcctagaattaaacttataatcagtgatcattttgatgggaaaatcatctcaaaagtcatgcattttttcagttttgatacaatacatggctctagtaacagaaatgcggcaagggtgctaatacaggcgatcaaatcacttaaaaatggatatgatatcggtatgactccggatggtccaaaaggaccaagacgtgaagttgctgatggaattgtagtcatgtcacaaaaaacaaaaagtgacatagttacttttaattgtgttccaagcagctattggcagttaaagagttgggataaattttcatcctaa

SEQ ID NO: 7550 - protein, 169 aa, Unknown
  Obtained from environmental sample
  DOMAIN (55)...(132): Domain of unknown function (DUF374)
  misc_feature (1)..(169): Xaa is any amino acid
MRKKILRALSLIFLPLIGSLLIRFIYLTSIKRFHLPENISNEPFIAALWHGDLLLQAFPYHKIRKTPRIKLIISDHFDGKIISKVMHFFSFDTIHGSSNRNAARVLIQAIKSLKNGYDIGMTPDGPKGPRREVADGIVVMSQKTKSDIVTFNCVPSSYWQLKSWDKFSS

SEQ ID NO: 7551 - DNA, 921 bp, Unknown
  Obtained from environmental sample
  misc_feature (1)..(921): n is a, c, g, or t
atggctgagtgggggactatagggaaaagagttgtagatattatcaatgatggatttctaagtgaagaggcaactattattgagataggtgcacatcatggttacctactttcagatatgattcaatttatatttactttaaacccagaacttataaaaacacttaaatttgctatagttgaaagatatgaacacttacgaataaaacaacaagagtatttcaaacaatgtttcggagatgagattgagcttatacattataatgacattagtgaggtaaacgaaaaagaggcatttgtagtagcaaatgaaatctttgatgcatttgcttgtgatttagtctatacaaatgataaaaatactttacaatacgctgttgtagaaaatgatactataaaatttatagataatgatgatacttttttagcacaatattgtgaaaaatataaagttacaaaaggggaagtagctcgagggtatgaagagtttgcttcaaatctgtgtaataatataaaaaaatttgaatttgtaacatttgactatggagaaaaatacccgagaaatgatttttcttgtagaatatatgaaaatcataatgtatatcctatctttgatgaaaatataaaattagaaaacctatataaacaaagtgatataacttatgatgtaaattttactcatgttattgatagctttaaaaaagctggttcagttaacttaagttatgagactcagttaaaagcacttgtaagttttggtattattgagcttcttgagatactacacaaaaatgtagatgaagacacttatttaaaagaggcgaacaaagtaaaaacacttctcaatcctataggtatgggagatagatttaaaatggttagttttaggaaaggtgaatatgaatttgatagtaaatggtga

SEQ ID NO: 7552 - protein, 306 aa, Unknown
  Obtained from environmental sample
  DOMAIN (1)...(297): Uncharacterized ACR, COG1565
  misc_feature (1)..(306): Xaa is any amino acid
MAEWGTIGKRVVDIINDGFLSEEATIIEIGAHHGYLLSDMIQFIFTLNPELIKTLKFAIVERYEHLRIKQQEYFKQCFGDEIELIHYNDISEVNEKEAFVVANEIFDAFACDLVYTNDKNTLQYAVVENDTIKFIDNDDTFLAQYCEKYKVTKGEVARGYEEFASNLCNNIKKFEFVTFDYGEKYPRNDFSCRIYENHNVYPIFDENIKLENLYKQSDITYDVNFTHVIDSFKKAGSVNLSYETQLKALVSFGIIELLEILHKNVDEDTYLKEANKVKTLLNPIGMGDRFKMVSFRKGEYEFDSKW

SEQ ID NO: 7553 - DNA, 450 bp, Unknown
  Obtained from environmental sample
  misc_feature (1)..(450): n is a, c, g, or t
atgcagatttttgatagttatgtttcagaatcatcctttgatgaagtgtatgacaacgaaaaaaatatcagagagtgttggaaagatattgtcagtgatatagaaaaatcaggtttagatcttcttcaagagaaacaagaggagatagactggcatctagaagacaatggagttacctacaatgtttatgatgaccatgaaaaatcatcacatcgttcatggagtttagatcctattccttttgttattgaagagagtgagtgggagagtattaaaaaaggtattcaacaacgtgcaaagttatttaatttaatactaaaagatctctactctgatcagaaacttataaaagacaatatcattcctgctgaggtaatttttggacataaaggcttctctcctgagtccttaacttcgaataaaagaggaattcaacctatatttttaggc

SEQ ID NO: 7554 - protein, 150 aa, Unknown
  Obtained from environmental sample
  DOMAIN (8)...(150): Domain of unknown function (DUF404)
  misc_feature (1)..(150): Xaa is any amino acid
MQIFDSYVSESSFDEVYDNEKNIRECWKDIVSDIEKSGLDLLQEKQEEIDWHLEDNGVTYNVYDDHEKSSHRSWSLDPIPFVIEESEWESIKKGIQQRAKLFNLILKDLYSDQKLIKDNIIPAEVIFGHKGFSPESLTSNKRGIQPIFLG

SEQ ID NO: 7555 - DNA, 906 bp, Unknown
  Obtained from environmental sample
  misc_feature (1)..(906): n is a, c, g, or t
ttgaaagtacaaaatcaattgacaaacaatctaacttctacaataaactttagacatgataatataaaatatgattataaaaataatcttgatacaactctaaatactgccccatcatatgatgcaaatacctatagagtagggtttaattataaattaagtgatacagataatatttacacaagttatgcaacaggatttagagcaccaacagcagaacaaataagtggaaatattgataaacttcaagcaaatcctacatttgatattccaactactcttgatatagaaactacaaataatatagaattaggaattaggggagacatctcatcatacaaatatgatgcatctatttaccaactagatagaaaagattatttaggtgtaagagctggttcttatattagagcttcagatgataaagcagatttagcagtagataatctgggagacatgagaagtagaggatttgaattagctcttagtagtgatagaaaaaaagccatctcattttcaactgcttatacatatttagatgcaaaatttaaagaatattcattaaaacaattagttcaagacaatgtttttccaatagctgatatctatcaaacagttaatttaaaagggaaaagagtacctagaacatcaaaacatactttaaatatcactgttgactttagaccaattgatgggcttactatatcaccagaacttatagcaaaaagtagttactatgcagatgaattaaacaaatacaaacaacctggttatgaaattataaatttaagatcagaatacaaaataaataaatctctagaaatttttgctaaaatagaaaaccttttagataagaactacaatcagtttgtaaatgtaagctcaagtgatatgcaaataatatga

SEQ ID NO: 7556 - protein, 301 aa, Unknown
  Obtained from environmental sample
  misc_feature (1)..(301): Xaa is any amino acid
MKVQNQLTNNLTSTINFRHDNIKYDYKNNLDTTLNTAPSYDANTYRVGFNYKLSDTDNIYTSYATGFRAPTAEQISGNIDKLQANPTFDIPTTLDIETTNNIELGIRGDISSYKYDASIYQLDRKDYLGVRAGSYIRASDDKADLAVDNLGDMRSRGFELALSSDRKKAISFSTAYTYLDAKFKEYSLKQLVQDNVFPIADIYQTVNLKGKRVPRTSKHTLNITVDFRPIDGLTISPELIAKSSYYADELNKYKQPGYEIINLRSEYKINKSLEIFAKIENLLDKNYNQFVNVSSSDMQII

SEQ ID NO: 7557 - DNA, 930 bp, Unknown
  Obtained from environmental sample
  misc_feature (1)..(930): n is a, c, g, or t
atgaaatttgaattagtttccgactataaaccagcaggagatcaacccagtgcaattaaaaagttgtcccgtgatttttacgctgggaaaaaacatcaaactctgtcgggagtgactggttcaggtaaaacctttacaatcgcaaatgtgatcgaaaaaattcaaaaaccaacattagtaattgcacataataaaactcttgccgctcaattagttagcgaatttcgtgaattttttcctaataatgcagttgagtattttgtttcttattatgactattatcaaccagaggcatatatgccagcccaggacgtttttatcgaaaaagatttagagattaatgaggaaattgataaattgagacattctgccaccgcatcgctcatctctcgtaaagatgttatcgttgtggccagtgtttcatgtatctacggtttgggctccccagacttttataagcaaaaaatcttaacattagaaaaaggaaaaaagattgatcgcaaggatattttgaaaaaattaattgatctgcaatattcaagaagtgatgttctgcttagaggtaagtttcgtttgcatggtgaaacgtttgagattatgcgaccagacaaagaaattgtgattcgtgtcgaattgaaaaatggggaagtgattcggatttatgaatacaatcatttaacaggtgaggttttggacaaggatatgttgcaagttttgatttttccagccaaacattttgttgcacctgaatcagtaatgaaaaaatcagtgggaaaaattcgacaggaaatgaaaaaaagagttaaattctttgaagacaatggtcaaattattgaagcagagagaattagaagaagaactaattttgacacagagctcatcgaagaaattggctactgtagtggaatagagaattattcttttacttaa

SEQ ID NO: 7558 - protein, 309 aa, Unknown
  Obtained from environmental sample
  DOMAIN (9)...(161): Type III restriction enzyme, res subunit
  misc_feature (1)..(309): Xaa is any amino acid
MKFELVSDYKPAGDQPSAIKKLSRDFYAGKKHQTLSGVTGSGKTFTIANVIEKIQKPTLVIAHNKTLAAQLVSEFREFFPNNAVEYFVSYYDYYQPEAYMPAQDVFIEKDLEINEEIDKLRHSATASLISRKDVIVVASVSCIYGLGSPDFYKQKILTLEKGKKIDRKDILKKLIDLQYSRSDVLLRGKFRLHGETFEIMRPDKEIVIRVELKNGEVIRIYEYNHLTGEVLDKDMLQVLIFPAKHFVAPESVMKKSVGKIRQEMKKRVKFFEDNGQIIEAERIRRRTNFDTELIEEIGYCSGIENYSFT

SEQ ID NO: 7559 - DNA, 720 bp, Unknown
  Obtained from environmental sample
  misc_feature (1)..(720): n is a, c, g, or t
atgaaagtcaaagcaagctcagactcaggcgaacaaagactttatgaacttatttttaacagaactcttgcatcacaaatggaagatgcaatttttgatagaacaacaatttctataaatgcatcagaatcagaaaaacacttaaccgcatctgctgaaatattaaaatttgaaggttttttaaaaatctacaaatactcagatattgacgttgagaaagaaatagaacaagtaattccagcattaaaaaaaggtcaaaaacttgatttattaaaagctcttgcaacagagaaatacacaaattcaccgggaagatatacagaagcaactcttgtacgaaaattagaagaactcggaattggtcgtccatctacgtatgctccaattatttctactattcaaaaacgttcttatgttttgaaagataacaacgaaggaacaccaatacaagtgaatgaattagttttagaaaaaaatataattacagaaactaaaaaagaagaaataaaaggaaaagaaaaaaataaattttctccaacagatgttggaaatatcgtaactaaatttcttgcagaacattttactaacattcttgattataattttacagcaacagtagaaaaagattttgacggaattgcagaagggaaaaaagaatggccaaaaataattgacaaattctatgtaacttttcacaaaaacattgaaacaacactttga

SEQ ID NO: 7560 - protein, 239 aa, Unknown
  Obtained from environmental sample
  DOMAIN (1)...(213): DNA topoisomerase
  misc_feature (1)..(239): Xaa is any amino acid
MKVKASSDSGEQRLYELIFNRTLASQMEDAIFDRTTISINASESEKHLTASAEILKFEGFLKIYKYSDIDVEKEIEQVIPALKKGQKLDLLKALATEKYTNSPGRYTEATLVRKLEELGIGRPSTYAPIISTIQKRSYVLKDNNEGTPIQVNELVLEKNIITETKKEEIKGKEKNKFSPTDVGNIVTKFLAEHFTNILDYNFTATVEKDFDGIAEGKKEWPKIIDKFYVTFHKNIETTL

SEQ ID NO: 7561 - DNA, 756 bp, Unknown
  Obtained from environmental sample
  misc_feature (1)..(756): n is a, c, g, or t
ttgttccacctgatccaggtgatggagggttcttctttattttgtgctttatattatgctaaatatataaaaaaagtgtcaccaaaatataaactagaaagtccatttttaggtaaacgatattctttagaagcattaaaaaaagatattgacaacaattttaccggtgaatttatacaaatagatgataaagaaaaattctttgactatgtttctgatttattaatagacaataatgtaattggttggttttatggtgagtttgagtggggtccaagagctttgggacatagaagtattattgcaaatcccatgaataaagatatgaaagatattattaatagtaagataaaatttagagaggcatttagaccatttgctccatcaattttaagtgattttgcaaaagagtattttaaaattgataaagttggggataatgaaatcgaaagctatatgcttggagtatctgatgtattcccagataaaatcgataaaataccagctgttgtacatgaagataatacagggagagttcaagtagtatttaaagaaaataatgagatgtattataacttaatagaaagtttttataaaaaaactggtgtgcccgttatcttaaatacctcctacaatttaaaaggtgagccagtagtttcatcactaaaagatgcactcttaacatttagttattcatatatggattacttagtagcttatccttttatattaagctcttttggtgttaagaaatga

SEQ ID NO: 7562 - protein, 251 aa, Unknown
  Obtained from environmental sample
  DOMAIN (1)...(180): Carbamoyltransferase
  misc_feature (1)..(251): Xaa is any amino acid
MFHLIQVMEGSSLFCALYYAKYIKKVSPKYKLESPFLGKRYSLEALKKDIDNNFTGEFIQIDDKEKFFDYVSDLLIDNNVIGWFYGEFEWGPRALGHRSIIANPMNKDMKDIINSKIKFREAFRPFAPSILSDFAKEYFKIDKVGDNEIESYMLGVSDVFPDKIDKIPAVVHEDNTGRVQVVFKENNEMYYNLIESFYKKTGVPVILNTSYNLKGEPVVSSLKDALLTFSYSYMDYLVAYPFILSSFGVKK

SEQ ID NO: 7563 - DNA, 801 bp, Unknown
  Obtained from environmental sample
  misc_feature (1)..(801): n is a, c, g, or t
atgacattaaaccaacttccaaagaatataacattatatctttatggtagtggatatatgggtgaaacttattttcaattaatacaaatattaagagatgatattcaagttaagtttatcgatgataatgataacaatgaggatgctattaattttcatacatttcatgatttagaaaaaaacaacttttttattgttaactgtataatcactgcaaatgtaaaagaatctattaatatcaaattaatcaataatgggtataaggactatttaattgaaataaagggaattgatggttttttaaaaagtgaaacattcccttttaactacatgatgttagaaaaattttatatcaacaataaatctattataaataaaaatattgattcactacattctaatcaagacaaattactatatgaatcattacttaagtacagatatctagatttaaaaaaacaagaactattaaaaaatggtgaattttttaatagttttggtaattataatgaagagttacaatattgtgaatatttaaatgatacacatatcaatacaattattgagggcggtatatttgatggtaagagtagtataaagattaaaaataaatatttatctgataatgggacactatatggatttgatcctatgctatacatacatataggagagaaaaagatagagagtatgaaaaagaaatatattcacctactagacattgctctttgggactctatcgaaaaattacattttattaacaatggttctgcatctaaaatacccaaaactccgacttaa

SEQ ID NO: 7564 - protein, 266 aa, Unknown
  Obtained from environmental sample
  misc_feature (1)..(266): Xaa is any amino acid
MTLNQLPKNITLYLYGSGYMGETYFQLIQILRDDIQVKFIDDNDNNEDAINFHTFHDLEKNNFFIVNCIITANVKESINIKLINNGYKDYLIEIKGIDGFLKSETFPFNYMMLEKFYINNKSIINKNIDSLHSNQDKLLYESLLKYRYLDLKKQELLKNGEFFNSFGNYNEELQYCEYLNDTHINTIIEGGIFDGKSSIKIKNKYLSDNGTLYGFDPMLYIHIGEKKIESMKKKYIHLLDIALWDSIEKLHFINNGSASKIPKTPT

SEQ ID NO: 7565 - DNA, 624 bp, Unknown
  Obtained from environmental sample
  misc_feature (1)..(624): n is a, c, g, or t
atgaatcaaaaaaagttatttaagaaattaaatgattttttagttcatgaaagagctaattatactatctatccaaaagaaaataatattttcaatgcttttaatattacaccatttgaaaatattaaagttgttattttgggtcaagatccttatcatggttataaccaatctcatggtctggctttttctgtaaatgattctattaagcatcctccatctttagttaatatttttaaagagttacatgatgatataggttgtaatattccaatgagtggaaatttgagtttttgggctacacagggtgtttttttattaaatactgttcttagtgtaagagcatctaatgcacattcacataaagagatgggttgggaaattttcacagattttgttattaaaatgattagtgataacagggataatattgtattcatattatggggaaaaccagctcagcaaaaaataaaatttatcgatcaaagtaagcatttaattctatcagcaccacatccttcacctctatcatcttacagaggtttttttggttcaaagcctttttctaaaacaaacagatatttagcagatcattcaatagatgcaattaattggtgcttataa

SEQ ID NO: 7566 - protein, 207 aa, Unknown
  Obtained from environmental sample
  DOMAIN (37)...(196): Uracil DNA glycosylase superfamily
  misc_feature (1)..(207): Xaa is any amino acid
MNQKKLFKKLNDFLVHERANYTIYPKENNIFNAFNITPFENIKVVILGQDPYHGYNQSHGLAFSVNDSIKHPPSLVNIFKELHDDIGCNIPMSGNLSFWATQGVFLLNTVLSVRASNAHSHKEMGWEIFTDFVIKMISDNRDNIVFILWGKPAQQKIKFIDQSKHLILSAPHPSPLSSYRGFFGSKPFSKTNRYLADHSIDAINWCL

SEQ ID NO: 7567 - DNA, 327 bp, Unknown
  Obtained from environmental sample
  misc_feature (1)..(327): n is a, c, g, or t
gtggggcatcgcaaagcaaaaaaatacaaaaacagcaatttaatatattttagttcaattgtgtacatttccaaccttattcagcttttaatctatgctgaaatattgttggtcgatagtttttgggttgttggtataatcttactcacttctaaatggcttattgattttatattactatatttggctgcaaacttttttaataagaaaaagtatcttgttctttttgtatttgtagcgtttatttatcctatatacattgtgtttataggattgttggcgttgattacaaatttcaaatggaagggaagaaggtatcatgagtaa

SEQ ID NO: 7568 - protein, 108 aa, Unknown
  Obtained from environmental sample
  misc_feature (1)..(108): Xaa is any amino acid
MGHRKAKKYKNSNLIYFSSIVYISNLIQLLIYAEILLVDSFWVVGIILLTSKWLIDFILLYLAANFFNKKKYLVLFVFVAFIYPIYIVFIGLLALITNFKWKGRRYHE

SEQ ID NO: 7569 - DNA, 393 bp, Unknown
  Obtained from environmental sample
  misc_feature (1)..(393): n is a, c, g, or t
ttgattgcttttcggtttttcttaatttttaataaatcaatggtaaaccctggcttttttgtagttaattctaacgtttggtcgtttgcttttggagtattgtcaggacgtgctaaagggcctaaaatagctaccatggctgctacaaaaataataagcattccaaaaacagaaagcttatttcttttaagcctctgccaagccattttgctcaacgacttcgattttgtattattttttttattactcatgataccttcttcccttccatttgaaatttgtaatcaacgccaacaatcctataaacacaatgtatataggataaataaacgctacaaatacaaaaagaacaagatactttttcttattaaaaaagtttgcagccaaatatag

SEQ ID NO: 7570 - protein, 130 aa, Unknown
  Obtained from environmental sample
  misc_feature (1)..(130): Xaa is any amino acid
MIAFRFFLIFNKSMVNPGFFVVNSNVWSFAFGVLSGRAKGPKIATMAATKIISIPKTESLFLLSLCQAILLNDFDFVLFFLLLMIPSSLPFEICNQRQQSYKHNVYRINKRYKYKKNKILFLIKKVCSQI

SEQ ID NO: 7571 - DNA, 558 bp, Unknown
  Obtained from environmental sample
  misc_feature (1)..(558): n is a, c, g, or t
atgagtaataaaaaaaataatacaaaatcgaagtcgttgagcaaaatggcttggcagaggcttaaaagaaataagctttctgtttttggaatgcttattatttttgtagcagccatggtagctattttaggccctttagcacgtcctgacaatactccaaaagcaaacgaccaaacgttagaattaactacaaaaaagccagggtttaccattgatttattaaaaattaagaaaaaccgaaaagcaatcaatcaatcttggtggtctaaattttctgaagggattgagaacacctatcaaattatccctgtttatgattatagttttgaaggaactaaaattgttgtagaaaaatatactggaggagatgtaaataatgggcctatagaanaaattgatctagctgacgttgttttttctttagaaaacactcaaatcaatgaaactaatggttctttagaattttacacctatgaagaaggtaagaaaactatgaccattgaagaacttcaaaaagaattaaatcagaaaacattattagaaaaacctattatttag

SEQ ID NO: 7572 - protein, 185 aa, Unknown
  Obtained from environmental sample
  misc_feature (1)..(185): Xaa is any amino acid
MSNKKNNTKSKSLSKMAWQRLKRNKLSVFGMLIIFVAAMVAILGPLARPDNTPKANDQTLELTTKKPGFTIDLLKIKKNRKAINQSWWSKFSEGIENTYQIIPVYDYSFEGTKIVVEKYTGGDVNNGPIEXIDLADVVFSLENTQINETNGSLEFYTYEEGKKTMTIEELQKELNQKTLLEKPII

SEQ ID NO: 7573 - DNA, 708 bp, Unknown
  Obtained from environmental sample
  misc_feature (1)..(708): n is a, c, g, or t
atggatgtgtataatgcttgggattttgaaaggagattaaaattacttctcggtaagtttaatattgttgatcttgaacaaaagattagcaaaatgtcgggaggacagataaagagattgtcgcttgctctaacattactcgataatccagatattcttcttctggatgaacctactaaccaccttgatatcgagatgattgagtggctcgaaaaccacctgtcggcttctgatattacattatttatggtaactcatgataggtattttctggatagaatatgcaatactattatcgaaattagcgatggaagtttatatactcataatggtaactatagctattttctagaaaaacaagccgaaagaaaggaaaatagcagaattgagatcgataaggctaaaaagctgatgaaaaaggagttggactggattcgtagaatgccaaaggccagaacaaccaagtcgaaagcccgaatagatagttttcatcgtattaaggacaaagctagcagcggaataatagaagatgagattaagctaggagttcaaatgtcgagggttggtggtaaaattcttgagatggataatgtaagtaagaggtttggtgatacaatcatccttgagaattttgaatacatctttaagaaaggggagaggataggatttgttggtaagaacggtgttggggaagtcaacattttttga

SEQ ID NO: 7574 - protein, 235 aa, Unknown
  Obtained from environmental sample
  DOMAIN (3)...(104): ABC transporter
  misc_feature (1)..(235): Xaa is any amino acid
MDVYNAWDFERRLKLLLGKFNIVDLEQKISKMSGGQIKRLSLALTLLDNPDILLLDEPTNHLDIEMIEWLENHLSASDITLFMVTHDRYFLDRICNTIIEISDGSLYTHNGNYSYFLEKQAERKENSRIEIDKAKKLMKKELDWIRRMPKARTTKSKARIDSFHRIKDKASSGIIEDEIKLGVQMSRVGGKILEMDNVSKRFGDTIILENFEYIFKKGERIGFVGKNGVGEVNIF

SEQ ID NO: 7575 - DNA, 300 bp, Unknown
  Obtained from environmental sample
  misc_feature (1)..(300): n is a, c, g, or t
atgccaaaacaacaaacaatgatggatagtaatagaattacagtagcaatgatttttttaaaagcttttataacgctagataaaaagcattctaatgaaacctatagtgctaaagagttttacaatcgtcttaacaaacgagctattacaggtgtgaactttaaagaagaggaaactgaagaaatattagaaaaaatgagtgtttcaagaatacttcataaaatagaagattcttccatagtaaaatataaactaagtccttttctaaaagaaccttctgttaatttagttgatgtctaa

SEQ ID NO: 7576 - protein, 99 aa, Unknown
  Obtained from environmental sample
  misc_feature (1)..(99): Xaa is any amino acid
MPKQQTMMDSNRITVAMIFLKAFITLDKKHSNETYSAKEFYNRLNKRAITGVNFKEEETEEILEKMSVSRILHKIEDSSIVKYKLSPFLKEPSVNLVDV

SEQ ID NO: 7577 - DNA, 735 bp, Unknown
  Obtained from environmental sample
  misc_feature (1)..(735): n is a, c, g, or t
gtggaaatatcaaaaaggttgcaaatattatctttattaacaagaaactcaatattaaataaaattacaaacaataaaaaaaatattaccaatattttaaaccttataaaaagcttttctgaaccaatggatataccagtagatgaatttttatttacaattaaactaaaagagaatcctttttataaaatgttaaaagattttctagatactaaagatattttagaatttaacaaaaaatacttaaataaagagattcctactttatataaaaatatcttcaaagaagaatttttaaaagcaaacgttcatataatgatacattttttcaagaaaacagcagaacttatgtatttaaaaggaattaaagaaataaaattaaaaaataatttaaaaattactgtttcaaactatttaaaaataccttctaataaaaactctcttattcaattaaataaagatactaaagatatgttagagtttgttttatttattctagaagataactcttttagagattataaaaacagaatagatagaggaagctataataatttttatatgcaatatattagtcattctcaagatgaaacgattaagggatatattaaagaagcaaaaagaataaaaaagaatgatgaatttaatgatttatctagttatttagatgtgattaatatttttattgataaacaagatatgagttcaaaaaaaatctttattataattaaagat

SEQ ID NO: 7578 - protein, 245 aa, Unknown
  Obtained from environmental sample
  misc_feature (1)..(245): Xaa is any amino acid
MEISKRLQILSLLTRNSILNKITNNKKNITNILNLIKSFSEPMDIPVDEFLFTIKLKENPFYKMLKDFLDTKDILEFNKKYLNKEIPTLYKNIFKEEFLKANVHIMIHFFKKTAELMYLKGIKEIKLKNNLKITVSNYLKIPSNKNSLIQLNKDTKDMLEFVLFILEDNSFRDYKNRIDRGSYNNFYMQYISHSQDETIKGYIKEAKRIKKNDEFNDLSSYLDVINIFIDKQDMSSKKIFIIIKD

SEQ ID NO: 7579 - DNA, 498 bp, Unknown
  Obtained from environmental sample
  misc_feature (1)..(498): n is a, c, g, or t
atgatacattttttcaagaaaacagcagaacttatgtatttaaaaggaattaaagaaataaaattaaaaaataatttaaaaattactgtttcaaactatttaaaaataccttctaataaaaactctcttattcaattaaataaagatactaaagatatgttagagtttgttttatttattctagaagataactcttttagagattataaaaacagaatagatagaggaagctataataatttttatatgcaatatattagtcattctcaagatgaaacgattaagggatatattaaagaagcaaaaagaataaaaaagaatgatgaatttaatgatttatctagttatttagatgtgattaatatttttattgataaacaagatatgagttcaaaaaaaatctttattataattaaagattacctattaggaaaagatatttttaagcataaaaatgattcactatatggaaatctagtaaaacaacttttagaataa

SEQ ID NO: 7580 - protein, 165 aa, Unknown
  Obtained from environmental sample
  misc_feature (1)..(165): Xaa is any amino acid
MIHFFKKTAELMYLKGIKEIKLKNNLKITVSNYLKIPSNKNSLIQLNKDTKDMLEFVLFILEDNSFRDYKNRIDRGSYNNFYMQYISHSQDETIKGYIKEAKRIKKNDEFNDLSSYLDVINIFIDKQDMSSKKIFIIIKDYLLGKDIFKHKNDSLYGNLVKQLLE

SEQ ID NO: 7581 - DNA, 804 bp, Unknown
  Obtained from environmental sample
  misc_feature (1)..(804): n is a, c, g, or t
ttgatagaattagacagtctggaaagtgccttaatcgaaatagcaaatttgaaatatgagactgagaatgattctttagagactttgtacttgaatatgataatagatagtattgaaggtttagagcctttgaataaagttgatttgttgactcggatttttgagcagacagtttccgtagaaccggatcttgatctgttcttgattgtggcagaaacttatgagcaactgaaactctattccgaagcaaatgatatttatcgcaacattataagatataatcataaattaaatagctctggctataaattgaaaatagcattaaatctaattcataagaaagattacgattccgcattagtagaattgaaacccattattacatctgaagattcactatatatagaagaagctttattttatgattatatagtgcattatgcattagatgattatcaagctgcctcacatagtttgttgcgactttattataaatttccagagaatgacaggaaaagcgaaattattgctcaattgtcaaatatctattttgaagaaaaacagtatgtactaagctggtattggcttgaacaactttataagatcagcgacaggggagagcaatctataattttacagaaaattaaaaggatcaaattaggcctagctgaatctaagaatgatctgaataatcaatttaaatattttaaaccaatttttgaaatggaattggtaaaaccgattggtgcagattcgctcaaaacagaagaaaaagaatcactaatcttagaaatatatttctga

SEQ ID NO: 7582 - protein, 267 aa, Unknown
  Obtained from environmental sample
  misc_feature (1)..(267): Xaa is any amino acid
MIELDSLESALIEIANLKYETENDSLETLYLNMIIDSIEGLEPLNKVDLLTRIFEQTVSVEPDLDLFLIVAETYEQLKLYSEANDIYRNIIRYNHKLNSSGYKLKIALNLIHKKDYDSALVELKPIITSEDSLYIEEALFYDYIVHYALDDYQAASHSLLRLYYKFPENDRKSEIIAQLSNIYFEEKQYVLSWYWLEQLYKISDRGEQSIILQKIKRIKLGLAESKNDLNNQFKYFKPIFEMELVKPIGADSLKTEEKESLILEIYF

SEQ ID NO: 7583 - DNA, 495 bp, Unknown
  Obtained from environmental sample
  misc_feature (1)..(495): n is a, c, g, or t
ttgagtaaagtatatttttctaattggcaaggggaagtagtagataatagaggtcttgatgttgaaaactggactgaagtatctgtaaaactccctgttaattatgatagcggaaccgaaacaaaagcttttgttggttgggatggttttgcaatatttcaaagtgatgttgatgttgtaaaattagcattaaactatgcaagacaataccaagaatatagtgaagcttgtggtagatgtacccctggacgatggggtggacaaatactttctgatatgattgataaaattgccagaggcgagggtgagtttagtgatttatcacatatcanagaggtaagttcaactatgaccacaacttcaaaatgtgaaataggaaaaacagtacctgtacctattttagggatgattgagaattttgaagagcattttgtaaaacttataaaaaaaaaaaaaaatcgccttggtatggaccagattccgaaaaatatatag

SEQ ID NO: 7584 - protein, 164 aa, Unknown
  Obtained from environmental sample
  misc_feature (1)..(164): Xaa is any amino acid
MSKVYFSNWQGEVVDNRGLDVENWTEVSVKLPVNYDSGTETKAFVGWDGFAIFQSDVDVVKLALNYARQYQEYSEACGRCTPGRWGGQILSDMIDKIARGEGEFSDLSHIXEVSSTMTTTSKCEIGKTVPVPILGMIENFEEHFVKLIKKKKNRLGMDQIPKNI

SEQ ID NO: 7585 - DNA, 762 bp, Unknown
  Obtained from environmental sample
  misc_feature (1)..(762): n is a, c, g, or t
atgctgttgttaaatcaaacgatgctgtatttactaaatttcaaagaatgttttaattatttagatacaataagcttaatgaaaaaaaatatactgatagttgaagatgaagaaactattgtaagcttaataaaaaaccgtcttaatagtgatatttacaatgtagatatcgcttatgatggaaaagaagctatatcaaaaatactagctaactcttatgatttaattactttggatattatgctcccttttcttgatggctttgaggtatgtaaaaaaataagaaacaaatcacaaaaaactttgattgttatgattagtgccttaggcacaatggaatttaaacaaaaaggttatgattttgggattgatgattatattgctaaacctttttcagcaaaagagttagcaataaaaatccactctttactaaaaagaagagaagagataagttctttaaaagtaaagtctatctcaaatattatcttaaatgaagactccaaagatataattataaatggctataatatagaacttacagctagtgaatatctaatactatcaacattaattataaataaaaatagagtttattcaagacaagaattggcacaactcatctatgataactattttggtacaatagatgaacaagggataaatagtcatatttatcatattcgagagaagataaaacaattttatgataaagatattataaaaacagtaagaggtatgggatataaaatatatgaaaattaa

SEQ ID NO: 7586 - protein, 253 aa, Unknown
  Obtained from environmental sample
  DOMAIN (174)...(250): Transcriptional regulatory protein, C terminal
  misc_feature (1)..(253): Xaa is any amino acid
MLLLNQTMLYLLNFKECFNYLDTISLMKKNILIVEDEETIVSLIKNRLNSDIYNVDIAYDGKEAISKILANSYDLITLDIMLPFLDGFEVCKKIRNKSQKTLIVMISALGTMEFKQKGYDFGIDDYIAKPFSAKELAIKIHSLLKRREEISSLKVKSISNIILNEDSKDIIINGYNIELTASEYLILSTLIINKNRVYSRQELAQLIYDNYFGTIDEQGINSHIYHIREKIKQFYDKDIIKTVRGMGYKIYEN

SEQ ID NO: 7587 - DNA, 681 bp, Unknown
  Obtained from environmental sample
  misc_feature (1)..(681): n is a, c, g, or t
atgaaattaataatatgtaataaagagtatatcattgatgacaacaaaataaaaagagatagtttactttctattttaacctatataaaaacaaaacttgacaatactcttagcttcagaagtggctgtagaagtggtgtttgtggaagttgtgccattagagtaaatggtgttgaaaagctagcttgcaaaacacatttagaagatggagatatagttgaacctcttaaaaacactactataataaaagatttggttgtagatatttcctcacaagcactttgtatcaaaaaagccaaagcaaatttagaggaaaaaagtaatcaaactattacatcattagatcaaaagaatatagacctacaaagcaactgtattttatgtaatagttgctatagttcttgtccagtttttgaggtaaacaaagactttataggaccttttgctcttacccgtgcctatcgatatgtaaatgataaaaaagaggataatactcaaacaaaaattgatgctgtacaaaaagatggtatttgggaatgtactttatgtggaaacctgtatatggtatgtcctgaacgaatagatattaaaaatgatattatgatgttacgaaaacaatcagcacaaatgggttatagtgatcctaatatgggaagttttgatggaggatttaatacaaat

SEQ ID NO: 7588 - protein, 227 aa, Unknown
  Obtained from environmental sample
  DOMAIN (10)...(69): 2Fe-2S iron-sulfur cluster binding domain
  misc_feature (1)..(227): Xaa is any amino acid
MKLIICNKEYIIDDNKIKRDSLLSILTYIKTKLDNTLSFRSGCRSGVCGSCAIRVNGVEKLACKTHLEDGDIVEPLKNTTIIKDLVVDISSQALCIKKAKANLEEKSNQTITSLDQKNIDLQSNCILCNSCYSSCPVFEVNKDFIGPFALTRAYRYVNDKKEDNTQTKIDAVQKDGIWECTLCGNLYMVCPERIDIKNDIMMLRKQSAQMGYSDPNMGSFDGGFNTN

SEQ ID NO: 7589 - DNA, 456 bp, Unknown
  Obtained from environmental sample
  misc_feature (1)..(456): n is a, c, g, or t
atgataagcgaaaagataagttggagtgatgaatacctcctcggtgatagcttggtagataaacagcacagaaaattatttgatatcgttgataatattttatccattgatgatgagaatttgaaagagagtataaaaacttgtttaagtgagttgaattcatacatgaattatcattttgatgaggaagaaaaatatatgtttagtatcaaatatcccctattagatgatcataaaatgttacataaacagataagagaagacctgtataagcttgtgcgtgaaaaagtaagtttacatgttctaaagacaaaaataaaaataggtgtaaaaaaagttttgataaagcatattttagaagaggatatgaaagtacaaccattctattttaaatataaagagacattttctaaaaaagttaaggtcaacactcaagaagagatagtagaaatttaa

SEQ ID NO: 7590 - protein, 151 aa, Unknown
  Obtained from environmental sample
  DOMAIN (1)...(135): Hemerythrin
  misc_feature (1)..(151): Xaa is any amino acid
MISEKISWSDEYLLGDSLVDKQHRKLFDIVDNILSIDDENLKESIKTCLSELNSYMNYHFDEEEKYMFSIKYPLLDDHKMLHKQIREDLYKLVREKVSLHVLKTKIKIGVKKVLIKHILEEDMKVQPFYFKYKETFSKKVKVNTQEEIVEI

SEQ ID NO: 7591 - DNA, 750 bp, Unknown
  Obtained from environmental sample
  misc_feature (1)..(750): n is a, c, g, or t
atgagagtagctattattggtggtggtgcagcagggttcttttctgcaattaatgtaaaagaaaattttcccaagtcagaagtatacatatatgagaaatcactcactttgcttgcaaaagtaaaaatttcgggcggaggacgctgtaatgttactaatgcttgcaaatcaattagtgaacttagcaaagcatatcctaggggtgctgtgtatttaaaaaaagcatttaagcaatttgataatactgatgcttttaattggtttcaaagtagaggtgttgagctcgttactcaagaagataattgtgtatttcctaaatctcaaaattctcaaagcataatagattgttttttaaacgaggctaagaagctagatattaaaataagaacaaattatgcggttaaatatcttcaccctaaggataaggaaattaatattgagtttgctgatgagtcaattataaacgaatcatttacaaaagtaattgtaacaacaggtggttcgccacaaaaaaaagctttgaaatggcttgaataccttggacataaaatagaaaatccagtgccatccttgtttacttttaatatgcctaaacatccggtaaataaactaatgggtattgtagtggaaaatgctttggtaaacatacaaaacaccaaactaaaatcagatggagctctattaattacacattggggaatgagcggaccagcaattcttaaattatcctcactaggagctcgtatttga

SEQ ID NO: 7592 - protein, 249 aa, Unknown
  Obtained from environmental sample
  DOMAIN (47)...(249): HI0933-like protein
  misc_feature (1)..(249): Xaa is any amino acid
MRVAIIGGGAAGFFSAINVKENFPKSEVYIYEKSLTLLAKVKISGGGRCNVTNACKSISELSKAYPRGAVYLKKAFKQFDNTDAFNWFQSRGVELVTQEDNCVFPKSQNSQSIIDCFLNEAKKLDIKIRTNYAVKYLHPKDKEINIEFADESIINESFTKVIVTTGGSPQKKALKWLEYLGHKIENPVPSLFTFNMPKHPVNKLMGIVVENALVNIQNTKLKSDGALLITHWGMSGPAILKLSSLGARI

SEQ ID NO: 7593 - DNA, 351 bp, Unknown
  Obtained from environmental sample
  misc_feature (1)..(351): n is a, c, g, or t
ttgacgataaaaaaccaaaaagaaaaaagaaaagaaataataaacgtaaaagaccaagaaatgaaggcgataaaagggcatagtgtttttttgttcttggcaattgtaacaatattttattcctgcgatcaaaatcaggtttacgaaagaaatattgaaattaacaatttaagttggcataaagataccattataaaatttcaggttgatattaaggatactataaatccgcataatatatatgttaatgtgagggatacctcgagatatcaattgcagaatttgcatcttattatcaccactacttctccaaataaatcaagcatgaagaacgatttgaatgttatttag

SEQ ID NO: 7594 - protein, 116 aa, Unknown
  Obtained from environmental sample
  misc_feature (1)..(116): Xaa is any amino acid
MTIKNQKEKRKEIINVKDQEMKAIKGHSVFLFLAIVTIFYSCDQNQVYERNIEINNLSWHKDTIIKFQVDIKDTINPHNIYVNVRDTSRYQLQNLHLIITTTSPNKSSMKNDLNVI

SEQ ID NO: 7595 - DNA, 729 bp, Unknown
  Obtained from environmental sample
  misc_feature (1)..(729): n is a, c, g, or t
atggaacttgcaaattatatagaaactgctatcagaagcatattaaagaatccaatacttgaagttttaacagagataaaaatcacgaagattttaaaacaaagtaattttgtaaagcgcaatactggacattcaccatttcaaatactcttacactttgtctatatgattgttatgaataaaagacaatctacttttataaaaaagagtactggtacatttggaaaagatgcatattatagatttttgaaagagagtcgctataactggagaaaacttttacttcttagcactacaacacttctacaaaaaataaaaccactgcataaaaaaggtgagcatagattgctcatcatagatgacactgttgaagttaaaagaggtaagcatattgagggtagttgcaaatatatttggagcaataaagaacatagaacaatcaatgcattaaatattgtatctcttaattatgcagattcacactcaacgtttcagctagacttttctataaaaatgaatgatagtcgtcgtaaagatatatccgagttcacttcagttgtacatcatcgtagtaatacttatatgcgtcaaatcgaatctctaaaaggtaaaaatattttagctattgagatgcttgagagagcgttggaacaaggcattgatgcagattacttactcatagatagctggtatgctaaaccaaactttaacatcaagctaatgagctag

SEQ ID NO: 7596 - protein, 242 aa, Unknown
  Obtained from environmental sample
  misc_feature (1)..(242): Xaa is any amino acid
MELANYIETAIRSILKNPILEVLTEIKITKILKQSNFVKRNTGHSPFQILLHFVYMIVMNKRQSTFIKKSTGTFGKDAYYRFLKESRYNWRKLLLLSTTTLLQKIKPLHKKGEHRLLIIDDTVEVKRGKHIEGSCKYIWSNKEHRTINALNIVSLNYADSHSTFQLDFSIKMNDSRRKDISEFTSVVHHRSNTYMRQIESLKGKNILAIEMLERALEQGIDADYLLIDSWYAKPNFNIKLMS

SEQ ID NO: 7597 - DNA, 906 bp, Unknown
  Obtained from environmental sample
  misc_feature (1)..(906): n is a, c, g, or t
atggaagcagaagaaacagctcaacaatcaaagattgttggctccgtaaacggaaacgaaaaagagaccagtgtagagtttgaagacattagttttaaagaagagagtgacggtaagaaaatcagagctaattttttgcagaactattattggtactttacaaaggaagaactcgaagaaattgcgccattcaaaataaaagaaggaaaaatcattttctttgaacgagagaaaagagtattcaacaaattcaatcaactcctcggagaaggattttctcgacttaaacatattattggcgataaagaatgcttgtacgtacatcgtaatagcagtattcctcttattggcagtaatgaattcggggtagtagacagaggaagcaatattattgagataaaacctcttacaggttgtaatctatcatgtactttttgttcggtaagcgaaggaaaagataatgggaaaagagacatcatagtcgaagaagaatatctcatagaagaattctcaaaacttgcaaaactcaaaaaacatccagtagaagcaaacattggaccacaaggagaacccatgctctacccacaattcgtaaaactcgttgctgatttgaaaaaaaatggagcgagcgtagtatcagtaaatacaaacggaacatttctcaataaaaaaattattgatgaactagtaattgcgggactagatagaataaatttatctttacacacattaaaccaaaaaaaatcaaacgaaataatgggcggcatgcaaaatggaaaacaaatcttggaaataatagattattgcgaggggaaaatagatatcttactagcgccagtactcatttcaggaaataacgatgaagatcttgatgatataatcatactttctaaaaaaattgcataa

SEQ ID NO: 7598 - protein, 301 aa, Unknown
  Obtained from environmental sample
  DOMAIN (133)...(297): Radical SAM superfamily
  misc_feature (1)..(301): Xaa is any amino acid
MEAEETAQQSKIVGSVNGNEKETSVEFEDISFKEESDGKKIRANFLQNYYWYFTKEELEEIAPFKIKEGKIIFFEREKRVFNKFNQLLGEGFSRLKHIIGDKECLYVHRNSSIPLIGSNEFGVVDRGSNIIEIKPLTGCNLSCTFCSVSEGKDNGKRDIIVEEEYLIEEFSKLAKLKKHPVEANIGPQGEPMLYPQFVKLVADLKKNGASVVSVNTNGTFLNKKIIDELVIAGLDRINLSLHTLNQKKSNEIMGGMQNGKQILEIIDYCEGKIDILLAPVLISGNNDEDLDDIIILSKKIA

SEQ ID NO: 7599 - DNA, 876 bp, Unknown
  Obtained from environmental sample
  misc_feature (1)..(876): n is a, c, g, or t
atgaacatttcacacgaaacgattgaagaagttaaaaaggttgcttatacatggcaaaagaagattcaagtctctagaaagggtaaagaacaagattttcatgagatgatgctaaaaatgcttgaaaatcctgttaataagatctttttaattgaactgcttgatcaatctttccgttctcataatccggacagagtcgcagatcaactggaacatatcttcgcaaaatataagagtacaaatttcttttcgcaatttgaacagatacttatctggctgtttagagatgtaggtgtttatgtaagctctatttcgatccctatgtttatcaagtacctcagaaatgatatctccagtatcgtcattcaaggtgaagaccctgttctttccaagcatatgaaagagagaaaaaaagagggaacacgcgtgaacatcaatgttatcggtgagattgtcttaagtaaggcagaagcggataaaagggttgccaagtatattaagcttttgcaaaacccagatattgactacctctccattaagatctcaaaccttttttctcagatcattcctcatgcgcatgattacaatattgaacagatctcgctccaacttgaaaaagtgtacaaagtggccatacaaaacccgtacatggatgcacaaggcaataagcacgcgaagtttgtaaaccttgatatggaagagtaccgggatctggaacttactattgatgtatttaaacaggtcttagacaaagaagagtttaaagacctctatgccggtatcgtgatccaaaactaccttcctgacgcgattatttacattaaagagttggctgattgggctaaaaacgtgttgaaagcggcggagctcctataa

SEQ ID NO: 7600 - protein, 291 aa, Unknown
  Obtained from environmental sample
  misc_feature (1)..(291): Xaa is any amino acid
MNISHETIEEVKKVAYTWQKKIQVSRKGKEQDFHEMMLKMLENPVNKIFLIELLDQSFRSHNPDRVADQLEHIFAKYKSTNFFSQFEQILIWLFRDVGVYVSSISIPMFIKYLRNDISSIVIQGEDPVLSKHMKERKKEGTRVNINVIGEIVLSKAEADKRVAKYIKLLQNPDIDYLSIKISNLFSQIIPHAHDYNIEQISLQLEKVYKVAIQNPYMDAQGNKHAKFVNLDMEEYRDLELTIDVFKQVLDKEEFKDLYAGIVIQNYLPDAIIYIKELADWAKNVLKAAELL

SEQ ID NO: 7601 - DNA, 789 bp, Unknown
  Obtained from environmental sample
  misc_feature (1)..(789): n is a, c, g, or t
atgtcacttcaaagtgcatattttaaactcacaaatgattacgctgtattgaaacttacatcttctcgtgatattcatacatttcttttaaaaaatcataatttctgttttgaaaatgtttcattatatacgacgttagaaccgtgttcacatgttggtaaaacaccatcttgtgcttctttgatctctgcattaggtataaaaaaagtatacgtaggctttaatgatattaatgatgtagcatctggtggaaatgagatattaagagaaaacagtgttgatgtacaaacctctattttagagataaaatcaagtgatttaataatgccttttaatcagtggaatcaagatagatttgtattttttaaatgggcgcaaagactaaatggtactacagatgccggaacgattagttgcaaaaattcaagaacaaatgtgcatgctatgagagatgtttgtgatctacttgtaatcggtggaaatacagtaagagaagatagaccaactctagatgcaaggcttgtaaatggtaaagctccagatatattaattatatcaagaaaaaatgagtttgataaatcaataccactctttaatgttaaaaatagaaaagtttttatagaagacaatttttctcgccttgataattataaaaatattatgattgagggaagttcaaaaatgtttgaattaactaaagaaattgtggattactatctgtgttatatagcttcaagtatgggcggtgatagtggattgaaaaaactaaagatctcgagccgattctga

SEQ ID NO: 7602 - protein, 262 aa, Unknown
  Obtained from environmental sample
  DOMAIN (118)...(262): RibD C-terminal domain
  misc_feature (1)..(262): Xaa is any amino acid
MSLQSAYFKLTNDYAVLKLTSSRDIHTFLLKNHNFCFENVSLYTTLEPCSHVGKTPSCASLISALGIKKVYVGFNDINDVASGGNEILRENSVDVQTSILEIKSSDLIMPFNQWNQDRFVFFKWAQRLNGTTDAGTISCKNSRTNVHAMRDVCDLLVIGGNTVREDRPTLDARLVNGKAPDILIISRKNEFDKSIPLFNVKNRKVFIEDNFSRLDNYKNIMIEGSSKMFELTKEIVDYYLCYIASSMGGDSGLKKLKISSRF

SEQ ID NO: 7603 - DNA, 744 bp, Unknown
  Obtained from environmental sample
  misc_feature (1)..(744): n is a, c, g, or t
atgaatatttttgatctggatggcaagtcagtcaccgacaaccacaaagataggttgtgggcaaccctgcaacccaacaaacccattacattaacttcggagcataaacggaaagatggctcaagttttccggttgaggtaagaatgagtctgatagacgtaaatggcgaaaagaaaatatttggccttgcaagagatttaactgacagaacaaaagataaattacaacttcaggaaagtgaggagaaattccggaaactaacagaaacaactccaactgctgtaatgatatatcaagatagcaaatgggtttataccaattctgccggttgtgaaatgagtggctattctgaagacgaattattgacaatgaatttcttcgactttgttcatcccgacttcaaagagataattgttgagaaaggggaaaaacgccaaatcggaaaaaatactgaaatagacagatatgaatttaagataatcacaaaacagggtgttgaaaaatgggtgctgctttcgggcgcaacaaccactttccaacataaaccagccgccattatttctgtaatggatataacggatagaaaaaacgttgaattggaattactaaacaagaatgaagaaattgctaggcaaaacgaagaatatgtagctataaacgaggagcttaaccagacgatgganacccctcaagcaatgaatattgaattgngacaagcaaaagaacaaagccgaggagagtga

SEQ ID NO: 7604 - protein, 247 aa, Unknown
  Obtained from environmental sample
  DOMAIN (82)...(143): PAS domain
  misc_feature (1)..(247): Xaa is any amino acid
MNIFDLDGKSVTDNHKDRLWATLQPNKPITLTSEHKRKDGSSFPVEVRMSLIDVNGEKKIFGLARDLTDRTKDKLQLQESEEKFRKLTETTPTAVMIYQDSKWVYTNSAGCEMSGYSEDELLTMNFFDFVHPDFKEIIVEKGEKRQIGKNTEIDRYEFKIITKQGVEKWVLLSGATTTFQHKPAAIISVMDITDRKNVELELLNKNEEIARQNEEYVAINEELNQTMXTPQAMNIELXQAKEQSRGE

SEQ ID NO: 7605 - DNA, 306 bp, Unknown
  Obtained from environmental sample
  misc_feature (1)..(306): n is a, c, g, or t
ttggctattgtctgctttttcatcaacaaaaaattctatctgaaaaaactcttcaaaattaatctggtcaataagaatataaaacatcaaataagttctttcaggtggtgtgcattcaaaaccaagttgccaaacatctttatacaaaacagtttgagttactcctggtttaacagaaaatcttccgatgccaaacaggtcggtaagtccaactgtggggtgttcaaaataacaacttctgaaatactcatcattattttccagaataaatccccagttttcaggtatagagaaagttgtgcctga

SEQ ID NO: 7606 - protein, 101 aa, Unknown
  Obtained from environmental sample
  misc_feature (1)..(101): Xaa is any amino acid
MAIVCFFINKKFYLKKLFKINLVNKNIKHQISSFRWCAFKTKLPNIFIQNSLSYSWFNRKSSDAKQVGKSNCGVFKITTSEILIIIFQNKSPVFRYRESCA

SEQ ID NO: 7607 - DNA, 663 bp, Unknown
  Obtained from environmental sample
  misc_feature (1)..(663): n is a, c, g, or t
atgaactgcttattaatcccaggagtaggtgttatccctgaagactacgttcaggtccgaaatctttttcttgagcatggtgaaaatctcaaaattcttgattctcgggaaatattaaataagaaaaaatgggattcaaactccttggttgatgccataaattcatttaaccataatactaaaattgactatttaataggagtttctttgggcggggcggtcgccatagaatatgccttgaactgtccaaaaaaagttaacaatctagttttgattagtcctcacttaaaacaaattgataattattttattaaaattattcatcgtttaagtgaggcttctgatcaaaatgttaaaagtgggttctcccttaaaggagtattaacatttattgggaggtatttgtctcgattaaagataatcaaaaaagaacttagtctaataggagaattaaacttttttaaaaacgattttcttctttttactaaaactttttttcttcttggagagttggataaaacttgcccaatcaaaaactatcaggccatcaagtcaaaatttattaatcatactttaaccttaattccaaacgtaggccatgaatggagtgatgacttaggattgttagaggaaaatattaaaaaaatagggattttccgatga

SEQ ID NO: 7608 - protein, 220 aa, Unknown
  Obtained from environmental sample
  misc_feature (1)..(220): Xaa is any amino acid
MNCLLIPGVGVIPEDYVQVRNLFLEHGENLKILDSREILNKKKWDSNSLVDAINSFNHNTKIDYLIGVSLGGAVAIEYALNCPKKVNNLVLISPHLKQIDNYFIKIIHRLSEASDQNVKSGFSLKGVLTFIGRYLSRLKIIKKELSLIGELNFFKNDFLLFTKTFFLLGELDKTCPIKNYQAIKSKFINHTLTLIPNVGHEWSDDLGLLEENIKKIGIFR

SEQ ID NO: 7609 - DNA, 522 bp, Unknown
  Obtained from environmental sample
  misc_feature (1)..(522): n is a, c, g, or t
ttgatagtaaatgcaaaaataggtgtagatatagagagtctcataaaaaagataaacttactctcaccagatatagaagcaaaaagcacatcagcatttgtagataactacaaccagtttaaaatcatagagacatcttcaaaactgatctctattttggctttctttatgggattagttggtgtgatctcgctcatgagcatctctgtaaatgagagaaaagaggagtttgggattttaagagccataggcaaaagcagactcttcatagtaaaaaaacttatttttgagagtagctttttatgggttgtctcgtttttaatctctttaggtttctcgtttggacttatagaatttttgaaaaatattgagaagtttcaaggctacataaacggtgatatctcaaatgagctgacactctttgtggctcttctatcttatgctatggcggtattgggctcgattgttccggcatattttgcagctaaaactgatccgtttatttcagctcaaagaggttga

SEQ ID NO: 7610 - protein, 173 aa, Unknown
  Obtained from environmental sample
  DOMAIN (2)...(166): Predicted permease
  misc_feature (1)..(173): Xaa is any amino acid
MIVNAKIGVDIESLIKKINLLSPDIEAKSTSAFVDNYNQFKIIETSSKLISILAFFMGLVGVISLMSISVNERKEEFGILRAIGKSRLFIVKKLIFESSFLWVVSFLISLGFSFGLIEFLKNIEKFQGYINGDISNELTLFVALLSYAMAVLGSIVPAYFAAKTDPFISAQRG

SEQ ID NO: 7611 - DNA, 591 bp, Unknown
  Obtained from environmental sample
  misc_feature (1)..(591): n is a, c, g, or t
ttggtaaataataaatttaactataccgatattagtgatgattgtatcaagtgtggtaaatgtaaaactgtatgtaccatatttaatgtcaatcaagatgaaacaacctctcctagaggttttatagaccttcttggagcttataaaagagatgaattagagctagataaaactgcaaaagatatttttgaaagttgttttttatgtacaaactgtgtagaggtttgtccaaatgacttaccaacagatatgataatagaacaagtacgaagtgatattgcaaaaaaatatggaatagcttggtacaaaagagcttttttcttccttttaagacatagaaaaattatggattttatggcgaaaatgggatgggtatttcaaacttgtggtcttaaaatagatgctcaaagccaaagttcaaaattacgattgaatctaccaatagagatgataaaagacagaactttaccttttgcagacagaacatcgtttttaaactctaatccagaaaatatcatccatcataaagagaataaagagttcaaaaaagtagctgtattttatggatgtatggggaactatgcatataca

SEQ ID NO: 7612 - protein, 197 aa, Unknown
  Obtained from environmental sample
  DOMAIN (59)...(82): 4Fe-4S binding domain
  misc_feature (1)..(197): Xaa is any amino acid
MVNNKFNYTDISDDCIKCGKCKTVCTIFNVNQDETTSPRGFIDLLGAYKRDELELDKTAKDIFESCFLCTNCVEVCPNDLPTDMIIEQVRSDIAKKYGIAWYKRAFFFLLRHRKIMDFMAKMGWVFQTCGLKIDAQSQSSKLRLNLPIEMIKDRTLPFADRTSFLNSNPENIIHHKENKEFKKVAVFYGCMGNYAYT

SEQ ID NO: 7613 - DNA, 597 bp, Unknown
  Obtained from environmental sample
  misc_feature (1)..(597): n is a, c, g, or t
atgcttcacagacctattgactttggacatgctcgtgtagatatgacaaaagcatacatcaaacaacactacgcacttgacgtagaagacataaagataaaaccaaagatgattgttctgcactggactgctgttatggactttgaagattgttttaaaagactaaagggaaacaaactctacagtgacagaggagacatagcaagcgcaggagcgcttaatgtttctgctcattttttagtggctagagatgggactattaaccaactaatgcccgataattggatggctaggcatgtcataggacttaactattcgagtatagggatagaaaatattggtggcgaaaataatgtaaaagatgacttaacagatgctcaagtagatgcaaatataaaacttgtcaaatatctaaaagcaaaatacccaaagatcgaatacctcatcggtcatcatgaatatcaaaaaatgaaaaaacttcctttatggctagagttagaccctttatatataacagagaaagctgatcctggagataagtttatgagcagtgtcagaagtgaagtaaaagatttaaacttaaaaggttcaaaatga

SEQ ID NO: 7614 - protein, 198 aa, Unknown
  Obtained from environmental sample
  DOMAIN (24)...(188): N-acetylmuramoyl-L-alanine amidase
  misc_feature (1)..(198): Xaa is any amino acid
MLHRPIDFGHARVDMTKAYIKQHYALDVEDIKIKPKMIVLHWTAVMDFEDCFKRLKGNKLYSDRGDIASAGALNVSAHFLVARDGTINQLMPDNWMARHVIGLNYSSIGIENIGGENNVKDDLTDAQVDANIKLVKYLKAKYPKIEYLIGHHEYQKMKKLPLWLELDPLYITEKADPGDKFMSSVRSEVKDLNLKGSK

SEQ ID NO: 7615 - DNA, 918 bp, Unknown
  Obtained from environmental sample
  misc_feature (1)..(918): n is a, c, g, or t
gtgtatgggattgaaaaagattacagacttgtaaaaactgcaaaagttggatgttatgtacatggggacggcttagcaaaagttatccatggagatggactctctaactttacaaatacaaaagagtataaagggaagttggcacataacgataaaacttattcacaagataataaaaaatttgatattgtagtttcaaatcctccatactctgtaagtgcttttaaaaatgtgagtaaaaagtttgatgaaaatgattttgaactgtataatagattaacagaccaaagtagtgagatagaagctttgtttattgagagaacaaaacagcttttaaaagatggtggtatagctggaatagtactgcctagttctattttaacaggtggtgggatttatataaaaactagagagattatatttaaatattttgatattataagtataaccgaacttggttctaatacttttatggcaacaggaacaaatacagttgttttattcttacgaagaaaaaataatatggaacatataaatatacaaacatctgttgaaaagctttttgaaattaaaacagatattactattaatagtatagagaaacctctgtcaaaatatcttgcttttgtatgggaaaatataacgcttgatgactatatctcttttatggaaaaaaatccaaatgatacaataaaatcacatactatctatcaagattatgataaaaagtttgatgatattgacaagatattagagatagaaaaagagaaacttttatattttattttggcatataaacaaaaagtaactatagtaaaaacaggtgcaaaaaaagaagagaaaattttcttggatatgaatttagtaatagaagaggaagtgaaagtatacatcccatttcaagaggaaaaagcatag

SEQ ID NO: 7616 - protein, 305 aa, Unknown
  Obtained from environmental sample
  misc_feature (1)..(305): Xaa is any amino acid
MYGIEKDYRLVKTAKVGCYVHGDGLAKVIHGDGLSNFTNTKEYKGKLAHNDKTYSQDNKKFDIVVSNPPYSVSAFKNVSKKFDENDFELYNRLTDQSSEIEALFIERTKQLLKDGGIAGIVLPSSILTGGGIYIKTREIIFKYFDIISITELGSNTFMATGTNTVVLFLRRKNNMEHINIQTSVEKLFEIKTDITINSIEKPLSKYLAFVWENITLDDYISFMEKNPNDTIKSHTIYQDYDKKFDDIDKILEIEKEKLLYFILAYKQKVTIVKTGAKKEEKIFLDMNLVIEEEVKVYIPFQEEKA

SEQ ID NO: 7617 - DNA, 549 bp, Unknown
  Obtained from environmental sample
  misc_feature (1)..(549): n is a, c, g, or t
atgatgcacgaaatatttaattctgccaaacgaccattttttgcaagttgtaccaatatgagtatggaggctatatcagaaactgaatataaaaaattcatcaaaaaacattttaataatgcaggtagaacaattagtgatgaatgtttaaattttatttgcgattggactcaattgcataccttttacactcaatatttttgttacaccttatttgctctgaataaaaataataatggaatagaagaagcaaaaattgctgcacaaacaatattaaaactgaatgaacctactttttttcaatacaaaaacttattaaccgaatcgcaatggaagtttttaattgctgtaggtaaagagacaaaagtgtatcaacccaatgcaaaaaaatttattaatacacatcaattaggaacaccatctacggttaccagaagtttagaagcgttaattactaaagaaatgttgtttcataatacaggtgtagcacaaccttattatgaagtttacgacaagtatctgatgcgttggatacaaattaagtattga

SEQ ID NO: 7618 - protein, 182 aa, Unknown
  Obtained from environmental sample
  misc_feature (1)..(182): Xaa is any amino acid
MMHEIFNSAKRPFFASCTNMSMEAISETEYKKFIKKHFNNAGRTISDECLNFICDWTQLHTFYTQYFCYTLFALNKNNNGIEEAKIAAQTILKLNEPTFFQYKNLLTESQWKFLIAVGKETKVYQPNAKKFINTHQLGTPSTVTRSLEALITKEMLFHNTGVAQPYYEVYDKYLMRWIQIKY

SEQ ID NO: 7619 - DNA, 765 bp, Unknown
  Obtained from environmental sample
  misc_feature (1)..(765): n is a, c, g, or t
gtgagtgttgttatggttaagttctttttagaacgtgatattaatgaggcaacaaatgatgtaagagataaggtttctgcagttattttgccaagtgatgctgaaactccgcttgtaagcaagttagatattggtggggcatctatcatcaatgttttcttaactgctaaagatgctccaataaaagatcttatgttgttttcagatgagaaagcaaaaccaaaactacaaaaaattaatggggttggagctgttaatatcgtagggtataaagatagagaaattaaaatatttcccgatcctaagttattaaacaagtttggaattacagtagctgaattaaactcaatagcagcaaaagaaaatgttaaaattggcggcggtaaattaatctcagaaaccaaagagttcacactaaagacaaaagcagatgccttgagtgtgaacgagcttcaaaatatcaagataaaagataacattaaacttaaagatattgcaaaagttgaggactctctaagtgatgcgaagagttactcctcatataatggtgttgaaggtgtgatgcttgagattcagaaaatctcaggaaccaatacaatagatatagttcaaagggtaaaagagacagtccctgctttaagagaattagcgggggagaagtatgatataaaaatcttaaatgacccatcaccgtttttaaacaactcactaaagcatggggaagttgaccttatttatgggtccgtccttggcaggtggaaataa

SEQ ID NO: 7620 - protein, 254 aa, Unknown
  Obtained from environmental sample
  misc_feature (1)..(254): Xaa is any amino acid
MSVVMVKFFLERDINEATNDVRDKVSAVILPSDAETPLVSKLDIGGASIINVFLTAKDAPIKDLMLFSDEKAKPKLQKINGVGAVNIVGYKDREIKIFPDPKLLNKFGITVAELNSIAAKENVKIGGGKLISETKEFTLKTKADALSVNELQNIKIKDNIKLKDIAKVEDSLSDAKSYSSYNGVEGVMLEIQKISGTNTIDIVQRVKETVPALRELAGEKYDIKILNDPSPFLNNSLKHGEVDLIYGSVLGRWK

SEQ ID NO: 7621 - DNA, 453 bp, Unknown
  Obtained from environmental sample
  misc_feature (1)..(453): n is a, c, g, or t
atgccatcaataaaatatcttttaagcttttttttaatcatttcgctttcattaaacaccaaggcacaactgttagatgctaataaacaactttttgatgatgagccttttttcaatgaaaaattcattaaaaccaacaaaataaaatccattaaaggaagttggtcatctaaaaaagtaaaagatattattcgaaagaaaaatgtagatttctattacgagtttgatgaaaatggcatgttacaacagcaatactctacctttctatctcaagacattaaaaaagacacaagtgtgattgcttatacttataatagtgaaaacaaaattattgtaaagcgaanaacagataataatggttttttttcactgacttatgattatgatgctaaaggtaacttaataaaagagacttatgctcgtgaggaaaatgcgagcaatactaaaaatgat

SEQ ID NO: 7622 - protein, 151 aa, Unknown
  Obtained from environmental sample
  misc_feature (1)..(151): Xaa is any amino acid
MPSIKYLLSFFLIISLSLNTKAQLLDANKQLFDDEPFFNEKFIKTNKIKSIKGSWSSKKVKDIIRKKNVDFYYEFDENGMLQQQYSTFLSQDIKKDTSVIAYTYNSENKIIVKRXTDNNGFFSLTYDYDAKGNLIKETYAREENASNTKND

SEQ ID NO: 7623 - DNA, 762 bp, Unknown
  Obtained from environmental sample
  misc_feature (1)..(762): n is a, c, g, or t
ttgttcctttttaaaaatgggggaggaaattcccccaggaagaggctggatgaactttttgcctatgtagccaaaatttccgaggaactaccttatttacggctatttcgggttcggattaccagactttccaataaatcctttatgcccaaagtgggtgccgaaaacatccgttttttcaagccatccgaaagagaagcgatctttcatctttctcagcacgccaaatcgatcggacttcagatcacaaactccgcgatagcacatcttctaagaagccagaacttcgatctttcccttgcctcaaatgagcttgccaaactggcagttctgggtcagcccatccatgaaaaagagatcgatgagcatgtctttcctctggctgaagtcaagctcgaccagcttatcatggcccttttggaaaagaaagacttcaaagcgaacctgcacagactcctggagacaggcgagaacgaaatccagatacttaccgccatcaccaacttcatcactcagctcttcctctttcacacctacatcaaaatacacggtgtgatagactcttctgctattttgggttacaggcttccgggatttatcgaaaaagagcgtgcttccctgtcaatacgctttaaacttcgtacctatgaaaagcttctggaccatctcctctcaactgaactgatgcttaaaagcggcgggcacaaggacaccaatgccatccttctctcagcactgttgaaacttcaaaccctcatttaa

SEQ ID NO: 7624 - protein, 253 aa, Unknown
  Obtained from environmental sample
  misc_feature (1)..(253): Xaa is any amino acid
MFLFKNGGGNSPRKRLDELFAYVAKISEELPYLRLFRVRITRLSNKSFMPKVGAENIRFFKPSEREAIFHLSQHAKSIGLQITNSAIAHLLRSQNFDLSLASNELAKLAVLGQPIHEKEIDEHVFPLAEVKLDQLIMALLEKKDFKANLHRLLETGENEIQILTAITNFITQLFLFHTYIKIHGVIDSSAILGYRLPGFIEKERASLSIRFKLRTYEKLLDHLLSTELMLKSGGHKDTNAILLSALLKLQTLI

SEQ ID NO: 7625 - DNA, 843 bp, Unknown
  Obtained from environmental sample
  misc_feature (1)..(843): n is a, c, g, or t
atgcttaaagacagaaaactgatcgtaaaatctatcttctctaactatagtgttcctgagggttatcgttttataaatgagagtgacgaatggatcattaatgctaaaattgacggtaaaattttacttcaaaaaagtgataaaagcagtagtgatataacaatagatgttaaaaaaacagttgcagcagcaagtgtaaaagatgatatgttagctattttgtttgcaaacaatgaaacagcaatatattcacttagcacaaaagagatgatatttaaagaagaggcaactgcacctatcgctcttgatgcacgtatagctaatccttatatatttaatgatctggtaatatttttatctttagatggaaaaattcaaattgtcaactcaaaaagtaaaaaagtgcttcgctcgattacacttggtaaaaaagagtattttgatgacataatctactttaatatgataaataacatcatggtagcagcaacaagtcatacaattctctcttttggtattaaagaatttcgccaaaattatgatattcgtgatgtagtatataatgaagatggaatctgggttactaccaagcagggtgaagtgattgcactggatccggctcttgaagtaaaagcttcaaaaaagtttccatttgctcattttttgggaatgattgttagaaatgacaaagtttatgtaattgaaaaagagggttatctgatcgttttagataaagatcttaaagagcataaaatttatgatgcagatgtaggtgacggatttgtatttgtaagtgatgatgtattttttaatgacaactcttacataaaatgtaaagagtaa

SEQ ID NO: 7626 - protein, 280 aa, Unknown
  Obtained from environmental sample
  misc_feature (1)..(280): Xaa is any amino acid
MLKDRKLIVKSIFSNYSVPEGYRFINESDEWIINAKIDGKILLQKSDKSSSDITIDVKKTVAAASVKDDMLAILFANNETAIYSLSTKEMIFKEEATAPIALDARIANPYIFNDLVIFLSLDGKIQIVNSKSKKVLRSITLGKKEYFDDIIYFNMINNIMVAATSHTILSFGIKEFRQNYDIRDVVYNEDGIWVTTKQGEVIALDPALEVKASKKFPFAHFLGMIVRNDKVYVIEKEGYLIVLDKDLKEHKIYDADVGDGFVFVSDDVFFNDNSYIKCKE

SEQ ID NO: 7627 - DNA, 402 bp, Unknown
  Obtained from environmental sample
  misc_feature (1)..(402): n is a, c, g, or t
ttgaactttttaaatagtttcagcataaaatcaaaactgttaattctctattttttagttacggttgctcttcttgtaattagtgttatcggcttttttaatatgaatgctatgaagaaaaacttagactcactctattttggctcacttatccctgttgtaaatttgaataaaattttagatagctactcaaatggagttgagggtacatttcataagcttataaccgactccatcagttctgaagaagcctctgtaaaaatagataagagtttagcagatgttatgaaactttggcaaaattatgcaacaagttataaaagtgataatgaaaaacctatcatagatgctactactaaacagataacaaatctgaaatactaccctcgagccgattcttaa

SEQ ID NO: 7628 - protein, 133 aa, Unknown
  Obtained from environmental sample
  misc_feature (1)..(133): Xaa is any amino acid
MNFLNSFSIKSKLLILYFLVTVALLVISVIGFFNMNAMKKNLDSLYFGSLIPVVNLNKILDSYSNGVEGTFHKLITDSISSEEASVKIDKSLADVMKLWQNYATSYKSDNEKPIIDATTKQITNLKYYPRADS

SEQ ID NO: 7629 - DNA, 555 bp, Unknown
  Obtained from environmental sample
  misc_feature (1)..(555): n is a, c, g, or t
gtgaaaatttgtgattttaatgatagaaaactaattttagagacagaaaattttaaatttttgctagtacgtaatcaagatgttgcgacatatgtttatcatcaggcagctgatatcggggtagtaggaaatgacacactggatgaacaaggtcttgatgtaattagacttcttgatttagagcgtgagaagtgtaaagttgcaattggtatgaaaaacggtgaaaaacttgatcttactaagccggagttgaaagtggcgacaaagatggtaaatatcacaaaacgctactttgcagagcgcgctgtggctgctgatattatcaaactctatggctctattgaattggctcctttagttggcttagctgatatgatcgtagatattgtagatacaggtgctacgatgaagcaaaatggcttagaagttgttgagactatcatggactcatcgactcaccttattgcaaataaaaacagcttttttgagaaaaaaggcgaaattttagatatatatgaaaaaatagaaaaagtcgttgttgatagtcgtaaatag

SEQ ID NO: 7630 - protein, 184 aa, Unknown
  Obtained from environmental sample
  DOMAIN (23)...(179): ATP phosphoribosyltransferase
  misc_feature (1)..(184): Xaa is any amino acid
MKICDFNDRKLILETENFKFLLVRNQDVATYVYHQAADIGVVGNDTLDEQGLDVIRLLDLEREKCKVAIGMKNGEKLDLTKPELKVATKMVNITKRYFAERAVAADIIKLYGSIELAPLVGLADMIVDIVDTGATMKQNGLEVVETIMDSSTHLIANKNSFFEKKGEILDIYEKIEKVVVDSRK

SEQ ID NO: 7631 - DNA, 864 bp, Unknown
  Obtained from environmental sample
  misc_feature (1)..(864): n is a, c, g, or t
gtggtattagagtacggtgatggaacagataaaaaaataaatcctatcatcttagaaaatgagagttataaaaaattatcaaattctacagttaaaaagatgagcagaaaaaaacagaaaaaaatagctatcccaaaagaagatataacaactatcaaagagataaaaatagacaacttctttagtatagaaaaacttagattagataatttagataagaaaaaagagatctacatagtcggtgaaaatggtgatggaaaaactttacttctgcaagctatagcactggctttaaaaggaacaactgagggtagagttgttgactttcttaaaacagataagagaaaaaaagagtatacattagaggttatagacagcaaagatgagttatttactgccaatgcttcaaaaacttatagaaatatgtttgcttacggtgctcatagaaacaataactgtaaaagtgaagatgaagagagtggatatttaactctatttgacaatagcatagatttaaaagatcctaaaaagtggctaatagaactctacaatgcgcaaatgtcacaagaagaaaatatcttatctgttgatgatgcaaaaaaactattaagtgttttactaagtagtgaaaacaatagtgagattgagatagatataagatataacagtgttgatttttttgaaaaagatactcctgtaagttttgaacaactatcagcaggttataaaagtgttataacgatagttggtgatctgattgtaagactgtctgaaaatcagcctcatgtaatgagcactgaggagtttgagggaatagttttaatcgatgagattgaacttcatcttcatccaaaatggaaataa

SEQ ID NO: 7632 - protein, 287 aa, Unknown
  Obtained from environmental sample
  misc_feature (1)..(287): Xaa is any amino acid
MVLEYGDGTDKKINPIILENESYKKLSNSTVKKMSRKKQKKIAIPKEDITTIKEIKIDNFFSIEKLRLDNLDKKKEIYIVGENGDGKTLLLQAIALALKGTTEGRVVDFLKTDKRKKEYTLEVIDSKDELFTANASKTYRNMFAYGAHRNNNCKSEDEESGYLTLFDNSIDLKDPKKWLIELYNAQMSQEENILSVDDAKKLLSVLLSSENNSEIEIDIRYNSVDFFEKDTPVSFEQLSAGYKSVITIVGDLIVRLSENQPHVMSTEEFEGIVLIDEIELHLHPKWK

SEQ ID NO: 7633 - DNA, 528 bp, Unknown
  Obtained from environmental sample
  misc_feature (1)..(528): n is a, c, g, or t
ttgaaacaactatcagcaggttataaaagtgttataacgatagttggtgatctgattgtaagactgtctgaaaatcagcctcatgtaatgagcactgaggagtttgagggaatagttttaatcgatgagattgaacttcatcttcatccaaaatggaaatataattttatgaaaaaactgagagatatatttccaaaaattcagtttattgtaactacacacagccctacagtcattttaggtgcaagtgaagaagcggtattttataaggtctataaagaggatggaaaagtagaaattacagatcaaatcatcaacaaaggctacacaaacaacactcttatctcttcacctctatttgatctggagacaatggcttcaagaaattatgatgataaaaactttagtgatgatgattttatctatgaaaaaattcatcaagtagtagcagcaaaaatcaaagaagatagagatatgagtgaagaggaaatatcaaaattaattgaagaagaactgaaaaacttatga

SEQ ID NO: 7634 - protein, 175 aa, Unknown
  Obtained from environmental sample
  misc_feature (1)..(175): Xaa is any amino acid
MKQLSAGYKSVITIVGDLIVRLSENQPHVMSTEEFEGIVLIDEIELHLHPKWKYNFMKKLRDIFPKIQFIVTTHSPTVILGASEEAVFYKVYKEDGKVEITDQIINKGYTNNTLISSPLFDLETMASRNYDDKNFSDDDFIYEKIHQVVAAKIKEDRDMSEEEISKLIEEELKNL

SEQ ID NO: 7635 - DNA, 792 bp, Unknown
  Obtained from environmental sample
  misc_feature (1)..(792): n is a, c, g, or t
atgcaaaacaaaccaacttatcaagaacttgaaaaagaattagaaattttaaagaaaagtaaaaaagctcaagttttaatagataggtcagacttgatttttatagaaactgatttaagaggaatagttacatatgtaaatgaaaaagcttgtgaaatttttggttataaaaagacagaaattattggtaaaaattggtttgaaaactttataccagaacatataaaaagtgaaattcaagtattatttaataatattatttcaagaaaaattgattctttgaaacatgttgataatttaattttgaccaaaaacggagaagaaagacttattagatggaacaatgttgcaaacttagatgaaaatggtgaaataattggaataattagttctggagaagatatcacagaaaggagaaatgttgaaacccaattattagaaactaagaatattatcgaaagaagccctatggttctttttctgtggaagaatcaagaaaatttgcctgttgagtttgctacaagaaatggagatacaatatttggttattcttcacttgaatttatgacaaataaagtgaattacaacaaaattattcaccccgatgatcttcatagagtagttagtgaaattgaagataattgtagcaataatattaactgttttactcttaaattttatangattataactaanacaggtgaaataaagtggttgaaagatgataggtatgttagaaagaatgaagatggccaaattactcaatttgaaggaatattacagatttaccgg

SEQ ID NO: 7636 - protein, 264 aa, Unknown
  Obtained from environmental sample
  DOMAIN (21)...(84): PAS domain
  misc_feature (1)..(264): Xaa is any amino acid
MQNKPTYQELEKELEILKKSKKAQVLIDRSDLIFIETDLRGIVTYVNEKACEIFGYKKTEIIGKNWFENFIPEHIKSEIQVLFNNIISRKIDSLKHVDNLILTKNGEERLIRWNNVANLDENGEIIGIISSGEDITERRNVETQLLETKNIIERSPMVLFLWKNQENLPVEFATRNGDTIFGYSSLEFMTNKVNYNKIIHPDDLHRVVSEIEDNCSNNINCFTLKFYXIITXTGEIKWLKDDRYVRKNEDGQITQFEGILQIYR

SEQ ID NO: 7637 - DNA, 939 bp, Unknown
  Obtained from environmental sample
  misc_feature (1)..(939): n is a, c, g, or t
atgcttttatatatacatattccattttgtgatagtaagtgtttttactgcgcgtttaactcttatacacacttacacagcttaaaaaatgattatatggttgctttaaaaaaacaacttaaatatgaactacaattaagagatgaaaaaatagaaactatctttataggtggcggaactcctagtactatagaagcttccaaatataaagagatttatgagattgtaaagccataccttctaaaaaatagtgaaatcactatagaagctaacccaaattctgcaacatttgactggcttgaagagatacatagtataggtatcaatcgtataagttttggagtacaaagttttgatgatgacaaactacaatttttagggagaaatcacaataaatcacaagcaattcaagctataaaaaatgcaaaagagattggctttgagcatattaactgcgacataatatatgacacaaaattagacactcaacaattactagaaaatgatttagtgatcatcaaagatttacctatagaccatattagtgcttatagtcttactatagaggaggggactaaattttttaataaaagtaatgtacaagtagaaaatatagaattagctcaatacctctttgatcaattaaactctttgggattcaatcaatatgagatatctaattttgctttaaataataaagctagaagtaaacacaaccttggatattggcaatataaagagtatttaggagttggaagtggagctgttggttgtatcgatgcccaaagactatattcatcaaaagatattcaaaaatatatagataatccacttcaatacgaagaggtagaaaaattatcatcagaagatattgcaatagaaaaaactctctgggattcgcagcattgtaggtgttacatatcaatgttcaataatgaa

SEQ ID NO: 7638 - protein, 313 aa, Unknown
  Obtained from environmental sample
  DOMAIN (4)...(169): Radical SAM superfamily
  misc_feature (1)..(313): Xaa is any amino acid
MLLYIHIPFCDSKCFYCAFNSYTHLHSLKNDYMVALKKQLKYELQLRDEKIETIFIGGGTPSTIEASKYKEIYEIVKPYLLKNSEITIEANPNSATFDWLEEIHSIGINRISFGVQSFDDDKLQFLGRNHNKSQAIQAIKNAKEIGFEHINCDIIYDTKLDTQQLLENDLVIIKDLPIDHISAYSLTIEEGTKFFNKSNVQVENIELAQYLFDQLNSLGFNQYEISNFALNNKARSKHNLGYWQYKEYLGVGSGAVGCIDAQRLYSSKDIQKYIDNPLQYEEVEKLSSEDIAIEKTLWDSQHCRCYISMFNNE

SEQ ID NO: 7639 - DNA, 420 bp, Unknown
  Obtained from environmental sample
  misc_feature (1)..(420): n is a, c, g, or t
atgaatcatataaaacagcaatatttaaacttatttaaagtgttaaaatatcttttgttacttttaatagttaccataatatcttgtaaatctgaggatacgcttcaactaattactaatggcgtttcaaattatgaaattgtttttaatggtgaagcaaatgaaagtgaatataaagctacggaggtattaaaaacttatattgataaaattagtaatgcaaacattccaattgtagatgaaagttctcaaaattcgcaattaaagaaaatttatgttggtaatttttcaaaagaatcattaattgcagatgaacttttaattaaagtagagaatgataatttgtatatatctggagggtctgatttagcaattcaaaatgcagtttatcgagtttctagaaaactatttaaattgtaa

SEQ ID NO: 7640 - protein, 139 aa, Unknown
  Obtained from environmental sample
  misc_feature (1)..(139): Xaa is any amino acid
MNHIKQQYLNLFKVLKYLLLLLIVTIISCKSEDTLQLITNGVSNYEIVFNGEANESEYKATEVLKTYIDKISNANIPIVDESSQNSQLKKIYVGNFSKESLIADELLIKVENDNLYISGGSDLAIQNAVYRVSRKLFKL

SEQ ID NO: 7641 - DNA, 528 bp, Unknown
  Obtained from environmental sample
  misc_feature (1)..(528): n is a, c, g, or t
atgagttttcttaaactaaagagtgataaaagagttttaatttcaccctttacacctctaagcattgccttaagaaagtttatagagagtgagtttaatgctcattttttgggcttcatagatagcagtaaaagcggtgatgagattttcaatccaaaagagatagagagtttagattttgatctgattttgattttatctccaaatcatgcattaaatatttttaatgctcttagtaaacactcaaaaaaatctaaactacagattatagatcttcaacatggaagctattttattcaaaatgtctggcaactgaaactaacaaaattgcaagagtcaatctctgtaaatatcatgaaacactcgatcaaatatctgaaaaagttttttgtaaagaaaaaccacattctatttttagcaccggactttgtagacaataatattaaagatctctatatctacatatctactcaaacagactatagagctgtgatagcaactaataatctttctcatgaagagctttaa

SEQ ID NO: 7642 - protein, 175 aa, Unknown
  Obtained from environmental sample
  misc_feature (1)..(175): Xaa is any amino acid
MSFLKLKSDKRVLISPFTPLSIALRKFIESEFNAHFLGFIDSSKSGDEIFNPKEIESLDFDLILILSPNHALNIFNALSKHSKKSKLQIIDLQHGSYFIQNVWQLKLTKLQESISVNIMKHSIKYLKKFFVKKNHILFLAPDFVDNNIKDLYIYISTQTDYRAVIATNNLSHEEL

SEQ ID NO: 7643 - DNA, 384 bp, Unknown
  Obtained from environmental sample
  misc_feature (1)..(384): n is a, c, g, or t
gtgtctactacgcaaaaaagaggagggcgcatagtggtaaaaaaaggcacccttacaaaactccccataaaaagagatgataacaagttctatattgttgctagtaaatcgcacctctctgatgagacaaaagagtacatagaaaatatagagactacnaaagagaaagttttaacctccataggaagctctcttaaactctgcatggtggctgaaggtgttgcagatatctaccctcgccatgcaccgacaagtgagtgggatacgggcgctgctcatgccgtagttcttgaagctggtaaagatgttgtagatgcttatgaaaactcctctttgatctacaacaaagagagtgttttaaatccgttttttatagtgaagtag

SEQ ID NO: 7644 - protein, 127 aa, Unknown
  Obtained from environmental sample
  misc_feature (1)..(127): Xaa is any amino acid
MSTTQKRGGRIVVKKGTLTKLPIKRDDNKFYIVASKSHLSDETKEYIENIETTKEKVLTSIGSSLKLCMVAEGVADIYPRHAPTSEWDTGAAHAVVLEAGKDVVDAYENSSLIYNKESVLNPFFIVK

SEQ ID NO: 7645 - DNA, 603 bp, Unknown
  Obtained from environmental sample
  misc_feature (1)..(603): n is a, c, g, or t
atgagtgaaaaaaacattatatggcataatcagcatgtaaaaaaagaggatcgctcaaaactcaaaactcaaaagccttgcatactctggtttacggggctaagcggaagcggtaaatcaaccatagcaaatgcacttgagttgaaacttcacgagaaagactatcatacatatctactagatggcgataacataagacatggattaaactctgatcttggatttgatgaaattagcagagttgaaaacattcgccgtatcggtgaagtggcaaaactctttgtagatagcggaactattgttttatctgcttttatatctccatttataagtgacagagagagagtaaaaaagttagttgaagaggatgaatttatagaaattttcgtagatactccacttgatgtttgtgaaagcagagatccaaaaggactatacaaaaaagcaagagttggtgagatatccgactttacaggaatcagttcaccttatgaaaaacctacaaatccatccatacagattaaaacancagagtgcgctgttgagctatgtgtagaccaaattatagagcacatgaaagaaaaagggtatataaatggttaa

SEQ ID NO: 7646 - protein, 200 aa, Unknown
  Obtained from environmental sample
  DOMAIN (25)...(181): Adenylylsulphate kinase
  misc_feature (1)..(200): Xaa is any amino acid
MSEKNIIWHNQHVKKEDRSKLKTQKPCILWFTGLSGSGKSTIANALELKLHEKDYHTYLLDGDNIRHGLNSDLGFDEISRVENIRRIGEVAKLFVDSGTIVLSAFISPFISDRERVKKLVEEDEFIEIFVDTPLDVCESRDPKGLYKKARVGEISDFTGISSPYEKPTNPSIQIKTXECAVELCVDQIIEHMKEKGYING

SEQ ID NO: 7647 - DNA, 882 bp, Unknown
  Obtained from environmental sample
  misc_feature (1)..(882): n is a, c, g, or t
gtggttcctttgaaggtgtcgcaaaaggagctattgctaatggctaggttacctgcgctattattttcattggttttagtgagtggcttaacaatctcgcaagttgttgtcgcaaaaacacaattaactgagcaattctttcaaggtgcattaattgttggtaaaacagcacccgaaaataaggtacaccttaacggtaaagctattaaagtatcgggttcaggtgactatgtactaggttttagccgcgatgaaaaaaacaatagcgtattaactattgttagcccaaaaggtgaggttgaaaaacgcaccttaaaacctttaaagcgtgaatataatattcaacgaattgaaggcattgcaaagaaaattatgaatcccaacaaaaaagccaatattcgtgtaggggaagataataaaaaaattaaagcagcgcgcaccatcgacagtgactttacggcttttgctcaaggttttattgcccccattgaaggcactattactggggtttacggcagtcaacgttactataatggcgtacctaagtggccacattacggcttagattatgcgggcaataccggtgatcctgtgaaagcacctgctgatggtgtggtacttatgtatgtgcctgatatgttttattctggtggcacaatgatcatagatcacggccacggcgtcagctcaacatttttacatttgagtgactcttatgtaaaagttggcgataaggtaagcaaagggcaagtggttgctgcggttggtgcaagcggtagagcaacaggtccacatcttgattggcgaataaattggttcaatgtcaggttagatccggcattggtattaaagcttaagccttggaataaaactattaaataa

SEQ ID NO: 7648 - protein, 293 aa, Unknown
  Obtained from environmental sample
  DOMAIN (183)...(279): Peptidase family M23
  misc_feature (1)..(293): Xaa is any amino acid
MVPLKVSQKELLLMARLPALLFSLVLVSGLTISQVVVAKTQLTEQFFQGALIVGKTAPENKVHLNGKAIKVSGSGDYVLGFSRDEKNNSVLTIVSPKGEVEKRTLKPLKREYNIQRIEGIAKKIMNPNKKANIRVGEDNKKIKAARTIDSDFTAFAQGFIAPIEGTITGVYGSQRYYNGVPKWPHYGLDYAGNTGDPVKAPADGVVLMYVPDMFYSGGTMIIDHGHGVSSTFLHLSDSYVKVGDKVSKGQVVAAVGASGRATGPHLDWRINWFNVRLDPALVLKLKPWNKTIK

SEQ ID NO: 7649 - DNA, 504 bp, Unknown
  Obtained from environmental sample
  misc_feature (1)..(504): n is a, c, g, or t
atggctgacgctgtttacgccgaagcaaaccctatcttcaaaaccagaacaggtaaagatattgacatggttttattaaattatggagggattcgttccattcttccaaagggtaatataaccaccaaaacggcttttgaattgatgccgtttgaaaactctatcgttgttgttgaacttaaaggaaagcaaattgatagcttagtttcttatttgtgtaaaagcaaaagagcacatcctatttcaaaattaaaacttagtatagacaaaaattttaagcttttaaatgcaactgttaaagaacaagccattgatacttcaaaaacatattatgttgctacaaatgactacttgtataacggtggagataatatgactttctttaaacctaatgatagtttatataatttaaactataaaataagaaatatactaatagattatttcaaaaaaacagacactatcaatcctactattgatgatagatttgttcaaattaaataa

SEQ ID NO: 7650 - protein, 167 aa, Unknown
  Obtained from environmental sample
  DOMAIN (5)...(130): 5'-nucleotidase, C-terminal domain
  misc_feature (1)..(167): Xaa is any amino acid
MADAVYAEANPIFKTRTGKDIDMVLLNYGGIRSILPKGNITTKTAFELMPFENSIVVVELKGKQIDSLVSYLCKSKRAHPISKLKLSIDKNFKLLNATVKEQAIDTSKTYYVATNDYLYNGGDNMTFFKPNDSLYNLNYKIRNILIDYFKKTDTINPTIDDRFVQIK

SEQ ID NO: 7651 - DNA, 912 bp, Unknown
  Obtained from environmental sample
  misc_feature (1)..(912): n is a, c, g, or t
ttgagccggcttatgcaccgctttggtttaatgtatgaagtaccggagtcaaaaacatatgttgtgcctgcgcatttatctgccctccaaccatacgttgattggcaatacgaaaatgaaacggaagttttgcaatttgcctacgagtttgataaatacatgccaaaaggtattatgccaaggatcatcgttgccttgcaccgctatatccaaaatcaggagtatgtgtggagtaaaggcctgaatatcgaaattgaaggcgccagtgcagaaattaaagaaacctatgataaaagcgacaagttcgtcattcgaattttcgggcccctaaaaaaggaattgctcggtatcatcatgcacgagtttaataaaatcctcggaccgtacaagaaattacattttgaaaagctggttccttgcatttgtggtgtttgtaaaaaaagctccaatccatatttcttcaagcattcagagctaatcgacagaaaggaagctagaaagaaaaccattgaatgtggtaaaaagccatttgacgatgtaaatgtaaatgaattactcgatggtgtaacaccaacacagcaaagtgcacaacatgagttgcaagcagatagtccacaaactgaaaaagcccaaaacatcataaatattaccggagatggaaatgtgattgggcagaatcttaaggacagcaattttaccgtgaataaaaaatcggaaaatctaaagcccgaattcgaaaaactccaccagcgccacgaccgccacgatgaacaattcgataatataaatgagaatttaaagctaaatcacaaagaaattattactgaacttcaggcccaaaatgttgatgtaaccccaattgaagaaacaataaaaaacatcaatttgccaaatgatncaacaataatttga

SEQ ID NO: 7652 - protein, 303 aa, Unknown
  Obtained from environmental sample
  misc_feature (1)..(303): Xaa is any amino acid
MSRLMHRFGLMYEVPESKTYVVPAHLSALQPYVDWQYENETEVLQFAYEFDKYMPKGIMPRIIVALHRYIQNQEYVWSKGLNIEIEGASAEIKETYDKSDKFVIRIFGPLKKELLGIIMHEFNKILGPYKKLHFEKLVPCICGVCKKSSNPYFFKHSELIDRKEARKKTIECGKKPFDDVNVNELLDGVTPTQQSAQHELQADSPQTEKAQNIINITGDGNVIGQNLKDSNFTVNKKSENLKPEFEKLHQRHDRHDEQFDNINENLKLNHKEIITELQAQNVDVTPIEETIKNINLPNDXTII

SEQ ID NO: 7653 - DNA, 627 bp, Unknown
  Obtained from environmental sample
  misc_feature (1)..(627): n is a, c, g, or t
gtgntccctttttttttatatttgtcaaaacatttgattatggaaacgcttcaacttgaccttagcaaacgttatactttcgctgattaccttacatggattgatgataaaagaagggaacttattgatggttttatcaatttgatgtcccctgccccaaccagagttcatcagaaagttgccgccagaatatttggacaattatggaatcagctttctgataatccttgtcaggcttattttgccccattcgatgtccgactgccaaacaatcccgatgaaatttccgataggcaggtttatactgtggtacaaccagatatttcgataatttgtgacctgaaaaaattggatgataaaggctgcattggcgcgccggattttattattgaaataatttcaccatccacagcaaaacatgatgttgaagataaataccgcctgtatgaaaaacatggcgttaaagaatactggatcgtctatcctgaaagcaaaagtgtaagtgtttttctcctcgataaaaaagggaaatatcaattggtcggaatgtatgccgatgattcaaacgtaaaggtgaatatctttgatgatattattgttgacttagaaaaagttttcaaagattga

SEQ ID NO: 7654 - protein, 208 aa, Unknown
  Obtained from environmental sample
  DOMAIN (25)...(206): Protein of unknown function (DUF820)
  misc_feature (1)..(208): Xaa is any amino acid
MXPFFLYLSKHLIMETLQLDLSKRYTFADYLTWIDDKRRELIDGFINLMSPAPTRVHQKVAARIFGQLWNQLSDNPCQAYFAPFDVRLPNNPDEISDRQVYTVVQPDISIICDLKKLDDKGCIGAPDFIIEIISPSTAKHDVEDKYRLYEKHGVKEYWIVYPESKSVSVFLLDKKGKYQLVGMYADDSNVKVNIFDDIIVDLEKVFKD

SEQ ID NO: 7655 - DNA, 828 bp, Unknown
  Obtained from environmental sample
  misc_feature (1)..(828): n is a, c, g, or t
gtggttcattttaaaatgtcagattttaaaagaatctcaaatgaagaagcattggatttaatccaaaatgcttcattattagaacttggaaaactctctagcaacagaaaagaagaactgcatccaaaaaaaacaacaacttttgttgttgatagaaatatcaactatacaaatatatgctgggttgattgtaaattttgtgctttttatcgccatgcaaaagatgaagatgcttatattttaacttatgaagagatagataaaaagatagatgaacttctagaaattggtggtactcaaatactttttcaagggggagtacatcctaaactaaaaatagatttttatgaagacttggttgaacatattcacaataaatatccaactattacaatacacggttttagtgctattgaaattgattatatagcaagactatcaaaaataagttatcaagaagttttagcaaaattaaaggcaaaaggattagcttctatccctggagctggagctgagattttaaatgatgatgttagagatattattgctcctaaaaagttagatacaaaagattggttagaggttcatagacaagcacatttacttgatataaaatcaactgctaccatgatgtttgggacagttgaaaccgatgaacaaattatagaccattgggataaaatacgacaacttcaagatgaaactggtggttttagagcttatattatgtggagtttttcaatctgcacatacaaaaatagccccaaagctgccaaatattccagtcaaagttccaacagatacttaagaacttcttggagttgctag

SEQ ID NO: 7656 - protein, 275 aa, Unknown
  Obtained from environmental sample
  DOMAIN (54)...(228): Radical SAM superfamily
  misc_feature (1)..(275): Xaa is any amino acid
MVHFKMSDFKRISNEEALDLIQNASLLELGKLSSNRKEELHPKKTTTFVVDRNINYTNICWVDCKFCAFYRHAKDEDAYILTYEEIDKKIDELLEIGGTQILFQGGVHPKLKIDFYEDLVEHIHNKYPTITIHGFSAIEIDYIARLSKISYQEVLAKLKAKGLASIPGAGAEILNDDVRDIIAPKKLDTKDWLEVHRQAHLLDIKSTATMMFGTVETDEQIIDHWDKIRQLQDETGGFRAYIMWSFSICTYKNSPKAAKYSSQSSNRYLRTSWSC

SEQ ID NO: 7657 - DNA, 777 bp, Unknown
  Obtained from environmental sample
  misc_feature (1)..(777): n is a, c, g, or t
ttgaactttttaacacaactcttaagtgacccaaatattacacaaaaatcactagataaaatcaaaactttacaatcaagtaaactcaaacaaaaagagaatgattttgactatgttgcatcatcaaatcttaaacaaataacttataaaaacacacctttagcacacacaagtgctggaactgttgatacaatagagaaaataaaacttaaagatgtgaaaaaaagactcaaagatattttaaatatagataaccttatcattgcagttggcggagatataagttttaaagagttttcttcccatagtgagcctattttaaaaaatctgaaatctcaagggaaaacagattttaataaaatagcaatttctagtaaacctaaaaacaaaattatactcaaagaaacagaacaatcatacatatacttttcaagtcctttctatattgattctgattcaaaagagagctataaagcaaaagtagcctcttttatattgggtggtagtggatttggtagtcgacttatggaggagattagagtaaaaaatggtcttgcttacagtgcttatggacatataaaaaataataaatctcacagtgacttctctggatacctacaaacaaaactagacaatacacaaaaagcaaaagatatggtgggaactattgttaaagactttgtagataatggtgtaacacaagaagagttagatgctgcaaaaaactttcttagtggaagtgaacctttaagaacggaaacatttctcaaagactag

SEQ ID NO: 7658 - protein, 258 aa, Unknown
  Obtained from environmental sample
  DOMAIN (67)...(244): Peptidase M16 inactive domain
  misc_feature (1)..(258): Xaa is any amino acid
MNFLTQLLSDPNITQKSLDKIKTLQSSKLKQKENDFDYVASSNLKQITYKNTPLAHTSAGTVDTIEKIKLKDVKKRLKDILNIDNLIIAVGGDISFKEFSSHSEPILKNLKSQGKTDFNKIAISSKPKNKIILKETEQSYIYFSSPFYIDSDSKESYKAKVASFILGGSGFGSRLMEEIRVKNGLAYSAYGHIKNNKSHSDFSGYLQTKLDNTQKAKDMVGTIVKDFVDNGVTQEELDAAKNFLSGSEPLRTETFLKD

SEQ ID NO: 7659 - DNA, 540 bp, Unknown
  Obtained from environmental sample
  misc_feature (1)..(540): n is a, c, g, or t
atgtactctttaatgaagtcaagagaaaaaatgctgggaattatcgcttatggaagtttgatcaatccgcgagaaacagaaaaacagcgggagcgacccacacatgtcgtcccaatcaaactcgtaacatttgaacgatccttcaaccaactgcctacatggcgaaaaaaaagtggtgaatgctctgccgtgttgaacgtacagatatctgagcaaaattggttaaatgctgtttgctactgttacccaaattttgatttcaccgatctggacaaccgggaacggggctacacaagaacaaaagtttcacttgaaaaaataaaaagttatcacggtttcaacctccctgagctgacagaaatatttatttatctgggaaaaaacgagaagaaaaacaatcgtatcctgccaaaccctgaatatctggatatctgcctgctgggagcaaaaaaatggggagaaagtttttatcatgactttttaaacaccacacatattaataatggggtactattagaaaattatttatcaccaaactaa

SEQ ID NO: 7660 - protein, 179 aa, Unknown
  Obtained from environmental sample
  misc_feature (1)..(179): Xaa is any amino acid
MYSLMKSREKMLGIIAYGSLINPRETEKQRERPTHVVPIKLVTFERSFNQLPTWRKKSGECSAVLNVQISEQNWLNAVCYCYPNFDFTDLDNRERGYTRTKVSLEKIKSYHGFNLPELTEIFIYLGKNEKKNNRILPNPEYLDICLLGAKKWGESFYHDFLNTTHINNGVLLENYLSPN

SEQ ID NO: 7661 - DNA, 738 bp, Unknown
  Obtained from environmental sample
  misc_feature (1)..(738): n is a, c, g, or t
atgaacaaatctgatacattgaatgattactcaaaaaaacttatgttcaaaaaagcttctaaaaaaacatatgcccatctacagtttgaaaaagagagtaaaaccccatttttatgtatttcaggtccacttaccatggataataaatttataggtatcagcatattaaaaatagatcttgaatctttaaataacattttaactcaaagagaaggtttaggggagagtggtgaggcacttcttggaacctatggaaaaaatggtgatattatactttttagtaaacttagatttgccaacgctcctctaataattgacaaaaacaacataaataaagcgactcccatgagagaagctttaaatgaaaaacatatagttataggagatggttttgattatcgaagagagagtgttatctttattacaaactattttgaacaacttaaaattggtattgttgtaaaaaaagatattaaagagcttatgaaacctgttaatgagttaaaaaatcttcttctcttaattatgatgattattatttttatatcaattgtactaagtctaattatttcatactatctgacaaaacagattataaatattacacaaattacttctgatatatcagatggtaatttagataaaagagttacttcatcatcaaatgatgagttaggctcactttcaaaatcagtcaataaaatggctgatactcttattcactcaaatcaaatatag

SEQ ID NO: 7662 - protein, 245 aa, Unknown
  Obtained from environmental sample
  DOMAIN (172)...(241): HAMP domain
  misc_feature (1)..(245): Xaa is any amino acid
MNKSDTLNDYSKKLMFKKASKKTYAHLQFEKESKTPFLCISGPLTMDNKFIGISILKIDLESLNNILTQREGLGESGEALLGTYGKNGDIILFSKLRFANAPLIIDKNNINKATPMREALNEKHIVIGDGFDYRRESVIFITNYFEQLKIGIVVKKDIKELMKPVNELKNLLLLIMMIIIFISIVLSLIISYYLTKQIINITQITSDISDGNLDKRVTSSSNDELGSLSKSVNKMADTLIHSNQI

SEQ ID NO: 7663 - DNA, 915 bp, Unknown
  Obtained from environmental sample
  misc_feature (1)..(915): n is a, c, g, or t
ttgggcgttatggctcggctcaataatattgatatcaaacaaaaagattttaacgaaagagttcaaaaaacgaattatctcaaatttataaattcagattttgattctttattgcttggaagtagtcgtgcgacatatattaatacaaaaagtctgcatgataaagtttttaactttgctgttaacgcaatatctgttgacgaatatgataatataatacaaaattttattcaaataacaggcaatatccctaaaaaaatttatataggtgttgatcctttttctttcggtagtgtacaaaatgttcaggtcaaaaaagctttaaaaaacacagaagatatattttatccttataaaagtttaatttctctggatatatttacagtgtcattaaagaatctcgtgtttacatataaattcaatcgaaatatgtatgacagaaaacaaaggttttatgataaaaacatgctaaaaggtattcaagttaaaaataatatttcaaacgaacgatatattttagcttcacaaggatacattttaaaaatacaaaataatattaatttaaaagttcttcaaaatctaaaaaaaaagtatagaaaaagtaaatttgtaatttttacaatgcccgttcataatgtgatatataaagatataaaagatcaaaaaaattattctttatggcttgaaagtttggttgaaatttttggtaaagtttatcacttcatgtatgaaaatgaaatttcaaaaagtaattatactttttttgacgcttttcatttttatcctattattggaaataaaatgttaaatgtaatatctgatgatgctaaaacagatataaatgataattttggtattatactgaataagacaaatattgatgactatctccaaacattacaatctaaggaataa

SEQ ID NO: 7664 - protein, 304 aa, Unknown
  Obtained from environmental sample
  misc_feature (1)..(304): Xaa is any amino acid
MGVMARLNNIDIKQKDFNERVQKTNYLKFINSDFDSLLLGSSRATYINTKSLHDKVFNFAVNAISVDEYDNIIQNFIQITGNIPKKIYIGVDPFSFGSVQNVQVKKALKNTEDIFYPYKSLISLDIFTVSLKNLVFTYKFNRNMYDRKQRFYDKNMLKGIQVKNNISNERYILASQGYILKIQNNINLKVLQNLKKKYRKSKFVIFTMPVHNVIYKDIKDQKNYSLWLESLVEIFGKVYHFMYENEISKSNYTFFDAFHFYPIIGNKMLNVISDDAKTDINDNFGIILNKTNIDDYLQTLQSKE

SEQ ID NO: 7665 - DNA, 438 bp, Unknown
  Obtained from environmental sample
  misc_feature (1)..(438): n is a, c, g, or t
gtgagcgcttatattttccatacctacgtcaggattatcatgaaactaaataaaacatcacagtatgcgataagagttatggttcttatctcagataatcatgaaaaagatcttttaagtgccaaatatatcgcgcaagagttatcaattccatacaaatatctaacctctattatgactcagcttgcagatgctggcttgattaactctacaagaggaaaatttggaggatactctttaaataaagagacatcagcaattaaaatcatagatatactagaagctgttaaagagtctatggatggtaaaaattgtcttcttggcatcggtctatgcagtgatggtgagaagtgtgccatgcatgaccaatgggttgaacctaagaaagtcctattaaatatgcttaattcaactacactttttgatcttcaatcgtaa

SEQ ID NO: 7666 - protein, 145 aa, Unknown
  Obtained from environmental sample
  DOMAIN (14)...(135): Transcriptional regulator
  misc_feature (1)..(145): Xaa is any amino acid
MSAYIFHTYVRIIMKLNKTSQYAIRVMVLISDNHEKDLLSAKYIAQELSIPYKYLTSIMTQLADAGLINSTRGKFGGYSLNKETSAIKIIDILEAVKESMDGKNCLLGIGLCSDGEKCAMHDQWVEPKKVLLNMLNSTTLFDLQS

SEQ ID NO: 7667 - DNA, 732 bp, Unknown
  Obtained from environmental sample
  misc_feature (1)..(732): n is a, c, g, or t
atgaataactacaatactttaaaagaacttatcgctatcgattctccttcgggatatactgataacgcaagcaaatatatttttgatttattaacaagctatggctatgctccagaatataccaacaagggagcagtaaaatgtgctttaggaaaaaatccaacagctgctcttgctgctcatgtggataccttaggtgctattgtttcaggaattaaatcaaacggcacacttgctttttctttgttgggcggactatctttaacaggagctgaaggcgagtatgtaaaaatcattactcacgaaggaaaaattcatacaggaactattttactaaacaatccttcggtgcatgccaataacgaaaaagaaaaaaccgaacgctctattaaaagcatgcacattagaattgatgaagaggtttatactaaagaagatgtagaaaaattaggaattgaagtaggtgatattatttgtgtggatgtaaaatatcaagaattagaaaatggctttataaaatcacgatttttagataataaagcaggttgttatgtattgtttgaaattgctcgaaggctgaaacaacaaaataaagaagtacccgtagaactatttttctctaactacgaagaagttggacatggaggaacagtaggatattcagcaaacataaaagaattattagtgttagatatnggagtcttaggagacgactgtcaagaaacgaagtaa

SEQ ID NO: 7668 - protein, 243 aa, Unknown
  Obtained from environmental sample
  DOMAIN (44)...(240): M42 glutamyl aminopeptidase
  misc_feature (1)..(243): Xaa is any amino acid
MNNYNTLKELIAIDSPSGYTDNASKYIFDLLTSYGYAPEYTNKGAVKCALGKNPTAALAAHVDTLGAIVSGIKSNGTLAFSLLGGLSLTGAEGEYVKIITHEGKIHTGTILLNNPSVHANNEKEKTERSIKSMHIRIDEEVYTKEDVEKLGIEVGDIICVDVKYQELENGFIKSRFLDNKAGCYVLFEIARRLKQQNKEVPVELFFSNYEEVGHGGTVGYSANIKELLVLDXGVLGDDCQETK

SEQ ID NO: 7669 - DNA, 489 bp, Unknown
  Obtained from environmental sample
  misc_feature (1)..(489): n is a, c, g, or t
ttggttttacatctttctgtattgatatcaaatataaaagatattataaaagagggagaacttccagaatttaaggggctaccaaaatttgaagattggtggattgaagagttatggagtaatcatcaagcttattttggactttataaatggaaacaaattattttctctttatgtattaccagtgaacaaaaaagagcttgggaagtgatattttcaaactggatttttataaaaaaagttttaaataaaaaacgaaaacttggttttgaatataattttgcttttgacactctacttaaataccatacagaactagaagaggaactagaggtggaaaacctaaagaatatggaaaatatcattcatcaaattacccaaaaagaggactttttatcttataaaaaacctcataatataataaccccttatttggaatttaaatggtctaaattaaatctctcacctacaaaagaaaaaaaagattaa

SEQ ID NO: 7670 - protein, 162 aa, Unknown
  Obtained from environmental sample
  misc_feature (1)..(162): Xaa is any amino acid
MVLHLSVLISNIKDIIKEGELPEFKGLPKFEDWWIEELWSNHQAYFGLYKWKQIIFSLCITSEQKRAWEVIFSNWIFIKKVLNKKRKLGFEYNFAFDTLLKYHTELEEELEVENLKNMENIIHQITQKEDFLSYKKPHNIITPYLEFKWSKLNLSPTKEKKD

SEQ ID NO: 7671 - DNA, 822 bp, Unknown
  Obtained from environmental sample
  misc_feature (1)..(822): n is a, c, g, or t
atgttagctgagcttttaaaaaaagatattaaagagctagaaaaacaagaaaaaataaaagaagcgatcgaaagaaaaaactatcttcactaccaaaaagtacgattaaaaagagataaattaagatcaaatgatgaaaaactagaagctatgcttattatagatgagctgcctgatgatttaggttttgatgatgccgatctatttagagtagctgaacaatctctaaaaatgcatctatctcttcatgagcaaatccatgaaacttttgctgagatacggggagaatttgaagaacttataaaagatttaaaaggggaacagctagatgaacttgctcttcttaattttcaaatccctgtagtagttttacactttcatactcttgttgaaaatattaaagccaatttagaagaagaccataatggtgaggataaatctaatgagaaaaacaaagagttattttcaggttttcctaaatttgaggattggtggattaaagagttatggataaatcatcaggcttattttggattatataaatggaaaactatcatctcttccttatgtcaatcatctgatcaacaaagagcatgggaagttatttttgcgaactgggtaaatataaaaaaacaaatcacatctaaaggtgcattagcatttgaatataactatgcttttgacacccttatacgaaactatagtggtttagaagaggagttagcaacaacaagtttagagtctatggaaaaagtgataaactatttaactaataaagaagattttacaaaaatggcatctccgaatgaacatgaacttata

SEQ ID NO: 7672 - protein, 274 aa, Unknown
  Obtained from environmental sample
  misc_feature (1)..(274): Xaa is any amino acid
MLAELLKKDIKELEKQEKIKEAIERKNYLHYQKVRLKRDKLRSNDEKLEAMLIIDELPDDLGFDDADLFRVAEQSLKMHLSLHEQIHETFAEIRGEFEELIKDLKGEQLDELALLNFQIPVVVLHFHTLVENIKANLEEDHNGEDKSNEKNKELFSGFPKFEDWWIKELWINHQAYFGLYKWKTIISSLCQSSDQQRAWEVIFANWVNIKKQITSKGALAFEYNYAFDTLIRNYSGLEEELATTSLESMEKVINYLTNKEDFTKMASPNEHELI

SEQ ID NO: 7673 - DNA, 501 bp, Unknown
  Obtained from environmental sample
  misc_feature (1)..(501): n is a, c, g, or t
atggctggcaccctcttttttgaatatctcacccctgaagcccagataaagttaaatactatctattattcaaccaaacgatattaccgtgttatcagtatcgcagatacctttgaggccatttcgtccccccgggtttataaaaaggcctcttccattggtgataccttggcaattatgatcaacagcaataaaaaagatgggctgttttataaaccctatttcgaaaaatttgtgagttttatcataaaaaaatttcttcccaaaaatttgaagtttaaaataagtgatgaaattatcgatctctattgtcgaaacgcatcattaacccatgaacaaaaagaacgttataaaaaaaaatatatgggtgtaattgttaattcctgctctaactttgaaacagctttggattgcgttatttatgaccctgaaacccagaatatgaagtgtgaattagatcttccgccaatgttgttcttgaaaaatttttattttgaatga

SEQ ID NO: 7674 - protein, 166 aa, Unknown
  Obtained from environmental sample
  misc_feature (1)..(166): Xaa is any amino acid
MAGTLFFEYLTPEAQIKLNTIYYSTKRYYRVISIADTFEAISSPRVYKKASSIGDTLAIMINSNKKDGLFYKPYFEKFVSFIIKKFLPKNLKFKISDEIIDLYCRNASLTHEQKERYKKKYMGVIVNSCSNFETALDCVIYDPETQNMKCELDLPPMLFLKNFYFE

SEQ ID NO: 7675 - DNA, 762 bp, Unknown
  Obtained from environmental sample
  misc_feature (1)..(762): n is a, c, g, or t
atgggatttaccgttttaggaaccgaattatacaatccgaaaataagagcttattttgctgaaagttactttaaacaacttccgcttgccctcgaactttcgctagaaagtttacctgcgatgatttcaaacacccccgatttaaaaacaattattaaaaatccgacactgtttgttcaccagattatggcattcgcagactttcgcataaatgagatcaatatgcaatcaaaagtcaaacaaaaggtatttattgttacagctggaattggacaagggaaaacaacatgtattaaaactttggttgataaatttcaaaaagaaaatatttctgtgtcaggaatttactcgtccagattactaaataatgagacgccaacaggatataatgttgtaaatatttctaacggagaaacgaataaatttctgagaaaagagggtgattcttctcaaaaaagaattggcaattactacatttttgatgaagggttgaaagcaggaaaccgagcaatacaaaacaataattcgcgattaattataattgatgaagttggcaaactggagctatcgggaaaaggctggtccgattctattgagcaattaattaaaaacccgaaaaatcacttaatacttgctgttcgtaaagatttcgtaacgcaggtggttgaaaagtttctaatacccaatgcatttattctaaatgtcagtaaagaaaatcgcattgatttttatgatattattctcaatgaaatagaattttaa

SEQ ID NO: 7676 - protein, 253 aa, Unknown
  Obtained from environmental sample
  DOMAIN (122)...(253): Protein of unknown function, DUF265
  misc_feature (1)..(253): Xaa is any amino acid
MGFTVLGTELYNPKIRAYFAESYFKQLPLALELSLESLPAMISNTPDLKTIIKNPTLFVHQIMAFADFRINEINMQSKVKQKVFIVTAGIGQGKTTCIKTLVDKFQKENISVSGIYSSRLLNNETPTGYNVVNISNGETNKFLRKEGDSSQKRIGNYYIFDEGLKAGNRAIQNNNSRLIIIDEVGKLELSGKGWSDSIEQLIKNPKNHLILAVRKDFVTQVVEKFLIPNAFILNVSKENRIDFYDIILNEIEF

SEQ ID NO: 7677 - DNA, 594 bp, Unknown
  Obtained from environmental sample
  misc_feature (1)..(594): n is a, c, g, or t
atgttaagtaatatagaattagtaaaattattacaagagatcaatattttatatattgaagatgataaagagacaaatgaagagataacagaaacattgaaaatgttttcacaaaatattttttctacctattgtgtagaggaagctatacaagtttataaaaaaaatcctatccaacttatcataacagatattgaactaccaaaagaaaatgggatcagtttcattgaaaaaattcgtgatacaaatattttcataccaattattgttatatcagcatataaaaccaatgattatttattttcatgtgcaaatttaaatatccaatcatatattataaaaccaatcaatgcaaataaacttaaagaatcattgtataaaattgtaaagtatttaaaccttatctcanatattctagtatatattgataaaaagctatcttatgataaagcaagcggtcaactcattcacaatggacttgcatacaaattaagtaaaaaagaaaaaatacttatggatttattagtagatcataaaaataaactagtaacttatggacaaatagaacaaactgtatggtatgatttccaatga

SEQ ID NO: 7678 - protein, 197 aa, Unknown
  Obtained from environmental sample
  DOMAIN (14)...(133): Response regulator receiver domain
  misc_feature (1)..(197): Xaa is any amino acid
MLSNIELVKLLQEINILYIEDDKETNEEITETLKMFSQNIFSTYCVEEAIQVYKKNPIQLIITDIELPKENGISFIEKIRDTNIFIPIIVISAYKTNDYLFSCANLNIQSYIIKPINANKLKESLYKIVKYLNLISXILVYIDKKLSYDKASGQLIHNGLAYKLSKKEKILMDLLVDHKNKLVTYGQIEQTVWYDFQ

SEQ ID NO: 7679 - DNA, 864 bp, Unknown
  Obtained from environmental sample
  misc_feature (1)..(864): n is a, c, g, or t
atgaagttggaagagtttttcaaagcatctattaaaacaaatctcaagcctgtcattgttcaagccaaatcaaaaggtgagcttttaactaacttgcatcaactgcgtaaaaagcttccaaatagtttttcatttgcttcatttgttcaagataaacaagaatgtgaaaaaaagaaaaaactcttaggggcttatgattttgcaagattaaacagcatcataaatgaacactcaacaaagataggttttaaagatggctactttgaaaattcatatacttttatcaaagattccactgagtgcgaacttcctaatctgaaaatatttggctcatataatttatacgtttacaatgacaaaagtagctactataccatcgctcttgtagatgatatatccaaagctttaagctttaacttcgtggcaaatattgatgtaaaagatatgttcgctaaacaagcagataaaatgtatgctgatttagcactttactcaggctttgttatcttggctgtgtttgccctgcttttctttagtgttaagtccaagtttttgtatgcactcaactacatcatttttccatcaagtttagtcttggcagttttatctatnttttatactatcaatcttatgcatctgttctctcttatcattcttatcgccattggaattgactatggcatctacatgagtaacaccaaagcacaagcaaataccatttttagctatcaaaatactctttgcttagtactttttgcagggttttggggtccttggttttttaatttctattggttgccgttgggaaatctaatccgaaatggtttatttaagcctaagggaataaattttcaaattttttaa

SEQ ID NO: 7680 - protein, 287 aa, Unknown
  Obtained from environmental sample
  misc_feature (1)..(287): Xaa is any amino acid
MKLEEFFKASIKTNLKPVIVQAKSKGELLTNLHQLRKKLPNSFSFASFVQDKQECEKKKKLLGAYDFARLNSIINEHSTKIGFKDGYFENSYTFIKDSTECELPNLKIFGSYNLYVYNDKSSYYTIALVDDISKALSFNFVANIDVKDMFAKQADKMYADLALYSGFVILAVFALLFFSVKSKFLYALNYIIFPSSLVLAVLSXFYTINLMHLFSLIILIAIGIDYGIYMSNTKAQANTIFSYQNTLCLVLFAGFWGPWFFNFYWLPLGNLIRNGLFKPKGINFQIF

SEQ ID NO: 7681 - DNA, 921 bp, Unknown
  Obtained from environmental sample
  misc_feature (1)..(921): n is a, c, g, or t
atgagaatcttcttatggaagaggtttctaaaaaaatccaaagagataacctcnccatctttacaaaaagttattaatgccacaggggtaatagtacatacaaatttaggaagaagtcttatctctcctgaaagctttgatagagttaaagatattgtaacttcatataataatttagagtatgatttagaaaaaggacaacggggagaacgatattctcatatctcaaatactctttgtcaacttcttgattgtgaagatgttttaatagttaacaataatgcaagtgcagtatttttagttcttaatacttttgctaaaaataaagaagttgtagtaagtcgaggagaacttgtggagattggtggtagttttcgagttcctgatgttatggcaagtagtggagctattttaaaagagattggtacaactaataaaacacacctaaaagactatgaaaatgcttgcaatgaaaacagcgcaattctgatgaaagtacataagtcaaactactcaattgaaggcttttcaagtgaagtatctcatgaagagatagtcaatgtagctacaaaaaacaatctaatagattattatgatatgggtagtggtcatatgattgatttaccatataatttaaatcaaacagaacctagtgtaaaagaaattatgaaagtaaatccaagtttagtaagcttttctggtgataaacttttaggttcagtacaagctggaattattgtagggaagaaaaagtatatagataaattaaagaaaaaccaactcttaagaatgttacgagttgataaacttacccttgctattttagaagacaatatcatctcgctttttcttgataaaaaggnaaaatattcctactttaaatatgcttttactccaatagctactcaaagtccagcataa

SEQ ID NO: 7682 - protein, 306 aa, Unknown
  Obtained from environmental sample
  DOMAIN (24)...(306): L-seryl-tRNA selenium transferase
  misc_feature (1)..(306): Xaa is any amino acid
MRIFLWKRFLKKSKEITSPSLQKVINATGVIVHTNLGRSLISPESFDRVKDIVTSYNNLEYDLEKGQRGERYSHISNTLCQLLDCEDVLIVNNNASAVFLVLNTFAKNKEVVVSRGELVEIGGSFRVPDVMASSGAILKEIGTTNKTHLKDYENACNENSAILMKVHKSNYSIEGFSSEVSHEEIVNVATKNNLIDYYDMGSGHMIDLPYNLNQTEPSVKEIMKVNPSLVSFSGDKLLGSVQAGIIVGKKKYIDKLKKNQLLRMLRVDKLTLAILEDNIISLFLDKKXKYSYFKYAFTPIATQSPA

SEQ ID NO: 7683 - DNA, 612 bp, Unknown
  Obtained from environmental sample
  misc_feature (1)..(612): n is a, c, g, or t
atggctgggtcttggattagtgtaacagggatgatacacccctcaaatattttaaaaaataacagtggaaaaattggagatgttttaatacttacaaagccaattgggcttggtgtattaacaactgcaataaaaagagatttactagacccctctatgataaaggaagtaataaaagtaatggaatgtttaaactatgaaacttcaaagatattaaaagagtatagagtaagtgcttgtacagatattacagggtttagtcttttaggacatagtttagagtcaacaagagatgatatatcttataaactttataatgactctattcctgtttttgataaagtaagagaacttacagaacaagatgtagtaccaggtggaagtaaaaaaaataaaaaatacttagaagataaagtatcctatgcatcaagtattagtgagataagaaaacaaattttatgtgatgcacaaacttcaggagggcttttagtagcaatagataaaaatgatgccaaagaatatctaaaaagaatagagaattttacttttggatatgcaaaaattattggggaaattgtcccaagagttgataagccaattgttgttgtttag

SEQ ID NO: 7684 - protein, 203 aa, Unknown
  Obtained from environmental sample
  DOMAIN (24)...(203): AIR synthase related protein, C-terminal domain
  misc_feature (1)..(203): Xaa is any amino acid
MAGSWISVTGMIHPSNILKNNSGKIGDVLILTKPIGLGVLTTAIKRDLLDPSMIKEVIKVMECLNYETSKILKEYRVSACTDITGFSLLGHSLESTRDDISYKLYNDSIPVFDKVRELTEQDVVPGGSKKNKKYLEDKVSYASSISEIRKQILCDAQTSGGLLVAIDKNDAKEYLKRIENFTFGYAKIIGEIVPRVDKPIVVV

SEQ ID NO: 7685 - DNA, 684 bp, Unknown
  Obtained from environmental sample
  misc_feature (1)..(684): n is a, c, g, or t
ttggaagggtttttattaggtaattatgctccagactttgaaggtgcttatcatcgagttgctcaaacatttaagttaaaaaagaatcatctaaccagaattgaaattaaaattaaacgaatgcttgaaggagcaaatgattctacaattactcaatcggaactaataaataaaaacaatcagaaagacatatggtattatttaacaaaggttgacaaacacggtgtgccggatttaagcaaaagatttacgggcgtaaaaagaataaggaaaaatgaagtagattattttggatcaggtcaaaataacttcaaagacattgactttataagcctttattttgatccaaccaaagaaggtaatctacctgccgggactgaaatagctttaatattggaatatggagtttcggatgttcgtaattattcgaatggtgagttaaaatgggaaggtggtcactatagagttgcaactgttgacaatgctgtgaatgctcctatgctcaatggaaaactttttaaaggttggcataccgaatttagcaggggttggtcaaaaccttataataaagaacttttgtgcaatatatattccccaagttccgatacagttaatgctcaaatgcacgactattgggtcgattttcaatgttcgattatttcgaaaatggtttctgaaatttag

SEQ ID NO: 7686 - protein, 227 aa, Unknown
  Obtained from environmental sample
  misc_feature (1)..(227): Xaa is any amino acid
MEGFLLGNYAPDFEGAYHRVAQTFKLKKNHLTRIEIKIKRMLEGANDSTITQSELINKNNQKDIWYYLTKVDKHGVPDLSKRFTGVKRIRKNEVDYFGSGQNNFKDIDFISLYFDPTKEGNLPAGTEIALILEYGVSDVRNYSNGELKWEGGHYRVATVDNAVNAPMLNGKLFKGWHTEFSRGWSKPYNKELLCNIYSPSSDTVNAQMHDYWVDFQCSIISKMVSEI

SEQ ID NO: 7687 - DNA, 300 bp, Unknown
  Obtained from environmental sample
  misc_feature (1)..(300): n is a, c, g, or t
atgctcctatgctcaatggaaaactttttaaaggttggcataccgaatttagcaggggttggtcaaaaccttataataaagaacttttgtgcaatatatattccccaagttccgatacagttaatgctcaaatgcacgactattgggtcgattttcaatgttcgattatttcgaaaatggtttctgaaatttaggatgagatcaataactttcattctaagtttatcgaaaatatcgatttatatattttatagtgattatcaaaaaagccaaacaatatttaattataaccaaaaaata

SEQ ID NO: 7688 - protein, 100 aa, Unknown
  Obtained from environmental sample
  misc_feature (1)..(100): Xaa is any amino acid
MLLCSMENFLKVGIPNLAGVGQNLIIKNFCAIYIPQVPIQLMLKCTTIGSIFNVRLFRKWFLKFRMRSITFILSLSKISIYIFYSDYQKSQTIFNYNQKI

SEQ ID NO: 7689 - DNA, 357 bp, Unknown
  Obtained from environmental sample
  misc_feature (1)..(357): n is a, c, g, or t
ttgatagatctgtgtatcagttcaaactccatcggaaaggcgacgcagtttaccaaagaccttgatccgaccattcctgaggtgcgcatgcatacggaaaacttcatcaaactattaaacaaggtctatgctttgcatgaagattctgactctattgacaccaagctttactttcgtgtcggtgagtacatcaagacggaagagaagaaatacacgctcttttctattgaagtcaaaagtgcatttgcaaaacccaacaaggtgtcagaagttcgtatgttggctgaaaagatgaacatctatatcgatttcaagtcagacatgacactcatgaacataccgctaataacggattag

SEQ ID NO: 7690 - protein, 118 aa, Unknown
  Obtained from environmental sample
  misc_feature (1)..(118): Xaa is any amino acid
MIDLCISSNSIGKATQFTKDLDPTIPEVRMHTENFIKLLNKVYALHEDSDSIDTKLYFRVGEYIKTEEKKYTLFSIEVKSAFAKPNKVSEVRMLAEKMNIYIDFKSDMTLMNIPLITD

SEQ ID NO: 7691 - DNA, 723 bp, Unknown
  Obtained from environmental sample
  misc_feature (1)..(723): n is a, c, g, or t
ttgtattcccaattaagcaataacgtaaatgttttgacgttatatatgttaaattgtattcagttaagcatagacgagtatttttatttccctagcagccagatcaaaaaaattatgagtaaattaaagatattagtaaagtttgccgttatttacttagctgtactcaattcaagtacagctatgacattcgaccgtgattatctttacaatttcatcaaatcttatgttgaaagcaatgtgagcatacctgctcagggaaaactaaacgttgaagtatctccaatcgatccaagaatttcattacagccttgcctatcgccattaacggcaaatatacctgaaaaacataatggtagaaacgtaaatgttaaaattgtttgtccagacgaggactcttggcaactatttattccggttaaaatagaaactatcgtgccaatattagtcactcggatgcgaatagctaaaggtaccttacttgataactctaatatggaagttatttttaaggacagtagccaggtaagagggacggtattaacggattcaaaggttgttactggtgcgagaattaaacgaaacttatctcaaggtagtgccatcactaacagaaacacttgttttgtctgtaaaggccaaccggtaaacattattgctaaatcaacaagctttgaaattaaatcctttggaattgctttaaaagacggtagtttagngtga

SEQ ID NO: 7692 - protein, 240 aa, Unknown
  Obtained from environmental sample
  DOMAIN (102)...(240): FlgA family
  misc_feature (1)..(240): Xaa is any amino acid
MYSQLSNNVNVLTLYMLNCIQLSIDEYFYFPSSQIKKIMSKLKILVKFAVIYLAVLNSSTAMTFDRDYLYNFIKSYVESNVSIPAQGKLNVEVSPIDPRISLQPCLSPLTANIPEKHNGRNVNVKIVCPDEDSWQLFIPVKIETIVPILVTRMRIAKGTLLDNSNMEVIFKDSSQVRGTVLTDSKVVTGARIKRNLSQGSAITNRNTCFVCKGQPVNIIAKSTSFEIKSFGIALKDGSLX

SEQ ID NO: 7693 - DNA, 447 bp, Unknown
  Obtained from environmental sample
  misc_feature (1)..(447): n is a, c, g, or t
ttgcgactgaatgctggtggagtattacccgcttttgtgggacaagctttgcgaggtgaggatttaaccgtttttgggaagggtaaccaaacacgttctttctgttatgtagatgatttgattgaaggtatttacagattactttttagcgattatgctgaaccagtaaatattggaaatcctgatgaagttaccattttagagtttgcggaagaaattataagagtgacaggaagaacccaaaaaattattttcaaagatttaccaaaagacgacccaatgcaacgtcagcctaatattgataaagctaaaaaattattaggttgggaacctaaagttagtagagccgaaggattaaaaattacttacgaatattttaaaaatctttcgcaagaagaattaacaaaagtagagcacaaagattttaataattatataaaaaaataa

SEQ ID NO: 7694 - protein, 148 aa, Unknown
  Obtained from environmental sample
  misc_feature (1)..(148): Xaa is any amino acid
MRLNAGGVLPAFVGQALRGEDLTVFGKGNQTRSFCYVDDLIEGIYRLLFSDYAEPVNIGNPDEVTILEFAEEIIRVTGRTQKIIFKDLPKDDPMQRQPNIDKAKKLLGWEPKVSRAEGLKITYEYFKNLSQEELTKVEHKDFNNYIKK

SEQ ID NO: 7695 - DNA, 894 bp, Unknown
  Obtained from environmental sample
  misc_feature (1)..(894): n is a, c, g, or t
atggagttagagggctttaattttacaggtattatagaagagcttacagaaaaaagattattaaataattgtttagtattagtattatcaacaatagaaaatccaaagttattaaaaaatattttaaaaagtggagcttctgactttttaaaaaaaccttttattaatgatgaatttatattgaaaatagaactcttaattaaaaaactacttgataaaaaactgatagaaaaacaaaaaaaagagatagaaaatacacttaaaaaatttaaagctctaattgattcctctataaacgctatgtatatttttaaagataatatttgcatagagtgtaacaaagaggcttctttactcttaggtttcaactcaaaagaggagataattgataaacatatttttaatatattttacaatgtctcaacaaaacataaaaatctacttgtggataatgaagttgaccataattttcaaacaacagttacagggcaacaaggtaatgtatatgaggtacaaataaaagagaaaaatatcccttttgatacagataatttaaaaattatatcagctatggatattacagatattaaaagaaatgaaaaaatattagcacaaaagtcaaaactagcttcaatgggagagatgataggaaatattgcgcatcaatggagacaaccacttactgcaatttctatagctgcaagtggtataaagcttatgcaagagtgcgatattgaagataaaatagaaactatagatagtctggataatattgtaaaaaatacaaagtttttatctgcaacgatagaagattttcaaaacttctcaaaaatgacaaagaaagttctactttttttatacagatgttttacgaaatactttaaagaatcctgg

SEQ ID NO: 7696 - protein, 298 aa, Unknown
  Obtained from environmental sample
  DOMAIN (211)...(281): His Kinase A (phosphoacceptor) domain
  misc_feature (1)..(298): Xaa is any amino acid
MELEGFNFTGIIEELTEKRLLNNCLVLVLSTIENPKLLKNILKSGASDFLKKPFINDEFILKIELLIKKLLDKKLIEKQKKEIENTLKKFKALIDSSINAMYIFKDNICIECNKEASLLLGFNSKEEIIDKHIFNIFYNVSTKHKNLLVDNEVDHNFQTTVTGQQGNVYEVQIKEKNIPFDTDNLKIISAMDITDIKRNEKILAQKSKLASMGEMIGNIAHQWRQPLTAISIAASGIKLMQECDIEDKIETIDSLDNIVKNTKFLSATIEDFQNFSKMTKKVLLFLYRCFTKYFKESW

SEQ ID NO: 7697 - DNA, 402 bp, Unknown
  Obtained from environmental sample
  misc_feature (1)..(402): n is a, c, g, or t
atgatagagaaagttctactttttttatacaagatgtttacgaagtacttaatgattcctgatgcgaatttaaaatttgaaaatataaaaatagttcaaagttatgaaaaagatatagaagttacaactattcaaaatgacttagtacaaattttattaaatattataaataatgcagtagatgcatttagagataaaacaataaaagataaatttttaattattgatatttaccaaaaaaaagatatagtttatatatcccttttagattctgcaggtggaattagtgaagatgttatagataaaatattcgaaccatattttagcaacaaaacatcaagctcaaggtacaggattagggctttatatgacacatcagattttgtcaaaactagatggtaa

SEQ ID NO: 7698 - protein, 133 aa, Unknown
  Obtained from environmental sample
  DOMAIN (43)...(124): Histidine kinase-, DNA gyrase B-, and HSP90-like ATPase
  misc_feature (1)..(133): Xaa is any amino acid
MIEKVLLFLYKMFTKYLMIPDANLKFENIKIVQSYEKDIEVTTIQNDLVQILLNIINNAVDAFRDKTIKDKFLIIDIYQKKDIVYISLLDSAGGISEDVIDKIFEPYFSNKTSSSRYRIRALYDTSDFVKTRW

SEQ ID NO: 7699 - DNA, 507 bp, Unknown
  Obtained from environmental sample
  misc_feature (1)..(507): n is a, c, g, or t
cataaaacatcagatgttcattctatcaacataggtaaaaatacaaatatttggcaattctgtgttgtcttaaaagaggcaaaaataggagataattgtaatataaatgctcaagtttttatagaaaatgatgttacaataggagataatgtaacaataaaaagtggtgttcaaatttgggatggagtaaagttagaggataatgtttttattggtcctaatgtaacttttacaaaggactttttaccaagaagtaaactgtatccaaaagagttcttaaaaacgatagtaaaaaagggagcttccgttggggctaatactactttagttggaagtgtaattgttggtgaatattctatgataggtgcaggaagtgtcgtaactaaaagtgttggaattcaagaattatggtatggtaatccagctaagcataaaggttatgtatgcaaatgtggtcaaaaatgtagtaaaacattaatatgtgatagatgcaatgaagatttttaa

SEQ ID NO: 7700 - protein, 168 aa, Unknown
  Obtained from environmental sample
  DOMAIN (44)...(61): Bacterial transferase hexapeptide (three repeats)
  misc_feature (1)..(168): Xaa is any amino acid
MKTSDVHSINIGKNTNIWQFCVVLKEAKIGDNCNINAQVFIENDVTIGDNVTIKSGVQIWDGVKLEDNVFIGPNVTFTKDFLPRSKLYPKEFLKTIVKKGASVGANTTLVGSVIVGEYSMIGAGSVVTKSVGIQELWYGNPAKHKGYVCKCGQKCSKTLICDRCNEDF

SEQ ID NO: 7701 - DNA, 348 bp, Unknown
  Obtained from environmental sample
  misc_feature (1)..(348): n is a, c, g, or t
atgattggcagtttatttttaggtttaatttctgattttccactagtagattggggcatgttacaaatggcaacagttcaattagcaagtgctttcatattatcaataattgtaatttattttttagtaaaattcttaccaaaatctaaagtatggaataacctagttctcaataaaaatattgacgaacaatctggatatacagctgaagaagatttaaaagaacttataggtaaatctggtaaagcattaacagatttaagacctagtggctcggctttattgagaagaaagaatgatgtagtactaatggagatacctaacaaaggaaccaacgtactgtcatga

SEQ ID NO: 7702 - protein, 115 aa, Unknown
  Obtained from environmental sample
  misc_feature (1)..(115): Xaa is any amino acid
MIGSLFLGLISDFPLVDWGMLQMATVQLASAFILSIIVIYFLVKFLPKSKVWNNLVLNKNIDEQSGYTAEEDLKELIGKSGKALTDLRPSGSALLRRKNDVVLMEIPNKGTNVLS

SEQ ID NO: 7703 - DNA, 756 bp, Unknown
  Obtained from environmental sample
  misc_feature (1)..(756): n is a, c, g, or t
atggctgagctaanagcaaacacaacagttaaaattgattcaaatggttcagtattcagtgctagcggtactcaaattactttcccaggttatttaagagcttatgttgaaactaaagatgatccagaagcagctttagatgataaagaaactttacttccacctcttgaaattggtcaacaacttgatttagataagttagcaagtcaaaaacacgaaacaaaagctccttcaagatttactgaagctactttagttagagagctagagcaaagaggaataggaagaccttcaacatattcttcaattattgaaacactcttaaatagacaatatttaatcaaagagggtaatgccttaattcctacctttataggttttgctgtttgccaatatttgattaatgccttccctaaatatgtcgcttctgattttacaagattattagaagccgatttagatcaaatagcaaatcataaaattgcaaaacaacctttattacaatcattttacctaggtgaaaatgcattaaaagagaaggtaaaacttcaaaaaagtaaagatgataaagttcttgcaaaaactttaaatttacctcaaataagtgaagataatccaattagaattggtcctcatggtccctatgtattaggtaaaacagtagatgaaaaacaagaatatattaatttaccaaaagaactgcttcccggtacaataactgatcgagagatcaaagaactaataaaaaaaaggtaa

SEQ ID NO: 7704 - protein, 251 aa, Unknown
  Obtained from environmental sample
  misc_feature (1)..(251): Xaa is any amino acid
MAELXANTTVKIDSNGSVFSASGTQITFPGYLRAYVETKDDPEAALDDKETLLPPLEIGQQLDLDKLASQKHETKAPSRFTEATLVRELEQRGIGRPSTYSSIIETLLNRQYLIKEGNALIPTFIGFAVCQYLINAFPKYVASDFTRLLEADLDQIANHKIAKQPLLQSFYLGENALKEKVKLQKSKDDKVLAKTLNLPQISEDNPIRIGPHGPYVLGKTVDEKQEYINLPKELLPGTITDREIKELIKKR

SEQ ID NO: 7705 - DNA, 411 bp, Unknown
  Obtained from environmental sample
  misc_feature (1)..(411): n is a, c, g, or t
atgacagatttgaaaaatcaaaataatgaaaaaagtgataaaattactttattaagaaaattatctaatgatttgaaacttggagaatataaaattaaattatgttttaacaagttagctttagatgtaaacgataaatattttgaagataattattttctaagtaaagaacttgtttgttcgtactatgggatattggataattatataagagatgatgaagcaataaaagaatttgatatccaaataaaacggtttgatgaagtgtatattgatactgctccattaatccacgaagattggtttttgtattttattgcaaatgcaagtttaactttgcgtagaagagagaaagaaattagttattttagaaaaaactatggaagagcttttcggaattgcaagaaatga

SEQ ID NO: 7706 - protein, 136 aa, Unknown
  Obtained from environmental sample
  misc_feature (1)..(136): Xaa is any amino acid
MTDLKNQNNEKSDKITLLRKLSNDLKLGEYKIKLCFNKLALDVNDKYFEDNYFLSKELVCSYYGILDNYIRDDEAIKEFDIQIKRFDEVYIDTAPLIHEDWFLYFIANASLTLRRREKEISYFRKNYGRAFRNCKK

SEQ ID NO: 7707 - DNA, 753 bp, Unknown
  Obtained from environmental sample
  misc_feature (1)..(753): n is a, c, g, or t
ttgaaaattgacttggagataaaggggaccccctccaacatgctcaacacctttttgattaatatgggaaaggccattaacaaccgggcaaggccggtggatgccatcaagcaccaggcaaaaaccgttactgtgggagccagccgaatttctgaagtattcgaaggcaccatatttgatcaacttaacgccaatgatatccagatatcccagttgaccaacaagaatgtattggtcatcaaaaacctccaggaagtgatctcaacggttaaggggggtcttttataccagatctcagggctcagcctcctgggagaggtcaccccgaagacaaaaatcagggtcatcaacaaaaccggttccctcacccaggaaacctcccgggtggaaagtgatccccggctgaagggaaccaaaaatatcattgtcagggaaggaaatgtctatattggaaagggaagaaaggacaacaaaagcatattggtgattccggtcatctccaaatcaccctccaccccgaacatcattgagtatattctatccttgaatgtggcctttaaaacacccggagaagtttcgcttttgaaaaaaataaaggccctggggggaaaatatacccggttaaaagattgggttcttgaaagtgaaaatatccagtgggatgataacttcttaaatctggttgccgttgaaaccttgtttggcgacacggctgaacaagtggtggaaaccattcttaaaaaaatcaaatga

SEQ ID NO: 7708 - protein, 250 aa, Unknown
  Obtained from environmental sample
  misc_feature (1)..(250): Xaa is any amino acid
MKIDLEIKGTPSNMLNTFLINMGKAINNRARPVDAIKHQAKTVTVGASRISEVFEGTIFDQLNANDIQISQLTNKNVLVIKNLQEVISTVKGGLLYQISGLSLLGEVTPKTKIRVINKTGSLTQETSRVESDPRLKGTKNIIVREGNVYIGKGRKDNKSILVIPVISKSPSTPNIIEYILSLNVAFKTPGEVSLLKKIKALGGKYTRLKDWVLESENIQWDDNFLNLVAVETLFGDTAEQVVETILKKIK

SEQ ID NO: 7709 - DNA, 483 bp, Unknown
  Obtained from environmental sample
  misc_feature (1)..(483): n is a, c, g, or t
atgtcccaatttaaaatagtttcagaaatgacccccaaaggcgatcagccggaagccattcaggcgttaagcaatggtattaaagaagggaaaaaaaaccaggtgcttctcggtgttaccggatccggtaaaacgtttacaatggccaatatcatagagaaagttcagaagccgacgctggtgctggctccgaataaaacgctggctgctccgctgtataatgaatttaaaaccctgtttccggataactcggtggagtattttgtcagttattatgattactatcagccggaagcatatcttccggtttcagatacctatatccagaagcattcatccatcaatgaaatgattgataaaatgaggcattcgtcgacccgatccgttttatgcgggccggatgttattgtgcttgccagtgtttcctgtattttcggtttaggcgctccggaaagactatattgccatgcgactggagcttga

SEQ ID NO: 7710 - protein, 160 aa, Unknown
  Obtained from environmental sample
  DOMAIN (10)...(152): Type III restriction enzyme, res subunit
  misc_feature (1)..(160): Xaa is any amino acid
MSQFKIVSEMTPKGDQPEAIQALSNGIKEGKKNQVLLGVTGSGKTFTMANIIEKVQKPTLVLAPNKTLAAPLYNEFKTLFPDNSVEYFVSYYDYYQPEAYLPVSDTYIQKHSSINEMIDKMRHSSTRSVLCGPDVIVLASVSCIFGLGAPERLYCHATGA

SEQ ID NO: 7711 - DNA, 324 bp, Unknown
  Obtained from environmental sample
  misc_feature (1)..(324): n is a, c, g, or t
gtggggaaaaaggttttaaaatgttccccaaaaaagagttggaattctctgttaatctccctaatggaggatattttaaatattgggatacaagcctatatttttgagttactcaataagtatgggataggggaacgagttgtatttgaaatagtagaagcagaatctattgaaaactttaatcaagtggtaagttttattagaaatgtgaaagagtttgggtgtaaaattgctatagatgactttggtacaggatacagtaacgtggaatatcttatgaagcttgaagcgagattatggcaagatagatggttctatgattaa

SEQ ID NO: 7712 - protein, 107 aa, Unknown
  Obtained from environmental sample
  misc_feature (1)..(107): Xaa is any amino acid
MGKKVLKCSPKKSWNSLLISLMEDILNIGIQAYIFELLNKYGIGERVVFEIVEAESIENFNQVVSFIRNVKEFGCKIAIDDFGTGYSNVEYLMKLEARLWQDRWFYD

SEQ ID NO: 7713 - DNA, 837 bp, Unknown
  Obtained from environmental sample
  misc_feature (1)..(837): n is a, c, g, or t
ttgaaaatttcaaagcaaattgccaacgataaagatattgtaaactctttaaaccttatatctaattatgaaaatccagtagagtatattcctgaaatttatgattttgagaaaagatcagttttagaaaatactcaaaaatggataaaagaatcagataactacacattaacgatatttgataaagaaaaaaatcttattttgataaatagaaaacatcaaaagaaaaaagatatgggatatgtttcttataataatggagtgaaaaattttattgattattacactaaagaatatatagtaacaccatctgttttaagtataaatgatatagattttaatttttatcacatagataatgaatattatattaaatttactacaccagtaatattagataataatattataggatatattagagtagggtatagtttaaatagtgattttataacatatttaaataataagttaggaactttagttgttttaaagtctcaagataaatatatttacgatactacaatagatcgtgatgagttacaagaaaaacttacttcagaagattattttatagaagagtacacagtaatagatgctgatattggtttaaaatcgatgtttttattagatcaaaaaagattaaatgaacaactaactaaaacttatttaccggtattttttgtttggatcttaatattagtaattacttttttagtttcattcttttttataaaaagattaattgtagagcctcttgataatttaaaagagagtattgaaaatattaaaaataataaatatgatgagattaaatttgataatatggagagataa

SEQ ID NO: 7714 - protein, 278 aa, Unknown
  Obtained from environmental sample
  misc_feature (1)..(278): Xaa is any amino acid
MKISKQIANDKDIVNSLNLISNYENPVEYIPEIYDFEKRSVLENTQKWIKESDNYTLTIFDKEKNLILINRKHQKKKDMGYVSYNNGVKNFIDYYTKEYIVTPSVLSINDIDFNFYHIDNEYYIKFTTPVILDNNIIGYIRVGYSLNSDFITYLNNKLGTLVVLKSQDKYIYDTTIDRDELQEKLTSEDYFIEEYTVIDADIGLKSMFLLDQKRLNEQLTKTYLPVFFVWILILVITFLVSFFFIKRLIVEPLDNLKESIENIKNNKYDEIKFDNMER

SEQ ID NO: 7715 - DNA, 426 bp, Unknown
  Obtained from environmental sample
  misc_feature (1)..(426): n is a, c, g, or t
atgggaaagttatcagaaattcaaagtgagtatgctttaaaaattgagaagataatgtttctgaacaaagaatttaatattatcaaatcgaaggttttttcaaacaaaaaaagaaagctgaaaaagatcaagtttgaaatatcagagatcaataattttataattaagaaagatattgaaatcatgcctgaatttagaattgtagaaaatcataatggtggcacaataatatcaaatatgattgctacattttatccatcccgggatcttcttctctccaatctaaaaaagatagaacaagatatttccagttttgaaaacgagcagaattttaagaaaacattgtatattgcgatagctgcttttttaatcagtcttgctccatatatctcagatgggattaaatatattgcatctctattttaa

SEQ ID NO: 7716 - protein, 141 aa, Unknown
  Obtained from environmental sample
  misc_feature (1)..(141): Xaa is any amino acid
MGKLSEIQSEYALKIEKIMFLNKEFNIIKSKVFSNKKRKLKKIKFEISEINNFIIKKDIEIMPEFRIVENHNGGTIISNMIATFYPSRDLLLSNLKKIEQDISSFENEQNFKKTLYIAIAAFLISLAPYISDGIKYIASLF

SEQ ID NO: 7717 - DNA, 402 bp, Unknown
  Obtained from environmental sample
  misc_feature (1)..(402): n is a, c, g, or t
ttgaagcaaatacaaaagatgaaaagacattattgttatgcgatacagaagatacatttatactatgcaggaagtttctataaaacaccaaccatagataaaaaagtattagaaagcacaagcagtagtgatatttttattacaaaatttgatgaaaattgtaaattacaaaagctagaaggaatacatggtaaaaacaaagatataattaatgattttgctatttcagaaaataacagactgtttattactggcagttttacaacaaatataaattttggcaataaggtattaaaatcaagtggtcgtaaagatatatactttgcagaaattgatatgagttctgacataacaagtaccaacttttggaaatttacaaagcatattggggggattatatga

SEQ ID NO: 7718 - protein, 133 aa, Unknown
  Obtained from environmental sample
  misc_feature (1)..(133): Xaa is any amino acid
MKQIQKMKRHYCYAIQKIHLYYAGSFYKTPTIDKKVLESTSSSDIFITKFDENCKLQKLEGIHGKNKDIINDFAISENNRLFITGSFTTNINFGNKVLKSSGRKDIYFAEIDMSSDITSTNFWKFTKHIGGII

SEQ ID NO: 7719 - DNA, 822 bp, Unknown
  Obtained from environmental sample
  misc_feature (1)..(822): n is a, c, g, or t
atgaatcaatataaaccaacgagttataactcggaagatatcttcctgattaaaaaatatattgataactacgatcagatcacaaagattctgaatgagattgaaggatttgaacttcccaatcccttcctgaacttaaagaagatattagaacaggatggcaaccgggaaactttctatctggccggcagttttgatcctgaacttaaaaaagtgcgtaaccagatctatgccctgcaaaaagagcagaaaaaagaaggcaaagatttcctcaatctgctaaaaacagaatatggaatagacctgcgtttccgtaactttgtggttctgcctcaggctgaggcaaaccagttgccggacaaactgttctacctggaaccttacgacagcaaccaggttattgtgaagccagaatatcctaaaaactacttcgcgcttatttcccagctggaagagattaaagctgtggaaaaacagcttgagcagaatatcctgcataaactttcccagcagataaatgagatttatcctgaactggaaaatacaattatagaactgacaaaagtcgatcgcatgctggctaaagccagactagttaataaattcaaattggtgaaacctgaaataagtgaaaccagaataaatatagaaattaaaaatgggatattcctacctcttcaggaaatatgtcggattaataaacgggattatcaaccactctccgcagtttttgataaccggaatatcgtggttctaggttccaacatgggtggaaaaaccgttctgctccaaactgtaggatttctgcaactcntaccctga

SEQ ID NO: 7720 - protein, 273 aa, Unknown
  Obtained from environmental sample
  misc_feature (1)..(273): Xaa is any amino acid
MNQYKPTSYNSEDIFLIKKYIDNYDQITKILNEIEGFELPNPFLNLKKILEQDGNRETFYLAGSFDPELKKVRNQIYALQKEQKKEGKDFLNLLKTEYGIDLRFRNFVVLPQAEANQLPDKLFYLEPYDSNQVIVKPEYPKNYFALISQLEEIKAVEKQLEQNILHKLSQQINEIYPELENTIIELTKVDRMLAKARLVNKFKLVKPEISETRINIEIKNGIFLPLQEICRINKRDYQPLSAVFDNRNIVVLGSNMGGKTVLLQTVGFLQLXP

SEQ ID NO: 7721 - DNA, 837 bp, Unknown
  Obtained from environmental sample
  misc_feature (1)..(837): n is a, c, g, or t
atggccggacataaattttttcctgaaagtttaaagaaactgacaaaatatagctgccaattcaacgtttttaaacttcttggaaaaaatgaatataaaaatttgcctgttcttgatatagatgttgaaactccggggcttgaagttgttaattttactggagacttctttcctgataaatcagataacccgaaaaatctccattacaaaggacacattaaattcaatgatgttgtaacagaaaaagatattactgattcaatgaaggtgacaaaagacggaaaagatatcaaatttgaagtttctctaacaaaaaatgatcccaaaacatttaaatatcagatagttgggatcgttagaagttccaaagttcaggaatttgttgttaaagtaaataaatcagatgcaatccagatctcaagtgatattgaaaaagctatagaattgcccgagatgcagaagttcatagtaagagagatcagtacagataccagccgagataaaccattttttattgtaaatttgagtgatactctcagtttaagtcagaatcttgcaggacttgtaacagttgacaacttggaatcgccgctaaaattaacgaaaaacggcaaagatatcattgttaatggtgattttagtcatggtgaaacatacattgttagagtacataaagggatcgaaagcaagtggggaacgaaaactgacttatataaaccatattcagtagtttttgaagatattaatccgcaaatgtcatttctaagtgggggagtgtatcttccatcttctaacaacaagaaaatacgttttcagaccgttaatttaaaaaagtga

SEQ ID NO: 7722 - protein, 278 aa, Unknown
  Obtained from environmental sample
  misc_feature (1)..(278): Xaa is any amino acid
MAGHKFFPESLKKLTKYSCQFNVFKLLGKNEYKNLPVLDIDVETPGLEVVNFTGDFFPDKSDNPKNLHYKGHIKFNDVVTEKDITDSMKVTKDGKDIKFEVSLTKNDPKTFKYQIVGIVRSSKVQEFVVKVNKSDAIQISSDIEKAIELPEMQKFIVREISTDTSRDKPFFIVNLSDTLSLSQNLAGLVTVDNLESPLKLTKNGKDIIVNGDFSHGETYIVRVHKGIESKWGTKTDLYKPYSVVFEDINPQMSFLSGGVYLPSSNNKKIRFQTVNLKK

SEQ ID NO: 7723 - DNA, 750 bp, Unknown
  Obtained from environmental sample
  misc_feature (1)..(750): n is a, c, g, or t
atgaataaggagagatttgagtttatcgttggatatccatcttctgtttatgatttcgttgttttaatgaaaaagcataacgtcaaacttgattatcaacccaaatgtttcttttctgcatccgatgttttactgcctatttatgaaaagacaatttccgagtattggaacattcaagtaactgatttttatggaagttctgaattctgtggcaatttttctaaatgtccatacggaaactatcaccttgattttgaatctggaatagtcgaatttttaccaattaagggacatgaaaacagtgattataaaaagatggtgtttaccggaatatcaaatttagcgatgccttatattagatttgatataggagattatgcaataacatctgatgaagaatgccaatgtggaagaaaaagcataattatcaagagtattgaaggtagaactgaggattgtatcaaaacaccggatggcaggacaataattaagttaggacaggttttcaaggctacaccaaatattcgtgaagcccaggtaattcaaacctctattaatcaaataattgttaatactattcctgagatatctttcacagatattgacaaggatattattctgaatgagttgagaactcgtttaggaaactatatggtaatagaatttaaccttgtaaaatcaattcttccatcaagaagcggaaaaaaacgcttagttattttcacatttaactctgagtctgaagggtga

SEQ ID NO: 7724 - protein, 249 aa, Unknown
  Obtained from environmental sample
  misc_feature (1)..(249): Xaa is any amino acid
MNKERFEFIVGYPSSVYDFVVLMKKHNVKLDYQPKCFFSASDVLLPIYEKTISEYWNIQVTDFYGSSEFCGNFSKCPYGNYHLDFESGIVEFLPIKGHENSDYKKMVFTGISNLAMPYIRFDIGDYAITSDEECQCGRKSIIIKSIEGRTEDCIKTPDGRTIIKLGQVFKATPNIREAQVIQTSINQIIVNTIPEISFTDIDKDIILNELRTRLGNYMVIEFNLVKSILPSRSGKKRLVIFTFNSESEG

SEQ ID NO: 7725 - DNA, 636 bp, Unknown
  Obtained from environmental sample
  misc_feature (1)..(636): n is a, c, g, or t
atggcaattttatcgttatggttagcagaacaccaaatgaataaagagtttgttagcgagttacaagattatggtaaagcagaagacattttaccgctaaaagaagctggtaatattactcaagggaatgccacacgtttaaattgggaagatacttgtcctaaaaatatagatgatgagatttatattttgggtaatccgccttatttaggtggtaaagctcagtcaaaagaacaaaaacaagatatgaaaattgcatttagcaatgcaaaaaaaattggtgaattagattatatagcttgttggtttattaaggcatcaagctacataaatgataatagttcttattgttttgtaactacaagctctatttgtcaaggatcacaagtccaacaattatggccacatattttaagattagaacaagaaataggttttgcatatacatcttttaaatggagtaataatgctaaaaataacgcaggagttgttgtgtcaataatttgtgttagacattcttcgaataagcttaaaactttaatagatgaanaaccgaaaaaaatagtccaaatatcagtcctatttgatggagggaacaaatactatcgtcttccaaagtttaaaacctatatctaa

SEQ ID NO: 7726 - protein, 211 aa, Unknown
  Obtained from environmental sample
  misc_feature (1)..(211): Xaa is any amino acid
MAILSLWLAEHQMNKEFVSELQDYGKAEDILPLKEAGNITQGNATRLNWEDTCPKNIDDEIYILGNPPYLGGKAQSKEQKQDMKIAFSNAKKIGELDYIACWFIKASSYINDNSSYCFVTTSSICQGSQVQQLWPHILRLEQEIGFAYTSFKWSNNAKNNAGVVVSIICVRHSSNKLKTLIDEXPKKIVQISVLFDGGNKYYRLPKFKTYI

SEQ ID NO: 7727 - DNA, 555 bp, Unknown
  Obtained from environmental sample
  misc_feature (1)..(555): n is a, c, g, or t
ttggagtgctcaaataataaggaagcttcaattttagatttgtctcaagaagctattacccaagctcgtttaagatatactcaaaagaaccctaatttagaagaagatattaaacattggtcagatactgttttcttaaataaagcaaaacttactataaaaggtgcaattacaaatgctacaataattttactgggtaaacctgaatcagaacattttataaatcctgcaacttctaaaattacttggatacttaaaggcagtgataatattgaaaaagattacgaacattttacttgtcctttacttttaaatattcaacaagtttatggtaaaatacgaaacctaaagtatcgttatcttacagatggcactttgtttccagaagaagtagaccaatacgattcttacatcattcgcgaaggtttaaacaattctattgtgcatcaagattatacattgggaggcaaaatattggtggtagaaaacggaaaagtgcaacccttaacttttgctaattctggtagttttattccacatagtatgaaaccgtaa

SEQ ID NO: 7728 - protein, 184 aa, Unknown
  Obtained from environmental sample
  misc_feature (1)..(184): Xaa is any amino acid
MECSNNKEASILDLSQEAITQARLRYTQKNPNLEEDIKHWSDTVFLNKAKLTIKGAITNATIILLGKPESEHFINPATSKITWILKGSDNIEKDYEHFTCPLLLNIQQVYGKIRNLKYRYLTDGTLFPEEVDQYDSYIIREGLNNSIVHQDYTLGGKILVVENGKVQPLTFANSGSFIPHSMKP

SEQ ID NO: 7729 - DNA, 333 bp, Unknown
  Obtained from environmental sample
  misc_feature (1)..(333): n is a, c, g, or t
ttggataaggttagctgcagcaaaagcagtccctccggtggcgataaggtcatcgatcaacaatacacgtgcgttctctacacctctaaaggcatcgatatggatctctacctcgtcaaaaccatattccaaagagtacttttccgagatggtcgtatagggcagctttccttttttacggatagggacaaaaccgatacccagatcacgcgcaagcgcggcaccgaagataaaaccgcgtgcatctataccggcgataaaatcaagttccatcccttcataacgttctttcagatggtccatcaaaaggccgaaagccttagcgtcatttaa

SEQ ID NO: 7730 - protein, 110 aa, Unknown
  Obtained from environmental sample
  misc_feature (1)..(110): Xaa is any amino acid
MDKVSCSKSSPSGGDKVIDQQYTCVLYTSKGIDMDLYLVKTIFQRVLFRDGRIGQLSFFTDRDKTDTQITRKRGTEDKTACIYTGDKIKFHPFITFFQMVHQKAESLSVI

SEQ ID NO: 7731 - DNA, 561 bp, Unknown
  Obtained from environmental sample
  misc_feature (1)..(561): n is a, c, g, or t
ttgcgcgatatttgtattttactggaaacacttcgagatcataacgcactgaaaaaccagtttaatgtgtctattaacattagccagtgtcagtttaattcttctactttaaaaggagaattgtttaaagcgattgagacgtatgatgtaacaccctcacaaattaaattagagatcactgagtccatgttagcgggtgatttaatgagtacggtaaagcaaatgaaagagctaaagtcgcagggatttgtattttcaattgatgactttggtaccggctactcgtgtttaaagcacttgagtgttttaccgatagacgaactaaaaatagataaaagctttattgataaagtgttggataacgcatcggggcaaagcatagttcagtctattattggtttaggtcatagtttagatattaatattgtagccgaaggggtcgaaagtgctgagcaactacatatattaaagtctatgggtgtaaacgcagtgcaagggttcttatttgcaaaaccattaacacacagcaattacttaaaatggcataaagagcaccaataa

SEQ ID NO: 7732 - protein, 186 aa, Unknown
  Obtained from environmental sample
  DOMAIN (1)...(172): EAL domain
  misc_feature (1)..(186): Xaa is any amino acid
MRDICILLETLRDHNALKNQFNVSINISQCQFNSSTLKGELFKAIETYDVTPSQIKLEITESMLAGDLMSTVKQMKELKSQGFVFSIDDFGTGYSCLKHLSVLPIDELKIDKSFIDKVLDNASGQSIVQSIIGLGHSLDINIVAEGVESAEQLHILKSMGVNAVQGFLFAKPLTHSNYLKWHKEHQ

SEQ ID NO: 7733 - DNA, 831 bp, Unknown
  Obtained from environmental sample
  misc_feature (1)..(831): n is a, c, g, or t
ttgaatttgtatttttacggaaaaaaagacatcaatgtaaaaattgaaagaataccctcttctgaagaaaacaaacttttcaatccttcaatttatcaatataaaagttatgatacttcttatgtaacttacgcaatagatagcgtagttggttacgatgaaataaaaacaccaaaagaatttagagtaattgcaagtgctgaatacgaaagtgttgaattaaaaaaagaaaaattgacgttgtcaggaggagctaaaaagggatatatttttaccaaacctaaaacacaaataaacacagatgacaaagaaatgaagctaatgggttatcaagtaatgataacttctgaagcaggtgcagatgaaatgtggggaaacattgggattggagttgacgtagcttgtttagcaatgtctttgtttttacctgctggaggtgtggccgcaggattagctgtaaaccaagcttttgaaatgatcgggccacaagaaggtggagaaccagtatattatataattacaaatagtcaaaaagatattgattattttacagatgacaacaatgacacaaaacccttggcttacgaacgaggattagcaacaggttacagtggaagttggtttgcaatggatactattgctgttggtttaaagaacctaaatattgcggttgaagttgaagttgtgattgttgtttctgctgtttatcaagctacaatttgggaaactattacacaagatattgtaacagtaaaacctaaaattgtaagagttgatcgaaaaagacaagttattgaaaacaaaaaacgtggaattttgaagaataattaa

SEQ ID NO: 7734 - protein, 276 aa, Unknown
  Obtained from environmental sample
  misc_feature (1)..(276): Xaa is any amino acid
MNLYFYGKKDINVKIERIPSSEENKLFNPSIYQYKSYDTSYVTYAIDSVVGYDEIKTPKEFRVIASAEYESVELKKEKLTLSGGAKKGYIFTKPKTQINTDDKEMKLMGYQVMITSEAGADEMWGNIGIGVDVACLAMSLFLPAGGVAAGLAVNQAFEMIGPQEGGEPVYYIITNSQKDIDYFTDDNNDTKPLAYERGLATGYSGSWFAMDTIAVGLKNLNIAVEVEVVIVVSAVYQATIWETITQDIVTVKPKIVRVDRKRQVIENKKRGILKNN

SEQ ID NO: 7735 - DNA, 618 bp, Unknown
  Obtained from environmental sample
  misc_feature (1)..(618): n is a, c, g, or t
atgcattacaaatttcataaggtatatatagagttaacaaatatttgtgggttagagtgcagtttttgcccaacaaaatctacaaaacctacaactatagatttaaacttttttgaaaatattttaattcaggtacaaccttatacgcatactattgcttttcatgtttttggggatccattaactcttaataatcttgaaaactacctagatattgcctttaaatataagatgaaagttgaaataactacaactgggtattatcttaaaaattttgatttaaatatttttttacataaagctattaaacagataaatttttcactcaatagctacaacaaaaatgagatgaatatatctctagaagagtacctcaaacctatgtttgagttatctgatttaaagctaaaaaataaagtacataattttatcaattttagactatggaacttggataataaccatagtgaggtaaattttaatactcaagttttaaacttactatctaaaaaatttcatattgatttaacaaacataaaatatgataagccagtgagggtagaaaatccgattcttatagattttgatacctatttcaaaatggccaaatctaagtga

SEQ ID NO: 7736 - protein, 205 aa, Unknown
  Obtained from environmental sample
  misc_feature (1)..(205): Xaa is any amino acid
MHYKFHKVYIELTNICGLECSFCPTKSTKPTTIDLNFFENILIQVQPYTHTIAFHVFGDPLTLNNLENYLDIAFKYKMKVEITTTGYYLKNFDLNIFLHKAIKQINFSLNSYNKNEMNISLEEYLKPMFELSDLKLKNKVHNFINFRLWNLDNNHSEVNFNTQVLNLLSKKFHIDLTNIKYDKPVRVENPILIDFDTYFKMAKSK

SEQ ID NO: 7737 - DNA, 513 bp, Unknown
  Obtained from environmental sample
  misc_feature (1)..(513): n is a, c, g, or t
atgaatatttctctagaagagtacctcaaacctatgtttgagttatctgatttaaagctaaaaaataaagtacataattttatcaattttagactatggaacttggataataacaatagtgaggtaaattttaatactcaagttttaaacttactatctaaaaaatttcatattgatttaacaaacataaaatatgataagccagtgaggttagaaaatcagattcttatagattttgatacctatttcaaatggccaaatctaagtgattcaacagctacaaatggtttttgtcatggattgacatcacaaattgctattttaagctcaggtgttgttgttccctgctgtttggatagctttggaataatagaccttggtaatgtccacaatagttcacttgaaaatatcttacaatcatataaagcaactcaaatagtcaatggatttaaaaataatattgccattgaggagttatgtcaaaaatgtacctttaaagatagatttaactaa

SEQ ID NO: 7738 - protein, 170 aa, Unknown
  Obtained from environmental sample
  misc_feature (1)..(170): Xaa is any amino acid
MNISLEEYLKPMFELSDLKLKNKVHNFINFRLWNLDNNNSEVNFNTQVLNLLSKKFHIDLTNIKYDKPVRLENQILIDFDTYFKWPNLSDSTATNGFCHGLTSQIAILSSGVVVPCCLDSFGIIDLGNVHNSSLENILQSYKATQIVNGFKNNIAIEELCQKCTFKDRFN

SEQ ID NO: 7739 - DNA, 813 bp, Unknown
  Obtained from environmental sample
  misc_feature (1)..(813): n is a, c, g, or t
ttgggtgttgttgattttgtaccaaaaccagtggatagtaatctttttcaagaggtattgttaaaagttgcaacaaaagcagctcaggagcctattaatactatttctacaaataaagtgaatacaaatctaaatgatgagatgtttaaaaaattgaatattgtatacaaaagtcacaatcagattgagtttattaatcactataaaggggttcctattttaaataaaggaattattaaagctattgatacaaattcagttacagttgaagttccttttttccaaggtatggcaattaaatatgaggggaagacagttttagattcagaattatttgataagtcaatagaagcaaaattagaaataataaatggacataatggtacgctaaaactttgtgatttaagatacttaaatttagcaacaatgaaacgaagacaaataagtgtagaaccagggaaaagtttttcggttgtaacacaatataaagaagagattttagaaacaaaagtgaaacatctatcaacagattttatatcattagttatagacaatgatcaattaacatttagtgagggagatcaacttaacttagagtttgaaataaaaagaacagaaaatagacatactttaaaaccaataaaaatagttactcaaggggaagtatatattattgatacaaataatacanaacaaaaagtacttatggttttatttgagttagataataatgaaaaaactattttagaatcttatattgaacatagaagattagatttagtagtagagtttaaacaacttaataaaagttag

SEQ ID NO: 7740 - protein, 270 aa, Unknown
  Obtained from environmental sample
  misc_feature (1)..(270): Xaa is any amino acid
MGVVDFVPKPVDSNLFQEVLLKVATKAAQEPINTISTNKVNTNLNDEMFKKLNIVYKSHNQIEFINHYKGVPILNKGIIKAIDTNSVTVEVPFFQGMAIKYEGKTVLDSELFDKSIEAKLEIINGHNGTLKLCDLRYLNLATMKRRQISVEPGKSFSVVTQYKEEILETKVKHLSTDFISLVIDNDQLTFSEGDQLNLEFEIKRTENRHTLKPIKIVTQGEVYIIDTNNTXQKVLMVLFELDNNEKTILESYIEHRRLDLVVEFKQLNKS

SEQ ID NO: 7741 - DNA, 354 bp, Unknown
  Obtained from environmental sample
  misc_feature (1)..(354): n is a, c, g, or t
ttgtctataactaatgatataaaatctgttgatagatgtttcacttttgtttctaaaatctcttctttatattgtgttacaaccgaaaaacttttccctggttctacacttatttgtcttcgtttcattgttgctaaatttaagtatcttaaatcacaaagttttagcgtaccattatgtccatttattatttctaattttgcttctattgacttatcaaataattctgaatctaaaactgtcttcccctcatatttaattgccataccttggaaaaaaggaacttcaactgtaactgaatttgtatcaatagctttaataattcctttatttaaaataggaacccctttatag

SEQ ID NO: 7742 - protein, 117 aa, Unknown
  Obtained from environmental sample
  misc_feature (1)..(117): Xaa is any amino acid
MSITNDIKSVDRCFTFVSKISSLYCVTTEKLFPGSTLICLRFIVAKFKYLKSQSFSVPLCPFIISNFASIDLSNNSESKTVFPSYLIAIPWKKGTSTVTEFVSIALIIPLFKIGTPL

SEQ ID NO: 7743 - DNA, 639 bp, Unknown
  Obtained from environmental sample
  misc_feature (1)..(639): n is a, c, g, or t
ttgaaatataatgacaaggcatcttttaaaaagatttgtcaacaattaaaaattcccgttgttgaaggtgtttcattcgagatgcaacctcaaaacagggagaattatagcctgatgaagaatgcaattatgggatttttgcaaaacttcagcacagttattattcggggggcactgggagaatctggtatgtcattgtttaaaacaaaaggtgatgacattggtggcatatatcaggaaatttcagatagtggtgaaaaaattataattattgaaccatttttaaatgtttcatcttctcctaatgatcaatggataattagcagagatggaagtataaatcaccttggaatacgtgatcaaatatgtaaaaatggtttaatacatactggtacaattaataaagttcaaatttcagatgaccattcaaaatatattaatgcatgctctctgaaaattgcaactaaaatggctgaaacaggttatgtaggagtaattggtattgattatattgtgactgacattggggtatatcctgttgaaaataacgctcgatttaatggttcatcttatgtgagccttattgttgataatattgaaaaattaggcacacctgttcaggtatggaaaatttggtaa

SEQ ID NO: 7744 - protein, 212 aa, Unknown
  Obtained from environmental sample
  misc_feature (1)..(212): Xaa is any amino acid
MKYNDKASFKKICQQLKIPVVEGVSFEMQPQNRENYSLMKNAIMGFLQNFSTVIIRGALGESGMSLFKTKGDDIGGIYQEISDSGEKIIIIEPFLNVSSSPNDQWIISRDGSINHLGIRDQICKNGLIHTGTINKVQISDDHSKYINACSLKIATKMAETGYVGVIGIDYIVTDIGVYPVENNARFNGSSYVSLIVDNIEKLGTPVQVWKIW

SEQ ID NO: 7745 - DNA, 513 bp, Unknown
  Obtained from environmental sample
  misc_feature (1)..(513): n is a, c, g, or t
atgagtaaactaaattcttatatgaatattcatgaagcatcttatgaaaatctttcaaaagaaccttttatctggggtaaaaatattgatacatttttaacacctgataaaaaaggaaacctattttttgtagaaaataaattattgagtgaaaaaacaaatttagaatatccatttattctactaacaggtaggacaagagatcagtggcatactggtacaaaaacaaatctacctactacattgttaaaatttaaagaactaaatttttgtgagattaattcttttgacgctgaagaattaaatatcaaagatggtgataccataattgtaaagtcaagaagagggtcattagaaacaaaagctttgataactgatactattaaacagaagattatatttataccaataagtaatagagaggttaattatcttacaaataatttattggacaaagagtcttttgaaccagattacaaccatagtgcaataaaaatagaaaaactaaattaa

SEQ ID NO: 7746 - protein, 170 aa, Unknown
  Obtained from environmental sample
  DOMAIN (59)...(163): Molydopterin dinucleotide binding domain
  misc_feature (1)..(170): Xaa is any amino acid
MSKLNSYMNIHEASYENLSKEPFIWGKNIDTFLTPDKKGNLFFVENKLLSEKTNLEYPFILLTGRTRDQWHTGTKTNLPTTLLKFKELNFCEINSFDAEELNIKDGDTIIVKSRRGSLETKALITDTIKQKIIFIPISNREVNYLTNNLLDKESFEPDYNHSAIKIEKLN

SEQ ID NO: 7747 - DNA, 444 bp, Unknown
  Obtained from environmental sample
  misc_feature (1)..(444): n is a, c, g, or t
ttgcaaaatcctgctgtccacacactctcgttgggaatgactgaagcaagtcatttggaagaaatgaaagaaattttcccttttactgttccagggcaggaaaaaacacagataataaaattgaaaatggacagctttattttagacgatccatacgccagctacgaaggttttgatctgcaacacgacccctcaggaattaatattccggcagttttacgtctgcgaaaactttggaaatgttacgatatgaaaacatatagtaaataccgatacaaaatatttcaacaaaaggaccactggtttccgggacgatatgcaaccaatgagaacatttcaaaagttgatttatcaaaagttccaaatagtattcctttaaaggagatgttggcagaaacgcacaaagaattatacaccccggaatttagtttgataaaagagtaa

SEQ ID NO: 7748 - protein, 147 aa, Unknown
  Obtained from environmental sample
  misc_feature (1)..(147): Xaa is any amino acid
MQNPAVHTLSLGMTEASHLEEMKEIFPFTVPGQEKTQIIKLKMDSFILDDPYASYEGFDLQHDPSGINIPAVLRLRKLWKCYDMKTYSKYRYKIFQQKDHWFPGRYATNENISKVDLSKVPNSIPLKEMLAETHKELYTPEFSLIKE

SEQ ID NO: 7749 - DNA, 384 bp, Unknown
  Obtained from environmental sample
  misc_feature (1)..(384): n is a, c, g, or t
ttgaagaaaataactcataacaaatcagtggagccaataaattaccctgcgggcaattcatcggctcatttcaaacgttatacacataagggcaacatgaaaaatccaaatagagaaactgtttcagaactagaagccttaccaaaccttggaaaagctatcagttcagatcttagattaataggtatatctaagcctcaaaatttaattggaaaaaatccctttgacttgtacaatgaattatgtataaaaaaaggcgaacaagttgaccattgtgttatagatgtatttatgtctgtagtagactttatggagggtgaagagcctaagccttggtggaaatttacccaaaaacgaaaacaaatatttaaagaggaaaaataa

SEQ ID NO: 7750 - protein, 127 aa, Unknown
  Obtained from environmental sample
  misc_feature (1)..(127): Xaa is any amino acid
MKKITHNKSVEPINYPAGNSSAHFKRYTHKGNMKNPNRETVSELEALPNLGKAISSDLRLIGISKPQNLIGKNPFDLYNELCIKKGEQVDHCVIDVFMSVVDFMEGEEPKPWWKFTQKRKQIFKEEK

SEQ ID NO: 7751 - DNA, 375 bp, Unknown
  Obtained from environmental sample
  misc_feature (1)..(375): n is a, c, g, or t
atggaaaaagatgtatatgtattagaagaatcctttggttatcatataaatagtttagcagttgcgataaaaagaaatatggatgagtatttaaaaccttatagtttgacccatttacaattttctatccttatgagtttatataaaaacaatgtcacgactcanaaagagatactcagatttacctatggggatgaagctggtattacaagacatattgataaattagaattaaaagggtatttacaaaggtctccttgtagtactgataaacgtaagaaaaaacttgtattgaccaatgatggaattactcttattgaagaaatcatcacttatgcttgtaaggttaatagggaagtaactaaaaacccttga

SEQ ID NO: 7752 - protein, 124 aa, Unknown
  Obtained from environmental sample
  DOMAIN (36)...(124): MarR family
  misc_feature (1)..(124): Xaa is any amino acid
MEKDVYVLEESFGYHINSLAVAIKRNMDEYLKPYSLTHLQFSILMSLYKNNVTTXKEILRFTYGDEAGITRHIDKLELKGYLQRSPCSTDKRKKKLVLTNDGITLIEEIITYACKVNREVTKNP

SEQ ID NO: 7753 - DNA, 717 bp, Unknown
  Obtained from environmental sample
  misc_feature (1)..(717): n is a, c, g, or t
atggacaactatgatgaaatcaaaaaaagatacacattaaatgtagatgctgaaacaattatagatacgatacgtacacacataaactatagtaaacatacacttgatgataaacagacttattgtcatctttcatttttcaagaatgatgagaaagtagttattaaagataggactattgagcaaacaaaatcaggattagtttcaaaaggacttgtctcaggtgaaagttctcaacaagaaaaaggtaattactttagtggatttggtttaagtaatgttgagaccacaggttttaaacacttagaattagcacaagtctataatgctatgcaacgacctgtatatgaaaccggtacaaactatgaatctaaaaagactattgcattaatgataagtgaaaatttcaaaactctgctaaaacagtcttacgaaaaagcactttggactgttatcattgatccaaaggttacgctagagttttttaacaatgctgaagatttaatacttatacacttttcagatcaatacagctcttctgcaaactacgatgctgttacggtaacggctcanaaagagttgtattctaacgtagttgctcatgtaggtagtgcaatagataaagagaacattattaagcagtttaacgcttttaacggtgaatggcttataaagatgataagcgagaatgaaaaagatcaaaaaagagcgtgttag

SEQ ID NO: 7754 - protein, 238 aa, Unknown
  Obtained from environmental sample
  misc_feature (1)..(238): Xaa is any amino acid
MDNYDEIKKRYTLNVDAETIIDTIRTHINYSKHTLDDKQTYCHLSFFKNDEKVVIKDRTIEQTKSGLVSKGLVSGESSQQEKGNYFSGFGLSNVETTGFKHLELAQVYNAMQRPVYETGTNYESKKTIALMISENFKTLLKQSYEKALWTVIIDPKVTLEFFNNAEDLILIHFSDQYSSSANYDAVTVTAXKELYSNVVAHVGSAIDKENIIKQFNAFNGEWLIKMISENEKDQKRAC

SEQ ID NO: 7755 - DNA, 630 bp, Unknown
  Obtained from environmental sample
  misc_feature (1)..(630): n is a, c, g, or t
atggtaagccctcttattcaatatactattgatgctgctcaaaaaagtaaatatatagataaaatttttttatccagtgatgatagtgagattgtagaagtagtaaaaaaattaggattaacttctgaatacgtaagaccacctcaacttgctgatgataaagctacaactatagatgctgtatttgatgcattactatggcttgaacaaaatgagaactactatcctgatgcagttttattgctgcaaccaacttctccattaagaatagttgtagacatagatgaagctatagaaaaatttaatagtgattctaaaaactgcttggtgagtgttcatgagatgatagaacatccttatgagtgtatttatgatattaaagatgataattggaagtatttagcgaaacaagagcaaaaagcaacaagacgtcaagattataaaagttctttttattatataaatggagctttatatttggcaaatacagattttttgaaaaaagagaaaacttttatcaaagaaaaagatacaactttttatgtaatgcctcacgaaagaggaatagatatcgatgagtatagcgatcttaaaagagcagaatttcatattaaaggtcataaaagttga

SEQ ID NO: 7756 - protein, 209 aa, Unknown
  Obtained from environmental sample
  DOMAIN (4)...(209): Cytidylyltransferase
  misc_feature (1)..(209): Xaa is any amino acid
MVSPLIQYTIDAAQKSKYIDKIFLSSDDSEIVEVVKKLGLTSEYVRPPQLADDKATTIDAVFDALLWLEQNENYYPDAVLLLQPTSPLRIVVDIDEAIEKFNSDSKNCLVSVHEMIEHPYECIYDIKDDNWKYLAKQEQKATRRQDYKSSFYYINGALYLANTDFLKKEKTFIKEKDTTFYVMPHERGIDIDEYSDLKRAEFHIKGHKS

SEQ ID NO: 7757 - DNA, 702 bp, Unknown
  Obtained from environmental sample
  misc_feature (1)..(702): n is a, c, g, or t
ttgatttttaaaaggtatattaaacccattgtcgaagttctacaacagttaggagttaatgcaaagcacgaaggacgcattgatataatgattatgggcaaaaaagtttcggggaatgcagagcatgttttcaagaaaagagttttacatcacggaacattgtgnttttcttcggtaatttctgatttatcaaaagctttaaaagtaaatcctttaaaatatcaagacaaaggagttaaatctgtaaaaagtagagttgctaatatcaacggatttttaactgaagaaatatcagtattcgaatttaaagataagattctcagattcataaaggagtcagagtctaaggttaaagattatatattttcagagtttgatattaataatattaataaattggtgttggataaatattctacttgggactggaattatgggtattcgcctaaatatagttttgagaaaacgattaaaatggaacaatatagcattgatatacaaatgaatgttgagaaaggaataatcacaaaccttaaatttgagagtaattatactcataaatcagatatttctgaacttgagcaaaatttaacaggaattagccataaagaagaatcattgctcaaagccttaaaagatatttcagataataattttgttactgcaatttcaacaaataagcttattaaatcacttttttaa

SEQ ID NO: 7758 - protein, 233 aa, Unknown
  Obtained from environmental sample
  misc_feature (1)..(233): Xaa is any amino acid
MIFKRYIKPIVEVLQQLGVNAKHEGRIDIMIMGKKVSGNAEHVFKKRVLHHGTLXFSSVISDLSKALKVNPLKYQDKGVKSVKSRVANINGFLTEEISVFEFKDKILRFIKESESKVKDYIFSEFDINNINKLVLDKYSTWDWNYGYSPKYSFEKTIKMEQYSIDIQMNVEKGIITNLKFESNYTHKSDISELEQNLTGISHKEESLLKALKDISDNNFVTAISTNKLIKSLF

SEQ ID NO: 7759 - DNA, 567 bp, Unknown
  Obtained from environmental sample
  misc_feature (1)..(567): n is a, c, g, or t
atgttagaaacagagatttattatcaacagttaagagaggtttgtaaagaatattatgactttagtgataaaagttttgatgcttttaagaaaatatgttttgtgaaaaatataaaaaaaggggagattctccaagatagttattctcctgcaaaatatatctattttatctataaaggtattttacgaacatattttttaaatgaaaaaggggcaatttatacaaaaaatctttttagtgaaaattatttttctgcttcaaaagtttctcttatcacaaaagaagactcttatttaaatatcgatgctttagaagatagtattttgatttatattaattttgatggatataagaatttaatagatactaacatagaatttaaaaacttttatataaattatttggaaaaaaattgggttatagtaaaggagaaaaatgaaatatctttgatacttgatgatgccaaaacaagatatgaaaactttatacaaaatattcaggatattgaaaaaaagataccattacatcctattgcaaatcatttaggtattccccctaccccgtta

SEQ ID NO: 7760 - protein, 189 aa, Unknown
  Obtained from environmental sample
  misc_feature (1)..(189): Xaa is any amino acid
MLETEIYYQQLREVCKEYYDFSDKSFDAFKKICFVKNIKKGEILQDSYSPAKYIYFIYKGILRTYFLNEKGAIYTKNLFSENYFSASKVSLITKEDSYLNIDALEDSILIYINFDGYKNLIDTNIEFKNFYINYLEKNWVIVKEKNEISLILDDAKTRYENFIQNIQDIEKKIPLHPIANHLGIPPTPL

SEQ ID NO: 7761 - DNA, 837 bp, Unknown
  Obtained from environmental sample
  misc_feature (1)..(837): n is a, c, g, or t
ttgaaactccttgggaaaggaggtgttagaaacttcaaatttatagatggtacatttaatctaaacataaagtatgcaaatgcactattggacttttttttagcaaaagagccaccctactttgcccattttgaagttatacctgatcattttccagattcactaaaagataaaataaaattcttccctccatcttcactacaactcgaagtaggtattcagacactaaatcctgagatcgcagatggaataaacagacctctaaaaatagagaagataaaagagaatatctcatttttagagaatgagacaaaagctcacatgcatcttgaccttattatcggtctgcctggcgagtcaatagagagttttggaaaaaacttgaatcaactctgctcaattgcgagcagtgagattcagctgggtgttttaaaaaaactatctggtacaacgctagatcgtcatgacaaagaacatggcatgatctactcaaacaagccaccgtatgagattttatcaaacactcaaataagctataagcagatgcagatcatgaaacgttttgcaagattttgggatcttttttataatagcggaaattttaaaaatggtattaaattactttttaaggatggagaggtttataaaaatttctactcattttcactttggatatatgctcagacaaactctacatggaaaatttcacttgatcgtttaaatgaactgctttttagctactttttagatgagatgaaactagaaaaaaatgaagtggctcaaatattactaaaagatttcatgagtgtaggtggtagaaaaatacccaaattttaa

SEQ ID NO: 7762 - protein, 278 aa, Unknown
  Obtained from environmental sample
  misc_feature (1)..(278): Xaa is any amino acid
MKLLGKGGVRNFKFIDGTFNLNIKYANALLDFFLAKEPPYFAHFEVIPDHFPDSLKDKIKFFPPSSLQLEVGIQTLNPEIADGINRPLKIEKIKENISFLENETKAHMHLDLIIGLPGESIESFGKNLNQLCSIASSEIQLGVLKKLSGTTLDRHDKEHGMIYSNKPPYEILSNTQISYKQMQIMKRFARFWDLFYNSGNFKNGIKLLFKDGEVYKNFYSFSLWIYAQTNSTWKISLDRLNELLFSYFLDEMKLEKNEVAQILLKDFMSVGGRKIPKF

SEQ ID NO: 7763 - DNA, 393 bp, Unknown
  Obtained from environmental sample
  misc_feature (1)..(393): n is a, c, g, or t
atgcattttaataatagggctataaaagtatttaatcaaggagagatgagtcgtgattttacatatatagatgatataataagtggaatagtgaaagtaatagataatccaccattgaagctatgtacaccttttaagatttataatattggaaataattcacctgtaaaattgctagattttataaaaactcttgaaaaatatttaggtaaagatactcaaaaagaatttttacctatgcaagatggagatgttgtttcaacatacgcggatgtaacagaacttattgatgattttaattataaacctagtacatctttaagtgttggaattaaaaaatttgtgaaatggtataaagacttctatggtcagaaaggaaatagtatacaatga

SEQ ID NO: 7764 - protein, 130 aa, Unknown
  Obtained from environmental sample
  misc_feature (1)..(130): Xaa is any amino acid
MHFNNRAIKVFNQGEMSRDFTYIDDIISGIVKVIDNPPLKLCTPFKIYNIGNNSPVKLLDFIKTLEKYLGKDTQKEFLPMQDGDVVSTYADVTELIDDFNYKPSTSLSVGIKKFVKWYKDFYGQKGNSIQ

SEQ ID NO: 7765 - DNA, 561 bp, Unknown
  Obtained from environmental sample
  misc_feature (1)..(561): n is a, c, g, or t
atgaagatatgtataatagggcttggatatgtggggcttccacttgctcatgcttttagtgaaaaatatgatgtagttggatttgatattaatacatcaagaattgatgagctaaatagtggatatgatagaactttagaattatcagaacttcaattacaagaagctatccaaaatggtatgaagtttagtttgaatttagaagatataaaagattgtaatatttatatagtgactgtaccaactccaatagataaaaataataaaccggacttaactccacttattaaatcatcacaaacagttggaaaagttcttaaaactgatgatgtagttatttatgaatctacagtttatcctggtgttacagaagaggtgtgtgtacctgaattagaaaaagtgagcggattaaagtttaatcaagatttttattgtggatatagtccagaaagaatcaatcctggggataaagaacacacagtaactaaaatccttaaaagtcaccgtcaggaagtacacccagatattgcaaccaaaagtagatggaactttataaaagca

SEQ ID NO: 7766 - protein, 187 aa, Unknown
  Obtained from environmental sample
  SIGNAL (1)...(18)
  DOMAIN (1)...(186): UDP-glucose/GDP-mannose dehydrogenase family, NAD binding domain
  misc_feature (1)..(187): Xaa is any amino acid
MKICIIGLGYVGLPLAHAFSEKYDVVGFDINTSRIDELNSGYDRTLELSELQLQEAIQNGMKFSLNLEDIKDCNIYIVTVPTPIDKNNKPDLTPLIKSSQTVGKVLKTDDVVIYESTVYPGVTEEVCVPELEKVSGLKFNQDFYCGYSPERINPGDKEHTVTKILKSHRQEVHPDIATKSRWNFIKA

SEQ ID NO: 7767 - DNA, 669 bp, Unknown
  Obtained from environmental sample
  misc_feature (1)..(669): n is a, c, g, or t
atgttgttgaaaaataacaccatttcaataccgccagaaatgctaacgtcttggcaaacggctgtcgacctcatcgccaaggtcgctaaagtgccagcatcattaatcatgaaacttcatgctaatgaagtggaagtctgtgtcgccaacaataacaccgataacccatatacacccgggatgaagggcaagctaggccatggcttatattgtgaatcagtgattaaacagcaaactgaattacacgttgagaatgcattaaacgaccccctttggagccaaaatccagatcttgcccatgggatgatttcttattacggcttaccactcaattggcccaacggcgagacctttggcaccatttgcgtatcagacaaaaaagcaaaaggctactccgccgacatcatcatgctattggagtgttttcgtaaaaatgttgaaagtaatctagaaatacttgatcaaaaggaaaaactggtacaagccaacttactattagaaactcgtattgcgcagcggacttttgaattagagaagcttaacaagaatttaatgcaggaaatcgactcacgagttgcagcggaaaaactattagatattcaacaacgttttgatattgttactggcttgcctaaattcaatcagctccaaaccatgttaaaccactga

SEQ ID NO: 7768 - protein, 222 aa, Unknown
  Obtained from environmental sample
  DOMAIN (13)...(150): GAF domain
  misc_feature (1)..(222): Xaa is any amino acid
MLLKNNTISIPPEMLTSWQTAVDLIAKVAKVPASLIMKLHANEVEVCVANNNTDNPYTPGMKGKLGHGLYCESVIKQQTELHVENALNDPLWSQNPDLAHGMISYYGLPLNWPNGETFGTICVSDKKAKGYSADIIMLLECFRKNVESNLEILDQKEKLVQANLLLETRIAQRTFELEKLNKNLMQEIDSRVAAEKLLDIQQRFDIVTGLPKFNQLQTMLNH

SEQ ID NO: 7769 - DNA, 492 bp, Unknown
  Obtained from environmental sample
  misc_feature (1)..(492): n is a, c, g, or t
atgccatcatctgtatttaaagagatgtggagcactattaagaataagaagatttggcatggtgtagttaaaaatatgaaaaaaaatggaggttcttattcggttgatgcaactataattccgattttaaatgtcaataaagagatagatgaatttatcgctatcagacatgatataactgaactggcaaatattaaagagcacctttccaaagagctaaatatctcaaataaaaacttttcagaagcatacaggcgttcaaaagagtacgaaaaagctattgatgagagtaatattttatctcgtaccgatactgatggaattatcacttatgttaatcaaaaattttgtgatgttacaggctattccaaagaggagttattggggaaaaatcactctattgtgagacatcctgacacacccaatcactatttaaagatttatgggatactattattgccggtaaaatctggtatgaccgataaaaattga

SEQ ID NO: 7770 - protein, 163 aa, Unknown
  Obtained from environmental sample
  DOMAIN (20)...(62): PAC motif
  misc_feature (1)..(163): Xaa is any amino acid
MPSSVFKEMWSTIKNKKIWHGVVKNMKKNGGSYSVDATIIPILNVNKEIDEFIAIRHDITELANIKEHLSKELNISNKNFSEAYRRSKEYEKAIDESNILSRTDTDGIITYVNQKFCDVTGYSKEELLGKNHSIVRHPDTPNHYLKIYGILLLPVKSGMTDKN

SEQ ID NO: 7771 - DNA, 318 bp, Unknown
  Obtained from environmental sample
  misc_feature (1)..(318): n is a, c, g, or t
ttgcaagtatttttaaacatcatcaaaaacgctaaagacaatcttcttaaaagagagatcaaagaggctaaaatatctattgatataagtgaaactgatgactctatactcacaagcatttgtgacaatggaggcggtatctctaaacatgatatcgagaggatcggtgaaccatatttcacaaccaagggagagaatggaatgggacttggactatatatgtctaaaactattgtagaaaaaaatctacaaggcagactgagttggaaaaatgaaaaccacggtgcctgttttgttgtgagtctgccaaagcagtaa

SEQ ID NO: 7772 - protein, 105 aa, Unknown
  Obtained from environmental sample
  DOMAIN (1)...(105): Histidine kinase-, DNA gyrase B-, and HSP90-like ATPase
  misc_feature (1)..(105): Xaa is any amino acid
MQVFLNIIKNAKDNLLKREIKEAKISIDISETDDSILTSICDNGGGISKHDIERIGEPYFTTKGENGMGLGLYMSKTIVEKNLQGRLSWKNENHGACFVVSLPKQ

SEQ ID NO: 7773 - DNA, 348 bp, Unknown
  Obtained from environmental sample
  misc_feature (1)..(348): n is a, c, g, or t
atgttagtattttttaatattggaggtggagaactggtaatcattgtgttggttatcgtaatgttttttggttctaaaaaaataccagaaattgctcgtaccttgggtaaaggaattagcgaattaaaaaatgctacttcagatattcaacaagaaataaaaaaatctgttccttcagaagttactaatataaaaaactctgtaaatgttgaacatcaggtaaaaagttttatcaaaaaagaaataactaaacctgtagaggataaaaatgttgatgagccttcagcttcagaagaggaagaggaagataaaaactcaacacctcccaactcaatttcaagaagttaa

SEQ ID NO: 7774 - protein, 115 aa, Unknown
  Obtained from environmental sample
  DOMAIN (7)...(59): mttA/Hcf106 family
  misc_feature (1)..(115): Xaa is any amino acid
MLVFFNIGGGELVIIVLVIVMFFGSKKIPEIARTLGKGISELKNATSDIQQEIKKSVPSEVTNIKNSVNVEHQVKSFIKKEITKPVEDKNVDEPSASEEEEEDKNSTPPNSISRS

SEQ ID NO: 7775 - DNA, 828 bp, Unknown
  Obtained from environmental sample
  misc_feature (1)..(828): n is a, c, g, or t
ttggctgaggtcgcagcccaggtttcacaagatctgcaatccgtcctccagattctgtccgaggaaaacttcctgataactgtctactaccttcactctgcttctattttttactggggtgagttgccaccttttcggcggaataaaaccaaaattgacaaaagcaaagtcactttgccaactctgactactcgctttcaggaaagaaaattctctggttttattgagatagaaatggaaaatcagaacgatagtgccattctgttttttcatgagggaaagcgtcgtggtggttcctattcctggggaaagggagggctgagttcttcagatgaggattataatcgtcttattcttagtgtggagagtactgatactgcgacttttaccttgggtcaatttatcgaagaggttgtatcttcaccagaacctgttgtggaaaaatcagctgaaactttggatgaagaactctttttatcagatctcgaaactggcataaaagaatttctgaatatttatatgctacttgtcaggaaaaagatccaaacggatccgattattcagctaaaacagaaatttcttgattccattaatgagtttcctttacttgatctctttaaacatcacttccaactgagcaatgatggaacaattgaatttgcaacagatgtcgatagaaaagaaatcacgataggcattgttacctgcacctggaaggttattaaagagaataagctggagaagaaattcaagactgctgttaccaaatgngactacagggcggcccttgaaaaaacggggaaattgccgtccctgcccttcgggtga

SEQ ID NO: 7776 - protein, 275 aa, Unknown
  Obtained from environmental sample
  misc_feature (1)..(275): Xaa is any amino acid
MAEVAAQVSQDLQSVLQILSEENFLITVYYLHSASIFYWGELPPFRRNKTKIDKSKVTLPTLTTRFQERKFSGFIEIEMENQNDSAILFFHEGKRRGGSYSWGKGGLSSSDEDYNRLILSVESTDTATFTLGQFIEEVVSSPEPVVEKSAETLDEELFLSDLETGIKEFLNIYMLLVRKKIQTDPIIQLKQKFLDSINEFPLLDLFKHHFQLSNDGTIEFATDVDRKEITIGIVTCTWKVIKENKLEKKFKTAVTKXDYRAALEKTGKLPSLPFG

SEQ ID NO: 7777 - DNA, 384 bp, Unknown
  Obtained from environmental sample
  misc_feature (1)..(384): n is a, c, g, or t
atgaacataataaactttaaaaatataaatgtaggttatgatgagaaaatcatcttacaaaatcttaacttaactataaaacaaggggagcattgggcaatacttggggcgaatggttctggaaaatctactttgatgaaactcatccaatcccaaatccatccacgctttgacaaaaactctacaaaagagatatttggtaagtcacgatattcactctttgaacttagagaaaaaataggtgtaattaccaatgatttacacaattatttcttagataaagttccttttttaactggctacgaagtggtgcaaagtggattttatagtagttttggtatctttgaacatcaagattcacagagcaacaacacaaaaaagttc

SEQ ID NO: 7778 - protein, 128 aa, Unknown
  Obtained from environmental sample
  misc_feature (1)..(128): Xaa is any amino acid
MNIINFKNINVGYDEKIILQNLNLTIKQGEHWAILGANGSGKSTLMKLIQSQIHPRFDKNSTKEIFGKSRYSLFELREKIGVITNDLHNYFLDKVPFLTGYEVVQSGFYSSFGIFEHQDSQSNNTKKF

SEQ ID NO: 7779 - DNA, 468 bp, Unknown
  Obtained from environmental sample
  misc_feature (1)..(468): n is a, c, g, or t
atggataatttagagatagaaaactttgagataacaaaacttacaaatccatcctttgtaaagcctgtacgattaaactatagtataaacgcatcagataagacctgggaagctgtgaagtctcacgatagtgtttctgtgcttttataccatacaagcaaagatgcttttcttttagtaaaacaatttcgagcaccagtttttatgaatcatgataactataggtttacttatgagttgtgtgctgggattgtagataaagatatctcgttggcagagatagcaaaagaggagatagaagaggagtgtggatatcaagtagatgttagttctataaaaaaaatctcttcattttttacaaatgtaggggtaagtggagcgaaacaacatctcttttttgccaagattgatgagtctatgaaaaatagtgagggtggtggagtcaatgatggatatatagaaaaagag

SEQ ID NO: 7780 - protein, 156 aa, Unknown
  Obtained from environmental sample
  misc_feature (1)..(156): Xaa is any amino acid
MDNLEIENFEITKLTNPSFVKPVRLNYSINASDKTWEAVKSHDSVSVLLYHTSKDAFLLVKQFRAPVFMNHDNYRFTYELCAGIVDKDISLAEIAKEEIEEECGYQVDVSSIKKISSFFTNVGVSGAKQHLFFAKIDESMKNSEGGGVNDGYIEKE

SEQ ID NO: 7781 - DNA, 603 bp, Unknown
  Obtained from environmental sample
  misc_feature (1)..(603): n is a, c, g, or t
atgtctaaactaagctctttatttaacagttttttaaaaagccccatacttctcaaactcttttttgcccttttatttgtcttatttgccattatgattgctactatatcttttgcagtacattataattatgaaaataattatatcaaaaaagatatacatcataaagctatctcttttatagaaactaaaactaatattttaaaacatcaaattgataaaaataaacaatatttatattcacttaaaaataatgctattttgcaatcctacataaaaacaggtgaaaataaagcaactacagttgcactatttgaacaaatcatctcagcagataaagatattatgcaaatacgatatatagatgaaagtggaatggaaattattcgacttgaaagaaatgaacaaaatgaaaagtatcgtattgtcaatgaaactgctcttcaaaataaaaaagatagatactatttccaagagacatcaaaactcaatgagagtagtcctatatggttatctgatattgatttaaatatagaaaatggtaaagttataaaaccatatatcccaacattaagacttgcaaaccactatttgaaaaaataa

SEQ ID NO: 7782 - protein, 200 aa, Unknown
  Obtained from environmental sample
  misc_feature (1)..(200): Xaa is any amino acid
MSKLSSLFNSFLKSPILLKLFFALLFVLFAIMIATISFAVHYNYENNYIKKDIHHKAISFIETKTNILKHQIDKNKQYLYSLKNNAILQSYIKTGENKATTVALFEQIISADKDIMQIRYIDESGMEIIRLERNEQNEKYRIVNETALQNKKDRYYFQETSKLNESSPIWLSDIDLNIENGKVIKPYIPTLRLANHYLKK

SEQ ID NO: 7783 - DNA, 825 bp, Unknown
  Obtained from environmental sample
  misc_feature (1)..(825): n is a, c, g, or t
ttgttttataatcaaataatgaaaaatatacccataatttacatactatttgtgttgatacttacaggatgttcacgcaatattcctacacctaacgaaagacttaatactgttctatctttacaagggaaagactcttttcaaaaaacaattaaaacaaaaaactttgaacttttttctatacaagaaactacaaaagagtgtaaaaatataaaagtatacatagagggagatggactcgcttggaaaacaagaacacaaatctcaaaagacccaactcctataaatccttcaggattaaaactaatgaatgaggatacaagtgattgtaaaatatatatagcaagaccttgtcaatacaccccatatgcaaaaaactgtaaaaataaatactggacaagccataggtttaataagcgtgtaatagatagttatgatgaagcacttaactctataaaaaaagagtatcaaaataatacattttcactcataggatatagtggaggaggttctgtagcacttcttgtagctacaaaaagagaggatataaaaaacatcaccacaatagctggaaatatcaaccatagcttttggacaaaatatcatcgtatcaatccactcaatggttcacaaaatcctataaactatacaaaacaattaaaaaaaatacctcagtatcatcttataggttcaaatgatactatcataccaaaagagatttttaactcttatattcaaaactttgaagatagcagtaatattcactcaaaaatatataatgcaacccatacaaaaaatgggaacaaaactatagaaactttttaa

SEQ ID NO: 7784 - protein, 274 aa, Unknown
  Obtained from environmental sample
  misc_feature (1)..(274): Xaa is any amino acid
MFYNQIMKNIPIIYILFVLILTGCSRNIPTPNERLNTVLSLQGKDSFQKTIKTKNFELFSIQETTKECKNIKVYIEGDGLAWKTRTQISKDPTPINPSGLKLMNEDTSDCKIYIARPCQYTPYAKNCKNKYWTSHRFNKRVIDSYDEALNSIKKEYQNNTFSLIGYSGGGSVALLVATKREDIKNITTIAGNINHSFWTKYHRINPLNGSQNPINYTKQLKKIPQYHLIGSNDTIIPKEIFNSYIQNFEDSSNIHSKIYNATHTKNGNKTIETF

SEQ ID NO: 7785 - DNA, 705 bp, Unknown
  Obtained from environmental sample
  misc_feature (1)..(705): n is a, c, g, or t
atgtttaaaaaagttgggattcttttgtttttaattgctttatcgcttgttgttttagcacaacaaagcaatataaagtttgatagaatcaactacaaagacgggctttctcaaagcgatgtcacttgtattgttcaagattataagggtttaatttggatgggaacacaagacgggcttaatcaatataatggctatgaattcaccgttttttcacatgatttattagatagttctactatttctaacagttttgctcatgttatttacgaagatagtgatagcaacctttggataggtacagaaaatgggctaaatttattcaacagagattatcaaacttttactcactaccttagtgaaaataaagcttctaatgggaaaaagcataatgtttggacaataaccgaaaatgaagaagataaaagtctttggataggaaccgaccaatctttatacaaacttgcaaaatcatcaaaaaaatctaaaaattttcaaatctcaaaaattgaaatcccttttagtaccaatattagaaaacttaatattaggaagttggtctttgtaacccccgaagtattaatgattgctacagaaaacaatggtttattattgtaccacatccacacccaagattatactcaatatacttcagggaactccagactaaaaagcaaccttgtttgggatgtacataaagatatn

SEQ ID NO: 7786 - protein, 235 aa, Unknown
  Obtained from environmental sample
  SIGNAL (1)...(19)
  misc_feature (1)..(235): Xaa is any amino acid
MFKKVGILLFLIALSLVVLAQQSNIKFDRINYKDGLSQSDVTCIVQDYKGLIWMGTQDGLNQYNGYEFTVFSHDLLDSSTISNSFAHVIYEDSDSNLWIGTENGLNLFNRDYQTFTHYLSENKASNGKKHNVWTITENEEDKSLWIGTDQSLYKLAKSSKKSKNFQISKIEIPFSTNIRKLNIRKLVFVTPEVLMIATENNGLLLYHIHTQDYTQYTSGNSRLKSNLVWDVHKDX

SEQ ID NO: 7787 - DNA, 423 bp, Unknown
  Obtained from environmental sample
  misc_feature (1)..(423): n is a, c, g, or t
ttgtcttttaagggtggtgtaattatgaaatttaacgaactaataaaagaggctcatgcgaatgcagttgagaagagggcttataggtgtcctgagtgtgacggtaaaggcatagatcaaaataaaaacatccctgaattattaatgttggttatttctaaaattggtgaggcggttaagtccttgaacgataatcaatttgctgattggaaaacttttgaaaaatctttaattgttggtgaatttatagacgaaaatatatcattcgagatgtatatcaaaaacacatttgaaaataaaattgcaaccgtatttattaggatttttgatttgtatgggtattttgggattgagatagatagttatgaaagcgaaggttttatgtcgcattgtcataaaaataaaattaatgcattgttttga

SEQ ID NO: 7788 - protein, 140 aa, Unknown
  Obtained from environmental sample
  misc_feature (1)..(140): Xaa is any amino acid
MSFKGGVIMKFNELIKEAHANAVEKRAYRCPECDGKGIDQNKNIPELLMLVISKIGEAVKSLNDNQFADWKTFEKSLIVGEFIDENISFEMYIKNTFENKIATVFIRIFDLYGYFGIEIDSYESEGFMSHCHKNKINALF

SEQ ID NO: 7789 - DNA, 717 bp, Unknown
  Obtained from environmental sample
  misc_feature (1)..(717): n is a, c, g, or t
atgcaagccaaaggaaatcaaggagacttgttaaaacgtgccttacaagatattattaccaatatccctgaagatgaaacgatctcattagtaacaaacgataacacgtacaaaaacactacgataaaagccattaaaaatgagctcctggaaattgactactcttcaaaatttataagctataatgctgctttattaacatgtaaaaagctgtttaagcaaactaattctataaaaaatattttgtttatttctgattttcaagaagaaaagtctcaatttaaaccagatattgattcgctatttagaaattttgctgtaaagttaaaacccgttagcactaaaaatatagcaattgattctgcttatatttcaaaaacaactggtaatacaatagaacttaatgttgccttaaaaaaccaaggtgattttattaataatctgcctatttcattatttaacaatgaccaattaatagcaaaaacatcagtatcgtttagcaaagatacaacagctactttttctctgccgttaaatcagcctattaacgggaaaattactattaatgatacagatttacaatatgataacagtttgtttttcaatataaacaatacgccaaaaattaatgttttaagcataaataatgcagatgactcgtttttaaaacgcatttatacaaacgatgagttttattataaatcaaccaccctttaa

SEQ ID NO: 7790 - protein, 238 aa, Unknown
  Obtained from environmental sample
  misc_feature (1)..(238): Xaa is any amino acid
MQAKGNQGDLLKRALQDIITNIPEDETISLVTNDNTYKNTTIKAIKNELLEIDYSSKFISYNAALLTCKKLFKQTNSIKNILFISDFQEEKSQFKPDIDSLFRNFAVKLKPVSTKNIAIDSAYISKTTGNTIELNVALKNQGDFINNLPISLFNNDQLIAKTSVSFSKDTTATFSLPLNQPINGKITINDTDLQYDNSLFFNINNTPKINVLSINNADDSFLKRIYTNDEFYYKSTTL

SEQ ID NO: 7791 - DNA, 594 bp, Unknown
  Obtained from environmental sample
  misc_feature (1)..(594): n is a, c, g, or t
ttggaatacaccaatggaaaactacatataccanccatatctaccgctaaatctgtcgctttaattagagaagccaaaaagaaaaaattagatgtgacttgcagtgtcgccatccataatttattttttactgatgaaattttaactgatttcaataccctttataaagtattgccaccattacgaacacaacacgatattgatgctttaattgaaggtattaaagatggcactattgatatggtaactagtgatcataatcccttggatatagagcataaaaaggtagagtttgaccacgcagcttatggaaccattggcttggaaagcgcttttggagccttacaaacactattcaccttaaagaaaaccgtagatattttaaccaaaggaaagccgagatttggtgtagagccaaccccgataaatattggaaacaaattagatattacgctatttaaccctgatacaaaatatacattttcaagtaaagacattatttctaaatctaaaaatgctatttttgaaaaccaggatttaaaaggaaaagtctacggaataatttcaaataatacgatttctttagattcataa

SEQ ID NO: 7792 - protein, 197 aa, Unknown
  Obtained from environmental sample
  misc_feature (1)..(197): Xaa is any amino acid
MEYTNGKLHIPXISTAKSVALIREAKKKKLDVTCSVAIHNLFFTDEILTDFNTLYKVLPPLRTQHDIDALIEGIKDGTIDMVTSDHNPLDIEHKKVEFDHAAYGTIGLESAFGALQTLFTLKKTVDILTKGKPRFGVEPTPINIGNKLDITLFNPDTKYTFSSKDIISKSKNAIFENQDLKGKVYGIISNNTISLDS

SEQ ID NO: 7793 - DNA, 471 bp, Unknown
  Obtained from environmental sample
  misc_feature (1)..(471): n is a, c, g, or t
ttgaaaaatatattaaaaggtaaaatcatgcttacaagccttaagataaaaaactttaagagcattaaggaagaacaattagattttaagccgttaactattttgactggtaaaaattctacaggaaaatcatcagttattcagagtatattacttgttgcaagaaactgtaatgtcgctaatgaatacataatgcaacgtcttgttagtcggttttctgactttgaaacaatccgcaacaagtatgaaaatgcaaagtctgttgaaataaatattgaaattgataatgaaataatgggatttttagcaactagggaatgtaaagtatcaaacataactcgtaacgattcattgttaaaatatgaagctaatagcagcgacaaacctgagttattttatttaaatgcaaaccgagatgggcaagaagatatcgcccaaatgtcaggtatgaaagttggggaaaccaggtga

SEQ ID NO: 7794 - protein, 156 aa, Unknown
  Obtained from environmental sample
  misc_feature (1)..(156): Xaa is any amino acid
MKNILKGKIMLTSLKIKNFKSIKEEQLDFKPLTILTGKNSTGKSSVIQSILLVARNCNVANEYIMQRLVSRFSDFETIRNKYENAKSVEINIEIDNEIMGFLATRECKVSNITRNDSLLKYEANSSDKPELFYLNANRDGQEDIAQMSGMKVGETR

SEQ ID NO: 7795 - DNA, 354 bp, Unknown
  Obtained from environmental sample
  misc_feature (1)..(354): n is a, c, g, or t
atggattttataaatagcaaaaaaactaatgatttaaatgtagaacttgaaacattgtttaataattctatgttaaatgttcatgaaattttaggtgatgaggtttttagatttaaaacaacaactaaaactaaacggccagtaaatataggcttatttgaaatgctatcttattgtttaatgaaaggtactcctaaacaaagtgaggtatcttcatttatttctgaagttaatgaaataaaaaagacaattgatagtgaaaaattatttgcaacaggcgcagacagtacaagtgttgtcgatattcgctttacttacgctgaacatttaattgaaaaatatattaaaaggtaa

SEQ ID NO: 7796 - protein, 117 aa, Unknown
  Obtained from environmental sample
  misc_feature (1)..(117): Xaa is any amino acid
MDFINSKKTNDLNVELETLFNNSMLNVHEILGDEVFRFKTTTKTKRPVNIGLFEMLSYCLMKGTPKQSEVSSFISEVNEIKKTIDSEKLFATGADSTSVVDIRFTYAEHLIEKYIKR

SEQ ID NO: 7797 - DNA, 921 bp, Unknown
  Obtained from environmental sample
  misc_feature (1)..(921): n is a, c, g, or t
atggtggaaaacccacaaagagctgaattaatagagtctattttacttggaatccctattcctttgatctatctttttgaagataaaaatggcattcgccaagttgtagatggtcgccagagaatcactgctttacagaagttttatgatggaaaatttaaatttaccaaacttaaagtattaacaaaacttaatggtaagtcttttgatgaactagatcctttctaccaaggtaaaattgaagactatcaaattaatacatatgtaattcaacctccaacacctgaaagtattaaatttaatatttttgatagagtcaatcggggtggcgtacaactaaataagcaagaaatgcgtcatgcgctatatcaaggtaaagcaactgacttattaaagttgttatcagaaaacgaaacatttaaacaagtaacagcaaatacagttagtcctaaaagaatgagagataaatatctaatcattaggctcattggtttttatctttatcaaaataaacgcttatttgttctaaaagatggtaaagaaatccaatatcaatatcgttctgatatagatgattttttaggtttagttatggattttataaataggcaaaaaactaatgatttaaatgtagaacttgaaacattgtttaataattctatgttaaatgttcatgaaattttaggtgatgaggtttttagatttaaaacaacaactaaaactaaacggccagtaaatataggcttatttgaaatgctatcttattgtttaatgaaaggtactcctaaacaaagtgaggtatcttcatttatttctgaagttaatgaaataaaaaagaccattgatagtgaaaaattatttgcacaggcgcagacagtacaagtggtgtcgatattcgctttacctacgccgaacttttaa

SEQ ID NO: 7798 - protein, 306 aa, Unknown
  Obtained from environmental sample
  misc_feature (1)..(306): Xaa is any amino acid
MVENPQRAELIESILLGIPIPLIYLFEDKNGIRQVVDGRQRITALQKFYDGKFKFTKLKVLTKLNGKSFDELDPFYQGKIEDYQINTYVIQPPTPESIKFNIFDRVNRGGVQLNKQEMRHALYQGKATDLLKLLSENETFKQVTANTVSPKRMRDKYLIIRLIGFYLYQNKRLFVLKDGKEIQYQYRSDIDDFLGLVMDFINRQKTNDLNVELETLFNNSMLNVHEILGDEVFRFKTTTKTKRPVNIGLFEMLSYCLMKGTPKQSEVSSFISEVNEIKKTIDSEKLFAQAQTVQVVSIFALPTPNF

SEQ ID NO: 7799 - DNA, 540 bp, Unknown
  Obtained from environmental sample
  misc_feature (1)..(540): n is a, c, g, or t
ttggaagtaacctccctaaaaaaactggtaaaccaaaaagcctcactcttctcaggcggacaaaaaagaagattaaacatagctataggactacttaataatccaaaaataatatactttgatgaaccaacagtagggcttgatccaaaaagtagaaatgagatacttgattcaattaaaaactataaaaagcttggaatgactgttgtttacacaagtcactatatggcggagatagaaaaaatctgtgatgaagttgccatactagaccatggaaagctaattgagcaagacagccttgaaaaccttctctcgaatcgagttacagatgctataaccatagaaatactttacaaagacgaagtcaatttactaggtttgactatcaaaaattcttcttttgtattaacaactgaagatgaactatttgcaacgctgagtttacttaagaaaaataaaattgctgtaaaacaaataagatacggctcaacaaatttagaaaaacacttcctagatgcaacaggttcaaatgatgcttag

SEQ ID NO: 7800 - protein, 179 aa, Unknown
  Obtained from environmental sample
  DOMAIN (1)...(92): ABC transporter
  misc_feature (1)..(179): Xaa is any amino acid
MEVTSLKKLVNQKASLFSGGQKRRLNIAIGLLNNPKIIYFDEPTVGLDPKSRNEILDSIKNYKKLGMTVVYTSHYMAEIEKICDEVAILDHGKLIEQDSLENLLSNRVTDAITIEILYKDEVNLLGLTIKNSSFVLTTEDELFATLSLLKKNKIAVKQIRYGSTNLEKHFLDATGSNDA

SEQ ID NO: 7801 - DNA, 417 bp, Unknown
  Obtained from environmental sample
  misc_feature (1)..(417): n is a, c, g, or t
atggatataaacaatgttccccaagatgatagctcaacatatgcaaacaacaaaaaagctatctatgcaaaagatgaagacggtgacataaaaatagtaggttcaacaggttgggacgtagaagaagctgtaacaaaacaagctcttgatgatttagaactaagtgcgcacgaagcatattgcaaagttaaaaaaggcgctaaatctccgctatattattatatgtacaaagagagaatggatttacaacttttagccgagtccacaggcttttttaagtggacaataaagcgtgattttaaacctgaagtctttgagaaaatcagcgaaaaaagattgtctatctatgctgatacattaggcaaaactatagaaaatttacaagtattggaagatataaattatgaatgcaactga

SEQ ID NO: 7802 - protein, 138 aa, Unknown
  Obtained from environmental sample
  misc_feature (1)..(138): Xaa is any amino acid
MDINNVPQDDSSTYANNKKAIYAKDEDGDIKIVGSTGWDVEEAVTKQALDDLELSAHEAYCKVKKGAKSPLYYYMYKERMDLQLLAESTGFFKWTIKRDFKPEVFEKISEKRLSIYADTLGKTIENLQVLEDINYECN

SEQ ID NO: 7803 - DNA, 855 bp, Unknown
  Obtained from environmental sample
  misc_feature (1)..(855): n is a, c, g, or t
gtgatcctacagggatacctgctaagcgtttttttaaaattaaaccctgctcctgccttagagtggctaaatgctttatcatcaatagaattaaagagagaggacttatcaagatttggagttttcgataagagttttagcgaagatttgaaatttaatttatttaaccgacctgcaaaaagttctctttctcctagcatggctttgtctcggcattcttatgttgaaactaagtgggatgaagtaatgctacatttaggaaactggttatcacgtcatcttaataatcccgatttagttgtttttatcttaaggcacggtggaatcttaaatagtcaatttagatggaaaattaatgcggatattgaagagcaaaaagaaaaaataaaaaaaggcgataacgcatactttgaacaattaaaatgttttagtcctgatgcagtagtctctgatgaaatgttgattgtttggtctcttgttctagcaggttattgtgagcagtccaataatacagtagacctatattcttgggctgataaatataaaaacagtgggataacagcggcacttaaaaaagaaatccgaagtattttatcgcctaaaattcaatttaaaaagccatataattattcttcaattgagcctaggaaagggcttaaaagtatgttggattgggacataaacctatcaacatcatttgttcactcttctatggaggagctaaataaaatacctcagtggaaaagtgatattggtggattagttctagagtttagtgcgctattgaaagaaactatggacataatggctgaattaaatgaggtcgaggagttcagcgatatccctcacccataa

SEQ ID NO: 7804 - protein, 284 aa, Unknown
  Obtained from environmental sample
  misc_feature (1)..(284): Xaa is any amino acid
MILQGYLLSVFLKLNPAPALEWLNALSSIELKREDLSRFGVFDKSFSEDLKFNLFNRPAKSSLSPSMALSRHSYVETKWDEVMLHLGNWLSRHLNNPDLVVFILRHGGILNSQFRWKINADIEEQKEKIKKGDNAYFEQLKCFSPDAVVSDEMLIVWSLVLAGYCEQSNNTVDLYSWADKYKNSGITAALKKEIRSILSPKIQFKKPYNYSSIEPRKGLKSMLDWDINLSTSFVHSSMEELNKIPQWKSDIGGLVLEFSALLKETMDIMAELNEVEEFSDIPHP

SEQ ID NO: 7805 - DNA, 939 bp, Unknown
  Obtained from environmental sample
  misc_feature (1)..(939): n is a, c, g, or t
ttgatggctgggcgattcaaaaacttattaagggaaaaaatagatgagatcattaatgtttcaggatcagagaaagtacaagaagagctagtgggactaaaacgcggcaaggtggatgttattggatatcatggagccaagtttttgtggaggctgattgaggaccacagtcagataagcgacaaattgcgtgaaaatgaagaaaaatataagaagatgtttgaactctctccgggagctattgttcttttagacgaaaaagggaatgttaaagatgtaaatggtagagtcttcgattggcttgggtatcgaagaaatgaaattattggcaagaacgcaactaagatgccatttttctcgtccgaagtaagaaagttggttgagagaaactttcagaacaggatcaaaggaaagaagatccttccatatcagatggaatacatggcgaagaacggaagaaaaatgataggtgaaatacaagccacacttaccaaggataccagcgggaaagtgacaggagcgctagttgttatccatgatacgactatacaaaaagaatctgaagatataataaagaaaagcgaagagaaatatagaactttttatggagtttcaagtgatgcaattatgacgcttgttccttttggtgaattcctggaatgtaatgacgcaacactcaaattatttggatgcaggaagcagagtgagtttgtagcacagacccctgcacgattttctcccaggtatcagcccgatgggaagctttcgtctgttcagtccaaagaatatatgcagaaagctatggaggaaggatcccagctatttgaatggactcataagaaaaagaacggaaaagaattcccggccacggttttgttaacgaggatgaagatacccggtaaagaggtgctacgggccaccggtaagagatgtacctaa

SEQ ID NO: 7806 - protein, 312 aa, Unknown
  Obtained from environmental sample
  DOMAIN (68)...(128): PAS domain
  misc_feature (1)..(312): Xaa is any amino acid
MMAGRFKNLLREKIDEIINVSGSEKVQEELVGLKRGKVDVIGYHGAKFLWRLIEDHSQISDKLRENEEKYKKMFELSPGAIVLLDEKGNVKDVNGRVFDWLGYRRNEIIGKNATKMPFFSSEVRKLVERNFQNRIKGKKILPYQMEYMAKNGRKMIGEIQATLTKDTSGKVTGALVVIHDTTIQKESEDIIKKSEEKYRTFYGVSSDAIMTLVPFGEFLECNDATLKLFGCRKQSEFVAQTPARFSPRYQPDGKLSSVQSKEYMQKAMEEGSQLFEWTHKKKNGKEFPATVLLTRMKIPGKEVLRATGKRCT

SEQ ID NO: 7807 - DNA, 726 bp, Unknown
  Obtained from environmental sample
  misc_feature (1)..(726): n is a, c, g, or t
gtgaattctcaaaacgaaattgataaatatattcttaatcacattgaggctgaagatgaggttttaaatgaactcgatcgcgaaacaaatctcaaggtattgggtggacgaatgatttcaggtcatttgcaagggcaggttttaaccatgctttcaaaaatgattcagccacgaaccatcctggaaattggaacttttaccggttactctgcaatctgcctttcaaagggacttcaaaaaaacggcaagctaattaccatcgaaattgatgatgaattagaatctatcgcctcgaaatatttcgaaaaagcaggggtaaaagaatatatagaacaacgaattggttccgccatagaaataattccttcgctgaacgagtcattcgatttggtatttattgatgcggataaacgcgaatacaccgaatactatgaattggttttcgagaaagtaccaagcggtggttacattattgcagacaatactttatggagtggaaaagttttgaatgtaccggccccagacgataattacacgaaaagtattatcgaatttaataccttagttaaaaacgataatcgcattgaaaaagtaattttccctttgcgcgacggaatgactgttatcccggaaaaagtaattttcaaattttcacaaggtgaatatccccgaactaaaatatgtgggcatttttattggctaatcgttatcattaaatattttgaa

SEQ ID NO: 7808 - protein, 242 aa, Unknown
  Obtained from environmental sample
  DOMAIN (12)...(212): O-methyltransferase
  misc_feature (1)..(242): Xaa is any amino acid
MNSQNEIDKYILNHIEAEDEVLNELDRETNLKVLGGRMISGHLQGQVLTMLSKMIQPRTILEIGTFTGYSAICLSKGLQKNGKLITIEIDDELESIASKYFEKAGVKEYIEQRIGSAIEIIPSLNESFDLVFIDADKREYTEYYELVFEKVPSGGYIIADNTLWSGKVLNVPAPDDNYTKSIIEFNTLVKNDNRIEKVIFPLRDGMTVIPEKVIFKFSQGEYPRTKICGHFYWLIVIIKYFE

SEQ ID NO: 7809 - DNA, 315 bp, Unknown
  Obtained from environmental sample
  misc_feature (1)..(315): n is a, c, g, or t
atgatctcgactttcgatcatgatactatatttaaagaagtagcggttctttatgcctttaaagagttaaacattcaagttagcgaattacccgaacaaagaattgaagagataaaaagacttctaaacttaaggggtgatgatatacgtgatcaattattaatacacaacatattaccatacagcgacgataaattaagagataaaattgtgcttggggctactgatccaacagataaagccattgcgaaaatcacccatagtcttaatattaccaagtttgaaataaatttcctacagaaagaaagaatatga

SEQ ID NO: 7810 - protein, 104 aa, Unknown
  Obtained from environmental sample
  misc_feature (1)..(104): Xaa is any amino acid
MISTFDHDTIFKEVAVLYAFKELNIQVSELPEQRIEEIKRLLNLRGDDIRDQLLIHNILPYSDDKLRDKIVLGATDPTDKAIAKITHSLNITKFEINFLQKERI

SEQ ID NO: 7811 - DNA, 654 bp, Unknown
  Obtained from environmental sample
  misc_feature (1)..(654): n is a, c, g, or t
atgagttttatcgaagctcagaaaagcgcaatcaaaaacccttctgattctacttttggagaactaaaaattttagaaaaaaaactcaaacttgactacntgattgaggacaccacagatttaattgatgaatcacttgatggctctgaaagggttcaaacaattgttaagaatctaaaaacgttttcccgaattgatcagaatgagctgcaaagtattgatcttaataattgcattgatgacaccatcaatattatttggaatgaactaaaatataaagtcagcctagaaaaaaactatggggagttaccatttataacttgtctaccccagcaactcggtcaagtcttcatgaatttgatgattaatgcatcccatgcaatagacaccaaagggattattgagatttgcagttgggcagataaagacaaagtatacgcttcagtatctgatgatgggggcggcatttcaaaagagaatttagcgagaatatttgaacccttttttacaactaaagatgttggaaaaggaacagggcttggtttgagtatggtctacgatattatcaaggggcatcaaggtgagattaccgttgaatctgagcttgaaacaggaacaacttttaccatcgcattgcccataaatagaaaatag

SEQ ID NO: 7812 - protein, 217 aa, Unknown
  Obtained from environmental sample
  DOMAIN (108)...(215): Histidine kinase-, DNA gyrase B-, and HSP90-like ATPase
  misc_feature (1)..(217): Xaa is any amino acid
MSFIEAQKSAIKNPSDSTFGELKILEKKLKLDYXIEDTTDLIDESLDGSERVQTIVKNLKTFSRIDQNELQSIDLNNCIDDTINIIWNELKYKVSLEKNYGELPFITCLPQQLGQVFMNLMINASHAIDTKGIIEICSWADKDKVYASVSDDGGGISKENLARIFEPFFTTKDVGKGTGLGLSMVYDIIKGHQGEITVESELETGTTFTIALPINRK

SEQ ID NO: 7813 - DNA, 840 bp, Unknown
  Obtained from environmental sample
  misc_feature (1)..(840): n is a, c, g, or t
ttgctttcttgggcccccggaggaaaatttctttttaaaatacaaccggatttgatgactaaattgctcaacgttttgccaggtatagacgccagttttgaaagaaaaccaggatcaattggccctggatgcagcatgtcctttaggagaatgtatcactttattgcaactaaacatgagcctcaaagagaactgacccttgatctgtataactcagatagaattcaaggtatttcaaaagctctcaacctccatgcaaacgatgtatatgaaacattagaaacggatgaaaagaaaaaaatagctgaaatcattttccgcagacttacccttaaaaccgttgaaaatgactatgtccgtgatcgagcaaccattgagaacttaacgcaattatgcattgaaagcaggtcaacccacatattcaataacatcgaaaaagaccagatagaggtgctggtcaaggaagtggcagatgaattcagaaaacaggaaaactgctttatttatccatcatcagacaagcagaaaattcttgattcagacagcaccttaaacattacccatgaaagtctgattcgctgctggaataaatgccgtcagtgggcagacaaagaagcaaaggaagctgagctttttcaagaaatccataagcatgcacaagggtcacaaaaaggtgatccctatgccgctggcaatcttctgaagcgatatgtaatctggtgcaatgaaccgtatcattcaaaagtctgggccgaacggtattatacaacttcaacagctaaataccagaacattggccaacccaaacatatgagttccaacaaacccgagccgatctga

SEQ ID NO: 7814 - protein, 279 aa, Unknown
  Obtained from environmental sample
  misc_feature (1)..(279): Xaa is any amino acid
MLSWAPGGKFLFKIQPDLMTKLLNVLPGIDASFERKPGSIGPGCSMSFRRMYHFIATKHEPQRELTLDLYNSDRIQGISKALNLHANDVYETLETDEKKKIAEIIFRRLTLKTVENDYVRDRATIENLTQLCIESRSTHIFNNIEKDQIEVLVKEVADEFRKQENCFIYPSSDKQKILDSDSTLNITHESLIRCWNKCRQWADKEAKEAELFQEIHKHAQGSQKGDPYAAGNLLKRYVIWCNEPYHSKVWAERYYTTSTAKYQNIGQPKHMSSNKPEPI

SEQ ID NO: 7815 - DNA, 852 bp, Unknown
  Obtained from environmental sample
  misc_feature (1)..(852): n is a, c, g, or t
ttggtggatgcggcgaggtcactaaaagtcggctctatttgggatttcaaaaaccgtataggtccttttataaatagcccttctggtattcttgaaaaagcactcagttacctagatgatggagaagagtggctaattgaaccatgttttacagatcatgaaaatccatacatgttaaaaccctccataagatggggaacaaaaagaggggacttttgtcacctaaatgagctatttggtcctgttcttagtgttatgtgtgctgaagatatttatgacgcgatagatattgtaaattcaactggatatggactaacttctggattagagagtttagatctgagagagcaaaatatttttaaagatagactgaaagcaggaaatctatatataaatcgtgtgacaactggggctattgtgataagacaaccttttgggggcatgggtaaatcggcgataggaagcggtaaaaaagccggtgggtttaattatgtctctcaatttttagatataagttttagtgctaacaagttaaaagagagttctgatcataaatatgtaaaaagattagaaaagcttttagaagatgaaaataaatattcacatatcataaaagagtctatacaaacagttaaaaattttgcatattggctggaaaaagagttctttaaagagtttgactatgcagatatccgcggagagagcaacattataaaatatcttagtattgaaaaaatgctctttagaattgaagaaaaagactctctttatgagattctatgcacaattatttcggctaaaatgtcaggctcatctttgcatatatcgataccaaaaaagttaattcactga

SEQ ID NO: 7816 - protein, 283 aa, Unknown
  Obtained from environmental sample
  misc_feature (1)..(283): Xaa is any amino acid
MVDAARSLKVGSIWDFKNRIGPFINSPSGILEKALSYLDDGEEWLIEPCFTDHENPYMLKPSIRWGTKRGDFCHLNELFGPVLSVMCAEDIYDAIDIVNSTGYGLTSGLESLDLREQNIFKDRLKAGNLYINRVTTGAIVIRQPFGGMGKSAIGSGKKAGGFNYVSQFLDISFSANKLKESSDHKYVKRLEKLLEDENKYSHIIKESIQTVKNFAYWLEKEFFKEFDYADIRGESNIIKYLSIEKMLFRIEEKDSLYEILCTIISAKMSGSSLHISIPKKLIH

SEQ ID NO: 7817 - DNA, 429 bp, Unknown
  Obtained from environmental sample
  misc_feature (1)..(429): n is a, c, g, or t
atgactaaaggattttggattgatcatttaataaatctgttttatcccagaatatgcctttcttgcggagaagcgcttaaagaacaggaagaaacactctgtatttcatgtatgttgagattacccaaaacaggttttcatatgcatgaggaaaatcctgtttcaagaatattttggggaagagtaaatatttatgcagccacttcttttttattttttagcaaaaagggaaaggttcaaagtttgattcatcatttaaaatataagcgacaaaaagaagtaggtattgtactgggaaggctttttggtcatgaactcctcaatagtccattgtttgcagatatcgactttattataccagtacccttgcatccaaaaaaattacgacaaagaggatataatcagagtatgatgattgcaatggggtga

SEQ ID NO: 7818 - protein, 142 aa, Unknown
  Obtained from environmental sample
  misc_feature (1)..(142): Xaa is any amino acid
MTKGFWIDHLINLFYPRICLSCGEALKEQEETLCISCMLRLPKTGFHMHEENPVSRIFWGRVNIYAATSFLFFSKKGKVQSLIHHLKYKRQKEVGIVLGRLFGHELLNSPLFADIDFIIPVPLHPKKLRQRGYNQSMMIAMG

SEQ ID NO: 7819 - DNA, 864 bp, Unknown
  Obtained from environmental sample
  misc_feature (1)..(864): n is a, c, g, or t
atgattgctgaagtagatgagatggcaagaggagatggaaaagttataccgtctcacaaaatacaaaaagttcaaaacttagatggtggtcttatatctgaaattcttgttaaaagtggagaacatgttgtaaaagaacaaccattaatgaaaatagatacgactagatttcaagcatccctagaagaagcaaaagagcaacgggttgctttgattgcaaagcaatctagattaaatacacaactagattttaatccatcaaaagagaaacctaaaattgattttccaaaagaattagatggtgttaaaaaatacactacaatagaaacacaaatctataataacaatattgatgaatatagaagttcattaaaaattttagaactacaatttgaacaaaaagtacaagaaaaaaaagagatagaatcaaaagtaaatcaactgaaaaaaagtgttagtcttgtaaaacaacaattacaaacaatcgaaagaatggtaaaatcaggttcaaaatctaaaattgatctccttaatttacaaaaagaatataatacacttgagggagacttaaactctgctgtactctcattacctagatcaaaattagctatctctgaagcagaaaataaaattcttgaaaaagtgaaaggctttagatcgaacagttataaagagtatcaagaggtcacttctgaacttaataaaattgatgcaagattagtttctgaaacagacaaattagaaaaaactattattcgctcacccgttaatgggatcataaaacagatcaatattaatactattgggggagttgtaaaatctggtgttgatttaatagagatagaccagactgagccattctga

SEQ ID NO: 7820 - protein, 287 aa, Unknown
  Obtained from environmental sample
  misc_feature (1)..(287): Xaa is any amino acid
MIAEVDEMARGDGKVIPSHKIQKVQNLDGGLISEILVKSGEHVVKEQPLMKIDTTRFQASLEEAKEQRVALIAKQSRLNTQLDFNPSKEKPKIDFPKELDGVKKYTTIETQIYNNNIDEYRSSLKILELQFEQKVQEKKEIESKVNQLKKSVSLVKQQLQTIERMVKSGSKSKIDLLNLQKEYNTLEGDLNSAVLSLPRSKLAISEAENKILEKVKGFRSNSYKEYQEVTSELNKIDARLVSETDKLEKTIIRSPVNGIIKQININTIGGVVKSGVDLIEIDQTEPF

SEQ ID NO: 7821 - DNA, 351 bp, Unknown
  Obtained from environmental sample
  misc_feature (1)..(351): n is a, c, g, or t
ttgtatgatagccctacaggtaagcccatcgctgaaaactcggccaatatgtacctgcttggccaaaaagctgaaaccatcaacgcgctcaaaaaagaaggccgcttgccactaggtgaaggcggctatgaatacctgaaaacggttcataccgtcactggtgtctattccgaaattttctttattaccgaaatgggcaccgggattggccgcctcatcgtcgatccgtttcacaagctgttgtactcgtcccgtgcagaagatgtaaacgcgattaaacagttaacgcgcaaaggcctttctgttgctgatgccatctctcagttgttgaaggagcgaggctatgaataa

SEQ ID NO: 7822 - protein, 116 aa, Unknown
  Obtained from environmental sample
  misc_feature (1)..(116): Xaa is any amino acid
MYDSPTGKPIAENSANMYLLGQKAETINALKKEGRLPLGEGGYEYLKTVHTVTGVYSEIFFITEMGTGIGRLIVDPFHKLLYSSRAEDVNAIKQLTRKGLSVADAISQLLKERGYE

SEQ ID NO: 7823 - DNA, 825 bp, Unknown
  Obtained from environmental sample
  misc_feature (1)..(825): n is a, c, g, or t
atgaataagtatactgtttacgcattaaaaatacctaataaatttttatttgccgatgaaaaagttcctttggatcgatgggatataaaagaatcattggacagagaactgcttgtaaatacctattggcaatctcaaaccttattgtttcttaaacgagctaatcgttatttccctatcatcgtacctatcttaaaagaggaaggtgtcccagatgattttaaatatttagctttaattgaaagtggcttaataacaacaattgtttcaccagcaggtgctgtcgggttttggcaatttatgccacctactgcccgcgactacaagcttgaaatcaacaaagaagttgatgaacgttacaatattgaaaaatcgacccgagcagcctgtaagtatttgaaagattcctataagaaatttggaagctgggcattggttgcggcctcatataatgcaggcagaacacacattcattctcaaatgaaacttcaaaatgcaggatcgtattatgaccttttgttgggtgatgaaacagctcgttatctgttcagaattattgcgaccaaacttataatggagaatcctcaagattttgggtttagattccgtgactccgatttatatcccaacattccaactcgtaagattaaaattaaaggtggggtgaagaattttgctgattttgcccaacagaatggggtgaattataaaatactaaaactctttaatccttggttaagaaagccatatctaacaaataagtataaaaaagagtacgaaattacacttcctgcccaaggatatattaattttgcgttttctgaa

SEQ ID NO: 7824 - protein, 275 aa, Unknown
  Obtained from environmental sample
  DOMAIN (58)...(173): Transglycosylase SLT domain
  misc_feature (1)..(275): Xaa is any amino acid
MNKYTVYALKIPNKFLFADEKVPLDRWDIKESLDRELLVNTYWQSQTLLFLKRANRYFPIIVPILKEEGVPDDFKYLALIESGLITTIVSPAGAVGFWQFMPPTARDYKLEINKEVDERYNIEKSTRAACKYLKDSYKKFGSWALVAASYNAGRTHIHSQMKLQNAGSYYDLLLGDETARYLFRIIATKLIMENPQDFGFRFRDSDLYPNIPTRKIKIKGGVKNFADFAQQNGVNYKILKLFNPWLRKPYLTNKYKKEYEITLPAQGYINFAFSE

SEQ ID NO: 7825 - DNA, 435 bp, Unknown
  Obtained from environmental sample
  misc_feature (1)..(435): n is a, c, g, or t
ttgagcttaaattctgcacatgatggttatacttaccaagatctattaatcagttactatatattaaaagatatattagatggcaataaagaatcaatatattcaattgataaaaagtatacgattggtaaatatctttctattgaaaaagataaaaatggaaactttaaagaaaaaagtattcctgatagatttgatgattttgttataaaaaaagaatccaatattgaaagaaagcaaataaagtatagtaatgaagaaaataatagaaaattaatcaaaaatgattttgcaaatgatagcaaaagattagcattatatgaattatatagaagttggagtgaattaaaagataatacaaaagaatttcgactatgtttagcatggaataatccagttgatgaagatattgcgtctatattaaaaaaaggttga

SEQ ID NO: 7826 - protein, 144 aa, Unknown
  Obtained from environmental sample
  misc_feature (1)..(144): Xaa is any amino acid
MSLNSAHDGYTYQDLLISYYILKDILDGNKESIYSIDKKYTIGKYLSIEKDKNGNFKEKSIPDRFDDFVIKKESNIERKQIKYSNEENNRKLIKNDFANDSKRLALYELYRSWSELKDNTKEFRLCLAWNNPVDEDIASILKKG

SEQ ID NO: 7827 - DNA, 420 bp, Unknown
  Obtained from environmental sample
  misc_feature (1)..(420): n is a, c, g, or t
atggatctggctgtccgagatggcattttcccgctgatcacaaattccaatatcaatgcctcagaagttctaaaggcttacaaaaaccaaccctatttggaaaaaaggatgtacacggccaagtcaatccttaatatcgcccctgtttttcttaaaaagccaaaacgtattgaggctatgacttttctttattttattgctctgatgatcgtcagcctcatggaacgtaatatcagaaaaaatatggttcaggaaaaaattgaaaagctaccgatattgcccaacggaatgaaaaccagcaaaccgacctggaacaatatcaaatatttttggtacaatattcatcttaccctcgttgaagaacaggggcgcgtcattccaacaaccataaaggcgttacaaaattacacaaaactgtaa

SEQ ID NO: 7828 - protein, 139 aa, Unknown
  Obtained from environmental sample
  misc_feature (1)..(139): Xaa is any amino acid
MDLAVRDGIFPLITNSNINASEVLKAYKNQPYLEKRMYTAKSILNIAPVFLKKPKRIEAMTFLYFIALMIVSLMERNIRKNMVQEKIEKLPILPNGMKTSKPTWNNIKYFWYNIHLTLVEEQGRVIPTTIKALQNYTKL

SEQ ID NO: 7829 - DNA, 720 bp, Unknown
  Obtained from environmental sample
  misc_feature (1)..(720): n is a, c, g, or t
ttgatactggaagaggtccgtcagcggcaggtagatctggtttttgccatggggtctttatcggttgatttcatgtataataactttaaaaatcaaaccattccagtggtgacaatctgtgccaaagatcctgtaatgatgaaatatatttcagattattccatgaaaagcgggaccaactttgcctttacctccataaatatccccgtcaagctgcaaatggtttatttcaaagagttgctaccggatttgaaaaatattggaattatgtatgccaggaacaataccagcgctgtaatgacccaggccctccctcttaaagaatatgcaaagcgtattggcgtcaaggtcttcgatgttgtggtagaggatcagaaaaatgccgtatcggaacttggactcaaggtgagccgtgccgtggaagagatgagaaaaaatgattctgacctgaaaaatagtatcttctgggtgacgggtagtacctcggtattcagtaattttggtattatcaatcaacatgccggttcgattcccgtaatcggagcctcgcccagtatggtgaagggtaaagatattccaggggcagtgatggcaataggggtagggtttgaaaataatgcccagcttgcatctatctatgctgaaaaaatacttaacggaaaaaagaagcccggggaatttgaggtaggggttattaaacccgccagatattgcctttaa

SEQ ID NO: 7830 - protein, 239 aa, Unknown
  Obtained from environmental sample
  misc_feature (1)..(239): Xaa is any amino acid
MILEEVRQRQVDLVFAMGSLSVDFMYNNFKNQTIPVVTICAKDPVMMKYISDYSMKSGTNFAFTSINIPVKLQMVYFKELLPDLKNIGIMYARNNTSAVMTQALPLKEYAKRIGVKVFDVVVEDQKNAVSELGLKVSRAVEEMRKNDSDLKNSIFWVTGSTSVFSNFGIINQHAGSIPVIGASPSMVKGKDIPGAVMAIGVGFENNAQLASIYAEKILNGKKKPGEFEVGVIKPARYCL

SEQ ID NO: 7831 - DNA, 819 bp, Unknown
  Obtained from environmental sample
  misc_feature (1)..(819): n is a, c, g, or t
atgaaagtcagcgccgacggtgttcgtattgggatgttgttcagttcgcctgctggaaatgatttattgtttgacgaaagttcatgtgagcaaggaagaaattttagcaataagatttggaatgctttccgattggtaaaaggatgggaagtagcagatatagatcaaccggaaagctctaaaaaagccattgagtggttcgaccataaattgaatgagacattaataacgattgaagatcattacgggaaatttcgaatgtctgatgcattaatgtcgacttataaattagtttgggacgagttctgttcatggtatttagagatgattaagccggcctatcagcagccaatcgatagagtgacttttgatgctacgataatgaatttcgagagaatccttaaagtgattcatccatttatgccatttatttcagaggaattgtggcacctaattgctgatcgtgaagaaaaggattgtttgatagtagcacagtggccaaccattggaacacctgatgaaaagttgttggctgactttgattacaccaaagagattgtttctgcaataagaaactttagaaaatcgaaaaacataccaaataaagatgccattcaactaaaggtaaaattgaatgatgcctataataagtcgtttgattccgtattgacgaacttgggtaatattgaagagttggagttcgttactgataaagtggatgaagccatgtcaatcgtaatcggaaaaaatgaattctttattcctgtttcaggggcgattgatgtagaagctgaaaaggaaaaattcagaaagacctag

SEQ ID NO: 7832 - protein, 272 aa, Unknown
  Obtained from environmental sample
  misc_feature (1)..(272): Xaa is any amino acid
MKVSADGVRIGMLFSSPAGNDLLFDESSCEQGRNFSNKIWNAFRLVKGWEVADIDQPESSKKAIEWFDHKLNETLITIEDHYGKFRMSDALMSTYKLVWDEFCSWYLEMIKPAYQQPIDRVTFDATIMNFERILKVIHPFMPFISEELWHLIADREEKDCLIVAQWPTIGTPDEKLLADFDYTKEIVSAIRNFRKSKNIPNKDAIQLKVKLNDAYNKSFDSVLTNLGNIEELEFVTDKVDEAMSIVIGKNEFFIPVSGAIDVEAEKEKFRKT

SEQ ID NO: 7833 - DNA, 348 bp, Unknown
  Obtained from environmental sample
  misc_feature (1)..(348): n is a, c, g, or t
atgtttttaaagaaaatagtagtaacgatatttatagttggtttttttgtaaatggttgtgcatctaagctaaatgatacggagacacttcataataaagcagctgagttgaagaacttaactatgaaagtaaaaggggcaatactacgtaaggtcccagatgaacaaatctatacttatttggaagatagatatcctaaagagcttcaagaattttctgaatactcattacatataaaaaatgtaaatgggtttgcagtagtgcttatttgtgataaagaacaaacaaaagctttagtcgaggatatttcatgtaccggtgcagttgaaggtggtgaggctttttaa

SEQ ID NO: 7834 - protein, 115 aa, Unknown
  Obtained from environmental sample
  misc_feature (1)..(115): Xaa is any amino acid
MFLKKIVVTIFIVGFFVNGCASKLNDTETLHNKAAELKNLTMKVKGAILRKVPDEQIYTYLEDRYPKELQEFSEYSLHIKNVNGFAVVLICDKEQTKALVEDISCTGAVEGGEAF

SEQ ID NO: 7835 - DNA, 645 bp, Unknown
  Obtained from environmental sample
  misc_feature (1)..(645): n is a, c, g, or t
gtgagaataatttttttagtactaatcagtttctctttatatgcaaataatattctaacaaattacagaattaacggcataaatgacattgaaaaacaaatggatttagaactaacaaagattgattactggaatgaatatattaaacaagtagatacaacatttggttacctagaatcttatccaaatgttttaacatgcaataaagaaaaatcaacactaaacctttacataaaagattcaaacaacacttatggatttaaaaaagaatatagtgccttcactggaaagataaaaggagacaaggtcaaagaaggagatcttaagactccaacaggcgtatataaaataactaaaaaactatcaaaagaaaacaatctagactcattttacggtccattggcctttgttacctcataccctaatgcttacgataaatatagagggaaaaatggacatggaatctggatacatggtcttcctactgagcnaacaagagatgaattcacaaaaggctgtattgctattgancacacaaatatagaatgcttagacaaaaacataaatatagatgctactcttcctactctagatagcaaaggagtaagaaaagatatctcaaaagaagtttttgcatctttactg

SEQ ID NO: 7836 - protein, 215 aa, Unknown
  Obtained from environmental sample
  SIGNAL (1)...(15)
  DOMAIN (48)...(212): Bacterial protein of unknown function (DUF949)
  misc_feature (1)..(215): Xaa is any amino acid
MRIIFLVLISFSLYANNILTNYRINGINDIEKQMDLELTKIDYWNEYIKQVDTTFGYLESYPNVLTCNKEKSTLNLYIKDSNNTYGFKKEYSAFTGKIKGDKVKEGDLKTPTGVYKITKKLSKENNLDSFYGPLAFVTSYPNAYDKYRGKNGHGIWIHGLPTEXTRDEFTKGCIAIXHTNIECLDKNINIDATLPTLDSKGVRKDISKEVFASLL

SEQ ID NO: 7837 - DNA, 507 bp, Unknown
  Obtained from environmental sample
  misc_feature (1)..(507): n is a, c, g, or t
atgcataaaattaaactcaatccttttttaattctttttttattttttggtgtaactatttatgcttcttctagtgtacaacttataaaaaaagaaaataaggactccaataccacactgctagtaataggtggaattcatggaaatgaacctggtggttattttgctgcatctcttctagctacacactacaaaatcaattctaaaaacctttggatagtaccaaatttaaataaatccagtatccagtccgataaaagaggtataaacggagatatgaatagaaaattctctgttattgataaaaaggacaaagacactaaaactattcaagatataaaaaaaataatactatcaaaacaagtatcattagttttaaatttacatgatggcaatggcttttacagaaaagaacatcaaggtaatatattcaatcctaactcttggggacaaacctgtgttatagaccaatgtaaactgaaacaagatcagccattggtaatttaa

SEQ ID NO: 7838 - protein, 168 aa, Unknown
  Obtained from environmental sample
  misc_feature (1)..(168): Xaa is any amino acid
MHKIKLNPFLILFLFFGVTIYASSSVQLIKKENKDSNTTLLVIGGIHGNEPGGYFAASLLATHYKINSKNLWIVPNLNKSSIQSDKRGINGDMNRKFSVIDKKDKDTKTIQDIKKIILSKQVSLVLNLHDGNGFYRKEHQGNIFNPNSWGQTCVIDQCKLKQDQPLVI

SEQ ID NO: 7839 - DNA, 885 bp, Unknown
  Obtained from environmental sample
  misc_feature (1)..(885): n is a, c, g, or t
ttggcgatatcaattttaaaaattcgagtttataaacaagcaggtgcctattatgatagcacgatgactaatttaaagcttaactcgaaaccatatcgcattattaaacgaaaacgagacaaccttgaagatgtaatttattacgaagagatagctcaagttaacgatagtattttacgattggcacatttaccagacgacaaaagaattatcttttttgactctattattgacaaacttaaaaccaaagccgaagaagaaaaagaaaagcaagaagtagcagaacgtaacaatggtttaaaaaccgttaataataacatatctggtataaacgcctcaccttcacgtggtggtttaccaatgcaagccgctacattttatttttacaatccaacaacggttgcttttggaaaaaatgaatttataaaaacctggggcaatagacctttagaagataattggagatggtctagcaaaggaaaatcaaataataacacaactattttaaataacgaagtgttagctgatgcaactcaagatgagttgtttgaccctcaatattatatttctaaaatcccttcagacacaaaagcaattgatagtatatccaaagaacgtaattatgcatactaccaattaggattaatttacaaagaaaagtttaaggaatttgaattggctaaaagcaaatttgaagcagtgcttgacagcaatccagaagaacgactcgttctaccttcaaaatacaatttatataaaatttatacgcagttaggacaaacagacgaagcatctatagcaaaaaatgatattatttctagcttccccaattctagaaatgcaaccatcctaaaaaaatccggaagtagcaacacaaaaagatga

SEQ ID NO: 7840 - protein, 294 aa, Unknown
  Obtained from environmental sample
  misc_feature (1)..(294): Xaa is any amino acid
MAISILKIRVYKQAGAYYDSTMTNLKLNSKPYRIIKRKRDNLEDVIYYEEIAQVNDSILRLAHLPDDKRIIFFDSIIDKLKTKAEEEKEKQEVAERNNGLKTVNNNISGINASPSRGGLPMQAATFYFYNPTTVAFGKNEFIKTWGNRPLEDNWRWSSKGKSNNNTTILNNEVLADATQDELFDPQYYISKIPSDTKAIDSISKERNYAYYQLGLIYKEKFKEFELAKSKFEAVLDSNPEERLVLPSKYNLYKIYTQLGQTDEASIAKNDIISSFPNSRNATILKKSGSSNTKR

SEQ ID NO: 7841 - DNA, 693 bp, Unknown
  Obtained from environmental sample
  misc_feature (1)..(693): n is a, c, g, or t
atgctctacagaagcatcctgcataactcggaagatttttcttctttccctatcactcaaccctataagggtatatcatctgatgatctgcctgataaattcactatatctgtcccaggctatgttgaccctaaaagaagagattacgaactagtttatagagttttcaagcagattagagatataacaaagaagaaaatcaggttgaaattattaggtatgccaataaaaaagaaggggattagagttttaaataagattaggcaattggcaaatgaaaatttagaaatagaaacatttgagaaaagacttaaccatgaagaatattataaggaaatgactacttctcatattcttctctctcctatgagtataaacacgaaagtactattttttaaagcagtatatggtcagacaaaggtctccggcattgaagatgatattgtaagatttcaaaaatcagtgattcttccagaaaattatcatcattcacaacatgtgaagcaacttgttcttaagtacaagaatgaatcagagctttgtgaattgttgttaaaactaattaataatgaaattggaattttatatccggaagaaattctgaaattgttttttgataatgaacactattctttggaatgggcaataaataattttaaaaaaatagtccctcaatataattatgttaaataa

SEQ ID NO: 7842 - protein, 230 aa, Unknown
  Obtained from environmental sample
  misc_feature (1)..(230): Xaa is any amino acid
MLYRSILHNSEDFSSFPITQPYKGISSDDLPDKFTISVPGYVDPKRRDYELVYRVFKQIRDITKKKIRLKLLGMPIKKKGIRVLNKIRQLANENLEIETFEKRLNHEEYYKEMTTSHILLSPMSINTKVLFFKAVYGQTKVSGIEDDIVRFQKSVILPENYHHSQHVKQLVLKYKNESELCELLLKLINNEIGILYPEEILKLFFDNEHYSLEWAINNFKKIVPQYNYVK

SEQ ID NO: 7843 - DNA, 852 bp, Unknown
  Obtained from environmental sample
  misc_feature (1)..(852): n is a, c, g, or t
ttgaacaaaagtgaaaaacttaagagacatattgtacggttgttcaatcaaagaagtgttgggaaaacagatgtggaaattaaaaatattgtgtttgattctcgtaatgtagaagagggggatgtttttgttgcaatcaaaggagcagcagttgatgggcatgcgtttattgatagtgcaatcaaaagtggtgcgactgtaatcgtttgtgaatcaaaaccagataaggttgaaggtggaatcaattatattgttgttgaggatgcgcatttcgcactttctgttatggccaataattattatgaccagccaggtaagaaattggagcttattggaattacaggaacaaacggtaagacaacaactacaacgcttttatttcagcttttcagagaaatgggaagttctgttggattgatttctacggtagtaaaccgaattaacgacgaagagattccaaccgaacgcacgacaccagatccagtaagtttaaacgcacttcttcagcagatggttgatgcgggttgtgattactgctttatggaggtgagttctcatgcgattcaccagaaaagaattgggaagctttacttctcaggaggagcatttacgaacatcaccaatgagcaccttgattatcacaaatcatttaaggagtatttaaacgttaaaaaggaattctttgacggactttcaaaagaggcttttgcagtaacgaatgtggatgataaaaacggtgaagtgatgcttcaaaattgtgatgctagaaaaatcacttatggtttgaaaaacatcgccgattataaggcgaaagtacttgagaataattctcagtctcctcagccaatctga

SEQ ID NO: 7844 - protein, 283 aa, Unknown
  Obtained from environmental sample
  DOMAIN (39)...(283): Mur ligase family, catalytic domain
  misc_feature (1)..(283): Xaa is any amino acid
MNKSEKLKRHIVRLFNQRSVGKTDVEIKNIVFDSRNVEEGDVFVAIKGAAVDGHAFIDSAIKSGATVIVCESKPDKVEGGINYIVVEDAHFALSVMANNYYDQPGKKLELIGITGTNGKTTTTTLLFQLFREMGSSVGLISTVVNRINDEEIPTERTTPDPVSLNALLQQMVDAGCDYCFMEVSSHAIHQKRIGKLYFSGGAFTNITNEHLDYHKSFKEYLNVKKEFFDGLSKEAFAVTNVDDKNGEVMLQNCDARKITYGLKNIADYKAKVLENNSQSPQPI

SEQ ID NO: 7845 - DNA, 642 bp, Unknown
  Obtained from environmental sample
  misc_feature (1)..(642): n is a, c, g, or t
atgacgcaaaaatttgacaccataattattggagcgggtatcgcaggactttgttcagccctgacttctgtgaaatatggaatgaaaactgctttggttgaaaaatataattatatgggcggtattgcacaagattgctttcacatatatatttgcggtctttttcaaaataatctgtcaagtccttttcaaattgcaaacccagggatttgctctgatatttttcaatatttacacaaaatttatggtgataaagcccttgttaagatggggaaagttgaaaccatggcatttattcaaaaggatttgtggcattttttttctgatcaattaaaaaattataattttactttttttaaacaaagtgagtgtacaaactatatagaaaataacaaccatatccagaatattacaattaccacagattcaaaagcgcataacccaaaaatcaagaaaaacaaaatcgatcttgaagctgatatttttattgatgcaacaggcaattcttttttttctgatacaacctttgatggagattctcaacttggaggatattgtttcttgttaaaaggaaaccttaaaaaagatttatctttggttgttccctatactgcccgcaaaatcgtagaaaagtataattga

SEQ ID NO: 7846 - protein, 213 aa, Unknown
  Obtained from environmental sample
  misc_feature (1)..(213): Xaa is any amino acid
MTQKFDTIIIGAGIAGLCSALTSVKYGMKTALVEKYNYMGGIAQDCFHIYICGLFQNNLSSPFQIANPGICSDIFQYLHKIYGDKALVKMGKVETMAFIQKDLWHFFSDQLKNYNFTFFKQSECTNYIENNNHIQNITITTDSKAHNPKIKKNKIDLEADIFIDATGNSFFSDTTFDGDSQLGGYCFLLKGNLKKDLSLVVPYTARKIVEKYN

SEQ ID NO: 7847 - DNA, 624 bp, Unknown
  Obtained from environmental sample
  misc_feature (1)..(624): n is a, c, g, or t
atggctgtacaaaatgcaggatatttgatgaatggcatctatcttctaagttgtgttgcgaaaagttttggctcactttataaaaaaaagagtatcaagggccatctacttgtgccaatcaatgtggatgtacggaaaactaaatttaatgctgagaaaattttttttaacaatgtttccttcatgttatttaaaatcaaacaagatctctctttgcctgagtttatcaataaattaaaaactcaattcattgatcaggttaaaaacaagattccatttcaatttattaatgcatctttattgatgcgcattatgccacttaacgcactttcattttttatgaatttaagaatgaaaaaaactccatgctcattctctttttcatatattgccgaacaggcttttcatttatcaaatgttcaaaaccttgaagttgtaaaccttttccacatgcctctagtgcctgttaatccgggtgtcggggttttttttacacggttcaatcataagattaatatggttatttcaagctcagattccaatctgaataaacaagacggtacctatttgcaggaaaaaattatcgctaccttaattaaaggatcaaatgacgcaaaaatttga

SEQ ID NO: 7848 - protein, 207 aa, Unknown
  Obtained from environmental sample
  misc_feature (1)..(207): Xaa is any amino acid
MAVQNAGYLMNGIYLLSCVAKSFGSLYKKKSIKGHLLVPINVDVRKTKFNAEKIFFNNVSFMLFKIKQDLSLPEFINKLKTQFIDQVKNKIPFQFINASLLMRIMPLNALSFFMNLRMKKTPCSFSFSYIAEQAFHLSNVQNLEVVNLFHMPLVPVNPGVGVFFTRFNHKINMVISSSDSNLNKQDGTYLQEKIIATLIKGSNDAKI

SEQ ID NO: 7849 - DNA, 768 bp, Unknown
  Obtained from environmental sample
  misc_feature (1)..(768): n is a, c, g, or t
gtgaatttaatagattttccaaaatataataaagaaccagtttttgctttcgatagagatggtaatctttgttcttcaaatgaacctaaaaaagaaaaattaccttttattgtaaaatataaccaattatttaaagatgatacaatcaaagatatatataatataattgataataatatggaaaaaaatacaattgtaatagaagataatagatactattctctaagattaattggttctaaagatgctaataaaattttagtatatgggtatgatataacacaaataaagaaaaatgaacaacagttaagagaacaatcaaaacttgcagctcttggggagatgataggaaatattgctcatcaatggagacaaccattatctgttatatcaacagcagcaacaggaatgaagatacaaaaggagtttaatcttttaaaagacgatgattttaattcagcttgtgacatgatagatgagtatgctcagtatctgtcaaaaacaattgatgattttagggattttataaaaggggatacaaaaaatgttcgctttaatttaaaagaggagatagaatcttttttgaaattagttgagtctgatataaaaacatatcatattgaggttataaatagttgtgaagataatattataatcaatggtcatccaaatgaattaaaaacatgttttataaatatctttaataaagcaaaagatgccttttttaccaaaattctcatcctgaaaaaaaaaaatttttttttttaa

SEQ ID NO: 7850 - protein, 255 aa, Unknown
  Obtained from environmental sample
  DOMAIN (111)...(181): His Kinase A (phosphoacceptor) domain
  misc_feature (1)..(255): Xaa is any amino acid
MNLIDFPKYNKEPVFAFDRDGNLCSSNEPKKEKLPFIVKYNQLFKDDTIKDIYNIIDNNMEKNTIVIEDNRYYSLRLIGSKDANKILVYGYDITQIKKNEQQLREQSKLAALGEMIGNIAHQWRQPLSVISTAATGMKIQKEFNLLKDDDFNSACDMIDEYAQYLSKTIDDFRDFIKGDTKNVRFNLKEEIESFLKLVESDIKTYHIEVINSCEDNIIINGHPNELKTCFINIFNKAKDAFFTKILILKKKNFFF

SEQ ID NO: 7851 - DNA, 876 bp, Unknown
  Obtained from environmental sample
  misc_feature (1)..(876): n is a, c, g, or t
gtgttccaaaaaaaacagtccacaaaaatgaacaaacacgaatcacataacaccgaattcaaatccatctggaaagatgagtatttgaaacagctatgtggttttgccaatgcaaaaggtggaaagctatacattggaattgatgataatggtatagttgtcggcatatctaacggcaaacgtttattagaagaaatacctaacaaagcattaaatttaatgggattactcctagaagtatcctttgaacagaaaaacaatctttattatttagtcataacaatccctgaaagttcactacccataagccttagagggaagtattattatcgaagcggtacaacaactcaagcaattagcggtaatgcactttatgatttcctatacaaaaaacaaaatcttacttgggacgcaattggagaagaaaatgcctcttttgaagatatcgacctggttgtagttcaaaaattcataaagctatcaattgcagctaatcgactcaacaaagatgctttaaacctaagtttaccagaactattcgaaaatctaaacttatttgataaagataaaaacataaaacgagctgccttacttgcttttgctaaaaacccaacacgtttttatccatcagtgtatgtgaaaattggtcgcttcatctccgaaaccgacattatagttcaggatgtgattgaagacaacctattcacgatgattgaaagaattattgaaatattaaaaaccaaatacttaaaatcagaaatttcatataaaggcatacaccgagaagaaaagcttgaatatccagaaaccggattgcgtgaatcaatattaaatgcaataattcatagagattattctggtctttctctcaaataa

SEQ ID NO: 7852 - protein, 291 aa, Unknown
  Obtained from environmental sample
  DOMAIN (35)...(122): Divergent AAA domain
  misc_feature (1)..(291): Xaa is any amino acid
MFQKKQSTKMNKHESHNTEFKSIWKDEYLKQLCGFANAKGGKLYIGIDDNGIVVGISNGKRLLEEIPNKALNLMGLLLEVSFEQKNNLYYLVITIPESSLPISLRGKYYYRSGTTTQAISGNALYDFLYKKQNLTWDAIGEENASFEDIDLVVVQKFIKLSIAANRLNKDALNLSLPELFENLNLFDKDKNIKRAALLAFAKNPTRFYPSVYVKIGRFISETDIIVQDVIEDNLFTMIERIIEILKTKYLKSEISYKGIHREEKLEYPETGLRESILNAIIHRDYSGLSLK

SEQ ID NO: 7853 - DNA, 768 bp, Unknown
  Obtained from environmental sample
  misc_feature (1)..(768): n is a, c, g, or t
atgcctttaaatagaaaagatttaattggatctcaaaacggtctgaaaaatatgtttatcaacagtggatataccgctgatttaattgaaataaaaaataatttgactatagatgaaaatgggacttatattccaaacggaatactcgaaattgatgtcattgaatatgcgatatacgatattattttgaggggaaacaaaggagatatcacatatgaagaagtaaaagaaatattgggattaaggttattcaaagattattttcaagaattttttaaattatttttaaaaatgcaaaattattatccaaaatattctaccatgcaaatggctttttcaaaattattcaacactggtttatacgatacaacaaaaacaaaggttatttttgaaacttttgatgaaccatttgaagctggtgaatacgttaaaaacttggtcatagacgttgttttaaacccaattgttcctgaaactatgcctatagaatacatatcaatcactggaaattctctcatagatgaaaatgaactattgaacgttgtagaatcattcaaagatcaatttactaatcttatgcatgttttgagagatatacaaaaaatcaaggaatattatgtaaaaaaaggttacccatatacaatagttccggcaaaatatgataattcaactggtgaattgaattacagtatttccgaggggtttgtaaaaaaagtaataattgaaggcttgataaaaacacgtgaagatcttgcttggcgtgaaata

SEQ ID NO: 7854 - protein, 256 aa, Unknown
  Obtained from environmental sample
  DOMAIN (184)...(239): Surface antigen variable number repeat
  misc_feature (1)..(256): Xaa is any amino acid
MPLNRKDLIGSQNGLKNMFINSGYTADLIEIKNNLTIDENGTYIPNGILEIDVIEYAIYDIILRGNKGDITYEEVKEILGLRLFKDYFQEFFKLFLKMQNYYPKYSTMQMAFSKLFNTGLYDTTKTKVIFETFDEPFEAGEYVKNLVIDVVLNPIVPETMPIEYISITGNSLIDENELLNVVESFKDQFTNLMHVLRDIQKIKEYYVKKGYPYTIVPAKYDNSTGELNYSISEGFVKKVIIEGLIKTREDLAWREI

SEQ ID NO: 7855 - DNA, 429 bp, Unknown
  Obtained from environmental sample
  misc_feature (1)..(429): n is a, c, g, or t
ttgaaacaaatctatcttttcagtgacggttctgccttaggcaatcccggtccgggcgggtacgggactatcgtacgctataaagacagtgaaaaagagctgacaggcggcgaaaagcatacgaccaacaaccgtatggaacttcttggtgtaatagaaggacttcgtgcgctaagagagccctgcaaagtcgagatcacttcggattcatcctatgtcgtaaaaggtataaacgaatggctcgaaggctggatcaaacgagactttaaaaaggtcaagaaccccgatctctggaaggcttatatcgaagctgccaaagggcatcagatccatgccgtttgggtcagaggccatgacgggcatgatgagaacgaacgctgtgaccagatcgcacggactacggcagaaaagtttaaaaaagaactctaa

SEQ ID NO: 7856 - protein, 142 aa, Unknown
  Obtained from environmental sample
  DOMAIN (1)...(136): RNase H
  misc_feature (1)..(142): Xaa is any amino acid
MKQIYLFSDGSALGNPGPGGYGTIVRYKDSEKELTGGEKHTTNNRMELLGVIEGLRALREPCKVEITSDSSYVVKGINEWLEGWIKRDFKKVKNPDLWKAYIEAAKGHQIHAVWVRGHDGHDENERCDQIARTTAEKFKKEL

SEQ ID NO: 7857 - DNA, 450 bp, Unknown
  Obtained from environmental sample
  misc_feature (1)..(450): n is a, c, g, or t
atgttaggagttataatggatagatcaaaattaaatctttttataatatttatcgtttttgcgattatattatcaataatagatataggagttcaaaaaatattttttggagacaatactcaaaaaatagcattacataacgctgtatataaaagtcaagagagagaagaacttatacaaaaatttttatttcaatcggaacaaacattacactctcttagacaactagatagttttaaaaaatatcttcaaaatggggaaggggagaagtcgttagaaaatatatttttatcatatgctatgtctcaaacttcgttcatgcaattaagatttatcgataaaaatggttttgaaaagataaagattgatagaaataaagaaaaattacaaccatatattatctctaaaaatcaatttcagaataaatcaaatagatattatttttgctga

SEQ ID NO: 7858 - protein, 149 aa, Unknown
  Obtained from environmental sample
  misc_feature (1)..(149): Xaa is any amino acid
MLGVIMDRSKLNLFIIFIVFAIILSIIDIGVQKIFFGDNTQKIALHNAVYKSQEREELIQKFLFQSEQTLHSLRQLDSFKKYLQNGEGEKSLENIFLSYAMSQTSFMQLRFIDKNGFEKIKIDRNKEKLQPYIISKNQFQNKSNRYYFC

SEQ ID NO: 7859 - DNA, 690 bp, Unknown
  Obtained from environmental sample
  misc_feature (1)..(690): n is a, c, g, or t
ttgagcttactcaatctaacacctatttcggaatataataatgaagacatatttatagcgggttacccaaaatcgggtaatacttggttgaaaacattgatagcttcaattttattagaaacgtctacttcaagattaacacctactttagttaatgaggttattccagatgtacatggtaaaaaatattataaacgctactttccgataactttttttaaaacccaccatttgccacaacctaattataaaaaagtaatacatttagtgagagatggtagggatgctatggtatcttattataagatggagagccataaaactagcaatgattccattaccctagaagatatggtgaagaatggtgaaaggttatttccatcaaaatggttttatcatactagaaagtggattgagaatccatttaattcagaaattttagttgttaaatatgaagacttgaaagaaaatccttttaatgagcttaaaaggatttgtagtttttcaaacttgaaaattgaagatgatttgcttagtaagattattaaacaaaatgaaatagactctatgagaaataggttttctaaatatggagtagaaaatgaaaaaatgtttaaaaataatgatatctcattattttttaggaaaggaaatataggtgattataagaaagaaatgagtgaagaatga

SEQ ID NO: 7860 - protein, 229 aa, Unknown
  Obtained from environmental sample
  DOMAIN (14)...(229): Sulfotransferase domain
  misc_feature (1)..(229): Xaa is any amino acid
MSLLNLTPISEYNNEDIFIAGYPKSGNTWLKTLIASILLETSTSRLTPTLVNEVIPDVHGKKYYKRYFPITFFKTHHLPQPNYKKVIHLVRDGRDAMVSYYKMESHKTSNDSITLEDMVKNGERLFPSKWFYHTRKWIENPFNSEILVVKYEDLKENPFNELKRICSFSNLKIEDDLLSKIIKQNEIDSMRNRFSKYGVENEKMFKNNDISLFFRKGNIGDYKKEMSEE

SEQ ID NO: 7861 - DNA, 825 bp, Unknown
  Obtained from environmental sample
  misc_feature (1)..(825): n is a, c, g, or t
gtgaggatattccaaagcgatagaaaaggtgcttttgccataatatatgagtttgaaactgatattgtagacaatgaaatagcttggatacaagctgataatatagaaaaagctatatgtaatattttaagatttaatcttctaaaacataatattaaatatatccatacaaataaagtatttttcaaactcttaaatacttttaaatcaaaagagctttcatatatagtaactttaaaagataatttgttttcagactttgagcttttaaatagtatcattgaagataaaatagtttttggtacaaactatgattttcttgaacttattggtgcagatatactctctttggaaaataagatttataatgtaaaaaaccttacaagtcactctctatttgaaacctctttctcttataaagacaaattttttgataagataaaaataccaactgtatatatcaatgacctgttacaacaactagaactttttgagtacaaagttgacttaaaacgcctcaatagttttaatctctttaaacctatttttatcaataaaagtaaccaaatagtacaatttggtcaaaccaatagatttatcatagcaaatgaagataaagatatttgtgacatagagataagctatctcaaagaacactatagctacgccaatataaaagttatcgatacaacatattatgatgaagatgcaatctttaattatataaaanacaataactttaatgccttgtatctttgtggtacaaatcataaaacaattataagaattcttngaaacaactatgatgacaatagacttttgtaa

SEQ ID NO: 7862 - protein, 274 aa, Unknown
  Obtained from environmental sample
  misc_feature (1)..(274): Xaa is any amino acid
MRIFQSDRKGAFAIIYEFETDIVDNEIAWIQADNIEKAICNILRFNLLKHNIKYIHTNKVFFKLLNTFKSKELSYIVTLKDNLFSDFELLNSIIEDKIVFGTNYDFLELIGADILSLENKIYNVKNLTSHSLFETSFSYKDKFFDKIKIPTVYINDLLQQLELFEYKVDLKRLNSFNLFKPIFINKSNQIVQFGQTNRFIIANEDKDICDIEISYLKEHYSYANIKVIDTTYYDEDAIFNYIKXNNFNALYLCGTNHKTIIRILXNNYDDNRLL

SEQ ID NO: 7863 - DNA, 351 bp, Unknown
  Obtained from environmental sample
  misc_feature (1)..(351): n is a, c, g, or t
ttgggcatcggggattttatctttggcaaagggggaaagtatttccccgttcattttggaaccctgaagaaatatctgtgtaatgggtgtgattgttccgataggaatcggaagttcccaagtgacttttcggagatcacccaggtcattttgttcaattctctgatcactcgacaaataatatcgcacgataagtcctgtcggggccaatccaaatcccttgttcgcgatctctacattaagctccatggtttttcctgctaccacggtattctctgcgggtgtaaaatcagtcatctccaggtcaggacggttgatgtctgttacatttacccagacaatgcccggtga

SEQ ID NO: 7864 - protein, 116 aa, Unknown
  Obtained from environmental sample
  misc_feature (1)..(116): Xaa is any amino acid
MGIGDFIFGKGGKYFPVHFGTLKKYLCNGCDCSDRNRKFPSDFSEITQVILFNSLITRQIISHDKSCRGQSKSLVRDLYIKLHGFSCYHGILCGCKISHLQVRTVDVCYIYPDNAR

SEQ ID NO: 7865 - DNA, 339 bp, Unknown
  Obtained from environmental sample
  misc_feature (1)..(339): n is a, c, g, or t
ttggatactncggncttctacaagtttataatgatttcaaaaggtcaaatttcagactttgtaactgtttcatcaacagatgcacttaaatctctcactccagagcaaaatagtgaatttttaaatagactttttgaatcagaatcaaaaaaaggttatatcaaattagccgatggtaaaattgttttatataatattttggaacaaaagatgcttgacaatttaaataatgatcaagacgataatatattaaatataaaatcttctatgtttaacagaggaattataaaacttcttgagaacaaatatccggtacaaatctttatggaagggttctaa

SEQ ID NO: 7866 - protein, 112 aa, Unknown
  Obtained from environmental sample
  misc_feature (1)..(112): Xaa is any amino acid
MDTXXFYKFIMISKGQISDFVTVSSTDALKSLTPEQNSEFLNRLFESESKKGYIKLADGKIVLYNILEQKMLDNLNNDQDDNILNIKSSMFNRGIIKLLENKYPVQIFMEGF

SEQ ID NO: 7867 - DNA, 744 bp, Unknown
  Obtained from environmental sample
  misc_feature (1)..(744): n is a, c, g, or t
gtgcaaattagtatgaatgagctccaacaaacatattcaaacctttatggacagtataaccagatgtttcaaggtaaatttgacgaagaacaggcaaaaacttttggtcttcaaaaacaggcaatgcgccaactaattgatcaagcactgataacaaacctagcaaatagctacaatctaaatatcagcgacaaagagctgtatgaaaacatctcttctcaaaactacttttttaaagatggttcatttgataaagtaacatataaaaatgttctttctcaaaataagttaactattaaagattatgaagacagtgttagaaaatcgttgctaattcaaaaaagtctctctctttttacaccagatatcagtgacttggagaaaagtgtaataaacagtgctttgaagatagaagataaactagaatataaaattttagacaaaagtatgataaaagtagctcttgatgataaaaagctagaggctttttggagcgaaagaaaaagtcaatttatgactcctactaaatattcactatctattgttgaacaaaatgcagttaaaataactccaactgaagagganatttcaaattattatgatgaaaatagacatgactttaaagacagtgaaggtgtcattttaactatagctgatgtaaaagatgacattatcaaagctatagcttcaaaagcaacacaccaagagtcactaaaaaaatatattgattttcaaaaaagataa

SEQ ID NO: 7868 - protein, 247 aa, Unknown
  Obtained from environmental sample
  misc_feature (1)..(247): Xaa is any amino acid
MQISMNELQQTYSNLYGQYNQMFQGKFDEEQAKTFGLQKQAMRQLIDQALITNLANSYNLNISDKELYENISSQNYFFKDGSFDKVTYKNVLSQNKLTIKDYEDSVRKSLLIQKSLSLFTPDISDLEKSVINSALKIEDKLEYKILDKSMIKVALDDKKLEAFWSERKSQFMTPTKYSLSIVEQNAVKITPTEEXISNYYDENRHDFKDSEGVILTIADVKDDIIKAIASKATHQESLKKYIDFQKR

SEQ ID NO: 7869 - DNA, 669 bp, Unknown
  Obtained from environmental sample
  misc_feature (1)..(669): n is a, c, g, or t
ttggaaaaagcacttgcttttattggttaccaaccaggaattattttttgtaatttcagggatgcactggaacgggtaagtgattttttaactgagaagcatattgatcatgagtgctttcacggaggtatggaacaaattgatcgggagcaagcactagttaaatttagaaatggtacaaatcaactccttctggcaaccgatttagctgctcgtggacttgatattccagaaataaaatttattcttcattatcaccttccgccacgtaataaagaattcacccacaggaatggacgaactgcacgtatgaaccgcaatggcattgcctatattctgcattggaaagaagaagaacttccagattttattcaggaaattgatccggagaacctaaatattgaagatcaacaaaaagctacgcttccttcaccagtaaaatggaaaaccttgtatattaatggagggagacgagataaaatatcaaaaggagatgtcgccggtttatttcttaagcagggtcaggttcaaaaagatcaactaggtgttattgaacttaaacagaattgtacgtatgctggtgtacatgctgaaatagctgaaatacttatagaaaaaaccaataataccaaacttaaaaaaaagaaggtgacaattagtcttatttga

SEQ ID NO: 7870 - protein, 222 aa, Unknown
  Obtained from environmental sample
  DOMAIN (136)...(222): DbpA RNA binding domain
  misc_feature (1)..(222): Xaa is any amino acid
MEKALAFIGYQPGIIFCNFRDALERVSDFLTEKHIDHECFHGGMEQIDREQALVKFRNGTNQLLLATDLAARGLDIPEIKFILHYHLPPRNKEFTHRNGRTARMNRNGIAYILHWKEEELPDFIQEIDPENLNIEDQQKATLPSPVKWKTLYINGGRRDKISKGDVAGLFLKQGQVQKDQLGVIELKQNCTYAGVHAEIAEILIEKTNNTKLKKKKVTISLI

SEQ ID NO: 7871 - DNA, 402 bp, Unknown
  Obtained from environmental sample
  misc_feature (1)..(402): n is a, c, g, or t
ttgatgggagattttatgagaatattaattactatactttttatgattactttaggtttctctcaggcattgttccttcccttgccacagaaaatatcttacaataaagagaaagtagatttaggaaaaaaccttttttttgatccccttttatcgcgagataaagatatctcttgtcactcttgtcattttaattatggtgcggatagagaacagtttagtataggaacagataatcaaaaagcttttataaatactccatctgttttcaatttaccatataaaataggttatttttggaatggaagaagcgaaactttagaagaacagatgatagatggaccattttttaataaacatgagatggcaagtagtaaagagataatgaaaaaagattattaa

SEQ ID NO: 7872 - protein, 133 aa, Unknown
  Obtained from environmental sample
  DOMAIN (21)...(128): Di-haem cytochrome c peroxidase
  misc_feature (1)..(133): Xaa is any amino acid
MMGDFMRILITILFMITLGFSQALFLPLPQKISYNKEKVDLGKNLFFDPLLSRDKDISCHSCHFNYGADREQFSIGTDNQKAFINTPSVFNLPYKIGYFWNGRSETLEEQMIDGPFFNKHEMASSKEIMKKDY

SEQ ID NO: 7873 - DNA, 498 bp, Unknown
  Obtained from environmental sample
  misc_feature (1)..(498): n is a, c, g, or t
atgcaggttctattttcggaaaacattgaagaaacttctgcacaaaatataaataattattctattaacaatgatattattgtgctgaatgctgctcaggatgctttccaaaaaagcaaagtgattttaacggtagccaatatgaaaataggtaccagtactttaacttgctctgcaatagaagaccttgccggaaatataatggacattgctacaatggattttatttcagattatgcaggtattgacgaaattcttgttcaaaccactattgttagccctaatcctgtagttgacaataaaataaatattaaatcgactcaaataatttcttccgttgagatttataatattacaggtgctattatttgcaagaaaaataatattgataaaatgaatacttcaattaagcttaaacaaagcgataaaggtatttatactgtaaaaataatttttgaaaacgatatgcaaattcagaagaaaattattgttgaataa

SEQ ID NO: 7874 - protein, 165 aa, Unknown
  Obtained from environmental sample
  misc_feature (1)..(165): Xaa is any amino acid
MQVLFSENIEETSAQNINNYSINNDIIVLNAAQDAFQKSKVILTVANMKIGTSTLTCSAIEDLAGNIMDIATMDFISDYAGIDEILVQTTIVSPNPVVDNKINIKSTQIISSVEIYNITGAIICKKNNIDKMNTSIKLKQSDKGIYTVKIIFENDMQIQKKIIVE

SEQ ID NO: 7875 - DNA, 321 bp, Unknown
  Obtained from environmental sample
  misc_feature (1)..(321): n is a, c, g, or t
gtgaatctttttgaaaatgggatagtacaagaggatttaatatatccatcacttacacagttacaaaatcaaattaaaaaatatttagctggcagtatcgctttagagataattaaaggtgaatcttatattgtatttgaagatgagataaaagaagcttataaaatagctcataatctagtagaagtatacaagatgaaaacttcacaagagagtgtgatacaaaaagcaaaagatgatttaaaagatgaaatatctgcaaatattgaagttgtaaaagagttaaaaaggaagcttttaaaggatgaaattgtattttag

SEQ ID NO: 7876 - protein, 106 aa, Unknown
  Obtained from environmental sample
  misc_feature (1)..(106): Xaa is any amino acid
MNLFENGIVQEDLIYPSLTQLQNQIKKYLAGSIALEIIKGESYIVFEDEIKEAYKIAHNLVEVYKMKTSQESVIQKAKDDLKDEISANIEVVKELKRKLLKDEIVF

SEQ ID NO: 7877 - DNA, 774 bp, Unknown
  Obtained from environmental sample
  misc_feature (1)..(774): n is a, c, g, or t
ttgcctaatatcgtacatgtcattcataataccttatcacacttgtataagtttgatagagtaaacgaaactgaacaactaaaatcaagaatgatggaaatatactctaaaaacccttgtgtatgtgtcagtcacggggctgaaaaggatttcataaagagcttcggtcaaattacgccaaccactgcaatccacaatccaattgataaagagagtattcaaaaacaagcaaatgctttcgttcctgagtatcaaaattacatcatccatgtgggtagctttaaagatgcaaagcgtcatgacgtattggtaaaggcttacgcaaaaaccgatcaatctatgccgttgttgcttttaggccaaggcaaacacaaaggtgatatagaggaattagttaaagatttaaatatagaagacaaagtggtatttttaggttttcaagagaatccttttccttatattaaacatgcacaacttaaagtactgacctctgactgggaaggatttgctttggttattgccgaggctttagtgctaggtactcctgttattagtaccgattgcccatcaggcccaagtgagttactgccagaaaataatttggtgcccatgagagatatagatgctatcgctgctaaaataagcttagcaatgaaaaatccggaacaatttcattctaaatttagtgaagagttgcttcctgtaacgacagcaaagaaatatatcgaatttgcatcgaatctttatgatattgataagaaatctaatccctga

SEQ ID NO: 7878 - protein, 257 aa, Unknown
  Obtained from environmental sample
  DOMAIN (72)...(235): Glycosyl transferases group 1
  misc_feature (1)..(257): Xaa is any amino acid
MPNIVHVIHNTLSHLYKFDRVNETEQLKSRMMEIYSKNPCVCVSHGAEKDFIKSFGQITPTTAIHNPIDKESIQKQANAFVPEYQNYIIHVGSFKDAKRHDVLVKAYAKTDQSMPLLLLGQGKHKGDIEELVKDLNIEDKVVFLGFQENPFPYIKHAQLKVLTSDWEGFALVIAEALVLGTPVISTDCPSGPSELLPENNLVPMRDIDAIAAKISLAMKNPEQFHSKFSEELLPVTTAKKYIEFASNLYDIDKKSNP

SEQ ID NO: 7879 - DNA, 891 bp, Unknown
  Obtained from environmental sample
  misc_feature (1)..(891): n is a, c, g, or t
atggacagcattcggctcgagaaatttaagccatataagctcataccaggatcccaaaggcgcgataaaatttttgcgcgtgctgttgatagatatatttcacaaaatatcggtcagcctgatctcatactatctaaccttgatcgtgcggatagcatcctgagtaatagcaaactgcccaatatcacctatattattcataacactgtatcactactttacaattttaataaaaatcatgatgctgagcagttgaagaaaagaatggtggagatatacgctaagcatccatgtgtgtgtgtcagtgaaggagctaaaaaagatttcatcaacagttttggccatattacgccaaccactacaatccataatccaattgatagagacagtattcaaaaacaggctgatgcttttgtccctgagtatcaaaactacataattcacgtgggtagctttaaagatgcaaagcgtcatgacgtactggtaaaagcctactcaagaactgatcagtctatgccgttgttacttttaggccgaggtaagcataaaagtgagatagaacagttagttacagagttaaaactagaaaataaagtggtgtttttaggttttcgtgaaaacccttttccttatattaaacatgcacaacttaaagtactgacctctgactgggaaggatttgctttggttattgccgaggctctagtgctaggtactcctgttatcagtaccaattgtccatcaggtccaagtgagctgctgcctgaaagcaatttgatgccagtgggcgatattgatgcgatcgccgaaaaaatgcgtccaagcctgganaaatccccaacaattttcttccacattttgaaggaacaactttttcccatccaccaatag

SEQ ID NO: 7880 - protein, 296 aa, Unknown
  Obtained from environmental sample
  DOMAIN (130)...(290): Glycosyl transferases group 1
  misc_feature (1)..(296): Xaa is any amino acid
MDSIRLEKFKPYKLIPGSQRRDKIFARAVDRYISQNIGQPDLILSNLDRADSILSNSKLPNITYIIHNTVSLLYNFNKNHDAEQLKKRMVEIYAKHPCVCVSEGAKKDFINSFGHITPTTTIHNPIDRDSIQKQADAFVPEYQNYIIHVGSFKDAKRHDVLVKAYSRTDQSMPLLLLGRGKHKSEIEQLVTELKLENKVVFLGFRENPFPYIKHAQLKVLTSDWEGFALVIAEALVLGTPVISTNCPSGPSELLPESNLMPVGDIDAIAEKMRPSLXKSPTIFFHILKEQLFPIHQ

SEQ ID NO: 7881 - DNA, 360 bp, Unknown
  Obtained from environmental sample
  misc_feature (1)..(360): n is a, c, g, or t
ttggggttttttttgaaaatttgggagaaatatttggatttcaattgctttcggagggatccaaatttttgggccaaacctttaaattattttttcagctattggtggatgggaaaaagttgttccttcaaaatgtggaagaaaattgttggggatttntccaggcttggacgcattttttcggcgatcgcatcaatatcgcccactggcatcaaattgctttcaggcagcagctcacttggacctgatggacaattggtactgataacaggagtacctagcactagagcctcggcaataaccaaagcaaatccttcccagtcagaggtcagtactttaagttgtgcatgtttaatataa

SEQ ID NO: 7882 - protein, 119 aa, Unknown
  Obtained from environmental sample
  misc_feature (1)..(119): Xaa is any amino acid
MGFFLKIWEKYLDFNCFRRDPNFWAKPLNYFFSYWWMGKSCSFKMWKKIVGDXSRLGRIFSAIASISPTGIKLLSGSSSLGPDGQLVLITGVPSTRASAITKANPSQSEVSTLSCACLI

SEQ ID NO: 7883 - DNA, 693 bp, Unknown
  Obtained from environmental sample
  misc_feature (1)..(693): n is a, c, g, or t
gtgcataagcactccttagaagatggctttagtgttagtcccaatactgtgcaaaaatatcgtaaagagttaggtttaagagctgtattagcagttaaagcaccatatacatctaaaggtaataaacagcatccgatatactcttataaactaaaaggactagatataacaagagccaatcaagtttggtcaactgatataacctatatccgtattaaaggtgggtttgtttacttagcagcaattatagattggtacagtaaggctgtattatcttacaaagtatcagtaaccatggatacagatttagttatgagtgtactaaatgaagcactatcactctatgctaaacctgaaatatttaatacagatcaaggtagtcaatatacaagttatattcacactgatacattaaaacaaaatggtatcactatatcaatggatggtaagggtagagctacagataatatttgtatagaaagattctggagaagtgctaaagttgaaaaaatatatctaaatgaatatgagagagtgtcaactttaaaagaagatgttaaagagtatatcaatttttataatcataaaagatttcatgaaacattaaactataaaaaacctatgaatgtttactgggacagtattaaaattaatgatgagaattatactaatttagaacaaagtgtggggtaa

SEQ ID NO: 7884 - protein, 230 aa, Unknown
  Obtained from environmental sample
  DOMAIN (55)...(212): Integrase core domain
  misc_feature (1)..(230): Xaa is any amino acid
MHKHSLEDGFSVSPNTVQKYRKELGLRAVLAVKAPYTSKGNKQHPIYSYKLKGLDITRANQVWSTDITYIRIKGGFVYLAAIIDWYSKAVLSYKVSVTMDTDLVMSVLNEALSLYAKPEIFNTDQGSQYTSYIHTDTLKQNGITISMDGKGRATDNICIERFWRSAKVEKIYLNEYERVSTLKEDVKEYINFYNHKRFHETLNYKKPMNVYWDSIKINDENYTNLEQSVG

SEQ ID NO: 7885 - DNA, 951 bp, Unknown
  Obtained from environmental sample
  misc_feature (1)..(951): n is a, c, g, or t
ttgggggaatgcgggagattaagccccacaacccccaaagaaaaagaaccattttttggatttgggaaaaaaacttggtggcccaaaaaggttcaacttttttggggtttgggcgcaaacaaaaataacaaccttaaaaagaacccttttccaggagtgataggaaaaaattgcaggattgcgaaacatcttggggttaagaacacctccattcttcaatttattaaaaaataccaagtagacatgtctcaggcgatcaacagtgatccactgtcttatcgcatttttaatgatttcttcacccgcgcaattcgccntgagcttcgccctatcagtgaagaaagcaacagcattgcctgcccggctgacggcgctatcagccagcttggcaacattgaacatggcaccatattgcaagccaaaggccatcactacagcctaacgagcttattgggtggcgatgccgctttgtccgatcaatttctaggcggctcttttgcaaccgtgtatttgtcgccaaaagactaccaccgcgtgcacatgcctctaacaggcaaactcaccaagatgatccacatccctggcaagctgttctctgtcaacaaggtaacggccgagcagatacccagtgttttcgctcgcaacgaacgcaccgtatgcctatttgataccgaagcaggcccaatggccgtgattcttgtgggcgccatgatagtggccagcatagagaccgtctgggcaggccaagttaccccttttaacaaaaatgtggtgacttgggattacagcgcccttaatgacgtagtgattaagaaaggcgaagaaatgggccgctttaagctaggctctacggccattgtattatttggcaaagacgccgtgaattgggaagaaagcctgcaagcagaaaccccaaccaccatgggcatgccatttggcaccatcaaataa

SEQ ID NO: 7886 - protein, 316 aa, Unknown
  Obtained from environmental sample
  DOMAIN (96)...(314): Phosphatidylserine decarboxylase
  misc_feature (1)..(316): Xaa is any amino acid
MGECGRLSPTTPKEKEPFFGFGKKTWWPKKVQLFWGLGANKNNNLKKNPFPGVIGKNCRIAKHLGVKNTSILQFIKKYQVDMSQAINSDPLSYRIFNDFFTRAIRXELRPISEESNSIACPADGAISQLGNIEHGTILQAKGHHYSLTSLLGGDAALSDQFLGGSFATVYLSPKDYHRVHMPLTGKLTKMIHIPGKLFSVNKVTAEQIPSVFARNERTVCLFDTEAGPMAVILVGAMIVASIETVWAGQVTPFNKNVVTWDYSALNDVVIKKGEEMGRFKLGSTAIVLFGKDAVNWEESLQAETPTTMGMPFGTIK

SEQ ID NO: 7887 - DNA, 384 bp, Unknown
  Obtained from environmental sample
  misc_feature (1)..(384): n is a, c, g, or t
atgatttggcaattaatggttaaaacagcggatgttggtattagagccaaagatgcactggtaagaataatagcaactaagcaaagtcctgctgctcaaagaggtgaaagagcatttaatgagggtggttgttctggatgtcatgttgttggaaaagtatcttcaggtcctgatttaacgggtgttttacaaagacatgaaaatgctgaaaaatgggtaaaaagttttattcttaacccagaaaaaatgtataaagatccatacgttgatggtatgattaactattttaatcttagaatgccaaatcaacatatgagtgagaaagaaacagacgacattattgaatattttaaatggatagataaaaatgctaacttattttaa

SEQ ID NO: 7888 - protein, 127 aa, Unknown
  Obtained from environmental sample
  DOMAIN (33)...(121): Cytochrome c
  misc_feature (1)..(127): Xaa is any amino acid
MIWQLMVKTADVGIRAKDALVRIIATKQSPAAQRGERAFNEGGCSGCHVVGKVSSGPDLTGVLQRHENAEKWVKSFILNPEKMYKDPYVDGMINYFNLRMPNQHMSEKETDDIIEYFKWIDKNANLF

SEQ ID NO: 7889 - DNA, 582 bp, Unknown
  Obtained from environmental sample
  misc_feature (1)..(582): n is a, c, g, or t
atgaaaaataataaaaaaatagcaatagtatttggtagtcagagttttgaacatgagataagtatcgttagtgcaataacaatgaaaaaggttttaaagtgtgaaattatttatatttttattgataagtatagagaattttatcttatccctacagatataataaaatcaaatcttttcagtagtggtgaatataaaaagtttgataaattagagttaaatcacaaggggtttactaagaaaaaactctttggaagagaaaaaatagagtttgatacggtattaaatttagttcatggtggagatggtgaagatggtgtactagctgggttatttaaattttacaatataccgtttataggtccacgaattgaagctagcgtagttagttgtaataaatatttaacaaaatcttacgctcatagttgtggagtaaagtctatagaatttcaatatttcactaaaaatgaaataattacagtagaaaaattttccagtaatcatttaacccagttccatttaagaagtaagtataggtggttcctggttgtgaaacaaaaaaaaaaggaagttgggatttag

SEQ ID NO: 7890 - protein, 193 aa, Unknown
  Obtained from environmental sample
  DOMAIN (5)...(131): D-ala D-ala ligase N-terminus
  misc_feature (1)..(193): Xaa is any amino acid
MKNNKKIAIVFGSQSFEHEISIVSAITMKKVLKCEIIYIFIDKYREFYLIPTDIIKSNLFSSGEYKKFDKLELNHKGFTKKKLFGREKIEFDTVLNLVHGGDGEDGVLAGLFKFYNIPFIGPRIEASVVSCNKYLTKSYAHSCGVKSIEFQYFTKNEIITVEKFSSNHLTQFHLRSKYRWFLVVKQKKKEVGI

SEQ ID NO: 7891 - DNA, 696 bp, Unknown
  Obtained from environmental sample
  misc_feature (1)..(696): n is a, c, g, or t
atggagattccatatgttgtattattaaatgaattaaaccatttacaaagtattcttattgaactttttatcaactatgataaaaaaattgaaactattgccttatataaactttctgctgtatcacaaaataaagttgcaaaagagtaccttaatatttatacgacaaatttaatatctatatgtaacattagactctcaagcatacacgacatgcttgaacattatgttgttgaacactatgtagagcatataaaatggcttatcaatcttgcacaaaacattaaagataccaatataaattcttttcctcaaacagacaaaacattgtgcaattttggaaaatggttagcacaagatggatcaaatattattaaaaataattcaaaacttaaagagttagaaaaggttcattctcagattcattatatatcatcacaaattaaacatattttaacacttaatgatcataattatgactatgatatattgttaacatatcttgaaaaatgcgaacttttatcactttctataggtacagaacttgctctcatagataatacaattgtcaatcaaaaagctgctaaagacacattaactggtgcattagggagacaagtattagaacaaatatttcaaaatcaatatgagatttcattagcaacctcatcaaaatttgtagtagcaatgttttga

SEQ ID NO: 7892 - protein, 231 aa, Unknown
  Obtained from environmental sample
  misc_feature (1)..(231): Xaa is any amino acid
MEIPYVVLLNELNHLQSILIELFINYDKKIETIALYKLSAVSQNKVAKEYLNIYTTNLISICNIRLSSIHDMLEHYVVEHYVEHIKWLINLAQNIKDTNINSFPQTDKTLCNFGKWLAQDGSNIIKNNSKLKELEKVHSQIHYISSQIKHILTLNDHNYDYDILLTYLEKCELLSLSIGTELALIDNTIVNQKAAKDTLTGALGRQVLEQIFQNQYEISLATSSKFVVAMF

SEQ ID NO: 7893 - DNA, 567 bp, Unknown
  Obtained from environmental sample
  misc_feature (1)..(567): n is a, c, g, or t
atgatagatattgttgaatcaaaatttattatttctgcaccaaatatagctatgtcaccagagaatgagtatcaagatgaagttgtatttatggctagatcaaatgttggtaaaagttctcttttaaactctttaactaatcataaaaacttggctaaagtatcttctactcctggaaaaacaagacttattaactactttagaacaacttttatggatagagagacttctgaaaaacttagtgccaactttgtggatttaccaggttttggttatgcaaaagtctctaagagtataaagtcagattgggagaaaaatttaacggattttatatctaaacgtgctcaaattaaactttttatacatttggttgattgtaggcatccacatttagatattgatagatctgtagatgattatataactgagataattaacccatctcaagtttatatcagagtctttacaaaaatagataaattaaatccaaaagagcaaaatgcactcagaagagagttcccaggtgcattaatgatatcaaatacaaaaaaacgtggtattgattaa

SEQ ID NO: 7894 - protein, 188 aa, Unknown
  Obtained from environmental sample
  misc_feature (1)..(188): Xaa is any amino acid
MIDIVESKFIISAPNIAMSPENEYQDEVVFMARSNVGKSSLLNSLTNHKNLAKVSSTPGKTRLINYFRTTFMDRETSEKLSANFVDLPGFGYAKVSKSIKSDWEKNLTDFISKRAQIKLFIHLVDCRHPHLDIDRSVDDYITEIINPSQVYIRVFTKIDKLNPKEQNALRREFPGALMISNTKKRGID

SEQ ID NO: 7895 - DNA, 309 bp, Unknown
  Obtained from environmental sample
  misc_feature (1)..(309): n is a, c, g, or t
ttgataaaaattttgacatacaagttatttcataaaaatttcactatgaaaaaagagattgaaaaatactttattattgacgaatttgaagatggttggggactggatgaactctatcatgaggaacttttatatgattattgtcaagaagttttatttattcccgatgagtttatagaagaactttctatgaaaagttttggattggagattattctatgtaatcttggttttgaagacacttatgaagattggtatattagtcttcatagattatcaaacgcactcaataaacgctacagtgcataa

SEQ ID NO: 7896 - protein, 102 aa, Unknown
  Obtained from environmental sample
  misc_feature (1)..(102): Xaa is any amino acid
MIKILTYKLFHKNFTMKKEIEKYFIIDEFEDGWGLDELYHEELLYDYCQEVLFIPDEFIEELSMKSFGLEIILCNLGFEDTYEDWYISLHRLSNALNKRYSA

SEQ ID NO: 7897 - DNA, 744 bp, Unknown
  Obtained from environmental sample
  misc_feature (1)..(744): n is a, c, g, or t
ttgtattgtttagtatgcttattattactttttcaacagtataaaaagaattattcacatgaatttaataagtattatatcttctattcaaatattcttaatgattttgtttatcaaaaaaactttggagaacaccaatttgaatatggtataaaagataaaataagttttaatagaatcacttatgaatcataccttccatttgtttattggaaaaatttggatattcaaaataagttacctattgtgataaatagtagaacatatgataaagaaactatcaaaaactcaagattaggttttagttataactctaaactattagaaccattggaggtaaaactttatccattattcaatccacaaagcgataaagggtctatatcttttcctgaagagatgtttgcaataaacgctaaaagtgccattgtatatgattatgataatggtatatcaaaagagttgagcgatcaattaaacagccttttaaaaatacaaaacttcaattaccctgccttaaatatatggggaaaatctacaaatatgaaaccttatgataaaggttatttaatactagatagtaaacaaaatctatttaatctcaaacggtataataataaatttgtagtttcaaaagtacaatatcccaaaagtatatctttagcatttataagattatcagaaaataaacaacgaatcctttctggatatgctatagatactcaaagtaacttttatctttag

SEQ ID NO: 7898 - protein, 247 aa, Unknown
  Obtained from environmental sample
  misc_feature (1)..(247): Xaa is any amino acid
MYCLVCLLLLFQQYKKNYSHEFNKYYIFYSNILNDFVYQKNFGEHQFEYGIKDKISFNRITYESYLPFVYWKNLDIQNKLPIVINSRTYDKETIKNSRLGFSYNSKLLEPLEVKLYPLFNPQSDKGSISFPEEMFAINAKSAIVYDYDNGISKELSDQLNSLLKIQNFNYPALNIWGKSTNMKPYDKGYLILDSKQNLFNLKRYNNKFVVSKVQYPKSISLAFIRLSENKQRILSGYAIDTQSNFYL

SEQ ID NO: 7899 - DNA, 528 bp, Unknown
  Obtained from environmental sample
  misc_feature (1)..(528): n is a, c, g, or t
atgtttaatgttgcagataaaataaaaaataaacaaagtatagatattattaatattaataaatgtattgatgaaattgttaatgagattaacaaatataaatcaagtattgaaaaaatgtcattggaaatggaagatgtgttaaatgagattggtgttttaactaatgataaaaatgacgtggagaaacgaaaaaatcttcaagttacgtttgatcaaattccaataaaaattcaaaatgaagatttgaaaattaatctactgaaacagaaaaaatataattatgaaaatagtttaaaacaaatcgaaagcaacaaaaaaactgaaagtcttattgttgaaggtaaggggaggttgagggttctcgaagatgaaatggaaaatgaaaagaatataatcttcatgaaaaaaaataatgtttctgaaaaagaaaatataatattaaacaacacgcagttaattaaagatttcaaatctcaagaatatcgtgatagtgttattggtttatataaaagaatgtgtacatag

SEQ ID NO: 7900 - protein, 175 aa, Unknown
  Obtained from environmental sample
  misc_feature (1)..(175): Xaa is any amino acid
MFNVADKIKNKQSIDIININKCIDEIVNEINKYKSSIEKMSLEMEDVLNEIGVLTNDKNDVEKRKNLQVTFDQIPIKIQNEDLKINLLKQKKYNYENSLKQIESNKKTESLIVEGKGRLRVLEDEMENEKNIIFMKKNNVSEKENIILNNTQLIKDFKSQEYRDSVIGLYKRMCT

SEQ ID NO: 7901 - DNA, 858 bp, Unknown
  Obtained from environmental sample
  misc_feature (1)..(858): n is a, c, g, or t
atggtcagtcacacatattataagttaaaagattttctaggtgattatagtatggtcggagacatccatttgcaacaatatttagatgaagctaaaacaaaagcatactgcggaagcttaataagtcaagatgtttcagaaggagatgataattttcatggctatttgttatgggatattaaaaataaggatgttaaagaaataccaatatataatgaatattcatttaaaaacgttaaattatcaccttatactgattttgatgatttagatttcgaaatagataaacctactaaatatatgaaaattaggtttatatggaacactttacctcaaacaagaacaaaagatgctgaaagaaaagttattgagtatataaaatctaattataagaatattactatttctcataaaaatgattttattgaagatgagaagattgagataagggaaaatgttacattaaaaaatattacagataaaactgttcaacatgaaatttttaaagaatatttaactaaaatcggaagtgacgagaagttaataaatgatgttcttgaacttgacgaagagatattaaaagaaatagatattgaagctattgttaacattngaatggatgtcataaaatttggtgtagaaaatttcatgtcatatgaaaattttgatattgattggagaaatatggatggcatgttttcaataaatggaaagaataccgcaggaaaaacaacaatatttaaagcattatcatacctaccattttggaaaacattagaaactgaaaataggggggaagtatgggtgaattgccaatttgtaacaataaaaacgatgcaaaaatattgtaatgggtaa

SEQ ID NO: 7902 - protein, 285 aa, Unknown
  Obtained from environmental sample
  misc_feature (1)..(285): Xaa is any amino acid
MVSHTYYKLKDFLGDYSMVGDIHLQQYLDEAKTKAYCGSLISQDVSEGDDNFHGYLLWDIKNKDVKEIPIYNEYSFKNVKLSPYTDFDDLDFEIDKPTKYMKIRFIWNTLPQTRTKDAERKVIEYIKSNYKNITISHKNDFIEDEKIEIRENVTLKNITDKTVQHEIFKEYLTKIGSDEKLINDVLELDEEILKEIDIEAIVNIXMDVIKFGVENFMSYENFDIDWRNMDGMFSINGKNTAGKTTIFKALSYLPFWKTLETENRGEVWVNCQFVTIKTMQKYCNG

SEQ ID NO: 7903 - DNA, 339 bp, Unknown
  Obtained from environmental sample
  misc_feature (1)..(339): n is a, c, g, or t
gtgagggtgtatatgttatctatattttttgaaggactactattaggttttggtgcggctgttcctttaggtccgataaatttactaattatgaatgaagcattaaagagttataaaaaagcagtaacaattgggtttggtgctatgagtgctgatattacctatttgataatgatcctttatggtattacaacattttttaaagataagttcatattaaatttattatctactttaggtggattttttctaatatttttagcatacctgatttttaaaggaagaaataaaaaaaatcataaagttaaaatagagaaaaaaactctcagccgaatctga

SEQ ID NO: 7904 - protein, 112 aa, Unknown
  Obtained from environmental sample
  misc_feature (1)..(112): Xaa is any amino acid
MRVYMLSIFFEGLLLGFGAAVPLGPINLLIMNEALKSYKKAVTIGFGAMSADITYLIMILYGITTFFKDKFILNLLSTLGGFFLIFLAYLIFKGRNKKNHKVKIEKKTLSRI

SEQ ID NO: 7905 - DNA, 492 bp, Unknown
  Obtained from environmental sample
  misc_feature (1)..(492): n is a, c, g, or t
atggttttggtatttcaaaactatccattcttcccacatcttaatattgcaaaaaatatagcatttggtattagtggcaaatctagccaattcaaaaaagagagagttatacaacttcttacgttgatgaatatgtctggtatggaaaataagtatcctcatcaaattagcggcgacaaacagcagcgcattgccatggcaagagttttagcaagagatagtgaacttattttatttgatgaagctttctcaagcatagactctacactaaaatcaaaaattatgacggagataaaagagattataaaatcaaatcataaaacagcaatctttgttacacactgcccaaaagaggcatttgaactaagtgataagatcgcatacatagaaaatggagaaattatccaatacgatacaccagtaaatatatgtaaaaacccatcaacagaatcaatatcaaaagtattttcagaatgtgggatacttttataa

SEQ ID NO: 7906 - protein, 163 aa, Unknown
  Obtained from environmental sample
  DOMAIN (1)...(132): ABC transporter
  misc_feature (1)..(163): Xaa is any amino acid
MVLVFQNYPFFPHLNIAKNIAFGISGKSSQFKKERVIQLLTLMNMSGMENKYPHQISGDKQQRIAMARVLARDSELILFDEAFSSIDSTLKSKIMTEIKEIIKSNHKTAIFVTHCPKEAFELSDKIAYIENGEIIQYDTPVNICKNPSTESISKVFSECGILL

SEQ ID NO: 7907 - DNA, 429 bp, Unknown
  Obtained from environmental sample
  misc_feature (1)..(429): n is a, c, g, or t
atgaaaaaatcaagtttattactactaataacttttgttgtagtattgtttcaagggtgtagttcaaaaaaatattatgaaccagaagtggtttatgatagtaatattgctgtatatgatttaggttctaaaataactaatattaatagtgatggtgctacacttgatgatggaaaatttgtctctaaagagggattatcaagtgaatttttagaagaggggtacacttttcttaataaaaacaatggcgtattactctcaacaaatgatgagtcttttttagcaataacaaaagatgggcatactgaaaaaatacaatttgataaaaatattgtttctgcaacaattgaagataatcttgtagctatgagttttattgataactctatctctttatttgaaataaaagaaaaaaaagtggttttttaa

SEQ ID NO: 7908 - protein, 142 aa, Unknown
  Obtained from environmental sample
  SIGNAL (1)...(19)
  misc_feature (1)..(142): Xaa is any amino acid
MKKSSLLLLITFVVVLFQGCSSKKYYEPEVVYDSNIAVYDLGSKITNINSDGATLDDGKFVSKEGLSSEFLEEGYTFLNKNNGVLLSTNDESFLAITKDGHTEKIQFDKNIVSATIEDNLVAMSFIDNSISLFEIKEKKVVF

SEQ ID NO: 7909 - DNA, 435 bp, Unknown
  Obtained from environmental sample
  misc_feature (1)..(435): n is a, c, g, or t
atgccaagggtactttttttattatgccaccggggtaaggagttaagtgaacctttttcaaaattaaaaaaaaatgatatagaggatactcttataaaaatactctatgctaaaggctccaaacaaagagtcgtccctattgcacaaacagcacttgatgctctttataaatatcttaacacaagaaaaataaaaagtaattatctttttattaactataaaggggagccaatcagtagaatctccgtttataaaatcacaaaaaaatactttaatgtatctcctcatgtatttagacactcttatgctacaagtttaatacttgggggtgctgatttgatggtagtaagtgaacttttaggacatacaaatatagagacaacacagatatatacccatatcaacaacaacatctcaacgctcgagccgatctga

SEQ ID NO: 7910 - protein, 144 aa, Unknown
  Obtained from environmental sample
  DOMAIN (1)...(141): Phage integrase family
  misc_feature (1)..(144): Xaa is any amino acid
MPRVLFLLCHRGKELSEPFSKLKKNDIEDTLIKILYAKGSKQRVVPIAQTALDALYKYLNTRKIKSNYLFINYKGEPISRISVYKITKKYFNVSPHVFRHSYATSLILGGADLMVVSELLGHTNIETTQIYTHINNNISTLEPI

SEQ ID NO: 7911 - DNA, 375 bp, Unknown
  Obtained from environmental sample
  misc_feature (1)..(375): n is a, c, g, or t
gtgaatatgtccaaagagttatcaacacactcactaagtagtacattttcacatatttacgtggaaaaaagagttttagatcatgagaaaacaaaagatattttaaaaaagtttaaaaattctcatatcatcatgatagatcactataaagatatttttaaccgttcacaccaaagtttttcagagcagtctcttagtaaaaatcttattttagctgcgagagatgagaactttttaatagaaggctcatattttagtgatggttttgagtatgaaaacttcttctacacaccatcgattttagggtgtctgtatgattgtgattactgttactacaaggcatgtacaactctgccaaacgtgtcatttttgtaa

SEQ ID NO: 7912 - protein, 124 aa, Unknown
  Obtained from environmental sample
  misc_feature (1)..(124): Xaa is any amino acid
MNMSKELSTHSLSSTFSHIYVEKRVLDHEKTKDILKKFKNSHIIMIDHYKDIFNRSHQSFSEQSLSKNLILAARDENFLIEGSYFSDGFEYENFFYTPSILGCLYDCDYCYYKACTTLPNVSFL

SEQ ID NO: 7913 - DNA, 786 bp, Unknown
  Obtained from environmental sample
  misc_feature (1)..(786): n is a, c, g, or t
ttgagaagatcagagtctcaaacaaaatctatggagaatatgaatgttattttggaagaaaaagttcttaaaaagacggcagctctaaatgaaaaaaatattcaactccagcgagcacaagagcttagttcataccttttagattcacaaaaaaactttatacgacatgccgtccatgaaacaaatactccgctatctgtgattttggcaaatatagagttgtatgagcttgaaaatggaaaaaataggtatctctcaaaagtagaggttgcggttaaaaatatctttagcatatatgatgacttaagttatttagtgaaaaaaaatcaagttgattatccaaaaagagagatagactttgttgagtatttaagaagcagaatcgatttttttaaagaggttgccgatcaaaaagatctaaaatttgtctacaacactaactctgataatgcactcataaagtttaatgagacaaaactacaaagagtaatagataataacatcacaaatgcaattaaatatacatcctcgcacaagagtatatatgtctatctgaaaaaaactcctaaacatctatactttataatatccagccaatcttctcaaattgtagatacaaaaagaatctttgatgagtactatagagaaaaaacacaacagcagggttttggtttaggtcttaacttggtaaaatccatttgtgatgaggaaaatgtcgatatagagacactctcagatgatagtgagacgaagtttatctataggtttaggttgaaagagtcatga

SEQ ID NO: 7914 - protein, 261 aa, Unknown
  Obtained from environmental sample
  DOMAIN (49)...(111): His Kinase A (phosphoacceptor) domain
  misc_feature (1)..(261): Xaa is any amino acid
MRRSESQTKSMENMNVILEEKVLKKTAALNEKNIQLQRAQELSSYLLDSQKNFIRHAVHETNTPLSVILANIELYELENGKNRYLSKVEVAVKNIFSIYDDLSYLVKKNQVDYPKREIDFVEYLRSRIDFFKEVADQKDLKFVYNTNSDNALIKFNETKLQRVIDNNITNAIKYTSSHKSIYVYLKKTPKHLYFIISSQSSQIVDTKRIFDEYYREKTQQQGFGLGLNLVKSICDEENVDIETLSDDSETKFIYRFRLKES

SEQ ID NO: 7915 - DNA, 675 bp, Unknown
  Obtained from environmental sample
  misc_feature (1)..(675): n is a, c, g, or t
atgataattttctactatttcaaacgtaatcagcaacaggtaaatatgattgtccaattaaaaaatactattgatcagacgactctggtatccaaaacagacctcaaaggaagaattacatatgtaaatgatgcttttgttaaactctcaggttatactcaagaggagctattaggtaaaccccataataaagttagacatcctgatatgccatcatctgtatttaaagagatgtggagcactattaagaataagaagatttggcatggtgtagttaaaaatatgaaaaaaaatggaggttcttattcggttgatgcaactataattccgattttaaatgtcaataaagagatagatgaatttatcgctatcagacatgatataactgaactggcaaatattaaagagcacctttccaaagagctaaatatctcaaataaaaacttttcagaagcatacaggcgttcaaaagagtacgaaaaagctattgatgagagtaatattttatctcgtaccgatactgatggaattatcacttatgttaatcaaaaattttgtgatgttacaggctattccaaagaggagttattggggaaaaatcactctattgtgagacatcctgacacaccaaattcactatttaaagatttatgggatactattattgccggntaa

SEQ ID NO: 7916 - protein, 224 aa, Unknown
  Obtained from environmental sample
  DOMAIN (89)...(131): PAC motif
  misc_feature (1)..(224): Xaa is any amino acid
MIIFYYFKRNQQQVNMIVQLKNTIDQTTLVSKTDLKGRITYVNDAFVKLSGYTQEELLGKPHNKVRHPDMPSSVFKEMWSTIKNKKIWHGVVKNMKKNGGSYSVDATIIPILNVNKEIDEFIAIRHDITELANIKEHLSKELNISNKNFSEAYRRSKEYEKAIDESNILSRTDTDGIITYVNQKFCDVTGYSKEELLGKNHSIVRHPDTPNSLFKDLWDTIIAG

SEQ ID NO: 7917 - DNA, 864 bp, Unknown
  Obtained from environmental sample
  misc_feature (1)..(864): n is a, c, g, or t
atgggtagctcagttggatattctccaattgcagttaaaaatgagggtgcaaaacatgaatttgactctattagaggtatgcttgaggatattgctatttttatcattaacttaaaagagttaagatttaaaataaaaggtggacaagagcaaattgaagtagaatactcatttagtaatgcacaagagataaaagcttcaagtttagaaaatgacgatattgaagttattaacaaagatcatcacttagctacaattaatagtgattgtacactaaacttttctgtaattatacaaaaaggtattggatatgttccaagtgaagatttaagagatttagtaccagctgattatatccctgttgatgctttctttacaccagtaaaaaaagtaacatatgatatagaaaaaatcttagtagaagataaccctaactatgaaaaagctgtatttacagttgaaacagatgggcaaatttctcctattgatgcatttaaagaagctgtaagtacaatgtactctcaaatgtcagtatttaataaagtatttgacttagcggaagtaaaattagtagaatcaaatgcaactgagagttcgatagatttaaaagatttaattgtaaaaattgatgatttaaatttaagtgctagaagttttaattcactagatagagctggaattaaatatgtaggtgatttagcacttatgagtgaagttgaagtaaaaagtatcaaaaacttaggaaaaaaatctttagaagagatttctgataagtttgctgagataggttatccaatagatagtagccttcctgaagatacagcatcagctttaagaaaaaaattagagcaaataaaagcttaa

SEQ ID NO: 7918 - protein, 287 aa, Unknown
  Obtained from environmental sample
  DOMAIN (70)...(181): RNA polymerase Rpb3/Rpb11 dimerisation domain
  misc_feature (1)..(287): Xaa is any amino acid
MGSSVGYSPIAVKNEGAKHEFDSIRGMLEDIAIFIINLKELRFKIKGGQEQIEVEYSFSNAQEIKASSLENDDIEVINKDHHLATINSDCTLNFSVIIQKGIGYVPSEDLRDLVPADYIPVDAFFTPVKKVTYDIEKILVEDNPNYEKAVFTVETDGQISPIDAFKEAVSTMYSQMSVFNKVFDLAEVKLVESNATESSIDLKDLIVKIDDLNLSARSFNSLDRAGIKYVGDLALMSEVEVKSIKNLGKKSLEEISDKFAEIGYPIDSSLPEDTASALRKKLEQIKA

SEQ ID NO: 7919 - DNA, 684 bp, Unknown
  Obtained from environmental sample
  misc_feature (1)..(684): n is a, c, g, or t
atgccatacaatgaaaagttagtaaaaagtaaattagcaaaactgtatgaaaaagagggaactctttataataaaggtagaaaatataatttagcattacaatcatatactaaagctgtagcgtttggaactacggaacttgaaaaaaagatagttgatattaaaaaaattttacaacatcaaaaaaatctaaaaaatgatactagaaaagtagtcaatcaaaactcaccaatatggacaaaagcaattggaagattggtaataccaacaagaataaagatggctacaaatagtgggtataaagtagatataaaaaaatgttccgctactttagtgaattttgaagagttacatagttcaaaaattattgttacagcatctcattgtttaactaagtttgataaaagtgttggtttattgagatttcttattaaatcaaaagagaataaaatcatacaaaaatatgcaactatatataaagacagtaattttgacccaaaattgaaaaaagcaagtgactttgcaatacttatattaagctcaccaatatcaaaagaggaagtggaacctgttaaagtggttgaaaaaagtttcaataagttacaagaggaatacaagtatcccttttgcatcgttaggcaggtttttcaagttgaaattggtgaattttgggactcaatttaa

SEQ ID NO: 7920 - protein, 227 aa, Unknown
  Obtained from environmental sample
  misc_feature (1)..(227): Xaa is any amino acid
MPYNEKLVKSKLAKLYEKEGTLYNKGRKYNLALQSYTKAVAFGTTELEKKIVDIKKILQHQKNLKNDTRKVVNQNSPIWTKAIGRLVIPTRIKMATNSGYKVDIKKCSATLVNFEELHSSKIIVTASHCLTKFDKSVGLLRFLIKSKENKIIQKYATIYKDSNFDPKLKKASDFAILILSSPISKEEVEPVKVVEKSFNKLQEEYKYPFCIVRQVFQVEIGEFWDSI

SEQ ID NO: 7921 - DNA, 561 bp, Unknown
  Obtained from environmental sample
  misc_feature (1)..(561): n is a, c, g, or t
ttgcggcctgacggtctagttcggtggcccgctggttatgcaaacgttatacggcttaaggaaaatcaaatggaaacaatcagaactcatttgctggatgcctcagctttagtaaagctcttcataaatgaagatggtagcgatacactcaaagagtattttaattcgaggtcagttttctggacaacatcgctttgttttgctgaggtattaggtgttttgaaaagaaaatatgtaagcaataaagaggacttaaccgaggaggaatacctcgcggcatctgaagatatggtagctcatattcgcaacggcactatatccgttgaagaagttgacatcacgaagctcgaaatcttcaatgaagtagaaaagattgttgagaaatactcaattgatttagcagatgcctttcagatagtttctttaaaaaaaggatttccttcttctttaagcggggattcaaaaacaatacttattactgctgataaagacttggctgaatcatctgaaagcgaaaggtttgcgtgtatggaactgtctttgaaagtgaagcaccaatga

SEQ ID NO: 7922 - protein, 186 aa, Unknown
  Obtained from environmental sample
  misc_feature (1)..(186): Xaa is any amino acid
MRPDGLVRWPAGYANVIRLKENQMETIRTHLLDASALVKLFINEDGSDTLKEYFNSRSVFWTTSLCFAEVLGVLKRKYVSNKEDLTEEEYLAASEDMVAHIRNGTISVEEVDITKLEIFNEVEKIVEKYSIDLADAFQIVSLKKGFPSSLSGDSKTILITADKDLAESSESERFACMELSLKVKHQ

SEQ ID NO: 7923 - DNA, 387 bp, Unknown
  Obtained from environmental sample
  misc_feature (1)..(387): n is a, c, g, or t
atgcttaaaaaaataaatataaaacagaaagaactaactcctttagtatgtgtagataaaaaaaacactaagctagtttttaaaggagtttgcgtgccagagaatacttatgagttttttaaccccatatttaaatggatagatgcgtacagtttaaacccaataaaagaatttaaatttcaatttgagttagattattttaatacatcatcatcaagaatgattttagagttaatgaaaagaattcagaaaatcccaaaccaatatatagagtggttgttattcgaagatgatgaagatattaatgaagtggttaatgattataatgaattactgggaggcggaataattattaaaattaaacatagagattttgcagtatcgtaa

SEQ ID NO: 7924 - protein, 128 aa, Unknown
  Obtained from environmental sample
  misc_feature (1)..(128): Xaa is any amino acid
MLKKINIKQKELTPLVCVDKKNTKLVFKGVCVPENTYEFFNPIFKWIDAYSLNPIKEFKFQFELDYFNTSSSRMILELMKRIQKIPNQYIEWLLFEDDEDINEVVNDYNELLGGGIIIKIKHRDFAVS

SEQ ID NO: 7925 - DNA, 546 bp, Unknown
  Obtained from environmental sample
  misc_feature (1)..(546): n is a, c, g, or t
atgagtgaagaaatactaatagcgttaatgaggctttttgccatcatctctaaacaagatgaagaattgagcaacgacaaaattgaatttgttcgctctttcttaaaacatcaattaagtgaggaaaaagtagaagagtattttctactttttgaagaacatcttaatgataataaatctgctaaagatgatgaggataaaaaaagaacttctgtaaccgactcggttaggattcttggtatctgtaaacgtattggtaaatctttaacgcaacaacaaaaaataattgtaatagttcgtttgtttgagctaataaatacagatagaaaattctctaaagaacaaatagaaaatatcgatactgcttcnaaggtgtttaagattaatgaagtggaatataagtcgatagaaaattttgtagtaaataatgactgttatcaaaatgaccatgaaaatctttttagcatttgccacgaaaatgtaccacaaaccccttccaacatttttaaatacaaaaattttattaggggttggttttggtattag

SEQ ID NO: 7926 - protein, 181 aa, Unknown
  Obtained from environmental sample
  misc_feature (1)..(181): Xaa is any amino acid
MSEEILIALMRLFAIISKQDEELSNDKIEFVRSFLKHQLSEEKVEEYFLLFEEHLNDNKSAKDDEDKKRTSVTDSVRILGICKRIGKSLTQQQKIIVIVRLFELINTDRKFSKEQIENIDTASKVFKINEVEYKSIENFVVNNDCYQNDHENLFSICHENVPQTPSNIFKYKNFIRGWFWY

SEQ ID NO: 7927 - DNA, 861 bp, Unknown
  Obtained from environmental sample
  misc_feature (1)..(861): n is a, c, g, or t
atgctgataggcgccttagaaaattggccgaagaagagggtcgttttagcaatgcaagatattgaaaacatagaagataaaaattattttgaaaaagaattagcaattaagtcagagttgggttctgaaattcaagttgccaaagttgaagaagataaaatagcagaagataatttagaatttagaataaaagaaattgaatcggcaattgaaaatgctagtgatgatattacgaaaaaacgttttaaaaagaaattattaatattagaagggaaaaaaaatattaagaaggtagagcttttaaaaaataaattaaatactttcattgatttagaagaaagttttttattttctaatatggaaaacttttctgagaaagagaaagctttattcttggaattaatacaagctgattttttgccaaatgattttgtgaaatctttgaaaaaccaaggttttgcagggcgtgcgttaacagaagggaaaacaagttttaaggaatatctaaaatttcaattatttggtttaagtcctagctataaaagtattgttgctgcagataaattaggtcagagagagattgactcagggattgatatttatggtatggataaaattgcgagtgattcttgggccgcagcgcatggctggggaaaagaatttttagattctgaattagataacttagaattaggagaattattaaaatatcttagccactatgaagtgaatgctttgtctaatggcattgatttaaataagagtgaatattttcaaaaagtattaagcattatttcagataaattagatattgctagagaaaaggaagaaaaaactttagaaagtttgaattatatttag

SEQ ID NO: 7928 - protein, 286 aa, Unknown
  Obtained from environmental sample
  misc_feature (1)..(286): Xaa is any amino acid
MLIGALENWPKKRVVLAMQDIENIEDKNYFEKELAIKSELGSEIQVAKVEEDKIAEDNLEFRIKEIESAIENASDDITKKRFKKKLLILEGKKNIKKVELLKNKLNTFIDLEESFLFSNMENFSEKEKALFLELIQADFLPNDFVKSLKNQGFAGRALTEGKTSFKEYLKFQLFGLSPSYKSIVAADKLGQREIDSGIDIYGMDKIASDSWAAAHGWGKEFLDSELDNLELGELLKYLSHYEVNALSNGIDLNKSEYFQKVLSIISDKLDIAREKEEKTLESLNYI

SEQ ID NO: 7929 - DNA, 498 bp, Unknown
  Obtained from environmental sample
  misc_feature (1)..(498): n is a, c, g, or t
ttgcaaggtgatcttaataaaattggatcattcctaaaacatagtcctaaatttcaatctaatattaaaacaggaatcagagctctactgaaatattatttacatgtagataattataagatagagcaagaggccaaagcggtaaaaataccgtctgacttgattggatctaaaataacagactattacatcgataaattcgaaagctggttagagaattttcatattaaaagtaacggtgagagattcagatctgccaaaaactattcaattgggttaaaaagagctattacagatttaaatattgatccgaaagaattcttttcatatacaagaaagtttcaaattgaaatgtttcatgtacgcctagagagcaataaaaatttctgggaccgatcagaatcagttaaacgtgaagtaacaagcagtataaataagtacaaatatttcatcgcagagaaaaacggtgaaaaacaagaaagcttatttagcgtatag

SEQ ID NO: 7930 - protein, 165 aa, Unknown
  Obtained from environmental sample
  misc_feature (1)..(165): Xaa is any amino acid
MQGDLNKIGSFLKHSPKFQSNIKTGIRALLKYYLHVDNYKIEQEAKAVKIPSDLIGSKITDYYIDKFESWLENFHIKSNGERFRSAKNYSIGLKRAITDLNIDPKEFFSYTRKFQIEMFHVRLESNKNFWDRSESVKREVTSSINKYKYFIAEKNGEKQESLFSV

SEQ ID NO: 7931 - DNA, 681 bp, Unknown
  Obtained from environmental sample
  misc_feature (1)..(681): n is a, c, g, or t
atggatattaatccattatctgagtatgtacctgatgctttttcaggaaggcagtattactctcagtttggcagggtagaagaatctaaaattttatttgacaggattgagagtcgttacagaactacccgttttatagattttctccctttttggaaaggtgtaattgagtttaaagaagagaactgggaaaattcttcaacttattttttattattcctggaaaataatccttcttcattaattaaagaagcctatctttacagggcaaaagctgaatactctcttggaaatatgaaatcagctatatttattatggataaatggtttgaactaacagaagattattatagtgatccctatgctcttactttttatcttactcttcaggaaaaaaatgaagagtatgaacatgtaataaagttaataaacaacatagaaaaaaatcaatataaaatatcctggatggaaaagttatatttaattcatgcagaaagtctttataagtccggacatattttagatgcagaaatatattataaaaagattcttagtgcagatccggatttagcttccattggttttattcgattgttttcaatttataaaaatgatactgagttacagaaagatatctttgataatgcacagcttcagctatcaggtcatccagctatgtaa

SEQ ID NO: 7932 - protein, 226 aa, Unknown
  Obtained from environmental sample
  misc_feature (1)..(226): Xaa is any amino acid
MDINPLSEYVPDAFSGRQYYSQFGRVEESKILFDRIESRYRTTRFIDFLPFWKGVIEFKEENWENSSTYFLLFLENNPSSLIKEAYLYRAKAEYSLGNMKSAIFIMDKWFELTEDYYSDPYALTFYLTLQEKNEEYEHVIKLINNIEKNQYKISWMEKLYLIHAESLYKSGHILDAEIYYKKILSADPDLASIGFIRLFSIYKNDTELQKDIFDNAQLQLSGHPAM

SEQ ID NO: 7933 - DNA, 594 bp, Unknown
  Obtained from environmental sample
  misc_feature (1)..(594): n is a, c, g, or t
ttgtgggatataattatgggaaataaaaaaattatcaatataccacttggaagtcaacatatctcacttttagagcctgtaaagtttaaatttgcttgtgaaaatgaaaaaatcatagaagtagatagtgatgtgggttttgtacatagggggattgaaaaggcgtgtaccacaaagtttaattttgatgcagtaccttatgttgtcgctcgaatttgtggactttgtgctattacacactcactttgttatacaacagctgtggagagtttactagagggggaagtgacacaaaaagcaaaatatcttcgtatcttacttgtagaacttgaccgtatccactctcatatgttgtgtttatctcatacagcagaaaatgcaggatttgaagctatgtttatgcaaatcatgggtgatagagaatatgtgatggacttgcaagaaaaaatttcaggaaatagggtgcaatttgactatgtaagtattggaggggtaaatcgtgatattaccacagatattatcaaagatataaaaacaaatcttaaactaataaaatcaaaagtagatgaatatatcgatgagtttacaaattaa

SEQ ID NO: 7934 - protein, 197 aa, Unknown
  Obtained from environmental sample
  misc_feature (1)..(197): Xaa is any amino acid
MWDIIMGNKKIINIPLGSQHISLLEPVKFKFACENEKIIEVDSDVGFVHRGIEKACTTKFNFDAVPYVVARICGLCAITHSLCYTTAVESLLEGEVTQKAKYLRILLVELDRIHSHMLCLSHTAENAGFEAMFMQIMGDREYVMDLQEKISGNRVQFDYVSIGGVNRDITTDIIKDIKTNLKLIKSKVDEYIDEFTN

SEQ ID NO: 7935 - DNA, 396 bp, Unknown
  Obtained from environmental sample
  misc_feature (1)..(396): n is a, c, g, or t
atggatataaaattaataaattcaaattttttaaaaatagaagctgaaagaaatccagatttttcaggaaaattaaaattaaaaacaaatattaatataaaatcagtagaaaaattagaaaaatcaaaagatatactaaaggtatcatatatctatgaaataaattatttagacctaggaaaaattataataacaggaaatctctttctaaaaggagacggaaaaacaataaaaaacataataaaaaaacaagaagaaaaagattataatagtgaagaaacgatactaataatgaacctaataatacaaaaagcttcacttcgagctcttcaaatagaagaagaattaggtttgccaattcatattaagttaccatctttatctacgaaaaagtaa

SEQ ID NO: 7936 - protein, 131 aa, Unknown
  Obtained from environmental sample
  misc_feature (1)..(131): Xaa is any amino acid
MDIKLINSNFLKIEAERNPDFSGKLKLKTNINIKSVEKLEKSKDILKVSYIYEINYLDLGKIIITGNLFLKGDGKTIKNIIKKQEEKDYNSEETILIMNLIIQKASLRALQIEEELGLPIHIKLPSLSTKK

SEQ ID NO: 7937 - DNA, 708 bp, Unknown
  Obtained from environmental sample
  misc_feature (1)..(708): n is a, c, g, or t
ttggctttgaaaaatatgtttttacaacaatcaaaactagcaaaaacagagagatggataggtaatattgcacatcaattagacaaaccattaataaatatctcttatatacttatgaacctaagaaaaaagttttcaaacaataaactagaggaatcatattttaataaaaaaacaaatcaaatagataaacaattacaatttctttcaacgacaatagaccattttaaagagttttatacaccatcaaagaaatntgaaacatttatgttaaaagaagctatcaataatagtattagcattttaagtgctgaactaaaaagaaaaaatattacactatcttgtgagtttaaaattaatgaaaatgtaaaaattgaggggataaaaaatgaactatctcaagtaatcttatctattcttaccaatgcttctgatgctcttagtaatattgaatctccacatattgatatagttgtacatagtaatgaagcagaagtaattattgatataaaaaacaatggaaaacagatagaaaaacaaaacatagataaaatatttgaaccatatttttcaactaaaagtgatggtactggtattgggttatacttgtctaaaattatattagaaaaaagttttcgtggagatatcaaagtaaaaaatattgaggaaggggttgtatttaccctcctcttagaaaaaactatttaa

SEQ ID NO: 7938 - protein, 235 aa, Unknown
  Obtained from environmental sample
  DOMAIN (127)...(234): Histidine kinase-, DNA gyrase B-, and HSP90-like ATPase
  misc_feature (1)..(235): Xaa is any amino acid
MALKNMFLQQSKLAKTERWIGNIAHQLDKPLINISYILMNLRKKFSNNKLEESYFNKKTNQIDKQLQFLSTTIDHFKEFYTPSKKXETFMLKEAINNSISILSAELKRKNITLSCEFKINENVKIEGIKNELSQVILSILTNASDALSNIESPHIDIVVHSNEAEVIIDIKNNGKQIEKQNIDKIFEPYFSTKSDGTGIGLYLSKIILEKSFRGDIKVKNIEEGVVFTLLLEKTI

SEQ ID NO: 7939 - DNA, 744 bp, Unknown
  Obtained from environmental sample
  misc_feature (1)..(744): n is a, c, g, or t
atgaaaagatggatatgggagcatgatgagtatcccaattttacttacgacataaaaaaactagctccacttatagagaaagtatcacaagaacaaggctatctaatagcaatgacaaaagttatgaatcaagataacattgatttaacacaattagacgcactgatgagtgaagctataagtacaagtgcaattgagggtgaaatactaaatcgagatagtgtaaaagcatccattaaaagaaaacttggatttgaagatgtagagcttagtaaaattgatagagatacagattatttagtagaagtattaattgatgcaaatagcaattatgatactgaattaacaaaagagcgattatttggttggcacaatgcactttttccaaaaggttatagtggtttaataaaaataaatgttgcaacctttagaggggaagagactatggaaatagtatcaggaagtgcaggaaaagagaaaacttattatatagcaccacctagagaaaagttagaagatgagatggatagatttttgcagtggtttaatacaacagaagcaagtttaataaaagcagctatcactcacctttggtttgtaataatacatccctttgatgatggaaacggcagaatcacaagagctataacagatttgagtttatctaaaatagaaaattcaaaaatctcaaaattatactcaatgtctagtgcaattaatgctgatagaaagaggttattatag

SEQ ID NO: 7940 - protein, 247 aa, Unknown
  Obtained from environmental sample
  DOMAIN (120)...(244): Fic protein family
  misc_feature (1)..(247): Xaa is any amino acid
MKRWIWEHDEYPNFTYDIKKLAPLIEKVSQEQGYLIAMTKVMNQDNIDLTQLDALMSEAISTSAIEGEILNRDSVKASIKRKLGFEDVELSKIDRDTDYLVEVLIDANSNYDTELTKERLFGWHNALFPKGYSGLIKINVATFRGEETMEIVSGSAGKEKTYYIAPPREKLEDEMDRFLQWFNTTEASLIKAAITHLWFVIIHPFDDGNGRITRAITDLSLSKIENSKISKLYSMSSAINADRKRLL

SEQ ID NO: 7941 - DNA, 741 bp, Unknown
  Obtained from environmental sample
  misc_feature (1)..(741): n is a, c, g, or t
atgacattaaatctatcacaagtagaacaagatagtacgaattatggttatgggcacttaatgctcaagggattgaatatcccctttaccggtgaattagttattaataatgaaggaattgatacttttcttagattgattgaattaaaggagtatttacctatacctgtaaggataacaagtaatagtggaacgatagattcttataacgaaataggaggctggagaattgatcttgataatcaagagcatatttcagcgagtaccttaaaaactataaaaactgaagaaagattatatgaagagtttaaaaaaacactggctcgagcagatgaatatgttgggattgaggatgaagagtctaaagaagtaccttacattcattcagctagaacatccgcaagtgatatagtggcggatatgaaatggaatttgaggaaagatgatatcattaatgaaaacaaaattacttatgataatgatgatatcgaaattattcttgatgattttgaaaaatatgtgattagttatgataatggtatttttacaggggaaatgaaatattatgactacaacaaaattactaaagaatcccttatcgtgaactcaaatgatctatcggtagataaatatattgatacgaaaagtgataatattgataatttaaattctaaacatctagtaaagaacgaatattggacaaatggaaatttaaaaatccaaggacttataaatttatga

SEQ ID NO: 7942 - protein, 246 aa, Unknown
  Obtained from environmental sample
  misc_feature (1)..(246): Xaa is any amino acid
MTLNLSQVEQDSTNYGYGHLMLKGLNIPFTGELVINNEGIDTFLRLIELKEYLPIPVRITSNSGTIDSYNEIGGWRIDLDNQEHISASTLKTIKTEERLYEEFKKTLARADEYVGIEDEESKEVPYIHSARTSASDIVADMKWNLRKDDIINENKITYDNDDIEIILDDFEKYVISYDNGIFTGEMKYYDYNKITKESLIVNSNDLSVDKYIDTKSDNIDNLNSKHLVKNEYWTNGNLKIQGLINL

SEQ ID NO: 7943 - DNA, 363 bp, Unknown
  Obtained from environmental sample
  misc_feature (1)..(363): n is a, c, g, or t
atgccggctatccttgacggaaacgtcgttctcgaaatgagaaacattgttaagcaattccccaaagttctagccaacaacaatatcaatatcaaacttcatgaaggcgagattctttcgctgcttggtgaaaacggagcaggaaaatcaaccctgatgaatgttctctacggtctctataaaccgacatccggtgatatatttctgaatggtgaaaaagtagttttttcctccccgaaagatgcaatcgcaaagggcctgggtatggttcatcagcattttatgcttgttgataccctcacagttactgaaaatataattctttggaagcgaacccggtcgcgccggtgtcatcaactataa

SEQ ID NO: 7944 - protein, 120 aa, Unknown
  Obtained from environmental sample
  misc_feature (1)..(120): Xaa is any amino acid
MPAILDGNVVLEMRNIVKQFPKVLANNNINIKLHEGEILSLLGENGAGKSTLMNVLYGLYKPTSGDIFLNGEKVVFSSPKDAIAKGLGMVHQHFMLVDTLTVTENIILWKRTRSRRCHQL

SEQ ID NO: 7945 - DNA, 732 bp, Unknown
  Obtained from environmental sample
  misc_feature (1)..(732): n is a, c, g, or t
atgaacaaaccactcgaagttgacatattcattccatgtataattgatcagatttatcctgaaaccggatttaacatgattaaaatacttgaaaaagcgggagtaaaagttcattataatccaaatcaaacatgctgtggtcaattagcttttaaagatggtttctgggaagacgctaaaaaacttggcattaagtttattaaagattttgataacggacgaatgattgtgggtccatcaacatcatgtattggttatatccgtaatggttatgacgaattattttataatggtgcttatcacaatgaatacaaacaattacaacgttcaatttttgaaataactgattttttggtgaatattgttaagattacagatctgggatctgtttttgaacataaagttacttttcatgattcatgctcagcattgcgtgaatacaaacttgccgatgagcctcgaacattattacgtaatgttagaggtattaagttaattgaaatgaaaaatactcatgaatgttgcggctttggtggtagtttttcaactaaatttgagccaatatcgactgcaatggcggagcaaaaagttcacaatgctatcgaaacgggagcagaatttattgtatcaaccgatagttcctgtctgatgcatcaattcgcttatattaaaaaacataacctgcccataaaagttgctcacattgtagatgttctggcagcaggtttataa

SEQ ID NO: 7946 - protein, 243 aa, Unknown
  Obtained from environmental sample
  DOMAIN (30)...(88): Cysteine-rich domain
  misc_feature (1)..(243): Xaa is any amino acid
MNKPLEVDIFIPCIIDQIYPETGFNMIKILEKAGVKVHYNPNQTCCGQLAFKDGFWEDAKKLGIKFIKDFDNGRMIVGPSTSCIGYIRNGYDELFYNGAYHNEYKQLQRSIFEITDFLVNIVKITDLGSVFEHKVTFHDSCSALREYKLADEPRTLLRNVRGIKLIEMKNTHECCGFGGSFSTKFEPISTAMAEQKVHNAIETGAEFIVSTDSSCLMHQFAYIKKHNLPIKVAHIVDVLAAGL

SEQ ID NO: 7947 - DNA, 324 bp, Unknown
  Obtained from environmental sample
  misc_feature (1)..(324): n is a, c, g, or t
atgaagccgtttgaaacacctgaagattattttaatcatttttcacctgttttcaaagataatgagggtgtattgttgcctttcatttcaaaaataaagttagctaataacgataattattctataattataattaataataacagtccaaaattggatgtcgagactttaggtgtttttcataaagctttaattataaaggaggatttaagcaccagtagaatcataaattcaatggttttaaatcttgtgtcaaaagataaaatcaccgaagatcaactaaaagaaaataactttttaaacactaatctcattagtaaataa

SEQ ID NO: 7948 - protein, 107 aa, Unknown
  Obtained from environmental sample
  misc_feature (1)..(107): Xaa is any amino acid
MKPFETPEDYFNHFSPVFKDNEGVLLPFISKIKLANNDNYSIIIINNNSPKLDVETLGVFHKALIIKEDLSTSRIINSMVLNLVSKDKITEDQLKENNFLNTNLISK

SEQ ID NO: 7949 - DNA, 789 bp, Unknown
  Obtained from environmental sample
  misc_feature (1)..(789): n is a, c, g, or t
atgactccgattatatacgataataaagcttcagtagtcgaagaaaataatataaaaagcttgatctttactgttaatacactaactgatatgaaagataaagagattggtaagattttatttactaaaaatatagatttttatatggataatatagggatattgaaaaatatatctatactctcagccttaattattttattaatctctttttatttaattagagctatattacgtaattatatgagtaccatatatagttatcaaagtaaattggagattaaaaatcgtacacttcttaagttgggtaatattgattatttgacgaaaattaataacagaaagtctattgaaaaactattaataaaagagctaaaaaaagcaaatcgttataatcaaaaagtatcattaatattgtttgacatagataattttaaaaatattaatgatacatacggtcataatataggtgataaagttttaaagaatatcgcaaaaattgtatcatcaaccatcagagagacagactattttggaagatggggaggagaagaatttattatattatcactggaaacatctttagataatgcattaattattgctgaaaaaataagaacaaatatctactcatatgagtttgaagaggtcggcagcgtgagttgcagtatcggtgttgcagagtacattaatggagatacttaccatacaatagtaaatagtgcagacagtgcgatgtatgaagctaaagatagcggtaaaaatagagttgttatgtataaaatttag

SEQ ID NO: 7950 - protein, 262 aa, Unknown
  Obtained from environmental sample
  DOMAIN (99)...(256): GGDEF domain
  misc_feature (1)..(262): Xaa is any amino acid
MTPIIYDNKASVVEENNIKSLIFTVNTLTDMKDKEIGKILFTKNIDFYMDNIGILKNISILSALIILLISFYLIRAILRNYMSTIYSYQSKLEIKNRTLLKLGNIDYLTKINNRKSIEKLLIKELKKANRYNQKVSLILFDIDNFKNINDTYGHNIGDKVLKNIAKIVSSTIRETDYFGRWGGEEFIILSLETSLDNALIIAEKIRTNIYSYEFEEVGSVSCSIGVAEYINGDTYHTIVNSADSAMYEAKDSGKNRVVMYKI

SEQ ID NO: 7951 - DNA, 906 bp, Unknown
  Obtained from environmental sample
  misc_feature (1)..(906): n is a, c, g, or t
atggctgagttatataaagttgggatatcgttaagcaatatgtacttgaaaaataaaaaacctaaaaaagctgaaaaaatattaatggatctatattcaaaggataccataaatggttttattgccaggaatattggtttatgtggatacaaacaagccgatagtaaaaaatcaattaaatggttttctcgtgctattaaacttgatagcacagacattaaggcctataaattcctttttacggtttatgctgcaaaagaagagtatgatttagcttttgaaattatggatttagcattaaatgttgaccctgaaaatatagatttatatagaatgataggagatttacatgttgttcgtaatcataatttcagagctattactgaatacttaaaagcatttgaaattgatagtaatgatgaagaaattgccagaaaattgggactttgttattataaaatcaaaaaatacgaaaaagcaaagtattacttattaatagcatctaaagaacttgatttaaatgtgtatacacatcttggttatatttataaaagatttaatgaatctgattccagtacaatgttttttactaaagcattggatattataagacctgataataattcattatttgatatttacgtaaatgttgctgagaattattattctttaaataattataatcacactattggatggtataaaagatcattaaagctcgaattagcaggtgtatggatgaatgactctaaaaataaagtcttagttgatctggcttcagtttatgctgataagcttaatgataaagaaaatgccattaaatatttaaaggaagttactaaagatatttttattaatgatgataaatattatgaatatgcacaaaagcaaataactaaaatttaa

SEQ ID NO: 7952 - protein, 301 aa, Unknown
  Obtained from environmental sample
  misc_feature (1)..(301): Xaa is any amino acid
MAELYKVGISLSNMYLKNKKPKKAEKILMDLYSKDTINGFIARNIGLCGYKQADSKKSIKWFSRAIKLDSTDIKAYKFLFTVYAAKEEYDLAFEIMDLALNVDPENIDLYRMIGDLHVVRNHNFRAITEYLKAFEIDSNDEEIARKLGLCYYKIKKYEKAKYYLLIASKELDLNVYTHLGYIYKRFNESDSSTMFFTKALDIIRPDNNSLFDIYVNVAENYYSLNNYNHTIGWYKRSLKLELAGVWMNDSKNKVLVDLASVYADKLNDKENAIKYLKEVTKDIFINDDKYYEYAQKQITKI

SEQ ID NO: 7953 - DNA, 567 bp, Unknown
  Obtained from environmental sample
  misc_feature (1)..(567): n is a, c, g, or t
atgacagaatcggctcgagaagaccaaaggaaagctagtccttacggtgtttatgacatacaaaataatacaggttgggtaaacgtgggaataagtagtgatactgcaagttttgcggtatctacaattcgtgattggtggaatgaagaaggcataaatctatatacaggatcaaagcaattatatataaatgcagatggtggtgaaagtaatggatctagaaataatttatggaaattagaattacaaaaatttagcaatgaaacaggattaataatccatgtaagtcatttccctccaggaacaagcaagtggaataagatagaacatagacttttttcatatatctctaaaaattggagagctaaacctcttgtttcattaagtgttattgtaagtttaataggtgcaactacaacagaaaaaggattatcagtaagggcaaatgcagatgaaaaaatatacaaaacaggtattaaagtaaccgaacaggaaaagaaaagtataaatatagaaagaaatgattttcatggcgaatggaactattgcattaaaccaaatatgtaa

SEQ ID NO: 7954 - protein, 188 aa, Unknown
  Obtained from environmental sample
  DOMAIN (1)...(187): Rhodopirellula transposase
  misc_feature (1)..(188): Xaa is any amino acid
MTESAREDQRKASPYGVYDIQNNTGWVNVGISSDTASFAVSTIRDWWNEEGINLYTGSKQLYINADGGESNGSRNNLWKLELQKFSNETGLIIHVSHFPPGTSKWNKIEHRLFSYISKNWRAKPLVSLSVIVSLIGATTTEKGLSVRANADEKIYKTGIKVTEQEKKSINIERNDFHGEWNYCIKPNM

SEQ ID NO: 7955 - DNA, 351 bp, Unknown
  Obtained from environmental sample
  misc_feature (1)..(351): n is a, c, g, or t
atgttagaagagaatgaattaaaagagaagtgggaaaatattttaaaaatggtagaacatcgttttgatgaacaaatagatgaacaaaccatactttatattattggtttacaagaactcaataaaccccatagagttttccagaaagaagaaaaagtagatattatacatattggtatttgtactgttttaagccaatatggatattataggtttactggtagagatgatgatggttggccacattttaaaaatgtaaaaaaaataccatctaacaccaaaggacgaaagcaacttttattaatgcgaaaaggaattattgattattttgagaacctgaaaaaattgtaa

SEQ ID NO: 7956 - protein, 116 aa, Unknown
  Obtained from environmental sample
  misc_feature (1)..(116): Xaa is any amino acid
MLEENELKEKWENILKMVEHRFDEQIDEQTILYIIGLQELNKPHRVFQKEEKVDIIHIGICTVLSQYGYYRFTGRDDDGWPHFKNVKKIPSNTKGRKQLLLMRKGIIDYFENLKKL

SEQ ID NO: 7957 - DNA, 558 bp, Unknown
  Obtained from environmental sample
  misc_feature (1)..(558): n is a, c, g, or t
ttgttagccttactattcaaaaagaagtcccaatatgcgttgaaattagaacgcatattgggattttttcctaaaaacacctccatttacaaacaagcactaacacataaatctttagttggtgatgataaaattattcaaagtaacgaacgcctagaattccttggtgatagtatattaagcagcgttgtttcccattatctttttttacggtatccatttaaagatgaagggtttcttacacaattacgatctcgttttgtaagcagagaaatgttaaataaacttggtaaaaaaataggtttagcagaacttattgaaaaaaaacctgaagaaaaaagtgtaagtatattaggaaatgcattggaagctttaattggtgcaatttacattgacaaaggttatgaacaagctcaaaaatttattcaacaaaaattaattgatattcatttagatagtgaaaaaatcgtagctcaagaaactaactttaaaagtagggtaatagaatggtgtcaaaaaaataaatacccttcgaatttgaaacaagtgaagaaatag

SEQ ID NO: 7958 - protein, 185 aa, Unknown
  Obtained from environmental sample
  DOMAIN (50)...(134): RNase3 domain
  misc_feature (1)..(185): Xaa is any amino acid
MLALLFKKKSQYALKLERILGFFPKNTSIYKQALTHKSLVGDDKIIQSNERLEFLGDSILSSVVSHYLFLRYPFKDEGFLTQLRSRFVSREMLNKLGKKIGLAELIEKKPEEKSVSILGNALEALIGAIYIDKGYEQAQKFIQQKLIDIHLDSEKIVAQETNFKSRVIEWCQKNKYPSNLKQVKK

SEQ ID NO: 7959 - DNA, 807 bp, Unknown
  Obtained from environmental sample
  misc_feature (1)..(807): n is a, c, g, or t
atgggtaatatggatttatcatttgttcttctgacatggaattcagagtcatacatagaaaattgttttgattctcttttgaactcgcttgctgcaacagagttctcttttgagatatttgttgttgataatggttccaaggattgcacggtagaaattctaaataattacctaacagaacatggagatgtacttacgttgatatttcttcatgaaaacgttggtacaactgtatcccgtaatatggcactaacgcaggttagtggtgattctattgtcattatggattcggatgtagaagtttcagaaggaatatttgaaaagttgatttgtagcatcaataaatcttctgaaattggaatggttgttccaagaattgtttatcctagtgggaaatggcagaaatctattgatcagtttccaactttacttcataagctccatcgtttttttcgattgagagatattgaaaaacaagaaggacgtacagaagttaagtgcttggatgaaaagcaagtcgattatgcgatttctgcattctggctatttaaaaaagaggtattggagcgggttggccttcttgatgaaaaatacttctacgctcctgaggatgtggattattgtcttgaggtctggaagggtggataccagatagtatacgtgccatcggtaactatcgttcatcatacacaagaaatatcgcggtgggataaaatgaataaagcaaaacttgaacatattaagggattgttctattttttttctaaacataaatactggtttaaaaaccctgtttttaaaagttag

SEQ ID NO: 7960 - protein, 268 aa, Unknown
  Obtained from environmental sample
  DOMAIN (7)...(192): Glycosyl transferase
  misc_feature (1)..(268): Xaa is any amino acid
MGNMDLSFVLLTWNSESYIENCFDSLLNSLAATEFSFEIFVVDNGSKDCTVEILNNYLTEHGDVLTLIFLHENVGTTVSRNMALTQVSGDSIVIMDSDVEVSEGIFEKLICSINKSSEIGMVVPRIVYPSGKWQKSIDQFPTLLHKLHRFFRLRDIEKQEGRTEVKCLDEKQVDYAISAFWLFKKEVLERVGLLDEKYFYAPEDVDYCLEVWKGGYQIVYVPSVTIVHHTQEISRWDKMNKAKLEHIKGLFYFFSKHKYWFKNPVFKS

SEQ ID NO: 7961 - DNA, 378 bp, Unknown
  Obtained from environmental sample
  misc_feature (1)..(378): n is a, c, g, or t
atgaaagcaccaaagtaccagaccatatttatcaaccctccatcaaagaacaaacgtatgttgatacgtaactttgattgtgcaacagagtcaaaaggcaactatctttatcaaccatacgacttcttgcttttgtcctcacattttaaagaagaccaattcatgctcattgatgctattgctgagtcaattgagattagtgaggttttcaaaagagttgaaaatgttaagtttaaatgcttaatcatagctttagcagatactaactgggatgaagattttgattttttacgggagacaagaaggcgatacccagaggcaacaatttatgtatttggcgattcttttatcgaaaaaaagtgcacaaaaaaaagttag

SEQ ID NO: 7962 - protein, 125 aa, Unknown
  Obtained from environmental sample
  misc_feature (1)..(125): Xaa is any amino acid
MKAPKYQTIFINPPSKNKRMLIRNFDCATESKGNYLYQPYDFLLLSSHFKEDQFMLIDAIAESIEISEVFKRVENVKFKCLIIALADTNWDEDFDFLRETRRRYPEATIYVFGDSFIEKKCTKKS

SEQ ID NO: 7963 - DNA, 765 bp, Unknown
  Obtained from environmental sample
  misc_feature (1)..(765): n is a, c, g, or t
ttgctatttgaagatgggcttaataaggaagaggaaggacacttaactatcgatgaatggagaaagattttaaagagactaccatggtataccattgtagacataactggggccgagccatttgcttataagaaccttgttccttttattgaattacttaaagagctaggacttcgctattctattactacaaatggaacaatatataatgatagcttaattgaaagccttgtcttaaataatttacaagttttaatggtttcactggatgggccggaagacacccataatattttaagaggtaactctaaggcctttagtaagacggttgagtttattaagaaagttgaaactataaagaaaaagtacaataggtctaagccacttataaatattaaatctacagttttagatgagaactgtagtgagttagtagatctcgtcgagttttgtaggagtcactttcatattgacctctatacatttaccttcttatttcagaatgaagctcgtggaggaatggacttaggggaggattttaagcttgagaaatatcaacgtggtaattatgctgaatataaaaaagtaaaagatgttatgaagtttgtaaatgatattgagcaaaggcaaagttcgtggagctttccagtagttataaaaccacgcatgccattaaagagtttacttagatatataaaagacccaagctcactgaatgttaaaaagtgtccacagtatcttaataacctaacattatatttttaa

SEQ ID NO: 7964 - protein, 254 aa, Unknown
  Obtained from environmental sample
  misc_feature (1)..(254): Xaa is any amino acid
MLFEDGLNKEEEGHLTIDEWRKILKRLPWYTIVDITGAEPFAYKNLVPFIELLKELGLRYSITTNGTIYNDSLIESLVLNNLQVLMVSLDGPEDTHNILRGNSKAFSKTVEFIKKVETIKKKYNRSKPLINIKSTVLDENCSELVDLVEFCRSHFHIDLYTFTFLFQNEARGGMDLGEDFKLEKYQRGNYAEYKKVKDVMKFVNDIEQRQSSWSFPVVIKPRMPLKSLLRYIKDPSSLNVKKCPQYLNNLTLYF

SEQ ID NO: 7965 - DNA, 411 bp, Unknown
  Obtained from environmental sample
  misc_feature (1)..(411): n is a, c, g, or t
atgaaaacacatgtcaatcatggtgttgatattgtaaaaaatatctcttggttacaagatgcacaaaaagtgatacaaaaccaccatgaaaaagttgatggaagtggctacccaaatggactaacaaaagatgatattcccatagaagccagaatattcgcagttgtagatgtatttgatgcacttacatctaaaagaccatacaaagaggcttttgatatagaaaaaagtatcaatattattaaaagtgggattaatgtgcattttgatgaaaaagttatttataaatttgaagagatttatgaaaaaatatattatgatattttagatatatctgccaaagagctagaagatatattttctataaatattgaaccttattttgatgtaaaatatattatacgaggataa

SEQ ID NO: 7966 - protein, 136 aa, Unknown
  Obtained from environmental sample
  misc_feature (1)..(136): Xaa is any amino acid
MKTHVNHGVDIVKNISWLQDAQKVIQNHHEKVDGSGYPNGLTKDDIPIEARIFAVVDVFDALTSKRPYKEAFDIEKSINIIKSGINVHFDEKVIYKFEEIYEKIYYDILDISAKELEDIFSINIEPYFDVKYIIRG

SEQ ID NO: 7967 - DNA, 471 bp, Unknown
  Obtained from environmental sample
  misc_feature (1)..(471): n is a, c, g, or t
ttgcaagagggaatatcaaaatttagttgcacggaaattgaatgtcaatctcaacttgtgcaagtacaacactttaataatcaaagagttaatcaagtaaatctaacctctgtgaatatatcagaattaagtattattaaaacgattcttgacaatccaatgttattagaagtggtaaaaaatgagctacaacctgatatgtttgaaacacatgcacatgaatataatatgttattagaagatattaatgatccaaacttacatggactgatgctaaatgaacatataatttcatatacacaagaggagttagataatcaattaaaaatacttcttgttccttattataaaaaaagattacaacaattaaaatttgatgaaaccatagattttaaaataaaagctagaaaaactgttgaacttaaacataaactaattgaactaaatcaaaaaaaactcatagcggtttaa

SEQ ID NO: 7968 - protein, 156 aa, Unknown
  Obtained from environmental sample
  misc_feature (1)..(156): Xaa is any amino acid
MQEGISKFSCTEIECQSQLVQVQHFNNQRVNQVNLTSVNISELSIIKTILDNPMLLEVVKNELQPDMFETHAHEYNMLLEDINDPNLHGLMLNEHIISYTQEELDNQLKILLVPYYKKRLQQLKFDETIDFKIKARKTVELKHKLIELNQKKLIAV

SEQ ID NO: 7969 - DNA, 333 bp, Unknown
  Obtained from environmental sample
  misc_feature (1)..(333): n is a, c, g, or t
atggcttttgtaacattagatataaaaaaactgaaatcaaattttaactatctcaatgcactctttataaagaatgggattgaatggtctattgtgtcaaaaatgttaagtggaaataaaacatatttaactgaattactaaaatttgacatacatcaaatctgtgactcccgggtgtctaatctgaaagagattaaaaccctcaatcctaaaatagaaactatttatattaagcctcctgccaaacgatccatagcgagtattgttaagtatgctgatattagtatgaatacagagattgaaactattaaacttttatcgaaggaagcctaa

SEQ ID NO: 7970 - protein, 110 aa, Unknown
  Obtained from environmental sample
  misc_feature (1)..(110): Xaa is any amino acid
MAFVTLDIKKLKSNFNYLNALFIKNGIEWSIVSKMLSGNKTYLTELLKFDIHQICDSRVSNLKEIKTLNPKIETIYIKPPAKRSIASIVKYADISMNTEIETIKLLSKEA

SEQ ID NO: 7971 - DNA, 465 bp, Unknown
  Obtained from environmental sample
  misc_feature (1)..(465): n is a, c, g, or t
ttgcgaataggcgaaaatatgtggctttatattccaaatgtaggtaagcctatccgtataaccagtttgcagtcgctcacagggggcgtctttaacaattcggatattatgcgtgtcgattacagttcagaatacaattgtgaaaaagttgaggcgtcagagaatgggcatatccttcaccttaaagcaaagacaaatactgttgcttatgacacagtaaagatgtgggtttatggtaaaaggcttcttccgaacaagttagaatgctttgcttcatcgggcatgcttattaaaactctgtattttaaaaaggttaaagattttggcggcggtattattcgtcctgccctgattgagacagacagccctctttataaaggatataaatctcttattatttttgcaaaaatgcaggccagctacctgcctgacgaagttttcaccttaatacctcagccgatctga

SEQ ID NO: 7972 - protein, 154 aa, Unknown
  Obtained from environmental sample
  misc_feature (1)..(154): Xaa is any amino acid
MRIGENMWLYIPNVGKPIRITSLQSLTGGVFNNSDIMRVDYSSEYNCEKVEASENGHILHLKAKTNTVAYDTVKMWVYGKRLLPNKLECFASSGMLIKTLYFKKVKDFGGGIIRPALIETDSPLYKGYKSLIIFAKMQASYLPDEVFTLIPQPI

SEQ ID NO: 7973 - DNA, 486 bp, Unknown
  Obtained from environmental sample
  misc_feature (1)..(486): n is a, c, g, or t
ttggttcaaaaagctagatatcttataaacttcggttttgagagcaaagagtctatacctgagcttggtacaaatgcaaaaatgaatgaatttgaagctgctatgggactctgtgtacttgacgagattgaatttatacaagatcaaagaaaaaaagtgcacaatcattataaagatgaactacaaagttttgtacagtttcaagataagaatctgaattgtacacaaaattatagttattttccaattattttgaaaagtgagaaggaacttaaaatggtacaaaaagccttgggtgaaaaagaaatatttccaagaagatatttttatcctcctcttgatacgttaagctatatcgaaccaaaacaatttatgtcgatatcaagagatatctctagtagaatattgtgtttaccaatttatccagatttgaaaatagatgagcaaaatttaattttagatacaataaaaaaagtattaatttag

SEQ ID NO: 7974 - protein, 161 aa, Unknown
  Obtained from environmental sample
  misc_feature (1)..(161): Xaa is any amino acid
MVQKARYLINFGFESKESIPELGTNAKMNEFEAAMGLCVLDEIEFIQDQRKKVHNHYKDELQSFVQFQDKNLNCTQNYSYFPIILKSEKELKMVQKALGEKEIFPRRYFYPPLDTLSYIEPKQFMSISRDISSRILCLPIYPDLKIDEQNLILDTIKKVLI

SEQ ID NO: 7975 - DNA, 798 bp, Unknown
  Obtained from environmental sample
  misc_feature (1)..(798): n is a, c, g, or t
atgttcagaatcggctcgagaagattcaaattaggctttgtatatgttttagatgagatgtgttttgataatggaaatcattccataaattttgttgtttcagaaacaaaagaaaaattagaatgtaatgtgaaaacctttaaagtaagtcctaaacaaaaagaaatattatctcagtatagatttatcacatctttagagaatgatttagatatagaaaaattaagaacattgtatggtaaaaattcaataggctttttagctattgatgataatttagaagatgaaacttttgtaaattatataaaagagttaactgtaagattttcaaaaattagtataaaagttttttcttttagtgatcaaaatagagagtgtgcagaaagaatttttaaagaatttgaaaatataaagattttgtataaatcaaacaatatagctgactttgttgaaaatattgaaatatttattcactatcaaggtaatacagtcggtacattaaacaagagtttgattcagtattgcctaaatatacatattatttattatagttcagaaagtaattataaaaaagtatctgatctgaatgaggttaatataccaatgtataataattttttgaactatattagagaagctggatatattccatttgaagataaaaaatataatcaagcaaaattgaatcaaaatacaattttgagatatattggattagaaaattcattacttaatgatgatgataacttatatgaacttagatattttaaatctattgagtatgcctttgaaatatga

SEQ ID NO: 7976 - protein, 265 aa, Unknown
  Obtained from environmental sample
  misc_feature (1)..(265): Xaa is any amino acid
MFRIGSRRFKLGFVYVLDEMCFDNGNHSINFVVSETKEKLECNVKTFKVSPKQKEILSQYRFITSLENDLDIEKLRTLYGKNSIGFLAIDDNLEDETFVNYIKELTVRFSKISIKVFSFSDQNRECAERIFKEFENIKILYKSNNIADFVENIEIFIHYQGNTVGTLNKSLIQYCLNIHIIYYSSESNYKKVSDLNEVNIPMYNNFLNYIREAGYIPFEDKKYNQAKLNQNTILRYIGLENSLLNDDDNLYELRYFKSIEYAFEI

SEQ ID NO: 7977 - DNA, 753 bp, Unknown
  Obtained from environmental sample
  misc_feature (1)..(753): n is a, c, g, or t
atgcgacttagtaaaacaaaaatggtggaaggaggtaacgtttggtctatctcatcaaatgaagcgcaactattggtcagttcagatagccctatcattcatatctatgattcagcccttaatataaccaaaaattatgattcaaaagttaaagggccaaagtcggcaataatgctcgactccttaatatatatcgccagttcaaagggccttatgtcattggacactgataatggaataataaaaaaaatagctgacggtacattctttgttgttagagcaagtaaagatggtggaagcatcttcgctggttcaactaaaggtcaagtccttaagtattatgtaaacacaaattatagtgaaatattaagtatagaccctggcaatcctgttttcgatattaaagagcaccataatgctctatatatcgcaactcaaggaggattattcaaatttgcgaatgatttagctacccctctctatacaaatcaaatggttctaagtattagcttatatgatgatgaactattatttggaacaggaacaagcttagagaaggtcgacattaaatcgaaagatataaaacaaatatacacaaataacaaacctatattttctataattcaagatgacagcattattgtcgcgtcatcagtaaatgaaattgtaataagaaataaaaaagacaaccgaaactttctcatagggaaggaattcggagtacaagatgaatataatacccacgccatatga

SEQ ID NO: 7978 - protein, 250 aa, Unknown
  Obtained from environmental sample
  misc_feature (1)..(250): Xaa is any amino acid
MRLSKTKMVEGGNVWSISSNEAQLLVSSDSPIIHIYDSALNITKNYDSKVKGPKSAIMLDSLIYIASSKGLMSLDTDNGIIKKIADGTFFVVRASKDGGSIFAGSTKGQVLKYYVNTNYSEILSIDPGNPVFDIKEHHNALYIATQGGLFKFANDLATPLYTNQMVLSISLYDDELLFGTGTSLEKVDIKSKDIKQIYTNNKPIFSIIQDDSIIVASSVNEIVIRNKKDNRNFLIGKEFGVQDEYNTHAI

SEQ ID NO: 7979 - DNA, 384 bp, Unknown
  Obtained from environmental sample
  misc_feature (1)..(384): n is a, c, g, or t
gtgatgcaacaactatctaaaatgggggtgagtttagccctggatgactttggtactggatactcttcgctgtcatatttaaagcgctttccaatccatactcttaagattgataaagcattcgttgacgatatcgataaatccgatcgcgatttaaaaatggtcgattcgattatcactatcgcccataacatggggctttctgtggttggtgaaggcgtggaagaaacgtctcaactaagtattttacgagcacttaaatgcgaagagatccaaggctatatttatagtaaagcagtaaccgaacatgagttcactaatcttctgcacaatgatacaaacgctaaaccattaaaggcaatctcactaaataaagcgcaataa

SEQ ID NO: 7980 - protein, 127 aa, Unknown
  Obtained from environmental sample
  DOMAIN (1)...(99): EAL domain
  misc_feature (1)..(127): Xaa is any amino acid
MMQQLSKMGVSLALDDFGTGYSSLSYLKRFPIHTLKIDKAFVDDIDKSDRDLKMVDSIITIAHNMGLSVVGEGVEETSQLSILRALKCEEIQGYIYSKAVTEHEFTNLLHNDTNAKPLKAISLNKAQ

SEQ ID NO: 7981 - DNA, 906 bp, Unknown
  Obtained from environmental sample
  misc_feature (1)..(906): n is a, c, g, or t
atggtaaatgaaattaattctacaaaagaaattgaaaataaaaaatcttctgaaattaaatcaaatgaaggtattgatgctaatgttttatttagtgattttaaagaaaattcagtagctgacttttttaaaaaaaatagacaaatgttaggtctttatggtaaacaaagaactttaacaacaattattcatgaaattgtaacaaattctttagatgcttgtgaagaagcaggaattttaccagaaattgaagttaaggtttctgaaattagtgaagaatattttgaaatttcagtagttgataatggtccaggaattccagaaaataaaattggaagcgctctgggaaaacttttagcaggaactaaatttcatagattagttcaaacaagaggtcaacaaggaattggagtttctggaattattttattttctcaaataacaactggaaaaccttcaaaagtaatttctggaactacatctggaaaaacagtttctttagaaatatctattgattcaaaaacaaattctccaaaaataactggaaaaacttatttaactaaaaaatttagaggacttgcaattaagtctaaatttaaagaaatacaatataaaaaaggacaaaattcagttgatgaatatttaagaagaacagcaatttcaaatcctcatgcaattattaaatttgaagatccttttggagaagtaactttatatcctagaacagttacagctcttccaaaaatacctcatgaagtaaaacctcatccnnagaggagtacagttgatgaaatgttatctcttgncagatatagtactgcaagaaaaatatcttcatattttaagttaacttttgatagatttggacaagtgcagttaaatatgttcaaaattagttcattttga

SEQ ID NO: 7982 - protein, 301 aa, Unknown
  Obtained from environmental sample
  DOMAIN (54)...(172): Histidine kinase-, DNA gyrase B-, and HSP90-like ATPase
  misc_feature (1)..(301): Xaa is any amino acid
MVNEINSTKEIENKKSSEIKSNEGIDANVLFSDFKENSVADFFKKNRQMLGLYGKQRTLTTIIHEIVTNSLDACEEAGILPEIEVKVSEISEEYFEISVVDNGPGIPENKIGSALGKLLAGTKFHRLVQTRGQQGIGVSGIILFSQITTGKPSKVISGTTSGKTVSLEISIDSKTNSPKITGKTYLTKKFRGLAIKSKFKEIQYKKGQNSVDEYLRRTAISNPHAIIKFEDPFGEVTLYPRTVTALPKIPHEVKPHPXRSTVDEMLSLXRYSTARKISSYFKLTFDRFGQVQLNMFKISSF

SEQ ID NO: 7983 - DNA, 1002 bp, Unknown
  Obtained from environmental sample
  misc_feature (1)..(1002): n is a, c, g, or t
gtggnnnngggattatggctgagtcttatctcagtaattaaggttttacaacctaaatactttgtaatggagaatgttaaaggaatcttgactaaagaggggggtaaaataaaggagttgatattagaagaaatcaattcgatagtagatattaaagaaatcccaaagcttacaggatttattaagaacttaaaaagctcaaacaaacaagatgaattcttaattgattgtttgattaaaagaattgagattgaacaattcagtgaaaagaaagcagaagaagcaaaagaggtatttataaaaactgttgaatctaaatttcgacaattaacaccaaaaattgttgattataaaacgagtaaaactgaccaacgaattggaacaattagacatggttttaatttgttacaaagaaataaagaatgggaagttttaaaacgcaagataatacgtgaaaaggatttttgtaacattgataacgactactttgtagagcatttcaataatttcttaactgaattagattcaatagaaattatcaagaaaatagaagaagcttttaaaagattaaatgtagcaaaagaatattacagagcttgtaatgacatacttactgctctacaaatttatacattcagttttgatgaaacacttcaatttagtaagaagttttgtaataagaagcagtacaaagaactgaataaaataatagatgccattcgactttataaaatagaagctccatttgttgctaatgcctcaaattatggcgttcctcaaaatagagaaaggggtttatttattgggtgtagaaaagaccagaaatttatttctgaaattccagccacagtaaaagaagaagaaaaagtgactgtttttgaggctttacatgattgggattttgtaggaaacgatgaaaaagctcgctattatgaatttagtggatatttcaaagcaattttaccggaactgcaaaaaagaatgagaagcctttttgaataa

SEQ ID NO: 7984 - protein, 333 aa, Unknown
  Obtained from environmental sample
  misc_feature (1)..(333): Xaa is any amino acid
MXXGLWLSLISVIKVLQPKYFVMENVKGILTKEGGKIKELILEEINSIVDIKEIPKLTGFIKNLKSSNKQDEFLIDCLIKRIEIEQFSEKKAEEAKEVFIKTVESKFRQLTPKIVDYKTSKTDQRIGTIRHGFNLLQRNKEWEVLKRKIIREKDFCNIDNDYFVEHFNNFLTELDSIEIIKKIEEAFKRLNVAKEYYRACNDILTALQIYTFSFDETLQFSKKFCNKKQYKELNKIIDAIRLYKIEAPFVANASNYGVPQNRERGLFIGCRKDQKFISEIPATVKEEEKVTVFEALHDWDFVGNDEKARYYEFSGYFKAILPELQKRMRSLFE

SEQ ID NO: 7985 - DNA, 696 bp, Unknown
  Obtained from environmental sample
  misc_feature (1)..(696): n is a, c, g, or t
atgaaaagacatattagcagtttgatttcacaaaagtttggaatattcgcttcgaaggagtttccttcttggtttcaaaatatagtaaatagctcttatgtaaaactgatgaagcttgatatgagtgagttttatgcaccatcatcatacaaatcactcaacaaactatttaccagaaatttaaaaaatgccagagagttctcacttgatggttctgttatgatctccccatgtgattcgttcataagtgagtgtggttcactagagggtgataaagctctacagattaaaggcatgagctactcggtggatggacttttaggtgagcatgtggatcaagtgcaaaaagatagagtgaaaaatggtaagtttataaacttctatctatctcctaaagattaccatcgctaccatatacctataaatttaaaagtaaacagagctattcacataccagggaaactctaccctgtaaatatgccgtacttaagaaaacagctaaatcttttcatagagaatgagagagttgttatcgagtgtgaaagtagtgaaggaaaacttttttatatggtactagttggcgcactaaacgtaggtgttatgaacgtctcatttgagccgagcattaaaacaaattctcagatcacaacaccacaagtgtatgagtatgagaacctacactttaaacaaaggtga

SEQ ID NO: 7986 - protein, 231 aa, Unknown
  Obtained from environmental sample
  DOMAIN (53)...(231): Phosphatidylserine decarboxylase
  misc_feature (1)..(231): Xaa is any amino acid
MKRHISSLISQKFGIFASKEFPSWFQNIVNSSYVKLMKLDMSEFYAPSSYKSLNKLFTRNLKNAREFSLDGSVMISPCDSFISECGSLEGDKALQIKGMSYSVDGLLGEHVDQVQKDRVKNGKFINFYLSPKDYHRYHIPINLKVNRAIHIPGKLYPVNMPYLRKQLNLFIENERVVIECESSEGKLFYMVLVGALNVGVMNVSFEPSIKTNSQITTPQVYEYENLHFKQR

SEQ ID NO: 7987 - DNA, 642 bp, Unknown
  Obtained from environmental sample
  misc_feature (1)..(642): n is a, c, g, or t
atgcgtaaaaaaacgcatgtcatagagttttctctaaaatcccttcttaagcagatagataaagatttttcaattaaagagatagataaaactctactatacctacaccacctaaatgttttagagttactaaacggcagatttatcagctactctcctatgaaaattcataaagaggaaaaactctctcaaaaacgaaaatatacacaaacagagtatgcaaatagactagagcctcattacattacaaaaatagagtcaatacatatcatgggagagtatgcaaaacgacttcaaaatgatgaccataaagccatattgtttttaaaagactactttacactaccctatgataattttaaaaagaagtataatcttctaaagaaaaagattaccagacccatcacacaacatagatacaacaaaatattttctaaaatgtcaactgaacaacaatcaattatttcagatagctccacaaaagccatgatgatattggcaggtccaggaagtggtaaaacaaaagttttggtacacaaaattgcttcactgattttaaacggaagatataaaagcctgaagcacttcaagatgctaacatttttcaagaaacttgctatggggaaaagtttcaaaaagtaa

SEQ ID NO: 7988 - protein, 213 aa, Unknown
  Obtained from environmental sample
  misc_feature (1)..(213): Xaa is any amino acid
MRKKTHVIEFSLKSLLKQIDKDFSIKEIDKTLLYLHHLNVLELLNGRFISYSPMKIHKEEKLSQKRKYTQTEYANRLEPHYITKIESIHIMGEYAKRLQNDDHKAILFLKDYFTLPYDNFKKKYNLLKKKITRPITQHRYNKIFSKMSTEQQSIISDSSTKAMMILAGPGSGKTKVLVHKIASLILNGRYKSLKHFKMLTFFKKLAMGKSFKK

SEQ ID NO: 7989 - DNA, 486 bp, Unknown
  Obtained from environmental sample
  misc_feature (1)..(486): n is a, c, g, or t
atgagactaaaaggactttacctaactattatattaggagcaataattttaagtagcactaacttatttgctcaacatgctactcaaattaaagatgtagatgagttaaaaacagaagacaaagtacttgttgaaagttatcctcatgtatttaaaggagcaaaagttaataaagtagaaaaattaaattcaaaacattcaaaagtttactactcggtaggagggaatgaatttgaagcaattgtaaattctgacaggaaagatttattgctagtagccacttgcaagctaattaagaatgatgaattacctaaattggtaaaggatgtttttacaaaagaggtgaaaggtaaaattgaaaaatcattttcagttacaactccttattcatctgaaatatatagaattgactatgttaaaaaagatggggaattgaagagtatgttttatgataaattaggaaatgtgcaaaaagcaccttattaa

SEQ ID NO: 7990 - protein, 161 aa, Unknown
  Obtained from environmental sample
  misc_feature (1)..(161): Xaa is any amino acid
MRLKGLYLTIILGAIILSSTNLFAQHATQIKDVDELKTEDKVLVESYPHVFKGAKVNKVEKLNSKHSKVYYSVGGNEFEAIVNSDRKDLLLVATCKLIKNDELPKLVKDVFTKEVKGKIEKSFSVTTPYSSEIYRIDYVKKDGELKSMFYDKLGNVQKAPY

SEQ ID NO: 7991 - DNA, 435 bp, Unknown
  Obtained from environmental sample
  misc_feature (1)..(435): n is a, c, g, or t
atggaaattttacttataacaccaaaaacaggaaaacactcaatttataacgataataaaattgttaactttttatttgaacatttagatcaatatggagatgcaaaagatgctatccaaaaatgtattgattatgtatttacgccaaacaaaggcggcttaattttattagctatagaagataacgaaattgtgggagccactatcatcaacaatacagggatgagtggttatattccagaaaatattttagtttatattgcagtaaacaaaaaccaacgaggaaaaggcgttggaaaacaaattatgcaaaaagccatagaaaacactgaaggcgatatagctcttcatgttgaaaaagataatcctgcaaaatttttatatgaaaaaatgggatttacaaatccgtatttagaaatgcgtttaaaaaaatga

SEQ ID NO: 7992 - protein, 144 aa, Unknown
  Obtained from environmental sample
  DOMAIN (56)...(134): Acetyltransferase (GNAT) family
  misc_feature (1)..(144): Xaa is any amino acid
MEILLITPKTGKHSIYNDNKIVNFLFEHLDQYGDAKDAIQKCIDYVFTPNKGGLILLAIEDNEIVGATIINNTGMSGYIPENILVYIAVNKNQRGKGVGKQIMQKAIENTEGDIALHVEKDNPAKFLYEKMGFTNPYLEMRLKK

SEQ ID NO: 7993 - DNA, 618 bp, Unknown
  Obtained from environmental sample
  misc_feature (1)..(618): n is a, c, g, or t
atgattgaacgatttctcactgtttttaagcagttcggtcctttcgagataaaggaaaaaggatcaaaatttatttcacactgttttccaataaagacagctgaagaagctgaagaagccattaaaaaactttggaaagagcactacaacgcgactcatatctgttatggctataatcttggagaaggaaaaactgaaaagttcaggtacaacgatgatggagaaccttcaggaacagcagggcttccgatctataacgaaatactgaaaaaagagctattcaacgtgcttgtgacatcaatcagatactatggcggcactaaacttggaacaggcggactcacaagaacttacggactctcagcgagaacggttcttgaagaggttgagacagtcacagtgcacctgaaaaaagatgttatgatggaagttccctttgatctgacaggaatcgctatgaaccacataaatcagtttgaaatggttgatatcggagaaactctatacaatgaaaccggtcagacaatgaaccttaaagtccctatcgcctcagtcgcaaagttcgttgctgacatgatcgaaagaagtaatggaaaggttgtgccggttgagtcctga

SEQ ID NO: 7994 - protein, 205 aa, Unknown
  Obtained from environmental sample
  DOMAIN (19)...(127): Uncharacterized protein family UPF0029
  misc_feature (1)..(205): Xaa is any amino acid
MIERFLTVFKQFGPFEIKEKGSKFISHCFPIKTAEEAEEAIKKLWKEHYNATHICYGYNLGEGKTEKFRYNDDGEPSGTAGLPIYNEILKKELFNVLVTSIRYYGGTKLGTGGLTRTYGLSARTVLEEVETVTVHLKKDVMMEVPFDLTGIAMNHINQFEMVDIGETLYNETGQTMNLKVPIASVAKFVADMIERSNGKVVPVES

SEQ ID NO: 7995 - DNA, 906 bp, Unknown
  Obtained from environmental sample
  misc_feature (1)..(906): n is a, c, g, or t
atggtcgatcttttttgcggatttgcaaaaatggcacttgataacaactactgccaacctgaaatatatgaagaggaaggtcttgaaattgttgatggaagacatcctgttgttgaggcatctgtccccagaggaacatacgttccagccacggttaaaattggagaatctgacagaagattttctattattaccgggcccaacatgggcggtaaatcaactttaatgagaatgacggctcttgttgttcttcttgctcagacaggaagttacgttcctgcaaaaaaggcaaaaatcggcatcgtggattcaatttttactcgcgtcggagccagcgataacctgtcaaaaggcgaatcgacatttcttgtcgaaatgaaagaaacagcttctattctcaacaaggctacatcaaaaagtcttataattcttgatgaaataggtcgaggaaccggaacttatgatggaattagcctcgcaaaggcaattgctgaatatattattgaaaaaataaatgcaaccacactttttgcgacacattatcatatccttacagagcttgcagaagatttttcgacatgctgcaactttcacatgaccgcaagagagtacgctggaagaatcaggtttatgtaccanatgaaagaaggcggaagcagccgcagtttcggtgttgaggttgcaaaactcacagacatgccgtcagtttgttataaaaaaagccgaaaaagattcttccgtggatatgggaaaaaaacagaacccccaggaattaagaattttgaaaagaagggcaagcttcctcctttcaaaaacaggattattcttttttttcaaatgggaaatttcttggccgaaaaaccccggtccctcaaaaaaaccttccccggaaaaccctttttttaa

SEQ ID NO: 7996 - protein, 301 aa, Unknown
  Obtained from environmental sample
  DOMAIN (17)...(244): MutS domain V
  misc_feature (1)..(301): Xaa is any amino acid
MVDLFCGFAKMALDNNYCQPEIYEEEGLEIVDGRHPVVEASVPRGTYVPATVKIGESDRRFSIITGPNMGGKSTLMRMTALVVLLAQTGSYVPAKKAKIGIVDSIFTRVGASDNLSKGESTFLVEMKETASILNKATSKSLIILDEIGRGTGTYDGISLAKAIAEYIIEKINATTLFATHYHILTELAEDFSTCCNFHMTAREYAGRIRFMYXMKEGGSSRSFGVEVAKLTDMPSVCYKKSRKRFFRGYGKKTEPPGIKNFEKKGKLPPFKNRIILFFQMGNFLAEKPRSLKKTFPGKPFF

SEQ ID NO: 7997 - DNA, 657 bp, Unknown
  Obtained from environmental sample
  misc_feature (1)..(657): n is a, c, g, or t
atgatgtgtatcccaaaagatcaagatgcccatgcaattggttttttaatgagtgaaaatgttatctcttcaatgaaagacataaaagagttaaaagtaagtgaagatggactaagagttgatgtgattgcaactataaacgaagactccttagaacatctttacacagaaaaaacattagtaagtggatgtggaggtggagtaactggaaatgttgaaggtggggtagagataccatttaatcaaacggcatttaaagtaaaaccagaaacaatctcaagtgagattaaaatattttaccatgaaagtgaactatacaacttaacaggttgtgtccataaagcgatgatatatcttcttgatggaaatacaattacagcagaagatataggaagacacaatgcaattgataaagtggttggaaaatgcaaactacaaggacttgacacaacaaagtcaatcctttttgtatctggaagattaagttcagagatggttacaaaagcagtaatgcataaaattccaatcattatatcaagaacagccccaacatatttaggtgttcaaacagcacataaacatggagttaccctaataggatttgcaagaggaaaaaagatgaatatctacactcatgcagggagaattgatgtctag

SEQ ID NO: 7998 - protein, 218 aa, Unknown
  Obtained from environmental sample
  DOMAIN (1)...(214): FdhD/NarQ family
  misc_feature (1)..(218): Xaa is any amino acid
MMCIPKDQDAHAIGFLMSENVISSMKDIKELKVSEDGLRVDVIATINEDSLEHLYTEKTLVSGCGGGVTGNVEGGVEIPFNQTAFKVKPETISSEIKIFYHESELYNLTGCVHKAMIYLLDGNTITAEDIGRHNAIDKVVGKCKLQGLDTTKSILFVSGRLSSEMVTKAVMHKIPIIISRTAPTYLGVQTAHKHGVTLIGFARGKKMNIYTHAGRIDV

SEQ ID NO: 7999 - DNA, 369 bp, Unknown
  Obtained from environmental sample
  misc_feature (1)..(369): n is a, c, g, or t
atggaagtaagagttaaagtatggattgaagatgataaaaataatttagtatttggtggtggaaaaactgaaattctagagtatatagatgaaaaaggctcaatcgctgaagcagcacaaatgatgggattaaattacaaaaaaacatggacacatataaaagtgcttgaaaagtatattgaggatgaacttgtaataacccaaaaaggtggtggagagcaaggtggaagtacacttactccaaaagcaaaagagataattgaaaactttaaaatactcaaaaaagatgttcgagcctatacacaagagagatttaaagatttatttattgatagtaaaacagatatattacatcttaaagagagttaa

SEQ ID NO: 8000 - protein, 122 aa, Unknown
  Obtained from environmental sample
  DOMAIN (28)...(84): Bacterial regulatory helix-turn-helix protein, lysR family
  misc_feature (1)..(122): Xaa is any amino acid
MEVRVKVWIEDDKNNLVFGGGKTEILEYIDEKGSIAEAAQMMGLNYKKTWTHIKVLEKYIEDELVITQKGGGEQGGSTLTPKAKEIIENFKILKKDVRAYTQERFKDLFIDSKTDILHLKES

SEQ ID NO: 8001 - DNA, 462 bp, Unknown
  Obtained from environmental sample
  misc_feature (1)..(462): n is a, c, g, or t
gtgatcaagggaaatgaactaatattagatttagagaaaaaattaaatttatattcaaaccatctagaaaaaaaagtaaatattattgaaaacgctcaatgtaaagattttgttgatattgtattcttaatttttgaaaaaaaagaactacaaaatgacatagaaaaatttaataataaatataatgataaccttatacttgaagaaaataaaataaaatatagtaacccaaagaatttttccaaaataggaatagaaatatttgaaaggttatatttcaaagagaaagaaaaagcattaataaaatggcttgatatgattaaattgtttgaaagttatggtttttggtattggttagatgaactttcaccaattgaagaagttagagaatattttttagatgaaatcacaaattatattattaataataaagaatcaaaagaaaagtggataaaaaattga

SEQ ID NO: 8002 - protein, 153 aa, Unknown
  Obtained from environmental sample
  misc_feature (1)..(153): Xaa is any amino acid
MIKGNELILDLEKKLNLYSNHLEKKVNIIENAQCKDFVDIVFLIFEKKELQNDIEKFNNKYNDNLILEENKIKYSNPKNFSKIGIEIFERLYFKEKEKALIKWLDMIKLFESYGFWYWLDELSPIEEVREYFLDEITNYIINNKESKEKWIKN

SEQ ID NO: 8003 - DNA, 642 bp, Unknown
  Obtained from environmental sample
  misc_feature (1)..(642): n is a, c, g, or t
ttgttgaaaaaatacgcaattattatagagtatgcaaaaggtagtgacaaaagttttgatggatttagaccagatacgaaacctattttaaagtcactaaaaaatatagcaaatattgatggtgaagttgttttttataatccaaaaagaaaacaagagttatttaaatatatcaaaaatacagcttcgattgttataagtagaatcaatcctggaaatctcaaagagatagatgagtattttatttttttaaaatctttaagtgatggtggtattaatatacatactcatcctgatgtgatgataaatcttgattttaaagatatcttagaaaagctcaaaaactcccttgtaggagacaaaggaactatgtttttccacacttacaaagagttcaaaaaagaatttcctcaaatccttgaaaaatatagagtacgagttctcaaaacaaactatggttcaactggagaaggagtttatcttataaatttaagagatgatgaaagtattgtatgtactgaggctgttgataatatcanatatttttatagcaatatggacgaatttatcanaagttttaaagaaaaatttgacatgatgattcanatgagatttattttaaagggaaaagtggttttgtag

SEQ ID NO: 8004 - protein, 213 aa, Unknown
  Obtained from environmental sample
  misc_feature (1)..(213): Xaa is any amino acid
MLKKYAIIIEYAKGSDKSFDGFRPDTKPILKSLKNIANIDGEVVFYNPKRKQELFKYIKNTASIVISRINPGNLKEIDEYFIFLKSLSDGGINIHTHPDVMINLDFKDILEKLKNSLVGDKGTMFFHTYKEFKKEFPQILEKYRVRVLKTNYGSTGEGVYLINLRDDESIVCTEAVDNIXYFYSNMDEFIXSFKEKFDMMIXMRFILKGKVVL

SEQ ID NO: 8005 - DNA, 354 bp, Unknown
  Obtained from environmental sample
  misc_feature (1)..(354): n is a, c, g, or t
atgaaaatagttatttcaccagctaaatcactcgattttacaagcattttaccaacaaaaaatcatacaaatgcacaatttttagatcaggccgaaaaattaaacacaattttaaaaaagaagagtccgaagcaattatctaaattaatgtcaatttcagataaacttggagaattgaactggcaacgcaatcaggattgggctttaccatttacaattgaaaatgctcgtcaggcaattttcgcttttaaaggaaccgtttatgaaggtttagatgcctattccattccaataaataagataaatcagttacaagataaattacgaatcctatccgggcaatatggcatataa

SEQ ID NO: 8006 - protein, 117 aa, Unknown
  Obtained from environmental sample
  DOMAIN (1)...(117): Protein of unknown function (DUF328)
  misc_feature (1)..(117): Xaa is any amino acid
MKIVISPAKSLDFTSILPTKNHTNAQFLDQAEKLNTILKKKSPKQLSKLMSISDKLGELNWQRNQDWALPFTIENARQAIFAFKGTVYEGLDAYSIPINKINQLQDKLRILSGQYGI

SEQ ID NO: 8007 - DNA, 447 bp, Unknown
  Obtained from environmental sample
  misc_feature (1)..(447): n is a, c, g, or t
atgactaaaattaaacagattttaatacatattttaaagttctttttgataagctgtatttttgttgttctagtaaccctgttggtgccctattttagtgattcttgtaaggtcaattctaacattaaaaaatttgatgttatcattgtattgggtagtcctgcaatagataattgtgaagcaggatcaataatgaaagatcgggttgctaaaggaattgaattattgaaattaggcatagggaaaaagatattgtttacaggtagttcggtgcggaataattgtactgaagctgaagtaatggaagcttacgcaattttcaaaggaatatctaaaaggaatattttaacagaaaccaaagcagcaaacacttttccaaaccctttttattctggtggcacattgaagcaacttatttttaaatccactgccaattgtcccctctga

SEQ ID NO: 8008 - protein, 148 aa, Unknown
  Obtained from environmental sample
  DOMAIN (44)...(148): DUF218 domain
  misc_feature (1)..(148): Xaa is any amino acid
MTKIKQILIHILKFFLISCIFVVLVTLLVPYFSDSCKVNSNIKKFDVIIVLGSPAIDNCEAGSIMKDRVAKGIELLKLGIGKKILFTGSSVRNNCTEAEVMEAYAIFKGISKRNILTETKAANTFPNPFYSGGTLKQLIFKSTANCPL

SEQ ID NO: 8009 - DNA, 375 bp, Unknown
  Obtained from environmental sample
  misc_feature (1)..(375): n is a, c, g, or t
ttgaagaatttaaaacaattaaaaatgaaaacaacaatttttattttactcaatctgtcaatattcattagttcctattctcaaaattcctttgaactgttgattgacaaagaaggagctcaacgcaacacatctgttgttgtagatagtaatggagattatattgtaagcacacaagaatttaaaaatggagagtataattttattttaacaaaaataagttcaattggtaaaatagttgattcaatttattttgaaaataacgaaaaagaagtagttattgatttgattcaagttgatgataatgaatttattgtcgtaggagcaatttatgcagataattatattgaatcatccttgtggttaagaaaatga

SEQ ID NO: 8010 - protein, 124 aa, Unknown
  Obtained from environmental sample
  misc_feature (1)..(124): Xaa is any amino acid
MKNLKQLKMKTTIFILLNLSIFISSYSQNSFELLIDKEGAQRNTSVVVDSNGDYIVSTQEFKNGEYNFILTKISSIGKIVDSIYFENNEKEVVIDLIQVDDNEFIVVGAIYADNYIESSLWLRK

SEQ ID NO: 8011 - DNA, 582 bp, Unknown
  Obtained from environmental sample
  misc_feature (1)..(582): n is a, c, g, or t
atgatggaaggcggggcatcatcggctgaagtgtttgctgaaacatttagaaatacctatggctggaatgtcatgaaaccttctttgataaagaaaagtctatgggaccggctatataatgtatatatagatgattccttaaagttggatgtgcataagttttttaaaaagaagaacccctatgcacttcaggagataacagctgtcatgttggaaacggttcggaagggatattggaaggcggataaaaatcagttggcaaaactggcaaatcttcatgcgacattaattataaactatgaccctggatgtagcggttttgtctgcaataataagaaactgcggagaatgatcaaagagaatttagatttggaaaaagcgaaaaaatacgataatgtcattcaatccagtctggtaaaggcaaggcctgttaaaggaatgaaattaaataaagaagacaaattaaaaaaaaaaaataagaaaaaagtaattcggaatgatacgttgatcgcactcagtgttgtttttgtttttctacttatatttataattggacgttttaaaaggagaaatgaaacttag

SEQ ID NO: 8012 - protein, 193 aa, Unknown
  Obtained from environmental sample
  misc_feature (1)..(193): Xaa is any amino acid
MMEGGASSAEVFAETFRNTYGWNVMKPSLIKKSLWDRLYNVYIDDSLKLDVHKFFKKKNPYALQEITAVMLETVRKGYWKADKNQLAKLANLHATLIINYDPGCSGFVCNNKKLRRMIKENLDLEKAKKYDNVIQSSLVKARPVKGMKLNKEDKLKKKNKKKVIRNDTLIALSVVFVFLLIFIIGRFKRRNET

SEQ ID NO: 8013 - DNA, 618 bp, Unknown
  Obtained from environmental sample
  misc_feature (1)..(618): n is a, c, g, or t
atgataaaagtctctaatcttactaaaaagtttggttcacatatctcacttgatagtgtcaatattgagtttaataaaaatgagagtgttgcgctcatgggtgcaaatggtgcaggaaaaactacactaatacgctcaattcttggatattaccacccaaatagcggtgagataatcatagatggtttaaatccgatcaaggagcgagttaaagttttgcaaaatataagttttgttcctcagcttcctcctccaattaagttaaatcttgatgagctgataaattatatagtgacaagtgcaaaggtcgataaagagctgattttacattatgctaatgagatgaagcttgatatcaactccaatttatacaaatcattttttaaattgagtggtggcatgaagcagaagatgttgattgcaatcagtttagccaaaaaaagtaaaataatcatatatgatgagccaacggcaaatcttgatccaaaagcaagagatgacttttataaacttctaaaacagaatgaagatgacaaaatcctcttatttgttacacatagactccaagaggttaaagagcttgaaacagacaggtatatatggatatgggaaaagtag

SEQ ID NO: 8014 - protein, 205 aa, Unknown
  Obtained from environmental sample
  DOMAIN (27)...(205): ABC transporter
  misc_feature (1)..(205): Xaa is any amino acid
MIKVSNLTKKFGSHISLDSVNIEFNKNESVALMGANGAGKTTLIRSILGYYHPNSGEIIIDGLNPIKERVKVLQNISFVPQLPPPIKLNLDELINYIVTSAKVDKELILHYANEMKLDINSNLYKSFFKLSGGMKQKMLIAISLAKKSKIIIYDEPTANLDPKARDDFYKLLKQNEDDKILLFVTHRLQEVKELETDRYIWIWEK

SEQ ID NO: 8015 - DNA, 600 bp, Unknown
  Obtained from environmental sample
  misc_feature (1)..(600): n is a, c, g, or t
atgtcaaaggtttttaaaaatcatgataaaggtaatacatttaaaattgtaaaggaaactttaaaagctttagggtataaaatttttgctgatgttttaaatgcaaaatattttggtgtgccacagaatagggaaagaatttatattattgcttttttagaagatcataataaacaagagataaaacttgattttgaaaaaataaaaaaaataaaaaaaatttctaaacttggaaatattttagataaaaatgttgattgtaaatatacaatttcagacaaattatgggcaggacatcaaagaagaaaattagaacataaagctaaaggtaatggatttggatattctatatttaatgaaaaatcagaatatacaagtacaataagtgctagatactacaaagatggttctgaaattctaatcgaacaaaaaaataaaaatcctagaaaattaactcctagagaggctggaagattacaaggttttcctgatagttttcaaataccggttagtgatactcaaagctataaacaatttggaaatagtgtagctgttccagtaattgaagaattagcaaaaagtattttcacattgctataa

SEQ ID NO: 8016 - protein, 199 aa, Unknown
  Obtained from environmental sample
  DOMAIN (1)...(197): C-5 cytosine-specific DNA methylase
  misc_feature (1)..(199): Xaa is any amino acid
MSKVFKNHDKGNTFKIVKETLKALGYKIFADVLNAKYFGVPQNRERIYIIAFLEDHNKQEIKLDFEKIKKIKKISKLGNILDKNVDCKYTISDKLWAGHQRRKLEHKAKGNGFGYSIFNEKSEYTSTISARYYKDGSEILIEQKNKNPRKLTPREAGRLQGFPDSFQIPVSDTQSYKQFGNSVAVPVIEELAKSIFTLL

SEQ ID NO: 8017 - DNA, 762 bp, Unknown
  Obtained from environmental sample
  misc_feature (1)..(762): n is a, c, g, or t
gtggtacgatatgcctatgctatagagtatgattatatagacccaacagagttacaacatacacttgaaacaaaaaagataaaaaatctttatttagcaggacaaatcaacgcaacaactggatatgaagaagcagcagcacaaggtttaatggctgggataaatgcaagtttagctattgaaaataaagagccttttgtattaagaagagatgagagttatattggagttttaatagatgaccttgtaacaaaagggacaaatgaaccatatagaatgttcacaagtagagctgaatacagacttcttttaagagaagagagtgccgatatgagacttatgggatatggacatgattttggacttatagatgatgatacttacaatacaatgactcacaaaaaacaaactatcaaagaatctgtagagtttatggaaaatgagtggttcacatcanaaaaagaaaatctaacacttcttgaagagttaggtgaagacaaaatttcagacncaattttacttgtagatttagtaggaagaaatactatcacaaaagaaaaatttgatagattggttcctagtcttgcacatcttgatgactatttaanagagcaagtgatagtagaagcaaaatattatagatgtggtgataaacaacaaaaaccgatggaaaagatgaaaaagatgctaaatctaaaaatacaagagatttcatctaccataacttacctggactttctccaaagttatcgaaaagcttaa

SEQ ID NO: 8018 - protein, 253 aa, Unknown
  Obtained from environmental sample
  misc_feature (1)..(253): Xaa is any amino acid
MVRYAYAIEYDYIDPTELQHTLETKKIKNLYLAGQINATTGYEEAAAQGLMAGINASLAIENKEPFVLRRDESYIGVLIDDLVTKGTNEPYRMFTSRAEYRLLLREESADMRLMGYGHDFGLIDDDTYNTMTHKKQTIKESVEFMENEWFTSXKENLTLLEELGEDKISDXILLVDLVGRNTITKEKFDRLVPSLAHLDDYLXEQVIVEAKYYRCGDKQQKPMEKMKKMLNLKIQEISSTITYLDFLQSYRKA

SEQ ID NO: 8019 - DNA, 771 bp, Unknown
  Obtained from environmental sample
  misc_feature (1)..(771): n is a, c, g, or t
atgaataaaataaaaatacttgggataatgatttttttattatcattattattggttgtaattgtaaattatatcgataaacagaataaacaaaaaagcaatattttaacactaattaatcaacaaaaagattatacgcaagagatatcaaaaaatattttttatatttatagaaatccaaatcatcccactattcaactagataaagcagtggaaaattttactaataatctcaataaaaaagatagaatactaatgaatattaaatctgaaaaaatcaaaagacaaagtcaaaaaatatttgaattttggaagcaatatcattcagaagttatattatttaaaaatcaaataaaagttattatgccttatacaaatatattattagaggaaacaatcacaagaatatatataagtaatatgtctttaacagctgaatttgatagtttaattaaattacataaagattattttaatgagtcattaagagaatacaaaattattcaatatattttatttattctcataagtagtcttcttatgtatctttttttacaagtaaaaccccttctttcttttatacaaaagtttatgaattctgcaaataatattatccaaaagaatacaattagcgagttagaaccaattaatataaaagttcataataaagatattcaaaatgtagcaaacaatttcaatagtttggtacaaaacattaatagttctattgaacaaggatatactgcaatagattatacttcaaattcttag

SEQ ID NO: 8020 - protein, 256 aa, Unknown
  Obtained from environmental sample
  misc_feature (1)..(256): Xaa is any amino acid
MNKIKILGIMIFLLSLLLVVIVNYIDKQNKQKSNILTLINQQKDYTQEISKNIFYIYRNPNHPTIQLDKAVENFTNNLNKKDRILMNIKSEKIKRQSQKIFEFWKQYHSEVILFKNQIKVIMPYTNILLEETITRIYISNMSLTAEFDSLIKLHKDYFNESLREYKIIQYILFILISSLLMYLFLQVKPLLSFIQKFMNSANNIIQKNTISELEPINIKVHNKDIQNVANNFNSLVQNINSSIEQGYTAIDYTSNS

SEQ ID NO: 8021 - DNA, 552 bp, Unknown
  Obtained from environmental sample
  misc_feature (1)..(552): n is a, c, g, or t
ttgagttgtgtagattgtcataaaaatagcaaagataaaaaatgggaaaacaaagttgattgtaaatcttgccatagtgatatttcaaaaaaaaatcatcaagaatatcatactaatatttcgtgtaatacttgtcatagctcttggaatattagtaactatgaactcaatgttttaagagatgacacaaagaactataaacagtggaaaaggctcacagtccaagaagatagatatttagaaaagtttttaaaaaaagctcttaaaaatccagagttaaagcctcaaatgccagattatctaaccaacaaattagaagatggagtttggtatagtggttggagatttaaaagatgggagaatttctttttagtaaatgatgagaatggaaaaattaaaatagcaataccaagatatcaatatagaattagctttaaaaatgaaaaaggggagatgatttttgatgatgtgtctcaaattgatgataaaaaattagaggcatttatccccacatcccccacacacaatcacaaaaaaagcaaaatcttgtga

SEQ ID NO: 8022 - protein, 183 aa, Unknown
  Obtained from environmental sample
  misc_feature (1)..(183): Xaa is any amino acid
MSCVDCHKNSKDKKWENKVDCKSCHSDISKKNHQEYHTNISCNTCHSSWNISNYELNVLRDDTKNYKQWKRLTVQEDRYLEKFLKKALKNPELKPQMPDYLTNKLEDGVWYSGWRFKRWENFFLVNDENGKIKIAIPRYQYRISFKNEKGEMIFDDVSQIDDKKLEAFIPTSPTHNHKKSKIL

SEQ ID NO: 8023 - DNA, 888 bp, Unknown
  Obtained from environmental sample
  misc_feature (1)..(888): n is a, c, g, or t
atgaaaataagaaacttgaatccttttacatggtttagaagtaatagcattgctacaagtagcgatgagattactgcattatttaccacttcaaaaactaaaagtggtacagtgataactattgataatgctatgcaaatatctacagtattttcatgtattagagttttatctgagggtattgcttgtctacctttacatctacataaaaaagatggtaaaaataaatcaaaagctacaaatcataaactctatgatgtgttacattttcaaccaaatagtgaacacacacctatatcattttgggaaatgtgtatagcttctctttgtctcaatggcaatttttacgcacaaattattagaaacaacagaggtgatgtgttagagctcataccttttatttcaaaaaatgtaagaaaatatagactcaaatcaacaggtaagatagtatttacatatttacttgatggtgtaacttatgagtttaaaaaagaagatatatttgaagttatggggcttactcttgatggttttataggggttagtcctattacatatcaaagagaaacattaggactaagtaaagcagctgtagaacatggatctaaatattttgcaaatgatgctacaccaccacttgcattagaagtaccaaatgaattaagtgatactgcatatgaacggcttaaaaaatcttggcatgaatcacaaggtggaaataacaaatttaaaacagcaatattagaacaaggcacaaaagcaaatcaactaagtatctctcataaagatagtcagtttttagaaacaagacaatttcaaagaagtgaaatagctggtatgtatagagtaccacttcatcttataaatgaccttctcgagccgatctga

SEQ ID NO: 8024 - protein, 295 aa, Unknown
  Obtained from environmental sample
  DOMAIN (31)...(295): Phage portal protein
  misc_feature (1)..(295): Xaa is any amino acid
MKIRNLNPFTWFRSNSIATSSDEITALFTTSKTKSGTVITIDNAMQISTVFSCIRVLSEGIACLPLHLHKKDGKNKSKATNHKLYDVLHFQPNSEHTPISFWEMCIASLCLNGNFYAQIIRNNRGDVLELIPFISKNVRKYRLKSTGKIVFTYLLDGVTYEFKKEDIFEVMGLTLDGFIGVSPITYQRETLGLSKAAVEHGSKYFANDATPPLALEVPNELSDTAYERLKKSWHESQGGNNKFKTAILEQGTKANQLSISHKDSQFLETRQFQRSEIAGMYRVPLHLINDLLEPI

SEQ ID NO: 8025 - DNA, 657 bp, Unknown
  Obtained from environmental sample
  misc_feature (1)..(657): n is a, c, g, or t
atgaaaattttaatagttgaagatgatgaaaacattctctctttgttaaaaagaggttttgaagaagagggttatataatagatagctcaagtgatggagaggaagctgagtatcttataacaacaaatagttatgatgttattatacttgattggatgcttccgagtaaaaatgggattgagatacttcaatcaattagagaaaaaaacatcactactcctattattatgcttactgcaaaagatgagattgacaatagagttttaggacttactaatggtgcagatgactatatgtgtaagccttttagttttaaagagttgcaagcaagagcaacagcactttatagaagatcaatctccttaaatacaaatattatacaaataaaagatctcactattgatattgatgcaaaaaatgtaaaaaaagatgatgtggatatacttttaacccaaaaagagtatgagcttttactatttttaatcaaaaataaaaatagaacagtttcaaatagcatgatagaagagcaactctggagtaatgaagagtatataaatagtaatgtgatacaagtcactatttataatttaagaaaaaaaatatcaaaagattttattaaaagttcaagaggactagggtatagaattgaagtttaa

SEQ ID NO: 8026 - protein, 218 aa, Unknown
  Obtained from environmental sample
  DOMAIN (145)...(216): Transcriptional regulatory protein, C terminal
  misc_feature (1)..(218): Xaa is any amino acid
MKILIVEDDENILSLLKRGFEEEGYIIDSSSDGEEAEYLITTNSYDVIILDWMLPSKNGIEILQSIREKNITTPIIMLTAKDEIDNRVLGLTNGADDYMCKPFSFKELQARATALYRRSISLNTNIIQIKDLTIDIDAKNVKKDDVDILLTQKEYELLLFLIKNKNRTVSNSMIEEQLWSNEEYINSNVIQVTIYNLRKKISKDFIKSSRGLGYRIEV

SEQ ID NO: 8027 - DNA, 399 bp, Unknown
  Obtained from environmental sample
  misc_feature (1)..(399): n is a, c, g, or t
atggctataaaaaatatgtggggcaatattgacgacatggacgatgttcgtccacctcatgaaattattgaagagcaaggaaaacttttagaaaaaatgagcaaaggggtcctagagataaaaattgaacgtaaacagagtgctaccgtatttaattacgatatctttattgctcttcctaccatgaaatacaggcaacgtattttccgtttgacccatgatttcaaactttatccggcaaatttatatgatgagcaggggagtcgtgaatacaaaagtaaggatcaggaagagtttgagggaaatcttggcaagattctatcctctaaggaaactatgacaacaatcagcgggatgatggcacaggctcgcttgggcgcaggtgatattctcatataa

SEQ ID NO: 8028 - protein, 132 aa, Unknown
  Obtained from environmental sample
  misc_feature (1)..(132): Xaa is any amino acid
MAIKNMWGNIDDMDDVRPPHEIIEEQGKLLEKMSKGVLEIKIERKQSATVFNYDIFIALPTMKYRQRIFRLTHDFKLYPANLYDEQGSREYKSKDQEEFEGNLGKILSSKETMTTISGMMAQARLGAGDILI

SEQ ID NO: 8029 - DNA, 756 bp, Unknown
  Obtained from environmental sample
  misc_feature (1)..(756): n is a, c, g, or t
atgaatacccaaagattatatatacaagaacacgagccattgaattttacatttcatcaaaataaatatgattttattgttaatgagataccaagtattgagtttaaaaatagaggaaactttttgattttaaaaatcaaaaaacaacatctctccacatgggagttattaggttatatctctacaactttagatatagatgaacatctaatagggtatgctggattaaaagataaaaatgcaacaacaacacaatatatctcaatacctatgaataaaagtagagatattgaatatttaaatagtaaaaatgtcaccatattggaaacttacaaacatgacaaaaaattaaaaataggtgatttaaaagcaaatagatttaaaatcattttaaaagatgtaaaacaagaggaattaccaaaaatatatcaaacaatctcccaaatacaaaagcatggtatgcctaactattttggatatcaaagatttggacaagagtgtagttttgaaaagacaaagcgagttgtttatggcgaagagataataagtgataaaaaacttaataagtttttaaaactagcatatcaaagttattttttcaatggatggttaataaaaagaatggagctttcaaaagagcaaaagagtaataaacttatccaacttgatggggatatttgcaaccttcatgatagaacagttgtaacaggattgcttcctggtagagatattttaagggccaaaggaaagcactga

SEQ ID NO: 8030 - protein, 251 aa, Unknown
  Obtained from environmental sample
  DOMAIN (3)...(250): tRNA pseudouridine synthase D (TruD)
  misc_feature (1)..(251): Xaa is any amino acid
MNTQRLYIQEHEPLNFTFHQNKYDFIVNEIPSIEFKNRGNFLILKIKKQHLSTWELLGYISTTLDIDEHLIGYAGLKDKNATTTQYISIPMNKSRDIEYLNSKNVTILETYKHDKKLKIGDLKANRFKIILKDVKQEELPKIYQTISQIQKHGMPNYFGYQRFGQECSFEKTKRVVYGEEIISDKKLNKFLKLAYQSYFFNGWLIKRMELSKEQKSNKLIQLDGDICNLHDRTVVTGLLPGRDILRAKGKH

SEQ ID NO: 8031 - DNA, 456 bp, Unknown
  Obtained from environmental sample
  misc_feature (1)..(456): n is a, c, g, or t
ttggataaagccatagaaataggaaatatctacgatgccactaccagaatggaatatgaagcagtaaagaaattgaccaactaccttattgaggaaagaaaaaaagtagctacacttggctacatcaattctaaaaaaggttcggaattaatgtctcctcacttacactatcgttatttcgataacaacaacctttctcgtttaatgattcccaaaggaaacgaagtagataaatttattgctactccttttcagattttaatagaccttaccatgtccgattgttttccaaataaatacattaccacactttctatagcacgttttaaagtgggtgcttgtggcgattaccgtgatgaagcttgtgatttaaccattgccttaaaagaaaataaatctatcgatcaacttatcttgcaaataaaacattatttaaagatgattaatgcaaattaa

SEQ ID NO: 8032 - protein, 151 aa, Unknown
  Obtained from environmental sample
  misc_feature (1)..(151): Xaa is any amino acid
MDKAIEIGNIYDATTRMEYEAVKKLTNYLIEERKKVATLGYINSKKGSELMSPHLHYRYFDNNNLSRLMIPKGNEVDKFIATPFQILIDLTMSDCFPNKYITTLSIARFKVGACGDYRDEACDLTIALKENKSIDQLILQIKHYLKMINAN

SEQ ID NO: 8033 - DNA, 555 bp, Unknown
  Obtained from environmental sample
  misc_feature (1)..(555): n is a, c, g, or t
atgagttgggtaaacggaaaaacaagtgctaatatttcttacagttatattttaatggcagtaaatgaggggagttttactattcctgcagcagaagtaactattgatggtgaaaaataccaatcaaataccatagaaataaatgttagcaaaggtgctaatgttcaaaacaaccctaatagtaataacactactataactaaaggttctggcgacttgtttattaaatctagtgtaaacaaaaccactgtttaccaaggagagcatttagtggcgacttatcaactttatactaaagtgaatattgctgctaacgaaatggttaaaaatgcagatttaaacggtttttggagtcaagaaattaatataggtcaggcacaatggacacaagaaaaaattaacaatgaagtatggaatattgctaccatcaaaaaaaatggattgtttcctcagcgttcaggagagctagaaatagacccattagaaatgcttttttattccccaaaagagagtaagttgcgggacaaagtattttttgatccgtttttttggtaa

SEQ ID NO: 8034 - protein, 184 aa, Unknown
  Obtained from environmental sample
  misc_feature (1)..(184): Xaa is any amino acid
MSWVNGKTSANISYSYILMAVNEGSFTIPAAEVTIDGEKYQSNTIEINVSKGANVQNNPNSNNTTITKGSGDLFIKSSVNKTTVYQGEHLVATYQLYTKVNIAANEMVKNADLNGFWSQEINIGQAQWTQEKINNEVWNIATIKKNGLFPQRSGELEIDPLEMLFYSPKESKLRDKVFFDPFFW

SEQ ID NO: 8035 - DNA, 405 bp, Unknown
  Obtained from environmental sample
  misc_feature (1)..(405): n is a, c, g, or t
atgttactagtgaaatggattccgttaataccgattctatatccatacctaaattatcaattaataaaagaggaacctgatgttactaatgtcattttagataatgtttccgattttcatgtggtacagaaaggagataatttatttcaactttcaataaagtacaaaacgagtttaggagaattacaagaagccaataacttagaaacgacacttattacaacaggacaacgcttaagagttcgaaattttactaaggttaataacgacgctaaagacatcacgttttgggtggttaaatatagtattgcaaaagataaaggaacaacgcttaatgcgcttatgcgaattaatggtttaaagagtgatgttattaaaattggtcaaaaactgcaattaaaatag

SEQ ID NO: 8036 - protein, 134 aa, Unknown
  Obtained from environmental sample
  DOMAIN (97)...(134): LysM domain
  misc_feature (1)..(134): Xaa is any amino acid
MLLVKWIPLIPILYPYLNYQLIKEEPDVTNVILDNVSDFHVVQKGDNLFQLSIKYKTSLGELQEANNLETTLITTGQRLRVRNFTKVNNDAKDITFWVVKYSIAKDKGTTLNALMRINGLKSDVIKIGQKLQLK

SEQ ID NO: 8037 - DNA, 429 bp, Unknown
  Obtained from environmental sample
  misc_feature (1)..(429): n is a, c, g, or t
atgcaaaaactaaataagctaacgctaaaacaaagagaagaactttttagacaacttcgtatatcaattacacatcactcaaatgcaatggaaggaactacattatcatttggagaaacaaaagagttacttgaattagggcatacagcaggacataagccactgggtgaacaacttgtaatattaggctttgcaaaagcttatgatgtaattattcgtgaagctacaaatccacataatattattgatagcaattttattaaagatattcatgcaattatgtttgaagatgctttaaaagttgcacctgaatatgtctctaaaccagttggggcatatagattagatgaaagatttataaaaggtgtagatataaaattatcagcccctcatatgatttcaaatgatattgaaaaatttattgtatag

SEQ ID NO: 8038 - protein, 142 aa, Unknown
  Obtained from environmental sample
  misc_feature (1)..(142): Xaa is any amino acid
MQKLNKLTLKQREELFRQLRISITHHSNAMEGTTLSFGETKELLELGHTAGHKPLGEQLVILGFAKAYDVIIREATNPHNIIDSNFIKDIHAIMFEDALKVAPEYVSKPVGAYRLDERFIKGVDIKLSAPHMISNDIEKFIV

SEQ ID NO: 8039 - DNA, 411 bp, Unknown
  Obtained from environmental sample
  misc_feature (1)..(411): n is a, c, g, or t
atggagagattagaggagagcttaaaagtaagtgaattaaatttttattttgggtttacacaaattttaaataatatcaattttgaactaaaagcaggtgaagttataagtatagtaggtccaagtggtggtgggaaaacaacactattaaaactttgtagtgatcttcttgatgtaacagaaggagagataacaaatagttttacctcatcagcttttgcttttcaagatgcgagactacttccttggaaaacagtagttgaaaatataatgctccctattatagcaacaaaaaaatatactactgcatacaaagaagcctgtgaaatagccctaagatttggacttgaagagaaagattttataaaatatcccaaaagatttaagtggtggaatgaaacagcgagttaa

SEQ ID NO: 8040 - protein, 136 aa, Unknown
  Obtained from environmental sample
  misc_feature (1)..(136): Xaa is any amino acid
MERLEESLKVSELNFYFGFTQILNNINFELKAGEVISIVGPSGGGKTTLLKLCSDLLDVTEGEITNSFTSSAFAFQDARLLPWKTVVENIMLPIIATKKYTTAYKEACEIALRFGLEEKDFIKYPKRFKWWNETAS

SEQ ID NO: 8041 - DNA, 489 bp, Unknown
  Obtained from environmental sample
  misc_feature (1)..(489): n is a, c, g, or t
atgaataattcagaaatctggcttaaagcgattctaatagaaggagaccgtctactggtcaataataatgaaaatgaaaaattgatgtgtggtctttttaaaaccgaccgtcaaatactgtgggacaacacacaaaaaagaatcatatttgaatatacattttcacttgtcgtgaacaaagcaattaactggttaaaagaaatgaggaaaactgacagttcaaaaaaacaagagattgacgaatttttatcacatatgccaactgcaaaagaggttagggacatgctggaacatgacattgattatcttaataatgaaggtaataagcaaaagcgttttgttcataacataaaaaagaagggtcttaaaattaaattagacacctctacaccccttattttaagtgataattacttaattggcggtaaacttgatgttctcaaaacaataaagaaaaccgaagaactattggctaaaataggcaaataa

SEQ ID NO: 8042 - protein, 162 aa, Unknown
  Obtained from environmental sample
  misc_feature (1)..(162): Xaa is any amino acid
MNNSEIWLKAILIEGDRLLVNNNENEKLMCGLFKTDRQILWDNTQKRIIFEYTFSLVVNKAINWLKEMRKTDSSKKQEIDEFLSHMPTAKEVRDMLEHDIDYLNNEGNKQKRFVHNIKKKGLKIKLDTSTPLILSDNYLIGGKLDVLKTIKKTEELLAKIGK

SEQ ID NO: 8043 - DNA, 459 bp, Unknown
  Obtained from environmental sample
  misc_feature (1)..(459): n is a, c, g, or t
ttgaaattgttacaaatagtacaaaacctcaatccccatttcactccagaccttaacgaagttgtaccttatcaatttaaactaccagctgccccatttgttgctaaaggtgatacaaagattgatatccaaaacttgctacaaaaagcaaaaaatcttttaaattattgtgatgttttaattgttgagggtgctggtggattaatggtaccaattgagaaaaactattttatgattgatttgattaaagagtttcacaaacaattaaatgcaaaaacgatacttatatctcctagtaacttggggagtattaacgatactatgctttctcaaactctattaaagaattataatataaattatgaatggtatattaacctttataaagataaagagagttttaaaactgtcactttgcctttttataaagagtatttcaatcaaataaattatttgtaa

SEQ ID NO: 8044 - protein, 152 aa, Unknown
  Obtained from environmental sample
  misc_feature (1)..(152): Xaa is any amino acid
MKLLQIVQNLNPHFTPDLNEVVPYQFKLPAAPFVAKGDTKIDIQNLLQKAKNLLNYCDVLIVEGAGGLMVPIEKNYFMIDLIKEFHKQLNAKTILISPSNLGSINDTMLSQTLLKNYNINYEWYINLYKDKESFKTVTLPFYKEYFNQINYL

SEQ ID NO: 8045 - DNA, 777 bp, Unknown
  Obtained from environmental sample
  misc_feature (1)..(777): n is a, c, g, or t
atgctagaaaaaagtgaccctatattatgtagtgcagactatagagctgcacatttgctaaaacagacttggtgtaaaaaaggtgtaggtgtagatgtaatagggaacatgccaaatgtcatggaaagaggtgatatgctcatctatgatgatagcaatgaagcaagtcctactatgcaagcgcatatgaaagagttttgtactcatctatataaagttggaactgatatcccttttgatatagttgatgagacattttttgaagaagtagaaaaaacaaatgaaaaagcgatattttttgctgatgatgattatgctgaatggttttttaaacttattcaaactgggtcaaaacaagatattcctcttatttggggacattattttttctttaaaaatgaatctaaaatagcttcctactttagtgaagtaatagaggaagatggatatatcccaacagtaaaatctacaaagtatcttttaacagcttcagttcatacagcacttgaatcaattgcaagtggtaactatcctgtattttttcatagaggagataagccagttgaacatagagatttacttgaaaagtacaatatccctattatccaaaaagtagaaaacatggaagagcttatgaaaagttttgaacaaatagttcaaagctatccgccattaaatccaattaaaaagttcgatattacaaagattaaaaatgagatagaaaatactatcaaaaaatttgagatgattcaaccatctttagaatataaattctaa

SEQ ID NO: 8046 - protein, 258 aa, Unknown
  Obtained from environmental sample
  misc_feature (1)..(258): Xaa is any amino acid
MLEKSDPILCSADYRAAHLLKQTWCKKGVGVDVIGNMPNVMERGDMLIYDDSNEASPTMQAHMKEFCTHLYKVGTDIPFDIVDETFFEEVEKTNEKAIFFADDDYAEWFFKLIQTGSKQDIPLIWGHYFFFKNESKIASYFSEVIEEDGYIPTVKSTKYLLTASVHTALESIASGNYPVFFHRGDKPVEHRDLLEKYNIPIIQKVENMEELMKSFEQIVQSYPPLNPIKKFDITKIKNEIENTIKKFEMIQPSLEYKF

SEQ ID NO: 8047 - DNA, 306 bp, Unknown
  Obtained from environmental sample
  misc_feature (1)..(306): n is a, c, g, or t
atgattttggaatttactgtaaagcaaggtagaactaaaataatcgaaattaccttttcgggcaattatcgcggtatatttaagtcgttcgtaatagcacatacggcagcgacttccttctcgaaaagcagcctttcgcaaaaaatcttccaggttatactcatcctttataataaaaggaattttctcttcttccaaataatgagccgctgtatccaaccgttttttatactcagtatagggatgaatgttaggattaaaccaaaagccgtgaacatcaaaaccagcttcacgcagatggtttga

SEQ ID NO: 8048 - protein, 101 aa, Unknown
  Obtained from environmental sample
  misc_feature (1)..(101): Xaa is any amino acid
MILEFTVKQGRTKIIEITFSGNYRGIFKSFVIAHTAATSFSKSSLSQKIFQVILILYNKRNFLFFQIMSRCIQPFFILSIGMNVRIKPKAVNIKTSFTQMV

SEQ ID NO: 8049 - DNA, 444 bp, Unknown
  Obtained from environmental sample
  misc_feature (1)..(444): n is a, c, g, or t
gtgcaagcaaccaagtttcataccaacaaaaatttgacagctttattgttattactaacgatagctctttttagcacaagctcttttttggttgcacaagaaacaacaacggattctacctcgcatttagtacccgacagctctatttctaaagatgctgtttcttcaaaacttcattacaaatctactgactccattagatttgacatgaaaaacaagaaggtttatctatttggaaatgttgaagtttattatgaagatattgaattaaaagccgaagaggttgagataaatttagactccaatattgttattgccagaggaaaacaagattctttaggaaagttttatggagaaccagtaatgaaagaagctggaaaagtatttaatgctcacgaaataaatacaatatttaaactaaaaaaggcattattaccgaagtaa

SEQ ID NO: 8050 - protein, 147 aa, Unknown
  Obtained from environmental sample
  misc_feature (1)..(147): Xaa is any amino acid
MQATKFHTNKNLTALLLLLTIALFSTSSFLVAQETTTDSTSHLVPDSSISKDAVSSKLHYKSTDSIRFDMKNKKVYLFGNVEVYYEDIELKAEEVEINLDSNIVIARGKQDSLGKFYGEPVMKEAGKVFNAHEINTIFKLKKALLPK

SEQ ID NO: 8051 - DNA, 876 bp, Unknown
  Obtained from environmental sample
  misc_feature (1)..(876): n is a, c, g, or t
atgatcgctgaggcctacattcagtctcagttgcgggtggttatggaagaactatttgtggtaaggttggtaaagatngttggttttaaaatatctcatttaaacacgagcaagtattcttcagtcaagcttgataagattgataagattgagggacgcttcgattttgcgatgactcaaactcaccattcaatggaaggaagagcaattgttcgagaagccaatttagatgaatatcagaaaaatccaaaagctggaaacgataataaacacgagtataagaatgctggactttataaagaacccaaattcccgaatcatcattggggattagctattgacttaaatgcctgcattggatgtggggcttgtacaattgcttgccaagctgaaaacaatgttcctattgtaggaaagaaagaagttattcgtgctcacgaaatgtcgtggatcagaatcgaccgttatttctctggagatgaaaacaaacctggagtcgtttttcaaccagtaatgtgtcagcattgtgataatgcaccttgtgaaaatgtatgtccagtagcagctacaaaccatagcagcgagggattgaaccaaatgatttataacagatgcattggaaccagatactgtggaaataactgcccctataaagtaagacgttttaattggttcgattatactcttgcagattctattcccaataaccttcatgatcccgctgggatgacagtagatttaagccgtatggtacttaatcctgatgttacaattagagctaaaggtgtgattgaaaagtgctcgatgtggtgtcagaggattcaagaaggcaaacttaatgcgaagcttgaaaggacgaaaagtaaaagatggtga

SEQ ID NO: 8052 - protein, 291 aa, Unknown
  Obtained from environmental sample
  DOMAIN (111)...(134): 4Fe-4S binding domain
  misc_feature (1)..(291): Xaa is any amino acid
MIAEAYIQSQLRVVMEELFVVRLVKXVGFKISHLNTSKYSSVKLDKIDKIEGRFDFAMTQTHHSMEGRAIVREANLDEYQKNPKAGNDNKHEYKNAGLYKEPKFPNHHWGLAIDLNACIGCGACTIACQAENNVPIVGKKEVIRAHEMSWIRIDRYFSGDENKPGVVFQPVMCQHCDNAPCENVCPVAATNHSSEGLNQMIYNRCIGTRYCGNNCPYKVRRFNWFDYTLADSIPNNLHDPAGMTVDLSRMVLNPDVTIRAKGVIEKCSMWCQRIQEGKLNAKLERTKSKRW

SEQ ID NO: 8053 - DNA, 402 bp, Unknown
  Obtained from environmental sample
  misc_feature (1)..(402): n is a, c, g, or t
ttgttatgttataatcacaaaactttaataaaatggatacaaaaattgaaacatatagtaataattggtggtggatacgcaggtgtttatgctttaaaagaactcataaaaaataaaaatatcaaaataacacttattgataaacatacttatcataatcttcaaccagaagtttatgaccttattgcaaacaaaggcactattgcagatgtaactattgacttgtcttcactttgtagtggatttgatcatccatttttagaatataaaaatttacgcgttactgataatgattataaacaaaagcaaatctctacagcagaccaagaaactattaaatttgattctctccctctttgggttgggaccagaactttttcccccaaaataatgaagggttaa

SEQ ID NO: 8054 - protein, 133 aa, Unknown
  Obtained from environmental sample
  misc_feature (1)..(133): Xaa is any amino acid
MLCYNHKTLIKWIQKLKHIVIIGGGYAGVYALKELIKNKNIKITLIDKHTYHNLQPEVYDLIANKGTIADVTIDLSSLCSGFDHPFLEYKNLRVTDNDYKQKQISTADQETIKFDSLPLWVGTRTFSPKIMKG

SEQ ID NO: 8055 - DNA, 384 bp, Unknown
  Obtained from environmental sample
  misc_feature (1)..(384): n is a, c, g, or t
atgaaaagagttgaaattgaaaagccggaagagtatctagctttagtagcaaaaaaagcaaaagagtatctctatcacgatcacccaactgaggggatagattttttttgtgatgatgagttagaaaatattggatggcactctagtgttttcgattttataaaatatagagatatagcagagtttatagaagaaaattgtgaaggtacacttacatttaatgatcacccaatggggtttaatggttttgtagaagttgacaacattgaagatgtacgagaaaaagtaaaacagtttgttgttgaaagaattaaaagtaataaactagatgaatatgacgatgatcaaaaagaatctttggaatttttttctattacgatataa

SEQ ID NO: 8056 - protein, 127 aa, Unknown
  Obtained from environmental sample
  misc_feature (1)..(127): Xaa is any amino acid
MKRVEIEKPEEYLALVAKKAKEYLYHDHPTEGIDFFCDDELENIGWHSSVFDFIKYRDIAEFIEENCEGTLTFNDHPMGFNGFVEVDNIEDVREKVKQFVVERIKSNKLDEYDDDQKESLEFFSITI

SEQ ID NO: 8057 - DNA, 393 bp, Unknown
  Obtained from environmental sample
  misc_feature (1)..(393): n is a, c, g, or t
gtgccccttaccaacatatttaaaaagaaaactttcgaaaaattctttcagcaactgaacgcaaaatattcccaaggcacaacaaaaaaaggcatactcagcatctttgagatcttcatcggacgaagtgatcttcaatccttcaggcaaagagatccccctgagaaatttgaattttctcttttttcttttaattctatggcatattcaggggaaacactccataaaacgacatcagcgtttttagaaaacagcataattgccaaagctgtaccccagccaccatcacctataatacatattttactcataataactgtcaaaagtttaacatatatgaatattatagtcaataatataagggcccgtaaaccaacaataaatcgttattaa

SEQ ID NO: 8058 - protein, 130 aa, Unknown
  Obtained from environmental sample
  misc_feature (1)..(130): Xaa is any amino acid
MPLTNIFKKKTFEKFFQQLNAKYSQGTTKKGILSIFEIFIGRSDLQSFRQRDPPEKFEFSLFSFNSMAYSGETLHKTTSAFLENSIIAKAVPQPPSPIIHILLIITVKSLTYMNIIVNNIRARKPTINRY

SEQ ID NO: 8059 - DNA, 525 bp, Unknown
  Obtained from environmental sample
  misc_feature (1)..(525): n is a, c, g, or t
atgtgggatgattttagcataaaggctgaatttgattatatcacagcttcaaataacaaaattgacggtaatgaacattcaaatgaagtgaaaggaatactgcaaagtaatggagattcctacatgaatttaaactttggaataatgtggcacttttttagaggaaaaccttcaaatatttgtaatccacctcaaggaataagagaagtaattgtatataaagaagtacctgttgagagaattgttatagatactgtctatataaataatacagtagtagaagctgttgaagagaaaaagccatttgtaattgaaaatgtacgtttccaatttgataaggatctattgactgatgaagcaaaaggaattctttcaagcgtggcagatgttctaaaaaaatatccagaaaccgattttgaaattcttggacatacagataattttggtagcgataaatataatttagacttatcaaaaagaagagcaattgctgtaaagaaatatttagttattactggaatttga

SEQ ID NO: 8060 - protein, 174 aa, Unknown
  Obtained from environmental sample
  DOMAIN (108)...(173): OmpA family
  misc_feature (1)..(174): Xaa is any amino acid
MWDDFSIKAEFDYITASNNKIDGNEHSNEVKGILQSNGDSYMNLNFGIMWHFFRGKPSNICNPPQGIREVIVYKEVPVERIVIDTVYINNTVVEAVEEKKPFVIENVRFQFDKDLLTDEAKGILSSVADVLKKYPETDFEILGHTDNFGSDKYNLDLSKRRAIAVKKYLVITGI

SEQ ID NO: 8061 - DNA, 507 bp, Unknown
  Obtained from environmental sample
  misc_feature (1)..(507): n is a, c, g, or t
gtggagccattacaggaatcatcgagagcaatgactagaacacctaaacttctaccagttaggctatacggcgataaaacgctgaagaaaatagcagaaccggttcaggaaataactcctgaaattaaggagtttattgaagatcttacttacaccatgtatgaaacagatggtgttggtttggcagccccccaagtgggacgttctttacgtatttttgtagtagatacaacctggtttgatgatgatgccaagaagaatccgatcgtactaattaaccctgaattcacagagttcgaaggtgaagaggtaaacgaagagggttgcctttcacttcccgatatatatgagaaggtgcatcgcgctgaaaaggttaagatcaaaggtttaaatgaaaacggtgaacctgttaagtacgaaggcgaagatctgttgggaagagctttccaacatgagtatgatcacctggatgggaacttgttcattggtaaaattccaaaaaattaa

SEQ ID NO: 8062 - protein, 168 aa, Unknown
  Obtained from environmental sample
  DOMAIN (17)...(168): Polypeptide deformylase
  misc_feature (1)..(168): Xaa is any amino acid
MEPLQESSRAMTRTPKLLPVRLYGDKTLKKIAEPVQEITPEIKEFIEDLTYTMYETDGVGLAAPQVGRSLRIFVVDTTWFDDDAKKNPIVLINPEFTEFEGEEVNEEGCLSLPDIYEKVHRAEKVKIKGLNENGEPVKYEGEDLLGRAFQHEYDHLDGNLFIGKIPKN

SEQ ID NO: 8063 - DNA, 312 bp, Unknown
  Obtained from environmental sample
  misc_feature (1)..(312): n is a, c, g, or t
ttgatgcagttgtgtatatcagtagaaatcctgattttacactccacattctgtaaacagtgtggcaaaagaatcagcacctctttcggtttaaacttcttctttctcatcgctttaataaaggcattattcacaaacacgaaggattcccgtagtttgttctttttaattccaactaaagtacccagaaacatggtcaccgggaagagtatcttgatgaacagtttaacaaaaaaattggagaaaataaaattcttctcagtaaggcaggtcaggttgattatcaaagaacctgttattagcaggaagtaa

SEQ ID NO: 8064 - protein, 103 aa, Unknown
  Obtained from environmental sample
  misc_feature (1)..(103): Xaa is any amino acid
MMQLCISVEILILHSTFCKQCGKRISTSFGLNFFFLIALIKALFTNTKDSRSLFFLIPTKVPRNMVTGKSILMNSLTKKLEKIKFFSVRQVRLIIKEPVISRK

SEQ ID NO: 8065 - DNA, 417 bp, Unknown
  Obtained from environmental sample
  misc_feature (1)..(417): n is a, c, g, or t
atggctgaggctgaatcctcacataggttgaaaatgggaatagtcgagggtggaaaaaatgctaaaacttcatttgctaaaattgtaacaagtgatgataataattatgaactcatagcagccaaactttatacaggacgaactcatcaaattagagttcatctagaatcacttcaaagacatattttaggggatgcattatatggttttaagggaaatttagataagcttaaaagagtttatttacatgcctttagtttatatctacaacatccaataacaggtgcagatatgagttttaatataggtataccagaagatatggaacaattttataataaaaatttcactaaggaagaaaagaatgggaaaattagtcaagagtttgttactagtaggtttgatactattaattag

SEQ ID NO: 8066 - protein, 138 aa, Unknown
  Obtained from environmental sample
  misc_feature (1)..(138): Xaa is any amino acid
MAEAESSHRLKMGIVEGGKNAKTSFAKIVTSDDNNYELIAAKLYTGRTHQIRVHLESLQRHILGDALYGFKGNLDKLKRVYLHAFSLYLQHPITGADMSFNIGIPEDMEQFYNKNFTKEEKNGKISQEFVTSRFDTIN

SEQ ID NO: 8067 - DNA, 645 bp, Unknown
  Obtained from environmental sample
  misc_feature (1)..(645): n is a, c, g, or t
atggctcagagtgtattagtgagcaaagagtttttcaataacaatgaagagtttaagaaaaatgttttggaactaaaatatctgtttatgacatctagtgatacattaatacatggtgatttacatactggttctataatgattaatgaaaatgaaacttttgttatagacccagagtttgctttttttggaccttttggttttgatattggtgctttaattgcaaatattatcaactcatatatttcacatagtgtgatattaagtgatgaagagtataaaaattggcttttaaatagtatagaggaattttatactaaatttgaagagaagtttttaaacttatgggataatcaaaaaagttcatcattgattaaagagggttttattggtagtgatatgcttgatgaatataaaaaagagtttatgaaaaatatctttatttcaagtattggatttgctggttgtaaaataacaagacgagtttttggagttgctggtgttgaagagattaggggactagaaaataaagaacaaagaaaaaaagctgaattacaagctttagaattagggcaacaactagtacttcaatataaaaacataacgaatacagaacaattaataaaaataataaaatcagtttaa

SEQ ID NO: 8068 - protein, 214 aa, Unknown
  Obtained from environmental sample
  misc_feature (1)..(214): Xaa is any amino acid
MAQSVLVSKEFFNNNEEFKKNVLELKYLFMTSSDTLIHGDLHTGSIMINENETFVIDPEFAFFGPFGFDIGALIANIINSYISHSVILSDEEYKNWLLNSIEEFYTKFEEKFLNLWDNQKSSSLIKEGFIGSDMLDEYKKEFMKNIFISSIGFAGCKITRRVFGVAGVEEIRGLENKEQRKKAELQALELGQQLVLQYKNITNTEQLIKIIKSV

SEQ ID NO: 8069 - DNA, 333 bp, Unknown
  Obtained from environmental sample
  misc_feature (1)..(333): n is a, c, g, or t
ttgccagatggattgcctatttttgcaagcatcaggatgaaaactttctttaaaaaatacatcaacaacaaatatttctataccggacttgccttcgtaatctggatgatattttttgaccaggaaagttttattgacaggtatcacctcaatcaaacactaaaagatctggaaaatcaaaaagcgttttatcttgatgaaatcagtaaaaatgaagctgccatttacattttggaaaacgatacttcacaactggaaaaatttgcccgcgagaagtattatatgaagaaagacaatgaagatgtgtttgttattgtaagagacgaaaagtaa

SEQ ID NO: 8070 - protein, 110 aa, Unknown
  Obtained from environmental sample
  DOMAIN (18)...(108): Septum formation initiator
  misc_feature (1)..(110): Xaa is any amino acid
MPDGLPIFASIRMKTFFKKYINNKYFYTGLAFVIWMIFFDQESFIDRYHLNQTLKDLENQKAFYLDEISKNEAAIYILENDTSQLEKFAREKYYMKKDNEDVFVIVRDEK

SEQ ID NO: 8071 - DNA, 426 bp, Unknown
  Obtained from environmental sample
  misc_feature (1)..(426): n is a, c, g, or t
atgagtcaaactaaaccaaaaatctttttatttacagatggaagtgttaatcctcagagtaatgtaggttttggtggttatttacttctagatgaatctgaattctcttcatatgaattagaaaaaaaagttataactaaaaaatttgataatacatcttcaacaaagttagagctagagacacttttatgggctttaaatgaggaaaatttaaatgagtttaaaatattagtctatacggattgtcaaaatattataggtttagaagctagaagagatggatttgagagaaaaaactatatgacttctaaagccaaacagataaaaaaccatgaattatatagagaattttttaaaaaaattgatactttagattgtaagtttataaagctaaaaggtcataaaaaaggagcttcaaaaatatga

SEQ ID NO: 8072 - protein, 141 aa, Unknown
  Obtained from environmental sample
  DOMAIN (5)...(139): RNase H
  misc_feature (1)..(141): Xaa is any amino acid
MSQTKPKIFLFTDGSVNPQSNVGFGGYLLLDESEFSSYELEKKVITKKFDNTSSTKLELETLLWALNEENLNEFKILVYTDCQNIIGLEARRDGFERKNYMTSKAKQIKNHELYREFFKKIDTLDCKFIKLKGHKKGASKI

SEQ ID NO: 8073 - DNA, 588 bp, Unknown
  Obtained from environmental sample
  misc_feature (1)..(588): n is a, c, g, or t
ttgggtaaaaaagataaagttgaagaatatactacagataaaaaagttaaatatgagaccaaatcaaatgattctagcttagctttagatataggtccagtaaaaataaacaatgctcaattgacctttcaagacaagaatttaaaagttccatttaaaacaaatattagcaaattaaatggtagtttttctgaactaaacagtaaaagttcaaagccaacaaaactaaaacttgacggtaaaattgacaaatatggatatacacgaatcacaggctttgttgaccataaaaatataaaaaaccttacagatgtaactcttatatttaaaaacattgcaattaaaaattttacaccctattcagcaaaatttgcaggtagagaacttgaagaaggtaaattaaatttaaatttaaaatataatatctccaaatcaaaccttaatgcaaaaaatagcattattatcacagatattaagctaggaaaagttgtagaaagtcctgatgctacaaatttacctcttgaacttggaattgctttgttagaagattcaaaaggtataatagatatgaccactatccggcgataa

SEQ ID NO: 8074 - protein, 195 aa, Unknown
  Obtained from environmental sample
  DOMAIN (25)...(181): Domain of Unknown Function (DUF748)
  misc_feature (1)..(195): Xaa is any amino acid
MGKKDKVEEYTTDKKVKYETKSNDSSLALDIGPVKINNAQLTFQDKNLKVPFKTNISKLNGSFSELNSKSSKPTKLKLDGKIDKYGYTRITGFVDHKNIKNLTDVTLIFKNIAIKNFTPYSAKFAGRELEEGKLNLNLKYNISKSNLNAKNSIIITDIKLGKVVESPDATNLPLELGIALLEDSKGIIDMTTIRR

SEQ ID NO: 8075 - DNA, 996 bp, Unknown
  Obtained from environmental sample
  misc_feature (1)..(996): n is a, c, g, or t
ttgataattntacttgcttttaaaagtgatttaaaaaaagtatcttttaatccatatactttaagtataagagttgatgacttctcaatatcaaataaagataaaaaaataatagcttttgatgaacttgaaattgattttgctcttttaaaatctatacatgagtcacatataagctttaaagcgttaaatatagtaaaaccatatgtaaatatagttcaagataaaaatggaagtataaatttagcctcaattttaaaacctcagaaaaaagatgtagaaaaagagtctagtgaaaaaacagatataccagcatttaaaatatcaaagactcaaatcatagatgcaaattttatttttactcaagtttttgattctaaaaagactacaactaacataagtaatttcaactatactttttatgatataggaacatttgaaaattatcttgcctcacatagcctagttacaaacataaataaagatacaaagttatatatagatgggggatttagactaactccttttaaaatgtatggaaaagtaaaacttgaagacctaaaatcaaatgaatatgttggatatacaaaagatttactaaactttcaaattggagagccaacattatctttatcttttggatatagagttgatacaactaaagaactagaagtatatattgacaatgcaaatcttagtttaaataacttaaaattaatcaaagacaataaagagattgcaggattaaatagttttgaaatagataatttaaagctagacttggccagacaaaaaatagatatcaataatatatcacttaactctttatttgtaaatatagtgtcaaataaaaatgaaaagctaaatatagataatcttgtaaatataaaaaacaatactaccaatgaaaaaaaaaatgaacccaaaaatggaaaaacttggcctggtagttttagcctcttttgcaataaaaaactcaaactttccttaggatga

SEQ ID NO: 8076 - protein, 331 aa, Unknown
  Obtained from environmental sample
  misc_feature (1)..(331): Xaa is any amino acid
MIIXLAFKSDLKKVSFNPYTLSIRVDDFSISNKDKKIIAFDELEIDFALLKSIHESHISFKALNIVKPYVNIVQDKNGSINLASILKPQKKDVEKESSEKTDIPAFKISKTQIIDANFIFTQVFDSKKTTTNISNFNYTFYDIGTFENYLASHSLVTNINKDTKLYIDGGFRLTPFKMYGKVKLEDLKSNEYVGYTKDLLNFQIGEPTLSLSFGYRVDTTKELEVYIDNANLSLNNLKLIKDNKEIAGLNSFEIDNLKLDLARQKIDINNISLNSLFVNIVSNKNEKLNIDNLVNIKNNTTNEKKNEPKNGKTWPGSFSLFCNKKLKLSLG

SEQ ID NO: 8077 - DNA, 318 bp, Unknown
  Obtained from environmental sample
  misc_feature (1)..(318): n is a, c, g, or t
atgattgaaatattaaataatattgtagtagttagtcaagattcaaataaagattatagtaaattcttatgggaaactattgatttaatgactaataggtttattattatttttattagttctaaaaaaattaaagttaattatgagaaatcttttaattataaatttgataatgatcatgtttttattttacaaggaagttcacaggatgaatttataaaaattttaaattttattagtaataattgtattcatgaattttatattaacttaaattctccattaataccattaaaacttatattgaagaaatgctga

SEQ ID NO: 8078 - protein, 105 aa, Unknown
  Obtained from environmental sample
  misc_feature (1)..(105): Xaa is any amino acid
MIEILNNIVVVSQDSNKDYSKFLWETIDLMTNRFIIIFISSKKIKVNYEKSFNYKFDNDHVFILQGSSQDEFIKILNFISNNCIHEFYINLNSPLIPLKLILKKC

SEQ ID NO: 8079 - DNA, 753 bp, Unknown
  Obtained from environmental sample
  misc_feature (1)..(753): n is a, c, g, or t
atgaaaactaaacatcttttacaaaaaaggattatacattttctatttagcgaaaaaatgtacaatgaaattaagttatttaagataatatttgaatttatattgagaagaccttatgaaatttcaccaatattacctcaaatgattaaaaatggtgaaattgttttagatattggtgcaaatatggggcaatttgcctgtagattgaataaactagttggtaaaaatggcggtgtatatagttttgaacctgtcaaggctaattatatagcactaagaaaaatgaagtcagtattgaatttgaccaatattaaaactcataatgttgctattagtaataaagatggtgatgcaacaattaaaatccctattcaaaatggaattcccattactacacaatcatcacttgttttagaaccaaaaaagtttaaaattgaaaaagtgaaactaagatcaatagatagtcttgtcaaagaattaagaattcctagggtagattttattaaaagtgatacagaaggaaatgacgggaatgtattagccggtggttatgaaactattaaaaattatttacctactatgtatttagaaatttaccataaaaaagaagctttaaagaaaatttacaaattgggatatctccctctccaatacgaaactaaaaagaaatcaatcgtaccaattactgacgatcaaccaggtgacctaattctaattcataaaagtaaaatgaaaaacttgtgccggcgataa

SEQ ID NO: 8080 - protein, 250 aa, Unknown
  Obtained from environmental sample
  misc_feature (1)..(250): Xaa is any amino acid
MKTKHLLQKRIIHFLFSEKMYNEIKLFKIIFEFILRRPYEISPILPQMIKNGEIVLDIGANMGQFACRLNKLVGKNGGVYSFEPVKANYIALRKMKSVLNLTNIKTHNVAISNKDGDATIKIPIQNGIPITTQSSLVLEPKKFKIEKVKLRSIDSLVKELRIPRVDFIKSDTEGNDGNVLAGGYETIKNYLPTMYLEIYHKKEALKKIYKLGYLPLQYETKKKSIVPITDDQPGDLILIHKSKMKNLCRR

SEQ ID NO: 8081 - DNA, 654 bp, Unknown
  Obtained from environmental sample
  misc_feature (1)..(654): n is a, c, g, or t
ttggcttatcaagtttggtttctgagtccgtctattccaattaattcttttttaaagagtttgtatgcaaaacaaatacttggtgatacgcccgttgtgactgttattggatgtcgaaacatgtgggtgatgtctcatgaaaaagtaaaaaaactaattgccgaggcaaatggaaatctagtggggaatgtttcttttgtagatagacatatcaaccacattagtgtaattacgattgttcattggatgtttagtggaaagaaaaccaaactttacggaattttcccaaaaccaggcgttgcgcagagagatattgatgctgcatcaaaatttggagaaattatattgaaaaatattgaaaaaaatgattttaagggccttccaaataaactttatgatgcaggtggggttttaactaaaccatttcttgtattaatggatcaaaaggcaaacaaaatgttttcactttggtcaaagtttgttttatcaaaaaataaaaatcgatcttttaaattatttctttttaaaatttatctttggctagcaatttggatcatttcgcctatagtatttctattatttttaataacttacccaattaagaaaagaaaaattgatcgtgaaatgaactattaccgaggaattgaaaaatga

SEQ ID NO: 8082 - protein, 217 aa, Unknown
  Obtained from environmental sample
  misc_feature (1)..(217): Xaa is any amino acid
MAYQVWFLSPSIPINSFLKSLYAKQILGDTPVVTVIGCRNMWVMSHEKVKKLIAEANGNLVGNVSFVDRHINHISVITIVHWMFSGKKTKLYGIFPKPGVAQRDIDAASKFGEIILKNIEKNDFKGLPNKLYDAGGVLTKPFLVLMDQKANKMFSLWSKFVLSKNKNRSFKLFLFKIYLWLAIWIISPIVFLLFLITYPIKKRKIDREMNYYRGIEK

SEQ ID NO: 8083 - DNA, 300 bp, Unknown
  Obtained from environmental sample
  misc_feature (1)..(300): n is a, c, g, or t
atgggtttgatactcccgtttaaagcgctggcattcctcgccaagaagatctttgcctatcacccctcttcctttttttgtcgggttaggtgcgttcattttttaacctgctactggtgtctgctgaactcatttagacctatcgctatgggtatgcttaatttaagcgtaggtaacgatttcaaaatagagccgataaatcatggcatagtggaggacaccgccgatgagaatcaggacatgaaacaattcatgaaaactaaatattcccggaacaagccgtggtctttaagggcataa

SEQ ID NO: 8084 - protein, 99 aa, Unknown
  Obtained from environmental sample
  misc_feature (1)..(99): Xaa is any amino acid
MGLILPFKALAFLAKKIFAYHPSSFFCRVRCVHFLTCYWCLLNSFRPIAMGMLNLSVGNDFKIEPINHGIVEDTADENQDMKQFMKTKYSRNKPWSLRA

SEQ ID NO: 8085 - DNA, 978 bp, Unknown
  Obtained from environmental sample
  misc_feature (1)..(978): n is a, c, g, or t
ttgagtgagagagatgaacttagtgcattgatttcaaaagagaaaattttagcttcgcagatagaaaaattaaaggaaaaggacagtgctccattttcaaaaataatcactcctccaagtattgaagaaaaggtaagtattactaatccatttgatatatttacaggtatttctcttattaaaactcttgattctgattttaatgactatagaaaaagaaaagatgaattgacagatttgatttctcttttggaaaaagaaaataatatttttaaagagatagctactattgatataaagaaaaaatatgcagaaaattcagagttaaaagcaaagcagttagagagattcacaacagccttggaaacaatggacgttacagctgaagtttatcaaaaaagattagaaatccttgaagtaaacataaacaaagacatagaagtgcaagttattaagcttggtaaaataggtgtagttgttcttgtcgtatttttcatattttttctacttaaattttttgttaaaaagtacatcacagataatgaacggttttatatggcaaacaaaatcattacatttataaatgttacacttatcattttaatagtgttctttaactacatagaaaatgctaattatcttgtaaccatcttaggttttgcatcagctggtattgctatcgccatgaaagattggtttatgagtatgttaggttggcttgtaatagttattggcgggagtatacatgttggtgacagaataagagtagatatggatggtatgaagtatgttgaagatgttatggatatctcacttcttcggatgacaatcttagaagaatataccctgacatcaattatgagtaatagaagagcagggagaattatattttataccaaaataactatggtttttacaaattatgatagccaaactattaccccctccttcaacaaaaaattggttggggagggaaga

SEQ ID NO: 8086 - protein, 326 aa, Unknown
  Obtained from environmental sample
  misc_feature (1)..(326): Xaa is any amino acid
MSERDELSALISKEKILASQIEKLKEKDSAPFSKIITPPSIEEKVSITNPFDIFTGISLIKTLDSDFNDYRKRKDELTDLISLLEKENNIFKEIATIDIKKKYAENSELKAKQLERFTTALETMDVTAEVYQKRLEILEVNINKDIEVQVIKLGKIGVVVLVVFFIFFLLKFFVKKYITDNERFYMANKIITFINVTLIILIVFFNYIENANYLVTILGFASAGIAIAMKDWFMSMLGWLVIVIGGSIHVGDRIRVDMDGMKYVEDVMDISLLRMTILEEYTLTSIMSNRRAGRIIFYTKITMVFTNYDSQTITPSFNKKLVGEGR

SEQ ID NO: 8087 - DNA, 900 bp, Unknown
  Obtained from environmental sample
  misc_feature (1)..(900): n is a, c, g, or t
atggccgagtggaatcactattatggaagcattagaaattttttttataatgaattagttaaatttcaacaagatgatttaaatatttatgcgcaagaaggtggaaatacttctgtaaaaataatattatcatttcaagtcgaaagtactgataccatagtaattgattcttcaaatcccacagatttgaaagatgaatttttattggataaagatggatatttaactttaattcaagagtgggattgttctaaaaatattacggtaaaaagtaaaaagtattttttagaatgtgaatatccaaccgtttggaaagataatccaaaaataaacctaaaaattaaagacttacaaaaagaattaaaagatttagttgataatgaagttataagtgaagaaatttatacatctattactaaaagtgcaaatgctccaatacgacaagctttatataaatatttacttgaagaagaggataagcaagataaaacaacaatccaaatagatttagcaaaaagtgaagactctaaaagtttgaaagaaagtattgataaaaacttgcctctatattttttatttcaatctgatagagcaaataaagatagcgatgatgatgtccaaaatcctttaaaaatagctatacaaaaagcacttcaaagtcaagaaattaaagacaaactagatgaagttgaaaaactaatgaagcaacaaatagaacaaattggtaatagtacattgaaaaaacttcaagagatggattctaaaatcgcttctaccttaaatccaaactattctaaagaacctgattggagatcagtttttaaatttaattttacaggagatggtattccatttaataaaaggggaagtggagttagaagacttgttttattaaactaa

SEQ ID NO: 8088 - protein, 299 aa, Unknown
  Obtained from environmental sample
  misc_feature (1)..(299): Xaa is any amino acid
MAEWNHYYGSIRNFFYNELVKFQQDDLNIYAQEGGNTSVKIILSFQVESTDTIVIDSSNPTDLKDEFLLDKDGYLTLIQEWDCSKNITVKSKKYFLECEYPTVWKDNPKINLKIKDLQKELKDLVDNEVISEEIYTSITKSANAPIRQALYKYLLEEEDKQDKTTIQIDLAKSEDSKSLKESIDKNLPLYFLFQSDRANKDSDDDVQNPLKIAIQKALQSQEIKDKLDEVEKLMKQQIEQIGNSTLKKLQEMDSKIASTLNPNYSKEPDWRSVFKFNFTGDGIPFNKRGSGVRRLVLLN

SEQ ID NO: 8089 - DNA, 402 bp, Unknown
  Obtained from environmental sample
  misc_feature (1)..(402): n is a, c, g, or t
atgacccaaataatattagtaaatattttgatttctatcaatagtcaaggactaaatacctttacatttgaaacaaaaaaaagagagatggaaaactatattcaccacaatattatcaatgatacttatgaagggttttctataatatatagtgaagaatgggatacattagatttaggagaagaagttgcaaaatatgttcataataattcagaaaattcagaaatagaatgggatgagattgaagataaagataaaaagaaaaagaaagttagtcgtgtaaaacaaagatttaatgaagagttatcaaaacaaattacaaaacaacatcttgaagagctagaagcttttgaagagataaaagaatggtttgaaaaaatcaaggaagctacaagaggataa

SEQ ID NO: 8090 - protein, 133 aa, Unknown
  Obtained from environmental sample
  misc_feature (1)..(133): Xaa is any amino acid
MTQIILVNILISINSQGLNTFTFETKKREMENYIHHNIINDTYEGFSIIYSEEWDTLDLGEEVAKYVHNNSENSEIEWDEIEDKDKKKKKVSRVKQRFNEELSKQITKQHLEELEAFEEIKEWFEKIKEATRG

SEQ ID NO: 8091 - DNA, 927 bp, Unknown
  Obtained from environmental sample
  misc_feature (1)..(927): n is a, c, g, or t
gtggtagttgtttctgcacctggtagagatgacttacatgatcaaaagattacagatcatctattaaactatgcaaccaatggaaaacatttttcagaccacttaatagaagtagatgcacaacaaagttttgaagcaattattactaaatatgaaaagttatgtatagatttaggtattgataaaaataagattatagaaccattaaaaaaagatttagaaaatacaaaattaaaagatgaaaaaagggaggctttttgtctttcaagaggtgaacatcataatgccaaagtaatagagcaatttatgaaaaaatcaaagataaatgtaaaactaatgcttcctgaagattttgggtttatattaagtgaaaattttacagatggtaaagtattaaatgagtcatatgaaaatattgagagagattttagtatagaggaggatatcctttatttagttccaggattttatggaattacaaaaaataaagagatagctgtgatgagtagaggtggtagtgatttaacaggtggagaattagcctatgcacttgatgctgatgtttatgaaaactggacggatacaaatggtgtgtatgaagtagatccaagagttatagaagatgctaatgtaataccaagacttacatttaaagagttacgacttttaagttcnaagggatttaatgtttttcattttgatgcaatgttaaattgtaaaaaaagtaaaataccaatncatatacgaaatacaaataatcccgaccatgaaggtacactgattttaagtgaaagagttcctatggaagacaatgtagggattgcaagacttgataatatggcttcaatacatataccaaaagatatgctagctgaagaaataggctttatggcggagctcttaaaagtatttagcggagtttggtaa

SEQ ID NO: 8092 - protein, 308 aa, Unknown
  Obtained from environmental sample
  DOMAIN (1)...(250): Amino acid kinase family
  misc_feature (1)..(308): Xaa is any amino acid
MVVVSAPGRDDLHDQKITDHLLNYATNGKHFSDHLIEVDAQQSFEAIITKYEKLCIDLGIDKNKIIEPLKKDLENTKLKDEKREAFCLSRGEHHNAKVIEQFMKKSKINVKLMLPEDFGFILSENFTDGKVLNESYENIERDFSIEEDILYLVPGFYGITKNKEIAVMSRGGSDLTGGELAYALDADVYENWTDTNGVYEVDPRVIEDANVIPRLTFKELRLLSSKGFNVFHFDAMLNCKKSKIPXHIRNTNNPDHEGTLILSERVPMEDNVGIARLDNMASIHIPKDMLAEEIGFMAELLKVFSGVW

SEQ ID NO: 8093 - DNA, 453 bp, Unknown
  Obtained from environmental sample
  misc_feature (1)..(453): n is a, c, g, or t
atggtcagaatcggctcgagaatgatttcagtagcaacaaaagagaatacaaaagagctttttaaccttgaaagttctgtattttccaaagatgattttggactaagtgtaggttctttttattaccacataaaaagaaatcatctttttgtttataaacaagataataaaattgtgggatatattttgtggctaaaaagaaaaaacaattatagactctactctttgtgtataaaaaaagagtttcaaggtcagggtattgcaacaaaacttttagaatattcttttaaaatattagaaacaaaaagtttcactttagaggtaaaaactataaataaaagtgccataaaactttatgaaaaaaacaatttcaaaatcaaaaaagttttaaagaactactatcctaacaatattgatgggtatttgatgtatcgaagttcaaatggcatttag

SEQ ID NO: 8094 - protein, 150 aa, Unknown
  Obtained from environmental sample
  DOMAIN (50)...(125): Acetyltransferase (GNAT) family
  misc_feature (1)..(150): Xaa is any amino acid
MVRIGSRMISVATKENTKELFNLESSVFSKDDFGLSVGSFYYHIKRNHLFVYKQDNKIVGYILWLKRKNNYRLYSLCIKKEFQGQGIATKLLEYSFKILETKSFTLEVKTINKSAIKLYEKNNFKIKKVLKNYYPNNIDGYLMYRSSNGI

SEQ ID NO: 8095 - DNA, 429 bp, Unknown
  Obtained from environmental sample
  misc_feature (1)..(429): n is a, c, g, or t
atgcttaaagatacacaaaagagaaaaaaagatcttgataattgtcaagcagaatataactcggcagctggtagtgcaaaacagtttaagcagaatataataagagcaaaaaaagagggacgtgatccatcgccagctgatattattcgacttaaaaaatttcaaggagtagctcaaaaattaactactttaacacaagagatgcaaagtgatgagaagataacacaaaaagtgaagtcagatttgcaagagctttatgacatcgaattgcactctaaagtggtcaatcatggaacatataactcaaatacaacggtaatttttgtagatgttgaaactaaagaagtatataaaatattaccgcatggaaaagtagaaaccatctgtttagaaaaagatggagataagaaaaaaattgtttctagataa

SEQ ID NO: 8096 - protein, 142 aa, Unknown
  Obtained from environmental sample
  misc_feature (1)..(142): Xaa is any amino acid
MLKDTQKRKKDLDNCQAEYNSAAGSAKQFKQNIIRAKKEGRDPSPADIIRLKKFQGVAQKLTTLTQEMQSDEKITQKVKSDLQELYDIELHSKVVNHGTYNSNTTVIFVDVETKEVYKILPHGKVETICLEKDGDKKKIVSR

SEQ ID NO: 8097 - DNA, 441 bp, Unknown
  Obtained from environmental sample
  misc_feature (1)..(441): n is a, c, g, or t
atgagcttatctatgtctaatagagatatttcactttatgttgtagatatatttatagctatagataagatccaaagatatacaaaaaaatttaataatgcagatgagtttaaatggagtgaattagagtgggatgcaactctaagagagttagaaatcatcggtgaagcaacaaacagacttataaaattagaaattttagagaatcaaaaatatagaaaaattgtagattttagaaatattattattcatggatattttggaattgatgaagatgaagtttggagtgtgttaaatgataaattagaaccatttttaaacgagctaaaagagaccattatagaaaaaaatatagatataaaagatgccgtctcttacgctaaagaagaaaattttaaaaataagtttatagttgaatttttagatagtttgattaaatag

SEQ ID NO: 8098 - protein, 146 aa, Unknown
  Obtained from environmental sample
  DOMAIN (35)...(109): Protein of unknown function DUF86
  misc_feature (1)..(146): Xaa is any amino acid
MSLSMSNRDISLYVVDIFIAIDKIQRYTKKFNNADEFKWSELEWDATLRELEIIGEATNRLIKLEILENQKYRKIVDFRNIIIHGYFGIDEDEVWSVLNDKLEPFLNELKETIIEKNIDIKDAVSYAKEENFKNKFIVEFLDSLIK

SEQ ID NO: 8099 - DNA, 609 bp, Unknown
  Obtained from environmental sample
  misc_feature (1)..(609): n is a, c, g, or t
ttgttaatatcgtatgctacatttgctccaactaaaacaactaagccaaccacagaagcaatcattaattttttgtattttttcacaaatttttcagtaataactgctttctcaaaaaacttctcttcagaattcaactcttcttttaccatctcaatatcattttttatactcaaaaatattccttgttatatatattatttcaaaaagtttaaaataatatcgcatactttgttaaagtttcatcaaacacatagaaattttttgttacaatcttatgaaacaatgatattaggaacatatatgcaagtagatgacgcattactaactaagttagagaaactatcttttttaaaggtttcagacgacaaaagagaagaaataatagggcaactatctgaaatagttagctttgttgataatttaagtgaacttaacactgacggtgttgatgacaattttgcgatgagtaacaaaggaacattcactagagaagattctccagcatgtgacaaaaatatccataatgatatcttgaaaaaatgcacctctaagtgggtgacaattttctttatcggtcccaaaattaatttgaattaccaccaatag

SEQ ID NO: 8100 - protein, 202 aa, Unknown
  Obtained from environmental sample
  DOMAIN (120)...(193): Glu-tRNAGln amidotransferase C subunit
  misc_feature (1)..(202): Xaa is any amino acid
MLISYATFAPTKTTKPTTEAIINFLYFFTNFSVITAFSKNFSSEFNSSFTISISFFILKNIPCYIYYFKKFKIISHTLLKFHQTHRNFLLQSYETMILGTYMQVDDALLTKLEKLSFLKVSDDKREEIIGQLSEIVSFVDNLSELNTDGVDDNFAMSNKGTFTREDSPACDKNIHNDILKKCTSKWVTIFFIGPKINLNYHQ

SEQ ID NO: 8101 - DNA, 591 bp, Unknown
  Obtained from environmental sample
  misc_feature (1)..(591): n is a, c, g, or t
atggaaagttatgtagaagatttagaaaatataatcttagagttacagttagacaaaccaatcctttgtggcttttctatgggtggttatataacacttagagcaaatgaaaaacaacccgaaaactataaagcactaatatttgcaaatacagctacaactagcgataatgatgaagcaaaattaaaacgctctggtgctatttctagtattgataaagatggagttgaaccttttttagataagtttttttcagttgcatttagtgaagattatacgaaaaaagagccattaagattaaaaaagcttaaagataaaatcatgaattttaatcctgtaggaattaagggtggattgttggctatgattagtagaactgatacaactaaaagcttacaaaaaatagatatccctgtgttattaataagtggagaaaatgataaaattatatctcctgatattatggagcaaatgtccaatagtataaaaaacaataccctagtctcgttaagtgatagtgggcatgcaagtatgattgaaaagccagagcaatttaatagtacccttaaagtatttttaaaaactctttag

SEQ ID NO: 8102 - protein, 196 aa, Unknown
  Obtained from environmental sample
  DOMAIN (1)...(191): alpha/beta hydrolase fold
  misc_feature (1)..(196): Xaa is any amino acid
MESYVEDLENIILELQLDKPILCGFSMGGYITLRANEKQPENYKALIFANTATTSDNDEAKLKRSGAISSIDKDGVEPFLDKFFSVAFSEDYTKKEPLRLKKLKDKIMNFNPVGIKGGLLAMISRTDTTKSLQKIDIPVLLISGENDKIISPDIMEQMSNSIKNNTLVSLSDSGHASMIEKPEQFNSTLKVFLKTL

SEQ ID NO: 8103 - DNA, 495 bp, Unknown
  Obtained from environmental sample
  misc_feature (1)..(495): n is a, c, g, or t
gtgatgtacgaaactgaattacgaatgaaagccggtattaacgttacttttatttactgggatacctatgaatggcaactgtctgcgcaacagcaacaagtaatcgatagaagaaattactttggtttacactacggttgttccatcttcaccaattcccacaaaaaggattttttctacctgatttcctttgccagccgcacaaaagtaccggatgcgcgagtggagaccatgacaaaaatagtctccacacacctgttagcagcaagaaagcggctggacatgttaatgctggtaaaatctctttcgaagaaggaactgaaagtcgcacaagagatgatgcagggaaaaaccaatcagattattgcaaacgatcttaacatcactgaaaatacagttaaattccatattaaaaacatcttcgacaagctacaggtgaataaccggctacaagccagttctgtgcttcacgccgaacgctatctaagtgtctaa

SEQ ID NO: 8104 - protein, 164 aa, Unknown
  Obtained from environmental sample
  DOMAIN (99)...(156): Bacterial regulatory proteins, luxR family
  misc_feature (1)..(164): Xaa is any amino acid
MMYETELRMKAGINVTFIYWDTYEWQLSAQQQQVIDRRNYFGLHYGCSIFTNSHKKDFFYLISFASRTKVPDARVETMTKIVSTHLLAARKRLDMLMLVKSLSKKELKVAQEMMQGKTNQIIANDLNITENTVKFHIKNIFDKLQVNNRLQASSVLHAERYLSV

SEQ ID NO: 8105 - DNA, 828 bp, Unknown
  Obtained from environmental sample
  misc_feature (1)..(828): n is a, c, g, or t
ttgggaaaatcagcggatacactaaatttgaaatttttcggtaagcctcactctatagtccgtcttccatcaatgcctagtcggatattaaaggaactttgggatgtaataaaagagaaacgtgcatggcatggtgtaatcacaaatatgaaaaaagatggacgtaagtatgtagtggactctacggtcatacctattttggatgttgatggagatatagtcgaatatattgctatacgacatgatgtaacagagtttgagcagacaaaagagcagctaggtacgctaaatcgtgctatgaaaaataaggtggatgagctatattccatgactgcaacattggaagaagaagcctctatagatgcattaacaggtgcatttaatcgttcaaaatttgagaaattttttgatcttgagatagagaaagctcagatgagccaaaatgtattgactatgatagtcttagatatagaccattttaaattaattaatgataattatggacatcacgttggtgatgatgttttaaaaaatatcgcatctcttgtgagtaaagctctaaaaaggacagatgtatttgctagatggggaggcgaagagtttgttgtacttctaccaggaactgatcttgaaggtgctgctattttagctgaaaagttaagaaaactgatcgaagagagtgatttttctattgcaggacagataacatccagttttggtgtaggtctgcataaagatgaagagaataaaaaagagttttttgagagagtggataagtttttatatgaggctaaaaagagtggtagaaatagagttgtatcagaataa

SEQ ID NO: 8106 - protein, 275 aa, Unknown
  Obtained from environmental sample
  DOMAIN (44)...(86): PAC motif
  misc_feature (1)..(275): Xaa is any amino acid
MGKSADTLNLKFFGKPHSIVRLPSMPSRILKELWDVIKEKRAWHGVITNMKKDGRKYVVDSTVIPILDVDGDIVEYIAIRHDVTEFEQTKEQLGTLNRAMKNKVDELYSMTATLEEEASIDALTGAFNRSKFEKFFDLEIEKAQMSQNVLTMIVLDIDHFKLINDNYGHHVGDDVLKNIASLVSKALKRTDVFARWGGEEFVVLLPGTDLEGAAILAEKLRKLIEESDFSIAGQITSSFGVGLHKDEENKKEFFERVDKFLYEAKKSGRNRVVSE

SEQ ID NO: 8107 - DNA, 849 bp, Unknown
  Obtained from environmental sample
  misc_feature (1)..(849): n is a, c, g, or t
ttggtaaaagcattaaatggatttgaaggtgatacaacaaatgaagagaaacaaaggggtatcactattaatctctctttttcaaatctcacgcaaaaagataaaaatattgcgtttatagatgttccaggacatgaaaaactagttaaaaatatgattgctggagcttttagttttgatgttattatgatagttgtaagtgctaaagagaaaatcatgcctcaaacagtggaacatcttgatattttaaacatcttaggtataaaaaaagcaatagttgttataactaaaaaagatttagtaacagaagaggaacttgaaaataactcaaaaaagatattaaactttatagattcatatgagtttgatattgttttatcaaaaagtgtttcaatatttgatgataactctattgatgagttaaaagaggctttgtttactttacaagcagatacaaaaccctcacaaaacttttttagatattatgtagatagaatttttaatacaaaaggaagtggtacagttgtaacaggtactgttcttggaaatcccatatctttagatgaaaaagtatttatttgtgatataaaaaaagaggtgaaattaaaagccattcaagtacatggaaatgacactcaaatagcaaatatctcanatagagctgctttaaacttacaaaatattgatacaaaacttataaaaaaaggctttattataagtaaaaaaggatatttacgaggatttaatcaagtagatatatcctatactttactaaaagataaagagcttatacacaataccttatactctatctatcttggttcaaaaaaaatagaagctcgtatttaa

SEQ ID NO: 8108 - protein, 282 aa, Unknown
  Obtained from environmental sample
  DOMAIN (1)...(152): Elongation factor Tu GTP binding domain
  misc_feature (1)..(282): Xaa is any amino acid
MVKALNGFEGDTTNEEKQRGITINLSFSNLTQKDKNIAFIDVPGHEKLVKNMIAGAFSFDVIMIVVSAKEKIMPQTVEHLDILNILGIKKAIVVITKKDLVTEEELENNSKKILNFIDSYEFDIVLSKSVSIFDDNSIDELKEALFTLQADTKPSQNFFRYYVDRIFNTKGSGTVVTGTVLGNPISLDEKVFICDIKKEVKLKAIQVHGNDTQIANISXRAALNLQNIDTKLIKKGFIISKKGYLRGFNQVDISYTLLKDKELIHNTLYSIYLGSKKIEARI

SEQ ID NO: 8109 - DNA, 615 bp, Unknown
  Obtained from environmental sample
  misc_feature (1)..(615): n is a, c, g, or t
atggaagagtgtnttatagatgaaaagtcgctaattatctacncattgcaaacaaaagagactattaaagatattattaaaaacatctatataaaaaacaaatatgctttactttcaaatagttccatagggttaagactagtttgggcaagtgaaacttttattgagcttgctttagaagaactttgtaatgaaaatatacttacaaaagatggtaacttgtataaaaatagtgatattaaagaagatatacaagataaactagaagttataatacttcaaagattaaaaaatgaggggattactcctacagcgccttataatatctatgatgaactagatattgacagaagacttggagatactattttcaaggcactcacaaagaaaaaacttgtaacaagaatacagcataacttatttatagaagctcaaatacttactaatttaatcactgaaatgaaaaatattattaaacaagaggggtatatagatattaaaaactttaaacaaaaatatactatgagtagaaaatatatgattgcatacttagactacttagataaaatgaataacatagaaaataaagatgggaaaagatacctactttcataa

SEQ ID NO: 8110 - protein, 204 aa, Unknown
  Obtained from environmental sample
  misc_feature (1)..(204): Xaa is any amino acid
MEECXIDEKSLIIYXLQTKETIKDIIKNIYIKNKYALLSNSSIGLRLVWASETFIELALEELCNENILTKDGNLYKNSDIKEDIQDKLEVIILQRLKNEGITPTAPYNIYDELDIDRRLGDTIFKALTKKKLVTRIQHNLFIEAQILTNLITEMKNIIKQEGYIDIKNFKQKYTMSRKYMIAYLDYLDKMNNIENKDGKRYLLS

SEQ ID NO: 8111 - DNA, 669 bp, Unknown
  Obtained from environmental sample
  misc_feature (1)..(669): n is a, c, g, or t
atgctaaacacccattccattcttaataaaaatttttcgaataaaatcaaaactctatatcctgctaaagaggttgaaaaaaaagagtattctcgattaatgaagatgatttttgaagtcaagcgtatcccgccagatgctgcaggtaagatgtgcaaaaatgcaaatcatcaaggtatcttagccgaagtgnatgattatgaacttcagtcctttaaatcttttttagataaagattttgttctggtgctctcaggtttaacagatgttggtaacattggcgcaattgttagaacagcttatgcaatgggtgttgatgccattgtcgtatgtgggattaaaaatctaaatcttgaaccggttatgagaacaagcacaggcgctttgtttgacatgccgtttgcgctagaacataatatacacaatgttatgaatgatttaaaaacatccggtttttgcatttatggtgcagatatgggtggaactgatataagagatattaagttaaaacaaaagagagctttagttttgggaagtgaaggggaaggtttaacttctcgtatcgtgtcaaaattagacgaagtcgttagtattaaaatgtcacatgggtttgattctttaaatgttagtgtggcaggagctattttaatggataggatgagaatatga

SEQ ID NO: 8112 - protein, 222 aa, Unknown
  Obtained from environmental sample
  DOMAIN (79)...(218): SpoU rRNA Methylase family
  misc_feature (1)..(222): Xaa is any amino acid
MLNTHSILNKNFSNKIKTLYPAKEVEKKEYSRLMKMIFEVKRIPPDAAGKMCKNANHQGILAEVXDYELQSFKSFLDKDFVLVLSGLTDVGNIGAIVRTAYAMGVDAIVVCGIKNLNLEPVMRTSTGALFDMPFALEHNIHNVMNDLKTSGFCIYGADMGGTDIRDIKLKQKRALVLGSEGEGLTSRIVSKLDEVVSIKMSHGFDSLNVSVAGAILMDRMRI

SEQ ID NO: 8113 - DNA, 816 bp, Unknown
  Obtained from environmental sample
  misc_feature (1)..(816): n is a, c, g, or t
atgttaaaaacgctattcagaantatctttttaaattccaaggtcgaagctgagttcatcaaggaaaccattattgattcgataggcgctacagatgcccgtatcgtcttgactcgattcaccaaagaccttgagaatcttgatgataagataagagatattcaggtgtttaagtctcaagaggttcaagaaaaagcacaggtagcaattcagaaataccacaatttatccggcataaaagaagagcgtaagcatctagttgataaccttaaatcgaaatacataacattggagccagcacgccttcgatctgttgcggccatagcagaattaaacacaaaactatcagagttaaagcatacccgagaggaacaagaatcacagttcagacagaacatcgttagtattgaaaaacaaatcggtgtagtggaagaatatctaaagcaggcagagaaaaaacaaaaagaatatgagttagataacatcaccgaagtcaaggcccgtgtagaccagaaggataaggttgagggggggatagaaaccctcaaacgtgaaaaacaaatcttgcttaaagagaatcaaacgattgtagaaaagtatgaacaaattatcagggatttagatattgaagctaaattactgtgcaataaaaaacaaactgaaatcgccaccctgcgcgagctgtgcaataaaaaaatatctgagctagtccaacaatacgaaaaacgccaagatgaaatccgtcagcaattcagcgcaaagttggaacacgcacgtaatgcaaccaaggctattcaaaatccatacacgatctaa

SEQ ID NO: 8114 - protein, 271 aa, Unknown
  Obtained from environmental sample
  misc_feature (1)..(271): Xaa is any amino acid
MLKTLFRXIFLNSKVEAEFIKETIIDSIGATDARIVLTRFTKDLENLDDKIRDIQVFKSQEVQEKAQVAIQKYHNLSGIKEERKHLVDNLKSKYITLEPARLRSVAAIAELNTKLSELKHTREEQESQFRQNIVSIEKQIGVVEEYLKQAEKKQKEYELDNITEVKARVDQKDKVEGGIETLKREKQILLKENQTIVEKYEQIIRDLDIEAKLLCNKKQTEIATLRELCNKKISELVQQYEKRQDEIRQQFSAKLEHARNATKAIQNPYTI

SEQ ID NO: 8115 - DNA, 783 bp, Unknown
  Obtained from environmental sample
  misc_feature (1)..(783): n is a, c, g, or t
gtgttgtacatggatgattttagtgaaataagaaaaattactagtcaaataaacagtgagaagacatctatatgtaaagattgggtggagtgtgaaaatatatctgaggtttttaaaaggactggtttaagtaaaacaaagtttcaaaagttttttgcaccaaaagttatagattattttatagatgtagcaaatgataaggaaaaaattggtaattgcccgataattggggttatgcttacagtttttcataaattaaatttgcagatagatgatatttttttaatatgcgttaatctgaaaaacagacttaatgatatagctgtcaactcttcaaatattcaactctctcatgagattaactatatacttgatcgaaattttgaaggtgttattaaagaatatatgtacattcattatccttctttgccaaaaagaaagatggttgtagagttaaacaatgataatttttatgtagataagataagtgcaattgatttattagatatggaaccgatcgatagctatcttattgatgatcttaatgatattgagaaagattttgatacaattttttgcgtagtagaagagttgacgcaagagttaatagatgaaattcaaaaattgttaagttcatatgtatctatcataaatcagatggttgattttaaagatctatattcgcacattatatattttaaatcgctacttgatgagattgatatagagaacataacttatgaagagtctaaaatgtataataaaatgataaattccgtatga

SEQ ID NO: 8116 - protein, 260 aa, Unknown
  Obtained from environmental sample
  misc_feature (1)..(260): Xaa is any amino acid
MLYMDDFSEIRKITSQINSEKTSICKDWVECENISEVFKRTGLSKTKFQKFFAPKVIDYFIDVANDKEKIGNCPIIGVMLTVFHKLNLQIDDIFLICVNLKNRLNDIAVNSSNIQLSHEINYILDRNFEGVIKEYMYIHYPSLPKRKMVVELNNDNFYVDKISAIDLLDMEPIDSYLIDDLNDIEKDFDTIFCVVEELTQELIDEIQKLLSSYVSIINQMVDFKDLYSHIIYFKSLLDEIDIENITYEESKMYNKMINSV

SEQ ID NO: 8117 - DNA, 489 bp, Unknown
  Obtained from environmental sample
  misc_feature (1)..(489): n is a, c, g, or t
atgaaagagatcaactgggttaccatatacgagtatgctgagcttacgggattagatgagagttcaattatggagttaattgcacgtggaaaactgacatctaaagaagaagagggtattgtatttatagatcctgaaaaacatacaagctcggtaataccaatagaacttcaagatattaagagtggcaacatatctatgaatcctcaatttgtagagaaaacaatcggaactattattaaccttcatgaaaaagttttgggtgcaaaagatgagactattgagtcaattaaaaatgaaaatagctttctaaaagatggtctttcatcacttcaagagctatatgatgaagatagaaaaacaatagcaatcttaacagaacagttaaaacatgcccaacaagaagtagagtttatgagacgtaagtacaaacttatgtggggtaaagttgtagatgattactcagcanaacctgaaataagtgcataa

SEQ ID NO: 8118 - protein, 162 aa, Unknown
  Obtained from environmental sample
  misc_feature (1)..(162): Xaa is any amino acid
MKEINWVTIYEYAELTGLDESSIMELIARGKLTSKEEEGIVFIDPEKHTSSVIPIELQDIKSGNISMNPQFVEKTIGTIINLHEKVLGAKDETIESIKNENSFLKDGLSSLQELYDEDRKTIAILTEQLKHAQQEVEFMRRKYKLMWGKVVDDYSAXPEISA

SEQ ID NO: 8119 - DNA, 306 bp, Unknown
  Obtained from environmental sample
  misc_feature (1)..(306): n is a, c, g, or t
ttgaagatagaacttgagtgtgtagagtgcataattaatcaaagtagacgggttagtaaggcaatagaggcagatgagactctcacaaatttgctggtttcacatgtaaaagatgcttctaaaaatttcagttttgatcaatctccccctgaaatagcatctactgtttatgaagagatggcacatcttgcatcaaaagatgatctatttgataaacaaaaagagttagcctacggttgctgcaaaaaaattttatcctttaatttaaaagaaaaactttttaatttcccaaataattttatttaa

SEQ ID NO: 8120 - protein, 101 aa, Unknown
  Obtained from environmental sample
  misc_feature (1)..(101): Xaa is any amino acid
MKIELECVECIINQSRRVSKAIEADETLTNLLVSHVKDASKNFSFDQSPPEIASTVYEEMAHLASKDDLFDKQKELAYGCCKKILSFNLKEKLFNFPNNFI

SEQ ID NO: 8121 - DNA, 561 bp, Unknown
  Obtained from environmental sample
  misc_feature (1)..(561): n is a, c, g, or t
atgccagggtttggaaaaagtgataataattatatattaacaacaatagattatgcaaatattataaaaatatttttaaacaagcttcatataaatccaaatgatgtaacgatagttggacactcttttggtggtaaagttgcaacttgtttgatgccaaaactattggtacttttaagtagtgcagggattgttgaagacaaatcatctaaaacacttcttacaatacgaatggcaaagatttttaatagatttggcttgagtaaagtaactaagatgtttagaagcaatgatgtaaatgggatgcctcaaaatatgtatgagacttttaaaaatgtagttgatgaagattttagtgagtactttaaaggattttataaagatgctttgatattctggggagaaacagatactgcaactacactagaatctgggaaaactatccatagtttcataaaaaatagctcatttaaatcttatgatggtgatcactatttctttttaaagtatagtgatgatatagctcttcatattgaaaaacatcttaccctattgggttaa

SEQ ID NO: 8122 - protein, 186 aa, Unknown
  Obtained from environmental sample
  misc_feature (1)..(186): Xaa is any amino acid
MPGFGKSDNNYILTTIDYANIIKIFLNKLHINPNDVTIVGHSFGGKVATCLMPKLLVLLSSAGIVEDKSSKTLLTIRMAKIFNRFGLSKVTKMFRSNDVNGMPQNMYETFKNVVDEDFSEYFKGFYKDALIFWGETDTATTLESGKTIHSFIKNSSFKSYDGDHYFFLKYSDDIALHIEKHLTLLG

SEQ ID NO: 8123 - DNA, 654 bp, Unknown
  Obtained from environmental sample
  misc_feature (1)..(654): n is a, c, g, or t
ttgattaatatattattactagaggatgatgaactttttagtctttctttgattgattatttagaagagtttggagagtttaatgtaacccatgtaaataactctcaaaagcttttagaactcacttttgaaaatcgatatgatttgtatctacttgatataaatcttcctgatatttgtggattagatttactaaaagagttgcgttctagtagtgatgaaacacctgctatatttttaacatcctataaagataaagaaactttaaaagagggttttcatagtggagcggatgactttttaacaaagccatttgatatggatgagctagttttacgaattaactcacttattaaaagatttaaaaaacattctgttgttagtattggaaatttagaatttaattttgataataaaactgtgacaaaagacggtgttattattaagtttagtctaaaagctttagatttatttgagctattttatcaaaataatcactcaattgtttcaaaagagatgattataaataaactgtggaatgtgaatgaagagtatagtgagggttctattcgtgtttatgtaaataacatcaaaaaattgtttgatgatgatactgtttttactatatcaaatttaaaaaatattgggatatag

SEQ ID NO: 8124 - protein, 217 aa, Unknown
  Obtained from environmental sample
  DOMAIN (144)...(217): Transcriptional regulatory protein, C terminal
  misc_feature (1)..(217): Xaa is any amino acid
MINILLLEDDELFSLSLIDYLEEFGEFNVTHVNNSQKLLELTFENRYDLYLLDINLPDICGLDLLKELRSSSDETPAIFLTSYKDKETLKEGFHSGADDFLTKPFDMDELVLRINSLIKRFKKHSVVSIGNLEFNFDNKTVTKDGVIIKFSLKALDLFELFYQNNHSIVSKEMIINKLWNVNEEYSEGSIRVYVNNIKKLFDDDTVFTISNLKNIGI

SEQ ID NO: 8125 - DNA, 636 bp, Unknown
  Obtained from environmental sample
  misc_feature (1)..(636): n is a, c, g, or t
ttgataataaatgatatagttcgtatgccagacttaaaaaatattgtaaaccaaaaagagattgataatataaaaagtcgctgtgaaatattgaatactaatataaaatatctttcaagtatttcaggtaactttcattttgaaaaaaaaacatacttttataaaatggtgttatatctagatgatgttttagatacaagtattaaacttgtaaatccacttattaaaaataataatattttaatcttaaaagatatagaaacagacataactattttaagtaataaatatattttagtggaggtagttttaaatatacttaataatgctgttgaacaattagagcttattgaggcaaactcaaagtatatatttataaaaatagaaaaagaaaataataaaattatcctctctattacagatacagcaggagggattaatcatgaagttataaatagaatatttgaaccttattttacaactaaaaaaaatccacaaaataagggattaggactttatatcacacatcagttgttagccaaaatagatgcaaaaataactgttacaaatgatattgtaattcatagaactttgtattatatgggtgctaagtttagtatagaactaccatattaa

SEQ ID NO: 8126 - protein, 211 aa, Unknown
  Obtained from environmental sample
  DOMAIN (94)...(197): Histidine kinase-, DNA gyrase B-, and HSP90-like ATPase
  misc_feature (1)..(211): Xaa is any amino acid
MIINDIVRMPDLKNIVNQKEIDNIKSRCEILNTNIKYLSSISGNFHFEKKTYFYKMVLYLDDVLDTSIKLVNPLIKNNNILILKDIETDITILSNKYILVEVVLNILNNAVEQLELIEANSKYIFIKIEKENNKIILSITDTAGGINHEVINRIFEPYFTTKKNPQNKGLGLYITHQLLAKIDAKITVTNDIVIHRTLYYMGAKFSIELPY

SEQ ID NO: 8127 - DNA, 483 bp, Unknown
  Obtained from environmental sample
  misc_feature (1)..(483): n is a, c, g, or t
atggaagtatatgagagaattaacaatattttaaaagagaaaaatcttacaaaaagggagtttgcaaaaaaacttcaagatttagaaccaaaacttcatagtacaggtgagacaccaaatgaaaaaacaatatataaatatcttgatggaactatatctttaaaaatagagctcataccttatatagcagatactttgcaaatctgtgaacaagagctatttactaatgatcaaaaatctagaaaaaagtttttccaaaatattttaaaaactgcaactcatgaagagatagagataatcaaaaataaatttgaactgcaaaacaaatataaagaccttataaaagaacctagtacaaactatggaaaagaactcactctggaaaatgagttaatatcattaatgccttatgcccctataccacttttagaaaattttatagcaaaactaaaagatttaaaagagtttaatgataatatataa

SEQ ID NO: 8128 - protein, 160 aa, Unknown
  Obtained from environmental sample
  misc_feature (1)..(160): Xaa is any amino acid
MEVYERINNILKEKNLTKREFAKKLQDLEPKLHSTGETPNEKTIYKYLDGTISLKIELIPYIADTLQICEQELFTNDQKSRKKFFQNILKTATHEEIEIIKNKFELQNKYKDLIKEPSTNYGKELTLENELISLMPYAPIPLLENFIAKLKDLKEFNDNI

SEQ ID NO: 8129 - DNA, 315 bp, Unknown
  Obtained from environmental sample
  misc_feature (1)..(315): n is a, c, g, or t
atgagttatttgatagtaatatatttatgtctattttgttatgttgtatttagtttgtattttatatatacgcaaagaaaaaaaataaaaatatacaaagataactttcaagataaaagtttcataaataatatagatagtgatacacttaaaatggatgcaataaaggatttattagagaatttaacacaccaatggataaaggcattaatgaaaataaatgatataattcgtatgccagacctaaaaaaatatgtaaaccaaaaaaagatggataatataaaaagccgctgggaaaattggatactaatataa

SEQ ID NO: 8130 - protein, 104 aa, Unknown
  Obtained from environmental sample
  misc_feature (1)..(104): Xaa is any amino acid
MSYLIVIYLCLFCYVVFSLYFIYTQRKKIKIYKDNFQDKSFINNIDSDTLKMDAIKDLLENLTHQWIKALMKINDIIRMPDLKKYVNQKKMDNIKSRWENWILI

SEQ ID NO: 8131 - DNA, 462 bp, Unknown
  Obtained from environmental sample
  misc_feature (1)..(462): n is a, c, g, or t
gtgagtgttggggattatgattttgtaaaagatgttattattgaagatttaaggtgtgagatattatttcaaggggcaaatatcaaaccagggaaacctattttatttgctcgcaaagataataagtttatcataggacttccaggatttgcatactctagtacagtaacttgtatactctatgttctaccacttatttttaaactaaaaaattcaaatgaatcgttacagatagttgaagcaatcatcgatgaaagctttccaatgaagtttgataaaactacttttagtgcttgtaatgttcactattgtaatggtgagtatcatattgattttgatgggaaaagaaaagggactagtgctattttaacgaatatgttgggtagtcctgggttgcttatgcaagatgttgggagccagtctttgaataaaggggatagagttaaggttattttactttaa

SEQ ID NO: 8132 - protein, 153 aa, Unknown
  Obtained from environmental sample
  misc_feature (1)..(153): Xaa is any amino acid
MSVGDYDFVKDVIIEDLRCEILFQGANIKPGKPILFARKDNKFIIGLPGFAYSSTVTCILYVLPLIFKLKNSNESLQIVEAIIDESFPMKFDKTTFSACNVHYCNGEYHIDFDGKRKGTSAILTNMLGSPGLLMQDVGSQSLNKGDRVKVILL

SEQ ID NO: 8133 - DNA, 354 bp, Unknown
  Obtained from environmental sample
  misc_feature (1)..(354): n is a, c, g, or t
atgaaaaaattaatcagttacgaacaaacattacatataatagattcaatcgaatcaacaatacaagcaactcaaaaattgtatatcagtgatactcttggaagagtgttagcaaaagatattgtagcacaggaaaactcacctgcatttgaaacctctggtatggatgggtatgctataaaacacgaagacctttcacttggtaaactaaaaatcgctgattttaatccagctggaactgttatagaattcagaagttactaccacctacttgtatccaaaacattttacagggttccctttatgccaccaagggaagtgaatccttttaataccctaatggaaaaatgttaa

SEQ ID NO: 8134 - protein, 117 aa, Unknown
  Obtained from environmental sample
  DOMAIN (4)...(114): MoeA N-terminal region (domain I and II)
  misc_feature (1)..(117): Xaa is any amino acid
MKKLISYEQTLHIIDSIESTIQATQKLYISDTLGRVLAKDIVAQENSPAFETSGMDGYAIKHEDLSLGKLKIADFNPAGTVIEFRSYYHLLVSKTFYRVPFMPPREVNPFNTLMEKC

SEQ ID NO: 8135 - DNA, 591 bp, Unknown
  Obtained from environmental sample
  misc_feature (1)..(591): n is a, c, g, or t
atggagaacctaaaagatttaactaaagaacaacttattggggtaatagagaaattaaaagaggaggcattaaaaccacaatctactattgaaaaccaccccgatatccttaataagtacaatacaaagatatttcaacaactttctgaaaatattccaatagttctttattctgcattatacgatgaatcttctacaacactatttgtttcaaatcaagtgaaagtacttttaggttatgaaccggaagcgttttataaatcatccgatctttgggggaaaatagttcatcctgatgatttagagcatgtttgggaagcagttaaggagcatcgtaaaaatagaacagatcttaaaatagattatagggtaattacaaaaaatggagaaataaaatgggtacacgatcgtgcaataccaatattgaatgaagagaatactattgagagaattgaaggatttatggaggatgtttctgagcgaaaaagaatagaaatggacttaaacaaatctgaacattttttaaccagtttaaccaatgccctgactgattctattttcacaataaatgtgaggagtaaggaaaattga

SEQ ID NO: 8136 - protein, 196 aa, Unknown
  Obtained from environmental sample
  DOMAIN (119)...(161): PAC motif
  misc_feature (1)..(196): Xaa is any amino acid
MENLKDLTKEQLIGVIEKLKEEALKPQSTIENHPDILNKYNTKIFQQLSENIPIVLYSALYDESSTTLFVSNQVKVLLGYEPEAFYKSSDLWGKIVHPDDLEHVWEAVKEHRKNRTDLKIDYRVITKNGEIKWVHDRAIPILNEENTIERIEGFMEDVSERKRIEMDLNKSEHFLTSLTNALTDSIFTINVRSKEN

SEQ ID NO: 8137 - DNA, 582 bp, Unknown
  Obtained from environmental sample
  misc_feature (1)..(582): n is a, c, g, or t
ttgaaaaataaagcagaaaatggtgaattgtttttttattctagagaagcaaaagacagaggaatactaaattcacttcctatggagctttatgaaaaagccacacaagaactatctagtatattaggagataaaccaattataattacagaaggtaaaacagattggaagcacctaaaacaagcactacgaaggtttcaagatgaatattactacctagacctagatattgaatttttgcagtatgaagataacatacaaatgggagatgctcaacttgattctatggttgaatcttttaaaaaaacaaatcagccaagaaaaacaatttttatgtttgatagagataatgataagtatactcgaaaatatggaaatgaagaattttataattataaaaataatgtatacattttctgtattccaaaaataaatgatgagctagataatatttgtttagaattttattatgaagaaaataacttaaaaactgaagatganagtggtagaagattatttttggggaaagatttttttactaatggtaatagtaaatgtggtgaatatcaggctanagaacaa

SEQ ID NO: 8138 - protein, 194 aa, Unknown
  Obtained from environmental sample
  misc_feature (1)..(194): Xaa is any amino acid
MKNKAENGELFFYSREAKDRGILNSLPMELYEKATQELSSILGDKPIIITEGKTDWKHLKQALRRFQDEYYYLDLDIEFLQYEDNIQMGDAQLDSMVESFKKTNQPRKTIFMFDRDNDKYTRKYGNEEFYNYKNNVYIFCIPKINDELDNICLEFYYEENNLKTEDXSGRRLFLGKDFFTNGNSKCGEYQAXEQ

SEQ ID NO: 8139 - DNA, 756 bp, Unknown
  Obtained from environmental sample
  misc_feature (1)..(756): n is a, c, g, or t
atgagtagtaatactaaagaggtgcagaactataaagatgccttgtatttgggatttgagatcatcaaaacaaaaagaattttgagtgttaatcatatcaaagagattcaagcgactttagagcaaaatgatgcagggtttagaaagcagagtggaaccgttctaaaaaatccaagaactggagagataaaacttataccgccacaaaatcctcaagacattattgagctgatggcaaatttgagtgagtatatcaatgatgatagtttggatgattttgatagtttggtgaaaatggcaatcattcattatcaatttgaagctacgcatccattttatgatggaaatggcagaacgggcaggattataaatattttatatcttgttttggcgggattgttggatgtgcctatattgtatctgagtcggtatattatcaaaaataaagcagactattacagacttttaaatgatgtgagttttaatgatgggcttcatgaatggatactttttatgctaaaaggtgttgaagagatttcaaaagagactattcaaatcattaaaaatatagaggttttgatggagaaaacaaaaaatatcatacaagaacaaaaaccaaaaatttatagtaaagatttactagaagcacttgtttaccacccttatactaaaagagcctttattgaagaacagttaaatatctcacgaccaacagcaacaaattatctcaaagagctgaaaatatgggattcttag

SEQ ID NO: 8140 - protein, 251 aa, Unknown
  Obtained from environmental sample
  DOMAIN (27)...(156): Fic protein family
  misc_feature (1)..(251): Xaa is any amino acid
MSSNTKEVQNYKDALYLGFEIIKTKRILSVNHIKEIQATLEQNDAGFRKQSGTVLKNPRTGEIKLIPPQNPQDIIELMANLSEYINDDSLDDFDSLVKMAIIHYQFEATHPFYDGNGRTGRIINILYLVLAGLLDVPILYLSRYIIKNKADYYRLLNDVSFNDGLHEWILFMLKGVEEISKETIQIIKNIEVLMEKTKNIIQEQKPKIYSKDLLEALVYHPYTKRAFIEEQLNISRPTATNYLKELKIWDS

SEQ ID NO: 8141 - DNA, 492 bp, Unknown
  Obtained from environmental sample
  misc_feature (1)..(492): n is a, c, g, or t
ttgttaattgtaccaaatacaaaagcaaaaaagatgataattgaaaactacaataaacaaaactttttaagtgaagatttttttgcttcttatttaaaacttacaaatacccctatccctttaaaagaagatattcaagagttttgtcaaaaacaacaaatagggactatctatattgttgttagaaacaatctttatattttagatgctttatcatttacaattattgatacaattgatatagctgtaaatgatggaagaactcaaatgccattttatacaaaaattgaagagatagaagagggaatatttggtggagattttggacttggtaccgttatagaactagcttcaaaaataaatctttatgaccctgattataatccaaatgaaaataaaactaatacaaagcaagaggtagagcaaatagatccaaatgaaaaatttgatgattacaataaacactatttaaatatgttaggaaaattataa

SEQ ID NO: 8142 - protein, 163 aa, Unknown
  Obtained from environmental sample
  misc_feature (1)..(163): Xaa is any amino acid
MLIVPNTKAKKMIIENYNKQNFLSEDFFASYLKLTNTPIPLKEDIQEFCQKQQIGTIYIVVRNNLYILDALSFTIIDTIDIAVNDGRTQMPFYTKIEEIEEGIFGGDFGLGTVIELASKINLYDPDYNPNENKTNTKQEVEQIDPNEKFDDYNKHYLNMLGKL

SEQ ID NO: 8143 - DNA, 831 bp, Unknown
  Obtained from environmental sample
  misc_feature (1)..(831): n is a, c, g, or t
gtgatggtgaagcatcaatggagaagaaaaaacaagaggggtatttttaagatggcacaccaatcagatttaattgctgaaaatattgaacaatatttaaaagagcatgaaaacaaagagatactaagatttataacatgtggttcagttgatgatggtaaaagtactttaattggaagattactttacgattcaaaaatgatttttgaagatcaattagctgcaattgaaaaagatagtaaaaaaagcggaacaactggtgataagattgacttagcacttttggttgatggactagcaagtgaaagagaacaaggtattactattgatgttgcttatagatttttctcaactgaaaaaagaaagtttatcatagcagatactccagggcatgaacaatacacaagaaatatggcaacaggtgctagtactgctgatgtagctattatcttaattgatgcaagacaaggaattttaactcaaacaaaaagacactcttatatagcttcattacttggtattaagaacctagtagttgctataaataaaatggatttagttgacttttcacaagaagtatttgaaaatattaaaaaagattatgcacaaattatccctaatcttccacataatgaagatatcaattttgagtatatcccaatctctgctttagatggagataatattcttacagtttcaccaaaatgttcttggtatacgggtcttcctcttatgcaattacttgatacaatatcaattcataaagatgagaatgatgactttagattgccagttcagtatgtgtcaagacctcaccctcagccaatctga

SEQ ID NO: 8144 - protein, 276 aa, Unknown
  Obtained from environmental sample
  DOMAIN (39)...(255): Elongation factor Tu GTP binding domain
  misc_feature (1)..(276): Xaa is any amino acid
MMVKHQWRRKNKRGIFKMAHQSDLIAENIEQYLKEHENKEILRFITCGSVDDGKSTLIGRLLYDSKMIFEDQLAAIEKDSKKSGTTGDKIDLALLVDGLASEREQGITIDVAYRFFSTEKRKFIIADTPGHEQYTRNMATGASTADVAIILIDARQGILTQTKRHSYIASLLGIKNLVVAINKMDLVDFSQEVFENIKKDYAQIIPNLPHNEDINFEYIPISALDGDNILTVSPKCSWYTGLPLMQLLDTISIHKDENDDFRLPVQYVSRPHPQPI

SEQ ID NO: 8145 - DNA, 837 bp, Unknown
  Obtained from environmental sample
  misc_feature (1)..(837): n is a, c, g, or t
atggctgcaccacagtttatagattttgtaaaaaaagaattgaatgaatacaaggaagggtatggttataataatgatagatttgcatttgaaccatgggctttgcagtatatattaggaatagatcgtgatatggctgttaacaatactgatacattattcagaggagatgaaggattagatggttggtactatgacgatgaaaataatatatttaatatatttcaaattaaatatccagataatcctaattcaatatataatgattcagcaaatgacgaattaatatcatttttaattaaactgcttgataaacaacatactttcacaaataaaaaattacagtatgtgtacaaggcatatcatgaagtgtataatcctgaaatcaaaattaaactcaatattgttgtattttcaaaagtacatgccgattataaaaaatcttataaggaacaattgacaaataagagtgctaaagttgaattggtagtttatgatattgaaaagctttataatatgtatattgatgaaaatgacatggatgatttagatggcataaccattaattttgatatattaaatggacaatacattgaagttgaatctcatgatcctagcagtatcggtaaagcaactattgtaactttaaatggcaaatcatttgcatcgtctgttaaaaaacattatcctaatatagttgctaaaaatgtacgttttcatttgggtaaagcgaaaaatcaaggcattatagatttattgcaaaatgaacaagaaaactataaattttggtactacaancatggaaatcacattttatgtgacaaatgggaaagttat

SEQ ID NO: 8146 - protein, 279 aa, Unknown
  Obtained from environmental sample
  misc_feature (1)..(279): Xaa is any amino acid
MAAPQFIDFVKKELNEYKEGYGYNNDRFAFEPWALQYILGIDRDMAVNNTDTLFRGDEGLDGWYYDDENNIFNIFQIKYPDNPNSIYNDSANDELISFLIKLLDKQHTFTNKKLQYVYKAYHEVYNPEIKIKLNIVVFSKVHADYKKSYKEQLTNKSAKVELVVYDIEKLYNMYIDENDMDDLDGITINFDILNGQYIEVESHDPSSIGKATIVTLNGKSFASSVKKHYPNIVAKNVRFHLGKAKNQGIIDLLQNEQENYKFWYYXHGNHILCDKWESY

SEQ ID NO: 8147 - DNA, 630 bp, Unknown
  Obtained from environmental sample
  misc_feature (1)..(630): n is a, c, g, or t
gtgatcagatcggctcgagagatgatgcatactgtcgaagaccttgaaaatagcattacaaataatggtgatgacttaaaagagataaacaaagaattaacaaaaaactttaaagctaaccaagagagatttgcgtttataaaaggttatgaagagcttcaagaagtttcaaaagtaagtgaaatggtttacaaagaagaacttcaagataaacttctagtcttcaacaaaacactcaaaagaagtacagcttcatttcttgaacagtatgagcatattaacgagatatgcatagatgaaaagcatagaatagtaataggtgacggtaagcaatctttagacatagagctactctcagctggtcaaaaacaggtactaaactttcttatagtgaaaagcatactagaatttaaagaattctcttcatttgtgatggtggacacgccttttggacgtctctcaaatgagaataaaaagttacttttaaatgattgctaccttaagtttgacaatcttatactactccttacggatagcgaatttgagtttgttcagactcaacagttaaactactcaacttatgacattttacgaaatgacttaggttcaaaaatagagagaagattatga

SEQ ID NO: 8148 - protein, 209 aa, Unknown
  Obtained from environmental sample
  misc_feature (1)..(209): Xaa is any amino acid
MIRSAREMMHTVEDLENSITNNGDDLKEINKELTKNFKANQERFAFIKGYEELQEVSKVSEMVYKEELQDKLLVFNKTLKRSTASFLEQYEHINEICIDEKHRIVIGDGKQSLDIELLSAGQKQVLNFLIVKSILEFKEFSSFVMVDTPFGRLSNENKKLLLNDCYLKFDNLILLLTDSEFEFVQTQQLNYSTYDILRNDLGSKIERRL

SEQ ID NO: 8149 - DNA, 948 bp, Unknown
  Obtained from environmental sample
  misc_feature (1)..(948): n is a, c, g, or t
ttggctcggattctgggagaccatgtactgaactctgtctacgttgctgattcaaaactggtcaccatgagaaatctggacgccattgccagtctggagaccaaattgcagttcatatcgcgatcgcctgcaagttttaattccaaaattacccagaagatccgtgatgaagcctatgaaaaaggtgagtggaacgccataggggcacaccgggacacgccaacaaaaaactcaacacttgcagaatacgaagcaatgtccttttgcagaaaaataaaggggttaaattaccggtttatcgtctacagaagtgatgcaaaagagcacctcgtcgacaaaaaaatgaaaaccgataaagaatccctcaattctgcgtttggcaagagattcaatggtaaaaaaaatatatttgcatgcgaaaaagacgctgaaaatgaaattctgaagtttattggcaaacataagaaaaatctctatgacgtctcgtgcaccatctcagaactggtcgagtacaagaagccaagaggcagacccggaaagaatccaaaaccgccggtgaagaatgttcagtacgctgttgaacttctggatattgctgagaacaaggttcgaatcgcagattgccggaagaaaacacagtcatttgtattgattacgaatgtccctgaatcagagatggatgaacgggcaatccttcacatatacaaagaacagaaggttgtcgaagacaatttttcaatcattaaacggcctgtcatggcgggcacactctttgttcaaaaaccgganagattagaggcattgatgattttgctctgtatttcgttgttacttcagattgcaatgaaattgattgtcagaaagaatctggcagagatggatttcattcctaatcttgacgtccacagaaaacctctgatcagaccgtcttccaagaagatatcgatt

SEQ ID NO: 8150 - protein, 316 aa, Unknown
  Obtained from environmental sample
  misc_feature (1)..(316): Xaa is any amino acid
MARILGDHVLNSVYVADSKLVTMRNLDAIASLETKLQFISRSPASFNSKITQKIRDEAYEKGEWNAIGAHRDTPTKNSTLAEYEAMSFCRKIKGLNYRFIVYRSDAKEHLVDKKMKTDKESLNSAFGKRFNGKKNIFACEKDAENEILKFIGKHKKNLYDVSCTISELVEYKKPRGRPGKNPKPPVKNVQYAVELLDIAENKVRIADCRKKTQSFVLITNVPESEMDERAILHIYKEQKVVEDNFSIIKRPVMAGTLFVQKPXRLEALMILLCISLLLQIAMKLIVRKNLAEMDFIPNLDVHRKPLIRPSSKKISI

SEQ ID NO: 8151 - DNA, 870 bp, Unknown
  Obtained from environmental sample
  misc_feature (1)..(870): n is a, c, g, or t
atggtttacgcccatgagaagtttgttgagccaatgcttgattacattgttaaagattttgaacaagcgcgaatatcaatgaacaataatggtattggtggcatggtcgtttgcgattcatcagaccaagctaaaatgatgtatgaaatctttcagcataaatacgctaaaacgcaggaaaagcaacaacaagtcttaatggctgctgagccaaaagctagctacaacgcaactaaaaagcaaaacagcgaagttaataccgcagctgtcatactgcacgacatcggtacaaaagaagagcgtaaacaaaaagtagaagactttaaagaaggtaaaatagacttcttatttgtctttaatatgttgcttactggctttgatgcaccgcgccttaaaaaactatatatcggtcgtgttataaaatcgcataacctattgcaaacacttactcgcgttaatcgtacatacaaagacttcggttatggctatgttgtcgattttgctgatattgaaagtgagtttgaaaaaaccaatcaagactatttcaaagagctgcaatcagaactaggtgacgagatagaacattttagtaacctgttcaaatcacaagaagaagttcaacaagaaataaatgaaattaaagatgtgctctttcatttcgatactaaaaatgcagaagtattttcagaccanattacgcanatagactcacgcggtgaaatgttaaaaatcacgcatgcgttaaacaatgccaaaagcctgtataatctcattcgcttgtcgggtgactacgaaatgttagaaaaactcgactttcaaatgctcaacgtattatcaagagaagcaaacaaccgcttnagcctaattaaa

SEQ ID NO: 8152 - protein, 290 aa, Unknown
  Obtained from environmental sample
  misc_feature (1)..(290): Xaa is any amino acid
MVYAHEKFVEPMLDYIVKDFEQARISMNNNGIGGMVVCDSSDQAKMMYEIFQHKYAKTQEKQQQVLMAAEPKASYNATKKQNSEVNTAAVILHDIGTKEERKQKVEDFKEGKIDFLFVFNMLLTGFDAPRLKKLYIGRVIKSHNLLQTLTRVNRTYKDFGYGYVVDFADIESEFEKTNQDYFKELQSELGDEIEHFSNLFKSQEEVQQEINEIKDVLFHFDTKNAEVFSDXITXIDSRGEMLKITHALNNAKSLYNLIRLSGDYEMLEKLDFQMLNVLSREANNRXSLIK

SEQ ID NO: 8153 - DNA, 630 bp, Unknown
  Obtained from environmental sample
  misc_feature (1)..(630): n is a, c, g, or t
atggaaccttttaaaaatatatataatgaaaaagagataacaaaattagctaaagaaataaaacttgtttatgaaccttttgtcaaagaaaaatttatagattcacttataaatgagagttgggaagaaaaagagttaaaacaaagaatacgcgctattagtttagctcttggagaatttttacctgataattataaagatgctttagagataataaaaaaagtacaggataaattcaatagtcttttccatctaatattccctgactttgtagaagtatatgggatagatgagtatgaagtatctattgaagctttaaagctttttactcaaaactcttctagtgagtttgcaattcgtccttttttagtgaaatatccacagcttactgaaactttaaaagagtggacaaaagatgaaaatgagcatataagaagactagtaagtgaaggttctcgacctagacttccttggggaatggcacttcaaaactacaaaaaagaaccaacaaaagtacttgaactcttggaacttttaaaagatgatgaaagtgaatatgtacgaaaaagcgtagcanacaatcttaatgatatctcaaaagacaatccaaaaacagtaaaggagatattt

SEQ ID NO: 8154 - protein, 210 aa, Unknown
  Obtained from environmental sample
  misc_feature (1)..(210): Xaa is any amino acid
MEPFKNIYNEKEITKLAKEIKLVYEPFVKEKFIDSLINESWEEKELKQRIRAISLALGEFLPDNYKDALEIIKKVQDKFNSLFHLIFPDFVEVYGIDEYEVSIEALKLFTQNSSSEFAIRPFLVKYPQLTETLKEWTKDENEHIRRLVSEGSRPRLPWGMALQNYKKEPTKVLELLELLKDDESEYVRKSVAXNLNDISKDNPKTVKEIF

SEQ ID NO: 8155 - DNA, 411 bp, Unknown
  Obtained from environmental sample
  misc_feature (1)..(411): n is a, c, g, or t
atgaaaaataaatacactctaacagcttttgaaaaagatagtaactctcttcttgctgaactgtttttacaagtacgagattttataaaaatttgtataggaaatagagttaaagaaaaatatagagaaaatataacctcatatttttctactgagggtggatattgttatctaaaagcttatgatgagtatattcatattggttggtttcgaggtgtaaatatagatgacaaatataaccaactttttggaagtgctaaaactataagaggtcaaaaagtgtataaactcgataaagttacacgagataccattagatattatattgaacaaactttgatatttttaatagaacataatgagttgatgaagatgaaaaaagggataaaaaaatatgatagagaactttga

SEQ ID NO: 8156 - protein, 136 aa, Unknown
  Obtained from environmental sample
  misc_feature (1)..(136): Xaa is any amino acid
MKNKYTLTAFEKDSNSLLAELFLQVRDFIKICIGNRVKEKYRENITSYFSTEGGYCYLKAYDEYIHIGWFRGVNIDDKYNQLFGSAKTIRGQKVYKLDKVTRDTIRYYIEQTLIFLIEHNELMKMKKGIKKYDREL

SEQ ID NO: 8157 - DNA, 825 bp, Unknown
  Obtained from environmental sample
  misc_feature (1)..(825): n is a, c, g, or t
atgctcttttatattaaaagtttagaaaaagcaaaagaaatgagaaataccccaagtaggtatttcaatgatagagattatattacagattatattgaaaacgagaatgctcgtaatacttatttgaaaccaaagaaaaatgattctgaaactagagtaaactctggtttgctagaaaaaaagattgaaacaattattaatgaattgttaacaatgaactttcaacctactattagaacttttaataaagaagataaagaactattagaattaggtgatgatatgacagatattgtcatgagaactaatcaacaagaagaagatgataacttctggaagaaattttattttgaactctttacccaaagagctgttttcgttagagagaaatttgaacagataactcttaaagatggaaagacaaaaattaaaatggcgaaaaaacaaatggtttcaggacttaaagtatttttaggtgatataagtattccagctgatgaaattgatagacaaccatatatagttacagttgatgtaatgaattttgatacagctaaaagtgaatttggtcatttaaagaattgggagcatgtccaatctgataatagaactagaagtgaatatttaagtggagcattaagttatagattttctgatgtagcanatggacaagttgagatcataacttatgaatctttacttgatgatgaataccaagtgattattaatggtgtaatgatgtatcctcttnaaactaagatgcctgataaatattgtaataaatataatttaagaatgtactcctctaaaagagaatgctcttga

SEQ ID NO: 8158 - protein, 274 aa, Unknown
  Obtained from environmental sample
  misc_feature (1)..(274): Xaa is any amino acid
MLFYIKSLEKAKEMRNTPSRYFNDRDYITDYIENENARNTYLKPKKNDSETRVNSGLLEKKIETIINELLTMNFQPTIRTFNKEDKELLELGDDMTDIVMRTNQQEEDDNFWKKFYFELFTQRAVFVREKFEQITLKDGKTKIKMAKKQMVSGLKVFLGDISIPADEIDRQPYIVTVDVMNFDTAKSEFGHLKNWEHVQSDNRTRSEYLSGALSYRFSDVAXGQVEIITYESLLDDEYQVIINGVMMYPLXTKMPDKYCNKYNLRMYSSKRECS

SEQ ID NO: 8159 - DNA, 765 bp, Unknown
  Obtained from environmental sample
  misc_feature (1)..(765): n is a, c, g, or t
gtggttgaggctgcaaatctcttgcaaactttgggtatctattttgagagaatagatatgagtgagtacatggaaaagcacgcactctctcgtcttatcggttcacctcctggttatgtgggatatgagcaaggtggtcttttaacagagagtgtcagaaaacatccatacatggttctactacttgatgagatagaaaaagcccaccctgatctgatcaacattttacttcaagtcatggatagtgcaacactaacagataacaacggaaataaagcaaacttctcaaatgtgatactcatcatgacatcaaacataggagctagtgaagcttctgtcatgggatttaacgcttctcaggagttatctagaaaccgtgcattaaaatctttcttcacacctgagtttagaaacagacttgatcgcatagtagagtttaaagcacttgaaatcagcagtgttatcaagatagtagataagtttatagatgaactaaacgtctctttaaatgagaaaaaagtacatgtaacactcactaaaaaagcaaaagagcacatagccattaaaggctatgacagtgagcttggtgcaagaccgctctctcgtgttatatctgaacttattaaagatagactaagtgaagagatgctttttggagagttaagaggtggcggagtgatgagtgttgatcttaaaaaaggctctttagagtttaaatatgataaaaacatgactagccgtgtaagtactttagcaaagagctaa

SEQ ID NO: 8160 - protein, 254 aa, Unknown
  Obtained from environmental sample
  misc_feature (1)..(254): Xaa is any amino acid
MVEAANLLQTLGIYFERIDMSEYMEKHALSRLIGSPPGYVGYEQGGLLTESVRKHPYMVLLLDEIEKAHPDLINILLQVMDSATLTDNNGNKANFSNVILIMTSNIGASEASVMGFNASQELSRNRALKSFFTPEFRNRLDRIVEFKALEISSVIKIVDKFIDELNVSLNEKKVHVTLTKKAKEHIAIKGYDSELGARPLSRVISELIKDRLSEEMLFGELRGGGVMSVDLKKGSLEFKYDKNMTSRVSTLAKS

SEQ ID NO: 8161 - DNA, 684 bp, Unknown
  Obtained from environmental sample
  misc_feature (1)..(684): n is a, c, g, or t
atgataatagttagaataagcggtggtctaggaaatcagatgtttcagtatgctatagcaaaagctatggctaaaaaaaatagtgatatattcaaacttgatatatctttttatcctacacaaactctaagaaagtatgaattaaattttttcaatatcgaagaaaatatcgcaacagaagatgaatatataaaatttagaggcagagaaaagtttgtttttaaagtaaaaaatagattaggtttaaatgtaaatagaccttcttcatatattttagagaatcatttaactaaatttgacagtgaaatatacaaaaaaaaaggtgatatctatttagatggtttttggcaaaatgaaaagtactttaagagtattaaagatgaaatactagaagactttacacttaaaagtaagattaccaatgaggtgaatgagcatttagttaatatgaaaaactccaacaccgttagtctgcacgtaagaagaggggattatgtagatgatactaatacaaacagtatccatggggtttgtggtattgattattataaaaaagctacagagtatataatcaaaaaagtacaaaatcctgttttttatatcttttcagatgatttgtcatggtgtaagaaaaatttcgattttttagaaaacagagtttttgtagaatatacaaaaagtgca

SEQ ID NO: 8162 - protein, 228 aa, Unknown
  Obtained from environmental sample
  DOMAIN (1)...(228): Glycosyl transferase family 11
  misc_feature (1)..(228): Xaa is any amino acid
MIIVRISGGLGNQMFQYAIAKAMAKKNSDIFKLDISFYPTQTLRKYELNFFNIEENIATEDEYIKFRGREKFVFKVKNRLGLNVNRPSSYILENHLTKFDSEIYKKKGDIYLDGFWQNEKYFKSIKDEILEDFTLKSKITNEVNEHLVNMKNSNTVSLHVRRGDYVDDTNTNSIHGVCGIDYYKKATEYIIKKVQNPVFYIFSDDLSWCKKNFDFLENRVFVEYTKSA

SEQ ID NO: 8163 - DNA, 870 bp, Unknown
  Obtained from environmental sample
  misc_feature (1)..(870): n is a, c, g, or t
gtgttttttgttgccgcagcaacactttttgcttgtaatggagatcaacaacctaaagaaactattgatgttgtagcacctcaagtagaaatagctgttgaagaaaaaacaattgagataaatggtgttgaacactttttcactataaaaggcgaaggtgatcctatactttttttacatggtggaccaggtctttctcataattacttacttccttattttgatgcattagcagccaattatcaacttattttttacgatcaaagaggtagtggaaaatctgctttcccagaagataccacttctataaacatagaaacttttgtggaagatattgaagccattagaaaacattttggcaaagaaaaacttacccttataggtcattcttggggtagtttattagcacttcattacggacaaaaataccctgataaccttactcaacttattttaatatctcctgctccaactaccagtgctcactacgaaaaaatgttgagcaacatgcagcaaaaaagaaaagaagaagataccaaagaattagtaaggttaatgatgtctaaagaatttgagaaaagagaccctgaaacttttgctaaagcgatgaaaattggtgataaagctaatttatacgaccaaactaaagtagatgaattatatgaattacataactacaatgaaaaaactgctggtaaattttggttggtaagcaacattatggagaaaaacttttttaactataatattactgctgaaattgacaacatttcttgcccatcaattataattattggtgatatggataacgtaccttttgcttctaaccaactattaagcgaaacgctaaaaaataccaaattagaagta

SEQ ID NO: 8164 - protein, 290 aa, Unknown
  Obtained from environmental sample
  DOMAIN (81)...(290): alpha/beta hydrolase fold
  misc_feature (1)..(290): Xaa is any amino acid
MFFVAAATLFACNGDQQPKETIDVVAPQVEIAVEEKTIEINGVEHFFTIKGEGDPILFLHGGPGLSHNYLLPYFDALAANYQLIFYDQRGSGKSAFPEDTTSINIETFVEDIEAIRKHFGKEKLTLIGHSWGSLLALHYGQKYPDNLTQLILISPAPTTSAHYEKMLSNMQQKRKEEDTKELVRLMMSKEFEKRDPETFAKAMKIGDKANLYDQTKVDELYELHNYNEKTAGKFWLVSNIMEKNFFNYNITAEIDNISCPSIIIIGDMDNVPFASNQLLSETLKNTKLEV

SEQ ID NO: 8165 - DNA, 627 bp, Unknown
  Obtained from environmental sample
  misc_feature (1)..(627): n is a, c, g, or t
atgagcatagatcagggtatggtaaaatacaacacccaagttggaaccncaaagaagaaaaaaagtaagaaaaggagatncctttcaatttcaacagtaccaaatagaagttcgttaatcatgtcaaatcagaaaactaaaatattaagccacgagcaaataagcagaaaaataaatcgtattgcttttcaaatttttgaggacaatcatttagaaaaagaaattattgtggttggcattgaaaaaaaaggacatttattagcaaaaaaaattgctgaaaaactaaagactatttctgatatcaaagtaatagaagcatcgttaaaagttaataaagacaaccctttgagcgaagaacctaaactttctattaccgaaaaagaaattgaaaataaagtggttattttagttgatgatgtactcaactcaggtaaaacacttatttatggtgttaaatatcttttaaattttaatatccacagaatgtcaacagttgtattggtggatagaaacaacaaacgctaccctattggtacacactatgttggcttatcgctttctactactttaaaagaccatatttctattgaatttgtgggcggaaaaatgacggcttacttgagttga

SEQ ID NO: 8166 - protein, 208 aa, Unknown
  Obtained from environmental sample
  DOMAIN (43)...(181): Phosphoribosyl transferase domain
  misc_feature (1)..(208): Xaa is any amino acid
MSIDQGMVKYNTQVGTXKKKKSKKRRXLSISTVPNRSSLIMSNQKTKILSHEQISRKINRIAFQIFEDNHLEKEIIVVGIEKKGHLLAKKIAEKLKTISDIKVIEASLKVNKDNPLSEEPKLSITEKEIENKVVILVDDVLNSGKTLIYGVKYLLNFNIHRMSTVVLVDRNNKRYPIGTHYVGLSLSTTLKDHISIEFVGGKMTAYLS

SEQ ID NO: 8167 - DNA, 912 bp, Unknown
  Obtained from environmental sample
  misc_feature (1)..(912): n is a, c, g, or t
ttgccgagaggactcgacagtttgcattatgaagttgcagatgttacttacgaaatgatcgaagaaaatacagcatatgtaaattttgtcctggtaatcaaaaataatgaaggtgaaaaattatttgatgtttttcaaacttatagtatttattccagtggtgatattatcattaaaaatgatctgaaggtcagtgacaaaatcaaatctttggcaaaagttgggatgcagatgaaaattccaggtgatatggataatgttacctattttggtaaaggagatttcggaacttaccctgatagaaattcagcaggtaccacaaaaatatattccacaaaagtggcagatatgtggcacaattactccaaaccacaggaaaatggaaatcgtagtaatttacgttgggcaacaatagcaaataataaaggtaatggattatttatccagtctgatgaaagttataatttaagtacatacaattttgatgatgtgaaaatttacaatgcacaacatccatcagaattaagtgctgaaaaatatattaccatgaatattgaccataaaattgctggtcttggtacagcaacatgtggccccggaatactggaaaaatacttgctgaaagagaaactttacagtttcaaaatccgaatcaagccggcaaatctgagaagacaattaccgtctaaactttttacacaggaattacctgagtatgaaactaactatctgcctgcacctacaatcgaagccgaaagtgaatatttcaataaaccaatttttgtcacattgaatgttgaccacgaagatattgatattcgatatacagttgatggctcaataccatcggaaaatgattctctttacacagagccatttttgaatgataagtctaccatcgtaatgctcgct

SEQ ID NO: 8168 - protein, 304 aa, Unknown
  Obtained from environmental sample
  DOMAIN (121)...(218): Beta galactosidase small chain, C terminal domain
  misc_feature (1)..(304): Xaa is any amino acid
MPRGLDSLHYEVADVTYEMIEENTAYVNFVLVIKNNEGEKLFDVFQTYSIYSSGDIIIKNDLKVSDKIKSLAKVGMQMKIPGDMDNVTYFGKGDFGTYPDRNSAGTTKIYSTKVADMWHNYSKPQENGNRSNLRWATIANNKGNGLFIQSDESYNLSTYNFDDVKIYNAQHPSELSAEKYITMNIDHKIAGLGTATCGPGILEKYLLKEKLYSFKIRIKPANLRRQLPSKLFTQELPEYETNYLPAPTIEAESEYFNKPIFVTLNVDHEDIDIRYTVDGSIPSENDSLYTEPFLNDKSTIVMLA

SEQ ID NO: 8169 - DNA, 414 bp, Unknown
  Obtained from environmental sample
  misc_feature (1)..(414): n is a, c, g, or t
atgtaccaattggaaaaaggtaatagaaatataaaaattaaagcttccgcttcttatatgttgatggaaaaaatgtgttttgaagtggaaaaattttccaaagaaataaaattcgaaaaccgacgatttgcattgatgatatgtgttcgggaagccctgacaaatgcaattcgacatggaagtaaaaatgatgattcaaaaacagtttatatggaagttaattatgatagaaatgggttacaatttacaattaccgatgaaggtgaaggctttgattggaagattgtgaaaaatacaaaatccagtcaattaaatactttcggtcgtggtcgagatattatgaaaatatattccgatgaatttcattacaatgaaataggaaatcaaataaaaatattaataagaaatgaataa

SEQ ID NO: 8170 - protein, 137 aa, Unknown
  Obtained from environmental sample
  DOMAIN (40)...(137): Histidine kinase-, DNA gyrase B-, and HSP90-like ATPase
  misc_feature (1)..(137): Xaa is any amino acid
MYQLEKGNRNIKIKASASYMLMEKMCFEVEKFSKEIKFENRRFALMICVREALTNAIRHGSKNDDSKTVYMEVNYDRNGLQFTITDEGEGFDWKIVKNTKSSQLNTFGRGRDIMKIYSDEFHYNEIGNQIKILIRNE

SEQ ID NO: 8171 - DNA, 546 bp, Unknown
  Obtained from environmental sample
  misc_feature (1)..(546): n is a, c, g, or t
atgtcgaagcaaaatagcagtaatagacttcttcatgtcgcaaccttgggcaaaactgtcgggttacgaggtgatatgaaacttcatatacaaagtgattttcctgaacagtttaaagatggtgcaacatttatcaccaaaggtgataaaaaagtaaaaatattatccattaatcaagataagtctatggtgcaaatagatggttacatgagcgtagaatcagcaaaagctctaactaacacaaagctatttactacatatgaggatactagagaaaactgtaatcttaatgatggtgagtttttttggtttgatatagttggttgtaaaattgtagaagatggaaaagttttgggagaagtttcagaaattgagagaatctctatcagtgattatttgaaaatagatacagatagtgagttgatagaagcaggtgaagtaaaaacatttttagttccttatgttgatcattttgtaaaaaatgtagatttagagagtaaaactatagaagtacaaggtgctttggatattttacaggcttcatga

SEQ ID NO: 8172 - protein, 181 aa, Unknown
  Obtained from environmental sample
  DOMAIN (98)...(178): PRC-barrel domain
  misc_feature (1)..(181): Xaa is any amino acid
MSKQNSSNRLLHVATLGKTVGLRGDMKLHIQSDFPEQFKDGATFITKGDKKVKILSINQDKSMVQIDGYMSVESAKALTNTKLFTTYEDTRENCNLNDGEFFWFDIVGCKIVEDGKVLGEVSEIERISISDYLKIDTDSELIEAGEVKTFLVPYVDHFVKNVDLESKTIEVQGALDILQAS

SEQ ID NO: 8173 - DNA, 411 bp, Unknown
  Obtained from environmental sample
  misc_feature (1)..(411): n is a, c, g, or t
ttgaatgttttaattataagagcaccaatggttctaacaaataatcaggatattggtatattaaatagagttcgtaaagagttattattaaataatgatattcatataactaattatgataaagttttcaataattttatccatgctaatgatttactaaactttattgtatcttataaatttagtactatctgtgaagtatttaatatagctgttgataaaacacacaccttatatgagataatattatatatgaaaaactttctttcttcagattccagattaataaaagatgataaaaaaactaatttttttaatatagatatatcaaaatttaagcaatgtaatattcaaactatgaatgtagaagaaagtttaaaaaggtggctaaatgaatttaatacaggataa

SEQ ID NO: 8174 - protein, 136 aa, Unknown
  Obtained from environmental sample
  misc_feature (1)..(136): Xaa is any amino acid
MNVLIIRAPMVLTNNQDIGILNRVRKELLLNNDIHITNYDKVFNNFIHANDLLNFIVSYKFSTICEVFNIAVDKTHTLYEIILYMKNFLSSDSRLIKDDKKTNFFNIDISKFKQCNIQTMNVEESLKRWLNEFNTG

SEQ ID NO: 8175 - DNA, 321 bp, Unknown
  Obtained from environmental sample
  misc_feature (1)..(321): n is a, c, g, or t
atgataaatttcactttgacagttataataccaactatgaaatttattctaagcttattaatcctaatttttttcgcaggttgttctaaagtagcttttattcagagtgaaatagcaccaaaattgactcttatcccatcttccatagataaacttgatggttacgagagtgtagattttgactcaatgtttttactctttgaaaataactgtcgtactcaaaaagctaaaaatatatacggtgaactatgtagtaacctaaatcaaataacagataaaagagagttcttcaagaacaacttcagaccatacaaaatttaa

SEQ ID NO: 8176 - protein, 106 aa, Unknown
  Obtained from environmental sample
  misc_feature (1)..(106): Xaa is any amino acid
MINFTLTVIIPTMKFILSLLILIFFAGCSKVAFIQSEIAPKLTLIPSSIDKLDGYESVDFDSMFLLFENNCRTQKAKNIYGELCSNLNQITDKREFFKNNFRPYKI

SEQ ID NO: 8177 - DNA, 732 bp, Unknown
  Obtained from environmental sample
  misc_feature (1)..(732): n is a, c, g, or t
ttggtaacactctccattattgcttctctatacatagcatttaagctatataaagtttatgttaaaagcaaactaagaaagatttcaagctctaaagagttgtttagagagagtgaattggggctttttattgcacttgttgcaaaagttgctaaagcagatggaagagtaagtgaattagaagcacaacttatagggattatgtttgatgatatctctggaatttttgtagataaagagagaacgagaaacattttaaaagagatttttaatgaagaaaaagagagagatgacgacacaaaagaggtggcacaatctctaaataaactactcggtcgtagcaggttgaagcgtagacagtttgtagaatttttaatccaacttgcatttgtagataatggaatcagttctgatgaagataaggttttacgtgaaattgttacagagttaaatattgcccctcatgaatatgagctcatggtaaataaatttaaaaatatgatgaaaaacagacaacaatccatgactcttgaagaagcttataaaattttaggtgtaaataaagatgatgatatgagcactgttaaaaagacgtatagaaagcttgtgcgagagtaccatccagatatcataaaatcacaagataaagatgaagcttacataaaagaggcaactgccaaaacacaagagataaaccaagcttatcagattatcaaagagacaaaaaagtag

SEQ ID NO: 8178 - protein, 243 aa, Unknown
  Obtained from environmental sample
  DOMAIN (179)...(243): DnaJ domain
  misc_feature (1)..(243): Xaa is any amino acid
MVTLSIIASLYIAFKLYKVYVKSKLRKISSSKELFRESELGLFIALVAKVAKADGRVSELEAQLIGIMFDDISGIFVDKERTRNILKEIFNEEKERDDDTKEVAQSLNKLLGRSRLKRRQFVEFLIQLAFVDNGISSDEDKVLREIVTELNIAPHEYELMVNKFKNMMKNRQQSMTLEEAYKILGVNKDDDMSTVKKTYRKLVREYHPDIIKSQDKDEAYIKEATAKTQEINQAYQIIKETKK

SEQ ID NO: 8179 - DNA, 309 bp, Unknown
  Obtained from environmental sample
  misc_feature (1)..(309): n is a, c, g, or t
atggttgtagttgatccccctagttttgcaagatctaaaaaacatacctttagtgtctcaaaagattatgtaaagttacttaaagagattatccaaataaccaataaaggtggagtaatagtagcctcaactaactatgcaaattttaacctagcaaagtttagagactttatagataaagcatttagagaatcaaaaagtcaatataaaatcgaacaaactttttcactaccaaaagattttagagtcagtgataaatttagagaagataactatttgaaagttgtttttattaggaagattaaatag

SEQ ID NO: 8180 - protein, 102 aa, Unknown
  Obtained from environmental sample
  misc_feature (1)..(102): Xaa is any amino acid
MVVVDPPSFARSKKHTFSVSKDYVKLLKEIIQITNKGGVIVASTNYANFNLAKFRDFIDKAFRESKSQYKIEQTFSLPKDFRVSDKFREDNYLKVVFIRKIK

SEQ ID NO: 8181 - DNA, 339 bp, Unknown
  Obtained from environmental sample
  misc_feature (1)..(339): n is a, c, g, or t
ttgcaagtcgcgaaagtaccagaccccgaaaaaggatataaatacacaatcccggaaacaacaaggaatcaaacacataaagaaatcaaccgagttaacttcctcgctgacggttttaaagacattaaattttcggggaatatgactgtattaaaaacgttaccaggttatgcgagtagtattgcctccgtaattgacaatgccaacccctgggaaattattggaaccattgcaggagacgacaccatcctgattattctacgagaaggggtatcaaaaagtgatattattaatacattaattctgatcatgccaaatttggaagataaaatcggatga

SEQ ID NO: 8182 - protein, 112 aa, Unknown
  Obtained from environmental sample
  DOMAIN (34)...(103): Arginine repressor, C-terminal domain
  misc_feature (1)..(112): Xaa is any amino acid
MQVAKVPDPEKGYKYTIPETTRNQTHKEINRVNFLADGFKDIKFSGNMTVLKTLPGYASSIASVIDNANPWEIIGTIAGDDTILIILREGVSKSDIINTLILIMPNLEDKIG

SEQ ID NO: 8183 - DNA, 885 bp, Unknown
  Obtained from environmental sample
  misc_feature (1)..(885): n is a, c, g, or t
gtggatgcattaagtgtttttaccactaatgaaatttatacattagataaactagggattcaatataatattttagatccagctgcatttggaacaaagttttatgacttaaatctttttacaacaaaaagtgaacttaaaaataaccctaaaagaattgagagttttagagaagcttctattaaaggttgggagtatgcactaaaacacaaagaagagctggtagatattattttaaaaaaatacaatactcagaacaaaacaaaggaggcattactttttgaatcaaagcagatagaatatctaatgttaacacatatttatccaataggaagtattgatttagatcgagtccaaatgatagcagatagttttgcacaatctttacttatccctaaagagtcaaaaaagaatcttgagtcttttatctataaagcagaaaaaagtatttttttattaacaaaagagcaaagaaaatacctaaaagataaaaaacaaattaaaatgtgtgtagacccaaactggatgcctttagaaaaaatagaagatggaaaacatatagggttagcagcggacattatggatttggtctcaaaaagaatagataccccaatacagttagtacctacgcaaagctggtctcaaactcttaatagtgtaaaaagtagaaaatgtgatatcttggcacttgcagaaaaaactccatcaagagaaaactaccttaactttacaacaccttatataaaagtccctttagtaatcgctacaaaaaaagggcaactttttatagataacctaaacaccatcataaaaaaaccacttggtattgtaaaaaactattctatatatgaattactcaaagaaaaatatccagacnataaattt

SEQ ID NO: 8184 - protein, 295 aa, Unknown
  Obtained from environmental sample
  misc_feature (1)..(295): Xaa is any amino acid
MDALSVFTTNEIYTLDKLGIQYNILDPAAFGTKFYDLNLFTTKSELKNNPKRIESFREASIKGWEYALKHKEELVDIILKKYNTQNKTKEALLFESKQIEYLMLTHIYPIGSIDLDRVQMIADSFAQSLLIPKESKKNLESFIYKAEKSIFLLTKEQRKYLKDKKQIKMCVDPNWMPLEKIEDGKHIGLAADIMDLVSKRIDTPIQLVPTQSWSQTLNSVKSRKCDILALAEKTPSRENYLNFTTPYIKVPLVIATKKGQLFIDNLNTIIKKPLGIVKNYSIYELLKEKYPDXKF

SEQ ID NO: 8185 - DNA, 501 bp, Unknown
  Obtained from environmental sample
  misc_feature (1)..(501): n is a, c, g, or t
atggatgattttaaaaacttttttacccctgacaaacaaaaaagtatttttgaccttgaagatgctattgaaaaatctttagatattgtaaaaggttcaatcaatacacaccgtgtagctgtagagatagatatagataaagagttaaaatgtcattgttatttagatgagttacaacaagttatcttaactttattaaacaatgcaatagatgccttaattcttaaagctatagaatcgccaaagatatatataaaagcttataaagaaaatgtaagtatttttatagatatacaagacaatgcaggtggcattccagagaatattatagataaaatatttgaaccttattttacaacaaaacataaaacacaagggacaggactcggactttatatggcaaaaatgattattgaaagtggtttagagggaacacttagtgtagaaaatagactagaaggtgcttgttttacaatacaagtaccacaagggagagtataa

SEQ ID NO: 8186 - protein, 166 aa, Unknown
  Obtained from environmental sample
  DOMAIN (53)...(164): Histidine kinase-, DNA gyrase B-, and HSP90-like ATPase
  misc_feature (1)..(166): Xaa is any amino acid
MDDFKNFFTPDKQKSIFDLEDAIEKSLDIVKGSINTHRVAVEIDIDKELKCHCYLDELQQVILTLLNNAIDALILKAIESPKIYIKAYKENVSIFIDIQDNAGGIPENIIDKIFEPYFTTKHKTQGTGLGLYMAKMIIESGLEGTLSVENRLEGACFTIQVPQGRV

SEQ ID NO: 8187 - DNA, 861 bp, Unknown
  Obtained from environmental sample
  misc_feature (1)..(861): n is a, c, g, or t
atggccgagggcttggggtataccgcaatacttccttgggaccaggaaagaattgaagaacaagctaagaaaattaaaatgcctgtggaaaatataaataaatataaaaatttaaaatacccaggtatcgttcctgactattacatgccagttaaaaattgggcttatgaacgtaataaagatgagtttaaaccagaaataattggtgatgcctttatgaaatggaatcaacctgttattgcatggattgctggtaatgcatcgcacttcactgaagttgctgctaattttaaaccaaattctcaggtggctaaacagattgctgttgtaaatgattctagagaacctgttacggttaaatataattggaatgttcctggcttggaactaaaaggttctggctcgctgactgtggcggttggatctactggatttgatccttttaatttcatcgttcctgataatgcatatggtcaatataaaattgttgcaaattttgatataaatggaaaacagtctgattattcttttgattttaatgttattaaagaagattcaaaattgaaattaaaatcaaaagttgctctttatgatccagaaggtgacaccattgttgaactgaagaaacacggtgttaaatttgatattgtgaaagcttcggatgatttaagcaaatttgatatacttgttgtaggtagaaatgccttaggtggtgaagaagctattacagatatcaaacgtgtaaacgagggcttgaatgttgtggtctttgctcaaaaaagtgaaatcttgcaagataaacttggcttcagaatttatgaacatggcttaagaagagtatatgtcagagataaattctcg

SEQ ID NO: 8188 - protein, 287 aa, Unknown
  Obtained from environmental sample
  misc_feature (1)..(287): Xaa is any amino acid
MAEGLGYTAILPWDQERIEEQAKKIKMPVENINKYKNLKYPGIVPDYYMPVKNWAYERNKDEFKPEIIGDAFMKWNQPVIAWIAGNASHFTEVAANFKPNSQVAKQIAVVNDSREPVTVKYNWNVPGLELKGSGSLTVAVGSTGFDPFNFIVPDNAYGQYKIVANFDINGKQSDYSFDFNVIKEDSKLKLKSKVALYDPEGDTIVELKKHGVKFDIVKASDDLSKFDILVVGRNALGGEEAITDIKRVNEGLNVVVFAQKSEILQDKLGFRIYEHGLRRVYVRDKFS

SEQ ID NO: 8189 - DNA, 348 bp, Unknown
  Obtained from environmental sample
  misc_feature (1)..(348): n is a, c, g, or t
ttggcaacactccgaaacgctttccctgtttctcgcaggctttctaatcccgtatcttgggcgaaagccgtattcactgtcgatattccactcaaaccgactgctaccaaggcaacagttaaaaataaccacttaaacatgctcatgatcgactcctctaagatatatttttttattttctccggagaaggtcatctgaaccagctcgatcatatcatccaggtcaaaaggtttatcaattgttgctatcgcaccaaagcgtctggcagtggaatgagtttcttcatcaccaaatgcggtcatacagataaagggtgggcaaaatggattgtcaaattgactttctaa

SEQ ID NO: 8190 - protein, 115 aa, Unknown
  Obtained from environmental sample
  misc_feature (1)..(115): Xaa is any amino acid
MATLRNAFPVSRRLSNPVSWAKAVFTVDIPLKPTATKATVKNNHLNMLMIDSSKIYFFIFSGEGHLNQLDHIIQVKRFINCCYRTKASGSGMSFFITKCGHTDKGWAKWIVKLTF

SEQ ID NO: 8191 - DNA, 423 bp, Unknown
  Obtained from environmental sample
  misc_feature (1)..(423): n is a, c, g, or t
atgtatcataaactcgatggtcaaatagctaatgctatgatggggttaaatgctgtaaaagctgtagagataggtgatggtatggagtctagtagatctaaaggtagtttaaataatgatcaaatcagatctcaaggatttcaaactaatcatagtgggggaatattaggggggattagtaatggtgatgagattattacaaaagtttatttcaaacctacaccttcaatttttactgaacaaaaaactgttgatgtaaataatattgaccaagtctacaacttaaaagggagacatgatccatgtgttgcattaagaggtagtgtggtttgtgaatcaatgatgagtttaattttagcagatatggtattacttaatatgaatagtaatataaaaaacataaaaaaagtttattctaaatag

SEQ ID NO: 8192 - protein, 140 aa, Unknown
  Obtained from environmental sample
  DOMAIN (2)...(127): Chorismate synthase
  misc_feature (1)..(140): Xaa is any amino acid
MYHKLDGQIANAMMGLNAVKAVEIGDGMESSRSKGSLNNDQIRSQGFQTNHSGGILGGISNGDEIITKVYFKPTPSIFTEQKTVDVNNIDQVYNLKGRHDPCVALRGSVVCESMMSLILADMVLLNMNSNIKNIKKVYSK

SEQ ID NO: 8193 - DNA, 357 bp, Unknown
  Obtained from environmental sample
  misc_feature (1)..(357): n is a, c, g, or t
atgataattagagctgaggattatactcgcgatatgtataatacagttgatcaggttatcagaaaactagaaaaacaagtaataagtcaaaaaactaaattagagtcaagacttaaaaagggtgcatttaaagaatcagataagtaccctgacattgaagaagctaaggcacaggaagttgtgaaaagaaaaagcttccctatagttcctatgagcgtagatgaagcaattatgcaaatgaatttactagcacactcattctacgtattcgttaacgcagaaactgataaggctaatgtaatatacattagagtggatggacaaataggattgctagagccagaatataataagtag

SEQ ID NO: 8194 - protein, 118 aa, Unknown
  Obtained from environmental sample
  misc_feature (1)..(118): Xaa is any amino acid
MIIRAEDYTRDMYNTVDQVIRKLEKQVISQKTKLESRLKKGAFKESDKYPDIEEAKAQEVVKRKSFPIVPMSVDEAIMQMNLLAHSFYVFVNAETDKANVIYIRVDGQIGLLEPEYNK

SEQ ID NO: 8195 - DNA, 675 bp, Unknown
  Obtained from environmental sample
  misc_feature (1)..(675): n is a, c, g, or t
atgctggataaacttgatgattctttttcaaaaataaaaagattttcaaatgatgtttcccatgagttaaaaacacctcttacaattataagaggagaaatagagttaggtttgagaaaagatagaacaaatgaagaatataaaaatatactcaaaagtacattagaggagacaaagtctttacaagagcttataaatagtttgctttttttatcaaaatcaaataataaagagatagaacatcagtttacagatgttgagttagacgatattattacagaagttatagcccaaaataaaaaactgattgagacaaaaaatattaagttttattttcatgattttgaaaatatcatcgtacaaggacatccattattattaaaaatattaattggaaatattattcaaaactctttaaaatattcccataaaaactctatcattgatatttcacttacagcgacacaacttgtcatcaaagattatgggatagggataaaagaagaagatttaaaaaatatttttgataggttttataggattgatgatgcaagaagtggaagtggctatggtcttggattatcaatagtaaaatcaattgccaatattcataaatttacattagaagtaaaaagtaaatatgaagaatttacccagtttactattaaattttaa

SEQ ID NO: 8196 - protein, 224 aa, Unknown
  Obtained from environmental sample
  DOMAIN (11)...(77): His Kinase A (phosphoacceptor) domain
  misc_feature (1)..(224): Xaa is any amino acid
MLDKLDDSFSKIKRFSNDVSHELKTPLTIIRGEIELGLRKDRTNEEYKNILKSTLEETKSLQELINSLLFLSKSNNKEIEHQFTDVELDDIITEVIAQNKKLIETKNIKFYFHDFENIIVQGHPLLLKILIGNIIQNSLKYSHKNSIIDISLTATQLVIKDYGIGIKEEDLKNIFDRFYRIDDARSGSGYGLGLSIVKSIANIHKFTLEVKSKYEEFTQFTIKF

SEQ ID NO: 8197 - DNA, 558 bp, Unknown
  Obtained from environmental sample
  misc_feature (1)..(558): n is a, c, g, or t
ttgaattcgttggctgaaaaagatctcatcacccaaatagaagatggtcagctggtattggggtataaaggtgaaaaactcgttgaacattatactttttatacagctttcaatacacccgaggaatacaggcttgaattcaacggaaaggctattggaactgtccccatagataaaccgctgatccaaggacaacatatcatttttgcaggtaaacgttgggaggttgtttatgttgatgataaacataaattgattacgcttaagaaagcaaaaggtggaactccaccccaatttagcggtgatggcctcaatatacacgatattgtaagacaggaaatgaaacgaatttacagtaaaaagcaaacacctgtttatctgaatgaaccggcaatgtttgcccttaaagaaggattcgataattaccactcattaaatcttgattccaggcaaataatccaaatagaaaatatggtccacatctttccatggctgggtgaccaagtgacgaatacgattacggttcttcttcagatgcatagcctggcggctgattga

SEQ ID NO: 8198 - protein, 185 aa, Unknown
  Obtained from environmental sample
  misc_feature (1)..(185): Xaa is any amino acid
MNSLAEKDLITQIEDGQLVLGYKGEKLVEHYTFYTAFNTPEEYRLEFNGKAIGTVPIDKPLIQGQHIIFAGKRWEVVYVDDKHKLITLKKAKGGTPPQFSGDGLNIHDIVRQEMKRIYSKKQTPVYLNEPAMFALKEGFDNYHSLNLDSRQIIQIENMVHIFPWLGDQVTNTITVLLQMHSLAAD

SEQ ID NO: 8199 - DNA, 546 bp, Unknown
  Obtained from environmental sample
  misc_feature (1)..(546): n is a, c, g, or t
ttgtattttgatgagacgaataaacccttgtcgctattagaagcgtgtaaaatggttggtaacaatagttttaaaaactgtttagtactaaactctatctctaaaagaagtagtgcaccagggcttagaagtggttttatagcaggggataaagagatattacaagagtatatgaaatatagaacttatgtaggatgtgcattacctttaccattacaaaaaactgccacagttgcttggaacgatgaaaaacatgtggaagaatttcgaaagctttataaagaaaattttgaaattgcaagtgatatattaggtattagtgcaccagaagccaccttttatatttggcttgaagttgaagatgaattgaaatttacaaaagagctttatgaagctaaaaatatcaaagtattaccaggaagttttcttggacgaaatggaatagggaaaaattttgtgcgaattgcacttgttgaaagcccacaaaaaactaaagaagtgctaacaagattaaaagagttcattactttatataaagtacaataa

SEQ ID NO: 8200 - protein, 181 aa, Unknown
  Obtained from environmental sample
  misc_feature (1)..(181): Xaa is any amino acid
MYFDETNKPLSLLEACKMVGNNSFKNCLVLNSISKRSSAPGLRSGFIAGDKEILQEYMKYRTYVGCALPLPLQKTATVAWNDEKHVEEFRKLYKENFEIASDILGISAPEATFYIWLEVEDELKFTKELYEAKNIKVLPGSFLGRNGIGKNFVRIALVESPQKTKEVLTRLKEFITLYKVQ

SEQ ID NO: 8201 - DNA, 870 bp, Unknown
  Obtained from environmental sample
  misc_feature (1)..(870): n is a, c, g, or t
atggttaatggaattatggatcaaagagatttttttttacaacatattgaaaatcttgaaaatataaatgagttatggattgcaagatctccaactgtaatcaaacaatttggagagggatttaataacgaaacgccaagagatgatatagataaagatgtgctcaaatcaggaataatgatctctgatgtaacagagatgtctaccaaaagtttaatgagagttacaatcccttttatagcttcagaatttggtaatccaaactgtttacagtgtcacagtgccaaagagggtgaagtacttggtgtagttagtatggtaattgatataactgatatccgtatgggaagttttaagacagttatgtacaatatgggtttaacaattattactattattttaatatttatgattattaacagatttataaagccttatgtaagtatattttactcaatcaaagatgtgatgatgaatgcatatcgtggaaactactctgtacgtgtagatggatataataatcctgagagccaatcagttgcagatcttctaaatactatgctcgagaaacttcaacatacctttgaggaactagataaaaaagtatatattttcataaaaaataaaaactacgtaaaagagcctgatccactaaaaaatattaatacaacaatagagcgcttgtctgatatatataaattcaaacagacaatagagaatgataaagagttagaagatatatatctaagaattgcctatgttctaaaaaatcattttaaattagatgattttaccttagccgagatagacaacgcaagtaaaataaagaaaattgtcactcggagaagggtgccactctcagccatctga

SEQ ID NO: 8202 - protein, 289 aa, Unknown
  Obtained from environmental sample
  misc_feature (1)..(289): Xaa is any amino acid
MVNGIMDQRDFFLQHIENLENINELWIARSPTVIKQFGEGFNNETPRDDIDKDVLKSGIMISDVTEMSTKSLMRVTIPFIASEFGNPNCLQCHSAKEGEVLGVVSMVIDITDIRMGSFKTVMYNMGLTIITIILIFMIINRFIKPYVSIFYSIKDVMMNAYRGNYSVRVDGYNNPESQSVADLLNTMLEKLQHTFEELDKKVYIFIKNKNYVKEPDPLKNINTTIERLSDIYKFKQTIENDKELEDIYLRIAYVLKNHFKLDDFTLAEIDNASKIKKIVTRRRVPLSAI

SEQ ID NO: 8203 - DNA, 393 bp, Unknown
  Obtained from environmental sample
  misc_feature (1)..(393): n is a, c, g, or t
ttgattctttttgaaacctttgaaggttacaccaaagctcgctgggatctgggtaaatcccatgcttaccgtctgatccaagcttatcaggttgttaataatttatccccaattggggacattttgcctgaaaatgaataccaggtgcgtcccctgataaaattagatccctttgaacagcgtagagcctggaaaacatttttaaaaagcgggatggaaatcacagcgcctaacatcaaaaaattcatcactggatgcaaaacgttcgctacaggaaaacctgttgaagagttaaccgatcaaattttaatttcaagttttgcattcattccagaatctctcaactccatttttaatattcccaaaagttcaaatacacttcttgttggataa

SEQ ID NO: 8204 - protein, 130 aa, Unknown
  Obtained from environmental sample
  misc_feature (1)..(130): Xaa is any amino acid
MILFETFEGYTKARWDLGKSHAYRLIQAYQVVNNLSPIGDILPENEYQVRPLIKLDPFEQRRAWKTFLKSGMEITAPNIKKFITGCKTFATGKPVEELTDQILISSFAFIPESLNSIFNIPKSSNTLLVG

SEQ ID NO: 8205 - DNA, 753 bp, Unknown
  Obtained from environmental sample
  misc_feature (1)..(753): n is a, c, g, or t
atgactaaaggcggttttaaactactctttcttttagttgcactcttaatgggtgcactatacttcaataaatctatacaagcaccgtttcttacagtgataagtcaaataaaaacaaactatttgtatgcattagagtttatagatgatactattacagaacatatatatcaaaaaaataccattattgaattaactaaaaaacttgaaaaatataaaaatcaacatcttatctctcatcaactctcatcagagattaatgatctgtatgcattagaaaaatcaaaactaacatcaaagccaaaagtcgaacttacacgtgtgatctcttatgcaaaatttggtgatcacaataaattctggctagaagtagatgattataacagctctaaaatttatggtttaatctttaatggtctctctgccggcattgtgatagagaaaaatgacaaacctctggcacttttaaactctgatcctaaaaattcatactctgtttacgtgggagaagatttagctcctggaatcgtgaaaggattaaatactaatatgttgagtgttgaattcattcccgcatggataaagataaaagtcggtgatgaagttattacatctggactggacaacctctttttcaagggattaaaggttggtaaagttatatctgtagataagtatcaaggctatcaacacgccatagtagacccatatttcaaatctattaagacaaaattctttcatattataaaagag

SEQ ID NO: 8206 - protein, 251 aa, Unknown
  Obtained from environmental sample
  DOMAIN (106)...(245): rod shape-determining protein MreC
  misc_feature (1)..(251): Xaa is any amino acid
MTKGGFKLLFLLVALLMGALYFNKSIQAPFLTVISQIKTNYLYALEFIDDTITEHIYQKNTIIELTKKLEKYKNQHLISHQLSSEINDLYALEKSKLTSKPKVELTRVISYAKFGDHNKFWLEVDDYNSSKIYGLIFNGLSAGIVIEKNDKPLALLNSDPKNSYSVYVGEDLAPGIVKGLNTNMLSVEFIPAWIKIKVGDEVITSGLDNLFFKGLKVGKVISVDKYQGYQHAIVDPYFKSIKTKFFHIIKE

SEQ ID NO: 8207 - DNA, 684 bp, Unknown
  Obtained from environmental sample
  misc_feature (1)..(684): n is a, c, g, or t
ttggcaggctctgtattggcttttcagctgatggaagaaggtaaaaaaattgtggtaatagatgaaaatcatcctcaaacttcttctaaagttgctgcgggcttgtgtaatccagtagtgtttaaaagacttaccaaaagttggttggtagagagtgttttgccaattgctgtaaatttttacagaaatcaggagcaattgcttagcaatagtttttaccaagaaatgcctatttataagctttttgtggatgaaaaagaaagctctttttggaaacaaaaaagcaatgaacccgaattattcgattggataagtgataaaaatgaaaaaccttttgacgaaaattttattaccacaccttttggggcttcaaaagtacttcaatcgggttttttacgaaccaaaaaatggttagaagcttttcaaaaatacctcattaaaaacaatgcttttattgaaagtaaatttaattatgctgatgtaaaaattgaagaaaacattgtttattggaataattttaaagctaaaggtattatcttttgcgaaggctataaaaatagcttcaacccttattttaaacacttgccgtttaaacttaccaaaggcgaagtgctaagtgtagattttgaaaacgccactttagatgttactattaataaagggtgtttttgtattaccttatga

SEQ ID NO: 8208 - protein, 227 aa, Unknown
  Obtained from environmental sample
  misc_feature (1)..(227): Xaa is any amino acid
MAGSVLAFQLMEEGKKIVVIDENHPQTSSKVAAGLCNPVVFKRLTKSWLVESVLPIAVNFYRNQEQLLSNSFYQEMPIYKLFVDEKESSFWKQKSNEPELFDWISDKNEKPFDENFITTPFGASKVLQSGFLRTKKWLEAFQKYLIKNNAFIESKFNYADVKIEENIVYWNNFKAKGIIFCEGYKNSFNPYFKHLPFKLTKGEVLSVDFENATLDVTINKGCFCITL

SEQ ID NO: 8209 - DNA, 318 bp, Unknown
  Obtained from environmental sample
  misc_feature (1)..(318): n is a, c, g, or t
ttgtttccaaaaagagctttctttttcatccacaaaaagcttataaataggcatttcttggtaaaaactattgctaagcaattgctcctgatttctgtaaaaatttacagcaattggcaaaacactctctaccaaccaacttttggtaagtcttttaaacactactggattacacaagcccgcagcaactttagaagaagtttgaggatgattttcatctattaccacaatttttttaccttcttccatcagctgaaaagccaatacagagcctgccaacccctgtccaactatgaagtaatcaatatcccttcataa

SEQ ID NO: 8210 - protein, 105 aa, Unknown
  Obtained from environmental sample
  misc_feature (1)..(105): Xaa is any amino acid
MFPKRAFFFIHKKLINRHFLVKTIAKQLLLISVKIYSNWQNTLYQPTFGKSFKHYWITQARSNFRRSLRMIFIYYHNFFTFFHQLKSQYRACQPLSNYEVINIPS

SEQ ID NO: 8211 - DNA, 756 bp, Unknown
  Obtained from environmental sample
  misc_feature (1)..(756): n is a, c, g, or t
atgagaaggttttatttagaatatcctgatgtccagacactgtctggacaattgacttggtctcatatctgtgaacttttgattatcgaagatgttaaaaaaagaggattttatgaaaaagagtcgattaattccgcatggtctatccgtgaattaaaacgacaaattgatagtttactttatgaaaggctgttactatcaaaagggaaaacgaacaaagagcagctaatcgaactttcaagaaaagggcaacaaatatcgaagcccgaagatattgtaaagaatccatatgtatttgaatttcttggagtaccagaacataaaccaattttagaaaaagatttagagaaaaaattaatcagacatattgaagattttctactggaattgggtagaggatttatgtttgtcgggtcacaacaacggattaccataaataatacgcattattatgtagatatggtgttttacaacaaaatcctacgggcttatattctgatcgaattaaaaacaacaaaactaaaaatcaatgatgccggacagcttaacacttatctgaattattataaaacagagattaatgacaaaggcgacaatcctccggttggaataatactatgtgcagaaaaggacgaaattgcagcagagtatattctagggggcttagagaataatgtttttgcttcnaaattcacatacgtactacctgataaagaagaattaattagagaacttgaaattgtgataaaagaataa

SEQ ID NO: 8212 - protein, 251 aa, Unknown
  Obtained from environmental sample
  DOMAIN (1)...(248): Protein of unknown function (DUF1016)
  misc_feature (1)..(251): Xaa is any amino acid
MRRFYLEYPDVQTLSGQLTWSHICELLIIEDVKKRGFYEKESINSAWSIRELKRQIDSLLYERLLLSKGKTNKEQLIELSRKGQQISKPEDIVKNPYVFEFLGVPEHKPILEKDLEKKLIRHIEDFLLELGRGFMFVGSQQRITINNTHYYVDMVFYNKILRAYILIELKTTKLKINDAGQLNTYLNYYKTEINDKGDNPPVGIILCAEKDEIAAEYILGGLENNVFASKFTYVLPDKEELIRELEIVIKE

SEQ ID NO: 8213 - DNA, 546 bp, Unknown
  Obtained from environmental sample
  misc_feature (1)..(546): n is a, c, g, or t
atgggagaggaagctggaatacttaaagaaaaagagttacatattatagaaaatatttttgaacttcgagatataaaagtaaaagatatctacacacctagaaatgttatgttcactatctctgaagatattttgttagagagtttaactaaaagtgataaaacagttatagaacttgaaaagatgaaagaatactcaagaatacccatatttaaaaaagatattgatgagattgttgggattgttttttcaaaagagtatttttatgaatttatagaaaatagattagaaaacaaacaagatattataaaatcagtatttaaagtacataagaatatccctatttctaaacttctagatctttttatctcaagaaaagagcatctatttattgtagttgataactatgaccaaacagcagggatagtaactcttgaagatgctatagaaactcttttaggtttggagattgttgatgaatttgacaataattctaatatgagagagttagcaaaaagcttaaagtttttaaaaaacaatatttaa

SEQ ID NO: 8214 - protein, 181 aa, Unknown
  Obtained from environmental sample
  DOMAIN (100)...(153): CBS domain
  misc_feature (1)..(181): Xaa is any amino acid
MGEEAGILKEKELHIIENIFELRDIKVKDIYTPRNVMFTISEDILLESLTKSDKTVIELEKMKEYSRIPIFKKDIDEIVGIVFSKEYFYEFIENRLENKQDIIKSVFKVHKNIPISKLLDLFISRKEHLFIVVDNYDQTAGIVTLEDAIETLLGLEIVDEFDNNSNMRELAKSLKFLKNNI

SEQ ID NO: 8215 - DNA, 378 bp, Unknown
  Obtained from environmental sample
  misc_feature (1)..(378): n is a, c, g, or t
atgaaaatagagtttcgaaagataccattaaattcaagtgaatttgaaatagattcaaattcagtgaagtttttaggaactttctgtaaaatatcatcaaaacttgctaaaattgagggagatatcaaaggaacattagatgttgattgctgtaaatgtggtcaatcatttaatatatctttagatgaaacaataaaatttttagttagtgatggtgtatactctagtgaagatgaagagaatgtagtaatagaagttgaaaatcatacattggattttaatgaagtactacaaagtgaattagagtcactaaaatcagagtattatatttgtgatacttgtaaaaaaaataacgactatgtcgaaatagaatattaa

SEQ ID NO: 8216 - protein, 125 aa, Unknown
  Obtained from environmental sample
  misc_feature (1)..(125): Xaa is any amino acid
MKIEFRKIPLNSSEFEIDSNSVKFLGTFCKISSKLAKIEGDIKGTLDVDCCKCGQSFNISLDETIKFLVSDGVYSSEDEENVVIEVENHTLDFNEVLQSELESLKSEYYICDTCKKNNDYVEIEY

SEQ ID NO: 8217 - DNA, 309 bp, Unknown
  Obtained from environmental sample
  misc_feature (1)..(309): n is a, c, g, or t
atttctccaaatccacctacaaatatagagaaatccagaattggaactcaaataaatattgcttgggatgaaccaaatgagaattcaaatgttacaatttattacaatgtctatatttgtaaaaataaaaaagagattaaaaaaataaatgcagaaaataaatacaaaactgtaactcacaattatattagatttgatagaagacgaaaatggcaaattctgggtaaaaaatacacatttgtaattacggcagtagataaatctgcaaatgaaagtctaccaagcgaacctgtacatataaaattgtaa

SEQ ID NO: 8218 - protein, 102 aa, Unknown
  Obtained from environmental sample
  misc_feature (1)..(102): Xaa is any amino acid
MSPNPPTNIEKSRIGTQINIAWDEPNENSNVTIYYNVYICKNKKEIKKINAENKYKTVTHNYIRFDRRRKWQILGKKYTFVITAVDKSANESLPSEPVHIKL

SEQ ID NO: 8219 - DNA, 486 bp, Unknown
  Obtained from environmental sample
  misc_feature (1)..(486): n is a, c, g, or t
atgatattgaaaatgaaaaaaatttggatgcttataatggcagtgattgttttgagttcttgtgatcaaaagaaaaaagatacaccggataaaaaacaagaaaagaaaccagaatacacggaattacaaataaaatccaaaactttttttggcgaattaccattagtagccgaaaatgcaaataatccgataacggaagaaaaagtagctttgggaaaaatattatattttgatactattttatccaaaaacaaaacacaaagctgcaatacttgtcataatttagatacttatggtgttgataatttacccacttcccctggagatggtaaaggaactataggaaccagaaactcgcctacagttctaaatgcagcactccatattgctcaattctgggatggcagagaaccagatgtggaagcacaggcgggtgggccagttctaaatcctgtgaaatgggaatggctagtgaaaaagaagtaa

SEQ ID NO: 8220 - protein, 161 aa, Unknown
  Obtained from environmental sample
  DOMAIN (46)...(161): Di-haem cytochrome c peroxidase
  misc_feature (1)..(161): Xaa is any amino acid
MILKMKKIWMLIMAVIVLSSCDQKKKDTPDKKQEKKPEYTELQIKSKTFFGELPLVAENANNPITEEKVALGKILYFDTILSKNKTQSCNTCHNLDTYGVDNLPTSPGDGKGTIGTRNSPTVLNAALHIAQFWDGREPDVEAQAGGPVLNPVKWEWLVKKK

SEQ ID NO: 8221 - DNA, 444 bp, Unknown
  Obtained from environmental sample
  misc_feature (1)..(444): n is a, c, g, or t
ttgatcatgttagtagctaaaaatataaaacacttttacggttcagatgagatcttaaaggggataagtttagaggtaaatgagggagaacttttagccattacaggagagagtggaagcggaaaatctacacttttagctactctttcaacactcttaaaacccacatctgctgagataacatttgaagatatttcatatgacaaaatcgaaaacatagataaatttcgcagtgaaaagataggttttatttttcagtttcactacctcatagattatctcaatgtaaaagagaacatagaactagcagccttaaacaagaaaaacaaagagcgatcatcagagcttttgaagatgtttaatatcgaaaacctagcttctcgttacccgagtgaaatatcaggcggaccacgtcaaccggggggcttttgtaaaaagctttga

SEQ ID NO: 8222 - protein, 147 aa, Unknown
  Obtained from environmental sample
  DOMAIN (29)...(142): ABC transporter
  misc_feature (1)..(147): Xaa is any amino acid
MIMLVAKNIKHFYGSDEILKGISLEVNEGELLAITGESGSGKSTLLATLSTLLKPTSAEITFEDISYDKIENIDKFRSEKIGFIFQFHYLIDYLNVKENIELAALNKKNKERSSELLKMFNIENLASRYPSEISGGPRQPGGFCKKL

SEQ ID NO: 8223 - DNA, 348 bp, Unknown
  Obtained from environmental sample
  misc_feature (1)..(348): n is a, c, g, or t
atggataaagaaatacataaaaaaattaaaaaaatccgcaaggaaaaaagctattctcaaacggtaatggcaaataaattaggtattacacaaatggcatattcaaaaattgaacgaggaataactaaattaaattgggattacatgcaccaattagcatctattttagaggtaaatatttgggatttaattgatgtccaaaaagagtatcaaccttctgccgcctatgaagtgcaagcagttgaaaacattgaattattaaaaaaacttatccatcagtatgataaagagttaagttctctaaaagaagaaataacgatgttaaaacaccgtttaacgaattgttaa

SEQ ID NO: 8224 - protein, 115 aa, Unknown
  Obtained from environmental sample
  DOMAIN (9)...(63): Helix-turn-helix
  misc_feature (1)..(115): Xaa is any amino acid
MDKEIHKKIKKIRKEKSYSQTVMANKLGITQMAYSKIERGITKLNWDYMHQLASILEVNIWDLIDVQKEYQPSAAYEVQAVENIELLKKLIHQYDKELSSLKEEITMLKHRLTNC

SEQ ID NO: 8225 - DNA, 342 bp, Unknown
  Obtained from environmental sample
  misc_feature (1)..(342): n is a, c, g, or t
atgggtaatgataaagcattacaagttttccatgatgcacgaattaactttttaaaaaaattaggatacactgaattagatatgggtaatggcatcgctgttattattgtagaagcaaatgttaagtacaaacaagaaatttttctgcatgacattttagaaacagaagtctgggtttctaaaatagacaggctaaaatggacaatttcatacaatacaaaaagaaaaaatgatggtaaaacagttttaacaggttcaactgtaatgttttgttatgattatcatcgtaaaaaaatcaccaaaataccagaagattttttagcaaaagtaagtgatagctag

SEQ ID NO: 8226 - protein, 113 aa, Unknown
  Obtained from environmental sample
  misc_feature (1)..(113): Xaa is any amino acid
MGNDKALQVFHDARINFLKKLGYTELDMGNGIAVIIVEANVKYKQEIFLHDILETEVWVSKIDRLKWTISYNTKRKNDGKTVLTGSTVMFCYDYHRKKITKIPEDFLAKVSDS

SEQ ID NO: 8227 - DNA, 300 bp, Unknown
  Obtained from environmental sample
  misc_feature (1)..(300): n is a, c, g, or t
ttgaccgtattcgtgagaatactcggtttacataagaaattaagcttaaaggtcaatatgaacaatgccttgaatgctacacttcctcgtacaattaacacttctggtactacattggtggtattattaaccatctttatttttggtggtgaaatcattagaggatttacctttgctttattagttggagttatggtaggtacatattcatcattatttacagctagtccgattgcttatgatttattaggtggcgacaaaaagaacctcgttcctgaaaaagcaagcaaaaagaaataa

SEQ ID NO: 8228 - protein, 99 aa, Unknown
  Obtained from environmental sample
  DOMAIN (2)...(85): Protein export membrane protein
  misc_feature (1)..(99): Xaa is any amino acid
MTVFVRILGLHKKLSLKVNMNNALNATLPRTINTSGTTLVVLLTIFIFGGEIIRGFTFALLVGVMVGTYSSLFTASPIAYDLLGGDKKNLVPEKASKKK

SEQ ID NO: 8229 - DNA, 489 bp, Unknown
  Obtained from environmental sample
  misc_feature (1)..(489): n is a, c, g, or t
atgaaaaaaccagtaattacagactacaaggattttatcaaaaattcaaaaatagataattcacaaattgaattagtagatcatgaaataactggattatatgcaaattctccaggtaccgttattaaatcgttccaaaggttgaataacacccctaattttaaaataaaattgggagaaaatggaagagaaaaagtaaagaaaatatataatgtgaaaatttcttcaaaaagcattgcaaaattactctatgattatttaaaaacaaaaaataataagtctaatttaaaatttgagaagttagaaataatcccttcaaaaatagaagttaaaagtttcaaagaagagtatatcaaacgtataagacaatttgaaataattgaaaaaaatgaaagaaaagtaaattacatcttgtggaataaaatagaaataacttatttaataataagaaaaatattaaagctatttagaataaatatagaaaattaa

SEQ ID NO: 8230 - protein, 162 aa, Unknown
  Obtained from environmental sample
  misc_feature (1)..(162): Xaa is any amino acid
MKKPVITDYKDFIKNSKIDNSQIELVDHEITGLYANSPGTVIKSFQRLNNTPNFKIKLGENGREKVKKIYNVKISSKSIAKLLYDYLKTKNNKSNLKFEKLEIIPSKIEVKSFKEEYIKRIRQFEIIEKNERKVNYILWNKIEITYLIIRKILKLFRINIEN

SEQ ID NO: 8231 - DNA, 516 bp, Unknown
  Obtained from environmental sample
  misc_feature (1)..(516): n is a, c, g, or t
atgagttatattaaaaaaactgggaattatacatataaagaatggttaaaaaaagaaaatatacatggggaatttttaccattggtcaaaattgaaatttttaaagaaaataagtttgatgaaaaaagattttgttttgaatcctttttttggaataaaattattaaaacaaatggagtgaaatgttttaataaaaatttaagaatctaccaaatgagcaaagatagcatatctaaagaattaaactcaacatcgaaaatgaaacaaagatatgaagactatcttaattatttaaaatcttttgaaaaagattacagacattataatcttaatcgtgagctttcaaaaatctatttaaaaatggcattttatgcgtggggaataaattacaaaaagaccacattaaatttaataattaaatcacttgaaataaaaatcacatttagagggatcatgttcttggggttgagattatttggtttaagaaaacaaacaataaaatatgtacaaggatga

SEQ ID NO: 8232 - protein, 171 aa, Unknown
  Obtained from environmental sample
  misc_feature (1)..(171): Xaa is any amino acid
MSYIKKTGNYTYKEWLKKENIHGEFLPLVKIEIFKENKFDEKRFCFESFFWNKIIKTNGVKCFNKNLRIYQMSKDSISKELNSTSKMKQRYEDYLNYLKSFEKDYRHYNLNRELSKIYLKMAFYAWGINYKKTTLNLIIKSLEIKITFRGIMFLGLRLFGLRKQTIKYVQG

SEQ ID NO: 8233 - DNA, 744 bp, Unknown
  Obtained from environmental sample
  misc_feature (1)..(744): n is a, c, g, or t
gtgaaaagacctggaagagtttatatcacaaaaaacacaacagatatttctcatgtaattagtaaagtcggaggatttacatctaatgcatcattaaagttttctgaattaattagaaatttagactcatattccactttaaaaaaacaagcaatagaagagaattttgataaaaatgttctaggtatagatgctcagaattttatgtctaatttaaatcaacaagagtacttaaaaatgtatagagctgctaatttaataatggcagatacattattctttagcattgataatgctctccgtggattaaatgggtcttctgaattagattttagatatctttcagataaagactcttatgaaagcaaatatcttgtgacagataaagatgttattattgttcccaaaaaattagacgatatttatctatggggtggagtaagaaaaactggtaactatcaatacaaagaagattcatctatttgggattatataaaccttgctggtggattatcagatattgcatatggggatgatgaaatatatctaatcaagggcaaatctagagattggataaatattgaggacaaagagaatctaattattgaagctggtgattttatttatgtcaaaaaagaagttcctcgagatactggatattatatttatagagtcgcccagtacgcaactatatttggtagtattgcaacagttattttattattaaatcaatttgggaaataa

SEQ ID NO: 8234 - protein, 247 aa, Unknown
  Obtained from environmental sample
  misc_feature (1)..(247): Xaa is any amino acid
MKRPGRVYITKNTTDISHVISKVGGFTSNASLKFSELIRNLDSYSTLKKQAIEENFDKNVLGIDAQNFMSNLNQQEYLKMYRAANLIMADTLFFSIDNALRGLNGSSELDFRYLSDKDSYESKYLVTDKDVIIVPKKLDDIYLWGGVRKTGNYQYKEDSSIWDYINLAGGLSDIAYGDDEIYLIKGKSRDWINIEDKENLIIEAGDFIYVKKEVPRDTGYYIYRVAQYATIFGSIATVILLLNQFGK

SEQ ID NO: 8235 - DNA, 855 bp, Unknown
  Obtained from environmental sample
  misc_feature (1)..(855): n is a, c, g, or t
ttgggtctcgggttgagtatgtttntgatatggatagattacaagaagaatcaactgaatcgtctccatccctttgaattgaattatttgtatgattctttaggaagtatcaaagagatagtaaagtttatggaaaactataactttgtaaaaccaccttgcagtagtgaagatattgagatttttatcaaaactattgaagagacatttgatctttcttgtagtgggaagtttatgttaaaagatattgattctaatatgatagcccgaggaattgatagtaaaatagatgaacttatcaaacaaaatgaacttttagaagagaagcttgatatatttgtagagcatattttaaaatttttaaaaagtgatgataaaaatcttatctctgtaacccgtttagggaaagagggattttttattgggcttacgaaaaatcgttactcttcaatcaagaaagagcttttggaatcacacttaataattgatgatgagttgtatctctttaaagatttttctataaaagtgcaaacttctagtgtcaaaataaccaataaactcacctctacaatctctgatcaatatgtgcataacttacaaaaaatcattgccctaaacaaagtgatatttaaagaaaaaatcgaatattatgagaaaaaatttgcttctatgcttttggagctggtttcatttatagctgaagttgatttaacagtatcaaatataaaaacagcaaaaaaatacaactttgtacaaccaaaaatcatcaaacaagatgaggtgaaaacaaacttcttagaacttatagatttacgacatccaattatcgaatcaactgaagagaatgggatctat

SEQ ID NO: 8236 - protein, 285 aa, Unknown
  Obtained from environmental sample
  misc_feature (1)..(285): Xaa is any amino acid
MGLGLSMFXIWIDYKKNQLNRLHPFELNYLYDSLGSIKEIVKFMENYNFVKPPCSSEDIEIFIKTIEETFDLSCSGKFMLKDIDSNMIARGIDSKIDELIKQNELLEEKLDIFVEHILKFLKSDDKNLISVTRLGKEGFFIGLTKNRYSSIKKELLESHLIIDDELYLFKDFSIKVQTSSVKITNKLTSTISDQYVHNLQKIIALNKVIFKEKIEYYEKKFASMLLELVSFIAEVDLTVSNIKTAKKYNFVQPKIIKQDEVKTNFLELIDLRHPIIESTEENGIY

SEQ ID NO: 8237 - DNA, 768 bp, Unknown
  Obtained from environmental sample
  misc_feature (1)..(768): n is a, c, g, or t
ttggaagtatgggtttattcggaaaaaaatgaaaaatatggtagtgcttccgttaaagatgggcttaacggaaaaattaaccaatttttcaaattggaacatggtagcaagtttacacgattcaatttaatgaaaatgaaaaattttataagattaaggtcagcgataacagtcgatgtggaagatgccgtcagtcttgccatgcgcaatttttttaataaacgtattgaaccgacggagcgcgtattaaaaaatacccgtcagatattaagtatatttagggcctatgatgtaaaagggactttttttatccttggcgaagtcgcggataagtatcccactttggttaaagaaatagacagggccgggcatgaaatcggcgtccatggactttcccatattgagttttttaaaatgacgccgggtaaagcatataatgaaataagcaaagcaaaaaaaatacttgaagatattatcggcaaacaagttttcgggcatcgtgcaccggccttttctattaaccgggacacgtcctgggcctttgatgttattgcggatgcgggttttagctatgacagcagtgtaatgcctgttaacgcacttcgttacggatgggggaaatttaataaagacattcactgtatggatttaggaaaaggaaagaagctgttagaagtccctctgtccacgtataanattttaggaagggaaatgccggtatgcggcggtggatacttcaggctctttccatattttgtcacaggatat

SEQ ID NO: 8238 - protein, 256 aa, Unknown
  Obtained from environmental sample
  DOMAIN (47)...(192): Polysaccharide deacetylase
  misc_feature (1)..(256): Xaa is any amino acid
MEVWVYSEKNEKYGSASVKDGLNGKINQFFKLEHGSKFTRFNLMKMKNFIRLRSAITVDVEDAVSLAMRNFFNKRIEPTERVLKNTRQILSIFRAYDVKGTFFILGEVADKYPTLVKEIDRAGHEIGVHGLSHIEFFKMTPGKAYNEISKAKKILEDIIGKQVFGHRAPAFSINRDTSWAFDVIADAGFSYDSSVMPVNALRYGWGKFNKDIHCMDLGKGKKLLEVPLSTYXILGREMPVCGGGYFRLFPYFVTGY

SEQ ID NO: 8239 - DNA, 303 bp, Unknown
  Obtained from environmental sample
  misc_feature (1)..(303): n is a, c, g, or t
ttgttaagtaatgtttctgtaagtgaattttttatttcccgccacaaaagattaattaatttgtgtttagcaaaatgccttgaatatactaaacttacctctctcaatggttttacatcgctaaacgacaagacgttagcccgtctttgttcgtacattgtatcttttgccaattcaggaattaaagtaatgcctccttctttgtcaacaatattcataagcgtttctaaggacccagcttcgaaatggaatgaatgtttggtgtttgttgtccccatatatgagcacaaatttacaacctga

SEQ ID NO: 8240 - protein, 100 aa, Unknown
  Obtained from environmental sample
  misc_feature (1)..(100): Xaa is any amino acid
MLSNVSVSEFFISRHKRLINLCLAKCLEYTKLTSLNGFTSLNDKTLARLCSYIVSFANSGIKVMPPSLSTIFISVSKDPASKWNECLVFVVPIYEHKFTT

SEQ ID NO: 8241 - DNA, 906 bp, Unknown
  Obtained from environmental sample
  misc_feature (1)..(906): n is a, c, g, or t
gtgaagggaaaaattgttattgtactaaatggtgacccaaaaaataaaactgaacgctactgggtttctaatactgacactccttctaaatggagtaacagaagaaataaccctaaattggctacagcaaaagaaaaaggtgctttggcattgcttattatcaatgaaaatacaactgaaatgattaaaacttacaagcactttattgaaagcgaaaaacttaaagtacttgataaacctgaggtagattacgattttcccaatttttacatttcttccgaaatggctgatgaaatcattgcaaaatcatcacaaaaaattaaagaaaaaataaatagcaaaggtgttcctgaaagttttaccattaaaaataagctaagcctagacatcaacaaaaaaacaacaattactgatgctcataatgtattggcctatattgagggaagcgatttaaaagatgaattgataattttaagtgcccattacgatcatattggcgaacatgatagcttaatttttaatggtgctgatgatgatggttctggaactgttgcgattatggaaattgccgaagcttttatcaaagctaaaaaagatggtaatggaccaagaagaagtattttagtactgaatgtttctggagaagaaaaaggattattaggctctaaatattatacagaatatcctgtttttcctttaaaaaataccgttgccaaccttaatattgatatgataggaagattggatgaaaaacacgctgataacgaaaattacatctacattattggctccaatatgcttagtgatgatttgcatgaaataaatgaaaatgcgaactccacttatactcagttggagttagattatgaatttaacaccacaaaagatccctcagccgaattctga

SEQ ID NO: 8242 - protein, 301 aa, Unknown
  Obtained from environmental sample
  DOMAIN (154)...(227): Peptidase family M20/M25/M40
  misc_feature (1)..(301): Xaa is any amino acid
MKGKIVIVLNGDPKNKTERYWVSNTDTPSKWSNRRNNPKLATAKEKGALALLIINENTTEMIKTYKHFIESEKLKVLDKPEVDYDFPNFYISSEMADEIIAKSSQKIKEKINSKGVPESFTIKNKLSLDINKKTTITDAHNVLAYIEGSDLKDELIILSAHYDHIGEHDSLIFNGADDDGSGTVAIMEIAEAFIKAKKDGNGPRRSILVLNVSGEEKGLLGSKYYTEYPVFPLKNTVANLNIDMIGRLDEKHADNENYIYIIGSNMLSDDLHEINENANSTYTQLELDYEFNTTKDPSAEF

SEQ ID NO: 8243 - DNA, 384 bp, Unknown
  Obtained from environmental sample
  misc_feature (1)..(384): n is a, c, g, or t
atgagtcacattaatacaaaccaaaatcataaaatagaaacgccacatgagaaacaaaatagacataaagctatggaagcaattaaggtaatcaatactttaaaagaggaatttaaatctcccattaaatctatggattatttttatagattgtttgaagatgtatattgtcaccaaaagtcactccatgatgataaggtaaaagtgggaactatgtgtattcaaatacccaatgaaatcatctatgctcttgatgctgtacctattcgactttgtaatggtttttatactgatgatgagattggaagtgaccttatgccctcaaaatcttgtcctcttgtaaaagctagntgttggacacttatcaagtcaaaacttaagtga

SEQ ID NO: 8244 - protein, 127 aa, Unknown
  Obtained from environmental sample
  misc_feature (1)..(127): Xaa is any amino acid
MSHINTNQNHKIETPHEKQNRHKAMEAIKVINTLKEEFKSPIKSMDYFYRLFEDVYCHQKSLHDDKVKVGTMCIQIPNEIIYALDAVPIRLCNGFYTDDEIGSDLMPSKSCPLVKAXCWTLIKSKLK

SEQ ID NO: 8245 - DNA, 546 bp, Unknown
  Obtained from environmental sample
  misc_feature (1)..(546): n is a, c, g, or t
ttgggggacaggctcagacctatggagattaaaaagtattccaaactacggttgatgaattttttgaaattaagagatgaaatagcaggtaccccagaaggtggagctgcaatatttgttattgcagtgaaaatatttaatgagaatcctgatttaggtgctcaatgtttggtgatagcaacagatcgaaatagacttcaaagtggtacagtttacaaaggttttcagctaatgagaagtgattttgacagaatgaaacgtcagttgtcacaatatccttttatccctaattcatacttcaaaggggcgacaccagaaaatggttataaatttgatttcccaactcaaatgaatttttcgtcaaatgcttatagtggtaataaatctgcaggaacattcaaagtttttgttcaatgttatggtgccgatagtcctcgaccaattactttagttcgtaataacaagggtttttggaaagcaaaagaatggagtagtattattatgggtatgaaaaaaccagtagtagaaattgatgacgatctttag

SEQ ID NO: 8246 - protein, 181 aa, Unknown
  Obtained from environmental sample
  misc_feature (1)..(181): Xaa is any amino acid
MGDRLRPMEIKKYSKLRLMNFLKLRDEIAGTPEGGAAIFVIAVKIFNENPDLGAQCLVIATDRNRLQSGTVYKGFQLMRSDFDRMKRQLSQYPFIPNSYFKGATPENGYKFDFPTQMNFSSNAYSGNKSAGTFKVFVQCYGADSPRPITLVRNNKGFWKAKEWSSIIMGMKKPVVEIDDDL

SEQ ID NO: 8247 - DNA, 570 bp, Unknown
  Obtained from environmental sample
  misc_feature (1)..(570): n is a, c, g, or t
atgagaatatccatattattggcagtagtaagttcaatcatatttgcacaagagtactcagttcaggtaatggcacttaaagatgaaaaaaatgtgacgccagatttactgatgaaggtagaaaagtttggtaagtgtcagattatacatgaagatggttacacaaaagtaagggtaggtggatttgatgattatttaaaagtatcttcaaaacttttagagataaaaaattcttttacttgtgatgcatttctagttaaagaaaaagttgattgtaaagatcagaaaatgactatggctaaagctgatgtagaaaaagatgtaaagagtttacctaaagaagttgcattaaaagagagtatttctgaatctaataatactatgaagacaacagaggtatttatggacacttctagaaataatataatgatgagcagtacaaaaatagttataaaagagagtccaaaaataacaaaaaaagagtcaaaaaaactacgtcgtaaatctgaactcgcagaagccatggctttttatgcaaactcagattactacaattttgctgggtattag

SEQ ID NO: 8248 - protein, 189 aa, Unknown
  Obtained from environmental sample
  SIGNAL (1)...(16)
  misc_feature (1)..(189): Xaa is any amino acid
MRISILLAVVSSIIFAQEYSVQVMALKDEKNVTPDLLMKVEKFGKCQIIHEDGYTKVRVGGFDDYLKVSSKLLEIKNSFTCDAFLVKEKVDCKDQKMTMAKADVEKDVKSLPKEVALKESISESNNTMKTTEVFMDTSRNNIMMSSTKIVIKESPKITKKESKKLRRKSELAEAMAFYANSDYYNFAGY

SEQ ID NO: 8249 - DNA, 720 bp, Unknown
  Obtained from environmental sample
  misc_feature (1)..(720): n is a, c, g, or t
gtgagtagttataaagagtattttaaaagacttaatgatggatctttaactatgcttgatccaactccaaagtggggagtgttgaaaagtagcactactatagccataggaaacagtgttagtgatgctaatgttattcatgacattaaagagcacacaatggagtcaattttaaatgctgaatctattgaaaagtatgttgcacttgacgaaaaagatatatttgatatggagtattgggagttagaacaagcaaaactgaaaaaatcaagttcaaaaccggagtttgaaggaaaaattgtatttgttaccggtggagccagcagtatagggaaagattgtgtagaaaactttgtatctaaaggtgcagcagttgtagcacttgatatagattcaaatattcagagtatgtataaaaaggctcaaatattaggaattaaatgtgatcttacaaatgaaattgaaattgatgaagctattaaaaaagcagtgtttacttttggtggtgtagatgttcttataaatagtactataaactccttaagtgctgagagtgaactgttttttgagaaaatagctacgtacctaaatttaggtttttcccctgcagttgtaaatatttttgaaaatgagaatgaaaacatagattatgtttttgatgaaaatataagagtaaacactattgttacttcatattatacccatgaaaagaatataaca

SEQ ID NO: 8250 - protein, 240 aa, Unknown
  Obtained from environmental sample
  misc_feature (1)..(240): Xaa is any amino acid
MSSYKEYFKRLNDGSLTMLDPTPKWGVLKSSTTIAIGNSVSDANVIHDIKEHTMESILNAESIEKYVALDEKDIFDMEYWELEQAKLKKSSSKPEFEGKIVFVTGGASSIGKDCVENFVSKGAAVVALDIDSNIQSMYKKAQILGIKCDLTNEIEIDEAIKKAVFTFGGVDVLINSTINSLSAESELFFEKIATYLNLGFSPAVVNIFENENENIDYVFDENIRVNTIVTSYYTHEKNIT

SEQ ID NO: 8251 - DNA, 342 bp, Unknown
  Obtained from environmental sample
  misc_feature (1)..(342): n is a, c, g, or t
atgcatgaatatagtattgtacaatcattaattgatagttgcgaagaaaatgcaaaagcaaatgatgctacaaaagttacaaaagtaattgtcaaaataggtgttatgagtggagttgaacctgacctacttcaaacagcttttgatacttttaaagaagaaacaatttgtcataatgctcaatttgttatcaatatacaaaaagtaaaaatactttgtaatgagtgtcaaacaactagtgaattagaaaaaaatgagtattgttgtcctaagtgtgaaagtacccaactagatattttggatggggaagagatgtatcttatgcaactagagttagaataa

SEQ ID NO: 8252 - protein, 113 aa, Unknown
  Obtained from environmental sample
  DOMAIN (1)...(113): Hydrogenase expression/synthesis hypA family
  misc_feature (1)..(113): Xaa is any amino acid
MHEYSIVQSLIDSCEENAKANDATKVTKVIVKIGVMSGVEPDLLQTAFDTFKEETICHNAQFVINIQKVKILCNECQTTSELEKNEYCCPKCESTQLDILDGEEMYLMQLELE

SEQ ID NO: 8253 - DNA, 495 bp, Unknown
  Obtained from environmental sample
  misc_feature (1)..(495): n is a, c, g, or t
ttgtgtttagaagatgatgaggggaaagatgtttgttatcttttttatcatatctcaagaaataatcaatatcttactattcataatattctcacaccttttcattcaagatttaatgggtatgcaaaaaaactattgacacttctttttaataagatacttctccatgcagatattgagagggtgaaaatgtattgtgtttcctcatcattaaagttttatatgaacttagggattgatttttggggtgtaaatagaattggtcaatactatacagactttccaatgcctgattctaatattaaagagatcaaggagcttatgaacaatgaagatttaacacaaattagtgaaaaaaatcgtgattctatttacaataagttaaaacaaaatggagaagagtttaatgaaaaagagatggttatatttaaaaaatcattaacacttcttaaagagagatatcgatttaaagagttaagaagtttttttatttaa

SEQ ID NO: 8254 - protein, 164 aa, Unknown
  Obtained from environmental sample
  misc_feature (1)..(164): Xaa is any amino acid
MCLEDDEGKDVCYLFYHISRNNQYLTIHNILTPFHSRFNGYAKKLLTLLFNKILLHADIERVKMYCVSSSLKFYMNLGIDFWGVNRIGQYYTDFPMPDSNIKEIKELMNNEDLTQISEKNRDSIYNKLKQNGEEFNEKEMVIFKKSLTLLKERYRFKELRSFFI

SEQ ID NO: 8255 - DNA, 615 bp, Unknown
  Obtained from environmental sample
  misc_feature (1)..(615): n is a, c, g, or t
ttgtatctaaaagggaaacttatagcttcaagtgttgataaaaagtacttagaaagtactctaaactcactagatactcttatagctttgatgtataaaaatggagaactatatcaccaaactatcaaaggaaaaactcctacacaaaaagctatactagaagattatagtttcctaagtgcgacactttttgaagcgtatcaaatcactttagagaacaaatatcttacactctatgaagaacttataaaaaaatctattgaactattttaccagaatggtagatgggcagaagcaaatgatgggtttgaaacatttgcagatattgaggagagtggttatgctagtgctttaggtgtacacttttcaaatttaattttatatgcaacaatgcaagaggactacaaaacttttgagatagtaaaaaaatcgatgcaatactatgtagagtatatcaacaaatatccatcatattttccaaatgcaacactagcttcaatcttttataatttagaacctgtatttatcaaagcaaacaaaaagaagcttgaaaagttctctagtgaagatttcaactatccctttgtatataaaaaagtgtatgatagtgatgac

SEQ ID NO: 8256 - protein, 205 aa, Unknown
  Obtained from environmental sample
  misc_feature (1)..(205): Xaa is any amino acid
MYLKGKLIASSVDKKYLESTLNSLDTLIALMYKNGELYHQTIKGKTPTQKAILEDYSFLSATLFEAYQITLENKYLTLYEELIKKSIELFYQNGRWAEANDGFETFADIEESGYASALGVHFSNLILYATMQEDYKTFEIVKKSMQYYVEYINKYPSYFPNATLASIFYNLEPVFIKANKKKLEKFSSEDFNYPFVYKKVYDSDD

SEQ ID NO: 8257 - DNA, 831 bp, Unknown
  Obtained from environmental sample
  misc_feature (1)..(831): n is a, c, g, or t
atgggtcaggatcggctcgagtgtttgtatacaggtaaaaaattaggagcaaaaagaaccatagccagaataaataactatgaaggcattggcacaagtatgcgtgtgttttacgaatctttaggggtcgataatattatttctcctgtggagctagcttcaaaagagataaacagattaattacccaatctgcttttactaacgattacgaatttgaaggaggaaaactttctgtttttggtattcctatttgtgataaatcaccactaaaagataagtctgttgttgaaacagcttacttaaatcctaaccgttcttttaaacccttatttttattaagaggagaaaaaacaattttaattcaagcatcaaccgaattaaaagaaaatgacattgtttactttatttctactccagaaagtattcctttaatcacaaaaatctgcggacagcagttttatgatattaaaaacattatgattttaggagcaagtagaataggagtgcttaccgcagaaattcttgaaaaagattacaatgtaattttaattgaagaagatagaaataaagctaccagaatagcagatcaactaaaacataccctagttataaatgctgatggaacagacgtttctgtattagaagaagaaaatattgccgaaatggatgcttttattgctgttacaggagattctgaaaccaacattatttcttcgttaattgcaaaatctcatggggttaaaaaaaccattgcaggagttgaaaatatagactatattaacctttcacataatattggaatagatacgcttatcaataaaaaaatatag

SEQ ID NO: 8258 - protein, 276 aa, Unknown
  Obtained from environmental sample
  DOMAIN (79)...(150): TrkA-C domain
  misc_feature (1)..(276): Xaa is any amino acid
MGQDRLECLYTGKKLGAKRTIARINNYEGIGTSMRVFYESLGVDNIISPVELASKEINRLITQSAFTNDYEFEGGKLSVFGIPICDKSPLKDKSVVETAYLNPNRSFKPLFLLRGEKTILIQASTELKENDIVYFISTPESIPLITKICGQQFYDIKNIMILGASRIGVLTAEILEKDYNVILIEEDRNKATRIADQLKHTLVINADGTDVSVLEEENIAEMDAFIAVTGDSETNIISSLIAKSHGVKKTIAGVENIDYINLSHNIGIDTLINKKI

SEQ ID NO: 8259 - DNA, 357 bp, Unknown
  Obtained from environmental sample
  misc_feature (1)..(357): n is a, c, g, or t
ttgggattaaaaaatgatagtgttgttgttagttttaaaactaaaaaagaatctgactacggtaatattatattgaaaatggatgtaaattttaaacccccttatattttgaaattgcttagaaacaacaaaattattgatgaaaaatacataagcaacagtcaaaatattaattacacttttttaaccccgggcgattatgatttgcatttaattgttgatgaaaatgataataaaaaatgggatacaggtaattatttaaaaacccaacaacccgaaacagtaattcattaccaaaaagccataaaaattcgtcctaattgggataatgaaatcatttggaatattaggctttag

SEQ ID NO: 8260 - protein, 118 aa, Unknown
  Obtained from environmental sample
  misc_feature (1)..(118): Xaa is any amino acid
MGLKNDSVVVSFKTKKESDYGNIILKMDVNFKPPYILKLLRNNKIIDEKYISNSQNINYTFLTPGDYDLHLIVDENDNKKWDTGNYLKTQQPETVIHYQKAIKIRPNWDNEIIWNIRL

SEQ ID NO: 8261 - DNA, 642 bp, Unknown
  Obtained from environmental sample
  misc_feature (1)..(642): n is a, c, g, or t
ttggctaaagaccntgatcttaggggtgcaggggtaaatttagagtatgtagatgattatggttttaaaaaaacaactgttataacaagaaatcacgataaggtttgtactgacaaggctaaagtaaatggtggagatcctgatgtagtttggggtggagattatgcaaaaagtagtgttccaggcaaatgtaaaaaaactttcataacaactattggtaaaatctctccaataaaaatagctgatggtattgaaacatacggtgagttagaagtaattgagttcatgaagaaaaagcaaactgataaaagtttagtattagttgatgcaagaatgaaaccttggtatgcaaaaggtacaattcctggggcagtaaatcttccttttaaatcatttgatccaacacattatgattttgagatagttatggatacagctggggtagtatatgaagagggtgaatatgactttaaaaatgcaaaaacacttcttttgttttgtaatggagtatggtgtccacaatcaacttgggcgatagaaaatcttcttaaaattgggtatccaaaagaaaaactactttggtatagaggtggaatgtatagctggaaaatgttaaatcttacaacaatagttccacaataa

SEQ ID NO: 8262 - protein, 213 aa, Unknown
  Obtained from environmental sample
  misc_feature (1)..(213): Xaa is any amino acid
MAKDXDLRGAGVNLEYVDDYGFKKTTVITRNHDKVCTDKAKVNGGDPDVVWGGDYAKSSVPGKCKKTFITTIGKISPIKIADGIETYGELEVIEFMKKKQTDKSLVLVDARMKPWYAKGTIPGAVNLPFKSFDPTHYDFEIVMDTAGVVYEEGEYDFKNAKTLLLFCNGVWCPQSTWAIENLLKIGYPKEKLLWYRGGMYSWKMLNLTTIVPQ

SEQ ID NO: 8263 - DNA, 675 bp, Unknown
  Obtained from environmental sample
  misc_feature (1)..(675): n is a, c, g, or t
atgaaatctttttatgaagatgtaagtaaaaatataaatagtttatttgataatccagaatcaatagaaaatgtaaaagaggcaaaagtagttgtaacagatatggtaaatactattcttcaagatgattttaaagttgaatcatttgtatcaatattatctagtgattattatacccatactcattcattaaatgtaagtgtatattccttatgtatagggaaacatatggggatggataaaaaacttttagaagaactaggaatttcagctttactccatgacttaggaaagactaaaattaatccagaaattattaataaaaatggaaaactaacagaccaagagtttaaagaagtacagaatcatccattttatggatggttattagcaaaaaaatgtggaattacaaatacaaatatattagcaggaattcgtaatcaccatgaaaaaattgatggaacaggatatcctgatggactttttgataaagagatacatgtttttgcaaaaataattggagtatgtgatgtatttgatgcactaactactaaaagaacctataaagattcagtgagtacttttgatacaataatgatgatgaaaaaagagatgtctaatcatttagatgaaaaaataattaatcaatttattcagatattaaaaggtgaataa

SEQ ID NO: 8264 - protein, 224 aa, Unknown
  Obtained from environmental sample
  DOMAIN (59)...(182): HD domain
  misc_feature (1)..(224): Xaa is any amino acid
MKSFYEDVSKNINSLFDNPESIENVKEAKVVVTDMVNTILQDDFKVESFVSILSSDYYTHTHSLNVSVYSLCIGKHMGMDKKLLEELGISALLHDLGKTKINPEIINKNGKLTDQEFKEVQNHPFYGWLLAKKCGITNTNILAGIRNHHEKIDGTGYPDGLFDKEIHVFAKIIGVCDVFDALTTKRTYKDSVSTFDTIMMMKKEMSNHLDEKIINQFIQILKGE

SEQ ID NO: 8265 - DNA, 744 bp, Unknown
  Obtained from environmental sample
  misc_feature (1)..(744): n is a, c, g, or t
gtgggttgctccatttattatgagcatcccatagcaggaaatgagtttccgcagcgaatttatgatggaattattcagtatgaacttcatttacgttattacaaagaagtacttcattatatcggattgccttatgcttttcatactgttggttcaagtatggccgttagagcaaatgtgtatcacaaacaaggcggaatgaacaaaagaaaagcaggagaggatttttattttctgcaaaaagtaattccattgggaaactttacagaactaaatactactacagtttttccttctccaagaatttctgagcgagtaccttttggaacaggaagagcgatgcagcaatggacaaataatgaagatgaaactttatttacctataattttaattcatttaaagagttgaaaatcttttttgataatagtgaacaactgttttcaaatgatgaaattcctttgccaaagagcgtattggaatttttaaatgaaaatgattttgaaaacaatttaaaaaatattagagcgaatgctaccaattcaaaacactttaaagaattactttttaaatggtttaatgcttttaaaaccctaaaatttttacatttttgtagagataatttccaccaaaatcaaccaattgatgaagctgccaatgtacttttaaaaactattaatctaaaaaaacaacaatcaataatagatttgcttttgaaatacaaaaatttacaaattacaaaataa

SEQ ID NO: 8266 - protein, 247 aa, Unknown
  Obtained from environmental sample
  misc_feature (1)..(247): Xaa is any amino acid
MGCSIYYEHPIAGNEFPQRIYDGIIQYELHLRYYKEVLHYIGLPYAFHTVGSSMAVRANVYHKQGGMNKRKAGEDFYFLQKVIPLGNFTELNTTTVFPSPRISERVPFGTGRAMQQWTNNEDETLFTYNFNSFKELKIFFDNSEQLFSNDEIPLPKSVLEFLNENDFENNLKNIRANATNSKHFKELLFKWFNAFKTLKFLHFCRDNFHQNQPIDEAANVLLKTINLKKQQSIIDLLLKYKNLQITK

SEQ ID NO: 8267 - DNA, 351 bp, Unknown
  Obtained from environmental sample
  misc_feature (1)..(351): n is a, c, g, or t
atggctatcaaatctgctttgattgacgctgtcattcgtattactgggctgtccggtgttttcattaaaacgcatcagcatgctctgaccaagctgggagcttgtcataaaaacagtgtgcctggcatgtcagattgtaacggggacggtctccccggaaggtccatttgtaattcccaaccagagaaacccatcacagataaacaaaagcacctgatcctgaaccttgctggacgaaaggggttaaccacagaaagtttggaaaaggagagtcggggcttgtttaacaaagatttaagagacttggacaaagtagaagcacaccaatttatccaacatttaaacggctga

SEQ ID NO: 8268 - protein, 116 aa, Unknown
  Obtained from environmental sample
  misc_feature (1)..(116): Xaa is any amino acid
MAIKSALIDAVIRITGLSGVFIKTHQHALTKLGACHKNSVPGMSDCNGDGLPGRSICNSQPEKPITDKQKHLILNLAGRKGLTTESLEKESRGLFNKDLRDLDKVEAHQFIQHLNG

SEQ ID NO: 8269 - DNA, 912 bp, Unknown
  Obtained from environmental sample
  misc_feature (1)..(912): n is a, c, g, or t
atgaatgatatgtctatgaaaatgaaaagaatatttcaaaaactaaattctaatatcgaaaatgttactaaaaaaatctctcaagatggacttacaaagcttgaaatgagacaaacatttgaaacagatatgaagaatatgtttattactaaaactgatggttatgtaataagtctaaaaattgagtctttaggagagtttgctaaaaacaactcaaatagtgcagtggataaactaataaaagattttgcaaatattttaaaagattccgatgatttatttgattttgatataaaagcttatagattttttggttcagaatttgcaatgattgctaaaaattgttcacaagaggatattgaaaaattagttaagcatctaaaaactaaatttgatgaagtttcagtagagataaaaatagcaaatttatcaaatattggtgtaacaatgtttaatcaaataggaacaacacctgagatgttaagtgcagcaatagaagcaagagagagcgcaaaacaagtaggaccaaatgaatttgtgataagagatgcaaatgatttagcgagggatatggagtcttggagagagttaatttttgacataattgataatgttaagttcaaagttggctttatcaataatgagtatcttttaaatggagaggagtatggtaaacttgtgatgcaagaagcctttacttctgcaaaagataaaaatggaaatgatataccaattggtacatttatttctattgctgaaaaatatgaaaaagttgtagattttgataaagctgtcgtaacaactgtaataaaacatataaaagagaacaatattcaaaataatatctcaataaacctatctcttgattcaattattgatttaagtntcataaatcctcagccgaaatcctga

SEQ ID NO: 8270 - protein, 303 aa, Unknown
  Obtained from environmental sample
  DOMAIN (22)...(178): GGDEF domain
  misc_feature (1)..(303): Xaa is any amino acid
MNDMSMKMKRIFQKLNSNIENVTKKISQDGLTKLEMRQTFETDMKNMFITKTDGYVISLKIESLGEFAKNNSNSAVDKLIKDFANILKDSDDLFDFDIKAYRFFGSEFAMIAKNCSQEDIEKLVKHLKTKFDEVSVEIKIANLSNIGVTMFNQIGTTPEMLSAAIEARESAKQVGPNEFVIRDANDLARDMESWRELIFDIIDNVKFKVGFINNEYLLNGEEYGKLVMQEAFTSAKDKNGNDIPIGTFISIAEKYEKVVDFDKAVVTTVIKHIKENNIQNNISINLSLDSIIDLSXINPQPKS

SEQ ID NO: 8271 - DNA, 561 bp, Unknown
  Obtained from environmental sample
  misc_feature (1)..(561): n is a, c, g, or t
atgaaaatcatcgtttatttcagagattttaccaaaatattaattttagacaataccctctctcctacttctaccattatagatttaacacaactcaatttagaagaaacttctttagtttgtcgctcttacaacaacggtatgtggtattacaatccgctaagatttgaactgattagaaaaaatcaagatttaaccacttccaacacctctgctaatttaagcaacttacttaataaaaatatccagcctaattttttagtagaacacaataaccaagtttacctaaacgaccctaaaaatggtattttagtattcgataattttggtacttatatcaaaaccatccctatttatggcttaaatacttttcaagtcaaagaaaaatttatcatctatatatcagaagatagttctgtaatgacttatgatttttttactttagagattaaaaaatatgagttatctactgaagaacctataaaatctgttagacttgagggaaaatacatttaccttcaaaccaaaaaaaatgaacttcttattgataaaatcaattaa

SEQ ID NO: 8272 - protein, 186 aa, Unknown
  Obtained from environmental sample
  misc_feature (1)..(186): Xaa is any amino acid
MKIIVYFRDFTKILILDNTLSPTSTIIDLTQLNLEETSLVCRSYNNGMWYYNPLRFELIRKNQDLTTSNTSANLSNLLNKNIQPNFLVEHNNQVYLNDPKNGILVFDNFGTYIKTIPIYGLNTFQVKEKFIIYISEDSSVMTYDFFTLEIKKYELSTEEPIKSVRLEGKYIYLQTKKNELLIDKIN

SEQ ID NO: 8273 - DNA, 648 bp, Unknown
  Obtained from environmental sample
  misc_feature (1)..(648): n is a, c, g, or t
atgaaaggtgggaatatagttgcactggaagccttaaaaaatatttataaatgcaatggaaaaattgaaaatatcgactttttgcttgtaagtgatgaggaaacaggaagtgatgatagtaagtttatcactttagagttagcaagaaactatgattattgttttgtatttgaagcagctggagaaaatcttgaattggtgacaggtagaaaaggtgtaggtacatatactataaccgtaagtggcaaagctgctcatgcaggaactagttaccaaaaaggtattaatgcaaatttagaagcttgtacaaaactacaagagctcactaaacttactaatcttgagattggaacaacagtaaatgttgggaaaattacaggtgggataggggcaaacaccattagtcccaagtgtgaattacttttagagatacgatatacaataaatagcgaaagagatagattacttcatgcactcaatagaataacaaataaaaactatgtagagggtactacctctatattggaaggtttaatacaaagagatgtgatggaacctaatagtaaatcagaaaagctaatatcgcgttttgaaaatattactgggtatacaataacctcaggaacaaagaaggtgggagttagttga

SEQ ID NO: 8274 - protein, 215 aa, Unknown
  Obtained from environmental sample
  DOMAIN (68)...(171): Peptidase dimerisation domain
  misc_feature (1)..(215): Xaa is any amino acid
MKGGNIVALEALKNIYKCNGKIENIDFLLVSDEETGSDDSKFITLELARNYDYCFVFEAAGENLELVTGRKGVGTYTITVSGKAAHAGTSYQKGINANLEACTKLQELTKLTNLEIGTTVNVGKITGGIGANTISPKCELLLEIRYTINSERDRLLHALNRITNKNYVEGTTSILEGLIQRDVMEPNSKSEKLISRFENITGYTITSGTKKVGVS

SEQ ID NO: 8275 - DNA, 348 bp, Unknown
  Obtained from environmental sample
  misc_feature (1)..(348): n is a, c, g, or t
ttgttggctcaagaaaataaacgagcattcttcatagagccagaatacatggtaggaaaagtagtcccaaattatctaaacaagtttccttctactcgtttacaacaaggcttagccgtaaatgttggttccttaaaaactgatagtaatagcacatgggctaaatattataatttcccacaaacaggtatctctttattttattcatctatcggcaatgagaaaatttttggagatgaatacagcattactacttttattgcttttaatatttttgatcagaaagaaaaaccaatttattttaaatttaagtttaggagctgcctattttactaccttctacgatag

SEQ ID NO: 8276 - protein, 115 aa, Unknown
  Obtained from environmental sample
  misc_feature (1)..(115): Xaa is any amino acid
MLAQENKRAFFIEPEYMVGKVVPNYLNKFPSTRLQQGLAVNVGSLKTDSNSTWAKYYNFPQTGISLFYSSIGNEKIFGDEYSITTFIAFNIFDQKEKPIYFKFKFRSCLFYYLLR

SEQ ID NO: 8277 - DNA, 426 bp, Unknown
  Obtained from environmental sample
  misc_feature (1)..(426): n is a, c, g, or t
gtgattgcacaagcagaagtgaaaacaatattgaaatcttcaggagagcgttacaaacgtattagagaaagtggagagtcactttctggcactggtgcagatgcaagaacttcaaactttaagattccagaagaaactacggcttcaaaaccgcttcaagataacgctgagaaattgggtaatctattagagggtattggtagatttgatccctcaatacaaacagctgatgacttaaaagttattagtggtattggcccaaaaatggaagaagtacttaataacattggtatctttacttatgcacaagtaagtaaaatgacaaaaagagaatatgacttgttagatgaaattacaggttctttcccaggaagagcagaacgtgatgattggtcaggacaagctaaaaacttattaaacaactaa

SEQ ID NO: 8278 - protein, 141 aa, Unknown
  Obtained from environmental sample
  misc_feature (1)..(141): Xaa is any amino acid
MIAQAEVKTILKSSGERYKRIRESGESLSGTGADARTSNFKIPEETTASKPLQDNAEKLGNLLEGIGRFDPSIQTADDLKVISGIGPKMEEVLNNIGIFTYAQVSKMTKREYDLLDEITGSFPGRAERDDWSGQAKNLLNN

SEQ ID NO: 8279 - DNA, 552 bp, Unknown
  Obtained from environmental sample
  misc_feature (1)..(552): n is a, c, g, or t
atgaaattcaatctcaactcttttcttatgagtgtctctttggcactagatatgtcagaaaaagagatacttggcgtagatatctaccatgcgagaaaagttgcatatgttagtcttagaattgcacaaagccttggtttgaaagatgatgagtgttttgatatttgtgcattggcaatactgcatgataacggcattacagaagctgtactgaaaagtaatatttccattaataaaggtgatttttatcaacttgaaaatatagttgaacactgcagtatcggtgaaaaaaatattaaaaattttcctttttttacaaatacgaaaaatgttattatgttccatcatgaaaattatgacggaagtggtttttttggaaaaaaaggtgatgatactcctcttttagccccaatcatatcatttgcagatgaattagattttaattttaatttgagtgatgacactcttgataacagaaatanaattgagaactatgtaaaagagaacattaatataaaacattctaaaactcttgcagatattttttttaaa

SEQ ID NO: 8280 - protein, 184 aa, Unknown
  Obtained from environmental sample
  SIGNAL (1)...(15)
  DOMAIN (27)...(148): HD domain
  misc_feature (1)..(184): Xaa is any amino acid
MKFNLNSFLMSVSLALDMSEKEILGVDIYHARKVAYVSLRIAQSLGLKDDECFDICALAILHDNGITEAVLKSNISINKGDFYQLENIVEHCSIGEKNIKNFPFFTNTKNVIMFHHENYDGSGFFGKKGDDTPLLAPIISFADELDFNFNLSDDTLDNRNXIENYVKENINIKHSKTLADIFFK

SEQ ID NO: 8281 - DNA, 579 bp, Unknown
  Obtained from environmental sample
  misc_feature (1)..(579): n is a, c, g, or t
atgagaagttanccacctgatgaaattctcaaaattttatttctctactttcactttgcatgttataatcacaaaatgagtataaaaaacaaaaaaatcaataaacaatcaaatcagtcaaaacagattaagtatgcatctttttctaaaagagccattgcttttattacggatctttttatgataggcattcctattagtattattataatgcttctttttggatacgatgcggtacatagtgctggaggagtagaccttttggtagatcctgaaaatgccaaaaaaaatgcaccctcacctgttagctctatcgcacagatagtactgtcatttgtagcatatatacttttttggaaaaaaggtggtcaaacacctggtaaaaagatgtttagtataaaagtagtagatagcacaacattagaaactgcatcatggttaaagttgattatacgttttataagttacttcatatcaatgctgacaattataggtttctttattggagtcctacgcaaagataacaggactctacatgatctgctaagtggtacagctgtaatagtttgtgaagagtag

SEQ ID NO: 8282 - protein, 192 aa, Unknown
  Obtained from environmental sample
  DOMAIN (45)...(189): RDD family
  misc_feature (1)..(192): Xaa is any amino acid
MRSXPPDEILKILFLYFHFACYNHKMSIKNKKINKQSNQSKQIKYASFSKRAIAFITDLFMIGIPISIIIMLLFGYDAVHSAGGVDLLVDPENAKKNAPSPVSSIAQIVLSFVAYILFWKKGGQTPGKKMFSIKVVDSTTLETASWLKLIIRFISYFISMLTIIGFFIGVLRKDNRTLHDLLSGTAVIVCEE

SEQ ID NO: 8283 - DNA, 456 bp, Unknown
  Obtained from environmental sample
  misc_feature (1)..(456): n is a, c, g, or t
atgatggatgatgctatagagcaggcatatagacgttttagaaaacataatgcttctatctggattgcaacacaaagttttgaggatattaatgactctaaagggttaacaagagcagggcaggtcataatttcaaactctccatggaagatctttttagctcaagaagagccatcattaaatctacttttacactcaaaaacatttcaatttaaccatacagaagaggagctgattaaaaaagtagatacgatcaaaggtcagtactcagaactgtttttaatcacgcctgagcagcaaaaaattccttataggcttataatgaataaatatttttactacctaactactactgatcaagacgataaagctaaggtgtatcaagtcatgagaagtgaaaatctctctaaaaaagatgcaataaatagactgattgagtatgaggatgcagcatga

SEQ ID NO: 8284 - protein, 151 aa, Unknown
  Obtained from environmental sample
  misc_feature (1)..(151): Xaa is any amino acid
MMDDAIEQAYRRFRKHNASIWIATQSFEDINDSKGLTRAGQVIISNSPWKIFLAQEEPSLNLLLHSKTFQFNHTEEELIKKVDTIKGQYSELFLITPEQQKIPYRLIMNKYFYYLTTTDQDDKAKVYQVMRSENLSKKDAINRLIEYEDAA

SEQ ID NO: 8285 - DNA, 669 bp, Unknown
  Obtained from environmental sample
  misc_feature (1)..(669): n is a, c, g, or t
atgtcaatcctacctgaacatataaagactcttttttcaaatactcaatgtggtgaggattatgtttcaatccctacaaaagctgcaagagaacagacaaaaagatattccattagtaaatatatacgcccaattaatgaacatcttgaagataccatatattgtaatgatggatattatggtgtcgtaatagaagcagttccgcacataagaatgggaactaaaactgcagaagcgataagagagattttaaacaagctctctcaagagacatttttccagattattttatggggttctaaaaatattgaaaatatgattgatcagtgggagcatgagcatagctcagataatgaagctgttgatgaagctatcaagcagttagcatctttttacaaaagtaagactaatgaaaagatatctgcatctatggagacaactattaaaaaccatagactctttttttcattcaaatcaaaaaaacaagatgaactcattgatctaaaagagcatgtgctaaacatactcagtacaaatagttttaatccgaaactattagatcttaaagcactaaagcctatatattgggagctgtttaatcctaaacactcttttcaagatatcccaaaatatgatcatagaagagagtttggcggacagtgtgtatct

SEQ ID NO: 8286 - protein, 223 aa, Unknown
  Obtained from environmental sample
  misc_feature (1)..(223): Xaa is any amino acid
MSILPEHIKTLFSNTQCGEDYVSIPTKAAREQTKRYSISKYIRPINEHLEDTIYCNDGYYGVVIEAVPHIRMGTKTAEAIREILNKLSQETFFQIILWGSKNIENMIDQWEHEHSSDNEAVDEAIKQLASFYKSKTNEKISASMETTIKNHRLFFSFKSKKQDELIDLKEHVLNILSTNSFNPKLLDLKALKPIYWELFNPKHSFQDIPKYDHRREFGGQCVS

SEQ ID NO: 8287 - DNA, 720 bp, Unknown
  Obtained from environmental sample
  misc_feature (1)..(720): n is a, c, g, or t
gtgattatagatatagcacatgagagtgaagactctattaaagatcttgtacgtcgctcagtttatttacacaaacagtttaaacatgacctctatttgaaagtcataaatgcaaataattttgaagtacttgagtatataaaaacatttaataacacgaatgtcatagttgatgtaaactatagtttatcatctatagatgatatcatattacaagatatcaatatgtatcatgtaggtttggtagttgtctctaaagctagttttgaacaacgtaaaatgaggaagattctgtttgaaggaagagttcctgttcttaagattgcaaataaatcagtctcaaaacttaaagaggcagtagctattatttctgataataaagagttagaaaaggtggctacaactatttttgatatctccatgcagttagacttgaatatggaaatatataactatacattagaacatcaagagtcaaaaatacagacaatagagcattttaataatctctctacaatcttttcaaaatctattaaagtttttgagaatgaaaaaaatcctcttagactattaaaaaaacgagaaaattttctacactgtctaccatttacatcaaaaattgcacagtaccgtattagtacaattttttcaaccgacagtgacatgctttattaccttcttaacgattatcatcagatctttattccttcgcaaatttaa

SEQ ID NO: 8288 - protein, 239 aa, Unknown
  Obtained from environmental sample
  misc_feature (1)..(239): Xaa is any amino acid
MIIDIAHESEDSIKDLVRRSVYLHKQFKHDLYLKVINANNFEVLEYIKTFNNTNVIVDVNYSLSSIDDIILQDINMYHVGLVVVSKASFEQRKMRKILFEGRVPVLKIANKSVSKLKEAVAIISDNKELEKVATTIFDISMQLDLNMEIYNYTLEHQESKIQTIEHFNNLSTIFSKSIKVFENEKNPLRLLKKRENFLHCLPFTSKIAQYRISTIFSTDSDMLYYLLNDYHQIFIPSQI

SEQ ID NO: 8289 - DNA, 459 bp, Unknown
  Obtained from environmental sample
  misc_feature (1)..(459): n is a, c, g, or t
ttggctcggagccgtgcttctataaccaaaggttttaaaaatgtatttcagctcgaaggcggtatcattaattacgtaagacaaattgaagcagaaggtttagagaataaatttttaggcaaaaactttgttttcgacgagcgtagatctgagcgtatttcagatgatgttatagccaattgtcaccaatgtggtgagcccgcagatttacataccaactgtgcaaatgaagcttgtcatttattatttattcaatgcgattcatgtaaagaaaagatggaaaactgttgttctacaaattgcatggaaataaatagattaccatacgaagaacaaaaagccttaagaaaaggacaaggcaatagtaatgatatcttcaaaaaaggacgtgcagatcacttaccctataaaaaagacttaagaaatatttttgagactttaaaaacggataaaatctaa

SEQ ID NO: 8290 - protein, 152 aa, Unknown
  Obtained from environmental sample
  misc_feature (1)..(152): Xaa is any amino acid
MARSRASITKGFKNVFQLEGGIINYVRQIEAEGLENKFLGKNFVFDERRSERISDDVIANCHQCGEPADLHTNCANEACHLLFIQCDSCKEKMENCCSTNCMEINRLPYEEQKALRKGQGNSNDIFKKGRADHLPYKKDLRNIFETLKTDKI

SEQ ID NO: 8291 - DNA, 465 bp, Unknown
  Obtained from environmental sample
  misc_feature (1)..(465): n is a, c, g, or t
ttgctaaatcatcttcaacaccaggtaaaacacaacttattaattattttgatattacatttagaagattataatgaagagaacgaagtgaaaaattattatgctcgatttgttgatttaccaggttttggttatgccaaagtttcaaaatctttaaaaaagaattggcgtccaaatttaacagattttttagaacaacgagcatcattacaaatttttgtacatcttatagatgcaagacactcaacattagatattgataaaagtgttgatgaatttctaaatcatataaaaagaggtgatcagattattatcaacgcttttacaaaaattgataagcttaaacaaacagagttacaaaaattacagagagaatatccagatggaatttttataagtaatctaaaaaataaaggtatgccagctttagaaaaaagaattgctaattatttatttggagagtag

SEQ ID NO: 8292 - protein, 154 aa, Unknown
  Obtained from environmental sample
  misc_feature (1)..(154): Xaa is any amino acid
MLNHLQHQVKHNLLIILILHLEDYNEENEVKNYYARFVDLPGFGYAKVSKSLKKNWRPNLTDFLEQRASLQIFVHLIDARHSTLDIDKSVDEFLNHIKRGDQIIINAFTKIDKLKQTELQKLQREYPDGIFISNLKNKGMPALEKRIANYLFGE

SEQ ID NO: 8293 - DNA, 321 bp, Unknown
  Obtained from environmental sample
  misc_feature (1)..(321): n is a, c, g, or t
atggctcaaatgataaatcaagatcataacccgttaaacaccacaataggtatatataggctagttatgaaatcaggaagtgataactttagagcaagtgctattcaaggcattatgaaaagaatcaaagcaaaaggtatagaggtagttatctatgagccagccatgaaagaagatgagtttttcaattcaaaggttatcaaaaatcttgaagagtttaaaagtctgagtgatgttatcatagcaaatagatttgagactattttagaagatgtgaaagacaaagtatatactcgtgatatttttaatagtgatagttaa

SEQ ID NO: 8294 - protein, 106 aa, Unknown
  Obtained from environmental sample
  DOMAIN (17)...(104): UDP-glucose/GDP-mannose dehydrogenase family, UDP binding domain
  misc_feature (1)..(106): Xaa is any amino acid
MAQMINQDHNPLNTTIGIYRLVMKSGSDNFRASAIQGIMKRIKAKGIEVVIYEPAMKEDEFFNSKVIKNLEEFKSLSDVIIANRFETILEDVKDKVYTRDIFNSDS

SEQ ID NO: 8295 - DNA, 429 bp, Unknown
  Obtained from environmental sample
  misc_feature (1)..(429): n is a, c, g, or t
atgaaaatattagtaacaggaacagcagggtttattggataccatttagcaaaaaagctattagaacgaggtgatgaagtagtaggaatagataatataaatgattactatgatatcaaccttaagtatggacgattaaaagagttaggtattgaaagagcacttgtagaagataatgtaagtatattatcaaaaaattataaaaatcataaatttattaaattagatttagcagataaagaagcaatggagaacctttttaaagttgaaaaatttgatgcagtttgtaatcttgctgcccaagcaggagttcgctatagccttgaaaatccatacacttatatacaaagtaatataattggatttttgaatgtactcgaggggtgtagaaattatggagtaaatacctctcttatgcatcgagcagtt

SEQ ID NO: 8296 - protein, 143 aa, Unknown
  Obtained from environmental sample
  DOMAIN (3)...(142): NAD dependent epimerase/dehydratase family
  misc_feature (1)..(143): Xaa is any amino acid
MKILVTGTAGFIGYHLAKKLLERGDEVVGIDNINDYYDINLKYGRLKELGIERALVEDNVSILSKNYKNHKFIKLDLADKEAMENLFKVEKFDAVCNLAAQAGVRYSLENPYTYIQSNIIGFLNVLEGCRNYGVNTSLMHRAV

SEQ ID NO: 8297 - DNA, 885 bp, Unknown
  Obtained from environmental sample
  misc_feature (1)..(885): n is a, c, g, or t
gtggtttcccacgatagaactctattggataatattacaaatagaacaatagaaattagtaacggtagggcatatgattataaggtgccctattcgtcatatattacccttcgagaagaaagggaaatacacctaaaggcaacttataataatcaacaacgcgaaatagtagaagttgaaaagtttgttgagagatttagatataaggcatcgaaggcaaaacaagttcagtcgagagttaagaagctggaaagaatggatgttatcgaactcgataatatcgataaaagtgccattcactttctctttccacctgctcctcacagtggtaaagttacaattgacggaaaaaaaatctctaaatgctatggggaatcggtaatacttaaagatgttgattttgagattataagaggtgagaaaattgcatttctaggacgtaatggtgagggaaaatcaacattagcaaagataatagctgattcaattgattataccggcgagctcaaccttggacatcaggttattactgcttattttgcacaggatcagggtaatatgcttgatccggagttaactgtatttgaaacaattgataatgttgcggttggagatatcagaaaaaaagttacttcaatactaggtgcttttctgtttcagggtgaggacataaacaaaaaagtgaaagtgctatcaggtggtgaaaaggcacgattgtcgttggcaatgttgttgttaacaccaagtaatttgttactaatggatgagcctacaaatcatcttgatttgcgatcaaaagatattctcaaaagtgcattgctagaatatgatggtacattggtaattgtatcgcacgacagggatttctacagggctgaccaatga

SEQ ID NO: 8298 - protein, 294 aa, Unknown
  Obtained from environmental sample
  DOMAIN (139)...(294): ABC transporter
  misc_feature (1)..(294): Xaa is any amino acid
MVSHDRTLLDNITNRTIEISNGRAYDYKVPYSSYITLREEREIHLKATYNNQQREIVEVEKFVERFRYKASKAKQVQSRVKKLERMDVIELDNIDKSAIHFLFPPAPHSGKVTIDGKKISKCYGESVILKDVDFEIIRGEKIAFLGRNGEGKSTLAKIIADSIDYTGELNLGHQVITAYFAQDQGNMLDPELTVFETIDNVAVGDIRKKVTSILGAFLFQGEDINKKVKVLSGGEKARLSLAMLLLTPSNLLLMDEPTNHLDLRSKDILKSALLEYDGTLVIVSHDRDFYRADQ

SEQ ID NO: 8299 - DNA, 357 bp, Unknown
  Obtained from environmental sample
  misc_feature (1)..(357): n is a, c, g, or t
atgatttcactcagtaatataagaaaagaattcagcggacagccactatttcaggaggtttcatttaatgtgaacccaaaggataggattggtttggcaggtgtaaatggagctggtaagtcgacattgcttaaaattatcgcaggagagttggaagctgacttaggtaagattgtatttccgtcagatgaaaatataggatatctaccacaggagaagataattaattcaactctaaatgtggtagaggaagcaatgcttgtatttaagtttcttgatgattacaagcgtgaaatagatgagatacataaaaaacttgaaaatgaagattacgtcttaaaaaatattcaacgctaa

SEQ ID NO: 8300 - protein, 118 aa, Unknown
  Obtained from environmental sample
  misc_feature (1)..(118): Xaa is any amino acid
MISLSNIRKEFSGQPLFQEVSFNVNPKDRIGLAGVNGAGKSTLLKIIAGELEADLGKIVFPSDENIGYLPQEKIINSTLNVVEEAMLVFKFLDDYKREIDEIHKKLENEDYVLKNIQR

SEQ ID NO: 8301 - DNA, 324 bp, Unknown
  Obtained from environmental sample
  misc_feature (1)..(324): n is a, c, g, or t
atgatgaagaactttgaaagtatcattaacactaaaaaatcggctataatttataatgccattgatttttctgcttttaccaaaaaagaaaaagctaacacttctcagaaagtaataattggcaatgcaggttcggttgatgattgtctttttcagatcatcggaaaggtgattgaagtaggcacagtatccagccacacgcaccagcaggtaggggtatttttccgggttgtcataggcatccagcagtatctcacggttgatgacattgggttggaactgcataccacccttcttcatgtaagtgctgaaaatgcttgctag

SEQ ID NO: 8302 - protein, 107 aa, Unknown
  Obtained from environmental sample
  misc_feature (1)..(107): Xaa is any amino acid
MMKNFESIINTKKSAIIYNAIDFSAFTKKEKANTSQKVIIGNAGSVDDCLFQIIGKVIEVGTVSSHTHQQVGVFFRVVIGIQQYLTVDDIGLELHTTLLHVSAENAC

SEQ ID NO: 8303 - DNA, 381 bp, Unknown
  Obtained from environmental sample
  misc_feature (1)..(381): n is a, c, g, or t
atgacagatcggctgaggaattctaaagacgccttgagtaaagctaaagatattaattatagctatcaacttactgattcaatactattttttccagattatttaaccactaaaaaagagaataaaattagaggtcagcaagtagaagtgattgtttatttaccactttatcaaagtatttatttagataagtctactaaagagttgatttatgatgtagataattttaccactacttatgataagaaaatggtaggtaaaaagtgggtgatgttagaacaaggattaacctgcttagattgtaatgatattgaaggaattacttctaaagaattggaagagcttaaagccttaaaaatggtggagacagtaatagagtaa

SEQ ID NO: 8304 - protein, 126 aa, Unknown
  Obtained from environmental sample
  misc_feature (1)..(126): Xaa is any amino acid
MTDRLRNSKDALSKAKDINYSYQLTDSILFFPDYLTTKKENKIRGQQVEVIVYLPLYQSIYLDKSTKELIYDVDNFTTTYDKKMVGKKWVMLEQGLTCLDCNDIEGITSKELEELKALKMVETVIE

SEQ ID NO: 8305 - DNA, 651 bp, Unknown
  Obtained from environmental sample
  misc_feature (1)..(651): n is a, c, g, or t
atgagaaaaatgacatgttttttaccttgtaggaaggggtcggtacgagtaccacataagaacacgaaaccttttgcagagtataataatggtttgattgaagtaaaattgaagcagttagctaatgtaaaagaaattgatgaaatagttttaacaaccaatgatgtagaaattcttgagtatgcagaaggtttgggtgtagaaaaaataacattgcatcatcgtaaagaagagctctcatcaagcttgacaagtacagacgagttggtgaagcatgcaagtagtctaataccgcaaggtgatattctttggacccatgttacctcaccatttatcacagaaagacattataaaaatattattcaggattataaaaaggcgataaaaaatggttatgactcattgatgacagtaacagagttatattcttttttatggaaaaatggcgtaccaattaattatgatcgaaatgtagaaaagtggccgcgaacacagactattgagcctatttatgaagttaacagtggtgcatttattgctgcttctgagttatacactgaatataatgatagaataggaaaaagtccttatctttatgtgctagataaactgacaagtcatgatattgattgggagatgattttttattgg

SEQ ID NO: 8306 - protein, 217 aa, Unknown
  Obtained from environmental sample
  DOMAIN (5)...(214): Cytidylyltransferase
  misc_feature (1)..(217): Xaa is any amino acid
MRKMTCFLPCRKGSVRVPHKNTKPFAEYNNGLIEVKLKQLANVKEIDEIVLTTNDVEILEYAEGLGVEKITLHHRKEELSSSLTSTDELVKHASSLIPQGDILWTHVTSPFITERHYKNIIQDYKKAIKNGYDSLMTVTELYSFLWKNGVPINYDRNVEKWPRTQTIEPIYEVNSGAFIAASELYTEYNDRIGKSPYLYVLDKLTSHDIDWEMIFYW

SEQ ID NO: 8307 - DNA, 723 bp, Unknown
  Obtained from environmental sample
  misc_feature (1)..(723): n is a, c, g, or t
ttggaagacagaagtatcagtagtaattatgtttttactatatttcaagatagaaataatatctactgggttggtacagtcaaaggtctaaacagatttgatcccgataaagaaaaattcaaactttggaatgtgagagataaaactaaaaaaacatttataaataataacatttgggatatttataaaggaaatagtaaggaaatatggcttggaacagaaaatggaatccttctttttaacatgaaatccaaagaagtaattaagaaaggactttttgatcgatttgaaactaacaggattagtttagtaacaaaagacagcagaaataatttatggattggaacagacagaaagggattatttaaatataacttggattcaaatgatcttgttaattttaaaaataacccagatgataaaaattccatttccgggaataaaatatatatattaattgaaactagagatgggtctttgtggattgggacagataaaggtataaatagatttgatcaagaaagaaatgcttttgatagctttattgatatcaatgataatgggagttcattcagtaaaaattcggtcttatctttagatgaaggattggatggggtactctggattggaactgaaataggattgtatatcttcgatccaaaactaaagaaaataatgaggtggatttataaaaagaataccaaaaaggtagtaatattgtaa

SEQ ID NO: 8308 - protein, 240 aa, Unknown
  Obtained from environmental sample
  misc_feature (1)..(240): Xaa is any amino acid
MEDRSISSNYVFTIFQDRNNIYWVGTVKGLNRFDPDKEKFKLWNVRDKTKKTFINNNIWDIYKGNSKEIWLGTENGILLFNMKSKEVIKKGLFDRFETNRISLVTKDSRNNLWIGTDRKGLFKYNLDSNDLVNFKNNPDDKNSISGNKIYILIETRDGSLWIGTDKGINRFDQERNAFDSFIDINDNGSSFSKNSVLSLDEGLDGVLWIGTEIGLYIFDPKLKKIMRWIYKKNTKKVVIL

SEQ ID NO: 8309 - DNA, 912 bp, Unknown
  Obtained from environmental sample
  misc_feature (1)..(912): n is a, c, g, or t
ttgnnnnnnttttttttgccgagaagagagggctataaagaagcatggaaacatgtaaaaaaaggtaataaactattcaaaatgaataaaaaaggtgcttatattgaagctcttggccattacttaaccgcacacaattacaatgaagataatgcagccttaaattatttaattggtatttcttatttaaaaacttcagaagcaaaaaaaggcttagaatatattgacaatgctaatttcatctatggtaacctaacagaagacattatgtattggttgggaatagcaaaccaatacaattataagtttgataatgctattgattattacgaagattaccttaactctttaacaccaaaaaagatgcaaagagttaaaacaaaagttgataaaagaataaaagaatgtgaaagtgggaaagatttagtaaacaatccagtaagatgttttattgacaatttaggagaaggggttaatacaaaagaccctgaatacagtccgatatttaactttaatgattctgtattatatttcacctcaagaagagaaaacacaactggaggaaagaaaagttcatacagtaggatgtattatgaagatgtttatatttcaaatttctataatggaagttggcaagttgcagaacaaatggaaaagccaataaatacaaaacataatgatgctgctgttgaaatttcaccagaaggacgagaactttgtatatatagggggaataaaggctcaggggacttatacaatagccaatttaaaaaagaccgttggtataaacctggtaaaatgaaaaaaattgataaaggaaattatagagaaagttctgtttctgtaactccangatctatgactctttattttatcagtgatagaaaaggaggacagggaagacaagatata

SEQ ID NO: 8310 - protein, 304 aa, Unknown
  Obtained from environmental sample
  misc_feature (1)..(304): Xaa is any amino acid
MXXFFLPRREGYKEAWKHVKKGNKLFKMNKKGAYIEALGHYLTAHNYNEDNAALNYLIGISYLKTSEAKKGLEYIDNANFIYGNLTEDIMYWLGIANQYNYKFDNAIDYYEDYLNSLTPKKMQRVKTKVDKRIKECESGKDLVNNPVRCFIDNLGEGVNTKDPEYSPIFNFNDSVLYFTSRRENTTGGKKSSYSRMYYEDVYISNFYNGSWQVAEQMEKPINTKHNDAAVEISPEGRELCIYRGNKGSGDLYNSQFKKDRWYKPGKMKKIDKGNYRESSVSVTPXSMTLYFISDRKGGQGRQDI

SEQ ID NO: 8311 - DNA, 660 bp, Unknown
  Obtained from environmental sample
  misc_feature (1)..(660): n is a, c, g, or t
gtgggagactttgcatttattggtgtttcaaaagtaagagaaagtgcaacattctcaggccttgaaattacaaaactagctaaaagagtaagtggtgtttggatagtaaatatcaaaaccaaagatataatctcatttgtagagtttacaagtggacttgatgaagtgtttgctataacagtagtgcctcatagaaaagtagagatgctagactttaatagtgaccagtcaaaagcaaactatatgatttccccagaagatattgaacaagtaagaatgcctgaaacaaagatagagatggcagccccacactttgaaaaaggtaatgatttttttaatgaaaataaaaaagaggaagctattatccactttcaaaaagctttagagatacaaagtgattatttacctgcaacatttaatctagcaatttgtttaggagacttagaaaaatacgatgaagcagaagctattttacaagaggttatagataaagatgcttcaatactacaaagttatgattcattaggatttatctattataaaaaaagagattttanaaaagctcaggagaactttcaaaagattcttgaattagaccctagtaatactaaagctaangactctttagagattttagaaagagaaaaaaataggaaataa

SEQ ID NO: 8312 - protein, 219 aa, Unknown
  Obtained from environmental sample
  DOMAIN (101)...(134): TPR Domain
  misc_feature (1)..(219): Xaa is any amino acid
MGDFAFIGVSKVRESATFSGLEITKLAKRVSGVWIVNIKTKDIISFVEFTSGLDEVFAITVVPHRKVEMLDFNSDQSKANYMISPEDIEQVRMPETKIEMAAPHFEKGNDFFNENKKEEAIIHFQKALEIQSDYLPATFNLAICLGDLEKYDEAEAILQEVIDKDASILQSYDSLGFIYYKKRDFXKAQENFQKILELDPSNTKAXDSLEILEREKNRK

SEQ ID NO: 8313 - DNA, 642 bp, Unknown
  Obtained from environmental sample
  misc_feature (1)..(642): n is a, c, g, or t
atgaaacatataaaaaaagcattactgatattacttttcttgttcctttcattctcctctagagaactatttgctcaaacaaatacgacgaattccattattttgattgaaaccaatttgggtaatattaaattgatgctttataaggatacgcctaaacaccgtaagaattttttgcagctaatagaaaataagcattttgatggaacattgttttatcgagtgataaaaggattcgttctacaaggaggatcgcaggattcaaggaatgctgctacaggaagacaaattggttacggtagctcaaatagaacgatagaatcagaattttgcccacaccattttcataaaaaaggagcgttggctgcagctcgtcagccagataaggtaaatatatttaaggaatctgatgtttctcaattctatattgcgcatggtcgagtttatactttggaagagttgaaggctatggaaaacgcggtaaataagcctttgaaaaagcaaattactaggcgataccttacacctaanaaacgtcagattttagattctttgaaaaaattgaacttgttaaagaatttagagcaattgcaaataagattaaatctgatattagtttcgattttgaaagttcagaaataa

SEQ ID NO: 8314 - protein, 213 aa, Unknown
  Obtained from environmental sample
  SIGNAL (1)...(19)
  DOMAIN (33)...(169): Cyclophilin type peptidyl-prolyl cis-trans isomerase
  misc_feature (1)..(213): Xaa is any amino acid
MKHIKKALLILLFLFLSFSSRELFAQTNTTNSIILIETNLGNIKLMLYKDTPKHRKNFLQLIENKHFDGTLFYRVIKGFVLQGGSQDSRNAATGRQIGYGSSNRTIESEFCPHHFHKKGALAAARQPDKVNIFKESDVSQFYIAHGRVYTLEELKAMENAVNKPLKKQITRRYLTPXKRQILDSLKKLNLLKNLEQLQIRLNLILVSILKVQK

SEQ ID NO: 8315 - DNA, 360 bp, Unknown
  Obtained from environmental sample
  misc_feature (1)..(360): n is a, c, g, or t
ttgtcaaaaagcatcataaaaacatactcatctgaacttacacaagttatgttaaatattttgacaaatgcaaaagagcagtttattaaagagaagatagccgatagaaaaataggtattattttaaaagaagatgatgaaatatataccattatcataacagacagtgcaggaggagcgagtgaaaatacgttaaaaaatatgtttgatatgaacttctccacaaaaatggatgataaaggcacaggtcttgggcttcatatgtcaaaaatcattatagaagatcactgcaaaggatcgataagtgcaaaaaatgttgataaaggtttagagtttactataactttaaaatcgctttag

SEQ ID NO: 8316 - protein, 119 aa, Unknown
  Obtained from environmental sample
  DOMAIN (8)...(119): Histidine kinase-, DNA gyrase B-, and HSP90-like ATPase
  misc_feature (1)..(119): Xaa is any amino acid
MSKSIIKTYSSELTQVMLNILTNAKEQFIKEKIADRKIGIILKEDDEIYTIIITDSAGGASENTLKNMFDMNFSTKMDDKGTGLGLHMSKIIIEDHCKGSISAKNVDKGLEFTITLKSL

SEQ ID NO: 8317 - DNA, 468 bp, Unknown
  Obtained from environmental sample
  misc_feature (1)..(468): n is a, c, g, or t
atggcatttaaaatagactctttgaagataacagatttaacagaaccgtattttgttaaaccgattagaattaactaccttcaagacggagaatccaagagttgggaagcagtaaaatctcatgacagtgtttctgtacttctatatcatactcaaaaagatgcttttttactagtaaaacagtttcgtccacctgtatatataaatgataaaaaccactctttaacgtatgagttatgtgcaggaatcatagataaagattgttcattagagcagattgtaaaagaggagatagacgaggagtgcggctataacgttgagctttcaaatatagaaaaaatcacatcattttttacaaatgttggagtttctggttccaaacaacacctctattttgcgcaaattgatgagagcataagagtacatgaaggtggaggaattcacacagaacagatagagttagagttt

SEQ ID NO: 8318 - protein, 156 aa, Unknown
  Obtained from environmental sample
  DOMAIN (40)...(155): NUDIX domain
  misc_feature (1)..(156): Xaa is any amino acid
MAFKIDSLKITDLTEPYFVKPIRINYLQDGESKSWEAVKSHDSVSVLLYHTQKDAFLLVKQFRPPVYINDKNHSLTYELCAGIIDKDCSLEQIVKEEIDEECGYNVELSNIEKITSFFTNVGVSGSKQHLYFAQIDESIRVHEGGGIHTEQIELEF

SEQ ID NO: 8319 - DNA, 780 bp, Unknown
  Obtained from environmental sample
  misc_feature (1)..(780): n is a, c, g, or t
atgactagacaactttcagagatttctagcacaaaaggttttgagttccgtataacaagtctcaaccctataaatccacataacaaagtaactccattcgaagaaaaagcactaaaatatatagaaagaaccaatgaaaaagagtattacgagataaatgataattcaaaatttaactatatgggtgtacttatcactaaagctgcttgtcttccttgtcataaacatcagggctataaaacaggagatatcagaggtgggattagtataagtattgattctattgagtactatactgtgacttcatctataaagaacagagcactaattttaaaagtgtttgttatactttttctactaagtattgttactcttgtatataaacaactaagacaaaatgaaaaacttcaaagtgaagtaaatcgtagaactaaagaaatagaatcaacaaaacaacttctacagcagattatagacacagattcaagttttattattcttgctgatgtaagagatgtaatttatgcgaacaaaaccatactcgaatttgctggttattcatcaattgatgaatttaaagcaaatcataaatacctatcagaactgtttgaaaaagttgatggaaataaaaactttttgcaaacatacaatgatggaattcactggattgactatttaagaaaagaacaaaattcaaaaaaattcaaaattttaataaaaaaagatggagagctaagatactttagacccatatctaaagatattaagattgaacaataa

SEQ ID NO: 8320 - protein, 259 aa, Unknown
  Obtained from environmental sample
  misc_feature (1)..(259): Xaa is any amino acid
MTRQLSEISSTKGFEFRITSLNPINPHNKVTPFEEKALKYIERTNEKEYYEINDNSKFNYMGVLITKAACLPCHKHQGYKTGDIRGGISISIDSIEYYTVTSSIKNRALILKVFVILFLLSIVTLVYKQLRQNEKLQSEVNRRTKEIESTKQLLQQIIDTDSSFIILADVRDVIYANKTILEFAGYSSIDEFKANHKYLSELFEKVDGNKNFLQTYNDGIHWIDYLRKEQNSKKFKILIKKDGELRYFRPISKDIKIEQ

SEQ ID NO: 8321 - DNA, 678 bp, Unknown
  Obtained from environmental sample
  misc_feature (1)..(678): n is a, c, g, or t
atgtttttaaaactaataaaagataaaagactttttttaaatacccaagtttccgatatagagtttgataatttttataaaattaaaacaaataatcaaatcattgaagcaaaaaaagttgtgattgcaagtggaggtttgagttatcaaagtttgggagctagttccatagcatttgatattgcaaaaaagtttaaacacaaagtcaattccttaaatcctgcacttgtgggttttactgtacaaaaagagcagttttggtttaaaaatctaagcggtatttctatgtatgtaaatgctaaagttgaaaataaaacttttgaaggaggtctactttttgcccataaaggcataactggacctgtgattttaaatagttctttgtattggaaaaaaggaaaaatgagtatagacttcttgccaaacaaaacttttaaatcatttttaaaaggcaataaaaatatctcctcaagttttaatttaccaaaaagatttatgcaagagtttttagcttcaattcaactagatgataaaccaattagtaaattaaacagtgaagaactaaaaaaactagaagttctaatctactatgagttcgcacctgcaggaaactttggatacccgaaagctaaggttgtaacggggaatgaggggggcaaaagnnnnanttgnnnttga

SEQ ID NO: 8322 - protein, 225 aa, Unknown
  Obtained from environmental sample
  DOMAIN (1)...(216): HI0933-like protein
  misc_feature (1)..(225): Xaa is any amino acid
MFLKLIKDKRLFLNTQVSDIEFDNFYKIKTNNQIIEAKKVVIASGGLSYQSLGASSIAFDIAKKFKHKVNSLNPALVGFTVQKEQFWFKNLSGISMYVNAKVENKTFEGGLLFAHKGITGPVILNSSLYWKKGKMSIDFLPNKTFKSFLKGNKNISSSFNLPKRFMQEFLASIQLDDKPISKLNSEELKKLEVLIYYEFAPAGNFGYPKAKVVTGNEGGKXXXXX

SEQ ID NO: 8323 - DNA, 588 bp, Unknown
  Obtained from environmental sample
  misc_feature (1)..(588): n is a, c, g, or t
atgcatgaacttagaactccaattacaaagggtaagtttttaagtgagttggaaaacagtgatgaaaatgctgaaaaaatgagaagagtatttacacgtttagaattacttattagtgagtttacccaaatagaagagcttatatcttccactaaaaatatagtaaaaaacaactactttttagatgatattatagacaatgcagaagatatgcttatgctagaagatgatgtaattatctcagagtatgaaaacaaaaaaataaatgtgaattttaaacttttttgtgtagctataaaaaaccttatagataatgcaataaaatactcagatgataaaaaagtaaccataaaaaccaatgataaaagtgaaataatatttgaaaatagtggaaagggcttagcttatcctttagaagactattttgaaccattctttgcaaatgaaaataaaaataaaaacagctttggacttggactttatatagtaaattcaattcttaaagcaaacgattatgtactaaaatatgagtataaagatgagataaatatatttactattgtaaagcttgaaaagaaggataagtaa

SEQ ID NO: 8324 - protein, 195 aa, Unknown
  Obtained from environmental sample
  DOMAIN (90)...(192): Histidine kinase-, DNA gyrase B-, and HSP90-like ATPase
  misc_feature (1)..(195): Xaa is any amino acid
MHELRTPITKGKFLSELENSDENAEKMRRVFTRLELLISEFTQIEELISSTKNIVKNNYFLDDIIDNAEDMLMLEDDVIISEYENKKINVNFKLFCVAIKNLIDNAIKYSDDKKVTIKTNDKSEIIFENSGKGLAYPLEDYFEPFFANENKNKNSFGLGLYIVNSILKANDYVLKYEYKDEINIFTIVKLEKKDK

SEQ ID NO: 8325 - DNA, 543 bp, Unknown
  Obtained from environmental sample
  misc_feature (1)..(543): n is a, c, g, or t
atgaacactataacctcaaatgttatggagtctgtattaataaaaaacctttatatttgtaaaaaagatgactttatgctattgatagaaaagatttcaaatcaaataaataaagatgaatataaaccagaatctttttcatcattttcaaagagagagtttatagacttaagtgatagtgatatttgtagatcaagagaatatattcaattaactcattgtaaaataagtcagaagcgtattgaaaaacatttattatataaacaatattatcaatcctataaatatgatttgttgttagataatagtttagaatcaatagaagatttagagtctagaacttatgataatttttgtgatgtaaaagaatatttaaaaagtgaaaataaagataccccattaaatagattaaatagaactaaagaaaaaggtaatacttatagttataatgaatatattaaatctggctcatgtatttatttaacaaaggataatacagatttagagtcaataatatcttggaaggatgatgaaagtgaataa

SEQ ID NO: 8326 - protein, 180 aa, Unknown
  Obtained from environmental sample
  misc_feature (1)..(180): Xaa is any amino acid
MNTITSNVMESVLIKNLYICKKDDFMLLIEKISNQINKDEYKPESFSSFSKREFIDLSDSDICRSREYIQLTHCKISQKRIEKHLLYKQYYQSYKYDLLLDNSLESIEDLESRTYDNFCDVKEYLKSENKDTPLNRLNRTKEKGNTYSYNEYIKSGSCIYLTKDNTDLESIISWKDDESE

SEQ ID NO: 8327 - DNA, 723 bp, Unknown
  Obtained from environmental sample
  misc_feature (1)..(723): n is a, c, g, or t
ttggattgtgtaactctgtttgctaaaacattatctgacattgagtctgtatttgaaatagtaaatcaatatgatgaaaatgatatttatagtagagagtatattgttaaaaatgaaagtgttaaagagagttttacttttgctattcctcaaaaagaacagttaaaattttttggagatgaacaagctgaaaagttattttttcaagcagtaaaaaaatttgaatcactaggtggaaaagcagtagagatagattatgaaccatttaatgaaagtgcaaatctactttatagtggaccttgggttactgagagatatatcgctataaaagaggtgataacaaaaactcctgaagtggtaaataaaacagttagagctatcataagtggaggagataaaatagatgcaataaactattttgaatcagaatatactttaaagaaaaatagaaaaatagctgataaaatttttaaagaatatgattttatgttaacaccaacaacgggaacaatttataaaatagatgaggtaaatgcagaccctatacagctcaatacaaatcttggatactatacaaattttatgaatttacttgatctgtctgcgattgctgtacctgcaggattgagagaaaatggacttccctttggagtaactatagttgctgataattttgaagaagagaaactattagcttattcaagtaagtatctagaggtttaa

SEQ ID NO: 8328 - protein, 240 aa, Unknown
  Obtained from environmental sample
  misc_feature (1)..(240): Xaa is any amino acid
MDCVTLFAKTLSDIESVFEIVNQYDENDIYSREYIVKNESVKESFTFAIPQKEQLKFFGDEQAEKLFFQAVKKFESLGGKAVEIDYEPFNESANLLYSGPWVTERYIAIKEVITKTPEVVNKTVRAIISGGDKIDAINYFESEYTLKKNRKIADKIFKEYDFMLTPTTGTIYKIDEVNADPIQLNTNLGYYTNFMNLLDLSAIAVPAGLRENGLPFGVTIVADNFEEEKLLAYSSKYLEV

SEQ ID NO: 8329 - DNA, 771 bp, Unknown
  Obtained from environmental sample
  misc_feature (1)..(771): n is a, c, g, or t
ttggattgtgattatgtaagtcataagtatgcagaagatatttttaatgatattgcaaaatatggaacagtaaatataagacgagcctatgggaactggaaagataaaaaactcataggttgggagaaactgttacaacaacataatatccaaccaattcaacaatttgcctacacacaagggaaaaatgctacagatatagctatgattatagatattatggatctattgtatacaaaagagttaagtggtgtagcacttgttacaagtgatagcgattttaccccaatagttacaagaatattagcaaatgggttaactgtatatggatatggggaagaaaaaactccaatggcctttacaaatgcctgttctcaatttatctatgttgaaaagttatcatcaaaagttacacctgagaaattagaagagaatgatactttagtaactgaagattatagttcagctagtggatatataggaaaaaactatgacattaaaagagatacaaaactcaaaaaatttatccttaatgcagtacaccaaaccactgatgacaatgactggagtgatgtaaaaaatattggactctatatcaaacaaaattcttcattttcccctattaaccatggttttaataaattgggtgatttgataaaagctttagaactctttgatgttgcctatacaaacaatagactaacaatgcttattagagaaaaagttggaaaaactcctganataggaaatttaaaagattttgagttttaa

SEQ ID NO: 8330 - protein, 256 aa, Unknown
  Obtained from environmental sample
  misc_feature (1)..(256): Xaa is any amino acid
MDCDYVSHKYAEDIFNDIAKYGTVNIRRAYGNWKDKKLIGWEKLLQQHNIQPIQQFAYTQGKNATDIAMIIDIMDLLYTKELSGVALVTSDSDFTPIVTRILANGLTVYGYGEEKTPMAFTNACSQFIYVEKLSSKVTPEKLEENDTLVTEDYSSASGYIGKNYDIKRDTKLKKFILNAVHQTTDDNDWSDVKNIGLYIKQNSSFSPINHGFNKLGDLIKALELFDVAYTNNRLTMLIREKVGKTPXIGNLKDFEF

SEQ ID NO: 8331 - DNA, 450 bp, Unknown
  Obtained from environmental sample
  misc_feature (1)..(450): n is a, c, g, or t
ttgaatacaaaagaaccaacaaaacacaaccttgcccttatggatttaggttcaatagtttgtactcctacaaatcctttatgtgagaattgtcctttatctataagttgtttagggaaagaaaatccagaactgtacacacaaaaaaagaaaaaagcgtatgagtcattagaattattttacggcatctatggaaaagaagataagatagcccttgttaaaacaacaggaaaaatgtataaaggaatgttagagttacctactgttgatcctatagaggaaaattttattggacagtttaaacatagttatacaaaataccgattaagtgtaaagctttataaaatagataatttaagtgatgaagttatttggattgatttagataaaattgattcaacacctatctcatcattgacaaaaaaggcgttgaaaaattttttattgtaa

SEQ ID NO: 8332 - protein, 149 aa, Unknown
  Obtained from environmental sample
  misc_feature (1)..(149): Xaa is any amino acid
MNTKEPTKHNLALMDLGSIVCTPTNPLCENCPLSISCLGKENPELYTQKKKKAYESLELFYGIYGKEDKIALVKTTGKMYKGMLELPTVDPIEENFIGQFKHSYTKYRLSVKLYKIDNLSDEVIWIDLDKIDSTPISSLTKKALKNFLL

SEQ ID NO: 8333 - DNA, 420 bp, Unknown
  Obtained from environmental sample
  misc_feature (1)..(420): n is a, c, g, or t
atggagtttttcgacttctcggtaggcaacgtaacccgcaaagaaaaagaagaaacagtaaagaaaagagtagagattaatccaaaagacacaacaaaaactgagtatattacttactcggcaaaattaaaaacatacaccgacgaagtagtttctggtggtcggctgaacttaaaaattgtcgatttccaaacaaataatttgcttcgcgacaaccttattcccggctcttttacctgggtaaacgattacgccatttttgcaggagacattgaagcgctcgacaaaaaacagcttgatttaacaaaacgaaaagtgatttctttacctcccgagcaagatttatttattgaatttacaaaacctatttacgagcaattaacaaatcaactcaatggttttttcagaaaatacagataa

SEQ ID NO: 8334 - protein, 139 aa, Unknown
  Obtained from environmental sample
  misc_feature (1)..(139): Xaa is any amino acid
MEFFDFSVGNVTRKEKEETVKKRVEINPKDTTKTEYITYSAKLKTYTDEVVSGGRLNLKIVDFQTNNLLRDNLIPGSFTWVNDYAIFAGDIEALDKKQLDLTKRKVISLPPEQDLFIEFTKPIYEQLTNQLNGFFRKYR

SEQ ID NO: 8335 - DNA, 396 bp, Unknown
  Obtained from environmental sample
  misc_feature (1)..(396): n is a, c, g, or t
atggagagattagaggagagcttaaaagtaagtgaattaaatttttattttgggtttacacaaattttaaataatatcaattttgaactaaaagcaggtgaagttataagtatagtaggtccaagtggtggtgggaaaacaacactattaaaactttgtagtgatcttcttgatgtaacagaaggagagataacaaatagttttacctcatcagcttttgcttttcaagatgcgagactacttccttggaaaacagtagttgaaaatataatgctccctattatagcaacaaaaaaatatactactgcatacaaagaagcctgtgaaatagccctaagatttggacttgaagagaaagattttataaaatatccaaaagatttaagtggggaataa

SEQ ID NO: 8336 - protein, 131 aa, Unknown
  Obtained from environmental sample
  misc_feature (1)..(131): Xaa is any amino acid
MERLEESLKVSELNFYFGFTQILNNINFELKAGEVISIVGPSGGGKTTLLKLCSDLLDVTEGEITNSFTSSAFAFQDARLLPWKTVVENIMLPIIATKKYTTAYKEACEIALRFGLEEKDFIKYPKDLSGE

SEQ ID NO: 8337 - DNA, 441 bp, Unknown
  Obtained from environmental sample
  misc_feature (1)..(441): n is a, c, g, or t
atgaaaaactatattcttcaagatgaaaatgctgtttattttgagtgtggatatagttgtgataatcttattttcttaaacattagtggtgataaatatttcatcactgatgctagatatgagatagaggcaaaactatttgctaaaaattgcgaagtagttgtaacaaatgatttagtaaaagcaacgcgaaaaatactaaaaaaatccaaaatcaaaaaaatctcatttgatccaaatgattttaaacttcttacatataactctttaaaagacaacttagatatgaagtttgttcaaaagccaaatttttcaaaattgaaacgaattatcaaaacagatgatgagataaaacttcttaaaaaagctatgagtttaggaagagaaggttttgagaggttttcttcttatattcaaaaagagggttttaggaaaaagtga

SEQ ID NO: 8338 - protein, 146 aa, Unknown
  Obtained from environmental sample
  misc_feature (1)..(146): Xaa is any amino acid
MKNYILQDENAVYFECGYSCDNLIFLNISGDKYFITDARYEIEAKLFAKNCEVVVTNDLVKATRKILKKSKIKKISFDPNDFKLLTYNSLKDNLDMKFVQKPNFSKLKRIIKTDDEIKLLKKAMSLGREGFERFSSYIQKEGFRKK

SEQ ID NO: 8339 - DNA, 660 bp, Unknown
  Obtained from environmental sample
  misc_feature (1)..(660): n is a, c, g, or t
atgcgtcaggcaaaaaactccatatatttttttcaacaaatccaaaataaaacaggaatctcttttactatatttagtggagatgaagaagcacgactcacacttcttgggcttcaatatagtctaaaaaaggaaagatttaatagtgaaaatattattttggttgatattggtgggggaagtaccgagatagtttttgtaaaagacaatattccaatttatcaaagttttgaagttggtattgttaccctaacacaatctttgaataaaaaagatattttaacccaatttgcaaaagatatacaaaatcatattaactctttagcttttgacatagactctttacagcttgttgcaacagcaggaactccaactacaattgcagcacttaaacacaatttaaattataaaacttacgataaaactataatcaatggtacaaaagtatatatgaaagatttagattattataagaattacttacagtcaatctctttagataaagctgagattttaacaggaacaaatcgcttgcagtatatagggtcagggatagatatttttaagcttatttataaagaattaaaaaaggagttttcagttgtatttgatgaagggttacgagagggcgttgtcgtcgataagtttttgagtttataa

SEQ ID NO: 8340 - protein, 219 aa, Unknown
  Obtained from environmental sample
  DOMAIN (1)...(219): Ppx/GppA phosphatase family
  misc_feature (1)..(219): Xaa is any amino acid
MRQAKNSIYFFQQIQNKTGISFTIFSGDEEARLTLLGLQYSLKKERFNSENIILVDIGGGSTEIVFVKDNIPIYQSFEVGIVTLTQSLNKKDILTQFAKDIQNHINSLAFDIDSLQLVATAGTPTTIAALKHNLNYKTYDKTIINGTKVYMKDLDYYKNYLQSISLDKAEILTGTNRLQYIGSGIDIFKLIYKELKKEFSVVFDEGLREGVVVDKFLSL

SEQ ID NO: 8341 - DNA, 819 bp, Unknown
  Obtained from environmental sample
  misc_feature (1)..(819): n is a, c, g, or t
atgggcggtccttacctccctcagatcctccgaaaacttggttgtgatgtaacagagatcttctgtgatcctgatggcagattccctaatcatcatccggatccaactgtacttaagaacaataaacaccttattgacaaggttgaagagacagaagctgaagttggtttaggaatggatggagatgcggacagaattggtgttattgatgaagaaggtaacatgctttatggtgaccaaattctcaatattatagcccgtgactatctcgagaagaacccaggttctactgttctcgccgacgttaaatgctcaaagaacctctttgatgatattgccgaatatggtggtaaaccaatcatgtacaaaactggtcatgcaaacattaaaaacgagatgcgcaataaaggcatcaaggttggtggtgagatgtccggacatgttttcctcggtgacagataccttggttttgatgatgcaatctatgtatgttgtcgctttgttgagataatgtcacgcactgacatgcctgtgagtaaattcttagctgatcaacctaagatgtataacactcctgaacttcacgtaagtgtacctgaatctgataagtttgcgattgtgaacaaggtcgttcagagcttcaaagatgagaagtatgatgtaaatgacattgatggtgttagaatcacttttgaagatggctggngtctttgcagagcttcaaatactacaccattacttgtacttaggtttgaagcaactaccgagaagagaatgaaagagattgagaaactatttcgcgataagcttgccgggata

SEQ ID NO: 8342 - protein, 273 aa, Unknown
  Obtained from environmental sample
  DOMAIN (193)...(272): Phosphoglucomutase/phosphomannomutase, C-terminal domain
  misc_feature (1)..(273): Xaa is any amino acid
MGGPYLPQILRKLGCDVTEIFCDPDGRFPNHHPDPTVLKNNKHLIDKVEETEAEVGLGMDGDADRIGVIDEEGNMLYGDQILNIIARDYLEKNPGSTVLADVKCSKNLFDDIAEYGGKPIMYKTGHANIKNEMRNKGIKVGGEMSGHVFLGDRYLGFDDAIYVCCRFVEIMSRTDMPVSKFLADQPKMYNTPELHVSVPESDKFAIVNKVVQSFKDEKYDVNDIDGVRITFEDGWXLCRASNTTPLLVLRFEATTEKRMKEIEKLFRDKLAGI

SEQ ID NO: 8343 - DNA, 894 bp, Unknown
  Obtained from environmental sample
  misc_feature (1)..(894): n is a, c, g, or t
ttgaagtggttggaacgcggatgtcaagcccgttcgacgaagccaaagaaccacataaaacgagttgaagaactacttgctaactcttttattatagaaaataagaaaatggatatatccttcgggaatcaacgacttggaaagactattctggaattgaatgagatctccaaatcttatggtgatttgcaattactagataacttctcgcatctgttccagaagaatgaacgattaggtatcttaggaccgaatgggtgtggtaaaacaaccctactaaaggttattacaggtgaaattgatcctgactccggttctttgaaaaaagggattaatactcacttctcgtacttcactcaaactcttgaagagttacctcctgagaagagggtttttgaatatatctctgagtatgctgataatatcaggacaaaagatggcgttctgcattccgctactgagatgttagaaagattccttttcgatggtaagcaccaacagagtaagattaagagtctttccggaggtgagaaaaagcgattatatcttctaaaatctcttatgtttggagcaaacttcataatcctggatgaaccgacaaatgacctggatctgcagacactggaaattcttgaagactaccttgatagtttcaatggttgtgttctcgttgtttcacatgatagatactttcttgatcgtgttgtggactccctcttcattttcgaacccgatagagttcataagtttgcaggtaactattcagattacctacttgtgaaacggtatcagaaagctactgaaaatgagaagaaaaaagaaactcaggtaattagagaagagaaaaaatcaacaaaactctcattaaattgtgcgcgagccgagccaatctga

SEQ ID NO: 8344 - protein, 297 aa, Unknown
  Obtained from environmental sample
  DOMAIN (76)...(245): ABC transporter
  misc_feature (1)..(297): Xaa is any amino acid
MKWLERGCQARSTKPKNHIKRVEELLANSFIIENKKMDISFGNQRLGKTILELNEISKSYGDLQLLDNFSHLFQKNERLGILGPNGCGKTTLLKVITGEIDPDSGSLKKGINTHFSYFTQTLEELPPEKRVFEYISEYADNIRTKDGVLHSATEMLERFLFDGKHQQSKIKSLSGGEKKRLYLLKSLMFGANFIILDEPTNDLDLQTLEILEDYLDSFNGCVLVVSHDRYFLDRVVDSLFIFEPDRVHKFAGNYSDYLLVKRYQKATENEKKKETQVIREEKKSTKLSLNCARAEPI

SEQ ID NO: 8345 - DNA, 312 bp, Unknown
  Obtained from environmental sample
  misc_feature (1)..(312): n is a, c, g, or t
atggcatctgtaaagattgtcaagaacatgaatgaaatagtaataaaaagctcaactgctaatagagtaagactaaaatcagatatatttaaaaattatcaaaatatatcgcttattgagaaaactcttcataatatagttgtagactttagagaaaatactgcctgtaaatcgatagttttaacctattcttctaatacaactttagaaaatatactacaaaaaataaataccctatttccaactataacacaatctatcccagcttcaaatgctatttgtggtgtagaagagtggctgtgtaacttgtaa

SEQ ID NO: 8346 - protein, 103 aa, Unknown
  Obtained from environmental sample
  misc_feature (1)..(103): Xaa is any amino acid
MASVKIVKNMNEIVIKSSTANRVRLKSDIFKNYQNISLIEKTLHNIVVDFRENTACKSIVLTYSSNTTLENILQKINTLFPTITQSIPASNAICGVEEWLCNL

SEQ ID NO: 8347 - DNA, 462 bp, Unknown
  Obtained from environmental sample
  misc_feature (1)..(462): n is a, c, g, or t
atgaaaaaaggtttaactataacttatgatgagtatatgttaaaatttaaaggactaataaaatctttaggactcaataattcagtacaaagagaatatgtattaaaaatattatttgattgtgacaatcacttaagtgcagaagatatagccaaaaaagtaaaagatgttcataatatcaatataggtattgcaactgtttacagaattttagctttacttgaggagttacatataataaaaggtatctcaatagatggttttgagagtaaagtatatgagttaaatcttacctctcatcatgaccatatggtatgtgtagagtgtggaaagattgtagagttttatgatgcggaagttgaaaagatacaagaattagttgcaatagaaaatggttttaaactccaaagtcacaatatgatgctctatggcatctgtaaagattgtcaagaacatgaatga

SEQ ID NO: 8348 - protein, 153 aa, Unknown
  Obtained from environmental sample
  DOMAIN (22)...(143): Ferric uptake regulator family
  misc_feature (1)..(153): Xaa is any amino acid
MKKGLTITYDEYMLKFKGLIKSLGLNNSVQREYVLKILFDCDNHLSAEDIAKKVKDVHNINIGIATVYRILALLEELHIIKGISIDGFESKVYELNLTSHHDHMVCVECGKIVEFYDAEVEKIQELVAIENGFKLQSHNMMLYGICKDCQEHE

SEQ ID NO: 8349 - DNA, 483 bp, Unknown
  Obtained from environmental sample
  misc_feature (1)..(483): n is a, c, g, or t
atgtttaaaactatattatttactattgtatttgttacaaatattttttcacaagaactcattttaggaaaaattgataaatttgatttacctgacttaaacctaaaatctgtaagagctaaaatagacacaggagcaaaaacctcatcactacattgtatgacaataaaaccaaccaaagatggttatgtaaaattcattacacttgatgaaaataataaaaaatttacaggtaactatatcacaaaaaagatttctagaattgccaatgtaaaaagttcaaatggaactatacaaacaagatatttcatacaaacacctattgttatttataataaaacttacaatatagagttgtctttaagctttagaggaagtatgaaatttcctcttttaatagggagagagcttataaaacaagattttttagtagatgttacaaaaaaagatttatcttttaatgctagtcagttgcctcaatag

SEQ ID NO: 8350 - protein, 160 aa, Unknown
  Obtained from environmental sample
  SIGNAL (1)...(17)
  DOMAIN (21)...(155): Protein of unknown function (DUF785)
  misc_feature (1)..(160): Xaa is any amino acid
MFKTILFTIVFVTNIFSQELILGKIDKFDLPDLNLKSVRAKIDTGAKTSSLHCMTIKPTKDGYVKFITLDENNKKFTGNYITKKISRIANVKSSNGTIQTRYFIQTPIVIYNKTYNIELSLSFRGSMKFPLLIGRELIKQDFLVDVTKKDLSFNASQLPQ

SEQ ID NO: 8351 - DNA, 303 bp, Unknown; identical to SEQ ID NO: 7205
  Obtained from environmental sample
  misc_feature (1)..(303): n is a, c, g, or t

SEQ ID NO: 8352 - protein, 100 aa, Unknown; identical to SEQ ID NO: 7206
  Obtained from environmental sample
  misc_feature (1)..(100): Xaa is any amino acid

SEQ ID NO: 8353 - DNA, 684 bp, Unknown
  Obtained from environmental sample
  misc_feature (1)..(684): n is a, c, g, or t
gtgatttatactagtgaagtagctatttttaacgatacgatttattttactcgattaaaagaacctttcatagcaaaagatgctgaaggaaacataatcaatgtttctatgatgggagtggaacaattacctgttaatatgaaagtaggaactactcttgttccttatcatgattatggtgttagcactccaaaacattctacttatactgcagaaagaaaagaacatgtaggtaccacttatagtttaccctatttagattacttaggtagaacttgtagaaccgttacacaccgttataaaactatttctgctgaagtaaaaaaagaagaaacaccctatatgcattctattcataatgttgaaagtgaaataactaaaatagaagaaatagaatttaatggcaaaaagtataatgcttacttaatagaatcaatgacttggtcaaaatttggaacagacatacagtttgaatctgcagatgctaaaattcaaaaacaacaaattaaaaacaatgaaaaagttgaaaaactactcaataaagccatgggcacaaacgatttaggctatttgcaaatgtttgttcaaaaatggtatgttccagaacttggtgttgtaaaacaaattaattatgaccataacggagctattttaacaacaactcagttaatctncattcaataa

SEQ ID NO: 8354 - protein, 227 aa, Unknown
  Obtained from environmental sample
  misc_feature (1)..(227): Xaa is any amino acid
MIYTSEVAIFNDTIYFTRLKEPFIAKDAEGNIINVSMMGVEQLPVNMKVGTTLVPYHDYGVSTPKHSTYTAERKEHVGTTYSLPYLDYLGRTCRTVTHRYKTISAEVKKEETPYMHSIHNVESEITKIEEIEFNGKKYNAYLIESMTWSKFGTDIQFESADAKIQKQQIKNNEKVEKLLNKAMGTNDLGYLQMFVQKWYVPELGVVKQINYDHNGAILTTTQLIXIQ

SEQ ID NO: 8355 - DNA, 819 bp, Unknown
  Obtained from environmental sample
  misc_feature (1)..(819): n is a, c, g, or t
gtgatgaatgataatattaaaatttatccggcaaaatttaaaaatacttaccggcactggatggaaaatgttagagactggtgtatatcgcgtcaattgtggtggggacatcgcatacctgtgtattatattttgggaacgaatgattatgttgttgcaaaaagcattgaagatgctcttattcttgcaaaagaaaaaacagctaattcagaacttacaattaaggatataaagcaagaagacgatgttctggatacttggttttcatcctggttatggccaatttctgttttcgatggaatttcaaatcccgagaatgaagacattaaatattattatcctacaaatgaccttgttacagctcctgaaattttgtttttctgggttgcccgtatgataattgccggttacgaatatcttggtgaaaaacctttcagaaatgtatatttaacaggaattgtacgcgatcaacaaagaagaaaaatgtcgaaatcgcttggtaattcacctgatccaattaaattaattgaaaaatacagtgcagatggtgttcgtgttggaatgctactttgctctcctgccggtggcgatttattatttgaggaaagtttatcggaacaaggaagaaattttgggaataaaatctggaatgctttcaggcttgtgaaacaatgngaggttgatgaaaatattgagcagcccaaagcagcaaaaacagcaattgattggtttagcgctaaactaaaagagaatatccaaaagttagacaagcaatttaaagattttcgtttgtcggaagcattaatgacagttttataa

SEQ ID NO: 8356 - protein, 272 aa, Unknown
  Obtained from environmental sample
  DOMAIN (1)...(201): tRNA synthetases class I (I, L, M and V)
  misc_feature (1)..(272): Xaa is any amino acid
MMNDNIKIYPAKFKNTYRHWMENVRDWCISRQLWWGHRIPVYYILGTNDYVVAKSIEDALILAKEKTANSELTIKDIKQEDDVLDTWFSSWLWPISVFDGISNPENEDIKYYYPTNDLVTAPEILFFWVARMIIAGYEYLGEKPFRNVYLTGIVRDQQRRKMSKSLGNSPDPIKLIEKYSADGVRVGMLLCSPAGGDLLFEESLSEQGRNFGNKIWNAFRLVKQXEVDENIEQPKAAKTAIDWFSAKLKENIQKLDKQFKDFRLSEALMTVL

SEQ ID NO: 8357 - DNA, 843 bp, Unknown
  Obtained from environmental sample
  misc_feature (1)..(843): n is a, c, g, or t
gtgttgatgccggacagaccgacaccggcatccgtttataataccattgaaagtcataatcccaccttgttttttggggttcctaccctctacggcgccatgcttgcccaagaaggagaagtgaatggtgtcagactctgtgtctctgcgggagaagcattgccagccgatatttttcaccggtggaaagataggttcaatgtggacattctggatgggattgggtctacagaagttgttcacatctatatttctaaccggatggataatatccggccgggaagtacggggcagcttgtgccggggtatgaagcaaagattgtggatgacaagttcaatgagctgccccagggagaaattggaacggttctcatcaagggagagagcatcgcagcctactattggaacaagcataaaaaaaccaaggaatccatgctgggagaatggtttaacacagacgataaattctttgtggatgaagaggggttttactattatgtaggtcggtccaatgatatgttaaaggttggaggtatctgggtttcccccattgaagtagaggcgagtctcatcggtcaccctgctgttctagagtgcgctgttgtgccgggcagggatgaagagaatcttgtaaagccctgtgcctatattgttctgaacaatggcttttcatcgtcagaggcgcttgagaaagagattaaaacctatgtaaagaaagacctggcccactacaaatttccccggtggattcattttgtggaggacctgcccaaaacagcaacaggaaaggtgaaacggtttgaattgaaaaaattggaagaagaaaaagtgatatctgcttaa

SEQ ID NO: 8358 - protein, 280 aa, Unknown
  Obtained from environmental sample
  DOMAIN (1)...(201): AMP-binding enzyme
  misc_feature (1)..(280): Xaa is any amino acid
MLMPDRPTPASVYNTIESHNPTLFFGVPTLYGAMLAQEGEVNGVRLCVSAGEALPADIFHRWKDRFNVDILDGIGSTEVVHIYISNRMDNIRPGSTGQLVPGYEAKIVDDKFNELPQGEIGTVLIKGESIAAYYWNKHKKTKESMLGEWFNTDDKFFVDEEGFYYYVGRSNDMLKVGGIWVSPIEVEASLIGHPAVLECAVVPGRDEENLVKPCAYIVLNNGFSSSEALEKEIKTYVKKDLAHYKFPRWIHFVEDLPKTATGKVKRFELKKLEEEKVISA

SEQ ID NO: 8359 - DNA, 489 bp, Unknown
  Obtained from environmental sample
  misc_feature (1)..(489): n is a, c, g, or t
ttgaataatggtataaaatttggaggatgtgatagttggtatagcgatgcttatttaaagcataaataccccgtgcagaacttttctcaaaaatctaataacaatatgtggaaaaactctatgtttgattcacgacaaatacttggaattaataattttgatgatatctatttcattgagcttcctaagatagaagcaatatataaagagtgtgatgtgatgattactcatgtaaacccttcatttttagagaagcacttaagtccatattttcaaggtcaccaatcaaatacattctttagctttgatgggcacaaatacttaaaagagggaaatatgatgtattgggtatttgggcatactcatgatgctatggagtatgaattctacgatgtaaaatgtgtctgtaacccatttggatatccaagtgaaaatcactttggtttaagtgtgaccattaagagtatatatatcaaggaaaataagtga

SEQ ID NO: 8360 - protein, 162 aa, Unknown
  Obtained from environmental sample
  misc_feature (1)..(162): Xaa is any amino acid
MNNGIKFGGCDSWYSDAYLKHKYPVQNFSQKSNNNMWKNSMFDSRQILGINNFDDIYFIELPKIEAIYKECDVMITHVNPSFLEKHLSPYFQGHQSNTFFSFDGHKYLKEGNMMYWVFGHTHDAMEYEFYDVKCVCNPFGYPSENHFGLSVTIKSIYIKENK

SEQ ID NO: 8361 - DNA, 507 bp, Unknown
  Obtained from environmental sample
  misc_feature (1)..(507): n is a, c, g, or t
atgaatattaataatagttttgtttaccctgagaaacattttgatatagtgaaaaatttgctaaatggtaagtttattttacataatgaagatttgtttgaaataataagtgataatttagagttttacattgattttttccaaaaatcctatgattatgagttagtaaaaaatacagaagttatctatgttatctcaagtatcacaagtgaaaaattttctagaaatattatgttggttttagcagttatctcttgggagtttaatcgggaaggtaaaaatatatataccgagctagaaaataagcatactattagaagtatagaagaactgatcaaaaaatcgagttttaaagatagctgtagaggggttaatattgataaactattgaaagatgcagcatctagaaatttagtgttgattcttgataatgaaaagagtataaaatttacgagtgctattaatatatttttagaagctgcgaaggagattgcagaattagattga

SEQ ID NO: 8362 - protein, 168 aa, Unknown
  Obtained from environmental sample
  misc_feature (1)..(168): Xaa is any amino acid
MNINNSFVYPEKHFDIVKNLLNGKFILHNEDLFEIISDNLEFYIDFFQKSYDYELVKNTEVIYVISSITSEKFSRNIMLVLAVISWEFNREGKNIYTELENKHTIRSIEELIKKSSFKDSCRGVNIDKLLKDAASRNLVLILDNEKSIKFTSAINIFLEAAKEIAELD

SEQ ID NO: 8363 - DNA, 891 bp, Unknown
  Obtained from environmental sample
  misc_feature (1)..(891): n is a, c, g, or t
gtggtaattccgacagcgttgtatctgggaatggctatgaactgtcattcaactcttgataaacgaccatgtggagtttgtccatcttgtacaaaatttctctcatttacgcatccggatttgatctatatttttccatttcctcaggagaaaaataaatctgacatatcagttgatggcgagatccgaactgaaaaaacactaatagaatataaagagtatattcaaaataaaattgatactccctggaaaaaatattttttttccaagaatataggaattcgtattgccagtattcgtatgctggaacatagagttctgctttcaccaaatgaaggtacttacaaaatttgtatcatcgaagatgccgatacaatgacaatacaagctgctaatgccttccttaaaactctggaagaaccaccggaagatacgataatcatcctcacaacttcaaaaccgaactcacttttacctacaataatctctcgctgtcagaaacttactttttatccaatcacaaaaactaaaattgaagaagaattattgaaacatcagaacttggaagtgtttgaagcaaagatgatatcacgaatttccagtggaaatatggaaaaagctctcagactaatggaaggtggaaaaattgagatccgagagcagtctttgcaattcttaaactacgttttaactaataatgatctgaaattcattgaactatcaaatcaattcaggacttcgaaaaatctcacgaaattgcaggagttgatctcacaattaattatctggatgagtgatcttgcatactataaacatcaacaatctgagatcacaaatcttgataaaaccgatatcctggaaattctatatactagaaatccgcacatcgaa

SEQ ID NO: 8364 - protein, 297 aa, Unknown
  Obtained from environmental sample
  misc_feature (1)..(297): Xaa is any amino acid
MVIPTALYLGMAMNCHSTLDKRPCGVCPSCTKFLSFTHPDLIYIFPFPQEKNKSDISVDGEIRTEKTLIEYKEYIQNKIDTPWKKYFFSKNIGIRIASIRMLEHRVLLSPNEGTYKICIIEDADTMTIQAANAFLKTLEEPPEDTIIILTTSKPNSLLPTIISRCQKLTFYPITKTKIEEELLKHQNLEVFEAKMISRISSGNMEKALRLMEGGKIEIREQSLQFLNYVLTNNDLKFIELSNQFRTSKNLTKLQELISQLIIWMSDLAYYKHQQSEITNLDKTDILEILYTRNPHIE

SEQ ID NO: 8365 - DNA, 387 bp, Unknown
  Obtained from environmental sample
  misc_feature (1)..(387): n is a, c, g, or t
atgcttaaagaagataaaagatttatgagaaaagagtatgtgtatactctttttgttttgaaatttttacttggaattggtttaatatattggacaatcgctacaacaatgaaatcagatgtggggcaagatgcagataatgcttttttatctacttatncagatgtagatagaaactataataatatgatggaatcaaataaaatatttggtagtaaatataatgtgaagtttttatttaataaaatcagagtagtagggctttctatagaggatgtttttttagctcaaagatctattcaggcgagaaaagatagaaaagatatggtaaatgttggagaagataaatttacaatattagtacaagataagatggaaatgatataa

SEQ ID NO: 8366 - protein, 128 aa, Unknown
  Obtained from environmental sample
  misc_feature (1)..(128): Xaa is any amino acid
MLKEDKRFMRKEYVYTLFVLKFLLGIGLIYWTIATTMKSDVGQDADNAFLSTYXDVDRNYNNMMESNKIFGSKYNVKFLFNKIRVVGLSIEDVFLAQRSIQARKDRKDMVNVGEDKFTILVQDKMEMI

SEQ ID NO: 8367 - DNA, 819 bp, Unknown
  Obtained from environmental sample
  misc_feature (1)..(819): n is a, c, g, or t
atgttgaatttaaaattagattcaattgaagtaaattcaatagagatatatacatctagcagtgtggttgattcaaactattcaaatgatataaaccatattttaaatagattgtatgaattaaagaaaaatagacgtatagacagtgtaaaagatgaagagttaatcaatccaaatgagttagagacacttgttataaaagcgataaaaagtagaaatatctctatcaaatttcaaaaaattgaaaataacggtgaaaatatattagaagcatctgtaaaacttttagatgatagtggcaattacatacatcaaaaagagtttataggtgtaatcaatagattaggtatgagtaaagattttgatatggttatacttgagctattagtgaatatattaaatagatatggtgatataacgctatctatcaaattttctacaatatctattcgtcacaaagagttttatgataggttaatatctcttgtatctgataaaagtgatttatctaaaagattaatttttataattagtgaaaaagattactacagagatataaaaagatttaattcacacctaaataattacagaagattgggcataaaaatagtacttgataattttggtaatgacacaatatcacttgcatattttaaaaacttagatatagacattgttagatttgatggtagtttcacaaaaaatattactcagtttaacagtagaaacttattatttggtttaataactgcagcagaaaaaattgggtataaatcgtggattaaatggttgagaatgaagagagttacaaaaatgcaa

SEQ ID NO: 8368 - protein, 273 aa, Unknown
  Obtained from environmental sample
  DOMAIN (57)...(273): EAL domain
  misc_feature (1)..(273): Xaa is any amino acid
MLNLKLDSIEVNSIEIYTSSSVVDSNYSNDINHILNRLYELKKNRRIDSVKDEELINPNELETLVIKAIKSRNISIKFQKIENNGENILEASVKLLDDSGNYIHQKEFIGVINRLGMSKDFDMVILELLVNILNRYGDITLSIKFSTISIRHKEFYDRLISLVSDKSDLSKRLIFIISEKDYYRDIKRFNSHLNNYRRLGIKIVLDNFGNDTISLAYFKNLDIDIVRFDGSFTKNITQFNSRNLLFGLITAAEKIGYKSWIKWLRMKRVTKMQ

SEQ ID NO: 8369 - DNA, 375 bp, Unknown
  Obtained from environmental sample
  misc_feature (1)..(375): n is a, c, g, or t
atggtgaaaaaaatagtaaatgagtttgatgtagagaaagatttagaaatctggccaaatgagcatgatcgtaactatttgattaagatgacgcttcctgagtttagctgtctatgtcctagaagcggttatcctgattatgcaacgatctacttagagtacacacctgataagctggtagtagagctaaaagctattaaactctatataaactcttttagagatcgtcacatttcacatgagaacagtgcaaatgagatttatgatgttttagataaaaagttaaagccaaaatatatgaaagttgtagcagattataaccctagaggaaatgttcatactgtcatagagatagatagtagtaaaattatttaa

SEQ ID NO: 8370 - protein, 124 aa, Unknown
  Obtained from environmental sample
  DOMAIN (26)...(122): GTP cyclohydrolase I
  misc_feature (1)..(124): Xaa is any amino acid
MVKKIVNEFDVEKDLEIWPNEHDRNYLIKMTLPEFSCLCPRSGYPDYATIYLEYTPDKLVVELKAIKLYINSFRDRHISHENSANEIYDVLDKKLKPKYMKVVADYNPRGNVHTVIEIDSSKII

SEQ ID NO: 8371 - DNA, 441 bp, Unknown
  Obtained from environmental sample
  misc_feature (1)..(441): n is a, c, g, or t
atgaaaaaatataatctaatagtaatttttattttaatacttatcacaataggtgtgagttcatacttctattttttagatattgtatataaagacaaagttgtaaaaagttctgtagatactcttaatgagtttaaaagtattgcatctaatgagattattaaatttgcagatgattatgatctagggcttaaaaatgatgaatacaatgaaattataagtgaattaaatatagaagcttattctcaaatagatggaaaatcactgaaagttgtcggtgtattaaatacagccttctcatatgtgttaatgaaaaaattattaaatattataaaaaatgatgatgtcaagatagaaaatgtctgtattggcacacaatgcagtgaagagagttacagttttgtagtgaaatttagaccatacgcattaaactttaaatag

SEQ ID NO: 8372 - protein, 146 aa, Unknown
  Obtained from environmental sample
  misc_feature (1)..(146): Xaa is any amino acid
MKKYNLIVIFILILITIGVSSYFYFLDIVYKDKVVKSSVDTLNEFKSIASNEIIKFADDYDLGLKNDEYNEIISELNIEAYSQIDGKSLKVVGVLNTAFSYVLMKKLLNIIKNDDVKIENVCIGTQCSEESYSFVVKFRPYALNFK

SEQ ID NO: 8373 - DNA, 696 bp, Unknown
  Obtained from environmental sample
  misc_feature (1)..(696): n is a, c, g, or t
atgcgcttattaggtgtaaaccgtgtaagttttggtgtacagagttttaatgaagataaattaaaatttctaggtcgtgcacatcactcaagtcaagcgattgatgctgttttaaatgctaaaaaagctgggtttaatcatgtctctattgatattatctataatgtgctcggtgacacttatgaacttttgaaaaatgatattgatagagctttttctcttcctatcgatcacataagtgcatattcattgaccatagaagatggaactaaatttcaaaactctccagatgtagcatatgataaccttgaactgactaaatatctgtttgagctgattacatctcatggatttaagcagtatgagatctcaaactttggaaaatattactcaaaacacaatattggatattgggaacataaaaactatatcggtatcggaagcggtgcagtaggtttttttgataatcgtcgtttttatccttctaccgacatatcttcttacataaataatccattatttcaaagtgtagaatcattaacaaatgatgatataaaaatagaaaaaatatttttaggttttagaagttatgttggtgttgataaagatatcttgaatttagatgagataaaacgggcaaatatggcagttgatgaaaaaaaactaactttaaaaaaggaagatactttaatgtga

SEQ ID NO: 8374 - protein, 231 aa, Unknown
  Obtained from environmental sample
  DOMAIN (135)...(230): HemN C-terminal region
  misc_feature (1)..(231): Xaa is any amino acid
MRLLGVNRVSFGVQSFNEDKLKFLGRAHHSSQAIDAVLNAKKAGFNHVSIDIIYNVLGDTYELLKNDIDRAFSLPIDHISAYSLTIEDGTKFQNSPDVAYDNLELTKYLFELITSHGFKQYEISNFGKYYSKHNIGYWEHKNYIGIGSGAVGFFDNRRFYPSTDISSYINNPLFQSVESLTNDDIKIEKIFLGFRSYVGVDKDILNLDEIKRANMAVDEKKLTLKKEDTLM

SEQ ID NO: 8375 - DNA, 780 bp, Unknown
  Obtained from environmental sample
  misc_feature (1)..(780): n is a, c, g, or t
ttggaattaactaaaaagttagagccgaatgtaattattttgaatgtaaatcaaaataatcaaaaattagtagagttagttaaaaagaagtttgcaaattgtgcaattatcgcagtttatgaccagataagtaagttggatattgctagattaaccctaaatggtgtctcatctgtcttaacaaatcctataaaaggtaaagagcttcaaagagagttctataaaataacacaaacacatttctctaatagatatatcttattagagcctaaaaaaattagaagatttgttgataacctatctgctctgccagatagcatgcaaagagtaaaagatgtatgtgattcagaagagagcacaataaaagaacttatagaagtggtcaggactgatcctatattagtaggggtgattttaaatgcttctagaaatcctatttatggattgaaggagattaaaagtattgatcaagcagtcagcgtttttgggaaaagaaccattaaagctcttgttttaatacagagcagtgcaattataggaaaatctgatttagatgtgtatggtattaatgatgcaacattttctaaagtctcttctgaacgattagctttaatgatgctttggtactcaaatgtagatagtactatgttagatattttatgtactacagccgttttaggaaatttgggacaactgctaattgctaaagagataaaagagttaaagaaagagaatgagttaaaaaagctctgcaaggaagagatctcgagccgatcctga

SEQ ID NO: 8376 - protein, 259 aa, Unknown
  Obtained from environmental sample
  misc_feature (1)..(259): Xaa is any amino acid
MELTKKLEPNVIILNVNQNNQKLVELVKKKFANCAIIAVYDQISKLDIARLTLNGVSSVLTNPIKGKELQREFYKITQTHFSNRYILLEPKKIRRFVDNLSALPDSMQRVKDVCDSEESTIKELIEVVRTDPILVGVILNASRNPIYGLKEIKSIDQAVSVFGKRTIKALVLIQSSAIIGKSDLDVYGINDATFSKVSSERLALMMLWYSNVDSTMLDILCTTAVLGNLGQLLIAKEIKELKKENELKKLCKEEISSRS

SEQ ID NO: 8377 - DNA, 870 bp, Unknown
  Obtained from environmental sample
  misc_feature (1)..(870): n is a, c, g, or t
ttgagaagagcagatgcaaaacctaattgtctagagtgtcatactgctaaagagggtgatgttcttggggttattagtatggacttagaggtaagttcaacacgaatggaaggtgtatttatagcttctaagattttgtttatattgttagtaattttagttatctccatttttgtagcaaattattttataagaccatatataaaactttttgatgatttagaaaatgggatattacaagcatatagaggtgatttctcttataaagtggatactacacttaaaaatgaagctggaaaagttgcagatagacttaatgagttatctgaaatctataggtttaaaaagacaattgagttagatgaaaataaaatagtgatatataacagaattgttcatatacttcaaagtaaatttaaaataagtaaatttatattttttgagattaataataaaaataaaataagagaagttattttcgactccgctgatttaaacgggatagagttggatgaaaatgcaaatgtttgtagatcatttagaacttcaaatcatgtatattcaagtgactttgatgatttatgtttaaattgtaaacaaaagttgagtgaatatatttgtttaaattatgacatagatgaggtaaactcattagttttacatatacaatcatcatcacaagaagagataaaaagaataaaagaagagatacccgttataagtaactattttgatatggcaaaacctgttattgaaagtaaaatacttatggatattttaaaagagacaacacttagagacccaatgacaggattatataatagaagatttttaaatgagctgttggatccaatattacaagtcgaatag

SEQ ID NO: 8378 - protein, 289 aa, Unknown
  Obtained from environmental sample
  misc_feature (1)..(289): Xaa is any amino acid
MRRADAKPNCLECHTAKEGDVLGVISMDLEVSSTRMEGVFIASKILFILLVILVISIFVANYFIRPYIKLFDDLENGILQAYRGDFSYKVDTTLKNEAGKVADRLNELSEIYRFKKTIELDENKIVIYNRIVHILQSKFKISKFIFFEINNKNKIREVIFDSADLNGIELDENANVCRSFRTSNHVYSSDFDDLCLNCKQKLSEYICLNYDIDEVNSLVLHIQSSSQEEIKRIKEEIPVISNYFDMAKPVIESKILMDILKETTLRDPMTGLYNRRFLNELLDPILQVE

SEQ ID NO: 8379 - DNA, 813 bp, Unknown
  Obtained from environmental sample
  misc_feature (1)..(813): n is a, c, g, or t
atgcctgtttgtcggttggaatattcaaagctatcanccgaataccaaaaaacagcgatatggagcacagccttaaacggtcaaaaaagtgctgaacattataaccagtggtttagccgatatttaaacaagccttgccagctattattttttggcaacgagtcggaacgctttgttaaaaataaaaatagccaagtaagttttgctgacggttaccctattttgcttatttctcagcaatctctcgcctatttaaaccaaaaactaggcacaaatcatgttgcgtctatggcacaatttagacccaacttagtggtagatggttgcaacagttttgatgaagatacttggaaacatattcgtattggtgaagttgagtttgaagtaactaaaccttgttctcgttgtattttcacgacgataaatccggaaacagctgagaaagatagccaacaagaacctttaaaaacattaaaagcgtttagacaagttgaaagtggcgatgttatgtttggtcaaaacttggtaccgctgaaccaaggacaaattaaaataggcgataaagttgaaataattgaaaccaaacaacctcctatttttgtcattaaagaagctaaacaaatgaaagataaaactagccaagatccaacgccagtaaaagcgaataaaaaacctaagcttcactttagctcttggaaaaaagaagtagttggtaacaacaagggcaccattttagagcaaggtgaagatgccggtttaattttaccttactcatgccgaggtggaatgtgcggacgttgtaaaataaactag

SEQ ID NO: 8380 - protein, 270 aa, Unknown
  Obtained from environmental sample
  DOMAIN (57)...(191): MOSC domain
  misc_feature (1)..(270): Xaa is any amino acid
MPVCRLEYSKLSXEYQKTAIWSTALNGQKSAEHYNQWFSRYLNKPCQLLFFGNESERFVKNKNSQVSFADGYPILLISQQSLAYLNQKLGTNHVASMAQFRPNLVVDGCNSFDEDTWKHIRIGEVEFEVTKPCSRCIFTTINPETAEKDSQQEPLKTLKAFRQVESGDVMFGQNLVPLNQGQIKIGDKVEIIETKQPPIFVIKEAKQMKDKTSQDPTPVKANKKPKLHFSSWKKEVVGNNKGTILEQGEDAGLILPYSCRGGMCGRCKIN

SEQ ID NO: 8381 - DNA, 591 bp, Unknown
  Obtained from environmental sample
  misc_feature (1)..(591): n is a, c, g, or t
gtgctggtaaaatctaccatacttaagctacttacaggcttgttacatcctacacaaggtagtatatttattgataaccatgatgtttcaacaatacatccagtagaaataagaaacaacattggggtaatggttcaagacccatttttgtttaatggtacattaaaagaaaatatcgaattatcaaaacctattagtaaagaaaaaatgatggagttaataacactaactggacttgaagatttagttaaaaaaagtggtcaaggtgatggtataccagttggagaaagaggttctaacttaagtacagggcagagacatttagttggccttgcaagatcaattgcaaatgatcctaaaatactaattttagatgagcctacaacgggcttagatgttggattagaaaagaaacttatgataaatttaaaaaatattgtaaaagacaaaacactaattttaattactcatagatttgcagcattggaactagttgatagaattattgtagtaaatgaaggtaaaattgttgctaatggtcctagagatgcagtattacaagctttacgaaatccagaggtaaaaaaatga

SEQ ID NO: 8382 - protein, 196 aa, Unknown
  Obtained from environmental sample
  DOMAIN (4)...(174): ABC transporter
  misc_feature (1)..(196): Xaa is any amino acid
MLVKSTILKLLTGLLHPTQGSIFIDNHDVSTIHPVEIRNNIGVMVQDPFLFNGTLKENIELSKPISKEKMMELITLTGLEDLVKKSGQGDGIPVGERGSNLSTGQRHLVGLARSIANDPKILILDEPTTGLDVGLEKKLMINLKNIVKDKTLILITHRFAALELVDRIIVVNEGKIVANGPRDAVLQALRNPEVKK

SEQ ID NO: 8383 - DNA, 705 bp, Unknown
  Obtained from environmental sample
  misc_feature (1)..(705): n is a, c, g, or t
atggtttttagagacaggacccttttaaagaagaaaattgatgttgccttgaagggatatcttgataatcctgaaagtgttgagattatacttgttccagaatcatcatcaaaacttctcggtggcgcctttaaagagataattgtggaaatgcgtggcagcgaggtagattctttgaaggtttcctacgcttatcttcgtcttaaagactgcgttcttgattttgaagctcttgtcaggaagcaaaaattcagctttcgtgatgaaggtcataacgattttcttcttcagattacagaagaagacctcaatgcagttttcaaggcaaaaagtaaaaagctcaagctatcaaggccaaaattagacttcagacctgggcatgtccggttttccggtggaataagcttccttttctttaaagataaagtgaaggttgacggccagtttgctgttcgcaatggtgatgaactccattttaatccgaaatggatgaaccttgggatagttcctctgccaggattcattttaagtaagattagaaaaagtattaaccccattgccaccttggaagactttaaatttcagattaaaatggaaattgttgaagtaactgagaacagttttattgtggcatctgaagcaatgcgtgatatggtaatacagctttctgcaatagataataaaagagaatataacgtagaatag

SEQ ID NO: 8384 - protein, 234 aa, Unknown
  Obtained from environmental sample
  misc_feature (1)..(234): Xaa is any amino acid
MVFRDRTLLKKKIDVALKGYLDNPESVEIILVPESSSKLLGGAFKEIIVEMRGSEVDSLKVSYAYLRLKDCVLDFEALVRKQKFSFRDEGHNDFLLQITEEDLNAVFKAKSKKLKLSRPKLDFRPGHVRFSGGISFLFFKDKVKVDGQFAVRNGDELHFNPKWMNLGIVPLPGFILSKIRKSINPIATLEDFKFQIKMEIVEVTENSFIVASEAMRDMVIQLSAIDNKREYNVE

SEQ ID NO: 8385 - DNA, 996 bp, Unknown
  Obtained from environmental sample
  misc_feature (1)..(996): n is a, c, g, or t
gtgaagggtggatataatccggaagagtatgtttctgaacgtatctttgccaagggacatgatggaattgaaattccaatttctcttgtttataaaaaggataccttcaataaagatggatctaatcctctgctacttgaagcttatggcgcttatggtgatagttccgatccttatttttctactattcgattgtctcttttagatcggggtgttgtttgtgctacagcacatgttcgcggtggaaaagagttaggagaaacctggtatgaacagggtaaaatgtttaacaaaaagaatacctttaaggatttcataagttgtgctgaatatttgaagcagaaacattatggcagcaggattgtagctgaaggtggtagtgccggtggtttgctgatgggggctattaccaatatgcgtcccgatctttttatcgggattatcgcagaagtaccttttgtggatattactaacaccatgatggatccaagtttatctgctgtggttagtgagtacgaagagtggggtaatcctaacataaaagaacagtttgattatattcacagctatggcccttatgataatgtctccgctcaagattatccctatatcctggctctaggtgggttttacgataccagagttaatttctgggaacctgccanatgngtggccaaactacgtgcaaccaaaaccgatgataatttgattttgttgaaaaccaatatgaacgccggacatggtggttcttcaggtagatatgattatctgaaagagatagcccttgacctataccttcatgctgaaagtttggggaaattgtggagtaaaagcatttttaaaattatactggtcgcggttgcttttccagcccgtgaacattcctaccttggccatcgaaaacttacctttggtcggtggaccaaaatttttaaaaatggcccccaaaaaacgaaagaagtgtttaatttttattcccccccccgttttttttag

SEQ ID NO: 8386 - protein, 331 aa, Unknown
  Obtained from environmental sample
  DOMAIN (58)...(274): Prolyl oligopeptidase family
  misc_feature (1)..(331): Xaa is any amino acid
MKGGYNPEEYVSERIFAKGHDGIEIPISLVYKKDTFNKDGSNPLLLEAYGAYGDSSDPYFSTIRLSLLDRGVVCATAHVRGGKELGETWYEQGKMFNKKNTFKDFISCAEYLKQKHYGSRIVAEGGSAGGLLMGAITNMRPDLFIGIIAEVPFVDITNTMMDPSLSAVVSEYEEWGNPNIKEQFDYIHSYGPYDNVSAQDYPYILALGGFYDTRVNFWEPAXXVAKLRATKTDDNLILLKTNMNAGHGGSSGRYDYLKEIALDLYLHAESLGKLWSKSIFKIILVAVAFPAREHSYLGHRKLTFGRWTKIFKNGPQKTKEVFNFYSPPRFF

SEQ ID NO: 8387 - DNA, 906 bp, Unknown
  Obtained from environmental sample
  misc_feature (1)..(906): n is a, c, g, or t
atgatcagatcggctcggggccgcactctactatttgatgaaggaaaccgggaattagaaaagctcctcacctctttgaaaggggatctgaaacagagaaattacaaaaatttcacagcaaatgttaaaaaactccaaaaaattgaaaaccattacattagaaaagaaaatattctatttccatatttagagaaaacctggaaacactgccgaccccttactgtaatgtggtctctacatgatgatattcgaatggagctaaaaaaactctacaagcttttggaagtgaaaacagaatttgatcaagatctctttatcattatcggtgatctcttctttctgctttatggcatgatagctaaagaagagttagtaatctatcctattgctatggaaaccctggagaagcacgtttggaatcagattcatcaacaaagttttgagattggatttagctatattgctacaccaccaaaacacattttggattttggacatgaaccggaacttaccgaaaagatctttgatgccgtattcaaatgtgagactggtagtttgaatcaggagcagttagaattgattttggacgctctaccgcttgatcttagttttattgatcataacgatgaagttcgatatttttctaatccaaaagatagatttttccctcgctccccggcaattattggccgcaaagttcagaaatgtcacccgcctgaaagtgtgcacattgttgaaaagatattaaaggcattcagagcaaaaaagcgtgatgaagcttctttctggatacagatgcgcggcaaatttatcccgatccgtttattatgcgattcgccaacagtgcaaggaaaatatctggggctgtcctgggaagtagggaaagggatatcccctgaagattaa

SEQ ID NO: 8388 - protein, 301 aa, Unknown
  Obtained from environmental sample
  misc_feature (1)..(301): Xaa is any amino acid
MIRSARGRTLLFDEGNRELEKLLTSLKGDLKQRNYKNFTANVKKLQKIENHYIRKENILFPYLEKTWKHCRPLTVMWSLHDDIRMELKKLYKLLEVKTEFDQDLFIIIGDLFFLLYGMIAKEELVIYPIAMETLEKHVWNQIHQQSFEIGFSYIATPPKHILDFGHEPELTEKIFDAVFKCETGSLNQEQLELILDALPLDLSFIDHNDEVRYFSNPKDRFFPRSPAIIGRKVQKCHPPESVHIVEKILKAFRAKKRDEASFWIQMRGKFIPIRLLCDSPTVQGKYLGLSWEVGKGISPED

SEQ ID NO: 8389 - DNA, 705 bp, Unknown
  Obtained from environmental sample
  misc_feature (1)..(705): n is a, c, g, or t
ttggtggctgagaactttacacaatgttcaccaaatatataccaagataaggtaagtgattctcaaaatggtatcaatagaaaatatcttatgaataaaatacattttaacgaaaatggaatctctgtatctgcaccttatattagtagtgcctcgggtatgatgtgtgtcactgttgcaaaactagaaaaagacaaaatatattttctagattttaaaatgacactcctactacaaagattaggtctagtggagatacataaacagtttaatatagtcaataaatctttttattttcttatctctatggtgatgattttattatcagtttttacacttggatattcattttttgaatttgttaatgcggttgttattaaagcacatttctctatagaggcaattttcaagccaattgttgctgtaaccttaggattagcgatatttgatcttgccaaaacggtcttagaacaagaggtatttttcaaaagttattcaaaaaatagtaaagctgaatataaagttcttacaaaattttcaataactattatcatcgcacttttaatcgaatcacttatggtagtatttaaaattgctcttgatgattattctcaaatggtaaacgctgtgtatctaataggtggcgtttcttttttaatcatctcactagggatatttatctatttaagtaaaaaaagtgagtag

SEQ ID NO: 8390 - protein, 234 aa, Unknown
  Obtained from environmental sample
  misc_feature (1)..(234): Xaa is any amino acid
MVAENFTQCSPNIYQDKVSDSQNGINRKYLMNKIHFNENGISVSAPYISSASGMMCVTVAKLEKDKIYFLDFKMTLLLQRLGLVEIHKQFNIVNKSFYFLISMVMILLSVFTLGYSFFEFVNAVVIKAHFSIEAIFKPIVAVTLGLAIFDLAKTVLEQEVFFKSYSKNSKAEYKVLTKFSITIIIALLIESLMVVFKIALDDYSQMVNAVYLIGGVSFLIISLGIFIYLSKKSE

SEQ ID NO: 8391 - DNA, 702 bp, Unknown
  Obtained from environmental sample
  misc_feature (1)..(702): n is a, c, g, or t
atgcctaaatttgggtgtattaatgaaagaagaaatcaacttcatgaagtaataagactttcaggtatgaaccttatcattgatgataacgatcatcccttaatcataaaagtaggctcaattcagcaagctagattacaagtatattttattgatagtgaagatttttttgatagaaaagcgatgttacacgatacaaaatcaggaaagctttttgaagataatgatgaaagagctatattttttgctagaggagtattagaaacagttaagaagttaggttgggtgccagatattgttcattgccatggatggatgactagcttggtaccattgtatattaaaacatcttatagtaaagaccctgtttttgaaaatgcaaaagttgtttattctttatacaataatgactttgaaggtaagctgaataaagatttaattaaaaaagcttacatggaaggaatggataaagatagagttaaagaattttctgaaacttgttttgttggtttaaataaagctgctattaattgttcggatgcagttataaaaggtagcgaaaacttaaacaaagatttacaagcagtttttgatgaatttaatggacctaaattagattatcaattaccagaagaatacatcaatgcctattcagatttttatgatgaggtatttgaaacaagtgaagtattaattggataa

SEQ ID NO: 8392 - protein, 233 aa, Unknown
  Obtained from environmental sample
  misc_feature (1)..(233): Xaa is any amino acid
MPKFGCINERRNQLHEVIRLSGMNLIIDDNDHPLIIKVGSIQQARLQVYFIDSEDFFDRKAMLHDTKSGKLFEDNDERAIFFARGVLETVKKLGWVPDIVHCHGWMTSLVPLYIKTSYSKDPVFENAKVVYSLYNNDFEGKLNKDLIKKAYMEGMDKDRVKEFSETCFVGLNKAAINCSDAVIKGSENLNKDLQAVFDEFNGPKLDYQLPEEYINAYSDFYDEVFETSEVLIG

SEQ ID NO: 8393 - DNA, 303 bp, Unknown
  Obtained from environmental sample
  misc_feature (1)..(303): n is a, c, g, or t
atgaacaatcatattaattatgcttgggagaataatgatttagctcaaaaaattcgagatgaagcaaaaaaaatatttcaagaaactgacattttaataattataggttattcattccctccttttaataaagaaattgatagtttattatttagtgaattaaaaaacagagtgactgaaatttattatcaagacattaatgcaagtaaagattacttagacatcttaactaatgattttgagtgtaaaatcaccttaataaaagataaagtagatcatttttatttaccttataccttttaa

SEQ ID NO: 8394 - protein, 100 aa, Unknown
  Obtained from environmental sample
  misc_feature (1)..(100): Xaa is any amino acid
MNNHINYAWENNDLAQKIRDEAKKIFQETDILIIIGYSFPPFNKEIDSLLFSELKNRVTEIYYQDINASKDYLDILTNDFECKITLIKDKVDHFYLPYTF

SEQ ID NO: 8395 - DNA, 351 bp, Unknown
  Obtained from environmental sample
  misc_feature (1)..(351): n is a, c, g, or t
gtggttgttggggaactttctcaagtgattattaatattataaataatgcaaaagatatactattagaaagaaaagttgaagatgcttggataaaagtagggctggagcaaaacagtagttttgtgaccatctgtatagaagataatggaggaggtgttccttctgagattatctcaaaaatatttgacccatatttcactacaaaacataaaagccaaggtacaggcttaggactacatatgagttataaaatagtaacagaaagcttaggtggagagttaaaagtatcaaatagtaccaatggagctctttttaaagttacaattccaatcaatactaaattgtcttaa

SEQ ID NO: 8396 - protein, 116 aa, Unknown
  Obtained from environmental sample
  DOMAIN (1)...(112): Histidine kinase-, DNA gyrase B-, and HSP90-like ATPase
  misc_feature (1)..(116): Xaa is any amino acid
MVVGELSQVIINIINNAKDILLERKVEDAWIKVGLEQNSSFVTICIEDNGGGVPSEIISKIFDPYFTTKHKSQGTGLGLHMSYKIVTESLGGELKVSNSTNGALFKVTIPINTKLS

SEQ ID NO: 8397 - DNA, 513 bp, Unknown
  Obtained from environmental sample
  misc_feature (1)..(513): n is a, c, g, or t
atgaaaaacagtaaactgaaacatttttttgagttggtagttcaagggttattttggcttttgccaatagttgttataaccatgatagttttatggttatatgataagatagatttaattgtaggcggtctctttaatctcataagttttcaccctgagaagaaccaatttttatggtttttgttagttattgctctgttctttgtacttctatattttgttggttattttatggaaacaagattggcaaactggacacaaaaaatattaaataagatacctttttactcaatcataaaagatattgtaggaatatttaattcttcaaaaaaaggcgatacaaaagttttagttgtagcaataagaggattcgcaaatgaaggttacaatataggtctcatgtactctcaaacagaaagtattataaaagatcattatactgtaacactatctcaaacacctatcccaaatggtggatatatgtttctgttcatagagagaaaatcatggtaa

SEQ ID NO: 8398 - protein, 170 aa, Unknown
  Obtained from environmental sample
  DOMAIN (52)...(167): Protein of unknown function (DUF502)
  misc_feature (1)..(170): Xaa is any amino acid
MKNSKLKHFFELVVQGLFWLLPIVVITMIVLWLYDKIDLIVGGLFNLISFHPEKNQFLWFLLVIALFFVLLYFVGYFMETRLANWTQKILNKIPFYSIIKDIVGIFNSSKKGDTKVLVVAIRGFANEGYNIGLMYSQTESIIKDHYTVTLSQTPIPNGGYMFLFIERKSW

SEQ ID NO: 8399 - DNA, 441 bp, Unknown
  Obtained from environmental sample
  misc_feature (1)..(441): n is a, c, g, or t
atggaacgtagaaaatttatcaaaacttgttgctattccgctattggtattccaatagttgctacactcatgcaatcgtgcggaggaatttattatgctactacaaatcgtattaatggaagactggctatttcaaaagatgaattcatccagataaaaaaagataagaaaatcaatagaaaatttgtccttgtaaaaacagaagctcttgattttcctatttgtatttataatacaggggagaatatttattcggcttcattacttaaatgtacacacagaggttgtgaactaaatgttggcggtggaatctatacctgcccttgtcatggaagtgaattctcgattaccggaaaagtattagaaggaccagcagataaaaatttaatgacattcaaaacagaaacagattatgaaaatatttacatctatatctcttaa

SEQ ID NO: 8400 - protein, 146 aa, Unknown
  Obtained from environmental sample
  DOMAIN (50)...(139): Rieske [2Fe-2S] domain
  misc_feature (1)..(146): Xaa is any amino acid
MERRKFIKTCCYSAIGIPIVATLMQSCGGIYYATTNRINGRLAISKDEFIQIKKDKKINRKFVLVKTEALDFPICIYNTGENIYSASLLKCTHRGCELNVGGGIYTCPCHGSEFSITGKVLEGPADKNLMTFKTETDYENIYIYIS

SEQ ID NO: 8401 - DNA, 717 bp, Unknown
  Obtained from environmental sample
  misc_feature (1)..(717): n is a, c, g, or t
ttgcataaatggatagacgaactagagacaaaaatatcaaagcttccaacaaatgacaatgcagggatgcaagcctttttatatctacacattctttttaaaatagactacctactagttccaagatgtgaaatttaccaaaaaataagtaaaaaagtacagatttactttagtgatgaagttacttcaaccgagtctaaaaatgaagagttaagaaaatatgtaaacaaactaaaagagatggagtttaaagatttcagcacaaaattttacaactcaaaatatactttcaacccgatggaaaaaacttcacatgaagaaatctgtaacttcatcagtgaatcactcataaagataagatggtataaaaacaaccgttacactcaaatcataccaaccatttataaatatatctctttttatattctttacagctatgggctaaaccctattaccaagtcacttatgcacactttagtcgaaattcaaaatccagaattttttgaagcacttgactacgcttcactttatgatgaagagaaaaaaacatttgctaaaaaagcaattattgcaaaaatagatgaagctatctcacctcatcatagtcagtacaaagagcttgaatcttttggagataaactgaacttttcatctctgaatgaacttagcaacagctaccttcttcaaataaaacatcttaattttgaggaaatatag

SEQ ID NO: 8402 - protein, 238 aa, Unknown
  Obtained from environmental sample
  misc_feature (1)..(238): Xaa is any amino acid
MHKWIDELETKISKLPTNDNAGMQAFLYLHILFKIDYLLVPRCEIYQKISKKVQIYFSDEVTSTESKNEELRKYVNKLKEMEFKDFSTKFYNSKYTFNPMEKTSHEEICNFISESLIKIRWYKNNRYTQIIPTIYKYISFYILYSYGLNPITKSLMHTLVEIQNPEFFEALDYASLYDEEKKTFAKKAIIAKIDEAISPHHSQYKELESFGDKLNFSSLNELSNSYLLQIKHLNFEEI

SEQ ID NO: 8403 - DNA, 558 bp, Unknown
  Obtained from environmental sample
  misc_feature (1)..(558): n is a, c, g, or t
atggtcaaaaatgtattaataatatttggtattttaatttcaatctttttgatgctggtaatctctttaactaatggatttaagatagataatatatcttttaaaaacattaatatacaaggtttgtatttaaagtatgataaaaaattaataatagatactagaaatatatcaataggctaccagggtaatacaaaaagtgttgatatgaaagttaaattttcaattgaaagcttttttgataattattttattgaggtctatgagtatgttttatttgaaccatacctaaaagcatcaggaaaatttatagttaacttagatgatttgtcacttgagtcaataataaaagatacaaatataaatgattttgcattacaatttaataacaaccttaagtttataacagcccagagttgttttgtaacttttaaggataataatttttattttagttttaaaaaacctatgtatgaaggggttaatttagaggggagtaaagctacaatccttgatttggatagattaaaactagagcttacttctggggataaataa

SEQ ID NO: 8404 - protein, 185 aa, Unknown
  Obtained from environmental sample
  misc_feature (1)..(185): Xaa is any amino acid
MVKNVLIIFGILISIFLMLVISLTNGFKIDNISFKNINIQGLYLKYDKKLIIDTRNISIGYQGNTKSVDMKVKFSIESFFDNYFIEVYEYVLFEPYLKASGKFIVNLDDLSLESIIKDTNINDFALQFNNNLKFITAQSCFVTFKDNNFYFSFKKPMYEGVNLEGSKATILDLDRLKLELTSGDK

SEQ ID NO: 8405 - DNA, 387 bp, Unknown
  Obtained from environmental sample
  misc_feature (1)..(387): n is a, c, g, or t
atggatggaacattaaattatggaaaaaattcacatattactgttacaccacagatgatcaaaaatgatacttcacaatataatacctacaaaagaaaaggggtaccagataatccaatttgtgctattgagtttgaagcaattcgctcagcaatttttccaacaaaaacaagttatctctattttatgagatctacagatggaaatagtcataatttttcctcgtcttacaaagagcatatagcaaatattagaaatgtacaaaagaacaatagaagtcctaaaaagaaacaaactagtataaatcaaacaaaaaaaatcaaacagaaacaacaaacagttgaaaagtcagtttttaaaagggatttaaaagcattatggaaataa

SEQ ID NO: 8406 - protein, 128 aa, Unknown
  Obtained from environmental sample
  misc_feature (1)..(128): Xaa is any amino acid
MDGTLNYGKNSHITVTPQMIKNDTSQYNTYKRKGVPDNPICAIEFEAIRSAIFPTKTSYLYFMRSTDGNSHNFSSSYKEHIANIRNVQKNNRSPKKKQTSINQTKKIKQKQQTVEKSVFKRDLKALWK

SEQ ID NO: 8407 - DNA, 567 bp, Unknown
  Obtained from environmental sample
  misc_feature (1)..(567): n is a, c, g, or t
atgtctctgaaattgaactctttaataaggccctataaattagtaggtgctcaaaatgaagaaataattacaaaacatataatggatagtttaattgcagtaaaagaaattgaaaaacacattgatgataactctcttatttgtgatgtaggctcgggcgccggacttcctggaattcctttggctatttactttgaaaataataaatttactttggttgagagaatgagtagaagagttaattttttaaacaatgctgtattagctctaaaaataaatgatagagttagtgttgtagccaaagatttaaaggatgttaagagtacttttgatttagtaacttttagagcttttcatccactatttgatatagttgatgatattgataaaataacgcataagtcttctattatttgtgcctataaagctaaagtagaaagtgtagaagcggaattaaaaatagtggaagaaacgtgtactagtaaatgggaatatgaaaatatagctttggatattccattcatagatgcccctagaatgttgtgtttgcttactaaaaaaaattaa

SEQ ID NO: 8408 - protein, 188 aa, Unknown
  Obtained from environmental sample
  DOMAIN (1)...(182): Glucose inhibited division protein
  misc_feature (1)..(188): Xaa is any amino acid
MSLKLNSLIRPYKLVGAQNEEIITKHIMDSLIAVKEIEKHIDDNSLICDVGSGAGLPGIPLAIYFENNKFTLVERMSRRVNFLNNAVLALKINDRVSVVAKDLKDVKSTFDLVTFRAFHPLFDIVDDIDKITHKSSIICAYKAKVESVEAELKIVEETCTSKWEYENIALDIPFIDAPRMLCLLTKKN

SEQ ID NO: 8409 - DNA, 438 bp, Unknown
  Obtained from environmental sample
  misc_feature (1)..(438): n is a, c, g, or t
atgcgcgagaacattctgctacacaagcaagtgacaatatttattgttgatgacgacgatgtagatgtccttggtattgaaagagccctcaagaaacttagaatcgctaatcccaccatacgcgccaaagatggtatcgaagcgctagaactgcttcgtaaaaaagccattgccaaaccttatattattttacttgatatcaatatgcctcgaatgggcggaatcgactttttgaaagaactccgtgctgacgatgatctgtgcggaagtgttgtctttatgttgactacttcaagtgacgatcaagataaaatgttagcctacaaaaaaaatgttgctggatacatagtcaaaaaacaagttggcgaatcctttttgaacattgttgatatgttggggcattattggcgtgtagtggagttgccgtacaatgaataa

SEQ ID NO: 8410 - protein, 145 aa, Unknown
  Obtained from environmental sample
  DOMAIN (11)...(140): Response regulator receiver domain
  misc_feature (1)..(145): Xaa is any amino acid
MRENILLHKQVTIFIVDDDDVDVLGIERALKKLRIANPTIRAKDGIEALELLRKKAIAKPYIILLDINMPRMGGIDFLKELRADDDLCGSVVFMLTTSSDDQDKMLAYKKNVAGYIVKKQVGESFLNIVDMLGHYWRVVELPYNE

SEQ ID NO: 8411 - DNA, 492 bp, Unknown
  Obtained from environmental sample
  misc_feature (1)..(492): n is a, c, g, or t
atgaaaatatcactaaaaactatacctcacatatctagtagagttgcaattgatttaaataagagtggtgttgttacgatgacaaaagggcttgaacctgttgcacaagaggctgaaaaaatacttcttcatagcgttcatcaagagatggcacttgaagaaaaagcagatgaaatttgtgaagagaatgaagaagagatagagttccaactcgtggatgagagacaacttttctttatgattaagaaaaaacttgctcctgaatttggtgtgatactaaactatgaagaaagatactcagatatttctcacaaaattttagatgaactttatgaagaagatttaatacattttgatgttacagaaaatcgtattaaaaatattatttacggtgcgattacatctttcattgcagatgcatctgagctcgatgatgctgtgatggaaaaaatcagatcatacaaaaaaagatcattcccgaacgagagttga

SEQ ID NO: 8412 - protein, 163 aa, Unknown
  Obtained from environmental sample
  DOMAIN (1)...(160): Protein of unknown function (DUF507)
  misc_feature (1)..(163): Xaa is any amino acid
MKISLKTIPHISSRVAIDLNKSGVVTMTKGLEPVAQEAEKILLHSVHQEMALEEKADEICEENEEEIEFQLVDERQLFFMIKKKLAPEFGVILNYEERYSDISHKILDELYEEDLIHFDVTENRIKNIIYGAITSFIADASELDDAVMEKIRSYKKRSFPNES

SEQ ID NO: 8413 - DNA, 921 bp, Unknown
  Obtained from environmental sample
  misc_feature (1)..(921): n is a, c, g, or t
atgctttatgttgaagatatgaatttaagtaaaattgtagataaatctatctctggattacttcatgaactagatgcacattcatcgatgcttaacaaagaatcatacaaagatatgcaagttgaaacaaaaggtgaatttggtggtcttgggattgttattggacaaagggatggtgcattaactattatctctcctattgatgatacaccagcatttaaagcaggtgttgaatctggtgacatcatcttaaaaatagatgaacaatcaacaattaatatgacactagaagatgcagttgatttgatgcgaggaaaagttgggactccaattagtatcactgtggtgcgaaaaagtgaaaataaacctattaaaatagatattattagagatattattaaaatacaatctgtatatgcaaaaacaatcaatgaagatatcttgtatttacgaatctcatctttcatggatatgaaagtagctagtgagcttagaaagtatattaaagaacataaagcaaaaacaaaagggattatcctagaccttagaaacaatcctggtgggcagcttggacaagcaattgatactgttgatttatttgtagataaaggaattattgtttcacaaaaaggtcgtgatgaaaaagatgatgaagtgttcaatgcaagttcttctaatacagcaactgatgtaccaatggttgttcttgtaaatgggggaagtgctagtgctagtgagattgttgctggtggacttcaagattcaaaaagagctatcgtaattggagaaacaactttgggaaagggagtgttcaaagaatcatcccaattacagatgatggaagtgaagcaatcaaacttactattgcaaaatactatttacctagtgaaagaacaatccaggcaaaaggataatccctga

SEQ ID NO: 8414 - protein, 306 aa, Unknown
  Obtained from environmental sample
  DOMAIN (38)...(116): PDZ domain (Also known as DHR or GLGF)
  misc_feature (1)..(306): Xaa is any amino acid
MLYVEDMNLSKIVDKSISGLLHELDAHSSMLNKESYKDMQVETKGEFGGLGIVIGQRDGALTIISPIDDTPAFKAGVESGDIILKIDEQSTINMTLEDAVDLMRGKVGTPISITVVRKSENKPIKIDIIRDIIKIQSVYAKTINEDILYLRISSFMDMKVASELRKYIKEHKAKTKGIILDLRNNPGGQLGQAIDTVDLFVDKGIIVSQKGRDEKDDEVFNASSSNTATDVPMVVLVNGGSASASEIVAGGLQDSKRAIVIGETTLGKGVFKESSQLQMMEVKQSNLLLQNTIYLVKEQSRQKDNP

SEQ ID NO: 8415 - DNA, 729 bp, Unknown
  Obtained from environmental sample
  misc_feature (1)..(729): n is a, c, g, or t
atgcgcctttcaagcttgcgtaaagatccaaagaaaaataaaaccctgatcaatttcgatgaatttaacttgctacaaccgaccaaagaaatcgaatcaatcaatgatatttttgctgatgacgatttagatattcttggtgagttggataccgataatatttttaatattaaacatgttccacaaacggtagacatgccagattatattgcgaggcgaaagccttgtaacgattttgatcaatttgaagcgttgtttcttcagtgccatacagacttacaatgtgaaaaacgaataatgcgtccatttgccaaagaacaacaaattaagcagggacatttttttgcactcaaaggcattttggtctacatagctgcggttggcaaaaaggaaaaatcggggggcaaaatgaatgcccgtttacgctgtattttcgaaaacggcaccgaatccgatatgctccttcgttcattggcaagtgaactctacaaagatggtcgccgggttacagaacaccaagaccgccttatggatgatctaaacaatattgcaacagcagattcgcaaacgggtcatatttatgtgcttaaatcgttgagcacgaaccccgacattgccgcaattaaaaatctttacaaaatcggctttagtaccgttccaattaaagagcgtatcaaaaatgcaaaggacgatccaaccctaccttatggctcctgttcatgtcgttga

SEQ ID NO: 8416 - protein, 242 aa, Unknown
  Obtained from environmental sample
  misc_feature (1)..(242): Xaa is any amino acid
MRLSSLRKDPKKNKTLINFDEFNLLQPTKEIESINDIFADDDLDILGELDTDNIFNIKHVPQTVDMPDYIARRKPCNDFDQFEALFLQCHTDLQCEKRIMRPFAKEQQIKQGHFFALKGILVYIAAVGKKEKSGGKMNARLRCIFENGTESDMLLRSLASELYKDGRRVTEHQDRLMDDLNNIATADSQTGHIYVLKSLSTNPDIAAIKNLYKIGFSTVPIKERIKNAKDDPTLPYGSCSCR

SEQ ID NO: 8417 - DNA, 753 bp, Unknown
  Obtained from environmental sample
  misc_feature (1)..(753): n is a, c, g, or t
gtgctcatcaagcaggatctcatcaaaaaaaaggatgggaactgtttacaaatgccgttattaaaaagctttctgaagaaaaatcaagacttgtatttttattatggggtaattttgctatctcaaaatcagcacttatcgatcaaaaaaaacatacgatacttactacagtccacccttcacccctttcggcacatcgtggctttttcggcagtaaacatttctcaaaaacaaatcaaattctcagtcaacaaggcatacaagctattgattggagtgttgaaaaataattctaagatgcaagaatggattgaacttaaaggagtaaaacaaaataatttaaagaatatctccttaaagctaccgcgaaataaatttatagtaattaccggggtttcgggatcaggcaaatcatcattagcctttgaagtaatcaataacgaaggacgaagaaaatactttatcaacctatccgggcaagcacgaaagtatttaaacaaattggaaaaacccgatgcggaaagtattgttggactaacacccactatcgcggtagcacaatcacataacaatcaaagcccacgatcaacagtaggaacaatttctgaaatctacgactatctccgtttgcttttcgctcgggtcggaaaatcagaaatcaggaatttagccattagccgaagtctgttttctttcaatagccccgaaggagcttgccccaactgcaatgggttaggattagaagataaattt

SEQ ID NO: 8418 - protein, 251 aa, Unknown
  Obtained from environmental sample
  misc_feature (1)..(251): Xaa is any amino acid
MLIKQDLIKKKDGNCLQMPLLKSFLKKNQDLYFYYGVILLSQNQHLSIKKNIRYLLQSTLHPFRHIVAFSAVNISQKQIKFSVNKAYKLLIGVLKNNSKMQEWIELKGVKQNNLKNISLKLPRNKFIVITGVSGSGKSSLAFEVINNEGRRKYFINLSGQARKYLNKLEKPDAESIVGLTPTIAVAQSHNNQSPRSTVGTISEIYDYLRLLFARVGKSEIRNLAISRSLFSFNSPEGACPNCNGLGLEDKF

SEQ ID NO: 8419 - DNA, 729 bp, Unknown
  Obtained from environmental sample
  misc_feature (1)..(729): n is a, c, g, or t
atggatataaatactccactattaagaaaaaagaatcgtgttaaaactttggcaggaactcttgaaatagagggtaactttatgggtgaagagaaaattacagctattttagaaggaaaaaaagtattgggtacttatcaagagatacttgaagttgaaggtgccatcaatgcttacaaaaaatttgaaaactatagatatgatagtttagatgatttactaaaagcacataaaattttaatgaaagggattttaacaactgccggaagttttaggggtgtaaatgtaggagttggtagtaaagatggtgttagtcatgttgcaccgccttttagtatagttccaaatcttatgagtgagttgtttgattggttaaaaaatagtgaggaacatatgcttatcaaatcttgtgtatttcactatgaatttgaatttatccatccttttagtgatggaaatggcagaataggaagactttggcaaagtgtgatgctttataattggagagatgtttttgtagtgatgccaacagagagtatagtaagagataatcaagaaaactactataaggcgttagaagattctggaagcataggtgaatctacaccatttatagagtttatgctagaagttatattaaatactgtaataaaagtcggcaataaagtcggtaataaagtccgtaatatattaacggaaaatcaattaaaaattgatggaaaattttga

SEQ ID NO: 8420 - protein, 242 aa, Unknown
  Obtained from environmental sample
  DOMAIN (73)...(198): Fic protein family
  misc_feature (1)..(242): Xaa is any amino acid
MDINTPLLRKKNRVKTLAGTLEIEGNFMGEEKITAILEGKKVLGTYQEILEVEGAINAYKKFENYRYDSLDDLLKAHKILMKGILTTAGSFRGVNVGVGSKDGVSHVAPPFSIVPNLMSELFDWLKNSEEHMLIKSCVFHYEFEFIHPFSDGNGRIGRLWQSVMLYNWRDVFVVMPTESIVRDNQENYYKALEDSGSIGESTPFIEFMLEVILNTVIKVGNKVGNKVRNILTENQLKIDGKF

SEQ ID NO: 8421 - DNA, 531 bp, Unknown
  Obtained from environmental sample
  misc_feature (1)..(531): n is a, c, g, or t
atggtttttaaaacatcaactcgtatcaataagtacatcagtgaaagtggcatgtgttcacgccgggaagctgatcgctatattgagcagggtaatgtgtttattgatggtaagcgtgcgacaaccggtgatcaggtttttcttggcagtattgtcaaggtaaatggccagacgctggagccctacgaagcggacgatctggtgtttattgccttgaataaacccgtgggtattgtcagtacgaccgaggcatcggaaaaaggtaatatcgttgattttgttaatcatggtgtgcgtatttttccgatagggcgtctggacaaggattcacaaggactgatttttttgaccaacaatggtgatctggtcaataagattcttcgggccagcaataatcatgaaaaagaatacctggtcacagtaaacaagccgatnacagatacctttttacagggaatgatgagtggtgtacctatcctgggacaggtaaccaaaaagtgtaaaatgaaaaggttccacctttgtttttaa

SEQ ID NO: 8422 - protein, 176 aa, Unknown
  Obtained from environmental sample
  DOMAIN (68)...(176): RNA pseudouridylate synthase
  misc_feature (1)..(176): Xaa is any amino acid
MVFKTSTRINKYISESGMCSRREADRYIEQGNVFIDGKRATTGDQVFLGSIVKVNGQTLEPYEADDLVFIALNKPVGIVSTTEASEKGNIVDFVNHGVRIFPIGRLDKDSQGLIFLTNNGDLVNKILRASNNHEKEYLVTVNKPXTDTFLQGMMSGVPILGQVTKKCKMKRFHLCF

SEQ ID NO: 8423 - DNA, 345 bp, Unknown
  Obtained from environmental sample
  misc_feature (1)..(345): n is a, c, g, or t
ttgaaacaaatcttccgtcttcatcttcccaacaatgtcttcgattttacaaccaatcatactggcagttttttcattaacgtcaagaaacaatccatcggacaaacgagaacggaaaagcccaaccatggcattatcaaaaaggttgcgatacttttcttcgctcaccctgatatcttccagattttttttcttatccagcagcataatattggcactagacgctatttgcgccaactcttcaaagtagattttattgcactctatctctttatcctcatgtgcagcttgatcaaaaaaagtaacaaacaaggaataatctttttgcagtcgcttactgaataa

SEQ ID NO: 8424 - protein, 114 aa, Unknown
  Obtained from environmental sample
  misc_feature (1)..(114): Xaa is any amino acid
MKQIFRLHLPNNVFDFTTNHTGSFFINVKKQSIGQTRTEKPNHGIIKKVAILFFAHPDIFQIFFLIQQHNIGTRRYLRQLFKVDFIALYLFILMCSLIKKSNKQGIIFLQSLTE

SEQ ID NO: 8425 - DNA, 372 bp, Unknown
  Obtained from environmental sample
  misc_feature (1)..(372): n is a, c, g, or t
atggaagctggtgaatttgatgttactttaaccattgctgataaaaatggcaaaattgatatggattctaccatagcatcaattacggatattactttgtcagatcaactctataaatccaaaaacaatagatttttggtttatcccaatccgctaaaagctactaatataaaaattgttttgccgaaaaataacaatcgatcagaatataaaatcaggattatgaatattcatggctttttagttgatgaattttctagcaaaaaatccaaattccttttaaacctcgaacatctggcaaatggaatgtatttgatttctgtccaaactcaaaatgaattaatggggtcgaaaattattattatgagataa

SEQ ID NO: 8426 - protein, 123 aa, Unknown
  Obtained from environmental sample
  misc_feature (1)..(123): Xaa is any amino acid
MEAGEFDVTLTIADKNGKIDMDSTIASITDITLSDQLYKSKNNRFLVYPNPLKATNIKIVLPKNNNRSEYKIRIMNIHGFLVDEFSSKKSKFLLNLEHLANGMYLISVQTQNELMGSKIIIMR

SEQ ID NO: 8427 - DNA, 900 bp, Unknown
  Obtained from environmental sample
  misc_feature (1)..(900): n is a, c, g, or t
ttggacaaccctggtttagtattgaaaaattatctcactccaatcctaatgatcatgatgactttaagttgtttgaaaattgagattaaaagattaaaaaatataaaaaaagattggtggagattcctgtttattatattaaatattttcatcatccctatattaattatatacttcacaaaaaatatttttcctaaagatatttttataggtcttcttatcaccgcagctataccttcagccatttctgtggttttcatgtcagatttactaaaaggtgatcctagcaaagctcttattaccacaaccctagcccatttatcagctcccattcttactcctggtttagtttggctttttgctcacgaagtaatccaaatcgattttttatccatgtttattttgattactaaactaataattattcctttaatcctagctcaaattataaacagattttctttagttaaaaaaattcacaactacagcggtagtataaatactttcctcctggtcctattaaattggggtataattgctcctgttaaaaatattattattgaaaatcaagctcaattttggaaaatttcccttgttgttactattattattagtcttcaaattattctagccatttggtttggccgtaacaaaaaagaaaaaataacctggagtgtttctagtatgtataaaaatttaggcttagctgcggttattactatgagtactttcgggccattagccacattgggttctgttatctatatgataataacaaatttaatttttgctccccttcaaatctgggcattaaaagaaaataatatgctttcactaggaatagttgggttacccaacgtcggaaaatctactttaatccatgctcttacaaaaaagtag

SEQ ID NO: 8428 - protein, 299 aa, Unknown
  Obtained from environmental sample
  DOMAIN (14)...(193): Sodium Bile acid symporter family
  misc_feature (1)..(299): Xaa is any amino acid
MDNPGLVLKNYLTPILMIMMTLSCLKIEIKRLKNIKKDWWRFLFIILNIFIIPILIIYFTKNIFPKDIFIGLLITAAIPSAISVVFMSDLLKGDPSKALITTTLAHLSAPILTPGLVWLFAHEVIQIDFLSMFILITKLIIIPLILAQIINRFSLVKKIHNYSGSINTFLLVLLNWGIIAPVKNIIIENQAQFWKISLVVTIIISLQIILAIWFGRNKKEKITWSVSSMYKNLGLAAVITMSTFGPLATLGSVIYMIITNLIFAPLQIWALKENNMLSLGIVGLPNVGKSTLIHALTKK

SEQ ID NO: 8429 - DNA, 648 bp, Unknown
  Obtained from environmental sample
  misc_feature (1)..(648): n is a, c, g, or t
atgctttcactaggaatagttggtttacccaacgtcggaaaatctactttattcaatgctcttacaaaaagtaagcaagctgaagcacaaaactatcctttttgtacaatagaaccaaatgttggtgtagttgaggtacctgatgaacgtttggaaaaattaagtaatatttctaaatcaaaaaaaattattcctacggccatagaattttatgatattgctggtctagtcaaaggcgcctcagaaggagaaggtttaggaaataaatttttgtctcacattcgtgaaactgacgctattgttcaagtggtaagaaatttcgaagataaaaacgttactcacgttcatggtaaaattgacccaacggaagattcacaaattataaacctagaacttgtcttagctgattggcaaacagtttctaaacgtttggaaaaaacgaaaaaaaatgccaaaggtacagccctcaaagatgcacaaaaagaaattgacttgttagaaaaaatttataaacagttagaagatggtcaaccagccagaaacctggattacactgatgatgaaaaaataatattaaaagatcttcatcttctaagcatgaaaccaatgttatatgtaatcaatgttgatgaaggggacataggataa

SEQ ID NO: 8430 - protein, 215 aa, Unknown
  Obtained from environmental sample
  DOMAIN (124)...(215): Protein of unknown function (DUF933)
  misc_feature (1)..(215): Xaa is any amino acid
MLSLGIVGLPNVGKSTLFNALTKSKQAEAQNYPFCTIEPNVGVVEVPDERLEKLSNISKSKKIIPTAIEFYDIAGLVKGASEGEGLGNKFLSHIRETDAIVQVVRNFEDKNVTHVHGKIDPTEDSQIINLELVLADWQTVSKRLEKTKKNAKGTALKDAQKEIDLLEKIYKQLEDGQPARNLDYTDDEKIILKDLHLLSMKPMLYVINVDEGDIG

SEQ ID NO: 8431 - DNA, 426 bp, Unknown; identical to SEQ ID NO: 7521
  Obtained from environmental sample
  misc_feature (1)..(426): n is a, c, g, or t

SEQ ID NO: 8432 - protein, 141 aa, Unknown; identical to SEQ ID NO: 7522
  Obtained from environmental sample
  DOMAIN (5)...(133): PIN domain
  misc_feature (1)..(141): Xaa is any amino acid

SEQ ID NO: 8433 - DNA, 801 bp, Unknown
  Obtained from environmental sample
  misc_feature (1)..(801): n is a, c, g, or t
atggtcaagatcggctcgagtgatttatttgggggtttggagaaacagcacacatttttaaaaaaccaaaaaatcattacctatcatcgtgaaaagataagagagtggtttgttaatctattttctggaaaatatgacctatcttattttatgtatctctataaaataggtgaaatacatgtcaaaattggcttacctacacattatgtaaattctgcatttacttttgtcagaacatttgtaatctccagcatagaagagaattttaaaaacaaggaactacatgttcaagagataaaagccgttgaaaaaataattgatataaatcttgatgtattaacaagttcttatagagaagaggagttgagtaaatttttatcgctctcgaaaattgaaaaaaatattctaacaagtttaaaaaaattcaattcatatattaattattttttagctggggcacttgcaattgttgcattttttgctgttgggctatttgcttatgacatttatctactctttttctcagatataggtatagaaaaaggtattattactgttttaggtagtttgcttgttttatgggcaactattgaattaatccacgaagagatcaaccatttacagggcaaaggttttgcaattggcgcatttattatgttagccatggcagcactgattagaaaagtattgatatattctctctcctatgaaaaaggtaaagagcttttgatcatagcagttgtaatagtcagtcttgccatagcatattggcttgtcggctctaaaaaagaacgacaatag

SEQ ID NO: 8434 - protein, 266 aa, Unknown
  Obtained from environmental sample
  misc_feature (1)..(266): Xaa is any amino acid
MVKIGSSDLFGGLEKQHTFLKNQKIITYHREKIREWFVNLFSGKYDLSYFMYLYKIGEIHVKIGLPTHYVNSAFTFVRTFVISSIEENFKNKELHVQEIKAVEKIIDINLDVLTSSYREEELSKFLSLSKIEKNILTSLKKFNSYINYFLAGALAIVAFFAVGLFAYDIYLLFFSDIGIEKGIITVLGSLLVLWATIELIHEEINHLQGKGFAIGAFIMLAMAALIRKVLIYSLSYEKGKELLIIAVVIVSLAIAYWLVGSKKERQ

SEQ ID NO: 8435 - DNA, 723 bp, Unknown
  Obtained from environmental sample
  misc_feature (1)..(723): n is a, c, g, or t
atggaaattatagataatatatcacttgattcaactgtaaaacatatgaaagctataggcaatggttctatatttttttcagattcggctagtgtcttttatatcgcagatttaaatgataaatatagtctaaaaagaaaaaatagaattggttcgcttacaccagaacaacaaaagcttaatatgcatgaattctctgctgatggtagatttttagctataaatgatcgtactaaaaaaagagttaatgtattcgattttcaaaataagaaacctcattttacaatagattggcatgtcggtgaaatagagagcatggcttttgataatcaaaatggatatattgcaacaggtggacaagatggtaaaggctttttatggtcattagctaccggtaaactaacctatgcacttccacctcattcagattttgtaactgctattgcatttaataaaagtggttcttgggttgccactggtagctatgacactaaagtcagagtgacaaacatatacgcagcanataaaacagttgatttagtcggtggtcatacgggatatgttaaatttattaactttatctcagacaatagattagttaccattgataaaaatggtggtgcgggtgtttgggactatgttaatggaaaaatgataaaccagctaagggaaattgactctgatcctacatcggttacatttatttatgatgacacctttatg

SEQ ID NO: 8436 - protein, 241 aa, Unknown
  Obtained from environmental sample
  DOMAIN (91)...(128): WD domain, G-beta repeat
  misc_feature (1)..(241): Xaa is any amino acid
MEIIDNISLDSTVKHMKAIGNGSIFFSDSASVFYIADLNDKYSLKRKNRIGSLTPEQQKLNMHEFSADGRFLAINDRTKKRVNVFDFQNKKPHFTIDWHVGEIESMAFDNQNGYIATGGQDGKGFLWSLATGKLTYALPPHSDFVTAIAFNKSGSWVATGSYDTKVRVTNIYAAXKTVDLVGGHTGYVKFINFISDNRLVTIDKNGGAGVWDYVNGKMINQLREIDSDPTSVTFIYDDTFM

SEQ ID NO: 8437 - DNA, 441 bp, Unknown
  Obtained from environmental sample
  misc_feature (1)..(441): n is a, c, g, or t
atgaaaaagcgtgttatgagcagtatgaaaagtggcggtgtagttgcagctgcaaatgtatgtataaaagaggcttatccaattacagacagtgttaataaaactcttaaagatggcatgagcattaaacgtatatctaatagatatagaaatcctgcaaataagcctagtgaagatgaaaaaaagatacttgattcattaaatgagttagttgaaaatggtgcagttgttatgccttatattttaactgagtcaaaagagtcatataagctttataagcctcttctgatagataagccaatctgtatgaaatgtcatgggaatatttcaaaagatagtgagctttctaaaatattatcaagtacatactctgatgataaatcactgaatcataaaatgggtgatttaagaggtgcagttgtagttactactaaaaagtag

SEQ ID NO: 8438 - protein, 146 aa, Unknown
  Obtained from environmental sample
  SIGNAL (1)...(16)
  misc_feature (1)..(146): Xaa is any amino acid
MKKRVMSSMKSGGVVAAANVCIKEAYPITDSVNKTLKDGMSIKRISNRYRNPANKPSEDEKKILDSLNELVENGAVVMPYILTESKESYKLYKPLLIDKPICMKCHGNISKDSELSKILSSTYSDDKSLNHKMGDLRGAVVVTTKK

SEQ ID NO: 8439 - DNA, 357 bp, Unknown
  Obtained from environmental sample
  misc_feature (1)..(357): n is a, c, g, or t
ttgatgctagagtttaaaatagattatatatttttatctggatatatgaaaaaaatcgaaaaaaatcttttaaaagaatttccaaataaaattataaattcacacccagccttacttcctaaatttggtggaagtgggatgtatggaagatttgtgcatgaggctgttataaaagctaaagagaaagaatcaggttgtacaattcattatgtaaatgaaaattatgatgaaggagagtatattttgcaaaaaagtatatctttacttcaagatgaaaaagtagaaacacttgaagagaaaataaaagagcttgaaaaagcagctgtagtagaagcatttttaaaattgacaatttag

SEQ ID NO: 8440 - protein, 118 aa, Unknown
  Obtained from environmental sample
  DOMAIN (3)...(113): Formyl transferase
  misc_feature (1)..(118): Xaa is any amino acid
MMLEFKIDYIFLSGYMKKIEKNLLKEFPNKIINSHPALLPKFGGSGMYGRFVHEAVIKAKEKESGCTIHYVNENYDEGEYILQKSISLLQDEKVETLEEKIKELEKAAVVEAFLKLTI

SEQ ID NO: 8441 - DNA, 564 bp, Unknown
  Obtained from environmental sample
  misc_feature (1)..(564): n is a, c, g, or t
atgaatatctcatatggttcagcaaccgctgctattgctgatattattgaaaagtttgcaaagttaagtattccaaaaattgccacattatcaagtgaaaactttaaagactatattaaaaataaagtagatgaataccatgtntgctatttggttagtcaatcaattgatgggaaactttcaggtgaaaatctctttttagtggatgacaaatctttaaagaatttagctttggagtttggtttaagtgaagtggaaatagatgaggatgaattaaaagatgtggttttggaaattacaaatattatttcatcaacaacttcaagtaaactcgctgaacttatagaaactgatattctatttgctcctcctcatgtggaaattattgactctgcccaagatttaggagattattataaagtagaatacaatcatataattataatctcaacattaatagagtttgaagaacagaatattaatagtgagttagtaataatgttaaaagatgattctattacatatttgagagacgcattagacaaagttatggatgagtattaa

SEQ ID NO: 8442 - protein, 187 aa, Unknown
  Obtained from environmental sample
  DOMAIN (91)...(128): CheC-like family
  misc_feature (1)..(187): Xaa is any amino acid
MNISYGSATAAIADIIEKFAKLSIPKIATLSSENFKDYIKNKVDEYHVCYLVSQSIDGKLSGENLFLVDDKSLKNLALEFGLSEVEIDEDELKDVVLEITNIISSTTSSKLAELIETDILFAPPHVEIIDSAQDLGDYYKVEYNHIIIISTLIEFEEQNINSELVIMLKDDSITYLRDALDKVMDEY

SEQ ID NO: 8443 - DNA, 801 bp, Unknown
  Obtained from environmental sample
  misc_feature (1)..(801): n is a, c, g, or t
atgatttttctctacaaaggaatagactctagcggtaaaaaaatcagcgataaactagaagcctcatcattagcagaagcaaaaagtaaactgcgttcacaaaagatcatttatcagagtattaatgaagatagtgaatccatcttcaactccatctcatttagtagaaaatatagaatctctccaaaagagttatcaaacctctcacgagagttagctatgtatatacgttcaggtatgaatatagtaagtgcactcagagtagttcagtctcactatgatgataacaaaaaactatcactttttttaaaaactgtaagcacctatttagatgaaggtaaaaacttttttacggcattagagaatcaaaatgttgtaatactacctccattttttgtgcaatctattaaggtgagtgaatcaagcggcattttagatgaagtgctcattgagttatcacgttttttaaaagaacaagagaagattgcaaaagagattaaaagtgcttttgcttatcctgctttcatgcttggagtatccattctaatggttgcatttatgttggcatttgttgtacctcaaataacatccatgtttgatagcatggatcaaaaactccctcctataacaatttttgtaatagctcttggtgacttttttaatgatcactacattgcgatgctgattattatatttacacttatctcaactttttctattatgatgagtattaatgagagattcaaatatgtcgttgactctatcatattgaaattaccgctgtttggaactatcgctctt

SEQ ID NO: 8444 - protein, 267 aa, Unknown
  Obtained from environmental sample
  DOMAIN (66)...(193): Bacterial type II secretion system protein F domain
  misc_feature (1)..(267): Xaa is any amino acid
MIFLYKGIDSSGKKISDKLEASSLAEAKSKLRSQKIIYQSINEDSESIFNSISFSRKYRISPKELSNLSRELAMYIRSGMNIVSALRVVQSHYDDNKKLSLFLKTVSTYLDEGKNFFTALENQNVVILPPFFVQSIKVSESSGILDEVLIELSRFLKEQEKIAKEIKSAFAYPAFMLGVSILMVAFMLAFVVPQITSMFDSMDQKLPPITIFVIALGDFFNDHYIAMLIIIFTLISTFSIMMSINERFKYVVDSIILKLPLFGTIAL

SEQ ID NO: 8445 - DNA, 819 bp, Unknown
  Obtained from environmental sample
  misc_feature (1)..(819): n is a, c, g, or t
atgtatgagttatggttccctctggagaggcatcaaaaagctgctcttataatcatgggaagtgaaggaagaggtgaacaacttctaagaagtgatcaagataacgctttaatattaaaagatagtaagtacgaaaatgagtttgaaacttacatgaagctctttaacaaaaatttgagtgaaataggatttccacagtgtaagggagatgttatggtaacaaatgatttttggagaaaagatattgcttcatataaaaaagatattgaaagttggtgcgatagtttaaacgcatcttcacttcaagcactctctatatttttagacgcttcatgtgttgcaggagagtgctctttacttgatgagcttagagagcatctatttcaagttttcagcactagaagtgatattttgtcacatgccgcgaaacctgtactcttttttgagacgcctctgagcctattttctaactttattgttgataacaaagaacatgcaagcgaactggatattaaaaaaggtgggattttcgctattgtacatggagtaagaattttatctttagagcataagatagatgagacaaacactacaaacagaattaaaaaattaaataatctctcggtaatagacaagtcatttgcaactgaacttatagaggcgtatgacacgcttttaaccataagattgaaagctatgatggctcatgacgttagcgatgttgaaaatttaaactacatcaatcctaaaaatttggataatgtagatagaaatctactcaaagacagttttaaagtgttaacaaatcaaaaagtttga

SEQ ID NO: 8446 - protein, 272 aa, Unknown
  Obtained from environmental sample
  DOMAIN (8)...(267): Putative nucleotidyltransferase DUF294
  misc_feature (1)..(272): Xaa is any amino acid
MYELWFPLERHQKAALIIMGSEGRGEQLLRSDQDNALILKDSKYENEFETYMKLFNKNLSEIGFPQCKGDVMVTNDFWRKDIASYKKDIESWCDSLNASSLQALSIFLDASCVAGECSLLDELREHLFQVFSTRSDILSHAAKPVLFFETPLSLFSNFIVDNKEHASELDIKKGGIFAIVHGVRILSLEHKIDETNTTNRIKKLNNLSVIDKSFATELIEAYDTLLTIRLKAMMAHDVSDVENLNYINPKNLDNVDRNLLKDSFKVLTNQKV

SEQ ID NO: 8447 - DNA, 702 bp, Unknown
  Obtained from environmental sample
  misc_feature (1)..(702): n is a, c, g, or t
atgctcagtgacactcaactgcaaaaaagctcacatgaacagtggttacttaatgctctggtagtgcttgatattgttgtactgattgctatatttttgattatattgaaaattctttctccattaaaagtactaattgctaaaatgcaaaaattcacacaaggcgactttaagagtcgtatagaggtaaaaagcagtgatgagattggaaatgtagcaaatacttacaacaccatggcgcaaaatatagaaaatctcataacttcaagagaggagtttttaagagatatcagccatgaacttagaactcctatctctaaaggactttttgctgttgagacacttgaggattcgcaagctaaacgtcttattgaaaaatcattctccgagcttgaacgtctgagttcagagcttttagagatagaaaaattacatgccatgaacactttgcagagtgaaagttttaaagctgaaacactcattttagaatcactatcaagacttattttagaagatgaatctaaaattgagattgatatcaaagataattttttaattgtgggtgatctgaattatctctctcttgcacttaaaaatttgattgataacgctattaaatatacaaatgagtttcctgtatatatagtcgctgataaagataaaatagtagtaaaaaccaaggtgaaaaacttctccatgata

SEQ ID NO: 8448 - protein, 234 aa, Unknown
  Obtained from environmental sample
  DOMAIN (89)...(147): His Kinase A (phosphoacceptor) domain
  misc_feature (1)..(234): Xaa is any amino acid
MLSDTQLQKSSHEQWLLNALVVLDIVVLIAIFLIILKILSPLKVLIAKMQKFTQGDFKSRIEVKSSDEIGNVANTYNTMAQNIENLITSREEFLRDISHELRTPISKGLFAVETLEDSQAKRLIEKSFSELERLSSELLEIEKLHAMNTLQSESFKAETLILESLSRLILEDESKIEIDIKDNFLIVGDLNYLSLALKNLIDNAIKYTNEFPVYIVADKDKIVVKTKVKNFSMI

SEQ ID NO: 8449 - DNA, 708 bp, Unknown
  Obtained from environmental sample
  misc_feature (1)..(708): n is a, c, g, or t
ttgaaggactttgaggagtttttaaagttacgaagatttgtacttaatggtaaaactatcccgtatctattctttactaatggttacggggattctgttgacatctctgaagctcagttaaatggttcttttagtgcaaagattaaacgttacatgataaagcaaattgatagtgagttacctgctgtaacatcacgttcttccagacgagataatgctcgtgatgccttgcaagagcatggtttagaaactgcattgtcagtattgcaaaatacatctaatgtgtttattgaccactataatggagagactgccgaagaaatggcttcaggggtctcaaatttcttaaaaagtatgcatgatacagttactagtgatgatccaattaacaaaaaagaagaacatgctatgggcggctgtaaagtcaaaggcctaaaagaacctgtgacttttagcgaagatagccctatcaaagcaaattgtgatgatccaaaaagctgcatattttgcgaatactatgtgacttttcctgaaacagaatatatacgtaagcttttgagtcttcaatatataatagaaaatacagcctatgacagagcagaaaatgaagacttctatgacaaaaagatgaagccttggctagatagaatagaatacatcctgaatcaaatgaaagaaaaagaacccaaatctgagcaaatgatttga

SEQ ID NO: 8450 - protein, 235 aa, Unknown
  Obtained from environmental sample
  misc_feature (1)..(235): Xaa is any amino acid
MKDFEEFLKLRRFVLNGKTIPYLFFTNGYGDSVDISEAQLNGSFSAKIKRYMIKQIDSELPAVTSRSSRRDNARDALQEHGLETALSVLQNTSNVFIDHYNGETAEEMASGVSNFLKSMHDTVTSDDPINKKEEHAMGGCKVKGLKEPVTFSEDSPIKANCDDPKSCIFCEYYVTFPETEYIRKLLSLQYIIENTAYDRAENEDFYDKKMKPWLDRIEYILNQMKEKEPKSEQMI

SEQ ID NO: 8451 - DNA, 594 bp, Unknown
  Obtained from environmental sample
  misc_feature (1)..(594): n is a, c, g, or t
ttgtttcgcacggaaaaagagatgccagaacttgaacggaaagctctaaaactttgccgtggtaaagttctggatgtaggagccgcagccgggtgtcactcaattttcttgcaaaaaaaaggatttaatatcaccgctttggaaaagtcggaattggctgttgaagtactgcaaaagcgcggcattcaaaaagttaattgtgccgatatttattcttttttagataaaaaatacgatacaattttattattaatgaatggaaccggaattggtgaaaccatcgaaggattaaaaagactgctactccatttaatatcgctgctaactgaaaatggacagattctaattgattcatctgacattaaatacctttttgaagaggaagatggttcgatgtggattgaccttacaaatgaaaaatattatggcgagatggaatataaagtaagctataaaaaatcaactgctaaatttaattggctttttattgattttgattcattgaaaaaactcgcaaatgaagttgggttaaattgcctattaattgaagaaggcgaacattttgaatatctggcacaattaaaacaattataa

SEQ ID NO: 8452 - protein, 197 aa, Unknown
  Obtained from environmental sample
  misc_feature (1)..(197): Xaa is any amino acid
MFRTEKEMPELERKALKLCRGKVLDVGAAAGCHSIFLQKKGFNITALEKSELAVEVLQKRGIQKVNCADIYSFLDKKYDTILLLMNGTGIGETIEGLKRLLLHLISLLTENGQILIDSSDIKYLFEEEDGSMWIDLTNEKYYGEMEYKVSYKKSTAKFNWLFIDFDSLKKLANEVGLNCLLIEEGEHFEYLAQLKQL

SEQ ID NO: 8453 - DNA, 723 bp, Unknown
  Obtained from environmental sample
  misc_feature (1)..(723): n is a, c, g, or t
atgcaacaacaagtgacaatatctccatatatgagagaagaagatacagtaatgatctccatatatgatatcagtgaacttcatgaaacaaaaataagtttagaacgtgaaatagataaagtaaactatctgaatgaagttttagaatctgatcaagagataattgaccaaaatattatgacaatgaaaacttcagtagatggaactatagttgatgttagtacactattttgtaactttttcgagtataaaaaagatgatcttataggtaaacaagcatctttgttaaaaagtggcaacctcccagataccatatataaagagatgtgggagatactactcaataaaaaatcatggtgtggtgaaatagagaacaaaactgcaaatggcggatcaaaatgggtccaatctcgaattacccctatttttgacaattgcggtgaactgctggaatttaatgctgtctaccatgacatcacaaataaaaaacttctagaagagctatatattacagatccattgacaaaactatataatcgtgcacattttgatgacattatgaactcaattaccaaacatcagagaaaagcagatactgatttttctttgattattactgatgttgatcactttaaatctataaatgacacctatggtcatcaagttggtgatgaagcactaaaagatgtggcaaatgctcttaagagtgtacttagagataat

SEQ ID NO: 8454 - protein, 241 aa, Unknown
  Obtained from environmental sample
  DOMAIN (120)...(162): PAC motif
  misc_feature (1)..(241): Xaa is any amino acid
MQQQVTISPYMREEDTVMISIYDISELHETKISLEREIDKVNYLNEVLESDQEIIDQNIMTMKTSVDGTIVDVSTLFCNFFEYKKDDLIGKQASLLKSGNLPDTIYKEMWEILLNKKSWCGEIENKTANGGSKWVQSRITPIFDNCGELLEFNAVYHDITNKKLLEELYITDPLTKLYNRAHFDDIMNSITKHQRKADTDFSLIITDVDHFKSINDTYGHQVGDEALKDVANALKSVLRDN

SEQ ID NO: 8455 - DNA, 786 bp, Unknown
  Obtained from environmental sample
  misc_feature (1)..(786): n is a, c, g, or t
ttgatagaaaaacttacatattttgaatatactacacttattggattgtatctcagtaataatttggaatttttagttttagaagctggtcttggtggagagtttgatgcaacaaatgttgttgtaaatgatttaacggttataacaacaattgatcttgatcatcaatcgtttttaggtgatacaatagaaaaaatagctagtacaaaactgagaagttgtgataatgcttttataatatcttctcagataaataatgaagtatatgaggtaaaaaatctacttttaaaagataaaaaagagattgagctgaaaaaatatccactctctgtggaatctaataatttaccacaatatttacaaaataatttgcaagtagctttaagtgtgttggagtatttaaaaattgactgcaataactatataatacctaaactttttggaagatttcaaaaaatagcagataatattactattgatgttggacataatccacttgccgcaaaagctatcgcgcaagagctaaaaaaatcagataaaaaagttattttgatatacaatagttacaaagacaaggattataaagaggttttgagaatattgcaaccatttataaaagagatacaaattatacaatgtgatgataaaagaatgctcaatacaaaagaattagagtgttttataaagagtttatgcttaaatataaaatattttgatataatgaatataagaagagataatcattatttagtatttggttcgtttattgtggttgaaaatttttaa

SEQ ID NO: 8456 - protein, 261 aa, Unknown
  Obtained from environmental sample
  misc_feature (1)..(261): Xaa is any amino acid
MIEKLTYFEYTTLIGLYLSNNLEFLVLEAGLGGEFDATNVVVNDLTVITTIDLDHQSFLGDTIEKIASTKLRSCDNAFIISSQINNEVYEVKNLLLKDKKEIELKKYPLSVESNNLPQYLQNNLQVALSVLEYLKIDCNNYIIPKLFGRFQKIADNITIDVGHNPLAAKAIAQELKKSDKKVILIYNSYKDKDYKEVLRILQPFIKEIQIIQCDDKRMLNTKELECFIKSLCLNIKYFDIMNIRRDNHYLVFGSFIVVENF

SEQ ID NO: 8457 - DNA, 561 bp, Unknown
  Obtained from environmental sample
  misc_feature (1)..(561): n is a, c, g, or t
ttgcgaacagttctagagagtaagtatctgcttaaaaaattagaagagacttctcttcgtgatgcaccgacaggactatacaacaggagatatttagataaatttgttgagacctcattaaataataaagatctaaattttacggtacttatgatagatattgacttctttaaacaggtgaatgatcaacacggacatgatattggtgataaggttatcgtgggattagcagatgtgcttaaaactactataaaaggttctgatctgatatttagatttggaggagaggagttcttagttatcttatatgatatatccaaagataatgcaaataaaatagctcaaaatattcgtatcacattttctaaaaaaagttttacaacatcaagtaaaaatattcaaaaaacactcagtataggtttatcgtcttttcctactgatgcagacaacccttggcaagcgattaaatttgccgacattgcactatatgaagcaaaaaacagcggacgtaataaagttgttatgtttgaaccatctttaaatcaaaatgaagagtattag

SEQ ID NO: 8458 - protein, 186 aa, Unknown
  Obtained from environmental sample
  DOMAIN (14)...(172): GGDEF domain
  misc_feature (1)..(186): Xaa is any amino acid
MRTVLESKYLLKKLEETSLRDAPTGLYNRRYLDKFVETSLNNKDLNFTVLMIDIDFFKQVNDQHGHDIGDKVIVGLADVLKTTIKGSDLIFRFGGEEFLVILYDISKDNANKIAQNIRITFSKKSFTTSSKNIQKTLSIGLSSFPTDADNPWQAIKFADIALYEAKNSGRNKVVMFEPSLNQNEEY

SEQ ID NO: 8459 - DNA, 681 bp, Unknown
  Obtained from environmental sample
  misc_feature (1)..(681): n is a, c, g, or t
atggatgggattgtttttaaagtacgtgagaactcaaaagtaatcaacaaaactatctatatagctgttggcttgcgaaaagatggattaaaggaagttttgggcttatggcttggtcgtaatgaaacttctgcattttggatgtctgtattaactgatatgaaggctagaggcgttcaagacatcttaattactgcaacagataatcttaatggttttactgataccataaaagctgtcttccctcaatctacaacacaaatttgtgttgtgcaccaaattagaaatgctacaagatatgtcgtttggaaagataaaaaagagttcactaaggacatgaaggaaatatataatgctcctactaaagaggcagcaagacatgctttgaatgacttctctacaaaatggaacagcaaatactcctatgctatcaaaagctgggaaaacaactgggataatttaactgctttctttgagttccccgttgaaatcagaaaaataatttacactactaatctaattgaaaaccttaatggcaaaatcagaaaatacactaaaaataagctctctttcccaactgacgaggcagtattaaaatcaacttttctcgctcttagagagtctactaaaaaatggactatgcccatcagaaattggggaattatccctaatcatttttaa

SEQ ID NO: 8460 - protein, 226 aa, Unknown
  Obtained from environmental sample
  DOMAIN (1)...(215): Transposase, Mutator family
  misc_feature (1)..(226): Xaa is any amino acid
MDGIVFKVRENSKVINKTIYIAVGLRKDGLKEVLGLWLGRNETSAFWMSVLTDMKARGVQDILITATDNLNGFTDTIKAVFPQSTTQICVVHQIRNATRYVVWKDKKEFTKDMKEIYNAPTKEAARHALNDFSTKWNSKYSYAIKSWENNWDNLTAFFEFPVEIRKIIYTTNLIENLNGKIRKYTKNKLSFPTDEAVLKSTFLALRESTKKWTMPIRNWGIIPNHF

SEQ ID NO: 8461 - DNA, 309 bp, Unknown
  Obtained from environmental sample
  misc_feature (1)..(309): n is a, c, g, or t
atgaaaaagtatttagctcttttcgcttttatattgctagttttaagctcatgcattgatcaaaaaaccagtgatacagatactgcaatattggctttttataatgttgaaaatttattcgacaccattgataatccaaatatcaatgacaaggattttttaccagatggtcgccaaaagtggaatactaaaaaatacaatcacaagatcaaaaatctttcagatgttttacttttcattgacagtactgatcctccagccattatcggtttagctgaagttgagaataagaagttttatttgacttaa

SEQ ID NO: 8462 - protein, 102 aa, Unknown
  Obtained from environmental sample
  SIGNAL (1)...(17)
  misc_feature (1)..(102): Xaa is any amino acid
MKKYLALFAFILLVLSSCIDQKTSDTDTAILAFYNVENLFDTIDNPNINDKDFLPDGRQKWNTKKYNHKIKNLSDVLLFIDSTDPPAIIGLAEVENKKFYLT

SEQ ID NO: 8463 - DNA, 300 bp, Unknown
  Obtained from environmental sample
  misc_feature (1)..(300): n is a, c, g, or t
atgaaatacagctatataaaaccaagaaaaaagaatgttttttcatcagaattacagttgctttttagtttttttagcataactatttttatgctgttcttgacctatctttttttagtttttaaagactacagattttctcaaaatattagcaacatagctcaaaaaagagttgcgttggagagtgatataaccaatatggatgcgcagattacttttatagaaaaagaagttcttttacatgaaagaatcagcacaaaaaatacagttttaaaagattctattgccaaccctttttga

SEQ ID NO: 8464 - protein, 99 aa, Unknown
  Obtained from environmental sample
  misc_feature (1)..(99): Xaa is any amino acid
MKYSYIKPRKKNVFSSELQLLFSFFSITIFMLFLTYLFLVFKDYRFSQNISNIAQKRVALESDITNMDAQITFIEKEVLLHERISTKNTVLKDSIANPF

SEQ ID NO: 8465 - DNA, 606 bp, Unknown
  Obtained from environmental sample
  misc_feature (1)..(606): n is a, c, g, or t
atgcaagatagtgaacttcaagataaaatacaaaaattaaatttacattcggataaagtaaatagtgactttagcatgcttgagggttatatcagccatatctcatttattaagtctcaaatagctatacatggcttaaaaagtaaagatgtagatgagatactttcactacatgacaacattaaaaacatttatcataaatgtaaaagcactatcaatattatgagtgaaagtataaaaacccttcctcttgatgtactacatacaaataagtgtgttatgattcattcacctgcatatattttaaaagctctacaaaagtgtcaaaaaagaaatttttatctcatagttacaaaaataataaaattaaataacacaaaatataggaagcctttaaaacgtaaatttttagaacagatggggaaaattttatcagatatatttgaaaatgagacaaaagaggagttccatgtattttacgaaaatagttttaaattagtaactattattgaagctcaagaaaataatcgagaaaaagatatacgccttcttaagcagtataaacaagaagctttcagaacagatccnaaaaacctttttttatga

SEQ ID NO: 8466 - protein, 201 aa, Unknown
  Obtained from environmental sample
  misc_feature (1)..(201): Xaa is any amino acid
MQDSELQDKIQKLNLHSDKVNSDFSMLEGYISHISFIKSQIAIHGLKSKDVDEILSLHDNIKNIYHKCKSTINIMSESIKTLPLDVLHTNKCVMIHSPAYILKALQKCQKRNFYLIVTKIIKLNNTKYRKPLKRKFLEQMGKILSDIFENETKEEFHVFYENSFKLVTIIEAQENNREKDIRLLKQYKQEAFRTDPKNLFL

SEQ ID NO: 8467 - DNA, 597 bp, Unknown
  Obtained from environmental sample
  misc_feature (1)..(597): n is a, c, g, or t
atgcatcttgaccttattatcggtctgcctggcgagtcaatagagagttttggaaaaaacttgaatcaactctgctcaattgcgagcagtgagattcagctgggtgttttaaaaaaactatctggtacaacgctagatcgtcatgacaaagaacatggcatgatctactcaaacaagccaccgtatgagattttatcaaacactcaaataagctataagcagatgcagatcatgaaacgttttgcaagattttgggatcttttttataatagcggaaattttaaaaatggtattaaattactttttaaggatggagaggtttataaaaatttctactcattttcactttggatatatgctcagacaaactctacatggaaaatttcacttgatcgtttaaatgaactgctttttagctactttttagatgagatgaaactagaaaaaaatgaagtggctcaaatattactaaaagatttcatgagtgtaggtggtagaaaaatacccaaatttttaagagactactctgatgtgagaagttctccaagagatcttgagaactcaaaatctacaaagagacaaaaagcaagagaatag

SEQ ID NO: 8468 - protein, 198 aa, Unknown
  Obtained from environmental sample
  misc_feature (1)..(198): Xaa is any amino acid
MHLDLIIGLPGESIESFGKNLNQLCSIASSEIQLGVLKKLSGTTLDRHDKEHGMIYSNKPPYEILSNTQISYKQMQIMKRFARFWDLFYNSGNFKNGIKLLFKDGEVYKNFYSFSLWIYAQTNSTWKISLDRLNELLFSYFLDEMKLEKNEVAQILLKDFMSVGGRKIPKFLRDYSDVRSSPRDLENSKSTKRQKARE

SEQ ID NO: 8469 - DNA, 423 bp, Unknown
  Obtained from environmental sample
  misc_feature (1)..(423): n is a, c, g, or t
gtgagcggcactgacttgtctagtacatttgtaaaagatacctatctcacttttcaatataacagaggtgaagagtataaagcatatttgagtggtgtaggcttggattttattacaccgttctttgatatttttggagtaaatatatatataaaaaatcaaaatatcggagataatacactccaactttcacttaactattttaaggcttctatctttcaaagtggatttgattttagcggatttactgactggactaaagaagattttctatcacaaaatcaactcctgtatgacgtgtctaaaatagtagatatagataaaaaaagtttttttggtggagtagagtggcactactacagagttaaaaagagtaatgtactatctaacactctgcaactgatggttaaatatatttggtaa

SEQ ID NO: 8470 - protein, 140 aa, Unknown
  Obtained from environmental sample
  misc_feature (1)..(140): Xaa is any amino acid
MSGTDLSSTFVKDTYLTFQYNRGEEYKAYLSGVGLDFITPFFDIFGVNIYIKNQNIGDNTLQLSLNYFKASIFQSGFDFSGFTDWTKEDFLSQNQLLYDVSKIVDIDKKSFFGGVEWHYYRVKKSNVLSNTLQLMVKYIW

SEQ ID NO: 8471 - DNA, 435 bp, Unknown
  Obtained from environmental sample
  misc_feature (1)..(435): n is a, c, g, or t
gtgttattactgacacacgaaaagaagctagtttttccgggtgaaacactccgatcatactatacttctattgaacagtacgtgcttgggctaaaggaaaaggaacccgtcagtagaaataaacttgatgtatctttttttaacagggagcggatacgttccttcctaatgtacctcgaggaagaacaagaaatatctgtttcaacgcgaaacttacgcagagccgagattgttgcctatcttgcatttgcgtcggaagtctgccctgtctataccaatgcttatcttgaagccaagaagataaaaattaagaaagcacccaaaccaaaaaaagatttcctcgtgattgaagaatacaaagcaatgcttgaattcatcgatgtatcaaagaacaatggttttaatcactatctgttaatcacgcataatgtatga

SEQ ID NO: 8472 - protein, 144 aa, Unknown
  Obtained from environmental sample
  misc_feature (1)..(144): Xaa is any amino acid
MLLLTHEKKLVFPGETLRSYYTSIEQYVLGLKEKEPVSRNKLDVSFFNRERIRSFLMYLEEEQEISVSTRNLRRAEIVAYLAFASEVCPVYTNAYLEAKKIKIKKAPKPKKDFLVIEEYKAMLEFIDVSKNNGFNHYLLITHNV

SEQ ID NO: 8473 - DNA, 588 bp, Unknown
  Obtained from environmental sample
  misc_feature (1)..(588): n is a, c, g, or t
gtgtcagcattttatattttctacggagataaaattggactagcaccaaaaccaatgtcaatcaaaaaggaaagaacaaatattggagatgctcagaattacggtctagaagtatttatggaagtggattgggctaaactcatttcaaattccaaaatatggtccgtaaaaacttttgtaaacacttcatacattgatgccaattatatttcttcaaaagagcccaattacattggtaatagagtagaatatgtaagtgagataatggtgaaaactggattaaatgtagagtacaaaaactggagttggaaagttcaatttagttataattcggaacaattttctgatgcatcgaatgcagttgaaccctcgggagatgccgtcataggcattgttccttcgtatcatatttttgatttttcagggagatataaattcgaaaagcattttcagattgagtttggtgtaaacaacttcaccaaccaaaaatactttactagaagagctacaggttacccaggaccaggaattctaccttcagatggtataaatgggtatgttactattcagtataaatttttgaagtaa

SEQ ID NO: 8474 - protein, 195 aa, Unknown
  Obtained from environmental sample
  misc_feature (1)..(195): Xaa is any amino acid
MSAFYIFYGDKIGLAPKPMSIKKERTNIGDAQNYGLEVFMEVDWAKLISNSKIWSVKTFVNTSYIDANYISSKEPNYIGNRVEYVSEIMVKTGLNVEYKNWSWKVQFSYNSEQFSDASNAVEPSGDAVIGIVPSYHIFDFSGRYKFEKHFQIEFGVNNFTNQKYFTRRATGYPGPGILPSDGINGYVTIQYKFLK

SEQ ID NO: 8475 - DNA, 855 bp, Unknown
  Obtained from environmental sample
  misc_feature (1)..(855): n is a, c, g, or t
atggaagaagcacaatcttacgatttgataatagctatggatgacggtaaaattttagcatctggtacaccacaagagttattaaaaaaaacaaatactactaatattgatgaagcttttattgaacttttaccatcagaaaaaagaaaaggtcatgaaaaacttatagttcctaaaagagtggaaaaagaagatgatatatttgccatagaagcagataacttaactatgaagtttggagattttacagctgtagataatgttagtttcaagataaaacaaggggagatatttggctttttaggctcaaatggttgtggaaaaactaccactatgaaaatgcttactggacttttacaaccaacaaatgggaaagcaaaattgtttggagagtatgtaaaagagaattctttagagatgagaaaaaaagtgggttatatgacacaagcattttcactctatactgaactcacagttcttcaaaatatttcacttcatgcaaaattatttcatattaataaaacatctatgccaaaaagaattgaagagacacttattcgatttaatctaaaacagtatcaaaatactctagcagaggaactaccacttggtattcgacaaagactatctttagcagttgccgttattcataaaccagagatgttaattttagatgaaccaacctctggagttgatcctgtatctcgtgataatttttgggaattacttattgatcttgcacgaaatgacaatgttacaatatttgtttcaacacattttatgaatgaaggggaaagatgtgataggatctctttaatgcatncagggaaagttttagcaagtgatactccaaaa

SEQ ID NO: 8476 - protein, 285 aa, Unknown
  Obtained from environmental sample
  DOMAIN (95)...(276): ABC transporter
  misc_feature (1)..(285): Xaa is any amino acid
MEEAQSYDLIIAMDDGKILASGTPQELLKKTNTTNIDEAFIELLPSEKRKGHEKLIVPKRVEKEDDIFAIEADNLTMKFGDFTAVDNVSFKIKQGEIFGFLGSNGCGKTTTMKMLTGLLQPTNGKAKLFGEYVKENSLEMRKKVGYMTQAFSLYTELTVLQNISLHAKLFHINKTSMPKRIEETLIRFNLKQYQNTLAEELPLGIRQRLSLAVAVIHKPEMLILDEPTSGVDPVSRDNFWELLIDLARNDNVTIFVSTHFMNEGERCDRISLMHXGKVLASDTPK

SEQ ID NO: 8477 - DNA, 444 bp, Unknown
  Obtained from environmental sample
  misc_feature (1)..(444): n is a, c, g, or t
atgaattattttttcgaaacaattagatgtgatgattttgaagtttttaatctccattaccacaatcaaagaatatcaagaacaataggacttaatattgatttacaagaatatatctatccaccaacagaccatcttcttagggtaaaagtaatttactcaaaaaacggtattgagaaaattgattactacaaatatacacctaaagagataaaagtgttgaaaatcattgaagatgataaaatagaatataattataaatatcttaatagagaatctatagataatctatattcaaaaaaaagtatagctgatgagataattatagtaaaaaacaagctagttacagatacctctatagcaaatattgcaatatataaagaaaataggtggttaacaccaaagcaacccttactaaaaggaaccactagagcaagattttag

SEQ ID NO: 8478 - protein, 147 aa, Unknown
  Obtained from environmental sample
  misc_feature (1)..(147): Xaa is any amino acid
MNYFFETIRCDDFEVFNLHYHNQRISRTIGLNIDLQEYIYPPTDHLLRVKVIYSKNGIEKIDYYKYTPKEIKVLKIIEDDKIEYNYKYLNRESIDNLYSKKSIADEIIIVKNKLVTDTSIANIAIYKENRWLTPKQPLLKGTTRARF

SEQ ID NO: 8479 - DNA, 408 bp, Unknown
  Obtained from environmental sample
  misc_feature (1)..(408): n is a, c, g, or t
gtgataaattatatccctaaaaataatatcaaagattttttaacccacacctataatttactagaaaacaatggttattttatctttgatattaatagtttatatggttttgaagaagtggcgcaaggaactcttacaatagatactgacgataaatttatagctatagatgcaaattttgaagataactgtttagctacagatatcaccttatttacaaaagagacaactttatataaaaaagattatggtactataaaacaatattatcatgaaaataaagagttgaaaaaaattcttcaagctgttgggtttaaaatagaaaatattataaattttaacctccatagtgatgaagattttgataaatttatatttgtatgcaaaagggttaaaaatgatttttaa

SEQ ID NO: 8480 - protein, 135 aa, Unknown
  Obtained from environmental sample
  misc_feature (1)..(135): Xaa is any amino acid
MINYIPKNNIKDFLTHTYNLLENNGYFIFDINSLYGFEEVAQGTLTIDTDDKFIAIDANFEDNCLATDITLFTKETTLYKKDYGTIKQYYHENKELKKILQAVGFKIENIINFNLHSDEDFDKFIFVCKRVKNDF

SEQ ID NO: 8481 - DNA, 534 bp, Unknown
  Obtained from environmental sample
  misc_feature (1)..(534): n is a, c, g, or t
atggctgcaaaagcaactatctacaaagcttcactaaatattgctgacagggatcaacactactatggagagcatgagttaactttagctcagcatccatcagaaaatgatcttcgccttatggttcgacttgtgacatttgtacttaatgcagatgaaaacctgctttttagtaaaggaatctcacaagatgatgagccagacctgtggcaaaaagagctaaacggcgagataaaactatggatagatctaggtcaacctgatgagaaacgcataaaaaaagcgtgtggaagagctgaaaaagtgatcatatacacctaccatgaaggaagcgcaactccatggtttaaacagatggaaaaaactcttaaacgttttaaaaatcttttcgttacatatttggatattgatggagatatagagcttttaacgaagcgttctatgtctttgcaatgtaacatcagcgatggcgaacttaccatacttgatgatgaacatagtgtcacaatcaaagaagatagatggaaagagtaa

SEQ ID NO: 8482 - protein, 177 aa, Unknown
  Obtained from environmental sample
  DOMAIN (1)...(177): YaeQ protein
  misc_feature (1)..(177): Xaa is any amino acid
MAAKATIYKASLNIADRDQHYYGEHELTLAQHPSENDLRLMVRLVTFVLNADENLLFSKGISQDDEPDLWQKELNGEIKLWIDLGQPDEKRIKKACGRAEKVIIYTYHEGSATPWFKQMEKTLKRFKNLFVTYLDIDGDIELLTKRSMSLQCNISDGELTILDDEHSVTIKEDRWKE

SEQ ID NO: 8483 - DNA, 627 bp, Unknown
  Obtained from environmental sample
  misc_feature (1)..(627): n is a, c, g, or t
gtgaatttacctttgattgaaaaggcttgncataaacaaccaatctcaataagaatgtttacctttatctataatttgaaattggacttaagagaagaaaaccatccagagtataggcactacacgcaagctgaaaaacaaactttgtgggttttttggagtcgattattcctaaagttgtccgcagaccttcccttaaatctatatataaatagcggccgctttgggcttacaatggacaaggcgatgaaatatcttgacattaaaaccgggctgggtgttttaacaagatggtatgatcgtattgattatcagataaagaatggtgagaccctggatgaatttgaattagctgtagcagataacctgttaatgttgacaaaggaacattatgacaagcgaaaagacttattcagcgtattaattaatcatcctgaaaccgattttgtcctatcgaatcataaatggatcgttaaatactgggatattttgcacgatagtgaaaaaactcaaattatagatatactgagatccgatcgaattgatctgagatggatcaaagcagttctgctggcatcagagaagcctcctaaagaggtaattgacgaattgctgggggatgtttag

SEQ ID NO: 8484 - protein, 208 aa, Unknown
  Obtained from environmental sample
  misc_feature (1)..(208): Xaa is any amino acid
MNLPLIEKAXHKQPISIRMFTFIYNLKLDLREENHPEYRHYTQAEKQTLWVFWSRLFLKLSADLPLNLYINSGRFGLTMDKAMKYLDIKTGLGVLTRWYDRIDYQIKNGETLDEFELAVADNLLMLTKEHYDKRKDLFSVLINHPETDFVLSNHKWIVKYWDILHDSEKTQIIDILRSDRIDLRWIKAVLLASEKPPKEVIDELLGDV

SEQ ID NO: 8485 - DNA, 513 bp, Unknown
  Obtained from environmental sample
  misc_feature (1)..(513): n is a, c, g, or t
ttgctgacattaaatgtctcgttaaattgtgcatccaatatccagactataaatcttgcggcaagtgacaaagaagaaaatattgaatttttgttaagcagagagaactcgggaggtagtaagcgagtcccaaagaaaaaaaaacacatgtattactatgacaatcccgagctgaccactgtaaaagcagtcagccttgatacatacctggataagaaaaaatttgatgttattgtgatggatattgagggatcggaattcttcgccttaaagggaatgactgagattctctctaactgtaaggtgctggtcatagaatttctgccgcaccacctgaagaatgtaagtggcgtatctgtggaacaattcctttctattcttgagcctcacttttccaagctaacgataccctcaaagcagcttgttttagactccgcagaatttgttagtcatctgaatgaaatgtacatgcttgagcagggagacgatggtattatttttgagaagatctaa

SEQ ID NO: 8486 - protein, 170 aa, Unknown
  Obtained from environmental sample
  misc_feature (1)..(170): Xaa is any amino acid
MLTLNVSLNCASNIQTINLAASDKEENIEFLLSRENSGGSKRVPKKKKHMYYYDNPELTTVKAVSLDTYLDKKKFDVIVMDIEGSEFFALKGMTEILSNCKVLVIEFLPHHLKNVSGVSVEQFLSILEPHFSKLTIPSKQLVLDSAEFVSHLNEMYMLEQGDDGIIFEKI

SEQ ID NO: 8487 - DNA, 582 bp, Unknown
  Obtained from environmental sample
  misc_feature (1)..(582): n is a, c, g, or t
atgggaacaagcatcaaacaagagtttagtgaagcggagttaaaagctttaatgaaaggtattgaagccgcttttacggatactaattatttaattactcaagagcaatctcccgaaattattcgtccttattttcagaaaaaacaagaagctgctcaagctgaagaaatgaaacagtttgaaaatgtgaaagcagagggtattaaatttttggaaaacaataaaaaaaatccaaacgttaaagttactccaagtggattgcagtacattgttatagaagaaggaactggaaaacaacctactgctacttctaaagttaaagtgcactatcatggaacaactcctgatggaactgtgtttgatagctcggtagaaagaggtcagccaattgaatttggattaaatcaagtaattccaggttggacagaaggtgtacagctaatgaaagaaggagcaaaatatatgttaattatccctcaagaattagcttacggagcaaatgctccacaaggtggtaaaggaccaattaaaccttttatgcccttggtttttgaagtagaattaattcaagtattagattaa

SEQ ID NO: 8488 - protein, 193 aa, Unknown
  Obtained from environmental sample
  DOMAIN (95)...(189): FKBP-type peptidyl-prolyl cis-trans isomerase
  misc_feature (1)..(193): Xaa is any amino acid
MGTSIKQEFSEAELKALMKGIEAAFTDTNYLITQEQSPEIIRPYFQKKQEAAQAEEMKQFENVKAEGIKFLENNKKNPNVKVTPSGLQYIVIEEGTGKQPTATSKVKVHYHGTTPDGTVFDSSVERGQPIEFGLNQVIPGWTEGVQLMKEGAKYMLIIPQELAYGANAPQGGKGPIKPFMPLVFEVELIQVLD

SEQ ID NO: 8489 - DNA, 540 bp, Unknown
  Obtained from environmental sample
  misc_feature (1)..(540): n is a, c, g, or t
ttgatacggattggttacggaatagaaaaaaaaggaaacaaaatgtgtaatgaccttcaaaatatagaaaatgagcaaaataaaattgtctacagtttcgtttctcacaggcggactatcacagaaacagacattgtaaattttgtaaacctcacgggacttcatgcgcccccttttattgatatggactgggtaaaaaaaaagatgccagggaaccataacaaacggtttgctccggctcccttcctcatctccctggcgacaggattagtctccaccagactaatggatattgaggagatcacaaaaaatgaaaatttaggttccttccatggcggagtaggtattgaagctgtactaaaggaaccggcttatcctggagatactttaagtgtggaatttgaagcctcagttgatcggaaaacaaaaaatggacaaacccttttcgattttaaacataccatgaaaaatcaacaaaacaaagtggtgttaatttatacggaaaaagtcctttttgatgcaccagataaaataaaataa

SEQ ID NO: 8490 - protein, 179 aa, Unknown
  Obtained from environmental sample
  misc_feature (1)..(179): Xaa is any amino acid
MIRIGYGIEKKGNKMCNDLQNIENEQNKIVYSFVSHRRTITETDIVNFVNLTGLHAPPFIDMDWVKKKMPGNHNKRFAPAPFLISLATGLVSTRLMDIEEITKNENLGSFHGGVGIEAVLKEPAYPGDTLSVEFEASVDRKTKNGQTLFDFKHTMKNQQNKVVLIYTEKVLFDAPDKIK

SEQ ID NO: 8491 - DNA, 843 bp, Unknown
  Obtained from environmental sample
  misc_feature (1)..(843): n is a, c, g, or t
ttgaattgccaactctcactttggttgcgaactgcacaaccccgacgaaagctgaataatttaagtagcaatataaagtgtggtaactcccttatcgatagcaaagccgttgcaggcgataaagcttttaaatgggaagacgagtttgctcatatttttaaagaaaaagataaaagagcatttcatataactacggctacgcataattcgagatattcgcaacgcatgttcgataatcatgtaaaactagacgaagcagtatatatcgacgaaaaagacgaaatagtaataacagaaacgatagccgaaatagtaaaaaaagataatctgaatgtaatagagtataatatatgtggcgatcatatgcacttgctactggtatgtgatgaaaatgaactgactaaaatagtagggaaaataaaagcgatgagctctcgtgctgcgaatattgctgcgggaagaactatccctgaaagcaaaacaaggggacatgtccccttatccagtaccggaaagaaaaaatataattccctatggacgcaaaaattcgggaaaagcgaaataaaagatgagaactatctaaataatgcgatagagtatatacggaacaaccgaataaaacacgaactacctaaaagtaaaggaatagaaaaactaaaaaaggaatttatatgctctaaagaacatgcctttcgtaaagaagttagtggtggtttcgatgtggtgattgggaatccgccttatgttcctactgaatttatttcagaagaagataaagtctatttagaaaagacatatgatttccgcttttgggcgaataaatttatatcctgtattttatga

SEQ ID NO: 8492 - protein, 280 aa, Unknown
  Obtained from environmental sample
  misc_feature (1)..(280): Xaa is any amino acid
MNCQLSLWLRTAQPRRKLNNLSSNIKCGNSLIDSKAVAGDKAFKWEDEFAHIFKEKDKRAFHITTATHNSRYSQRMFDNHVKLDEAVYIDEKDEIVITETIAEIVKKDNLNVIEYNICGDHMHLLLVCDENELTKIVGKIKAMSSRAANIAAGRTIPESKTRGHVPLSSTGKKKYNSLWTQKFGKSEIKDENYLNNAIEYIRNNRIKHELPKSKGIEKLKKEFICSKEHAFRKEVSGGFDVVIGNPPYVPTEFISEEDKVYLEKTYDFRFWANKFISCIL

SEQ ID NO: 8493 - DNA, 456 bp, Unknown
  Obtained from environmental sample
  misc_feature (1)..(456): n is a, c, g, or t
gtgggcaagaccacacctagttttgatttggagacagaatatgacgaatcctaccccattgaccatatcaatgatgaactaatgaataaagtagttgaagagtttctcggagagcagcttcaaactccacctgttttttccgcaaaaaaaatagacgggaaaagagcctatgaatcagctagacaaggtaaacacatagaaatgaggcagaacttaattcatatacatcacttcacaattgattcaaaagatttcccaaaggttcattttgaaattaaatgctcaaaaggaacttacattcgttcgattgctcaggattttggtaaaaaacttggttccggagcttgcttaattgcactgagaagaactcaatctggtgatttttcaattaaagacgctaagtccgtagaggaatggttggaaattattgaaaatacatccgttgcaaacgattag

SEQ ID NO: 8494 - protein, 151 aa, Unknown
  Obtained from environmental sample
  DOMAIN (3)...(100): TruB family pseudouridylate synthase (N terminal domain)
  misc_feature (1)..(151): Xaa is any amino acid
MGKTTPSFDLETEYDESYPIDHINDELMNKVVEEFLGEQLQTPPVFSAKKIDGKRAYESARQGKHIEMRQNLIHIHHFTIDSKDFPKVHFEIKCSKGTYIRSIAQDFGKKLGSGACLIALRRTQSGDFSIKDAKSVEEWLEIIENTSVAND

SEQ ID NO: 8495 - DNA, 468 bp, Unknown
  Obtained from environmental sample
  misc_feature (1)..(468): n is a, c, g, or t
atggagatagaaggctctgaaaatatcaaagttgaagaattaatagttgatcatataatgtttcctgtttataataacgatacatttctggatgagatgaaagagatctgggatgctaaaaatgttggagagataaaaagggatgattatgatgcttattctggagttttttttcaaactaaaagcttttatgtggaatatctttcaactaacaaaggtgatggttggtggaaaaacagaatttgcattgtaatggataaaaaatattgggattactatcaagagccatttataaaggatgatttttttttgacaccagaaataacttcaggtttcttccttgttagtccagaatatattaaaacaagtaataatcttgttcacaaaacagatatcgttgttgttgatgaaaaaggtgaatatatcgctccatttctgcagagtaatatcccttggatttttgaataa

SEQ ID NO: 8496 - protein, 155 aa, Unknown
  Obtained from environmental sample
  misc_feature (1)..(155): Xaa is any amino acid
MEIEGSENIKVEELIVDHIMFPVYNNDTFLDEMKEIWDAKNVGEIKRDDYDAYSGVFFQTKSFYVEYLSTNKGDGWWKNRICIVMDKKYWDYYQEPFIKDDFFLTPEITSGFFLVSPEYIKTSNNLVHKTDIVVVDEKGEYIAPFLQSNIPWIFE

SEQ ID NO: 8497 - DNA, 387 bp, Unknown
  Obtained from environmental sample
  misc_feature (1)..(387): n is a, c, g, or t
ttggagaatcttaatgatttgtatagtttacttgaatttaccgatatacaaagatacaagtttagagaaagttttggttatgtaagtaaaaacaattataaaaaactccaagtaagccttgaaagattatgtaagaagtatgaagagattgacaatgacactttttacacttatagaatcgtatctttaaatattggtattgataaagagttttgcctttttgatggagatgaacttgtcaaaatagatcaagtttctactttacgaaaaagacttaaaaaatcgattttaaataccgttcctttttatattttttccaataaacacctactgaatgaaaatatgaaaaaagagataaaaaatatactgtatgaagtttttttataa

SEQ ID NO: 8498 - protein, 128 aa, Unknown
  Obtained from environmental sample
  misc_feature (1)..(128): Xaa is any amino acid
MENLNDLYSLLEFTDIQRYKFRESFGYVSKNNYKKLQVSLERLCKKYEEIDNDTFYTYRIVSLNIGIDKEFCLFDGDELVKIDQVSTLRKRLKKSILNTVPFYIFSNKHLLNENMKKEIKNILYEVFL

SEQ ID NO: 8499 - DNA, 360 bp, Unknown
  Obtained from environmental sample
  misc_feature (1)..(360): n is a, c, g, or t
atgtttatatttaaaagtgtagaaacaaaattaaaatcaatatctattatcacaattttgggattttcaatattagtatatttaattatattttactctcaaactcaagaagagtattcacagattaaaaacaaatccaatttactacaaaatgagattagaagcttagagtatatttcaaaagagaaagcaacaaataaattttttgaaaaatatataactattattcaaaatttaaaaaatttaaaaaactcaatggagaacttaaaccttaatactacatctttagataaattagaaaaacaactcataatttcaaaaacctcttatcaaactgtattgatacgcaacaaaaaatga

SEQ ID NO: 8500 - protein, 119 aa, Unknown
  Obtained from environmental sample
  misc_feature (1)..(119): Xaa is any amino acid
MFIFKSVETKLKSISIITILGFSILVYLIIFYSQTQEEYSQIKNKSNLLQNEIRSLEYISKEKATNKFFEKYITIIQNLKNLKNSMENLNLNTTSLDKLEKQLIISKTSYQTVLIRNKK

SEQ ID NO: 8501 - DNA, 444 bp, Unknown
  Obtained from environmental sample
  misc_feature (1)..(444): n is a, c, g, or t
atgttaatttcaagatttgatccatttcaagagttgagagatcttaatagcagatttaagtattttagcaatgcttatccaaaagttgatttagaacaagagtcgtctatttctggtttcacacctgctatgaataccagagaaggagagttcgcgtatcatatagatcttgatattccaggagttaaaaaagaggatataaaggttgatattgaagataatattctgaaaatatctggtgagagaaattttaaaaatgaggtaaaagaggaagattactataaagttgagacttcatttggcaagtttcagagaaatttcacactgcctgagaatgtagatgtagaaaacatcggagcatcagctgaagatggtgtgctggagattgtcctgccaaaaattgctcaaaaagaaaaagaggtgaaaaaaatagagattaaatag

SEQ ID NO: 8502 - protein, 147 aa, Unknown
  Obtained from environmental sample
  DOMAIN (45)...(147): Hsp20/alpha crystallin family
  misc_feature (1)..(147): Xaa is any amino acid
MLISRFDPFQELRDLNSRFKYFSNAYPKVDLEQESSISGFTPAMNTREGEFAYHIDLDIPGVKKEDIKVDIEDNILKISGERNFKNEVKEEDYYKVETSFGKFQRNFTLPENVDVENIGASAEDGVLEIVLPKIAQKEKEVKKIEIK

SEQ ID NO: 8503 - DNA, 654 bp, Unknown
  Obtained from environmental sample
  misc_feature (1)..(654): n is a, c, g, or t
ttgttgattttaatttcaactaatgacggaaatagttttagtgatgctaatgaagtggattttgaattaagaggagatactttatattacaaaaccgaagaagttgagaacacatatgctatttttaatatttcattcgaattatttaaaggagatgatgaaaaatctaactggtttcagaaatataacaactctttaaataatttagacaaaatacttatgacaatagaaaaaactgaaattgagaaaatttatgatgattctataaaaatgtggattgagggtaatgcactaattgatgctgatgctacatacgttaacaaggagaaattgaaaataaaaggactagctttaaatacaatcagggcaaaatattcagaactaagtaatacaatacctactggagacctattaaagtcaacagatcttttgagtggtttaacgggttctactactttcgatattatcaaggaagcattaccttcaactggtagtttaatcgaagctaacattgatattgaatcgagtgaatctattaatccttttaaattgaataatctaaataatgatagtaaattcttagaatcattgaatattgatacttcaaattatttaaaagatttacaggaaaacaaattccttttcatctatcag

SEQ ID NO: 8504 - protein, 218 aa, Unknown
  Obtained from environmental sample
  misc_feature (1)..(218): Xaa is any amino acid
MLILISTNDGNSFSDANEVDFELRGDTLYYKTEEVENTYAIFNISFELFKGDDEKSNWFQKYNNSLNNLDKILMTIEKTEIEKIYDDSIKMWIEGNALIDADATYVNKEKLKIKGLALNTIRAKYSELSNTIPTGDLLKSTDLLSGLTGSTTFDIIKEALPSTGSLIEANIDIESSESINPFKLNNLNNDSKFLESLNIDTSNYLKDLQENKFLFIYQ

SEQ ID NO: 8505 - DNA, 486 bp, Unknown
  Obtained from environmental sample
  misc_feature (1)..(486): n is a, c, g, or t
atgatagactttagagaagaggacatagagccattagactggatagtcaatgaggttatcatccgatactctttgaaaccaaaagaccttgtagaagcaggaattattaaagaacagcaaggtttagaaatagatgtcacatataattctattaccgaatttaataggtatctatatgtccttaacaagtacaaagtctgtgattgtatttcaaatatgagtgtagtaaatattcgagtaaatgaatatactccacaattcaaaaagcttggtggatttaaaaaattgtatgcagattataaaaaacaagaagaaagaaaagaccttgaatttgaattagcggaatccaatattcgtgcgaacaagttaaataaaaaaattgcgaaaagaaataaaagagaaaccattatcaacattgttttaggattaataaacattggtatattaatatggcagtcgttattaattctacaatcatcaaaataa

SEQ ID NO: 8506 - protein, 161 aa, Unknown
  Obtained from environmental sample
  misc_feature (1)..(161): Xaa is any amino acid
MIDFREEDIEPLDWIVNEVIIRYSLKPKDLVEAGIIKEQQGLEIDVTYNSITEFNRYLYVLNKYKVCDCISNMSVVNIRVNEYTPQFKKLGGFKKLYADYKKQEERKDLEFELAESNIRANKLNKKIAKRNKRETIINIVLGLINIGILIWQSLLILQSSK

SEQ ID NO: 8507 - DNA, 723 bp, Unknown
  Obtained from environmental sample
  misc_feature (1)..(723): n is a, c, g, or t
ttgaaaactatgtgttgttatgcgggtgatagtgatgagataaagaatcatcctaaagtaaaaaacataggggtttatactggtgaaaagaaaatcaaaacaattcttaatttcaaggaattagaacagataaaaaacggtactctattggatgaatccttatgtattgctagggattggttattgattggttgtaatacagcacaaagggtatctgatctattatctcttacacaaaagaatataacaactattgatggcagtgaggtaattgatatgagcaacaaaaaaacgggaaaagaactgtacattcctctctttaaagaagtcaaggaaatattagcaaaatatgatgataatttccctcaactaataactgctcaacattttaaccgtcaaattaaattagtcgctaaaattgcgaaactagacaaaattgaagtaggtgaattaatgaaccccaaaactaaaagaaaagaaaaaggcgaattccctaaatggaagctttgtagtagtcatattatgagaagaagcttcgcgactaattactatgggaagtatccaacccctttattaatgcaaattacaaaacacgctaccgaaaaatcattcttaaattacattcacaaagactcttttgaccatgtaaagcaatttgaaaatgaaatggaaaaaagagaagaaccacgatttaaagtgataaaacaagctaatataatataa

SEQ ID NO: 8508 - protein, 240 aa, Unknown
  Obtained from environmental sample
  DOMAIN (36)...(218): Phage integrase family
  misc_feature (1)..(240): Xaa is any amino acid
MKTMCCYAGDSDEIKNHPKVKNIGVYTGEKKIKTILNFKELEQIKNGTLLDESLCIARDWLLIGCNTAQRVSDLLSLTQKNITTIDGSEVIDMSNKKTGKELYIPLFKEVKEILAKYDDNFPQLITAQHFNRQIKLVAKIAKLDKIEVGELMNPKTKRKEKGEFPKWKLCSSHIMRRSFATNYYGKYPTPLLMQITKHATEKSFLNYIHKDSFDHVKQFENEMEKREEPRFKVIKQANII

SEQ ID NO: 8509 - DNA, 390 bp, Unknown
  Obtained from environmental sample
  misc_feature (1)..(390): n is a, c, g, or t
ttgtataaaatgaagaagctatttattatttttcttttatttccctctatcgttttttcgcaggaaatacctgattctctaaaaatttggcaaaagggaggtgttttaaccttgaatttttcgcaagtttcgttaactaattgggctgccggtggaaaaagttcggcctccggggtttttatgatgaacacatttgccaattatcaaaaagataatgtgagctgggataatacgattgatttgagttatggtttcttaaaagagaacgacaacgatttaattaagtcaaatgataaaattgatttaaactctaaattaggaataaaagcaactgaaaaatggaattatgcagctgttgtaaattttaagtcgcaatttgcaccgggttaa

SEQ ID NO: 8510 - protein, 129 aa, Unknown
  Obtained from environmental sample
  misc_feature (1)..(129): Xaa is any amino acid
MYKMKKLFIIFLLFPSIVFSQEIPDSLKIWQKGGVLTLNFSQVSLTNWAAGGKSSASGVFMMNTFANYQKDNVSWDNTIDLSYGFLKENDNDLIKSNDKIDLNSKLGIKATEKWNYAAVVNFKSQFAPG

SEQ ID NO: 8511 - DNA, 303 bp, Unknown
  Obtained from environmental sample
  misc_feature (1)..(303): n is a, c, g, or t
atggaacagagaaacgaaattagaatggaaattatgaaaaataaaattagtgctaccatattttacaaaacacattattcaacgaaaatagtcatttcgggattaacaaaaaaagagacagatattaaaatggtaacccaaacccgaataatctggaaaaacagatctcaaaataaaaataatccaaacctgtcaggcatacaaaacgtattgttcaattttagaaccatcaaattccaaacaggcaatttgataacaaattgtatagcgattggttcgctggtttatcattctataatttag

SEQ ID NO: 8512 - protein, 100 aa, Unknown
  Obtained from environmental sample
  misc_feature (1)..(100): Xaa is any amino acid
MEQRNEIRMEIMKNKISATIFYKTHYSTKIVISGLTKKETDIKMVTQTRIIWKNRSQNKNNPNLSGIQNVLFNFRTIKFQTGNLITNCIAIGSLVYHSII

SEQ ID NO: 8513 - DNA, 666 bp, Unknown
  Obtained from environmental sample
  misc_feature (1)..(666): n is a, c, g, or t
atgaaattactattattactttttttagtactattgaatgtgaatgcaaaaactttagatagtacacaagtattcaataaaacaacagttaaggtacaaaaacaaacattaggcttatcaaaagagttttatgctgatattgtacttgatgaaacagatatcaaagatattacactaagatttgatggttttatccaaaagttgtatcaagacaaaaaatatagctatatcaatagtggtgaaaaactatttagtatctattcaaatgaagtatatacttcactgcaagagtttttaactatagacctaaccaatcaaagaagatataaaagttatatggataagtttaaaaatcttgatatagatacaaaacaaatagtcaacatcttaaaatcaaaagagatgagagaaaatatagatatttattctccatatagcggatatcttataacaaaacaaatcaatacaggaagtgccgtaaaaaaagggcagcttctttttcaaatagcaagtatgaaacagctttggggaaaagttaaagtgtaccaaaaagatttatcatacattaaaaaagatatggatgtaaaactttttatagagggtgttggtgtggtgacttcaaaagttgattttatctatcccactatagatgagcaaacaaaaact

SEQ ID NO: 8514 - protein, 222 aa, Unknown
  Obtained from environmental sample
  SIGNAL (1)...(16)
  misc_feature (1)..(222): Xaa is any amino acid
MKLLLLLFLVLLNVNAKTLDSTQVFNKTTVKVQKQTLGLSKEFYADIVLDETDIKDITLRFDGFIQKLYQDKKYSYINSGEKLFSIYSNEVYTSLQEFLTIDLTNQRRYKSYMDKFKNLDIDTKQIVNILKSKEMRENIDIYSPYSGYLITKQINTGSAVKKGQLLFQIASMKQLWGKVKVYQKDLSYIKKDMDVKLFIEGVGVVTSKVDFIYPTIDEQTKT

SEQ ID NO: 8515 - DNA, 750 bp, Unknown
  Obtained from environmental sample
  misc_feature (1)..(750): n is a, c, g, or t
gtgaataatgaaacagagacacctgttttactaatcgttgaagataatcctgatatgcgtcactatattaaaactaattttgagaacacatatcaaattttggaagctgaagatggtgaaaaaggtattcagcttgccttagataatattccagatcttattatctcagacgtgatgatgcctaatgttggaggtatagaactgtgtacaactcttaaatcggacgtaaaaaccagccatattcctattattttactaactgcaaaagttggtgacgaaaatgtacttggcggtttaaaatctggtgcagatgactatatagttaaacctttcaatgctcaagccttatcggtaaaagttgaaaatctaataaaattaagaagaaacttacaggagaaatatcaaaaagaacttgtaataaaccctttaaacctcgtttttaaatctgaagatgaaaagtttgcaaatactttacaagaagttcttgataagtatttaccagatccagagttctcagtcgatcagttttgcagcaaaacttgtatgagtagaacccagttgcacagaaaattaaaagcatttacaggactatctgcaactgcatttattcgctctcaacgaattaagttagcagcgaacatgatgcttaatcctgacattgctattagtgacgtttgttacgcaacaggctttaacaatacttcgtacttctcaaaaagctttaaagaaatttcaaggcccaaacgccct

SEQ ID NO: 8516 - protein, 250 aa, Unknown
  Obtained from environmental sample
  DOMAIN (8)...(128): Response regulator receiver domain
  misc_feature (1)..(250): Xaa is any amino acid
MNNETETPVLLIVEDNPDMRHYIKTNFENTYQILEAEDGEKGIQLALDNIPDLIISDVMMPNVGGIELCTTLKSDVKTSHIPIILLTAKVGDENVLGGLKSGADDYIVKPFNAQALSVKVENLIKLRRNLQEKYQKELVINPLNLVFKSEDEKFANTLQEVLDKYLPDPEFSVDQFCSKTCMSRTQLHRKLKAFTGLSATAFIRSQRIKLAANMMLNPDIAISDVCYATGFNNTSYFSKSFKEISRPKRP

SEQ ID NO: 8517 - DNA, 825 bp, Unknown
  Obtained from environmental sample
  misc_feature (1)..(825): n is a, c, g, or t
ttgacagattcggctcgagtaaagattgaatcttatcaacctattctgcataatattgccaatgctaccaatacagcgaaatcactgactcaaactttcactattattcataatgaactttcccgaattattgatgttactaacttcttcatcgcaatttatgatgccagttcgaatctaatatcagcacctttttacaaagatactttcaacaaacaaactcccccacctcaattgatgggaaagggaatcacagcttatgtaattaggaacggaaaatctctcttcttaactcctgaacttaggaataacctgattgaacaggatgaaatcaccaaaactgattatcgcagcaaaatttggatcggagttccgctgaaaatcgagaataggataattggggcaattgtaattcaaagctacgctaaccaagatcagtatagttttagggatatgaagttgatcgagaccatttcagatcaaattgcactttctatccaccagaaacaaactgaggaaaagttaaaagaatcactgcaggaaaaacagcttctgttaaaagagattcaccatcgcgttaaaaacaacatgcaaattataaccagtattctccatctgcagaaacccttcctactaactgaagatcctgtaaagatttttgagaattgtgccagcagggttaatacgatggctataattcaggaaaaagtatatcagcagaacaacctgactaaaataaatttgaaagaatttatacacagtcttatagcttatcttcttggtttctatgggataaattctaataaaattcaagttggaatttaa

SEQ ID NO: 8518 - protein, 274 aa, Unknown
  Obtained from environmental sample
  DOMAIN (28)...(166): GAF domain
  misc_feature (1)..(274): Xaa is any amino acid
MTDSARVKIESYQPILHNIANATNTAKSLTQTFTIIHNELSRIIDVTNFFIAIYDASSNLISAPFYKDTFNKQTPPPQLMGKGITAYVIRNGKSLFLTPELRNNLIEQDEITKTDYRSKIWIGVPLKIENRIIGAIVIQSYANQDQYSFRDMKLIETISDQIALSIHQKQTEEKLKESLQEKQLLLKEIHHRVKNNMQIITSILHLQKPFLLTEDPVKIFENCASRVNTMAIIQEKVYQQNNLTKINLKEFIHSLIAYLLGFYGINSNKIQVGI

SEQ ID NO: 8519 - DNA, 597 bp, Unknown
  Obtained from environmental sample
  misc_feature (1)..(597): n is a, c, g, or t
atgacaaagatagtaaaagattatttaaagattttagaatttgagaactcaattaattctgtagctgaaataaataagttaataaaagcacatttaagaaacttctctttttcaagtatagctgttttattaaaagatgaaatctctttggatataaatgatatttataaaaaaattgtaattgataaaagaggtggctattgttttgaacataataaacttttttttacagttttaaaagagttgggctttgatgttaaatcatatatggcaagagttgttaacaatacaaataatattgttcctaaaacccatagatttacaattttagattttaataatgagagatatttaatagatgtgggtattggatttaggtccccttgtgttccagttaaaataatagatgaattcacaccaagtcatttgggtatttcatactgtgttaaaacattggataanaatctttttgccctagcatcattaaaagatgaagaaaaatttactatcacaaattacgaattaaacaaatataatgaagcagattatgagatgggacacttctattctcacaaacatccaatgcagtctttgtaa

SEQ ID NO: 8520 - protein, 198 aa, Unknown
  Obtained from environmental sample
  DOMAIN (20)...(194): N-acetyltransferase
  misc_feature (1)..(198): Xaa is any amino acid
MTKIVKDYLKILEFENSINSVAEINKLIKAHLRNFSFSSIAVLLKDEISLDINDIYKKIVIDKRGGYCFEHNKLFFTVLKELGFDVKSYMARVVNNTNNIVPKTHRFTILDFNNERYLIDVGIGFRSPCVPVKIIDEFTPSHLGISYCVKTLDXNLFALASLKDEEKFTITNYELNKYNEADYEMGHFYSHKHPMQSL

SEQ ID NO: 8521 - DNA, 804 bp, Unknown
  Obtained from environmental sample
  misc_feature (1)..(804): n is a, c, g, or t
gtgttaaaaactatattcataggaaaaaaaatatatagtgaccaaaaagagaataaatttattgtagtctataatattccagatattatgaataatcctatgggaagtagtattgcctttaaagatttagactcttgtaatatggatgatattgaatctataaaaacaaacatgatattttatatagtattatttatattagtggttattttaataggatattattttctggcaagaaagcatacaaaagagttagacatcaaggttattaaaagatcaaaagaattatacaatgaaaaacgatatatacagacaatattagatacgaatccaagtattattattgtaactcaaaactctcaaatagtaaatgcaaataatagattttttgaatttttccattataaaaatttagatgaatttaaagaacactataattgtatatgtgatttttttctcactttagatgaagttgtctttcctgaaaatcatcagatatttggagagttatggtctatttatcttgcaaataattctaaaaaagaacattttgtatcattaaaatttcaagatgaggagtattattttattgtaagtgcagcgtatttaaaaaataatggggatattttactgacttttcaaaatattactgatttaaagaaaaaagacaagttattgtatgaacaatcaaaaatgacatcaatgggtgagatgatagggaatattgctctccaagggagacaaccactgagtataatatcacctgctgcaacaggtatgaaagtacaaaaccaggtttggtaa

SEQ ID NO: 8522 - protein, 267 aa, Unknown
  Obtained from environmental sample
  misc_feature (1)..(267): Xaa is any amino acid
MLKTIFIGKKIYSDQKENKFIVVYNIPDIMNNPMGSSIAFKDLDSCNMDDIESIKTNMIFYIVLFILVVILIGYYFLARKHTKELDIKVIKRSKELYNEKRYIQTILDTNPSIIIVTQNSQIVNANNRFFEFFHYKNLDEFKEHYNCICDFFLTLDEVVFPENHQIFGELWSIYLANNSKKEHFVSLKFQDEEYYFIVSAAYLKNNGDILLTFQNITDLKKKDKLLYEQSKMTSMGEMIGNIALQGRQPLSIISPAATGMKVQNQVW

SEQ ID NO: 8523 - DNA, 867 bp, Unknown
  Obtained from environmental sample
  misc_feature (1)..(867): n is a, c, g, or t
atgttcagaccaggttttgctatagaatacgatttttcccacctaccacaacttaaaaacacactggaaactaagctagtagagaatctatattttgctggacaaataaatggaactacaggttacgaagaagccgctggacaaggtttaatggctggaataaatgctcatttaaaaacaaatgaaaaagaagcttttattttaaatagagacgaagcttatattggtgttttaatagacgatttaattaataaaggcacaaacgaaccttatagaatgtttacgtcaagagcggagtatagaattcttttaagacaagataatgcagatattcgtttaacagaaagaggctttaatcttggtttagcttctgaattaagaatgaaaaaagttgaagagaagaaacaaaatattgaaaaaataatcaaaagatttgaagaagtttctgtacttccaaaagaagtaaacagctatttagaacaacaaaattcttctcctttaaaacaaaaagtaaaagcaatttctgttattactagaccaaatattgctataagagaatttagttcttgtaatactaaattaacagatgaagtaaatttatatactggagatgttttggaaagtgcggaaattttaatgaagtatgatggctatattaaaagagaaaaagaggttgctgataaaatttctagactagatgatattaaaattcacgatacaattgactacactaaacttggatctttatctgctgaagcagtagataagcttactaaaataaaaccatcaaccatcggacaagcatcaagaattagtggagtttctccttcagatgtttctgttttgatggtttacatgggaagatag

SEQ ID NO: 8524 - protein, 288 aa, Unknown
  Obtained from environmental sample
  misc_feature (1)..(288): Xaa is any amino acid
MFRPGFAIEYDFSHLPQLKNTLETKLVENLYFAGQINGTTGYEEAAGQGLMAGINAHLKTNEKEAFILNRDEAYIGVLIDDLINKGTNEPYRMFTSRAEYRILLRQDNADIRLTERGFNLGLASELRMKKVEEKKQNIEKIIKRFEEVSVLPKEVNSYLEQQNSSPLKQKVKAISVITRPNIAIREFSSCNTKLTDEVNLYTGDVLESAEILMKYDGYIKREKEVADKISRLDDIKIHDTIDYTKLGSLSAEAVDKLTKIKPSTIGQASRISGVSPSDVSVLMVYMGR

SEQ ID NO: 8525 - DNA, 762 bp, Unknown
  Obtained from environmental sample
  misc_feature (1)..(762): n is a, c, g, or t
atgaattattctgaagataaagacaaggcgggtgaatatttaaggctggccctgggctatcttgtaaaatataaccagccggcaagtcctgttaattatacggtatggtacgagtatgtgtcaggaaagaatccgaagttaaaaaaaaccattgattctgcaattgaatctgccacccccctcacctgtaataatatggaaattttgtaccagaaatttgtggccgatggggacagaataatcatcagcaagctattgaccaaggtcaacctcatgctcagggaaattaccggccatgtgctggagaccgaaggcgatctttccggtcatggaaccatcctaagggggctttcagaagagattctcgaggttcgggattttgaaggagctaaaaggatcattgatcagatggtcctggagaccaagacccttataaaatcaggctctaatctccaaagccggatgaagatttcctcggcagagttgcagcagcttcatcgggaattggaaaaatctcagcaggaagcacacacagattccctgaccgggttgattaaccggaggggacttgaaaaacgatttgagctggaacggatacnggcaaaacagaacaatatccctttttcaatcataatgttagatattgatcattttaaaaaggtcaacgacacctatgggcatctggtgggggaaagtctgcttcagggaatctccaatattttaaaaaacagctgcggcggaatgatattgcccccagatacg

SEQ ID NO: 8526 - protein, 254 aa, Unknown
  Obtained from environmental sample
  DOMAIN (172)...(254): GGDEF domain
  misc_feature (1)..(254): Xaa is any amino acid
MNYSEDKDKAGEYLRLALGYLVKYNQPASPVNYTVWYEYVSGKNPKLKKTIDSAIESATPLTCNNMEILYQKFVADGDRIIISKLLTKVNLMLREITGHVLETEGDLSGHGTILRGLSEEILEVRDFEGAKRIIDQMVLETKTLIKSGSNLQSRMKISSAELQQLHRELEKSQQEAHTDSLTGLINRRGLEKRFELERIXAKQNNIPFSIIMLDIDHFKKVNDTYGHLVGESLLQGISNILKNSCGGMILPPDT

SEQ ID NO: 8527 - DNA, 687 bp, Unknown
  Obtained from environmental sample
  misc_feature (1)..(687): n is a, c, g, or t
ttgaacatttcaaactatagagaactacttttcacaaaggactcttacaccttaggactagcagattatacctcagagggaattgctgctaatgataaaaaagtaagtattaccgcaatagaaggttatgaagagaacccaattttattgaccaaaacacaagagtatggaggaaaaaagattggttatctggtttacaacagttttattggcacaaataaattcaaccttgctttaaatgatagcattgccaaattaaaagaggcaggcgtaacagaaatggttctagatctgcgctataatggaggaggctctctttatacagaccaactactttgcagcatgcttaccggatcacacacaggagaactgttctctgagagtaagtataatgagcttttatccaactactatattaaggagtatggtaaaaatgcactaaaagacttctttgtagataaaatcaaagacaataaaggaaatacactagctcctattaactcattacatttaaaaagactttttgtactcacttctggaagctcagcctctgccagtgaacaacttatcaatggattaaaaccttatatagatgttgtgttacaaggaacaacaacgagtggtaaatacacttcctctattactgtttatgactatatcgatgataaagggacccaaaaatcctaa

SEQ ID NO: 8528 - protein, 228 aa, Unknown
  Obtained from environmental sample
  DOMAIN (60)...(228): Peptidase family S41
  misc_feature (1)..(228): Xaa is any amino acid
MNISNYRELLFTKDSYTLGLADYTSEGIAANDKKVSITAIEGYEENPILLTKTQEYGGKKIGYLVYNSFIGTNKFNLALNDSIAKLKEAGVTEMVLDLRYNGGGSLYTDQLLCSMLTGSHTGELFSESKYNELLSNYYIKEYGKNALKDFFVDKIKDNKGNTLAPINSLHLKRLFVLTSGSSASASEQLINGLKPYIDVVLQGTTTSGKYTSSITVYDYIDDKGTQKS

SEQ ID NO: 8529 - DNA, 591 bp, Unknown
  Obtained from environmental sample
  misc_feature (1)..(591): n is a, c, g, or t
atggatatgtggcgagcttttgttacagctagtaataaagtatttcctttaacagatatagttcatgacaagttccatctaatgaaatatttgaatgatggcgtagataaaacgagaaaaagagaagttaaaaaattagataggaacaatgataacagcttgaagagaacaaaatatttatttttaaaaaatcaagaaaatatgacagataaacaatttttgcgatttgaaaaagtgaaagctatcaatttggaaacctgcaaagcttgggaaataaaagaaaacttcaaaggattttttaatagtggaacaataaatgaagctaaattatttttcaatggttggttaaatgatgtgagaaaaagtggattaaaatatatgataaaggtttcagaattgataataaatcattggactggtattataagctacataaaacataaaataacgaattctctcgcagaaaacataaatggaagaattcagaacataaaaacaattgctagaggtttcagagcttttgaaaattatcgaatttcaattcttttttatctcggtaaattagacctcacaccacacaatatcttgtag

SEQ ID NO: 8530 - protein, 196 aa, Unknown
  Obtained from environmental sample
  misc_feature (1)..(196): Xaa is any amino acid
MDMWRAFVTASNKVFPLTDIVHDKFHLMKYLNDGVDKTRKREVKKLDRNNDNSLKRTKYLFLKNQENMTDKQFLRFEKVKAINLETCKAWEIKENFKGFFNSGTINEAKLFFNGWLNDVRKSGLKYMIKVSELIINHWTGIISYIKHKITNSLAENINGRIQNIKTIARGFRAFENYRISILFYLGKLDLTPHNIL

SEQ ID NO: 8531 - DNA, 702 bp, Unknown
  Obtained from environmental sample
  misc_feature (1)..(702): n is a, c, g, or t
ttgctgttagaacagtcaaaattagcacaaatgggtgagatgttaaatatgatagctcatcaatggagacaacctttaaatacaatatctgcttctgctatgaacctatcttttcaaaatgaacttgatatgcttgataaaaatagtatagaagagacaagtgcttttattcaaaatgagacacaacggatgtctggaatcattaatgattttatggagtttaataaaacagaatcaaacaaagagttttttatatataaggctactgatgaggttcgtaaaatgatctctcctcaacttaaaaacagatctatactgttagagattgatattgataaaaggttaaaagtttttcataatatgaaaagcattgagcatgtgttattaaatattataaataatgccagagatgcttttgaaggtaaaaaatatataactaataaaaaaataagtattttcacaacagctgatgaaaaatcgataactctaaatatagaagataatgctggaggaatatcgaaaaatattatgaacaaaatatttaatccgtactttactacaaaagagcagggtaagggtactggaataggtttatatatgtcaaaacagatggttgaaggagtagctggtgcatcaataaacgtaaaaaacagtgaagatggtgcgcagttttctattatacttagcagaattgaggtgtaa

SEQ ID NO: 8532 - protein, 233 aa, Unknown
  Obtained from environmental sample
  DOMAIN (10)...(80): His Kinase A (phosphoacceptor) domain
  misc_feature (1)..(233): Xaa is any amino acid
MLLEQSKLAQMGEMLNMIAHQWRQPLNTISASAMNLSFQNELDMLDKNSIEETSAFIQNETQRMSGIINDFMEFNKTESNKEFFIYKATDEVRKMISPQLKNRSILLEIDIDKRLKVFHNMKSIEHVLLNIINNARDAFEGKKYITNKKISIFTTADEKSITLNIEDNAGGISKNIMNKIFNPYFTTKEQGKGTGIGLYMSKQMVEGVAGASINVKNSEDGAQFSIILSRIEV

SEQ ID NO: 8533 - DNA, 519 bp, Unknown
  Obtained from environmental sample
  misc_feature (1)..(519): n is a, c, g, or t
atggagattgagagagggatcatttacattgtcgatcgaaaaaaagagatcatcgctcacgcgctggatggaaaaaacattccaccacaaccactggaaaacagcctcaaactggataaatacatctctcaagcctatatccatggtgacaaaaaaccctacctgatcgcggttctaacccccaacctggagcgcttgattgagttcggccatgaaaaacatatcgattatctgggagtcgacgatctggtcgccaacgatctagtacagcaactatttgttgaacggatcgctcaattcaataagaaccttgctgcctatgaatcaatcaaaaaattcatcttgcttccgcgtgaattctccgcagaggggggagaattgaccccgacaatgaagctgaaacggaaagcgatctacaacacctataaagataaaatcgaacaactatatctgcacaatggcaacggccagaacgcccagccacaatctgaaaatggaggaaaaaatgaggcaaattaa

SEQ ID NO: 8534 - protein, 172 aa, Unknown
  Obtained from environmental sample
  misc_feature (1)..(172): Xaa is any amino acid
MEIERGIIYIVDRKKEIIAHALDGKNIPPQPLENSLKLDKYISQAYIHGDKKPYLIAVLTPNLERLIEFGHEKHIDYLGVDDLVANDLVQQLFVERIAQFNKNLAAYESIKKFILLPREFSAEGGELTPTMKLKRKAIYNTYKDKIEQLYLHNGNGQNAQPQSENGGKNEAN

SEQ ID NO: 8535 - DNA, 513 bp, Unknown
  Obtained from environmental sample
  misc_feature (1)..(513): n is a, c, g, or t
atgattatcaattcatcaaaagttaaatctgaagcattattactattttgtagagagttaatcctctcttatgaaaaaagtgatgacaatatgtttaatatatcccaaaatacaaaaacttttatagatgaacaaataaaacaactccataaagctataaatgtagtgatacaaccaaatgactactatacaagaaatacaagagttacaagaattgcaattattattaaaacttacgaatttttaagtaagaatttatcaaaaaaatttgaaaaaggtgatgtatttaatcctgcaatgctttgttttgcacttctttctacatggtttgcagagttaagtatcaccgaagatgataaagagtttctctattttaatatctatccttatagtgaaatttatgataaattactattaaatattgatgatgtacaatataaacaacttaatattaagatgctacaaatagctgaagatactatttttaaacttaacaattataggtttaaataa

SEQ ID NO: 8536 - protein, 170 aa, Unknown
  Obtained from environmental sample
  misc_feature (1)..(170): Xaa is any amino acid
MIINSSKVKSEALLLFCRELILSYEKSDDNMFNISQNTKTFIDEQIKQLHKAINVVIQPNDYYTRNTRVTRIAIIIKTYEFLSKNLSKKFEKGDVFNPAMLCFALLSTWFAELSITEDDKEFLYFNIYPYSEIYDKLLLNIDDVQYKQLNIKMLQIAEDTIFKLNNYRFK

SEQ ID NO: 8537 - DNA, 702 bp, Unknown
  Obtained from environmental sample
  misc_feature (1)..(702): n is a, c, g, or t
atgttaagtttaatgaattatttacatgagctactattaagatttaaaaaaaataagggactttggtttactacaattacaactctcgctgtatttggtatagttatagcgatgtatatcattatgactatgacaagtaatgtatctgaaaaagtatatcaaagtatggcaaaagattatcgtataaaagttacaactttatttgatagtaaagaattagagtttaaaaaaatgatttcagttatagaggaaaataaacctttattagctcaaattgagcaaaaccaagaacaagagattttggtatctcaaaaagctatcaatgattcttttggcaaaaaaggtattaataactataaagtatcattttattctgttgctaataataaagagatatttcgttcaagtattatctctgtaattaaatctaaaaatacaatatatgggttagaggttatgtcagatggagtttttaatacttatttacaacctttaataaaagatggtaatgtatatggtgtgattgaggtaaaagagtctatccataattatagaaagatttttgaaagtttaaatgatgagtatgtttttttacttgataaaaaaatgttatcactaatttctatagatgcaaaaaatggaagatatagagatatgataaatgactatacagttgaacaaccttttatgatacaaaattta

SEQ ID NO: 8538 - protein, 234 aa, Unknown
  Obtained from environmental sample
  misc_feature (1)..(234): Xaa is any amino acid
MLSLMNYLHELLLRFKKNKGLWFTTITTLAVFGIVIAMYIIMTMTSNVSEKVYQSMAKDYRIKVTTLFDSKELEFKKMISVIEENKPLLAQIEQNQEQEILVSQKAINDSFGKKGINNYKVSFYSVANNKEIFRSSIISVIKSKNTIYGLEVMSDGVFNTYLQPLIKDGNVYGVIEVKESIHNYRKIFESLNDEYVFLLDKKMLSLISIDAKNGRYRDMINDYTVEQPFMIQNL

SEQ ID NO: 8539 - DNA, 756 bp, Unknown
  Obtained from environmental sample
  misc_feature (1)..(756): n is a, c, g, or t
atgaaaaatttagagttaatacaaaaggcgctagctgaaaatgatttgagcgcattagactctttggcaacggcagtcgggcgtgacataaataaaagtttaaatttttcctcaccgcttatgctctcagctcataatctgaaacatcttcaaaaaatttcttcaattaacagtgactcgataatgcttaatcttgaagatggtgtaagtgaagagcaaaaaccgtttgctttaagactctgtgcattggcactcttatcatattctagtatagataagaagttaatagttagagtaaatgcacttgatgaaggtggtgatgaagagataagatatctaaatagatttcaaccagatgccataagagttcctaaagtgaaaactacagatgatgtaaaaagagcactagaacttttaaatgaaaagatagaactacacctctctatagagacaaatgaggcttggctaaatctacaaaacttaagagtagatgatcgtgtaaaagttttttatttaggaattttagacctatttgcagacatgaacctctctcaatcattgataaaagtagataatcctctcattcatcatatactttcacattttcttattacatctaaagctattggagtaaaaactgtctcatttgtatttcaagattatagagatagtgaaaaattcaaagagtggttagagcttgagaagtctatggtttttaattcaaagggtgtatctcaccaacacaagcttcattag

SEQ ID NO: 8540 - protein, 251 aa, Unknown
  Obtained from environmental sample
  misc_feature (1)..(251): Xaa is any amino acid
MKNLELIQKALAENDLSALDSLATAVGRDINKSLNFSSPLMLSAHNLKHLQKISSINSDSIMLNLEDGVSEEQKPFALRLCALALLSYSSIDKKLIVRVNALDEGGDEEIRYLNRFQPDAIRVPKVKTTDDVKRALELLNEKIELHLSIETNEAWLNLQNLRVDDRVKVFYLGILDLFADMNLSQSLIKVDNPLIHHILSHFLITSKAIGVKTVSFVFQDYRDSEKFKEWLELEKSMVFNSKGVSHQHKLH

SEQ ID NO: 8541 - DNA, 825 bp, Unknown
  Obtained from environmental sample
  misc_feature (1)..(825): n is a, c, g, or t
atggtagctggccgagtgtttgagggagtgtgtgaaattattcctattacaaatgctcaaaataaaagatattgggctgataaaccaatgttaagagctttagatgaacatgaaggttatgaacttatagctagaaaaaaacatcttaaaagggttttatttaatgaagttgcaaatcaaacaggaaaaatgtttgacccagatattttaacaattgtttgggcaagaagatttgcagaatataaaagaccaggattactaaaatacgattttgaaagatttgaaaaacttattactcgaacaaaagaacctattcaaatcatttgggcaggaaaaccttatccacacgatacaaatgcaattaatatttttaatgagttaacttatatatgtagaagttataaaagtgtggcagttttaattggttatgagttagagttatcaagacttcttaaaaaaggtgctgatatttggctcaatactccaagaatcacaagggaagctagtggtacaagtggtatgagtgctgctatgaatggagcaattaatttttcaatagcagatggttggcatccagagttttgtaaagaggaaaagaatagttttacaattttaggagcagatgctagtttaagtgttgaaaatcaagatcaagtagacaacaaaagtatgatggatatacttgaagaaaaaatcatcccaacttattatgaaaatgaaaaagagtggatagagttgatgaaaaactctatgagtgatgtattatttgaatttgattcaggttctatggctcacaaatattatgaaaaaatgtataaattctag

SEQ ID NO: 8542 - protein, 274 aa, Unknown
  Obtained from environmental sample
  misc_feature (1)..(274): Xaa is any amino acid
MVAGRVFEGVCEIIPITNAQNKRYWADKPMLRALDEHEGYELIARKKHLKRVLFNEVANQTGKMFDPDILTIVWARRFAEYKRPGLLKYDFERFEKLITRTKEPIQIIWAGKPYPHDTNAINIFNELTYICRSYKSVAVLIGYELELSRLLKKGADIWLNTPRITREASGTSGMSAAMNGAINFSIADGWHPEFCKEEKNSFTILGADASLSVENQDQVDNKSMMDILEEKIIPTYYENEKEWIELMKNSMSDVLFEFDSGSMAHKYYEKMYKF

SEQ ID NO: 8543 - DNA, 378 bp, Unknown
  Obtained from environmental sample
  misc_feature (1)..(378): n is a, c, g, or t
ttgggaagagataaaaacaataataaggaaaaaaaagtgaaaatagtatttacagcaaaaggtgaaaattgggatagtcttgttgatgcaagatttgggaggatggaagttctagttatttatgatgagattagtgatacactacgaagtattacaaatagtcaaacagaatctatggaacatggagctggacttcaaacagctcaaaaagttttagaattaaaccctgatgtaatcattacaggaaatggagcagggcaaaaagcacttgatattttaaaaagatcaaatgtaaaaatgtatattggcgctggagatatgactataaaagatgcatatgaagcatataaaaatgataaattaccattacaattttaa

SEQ ID NO: 8544 - protein, 125 aa, Unknown
  Obtained from environmental sample
  misc_feature (1)..(125): Xaa is any amino acid
MGRDKNNNKEKKVKIVFTAKGENWDSLVDARFGRMEVLVIYDEISDTLRSITNSQTESMEHGAGLQTAQKVLELNPDVIITGNGAGQKALDILKRSNVKMYIGAGDMTIKDAYEAYKNDKLPLQF

SEQ ID NO: 8545 - DNA, 417 bp, Unknown
  Obtained from environmental sample
  misc_feature (1)..(417): n is a, c, g, or t
atgaaagagcaaatacgatcattattgatggaactaaccaattatgattactactattttggtggtgtttttgccctttttttactactaattatttttgccatcgcactatatcggcatattattatctctgtacttctgctttttacagctattaccattttaattttatctcctaatgtaggtcactattactttaagcaagaattatataaaacagatataaatattacgcaggtgaaagctttagagtatagtcaagcattgttagtaaaagggacaataaaaaatatatctgattttactttttctaaatgtaaaagtaagtgcaaagtatataaagttgctcataatcctcttttagatatcctatatcctttaaacccttttaagacaaagagtattatactagataag

SEQ ID NO: 8546 - protein, 139 aa, Unknown
  Obtained from environmental sample
  misc_feature (1)..(139): Xaa is any amino acid
MKEQIRSLLMELTNYDYYYFGGVFALFLLLIIFAIALYRHIIISVLLLFTAITILILSPNVGHYYFKQELYKTDINITQVKALEYSQALLVKGTIKNISDFTFSKCKSKCKVYKVAHNPLLDILYPLNPFKTKSIILDK

SEQ ID NO: 8547 - DNA, 393 bp, Unknown
  Obtained from environmental sample
  misc_feature (1)..(393): n is a, c, g, or t
atgaatatcaaaatagcgaagaatcttcaaaaaacacttaaatcaaacatattatatttagtaaagtcaaattctgatctagaaaaaataggtttagaaaagcatgagcttgattttgctaagaaagagtatcaagcaaagagtgatataatagagattaatagatacagttatcgagtattcgttgtatatgataattctaagggtagtatggcattaaagcttgaagctattcgtgggctaggtaatactgcattaaaatctattaataaatccaaaatcacgaaagttggactatgttcttctagtttttcttcaaatgaaacattagcttttattgaagggatgatattgggaaattatcagttttttgactataaaacccggagataa

SEQ ID NO: 8548 - protein, 130 aa, Unknown
  Obtained from environmental sample
  misc_feature (1)..(130): Xaa is any amino acid
MNIKIAKNLQKTLKSNILYLVKSNSDLEKIGLEKHELDFAKKEYQAKSDIIEINRYSYRVFVVYDNSKGSMALKLEAIRGLGNTALKSINKSKITKVGLCSSSFSSNETLAFIEGMILGNYQFFDYKTRR

SEQ ID NO: 8549 - DNA, 606 bp, Unknown
  Obtained from environmental sample
  misc_feature (1)..(606): n is a, c, g, or t
atgcaatctttactaactatatcgcaggagcatataatgaataaaatatttttaataaccatagtcttagcatctactatttttgcaatggaaataccgactaaacatgccgtgataagagcatttggaaagtcagtagaactaaatgcacagataatccaactctcaaatgcaaaacaatccatcatgtcacttgtcagcggacatatagaaaagtattttgtgaaagttggtcaaagcgtaaaagacggagagaaaattgttcttatagagtccataatgctctcaaaaatgacagcagattttatctctctaaagaagcagttaaactctcaagagaagaactaccaagcttcaaaaagtctttatgaaaaagggatgacttcgatgcaagaactaaatgcacaaagtatcaaaagagatgaagttttagcaaaattaaccgctctaaaatctcagctaaacactttggacataaacacagacgagttaaaacaagcttcatcaaactttatcctttacgcacatagcgacggtgttgtatcagagatacttcaaccgcttcactctagcatcaaagaagatactcatattatctcggtttaa

SEQ ID NO: 8550 - protein, 201 aa, Unknown
  Obtained from environmental sample
  misc_feature (1)..(201): Xaa is any amino acid
MQSLLTISQEHIMNKIFLITIVLASTIFAMEIPTKHAVIRAFGKSVELNAQIIQLSNAKQSIMSLVSGHIEKYFVKVGQSVKDGEKIVLIESIMLSKMTADFISLKKQLNSQEKNYQASKSLYEKGMTSMQELNAQSIKRDEVLAKLTALKSQLNTLDINTDELKQASSNFILYAHSDGVVSEILQPLHSSIKEDTHIISV

SEQ ID NO: 8551 - DNA, 381 bp, Unknown
  Obtained from environmental sample
  misc_feature (1)..(381): n is a, c, g, or t
gtggccttgaactccaagttgttaatgcacgcctcgaacaaagagcaaaagaggaagtcgtcagaagaatatacaggcccaaaaacatctgtcacatcggaaaaaatggcatcaatgggtgaaatgataggaaatatcgctcatcaatggagacaacccctttctataatatactgtctggtgctacagtggacgaagatgaaaaaaactttcaataccgtagatgataagttttttgaagaaacttgtgatcttgtaaatgatgatgcacaatacctctccaaacctattgatgattttagaaattttattaaaggtgatacgggtaaaattaaaattctgatctggaagaaactatcaatagttttcttaagctcgtag

SEQ ID NO: 8552 - protein, 126 aa, Unknown
  Obtained from environmental sample
  misc_feature (1)..(126): Xaa is any amino acid
MALNSKLLMHASNKEQKRKSSEEYTGPKTSVTSEKMASMGEMIGNIAHQWRQPLSIIYCLVLQWTKMKKTFNTVDDKFFEETCDLVNDDAQYLSKPIDDFRNFIKGDTGKIKILIWKKLSIVFLSS

SEQ ID NO: 8553 - DNA, 819 bp, Unknown
  Obtained from environmental sample
  misc_feature (1)..(819): n is a, c, g, or t
gtgggctctggggttatagatagtgatgcaattattaggtattacccttttattggtttacatcaatacttatctgatgtatcagacttttttgattggagtttttattatgaggctgatttaaaacacaatccatcaaagaaagctttatggagttctgtttacttggatcctgcaatgaatggatggatgacttcctatatagcaccaatttataataaaaaagatgaatttaatggtgtagttggtattgatgttccaataaaacaattagcaagtgaagttttacctaaaaacataccttttaacggagaagtatttttaacagatgataagggtatggtatttgctattagtgataaacttaatctatttcttgatttggttcaattaaagaaaaatgataagaacgaactagttatacatgaaattttacaacctaaagaacataacctaataaatcataaaaacaaacaaatatcaatgcagtttgaaaattactataaaaataatcaaaaaagtggatttttctcttttaaaaataaaacctttttagttgagaatagagatattcaaggtacagattggaaggtgttctttttaattgatgaagatgttgtaataaaagacaccctaaaaactcaaaatttctcgtataaagtctctatttatattcttatatttattcttctttgtttagcttgcataatatatattatatacaaaaaatcaaatcaactatctaaagagttgtcatatccaatagaaacactttctaaaaaaactgaaaatatagataatatctcgagccgatcctga

SEQ ID NO: 8554 - protein, 272 aa, Unknown
  Obtained from environmental sample
  DOMAIN (51)...(126): Cache domain
  misc_feature (1)..(272): Xaa is any amino acid
MGSGVIDSDAIIRYYPFIGLHQYLSDVSDFFDWSFYYEADLKHNPSKKALWSSVYLDPAMNGWMTSYIAPIYNKKDEFNGVVGIDVPIKQLASEVLPKNIPFNGEVFLTDDKGMVFAISDKLNLFLDLVQLKKNDKNELVIHEILQPKEHNLINHKNKQISMQFENYYKNNQKSGFFSFKNKTFLVENRDIQGTDWKVFFLIDEDVVIKDTLKTQNFSYKVSIYILIFILLCLACIIYIIYKKSNQLSKELSYPIETLSKKTENIDNISSRS

SEQ ID NO: 8555 - DNA, 900 bp, Unknown
  Obtained from environmental sample
  misc_feature (1)..(900): n is a, c, g, or t
atgagcgaccatgagcgtttagccgaactggagacgatctgtgttgaagaagatcctacctatgagtatgacgtgcatatcacgaagatacttgaaaatatcggtattcctgcagaagtccatcaagacctaatgtcgtcggtagagagttctacgaagatcaaagtccttttggcgcaggtcctttttccaaaaccggaagtattgttcctggatgagccgacgaacaaccttgatatagagacgatcggctggctggagaacgagcttaagcgacatgaagggacactggtcgtcatctctcacgatagacactttatcaactctgtcgtgaccaatatcctggatgtggactatcagaagatccgccagttcacaggtaactacgatgagtggtatatcgcgtcaacggtcatgctgaaacagcaagaagcagaccgttcaaaagcagaaaaagagaaggcagaccttgaagcctttgtccgccgtttctcggcaaatgcttccaaggccaagcaggcgacatcacgccagaagcagcttgaaaagatcaatatagaagacatcaaaccctcttcacgccgtgatccgagtatcgtctttacggccaagcgccagatgggcggagaagcattggagctcacagatattacacatgactacggtgaaggtgacggtcctttgcttaacggtatcactttacgtatcgaaccggaagagaagatcgcggtcatcgggccgaacggtatcggtaagacgacactgttgaagatcattatggaagagatcaagccgacaaaaggtaccgttaagtggggtgcgacgatcgagccttcgtatttccccaagatacagttgagacgatcagcggggacgggacactgtatgactggcttcgcg

SEQ ID NO: 8556 - protein, 300 aa, Unknown
  Obtained from environmental sample
  DOMAIN (1)...(120): ABC transporter
  misc_feature (1)..(300): Xaa is any amino acid
MSDHERLAELETICVEEDPTYEYDVHITKILENIGIPAEVHQDLMSSVESSTKIKVLLAQVLFPKPEVLFLDEPTNNLDIETIGWLENELKRHEGTLVVISHDRHFINSVVTNILDVDYQKIRQFTGNYDEWYIASTVMLKQQEADRSKAEKEKADLEAFVRRFSANASKAKQATSRQKQLEKINIEDIKPSSRRDPSIVFTAKRQMGGEALELTDITHDYGEGDGPLLNGITLRIEPEEKIAVIGPNGIGKTTLLKIIMEEIKPTKGTVKWGATIEPSYFPKIQLRRSAGTGHCMTGFA

SEQ ID NO: 8557 - DNA, 438 bp, Unknown
  Obtained from environmental sample
  misc_feature (1)..(438): n is a, c, g, or t
atggttagttcttgtttattaggtgagttagtaaagtataatggtggtcataatttaatagatgaggatctacttatacagttagaagaaaaatatgagctttatccattttgtcctgaagttgagagtggtatggagattccaagagtcccttgtgaaataatctcaagtgatccaatacaagtggtaaataaaaattatgaagataaaacgcaattctttttattgggtgcaaataaagctcttgatttgtgtaaaaaagaaaatataaaaaaagctcttttaaaagctaattcaccatcatgttctagtgagactatttatgatggaacatttagtggaattacaatgtttggttttggtgtaacaacaaaccttttaaaaaaatgtggtataactatatttgatgaaacaagaatagatgagttactaaattaa

SEQ ID NO: 8558 - protein, 145 aa, Unknown
  Obtained from environmental sample
  DOMAIN (1)...(133): Protein of unknown function (DUF523)
  misc_feature (1)..(145): Xaa is any amino acid
MVSSCLLGELVKYNGGHNLIDEDLLIQLEEKYELYPFCPEVESGMEIPRVPCEIISSDPIQVVNKNYEDKTQFFLLGANKALDLCKKENIKKALLKANSPSCSSETIYDGTFSGITMFGFGVTTNLLKKCGITIFDETRIDELLN

SEQ ID NO: 8559 - DNA, 630 bp, Unknown
  Obtained from environmental sample
  misc_feature (1)..(630): n is a, c, g, or t
gtggtagtggggaaacaacactttttacgacaaatgataatgttagatgagattcaaaaaggttctattgaaatttttggacataaacttacaaaattaaaacctatacatagaaactatataaaaagaaactggggtgttttatttcaatttggagcactattttcctcattaaatgttattgaaaatattgggattatgttaaaagaaaatacaaaactcccacaagatattatcaacgatatagcctatacaaaactcaaaatggtaggacttgatgcagatgttggaaaactgtatccagaggagcttagtggtggtatgaaaaaaagggttgcaatagctagaagtttagcacttgacccaaagatactttttcttgatgagccaacctctggacttgatccatatagtgcaaaagcttttgatgaacttattttagaacttcgagatatgctaggtttaactgttgttattatcacccatgagctagatactatagaaaatgtattagatagatttactattatctcagaagcaaatcttgtgtttacaggcacttatgacgaagcattaaaagaaaataatggtacaataaataaatttttgaaccaaaacagaaaagggtaa

SEQ ID NO: 8560 - protein, 209 aa, Unknown
  Obtained from environmental sample
  DOMAIN (4)...(180): ABC transporter
  misc_feature (1)..(209): Xaa is any amino acid
MVVGKQHFLRQMIMLDEIQKGSIEIFGHKLTKLKPIHRNYIKRNWGVLFQFGALFSSLNVIENIGIMLKENTKLPQDIINDIAYTKLKMVGLDADVGKLYPEELSGGMKKRVAIARSLALDPKILFLDEPTSGLDPYSAKAFDELILELRDMLGLTVVIITHELDTIENVLDRFTIISEANLVFTGTYDEALKENNGTINKFLNQNRKG

SEQ ID NO: 8561 - DNA, 624 bp, Unknown
  Obtained from environmental sample
  misc_feature (1)..(624): n is a, c, g, or t
gtgaaattaaatgaaggtgcaattttagttctctcaggtccaagcggtgccggtaaaagctcactcataaacaagattaaagatcatataggtgattattatttttctatctctactacaactagagatatgcgccatggtgagtcagatggtgtagattaccattttacttcagaagatgagttcaaaaaagatatagaagatgaaaattttttagagtatgctcaagtacatggtaactactatggcacatctcttaagcctgtaaaagatgcactaagagatggtaagctagtaatttttgatatagatgtacagggtcatacagctgttcaaaatagactagcagatattacaagttcagtttttattacaacaccatctttgaagattttaaaagagcgtctatataaacgtgatactgatgctcaagagattatagagaacagaattaaaatggcgcgcatagaggtacaacgaattagtgagtatgattatctaattataaatgatgatttagatgaagctagtgatagactgatatctatagcaaaggcagctagaatgaagatgccgagtatgacaataaatgagtttgtccgtaagtgggaagtaaagagttaa

SEQ ID NO: 8562 - protein, 207 aa, Unknown
  Obtained from environmental sample
  SIGNAL (1)...(17)
  DOMAIN (41)...(146): Guanylate kinase
  misc_feature (1)..(207): Xaa is any amino acid
MKLNEGAILVLSGPSGAGKSSLINKIKDHIGDYYFSISTTTRDMRHGESDGVDYHFTSEDEFKKDIEDENFLEYAQVHGNYYGTSLKPVKDALRDGKLVIFDIDVQGHTAVQNRLADITSSVFITTPSLKILKERLYKRDTDAQEIIENRIKMARIEVQRISEYDYLIINDDLDEASDRLISIAKAARMKMPSMTINEFVRKWEVKS

SEQ ID NO: 8563 - DNA, 333 bp, Unknown
  Obtained from environmental sample
  misc_feature (1)..(333): n is a, c, g, or t
atgctaacgcaagcaaggaaagccaataaaaaacaccatataacgggcttattactctaccaagatggcaactttatgcaggttattgaaggtgaagcaggaaaaatagagcagttatttactaatattagtgaagactataggcattcgggtattattttacttttaaaacaagcaattacacggcgtgaatttcctgactggtcaatggcattcaaaaaactatcaccaacaacaccagctggcttctctaattttttatcttcgaaaacaaacaatggtttacaacctggaaatgcaaaagccgtgctgctaagttttagagataaataa

SEQ ID NO: 8564 - protein, 110 aa, Unknown
  Obtained from environmental sample
  DOMAIN (1)...(72): Sensors of blue-light using FAD
  misc_feature (1)..(110): Xaa is any amino acid
MLTQARKANKKHHITGLLLYQDGNFMQVIEGEAGKIEQLFTNISEDYRHSGIILLLKQAITRREFPDWSMAFKKLSPTTPAGFSNFLSSKTNNGLQPGNAKAVLLSFRDK

SEQ ID NO: 8565 - DNA, 855 bp, Unknown
  Obtained from environmental sample
  misc_feature (1)..(855): n is a, c, g, or t
ttgggatcagtttttatacccttaaaaatgctcatggctcctaaaaaaattcttggagaaattgatagaacttcatctttattaagagatttactaaacaaagactttagcagtattcatattgatgatgaaaccttatttaatgaggttaaaacatttttaagctcaatagctcctgataaagaaaagatattaaaacaatatagtggtaaatctcctatttttgagcagtttggtattgaaagacaaataaaatctttatttggtaaaaatgtaaccttaaaaacgggtgtttatctaattatagagcatacagaagctttgcatgttattgatgtaaatagtggacaaagaggaaagaagaaagataaaacacaagaagaaaatgcacttgaggtaaacttagaggctgcagaagaaattgctcgtcaactaaggttgagagatatgggaggaattgttgttgttgatttcattgatatgaaagaagctgaaaacagaaaaaagctttatgaaaagatgcaggaatttatgcaacttgacagagcaaaacataatattcttcctccaagtaaattcggtttagtacaaattactcgtcagcgagttcgtccagaaatggaaattaaaactgctgaaaaatgtccttgttgtggaggtaaaggagaggttcagtcaactgttttgttggtagatgagattgaaaataacctgcgttacattacacaacagttaaatattaataaagttagtattacggtacatccatttttagaagcttacattaataaaagaaaaggaatattatcttctttaagaaaagaatggcaagctaaatttaaggcatctgtggaa

SEQ ID NO: 8566 - protein, 285 aa, Unknown
  Obtained from environmental sample
  misc_feature (1)..(285): Xaa is any amino acid
MGSVFIPLKMLMAPKKILGEIDRTSSLLRDLLNKDFSSIHIDDETLFNEVKTFLSSIAPDKEKILKQYSGKSPIFEQFGIERQIKSLFGKNVTLKTGVYLIIEHTEALHVIDVNSGQRGKKKDKTQEENALEVNLEAAEEIARQLRLRDMGGIVVVDFIDMKEAENRKKLYEKMQEFMQLDRAKHNILPPSKFGLVQITRQRVRPEMEIKTAEKCPCCGGKGEVQSTVLLVDEIENNLRYITQQLNINKVSITVHPFLEAYINKRKGILSSLRKEWQAKFKASVE

SEQ ID NO: 8567 - DNA, 648 bp, Unknown
  Obtained from environmental sample
  misc_feature (1)..(648): n is a, c, g, or t
atggaaaaatatttatgggacaaggttttctcttcaaaaaataagggtgtaaaatcatcctttttcaaaagttatgaatccattgttacatcaaaagaagggttgaataatctttacaaaatttggaatggggatattagtattactgacatacaactatctattaacgatttttcgaacatagcacttgagctttctgttaaaaattatgttaatttccctgaaatactagatacgcaacttgaatctatcaagaatacagaaaaaaaagaacgctttagttttatttcaaatgcaattaccaaccgagattcgttttttgagagtttaatgctcgaaaaaaatcgagagaaagagccatgggtaattgatgccttaagctatttacaccacccccttaaaagcaaggaatctataaaattcataagaccttctctggaaattatggaggagcttcaaataactggagatattttctttccccaaagatggcttgacgcaactttcagtggtcattcatccattgacgcggttactgaaattaacttatttcttaacgagaatcctgaatttcctgagaacctaaaaaataaagttttacaatctactgacttagtttttagggcgagcattattaaaaatgaataa

SEQ ID NO: 8568 - protein, 215 aa, Unknown
  Obtained from environmental sample
  misc_feature (1)..(215): Xaa is any amino acid
MEKYLWDKVFSSKNKGVKSSFFKSYESIVTSKEGLNNLYKIWNGDISITDIQLSINDFSNIALELSVKNYVNFPEILDTQLESIKNTEKKERFSFISNAITNRDSFFESLMLEKNREKEPWVIDALSYLHHPLKSKESIKFIRPSLEIMEELQITGDIFFPQRWLDATFSGHSSIDAVTEINLFLNENPEFPENLKNKVLQSTDLVFRASIIKNE

SEQ ID NO: 8569 - DNA, 690 bp, Unknown
  Obtained from environmental sample
  misc_feature (1)..(690): n is a, c, g, or t
gtgaggtatagttttaagttggaaggatatgatgaaaaatggtcgcctaaaactgataaaaattctatttactacactagaatgaatgaaggagagtatgtctttagagttaaatcattcaatgcagatggaactgaaggtacggaggcgtctataaaaattattgtggcaaaaccttattggaaaacatggtggttttatacgttgtgttttattggaactggagcattgatatttgttattgtaaaatttagagagcgctcctttattaggtatcaggaaaaattgaaaagggaccttgcactcagaacaagagaagtggttgagcaaaaaaacaaaattgaagcgataaacaaggatattacagatagtatcaattatgctcaaagaatccaagggtctattcttcctcaagatgattatatagaaaaattgtttccaaagtactttatattttttagaccaagagacattgtctccggtgatttctactggtgtggagaaatgggagggaagcagttgattgtttgtgcagactgcactggacatggtgttcctgggggttttatgagtatgatttctcacattcttttgagagaagccctttcggaagagtcgctaaataatccagcattaattcttcagcagattaatagtaaaattgtagaagtattaaaacaaacgggatga

SEQ ID NO: 8570 - protein, 229 aa, Unknown
  Obtained from environmental sample
  DOMAIN (3)...(41): Two component regulator three Y motif
  misc_feature (1)..(229): Xaa is any amino acid
MRYSFKLEGYDEKWSPKTDKNSIYYTRMNEGEYVFRVKSFNADGTEGTEASIKIIVAKPYWKTWWFYTLCFIGTGALIFVIVKFRERSFIRYQEKLKRDLALRTREVVEQKNKIEAINKDITDSINYAQRIQGSILPQDDYIEKLFPKYFIFFRPRDIVSGDFYWCGEMGGKQLIVCADCTGHGVPGGFMSMISHILLREALSEESLNNPALILQQINSKIVEVLKQTG

SEQ ID NO: 8571 - DNA, 471 bp, Unknown
  Obtained from environmental sample
  misc_feature (1)..(471): n is a, c, g, or t
gtgagaaatcatactcataaaacccccaggaacaccatgtccagtgcagtctgcacaaacaatcaactgcttccctcccatttctccacaccagtagaaatcaccggagacaatgtctcttggtctaaaaaatataaagtactttggaaacaatttttctatataatcatcttgaggaagaatagacccttggattctttgagcataattgatactatctgtaatatccttgtttatcgcttcaattttgtttttttgctcaaccacttctcttgttctgagtgcaaggtcccttttcaatttttcctgatacctaataaaggagcgctctctaaattttacaataacaaatatcaatgctccagttccaataaaacacaacgtataaaaccaccatgttttccaataaggttttgccacaataatttttatagacgcctccgtaccttcagttccatctgcattgaatga

SEQ ID NO: 8572 - protein, 156 aa, Unknown
  Obtained from environmental sample
  misc_feature (1)..(156): Xaa is any amino acid
MRNHTHKTPRNTMSSAVCTNNQLLPSHFSTPVEITGDNVSWSKKYKVLWKQFFYIIILRKNRPLDSLSIIDTICNILVYRFNFVFLLNHFSCSECKVPFQFFLIPNKGALSKFYNNKYQCSSSNKTQRIKPPCFPIRFCHNNFYRRLRTFSSICIE

SEQ ID NO: 8573 - DNA, 366 bp, Unknown
  Obtained from environmental sample
  misc_feature (1)..(366): n is a, c, g, or t
atggaaaaagataacaagttaaaaattaaaaaagataatcattttataaaggaggctaaagaactctttgagatgttaactcataacaaagccattcttttggttgttattttatcacttataattactttttttatgtataagctagatacaccaagatctttcgtcccgggcacaatattaacaattgaagaaggttcctcagttaagcaagttgctaatagattacctgaaaataatattataaaatcaactaccttatttaatttggttgttcagttttctgacacccaaactgtgattgctggagaatatcttttttcccaagagnganattttgatagaagttgccaaagagaatccggg

SEQ ID NO: 8574 - protein, 122 aa, Unknown
  Obtained from environmental sample
  misc_feature (1)..(122): Xaa is any amino acid
MEKDNKLKIKKDNHFIKEAKELFEMLTHNKAILLVVILSLIITFFMYKLDTPRSFVPGTILTIEEGSSVKQVANRLPENNIIKSTTLFNLVVQFSDTQTVIAGEYLFSQEXXFDRSCQRESG

SEQ ID NO: 8575 - DNA, 837 bp, Unknown
  Obtained from environmental sample
  misc_feature (1)..(837): n is a, c, g, or t
gtgggattttattacaaatacttacttgggtttggcgaggcagacgaggtgaaggaagaaattgaagcgagtagttttggtagttttattcacgatacgttagaaacactttatcaaccttatgcaaaatatgatgacaaaggagaagttcaaaatgatcctcccagagcgctatcagttgctggaatagaacaaatgctagaacaacaaaaagcacttttaaaacaaggttttgaaaaacatttcgaaaaggacaaaaacgcaattctcgaagggaaaaactacttgagttttgaagttgccagtcacttgaccgaaagatttttaaaagccgaacgcaaattacttaaatctcaaaaaggacatcttttcattgaatcattggaggaaaacatcacaaaaacgattaaactcaatattggcggcaaagaaaaaaagatttgcctaaaaggaatcatcgaccgcgtggaccgattcaacgatggtgttcgaatcattgattataaatctgggaaatgtgaaaaattagatgtaagaatcactgccaaacagaaaaacagcaccaaatcggatgttgaacaattgatttacaacattaaagaacgaaaatacgtgcttcagttattagtttacaattatttgtatcaagagaaatacggtgtttatcctgaattgtccgggattgtttccttgattaatattgaagaaagccctttttatttggataataatctgactggagatataacatcattaatggagctttttgaagaagcactttttgaaattgtctcatcagcttacgatcaagagaaccttttgagcatgatattctag

SEQ ID NO: 8576 - protein, 278 aa, Unknown
  Obtained from environmental sample
  misc_feature (1)..(278): Xaa is any amino acid
MGFYYKYLLGFGEADEVKEEIEASSFGSFIHDTLETLYQPYAKYDDKGEVQNDPPRALSVAGIEQMLEQQKALLKQGFEKHFEKDKNAILEGKNYLSFEVASHLTERFLKAERKLLKSQKGHLFIESLEENITKTIKLNIGGKEKKICLKGIIDRVDRFNDGVRIIDYKSGKCEKLDVRITAKQKNSTKSDVEQLIYNIKERKYVLQLLVYNYLYQEKYGVYPELSGIVSLINIEESPFYLDNNLTGDITSLMELFEEALFEIVSSAYDQENLLSMIF

SEQ ID NO: 8577 - DNA, 573 bp, Unknown
  Obtained from environmental sample
  misc_feature (1)..(573): n is a, c, g, or t
atgaaaatggaagaaaattcaaacaaaaaatttcttaaagatagagaatggcttactattgatggtgagctttgttttgtgaaaaaatttgaaccattatatggtagtgtagtgaaagacaatgaggtgatatcaaaagacactactaagccatatgcttcattaactttaaagtgcagtaaatttgatgaggacgtaatcggctatataacccataaaatagactttgtaaatctatggcatgtatttagagaaaacaattttaatgatgaaaaagaagaagttttgatttattggtcagttaaacattacaacaataaaatagcagaattaatttcaagtatacttttaaaaattttaggcggtacacctttaccaaaattgtttataatgctctatcanaagggttcctatataaattttgagaaaataggatcaactcaattaccagtagatgagaatgcaagggtctttatatatggttcaatgcctataaactcttggatacctgaaattatgaaagagaaatcaaaagataaagttgtaataatttaccaatccttaattttgttc

SEQ ID NO: 8578 - protein, 191 aa, Unknown
  Obtained from environmental sample
  misc_feature (1)..(191): Xaa is any amino acid
MKMEENSNKKFLKDREWLTIDGELCFVKKFEPLYGSVVKDNEVISKDTTKPYASLTLKCSKFDEDVIGYITHKIDFVNLWHVFRENNFNDEKEEVLIYWSVKHYNNKIAELISSILLKILGGTPLPKLFIMLYXKGSYINFEKIGSTQLPVDENARVFIYGSMPINSWIPEIMKEKSKDKVVIIYQSLILF

SEQ ID NO: 8579 - DNA, 705 bp, Unknown
  Obtained from environmental sample
  misc_feature (1)..(705): n is a, c, g, or t
atgaatattcaaaatagctttgaaatagagaatgaggttttttattattatgatttagaaaaagttttttcattatatgaaagtttaagagaacttcctatttgtttaaaaatattattagaagagaatttaagaaaagcaaataatgatgaagaaatagagtatataattgagctatttttaaatagaaaaaatcttaaaatagatttttatccttcaagaattgtaatgcaaaactttagtggaatatcttcccttgttgatttagcatcaatgagagatgtaattgctagatatgaaggtgatataaataaagtaaatccttctgtaatgatagacattatacttgatgactctttagatgagaatattgaaacaaaagagaagtataaatttataaaatgggcaaaaagtaaatttgaaaatattagagtaattccccctggttcaaaaatttgtcatcaaataaatttagagtatttatctacaataattcatctagaacaaaaaaatgaaaaaaattatctatttcctgagacaatagtggcaacaaataaagatactattagtataagttcattgggtgttttagcttgcaaagcagaaggtgttaaatctgagtcaacaatatttggatttcctttatcctttaacttgcccaaagtaataggtgtcgagataaaaggagactggaaaaaacagtaa

SEQ ID NO: 8580 - protein, 234 aa, Unknown
  Obtained from environmental sample
  misc_feature (1)..(234): Xaa is any amino acid
MNIQNSFEIENEVFYYYDLEKVFSLYESLRELPICLKILLEENLRKANNDEEIEYIIELFLNRKNLKIDFYPSRIVMQNFSGISSLVDLASMRDVIARYEGDINKVNPSVMIDIILDDSLDENIETKEKYKFIKWAKSKFENIRVIPPGSKICHQINLEYLSTIIHLEQKNEKNYLFPETIVATNKDTISISSLGVLACKAEGVKSESTIFGFPLSFNLPKVIGVEIKGDWKKQ

SEQ ID NO: 8581 - DNA, 630 bp, Unknown
  Obtained from environmental sample
  misc_feature (1)..(630): n is a, c, g, or t
atgcatctgtttatgcaaatacctcttgagtttcgctatgagtgtaattttacatcgtatcatagaccacctgtatttataaaacgtaaaagcggtcaattaataacgatcagtgccgtttcactaatcggttcattagcttatccacttacattttggacaatgtcttatttaaaagatattgaggcttcagctttgaatgaagagtacaaaattattcacaatgaacgtacaatccgtgaaaaaactataaaattaaaacttaaagaagaagaagcagcaaaaaagaaacttcaattgcaagaagatgagtacaatgagagaaaaagcactctaataaaaattcatgatgtaaaagtcaactaccctatgaaagcaaaaatattaacgcagtttactcaaagattaaataagtttgctgttaatattagcgatataaaatataatgaagaggaagataagaaaaaatttatcttaacactgaatacaaaaagtgaaaaaaacatcacatcccttttagaatacttaacaaaatatgagacaaaaaagtatcgttttactcttgaagagattatatttaatgaagataaaaagagatacacttgtgatctgaaagtgacactaaaatga

SEQ ID NO: 8582 - protein, 209 aa, Unknown
  Obtained from environmental sample
  misc_feature (1)..(209): Xaa is any amino acid
MHLFMQIPLEFRYECNFTSYHRPPVFIKRKSGQLITISAVSLIGSLAYPLTFWTMSYLKDIEASALNEEYKIIHNERTIREKTIKLKLKEEEAAKKKLQLQEDEYNERKSTLIKIHDVKVNYPMKAKILTQFTQRLNKFAVNISDIKYNEEEDKKKFILTLNTKSEKNITSLLEYLTKYETKKYRFTLEEIIFNEDKKRYTCDLKVTLK

SEQ ID NO: 8583 - DNA, 732 bp, Unknown
  Obtained from environmental sample
  misc_feature (1)..(732): n is a, c, g, or t
atgttcatattatctattgatgacattattacagttataaaaaatagtggagataaaagtggtttaacaaaattaaaatatttttttgattatgaaaaatttcaaagtgaaataacaaaattctttacagataactttagctttagaacttgtttttactgcaataaagattttataatcaattttgatgccgataaaaaagtatcaacttttcaacttgatcatttctatgataaaggtacttatccatatttagcattaagtttttataatcttgtaccatcttgttctacatgtaactcttcaaaagtcaaaggaagcaaaaatacttttgcacatgatagcaagataggaacatttcaaaatgaaacttgtctagcgccaaataacaacaatttcgatttcaatgaaaaagtaaaattcaaactgtttttaagtgataaaaataaaaatttacacataaagtcaaaggatgatattgatatttcactaaaagaaaactactcaaaaaagtatgataaatatatagaagttttcaaattaaacgagcgatataaagtacataaagacatagtttttgagatgatagaaaaggctgagctatatcctgaaagtaggttaagagagttggaaaacttaactggaataccttttgagcagataaaaaaagatatttttaacttaatagatgaagattctgatttatcaaaacagccatttcaaaactcataa

SEQ ID NO: 8584 - protein, 243 aa, Unknown
  Obtained from environmental sample
  misc_feature (1)..(243): Xaa is any amino acid
MFILSIDDIITVIKNSGDKSGLTKLKYFFDYEKFQSEITKFFTDNFSFRTCFYCNKDFIINFDADKKVSTFQLDHFYDKGTYPYLALSFYNLVPSCSTCNSSKVKGSKNTFAHDSKIGTFQNETCLAPNNNNFDFNEKVKFKLFLSDKNKNLHIKSKDDIDISLKENYSKKYDKYIEVFKLNERYKVHKDIVFEMIEKAELYPESRLRELENLTGIPFEQIKKDIFNLIDEDSDLSKQPFQNS

SEQ ID NO: 8585 - DNA, 426 bp, Unknown
  Obtained from environmental sample
  misc_feature (1)..(426): n is a, c, g, or t
gtgaaaaaatttacactatctattttaatttctagctctttagcatttggggttgagataaatctccttgaaagttttcaagcaaatttcactcaggagataatagatgaccataataaaagtattaaatataacggagagctatatgccaaaaaaccctctttagctctttggaaatatatatcaccaatagagaaaagtgtatatcttagaaattttattatcaccatagtagaacctgagttagaacaggcaattattaaacatgtttcaaaagatattgatctgtttaacattatctcaaaagccaaaaaaatagataatgagaattacatagctgagtatagctctcaaaaatatgatataaagttaaaagatagtgtactaagtttcataagttataaagatagtttgataataaagtag

SEQ ID NO: 8586 - protein, 141 aa, Unknown
  Obtained from environmental sample
  SIGNAL (1)...(17)
  misc_feature (1)..(141): Xaa is any amino acid
MKKFTLSILISSSLAFGVEINLLESFQANFTQEIIDDHNKSIKYNGELYAKKPSLALWKYISPIEKSVYLRNFIITIVEPELEQAIIKHVSKDIDLFNIISKAKKIDNENYIAEYSSQKYDIKLKDSVLSFISYKDSLIIK

SEQ ID NO: 8587 - DNA, 726 bp, Unknown
  Obtained from environmental sample
  misc_feature (1)..(726): n is a, c, g, or t
gtggtgacagcagtttttatcacacttcttcttgcttgtcagcctgctatttatgagaaaactaaagattcttccattaacattattgaaacaacaacagaacatcaacaggcaacagctttaatttctccttataaagagaatttagaaaaagaaatgaatgaagtattggttatttctgctgaggaatttccaaaagaaaaaggtaaaccagaaactaaattaggcaatttggttgcagatttaagtatggaaatagctcaaaaaacatataatggtaatatagatttttgtttattgaattttggtggactgagaacttctttgcctaaaggagaaattacccgtggaaaaatttttgaattaatgccttttgagaatgaattggtagtggttaccttatcagaaactaaatttctggaattaatggaatatttaaaaaatgttggaccacaacctatttcggggctttcatttgattttacaataaatattgaaaatgaaattaagaatttgttttctcaagaaggaacttctgaaatcaaaatcctcacatccgactatctagccaatggaggcgacaacatgactttttttctaaatcctattaaaatagaaaaagtagggataaaattgagagatgccattatacaatattgtgtagaacagcacgcacaaggaaagcaactaaatggaaaaatagaagggaggatagtttatgagtaa

SEQ ID NO: 8588 - protein, 241 aa, Unknown
  Obtained from environmental sample
  DOMAIN (56)...(201): 5'-nucleotidase, C-terminal domain
  misc_feature (1)..(241): Xaa is any amino acid
MVTAVFITLLLACQPAIYEKTKDSSINIIETTTEHQQATALISPYKENLEKEMNEVLVISAEEFPKEKGKPETKLGNLVADLSMEIAQKTYNGNIDFCLLNFGGLRTSLPKGEITRGKIFELMPFENELVVVTLSETKFLELMEYLKNVGPQPISGLSFDFTINIENEIKNLFSQEGTSEIKILTSDYLANGGDNMTFFLNPIKIEKVGIKLRDAIIQYCVEQHAQGKQLNGKIEGRIVYE

SEQ ID NO: 8589 - DNA, 945 bp, Unknown
  Obtained from environmental sample
  misc_feature (1)..(945): n is a, c, g, or t
atggttatgcatcccattaagccttcattaaataataccaatatatcaagtgtaaaagatccaaatggaaaactattatttgtcgaaatggcaaaagttgctaaaacaaaagggagtgggtatattaattatcaatgggcaaagcctggttttgataaacctcaaaataaaatctcttatgtagcatattttaaagagtgggattgggtagtaggaactggtgtttatatagatgatattgaacaagaagttataaacatggaaaatcaagcttcggaaaatgtagcaactattgttatatcatttattgttcttacactattactattagctatttcattgtctcttctctattttgctattataaaaagtgtaattacgccgctaaagaacttacaagttggatttaataagcttttaacttctaatgacattacaactagattaagtatttcatcacatgatgaaattggaaaagcatcagaactattcaatcaatatatggactcaatacaagagggacttaaaaaagatcaagttgtaattgatgagattaaagaggtagtagatagagttggtagcggattcttcgtgtacaaggtaaaaggtcaagctaataataaaaatattaatgatttaaaagatgtattaaatagtatgattggtactatgaaaacacaacttgtcactattaatgaagctttaatgcaatttggtaaagctaatttttcacataaattatcaattgataatgttagtggtgagataggaacagttataacacaaacaaaggctattggaaataatgtatcagagatttttgcaatgattcaannacagcgtgatgaactagcaaataatattgtatctttaacaaactcttncacagaactttcaacagctgctaatgcacaagcagcttcactagaagaaacagcagctgca

SEQ ID NO: 8590 - protein, 315 aa, Unknown
  Obtained from environmental sample
  DOMAIN (103)...(173): HAMP domain
  misc_feature (1)..(315): Xaa is any amino acid
MVMHPIKPSLNNTNISSVKDPNGKLLFVEMAKVAKTKGSGYINYQWAKPGFDKPQNKISYVAYFKEWDWVVGTGVYIDDIEQEVINMENQASENVATIVISFIVLTLLLLAISLSLLYFAIIKSVITPLKNLQVGFNKLLTSNDITTRLSISSHDEIGKASELFNQYMDSIQEGLKKDQVVIDEIKEVVDRVGSGFFVYKVKGQANNKNINDLKDVLNSMIGTMKTQLVTINEALMQFGKANFSHKLSIDNVSGEIGTVITQTKAIGNNVSEIFAMIQXQRDELANNIVSLTNSXTELSTAANAQAASLEETAAA

SEQ ID NO: 8591 - DNA, 528 bp, Unknown
  Obtained from environmental sample
  misc_feature (1)..(528): n is a, c, g, or t
ttgcttggagatgtcgaaattaaaggattaaataaagattcaattcaagctgacaaagctatattagaattattggatatagctagagtaaaagtagaatacagaaatgaaaaatattgtgtttcaaaatctgatataaattcattcgaatttgattttttacataatcctgatctttttcctgctgctcttttacttgctgtttatgctactggtacaagtaagtttactggtattgagcgattaaaattaaaagaaagcaatagattagatgtattgtgtgatgaattagaaaaatctggtgtgaactcatactgcaatggaacagaattaattatagaaggaaatcagaaaatatcttacgctaagtacaattcttataatgaccatagggtagctatgatgcttattattcatgctatgaagtgtgccgaaggtggcgaaattgatgaagtaaattgtatttcaaaaagttatcctgattttataactgatattaaaaaaattggaggtttgataaatgaatag

SEQ ID NO: 8592 - protein, 175 aa, Unknown
  Obtained from environmental sample
  misc_feature (1)..(175): Xaa is any amino acid
MLGDVEIKGLNKDSIQADKAILELLDIARVKVEYRNEKYCVSKSDINSFEFDFLHNPDLFPAALLLAVYATGTSKFTGIERLKLKESNRLDVLCDELEKSGVNSYCNGTELIIEGNQKISYAKYNSYNDHRVAMMLIIHAMKCAEGGEIDEVNCISKSYPDFITDIKKIGGLINE

SEQ ID NO: 8593 - DNA, 330 bp, Unknown
  Obtained from environmental sample
  misc_feature (1)..(330): n is a, c, g, or t
gtgttnnnnnnnggtttgtggccgaggctaagctcaccgttcctaattgatgttgatgacttaagtgatttactttcaggaattattgattctagtgaatatgataataaaatattgaatatttgctttaataataaaattagtattttagaactagtatctatttttgaaaaaacaatcggaaaaaaggctctttacgaaatgagcaaaaaaggaagtgtttacattccaaacaatgttgaatttttaaactatcttcaaaaaatagatttcaaaattaaagcaagttataacgaagatgttatcgcaaaatattactctaaccggtaa

SEQ ID NO: 8594 - protein, 109 aa, Unknown
  Obtained from environmental sample
  misc_feature (1)..(109): Xaa is any amino acid
MXXXGLWPRLSSPFLIDVDDLSDLLSGIIDSSEYDNKILNICFNNKISILELVSIFEKTIGKKALYEMSKKGSVYIPNNVEFLNYLQKIDFKIKASYNEDVIAKYYSNR

SEQ ID NO: 8595 - DNA, 621 bp, Unknown
  Obtained from environmental sample
  misc_feature (1)..(621): n is a, c, g, or t
atgatgtttgcagatgcatttgatgctatgaccacaaatcgcatctataaggaatataaagatgttcaaggtgcaattagagaacttaaagagttctcaggtaaacaatttcacccagaagttgtcaaaagtgccctaagagttctttgcgatgttaaaatagaaataacaatcaatcaactgcctacaacagaggtggaaaaagaacgctttgcttacttctaccgagatcagcttacaaatgcatacaacactgagtatctaaatttcattttaaatcgtaatgtctttgacaaagagtattcttatattaacaccctctatctacacaatttcagtaactacaatcaaaaatatggttgggatgagggagataagcttctcaatgaggtatgtaactatctgcataattactttccatcatcattcatttttagggtgcatggtgatgatttcattgtcattaacaaaggacatatagaagtgaatcttgctcagagcgagtatttaaaagagcttgaagataagcattctataagcagtagtacacatcgtattgatttaggtaaagataaaataccaagtcttaaagtacttgaaaccgttatgttaagtgcctaa

SEQ ID NO: 8596 - protein, 206 aa, Unknown
  Obtained from environmental sample
  DOMAIN (71)...(192): GGDEF domain
  misc_feature (1)..(206): Xaa is any amino acid
MMFADAFDAMTTNRIYKEYKDVQGAIRELKEFSGKQFHPEVVKSALRVLCDVKIEITINQLPTTEVEKERFAYFYRDQLTNAYNTEYLNFILNRNVFDKEYSYINTLYLHNFSNYNQKYGWDEGDKLLNEVCNYLHNYFPSSFIFRVHGDDFIVINKGHIEVNLAQSEYLKELEDKHSISSSTHRIDLGKDKIPSLKVLETVMLSA

SEQ ID NO: 8597 - DNA, 825 bp, Unknown
  Obtained from environmental sample
  misc_feature (1)..(825): n is a, c, g, or t
gtgtcggcaattatagtacctgtaaaaaatgaagaaggtaaagtcatcaactacatcggaatcaagcaggagagtacagaacaagtctacttaaaagcaaaactagcagataaagaagatatcataattgctcagtcacgccatgcggctatgggagagataattggtatgattgctcatcagtggagacagcctcttagtgtgattgcaatgggtgctaacaatttacttattgatattgacctagatgagcttaatcaagagagcattacagaagaagcacggggcattataaagcaaacagagtatctatcaaagaccattgatgactttagaaacttcttccgtccagacaaggaaatagaagaggtagaaattcaagagatagtgcatgaagcacaaaatattataggtaaaagtcttgagaataaacaagttacactatccataaagtacgaagaaaactgtaaggtaaacacctattctagagaactgttgcaggtctttattaacttgcttaaaaattctgaagaagcactctgtgaaaatatgggaaaagaccgtcaaataagtgttaatataagcagcattgcagagaattctattacaacaatatgtgataatggaggtggcattaatgaagaaattatagataaaatcttcaatccatacttctcaacaaagaatgaaaaaaatggtactggactggggctatatatgagtaaaacaatcattngaaaacatttaaatggaacaattgaagtctataatactacagctgggggctgctttaaaataactatccctacgggagggaaaccataa

SEQ ID NO: 8598 - protein, 274 aa, Unknown
  Obtained from environmental sample
  DOMAIN (50)...(120): His Kinase A (phosphoacceptor) domain
  misc_feature (1)..(274): Xaa is any amino acid
MSAIIVPVKNEEGKVINYIGIKQESTEQVYLKAKLADKEDIIIAQSRHAAMGEIIGMIAHQWRQPLSVIAMGANNLLIDIDLDELNQESITEEARGIIKQTEYLSKTIDDFRNFFRPDKEIEEVEIQEIVHEAQNIIGKSLENKQVTLSIKYEENCKVNTYSRELLQVFINLLKNSEEALCENMGKDRQISVNISSIAENSITTICDNGGGINEEIIDKIFNPYFSTKNEKNGTGLGLYMSKTIIXKHLNGTIEVYNTTAGGCFKITIPTGGKP

SEQ ID NO: 8599 - DNA, 564 bp, Unknown
  Obtained from environmental sample
  misc_feature (1)..(564): n is a, c, g, or t
atgccatttattgaaaatgaagaaatcgtttttttggtttctaaaattgaaaacctaaaaaaagaatatttagatactaatgaaattcaaaattcttctgaatatgaaaataaattggatttagtcattaaggaactcgatcaaaaagtacttgaagcatttaatttaaatgagcaagagtatgctttagtagattatacaaatagcgtagtaataccttgggtaatacaaaaaaaatacaatgtagcctttaaaaaactagctttagaagatgaaattttaaaagattatatcaatatttttctaaatcattattccaaaatatatgaacaaaacaatatgtattttcaagctaatgtgttttgggatgactatgctatagggatatatttcaaagttttaaatgaaaaacctgatgaagaaacaacatggaaaaaagaaaaaaatattcaaaactttccaaagatgtcagaaagtcgaattttagaaaatctttttattcaaaaagatatcaaaggctttgaaaaagatggtttttatgttgtcaagcccaatgagtattaa

SEQ ID NO: 8600 - protein, 187 aa, Unknown
  Obtained from environmental sample
  misc_feature (1)..(187): Xaa is any amino acid
MPFIENEEIVFLVSKIENLKKEYLDTNEIQNSSEYENKLDLVIKELDQKVLEAFNLNEQEYALVDYTNSVVIPWVIQKKYNVAFKKLALEDEILKDYINIFLNHYSKIYEQNNMYFQANVFWDDYAIGIYFKVLNEKPDEETTWKKEKNIQNFPKMSESRILENLFIQKDIKGFEKDGFYVVKPNEY

SEQ ID NO: 8601 - DNA, 870 bp, Unknown
  Obtained from environmental sample
  misc_feature (1)..(870): n is a, c, g, or t
atgagtcttttagagataaaaagttttattaaaaatataaaaccttttgataatttattaaataatgagcttgaagaggtgtgtagtcacttagatatattatattttaaagccaatgaagagattttatctcctgctaaaaatgctgaatatctttattttattattaaaggggtagtgcaagaaaaactagaagaggaggtagtatctgtatattctgctaatgagtattttgatcctataacacttatagaaaataagataaaaaatacttttgtcactgtacaagagtcaattttgtatgcactaccaaaagagatatttctaaaatatatgtatcaaaatgacgctttagagagttattttttctcaactatttcacaaaaattaaatagtagtatgcaaaatgaacaaaagaaaaagttattagattttgctatgtcaaaggttgaagatgcctatttacaaaaaccgatctatatagatgaaactgaaactatctatagtacagttgtacaactcactactaataatattcaatcaattttagttaaaagagcagacggtgagattggtattgtaacagactcaagttttgtaaaaaaagtacttcttaaaaggatggatgtagatggacctattagtcaaattacaacttacggtttaaaatatatagaagctacagactttttatttaatgcccaactacaaatggcnaaatacaatattaaaagacttgtggtaagaaaagagggtgagattgtaggtatattagatattgtgagtcttagtagcttttttgcttctcatacacactcaactagcatgttaatagaagaggctaaaactgttgaagaggttaaagaagct

SEQ ID NO: 8602 - protein, 290 aa, Unknown
  Obtained from environmental sample
  DOMAIN (30)...(117): Cyclic nucleotide-binding domain
  misc_feature (1)..(290): Xaa is any amino acid
MSLLEIKSFIKNIKPFDNLLNNELEEVCSHLDILYFKANEEILSPAKNAEYLYFIIKGVVQEKLEEEVVSVYSANEYFDPITLIENKIKNTFVTVQESILYALPKEIFLKYMYQNDALESYFFSTISQKLNSSMQNEQKKKLLDFAMSKVEDAYLQKPIYIDETETIYSTVVQLTTNNIQSILVKRADGEIGIVTDSSFVKKVLLKRMDVDGPISQITTYGLKYIEATDFLFNAQLQMAKYNIKRLVVRKEGEIVGILDIVSLSSFFASHTHSTSMLIEEAKTVEEVKEA

SEQ ID NO: 8603 - DNA, 525 bp, Unknown
  Obtained from environmental sample
  misc_feature (1)..(525): n is a, c, g, or t
gtgncaattacaggagataataagtatttgactgatttaaaagagtatatgtatacaatatgtgaaaatgcaccatctttttatccatatttgcggaagcctattgtctcatttgaaacaccattaggattatttagtgattttgttgtggataaagatttacataaagatgaattagatattaaaaaaggtggaattttccctattgttcatggggtgagaactttagctatagaaaaaaacctacatgaaacaaacactgtagatcgtttaaaagaacttcatgagttagatataatagatgaagagtttatgaatgaattgactgaagcatttaactttttattgacattacgattacgatttaggcttgaaaaaatagataaaagagaagagttggataattatataaatccatctagattaactattttagaaaaagatttattaaaagatagtttaaaaatagtgaataaatttaaaaaatttatcacatatcattgtaaaataaatatgataagttaa

SEQ ID NO: 8604 - protein, 174 aa, Unknown
  Obtained from environmental sample
  DOMAIN (1)...(171): Putative nucleotidyltransferase DUF294
  misc_feature (1)..(174): Xaa is any amino acid
MXITGDNKYLTDLKEYMYTICENAPSFYPYLRKPIVSFETPLGLFSDFVVDKDLHKDELDIKKGGIFPIVHGVRTLAIEKNLHETNTVDRLKELHELDIIDEEFMNELTEAFNFLLTLRLRFRLEKIDKREELDNYINPSRLTILEKDLLKDSLKIVNKFKKFITYHCKINMIS

SEQ ID NO: 8605 - DNA, 333 bp, Unknown
  Obtained from environmental sample
  misc_feature (1)..(333): n is a, c, g, or t
atgcaagtaaattatagaaccacaaaacttggaaaagttttaaatagtagaaaattattagaaaaaaactatggcttgataaatgcaaaaaaaatcatgctacgtttaacagacatgaaatctattaataatctacaaaccttgatgacattgccagggagatatcatcaattgaagggcaatcgcaaaggagaatttgcatgcgatttagaacatccatttagattaattttcaaacctgataacaatcctcttccagttgatgaagatgataatttattattgtcaaaagttacaattattgaaattgaggaaatagttgactatcactaa

SEQ ID NO: 8606 - protein, 110 aa, Unknown
  Obtained from environmental sample
  misc_feature (1)..(110): Xaa is any amino acid
MQVNYRTTKLGKVLNSRKLLEKNYGLINAKKIMLRLTDMKSINNLQTLMTLPGRYHQLKGNRKGEFACDLEHPFRLIFKPDNNPLPVDEDDNLLLSKVTIIEIEEIVDYH

SEQ ID NO: 8607 - DNA, 888 bp, Unknown
  Obtained from environmental sample
  misc_feature (1)..(888): n is a, c, g, or t
ttgatatacctgctcatttttggatacagcggcagtctgactacaatgaagttgttgccagactcagccagaaaaaccaatattgtggaggctgtagattgggcaaagaatttcccttatgcagcaatggtcaagttgggatgggtgccggttacaagaaagattgaagaaaaggcagaagaactgttaaactattttcagatttcgaaagcgtcctcatgggacagcctgtatttacaagaaaaattacccttataccttcgcatttcattaaaacatgccaaagacccttacgcattatcagcatggttagtgcatggccaaaaagttgccagcgaaatggaagctcctgattacgataaaaaagaactggagaagtgcttgcctctgttaaaggacatcatggcaaaacaacccgataatttctaccataaaattcaatcggtttgtctgagggccggtgttaaaatagtatttacaccacttttacccaaaaccgttatcaatggtgcggttcgctggtcaggaaaaaacccacttgttcaggtttcagacaggtacaaacgttacgacatcttctggttctcattgtttcatgaattgggacatgttttgctgcatggcaacaaaaaaaatatttttattgaagacatttcggggattgaccaaagcgaccaaaaagagcaggaagcaaacgatttagcaattaaatggacattaaccgatgaggaataccaggaaatttttgacaccatcaatgtgggagcggatattgcaacaaccgtaaatctttatgcaaagaaatatgcaacccatcaggatatgattatcggtagattgttacgtagaaatgagggatttacaaatacaatctccgagccaatctga

SEQ ID NO: 8608 - protein, 295 aa, Unknown
  Obtained from environmental sample
  DOMAIN (150)...(281): Domain of unknown function (DUF955)
  misc_feature (1)..(295): Xaa is any amino acid
MIYLLIFGYSGSLTTMKLLPDSARKTNIVEAVDWAKNFPYAAMVKLGWVPVTRKIEEKAEELLNYFQISKASSWDSLYLQEKLPLYLRISLKHAKDPYALSAWLVHGQKVASEMEAPDYDKKELEKCLPLLKDIMAKQPDNFYHKIQSVCLRAGVKIVFTPLLPKTVINGAVRWSGKNPLVQVSDRYKRYDIFWFSLFHELGHVLLHGNKKNIFIEDISGIDQSDQKEQEANDLAIKWTLTDEEYQEIFDTINVGADIATTVNLYAKKYATHQDMIIGRLLRRNEGFTNTISEPI

SEQ ID NO: 8609 - DNA, 717 bp, Unknown
  Obtained from environmental sample
  misc_feature (1)..(717): n is a, c, g, or t
atgagattaggggctgattatttagcaacaggacattatgctaaaacggatggtgagtttatttataaagcagaagatttatctaaagatcaaagttatttcttaggacaagtttcaaaagaggtattaccaaagttacttttccctatgaataaatatacaaaagaatatatcaaaagtgaagcttcaaagattccacaattagcatcaatagcaacacaaaaagagtcacaagagatctgttttgtagatacagtatataccgatatcataaaaaaatataccaatattgatatccctggaaaaactttagatacccaaggaaatgtagtaggagatcataaaggttatatgcactatactgttggtaagagaagaggattttatgtacatggtgcccatgatccccattttgtaacttcattggataaagaatcaaatacaataactgttggtaaaaaagaagatttagctataaattatgttattgcaaataatctaaatatgtatatagaagataaaaaaatatcttgtgatgttaaactaagatttagaagtacaactgtaaaatgcgatttaattattgaagatgataaagcttccataaagctagaagaaccagtttatggagttgctacaggacaaacagctgttttctatgacaatgataaagttataggtagtggctggatagaaaaaacagagtttaaaaaatag

SEQ ID NO: 8610 - protein, 238 aa, Unknown
  Obtained from environmental sample
  DOMAIN (1)...(231): tRNA methyl transferase
  misc_feature (1)..(238): Xaa is any amino acid
MRLGADYLATGHYAKTDGEFIYKAEDLSKDQSYFLGQVSKEVLPKLLFPMNKYTKEYIKSEASKIPQLASIATQKESQEICFVDTVYTDIIKKYTNIDIPGKTLDTQGNVVGDHKGYMHYTVGKRRGFYVHGAHDPHFVTSLDKESNTITVGKKEDLAINYVIANNLNMYIEDKKISCDVKLRFRSTTVKCDLIIEDDKASIKLEEPVYGVATGQTAVFYDNDKVIGSGWIEKTEFKK

SEQ ID NO: 8611 - DNA, 510 bp, Unknown
  Obtained from environmental sample
  misc_feature (1)..(510): n is a, c, g, or t
atganaataaaaaaagaggttagcgtaaaagagggtaataagtatgtaaaattatctcctgcatctgatctatcttatatgtttatgattaagtttgagcatcctgctataaatgagcaaaattttacacttcatttttctaaagagaactataaagagcagatatcacgtgcacgtacatttggttttttacatgaagttcaatatttaagatcaaaaggtttagcactcggcggcagtctagaaaatgcagttgttttagatgataagaaggttattaattcagaaggattgagatattcagatgagtttgttcgtcataaaattttagatgctatcggtgatatgtctctaattggtttaaactttgtaggtaattatgaagcatatgctggaagtcatgatctaaatcataaacttacattagaactgctaaaagatccgcaaaattatgaagtaatagagttagatgctatccaagagaaggagatggctaaagcttatgcatag

SEQ ID NO: 8612 - protein, 169 aa, Unknown
  Obtained from environmental sample
  DOMAIN (1)...(149): UDP-3-O-acyl N-acetylglycosamine deacetylase
  misc_feature (1)..(169): Xaa is any amino acid
MXIKKEVSVKEGNKYVKLSPASDLSYMFMIKFEHPAINEQNFTLHFSKENYKEQISRARTFGFLHEVQYLRSKGLALGGSLENAVVLDDKKVINSEGLRYSDEFVRHKILDAIGDMSLIGLNFVGNYEAYAGSHDLNHKLTLELLKDPQNYEVIELDAIQEKEMAKAYA

SEQ ID NO: 8613 - DNA, 339 bp, Unknown
  Obtained from environmental sample
  misc_feature (1)..(339): n is a, c, g, or t
atgctatccaagagaaggagatggctaaagcttatgcatagtgttgtcgttgttgcattaagctcacctctgattataggagtttatgaaaatgaagctcttattgaagagataaagagtgatgggaaatcttcagaacttttgccgtcactttttagagaacttttacaaaagtatgatattgaaaatttaatatatgcaaaaggtcctggaagttttatggccataaaagtaagctatatatttttaaaaactttatcgattgtaaaaaaaataaattttttagcaacagatgctttctattttaatgataattccacctataaaagcgattggtaa

SEQ ID NO: 8614 - protein, 112 aa, Unknown
  Obtained from environmental sample
  DOMAIN (33)...(107): Glycoprotease family
  misc_feature (1)..(112): Xaa is any amino acid
MLSKRRRWLKLMHSVVVVALSSPLIIGVYENEALIEEIKSDGKSSELLPSLFRELLQKYDIENLIYAKGPGSFMAIKVSYIFLKTLSIVKKINFLATDAFYFNDNSTYKSDW

SEQ ID NO: 8615 - DNA, 804 bp, Unknown
  Obtained from environmental sample
  misc_feature (1)..(804): n is a, c, g, or t
ttgatgcaaattgttataaaaaatgcgggagcacaacgaggtgtcttactcttaaaagataaagaggggctttttgtagaagctgttagttctattgataataataaaactgaagtgatgcaccataaagcttatatgcagtgtgaaagaatagtccatactgtagtaaattatgttttaagaacacaaaaatatattgttatagataaccttaatgaagacaaagtttttaaagatagtaataatagagatattaaatctgttttgtgtgctcctttattgttacaaggggaattaaaaggtattatgtatttagaaaataatcttttgccagctgtatttacagatgaaaatgtacagtttttacaatacttaagtggtcaaatcaccatatcaattgaaaatgcaatggtatataataatctagaaaagacagtagaatcaagaacaaaagaacttgaaatcgctaaaagtaaagcagaaattgcaacacaaactaaatcagaatttttagcaaatatgtcccatgagatacgaacacctatgaatggaattatagggatgtctcatttagtattacaaacagatttaaatgaaaaacagaaaaactatatacaaaaaattgataatagtgctaaaaacttattgagtattataaatgatattttggatttttctaaaatagaagctggaaaaatagagatagaaactatagaatttgatctttttacggtcatagataatagcattaatcttatagagttattagcacatgaaaagaatttagagataatagtaagttat

SEQ ID NO: 8616 - protein, 268 aa, Unknown
  Obtained from environmental sample
  DOMAIN (1)...(133): GAF domain
  misc_feature (1)..(268): Xaa is any amino acid
MMQIVIKNAGAQRGVLLLKDKEGLFVEAVSSIDNNKTEVMHHKAYMQCERIVHTVVNYVLRTQKYIVIDNLNEDKVFKDSNNRDIKSVLCAPLLLQGELKGIMYLENNLLPAVFTDENVQFLQYLSGQITISIENAMVYNNLEKTVESRTKELEIAKSKAEIATQTKSEFLANMSHEIRTPMNGIIGMSHLVLQTDLNEKQKNYIQKIDNSAKNLLSIINDILDFSKIEAGKIEIETIEFDLFTVIDNSINLIELLAHEKNLEIIVSY

SEQ ID NO: 8617 - DNA, 789 bp, Unknown
  Obtained from environmental sample
  misc_feature (1)..(789): n is a, c, g, or t
atgaaagatgtgcatttaacacctgttgtaaatcctgatactattaattttacagtgaattttgaacaaaataaatcggaatatgaacaaagtgaaattcaacctcttgttaatttaataaaaagcgaggatcgtataattttacatgcagatgtttctgctttttcaagtgttgaagggactcccgatattaataaacgaatttttaccgaacgtggcgaaaacattattaaagcctttgaggttgcacaagatagtagtattgaaatgactattataacacaagaaaactggaaactgttttatcaacaattaaaagaaagtgagaaatattcatttctggcagaaaaggatactattgaattaagaaaatatgtaaacgaacaaaacaatgcaagtgaacttgaaccatttctggcaaaacaacgatatgtaaaggtcgatttaattactgaaccaaaacttaccgaaaaaaacaaaatcattctattaaaaaaatcatatgacgatcttgtatttacgcttagtgtaaaagcaaaaaattacagaaaaaaaggatattctgaaaaagatattaatcgaaaactgaaaaaatatattaaatcaattaaagatatccagattttcttttttaataaatatttggaaaagaaaatcactgtaaaacaaattgatagactgaatataataaatgatcctgttttctctgaaatgattttcaataagttaatgttcgattatctttattcggagaacaaactagtaacagaaattttcaaccggccataa

SEQ ID NO: 8618 - protein, 262 aa, Unknown
  Obtained from environmental sample
  misc_feature (1)..(262): Xaa is any amino acid
MKDVHLTPVVNPDTINFTVNFEQNKSEYEQSEIQPLVNLIKSEDRIILHADVSAFSSVEGTPDINKRIFTERGENIIKAFEVAQDSSIEMTIITQENWKLFYQQLKESEKYSFLAEKDTIELRKYVNEQNNASELEPFLAKQRYVKVDLITEPKLTEKNKIILLKKSYDDLVFTLSVKAKNYRKKGYSEKDINRKLKKYIKSIKDIQIFFFNKYLEKKITVKQIDRLNIINDPVFSEMIFNKLMFDYLYSENKLVTEIFNRP

SEQ ID NO: 8619 - DNA, 744 bp, Unknown
  Obtained from environmental sample
  misc_feature (1)..(744): n is a, c, g, or t
atgggacctcttattcacaatacaaatganatagatagacttaagaatgattataatgtaggactgtatacctctttagatgaagtgaaagataaagatacaatcattattagaacacatggtattccaaaatttgatttaaaagatttaaaagcaaaagatgcaaaagttatcaatgcaacatgtccttttgttacaacgcctcagcaaatagttaaaaaaatgtcccaagagcaatactcaattgtaatttttggagatgaagatcatcctgaagttttaggcgttcaatcatatgcaaaagaccaagatgatgtttttgtaatacttgaacctagtgatttggataaaataacttttaaatactcaaaagtagcaaccattgcgcaaacaacaaagaaaaaagagaaatatctagaaattgtaaacactttaattttgaaaaacaaagaagtgagggtatttaacacaatttgtgatgcaacttttgaaaatcaagatgcagcaagagagttgtcaagagaagtagatattatggttgtaattggaggtaaaaactcctcaaatacaaaacaacttctaagcatcgcacaagagaattgcaaagatagttatcttttggaagatgagagagaattagaagcttcatggttcaaaaataaaaacctttgcggtataacagccggtgcatcaacgccagattgggttatacagaaagtagtagaccaaatagaaaaatattaa

SEQ ID NO: 8620 - protein, 247 aa, Unknown
  Obtained from environmental sample
  DOMAIN (1)...(247): LytB protein
  misc_feature (1)..(247): Xaa is any amino acid
MGPLIHNTNXIDRLKNDYNVGLYTSLDEVKDKDTIIIRTHGIPKFDLKDLKAKDAKVINATCPFVTTPQQIVKKMSQEQYSIVIFGDEDHPEVLGVQSYAKDQDDVFVILEPSDLDKITFKYSKVATIAQTTKKKEKYLEIVNTLILKNKEVRVFNTICDATFENQDAARELSREVDIMVVIGGKNSSNTKQLLSIAQENCKDSYLLEDERELEASWFKNKNLCGITAGASTPDWVIQKVVDQIEKY

SEQ ID NO: 8621 - DNA, 426 bp, Unknown
  Obtained from environmental sample
  misc_feature (1)..(426): n is a, c, g, or t
ttggatagacctttaagtcaaagagtagaggatgatgcatacctaatggcaaataagttagtagagttaaacattttcccagacttaattatctcaagcccttcaaaaagaacaaaatgcacaataaacattatagctccacaattgggttatgaaaaagatattgtatatgacgataaaatttatgaatcaaatatgacaaatttaaaaaagatagtgaagaatctcgataataaaaataattcagtatttctttttgggcataatcctggtttaaatatgttagcagaagatttatgcggatttataaaaaatattgcaacgacaggtatattgattataaattttgattgtaactcttggagtgaagtatcaaatctcaatagtaatttaagtgattatatttatccaaaaaaatataaataa

SEQ ID NO: 8622 - protein, 141 aa, Unknown
  Obtained from environmental sample
  misc_feature (1)..(141): Xaa is any amino acid
MDRPLSQRVEDDAYLMANKLVELNIFPDLIISSPSKRTKCTINIIAPQLGYEKDIVYDDKIYESNMTNLKKIVKNLDNKNNSVFLFGHNPGLNMLAEDLCGFIKNIATTGILIINFDCNSWSEVSNLNSNLSDYIYPKKYK

SEQ ID NO: 8623 - DNA, 399 bp, Unknown
  Obtained from environmental sample
  misc_feature (1)..(399): n is a, c, g, or t
ttgaataagtcgctcatcatacaagaacaaggacaggatgcttatgattttataagtaattacatggatgttcagtctaatgaaactgaggtgctaaaaacaattaatgtatttaacatcaaaaaaattgagcctccaaaaaaaggaatagtcaacctcaataaaatgaatgacattaaggataataatttattctttacagaggtctataataaattggtgagtgatggaatttttattggctgtgtggaaaccaaagaagagcgtagaagaaggatttacaaganatatcctatcatcattgctcaaatttnatatttcttcgattttatttttaagcgggttttttccagttgtttttaccagtgggtctatttttcatactgctggcagaaccaa

SEQ ID NO: 8624 - protein, 133 aa, Unknown
  Obtained from environmental sample
  misc_feature (1)..(133): Xaa is any amino acid
MNKSLIIQEQGQDAYDFISNYMDVQSNETEVLKTINVFNIKKIEPPKKGIVNLNKMNDIKDNNLFFTEVYNKLVSDGIFIGCVETKEERRRRIYKXYPIIIAQIXYFFDFIFKRVFSSCFYQWVYFSYCWQNQ

SEQ ID NO: 8625 - DNA, 609 bp, Unknown
  Obtained from environmental sample
  misc_feature (1)..(609): n is a, c, g, or t
atgaaaaatatcagtgtaagtcaaaaaataaaagtacttgcatcccttttaatcttaactatttttacagttataagtatcactatatatctaaatcaaaagaatataaaagatgcaacaatagtaaatatagctggtaaacaaagaatgttaacacaaaaaatcacaaaaaatattttttatctttaccaatacaaaactgatgacttttcagaacttgataatgctatatctgaatttaatcatggactgaaaactttaaaagatggaaataaacttttaggtatctcagcagctccaacccaagatattaacaatcaaatatcaaaagtaattattctttgggatagttttgaaaaaaatactaataattttaaaacttctttaatgcaaaatgacataaatcagttgaactccattttgaaatatatatacaaaacaaacaataaattattagcagaagtggataccattgtgactctttatacaaaacatatagaacaaaaaacaaattttataaagaattttcaatatgtatcattctctttactatttatttttgccctatatgctttgatacaattaagacagatagaagctcatgctaga

SEQ ID NO: 8626 - protein, 203 aa, Unknown
  Obtained from environmental sample
  misc_feature (1)..(203): Xaa is any amino acid
MKNISVSQKIKVLASLLILTIFTVISITIYLNQKNIKDATIVNIAGKQRMLTQKITKNIFYLYQYKTDDFSELDNAISEFNHGLKTLKDGNKLLGISAAPTQDINNQISKVIILWDSFEKNTNNFKTSLMQNDINQLNSILKYIYKTNNKLLAEVDTIVTLYTKHIEQKTNFIKNFQYVSFSLLFIFALYALIQLRQIEAHAR

SEQ ID NO: 8627 - DNA, 339 bp, Unknown
  Obtained from environmental sample
  misc_feature (1)..(339): n is a, c, g, or t
atgaagaacacagattttatagtacctagagcagatatatatgaaaacgaggatcagtacatcgttgtactcgacatgcccggcaccacaaaggagggcattgaagtaaccgccgtagaagatactcttactattaccggtaaagtcaacatcgtaaaagagacatggaaagccgtgtcgagagagttttcactccgtgattacaagcgtgatttcgccatcggtaacaagatagaccgtgacgctatagaggcacactacgaaaacggtattttacgactggagctaaaaaaatccgaggtcgctaagcctcgcaagatacaagtagccatgaactaa

SEQ ID NO: 8628 - protein, 112 aa, Unknown
  Obtained from environmental sample
  DOMAIN (12)...(110): Hsp20/alpha crystallin family
  misc_feature (1)..(112): Xaa is any amino acid
MKNTDFIVPRADIYENEDQYIVVLDMPGTTKEGIEVTAVEDTLTITGKVNIVKETWKAVSREFSLRDYKRDFAIGNKIDRDAIEAHYENGILRLELKKSEVAKPRKIQVAMN

SEQ ID NO: 8629 - DNA, 849 bp, Unknown
  Obtained from environmental sample
  misc_feature (1)..(849): n is a, c, g, or t
ttgatggctccgaatggaggcagtgtaagagctattaaagctgttgatgcttcagatatgggtcgtaaaaaaattgataagttagttgagtttgtaaaaacatataatgcaaagggattggcttggattgcatataaagaagaagaaattaaatctccaatatctaagtttttaaaagaagaagaaattaattctataatttctaaaatggatgcaaaatgtggagatttaattttaatagttgctgataaagataatgttgtattacaatctttaggtgcattgagattacagttagcaaaagatttagaaatacttaaagataatcatgaatttaattttgtatgggtaacagaatttcctttagtatcatttaatgaggaagaaaatagatatcaagctgagcatcatccttttacaatgccaatggatgaagatattgagtatctagataaggatccttcaagagtaagggctaaggcctatgatatagtacttaatggagaagaactaggtggaggaagtataagaattcatgatagtaagcttcaagaaaaggtatttgaagttttaggatttacaaaagaatctgcttgggaaagatttggatttttactagaagcatttaaatatggtccacctccacatggcggtttggcatatggatttgatagattagtaatgtttttatgtggaacagataatattaaagatgttatagcatttcctaaaaatcaaaatgcttattgccctatgacagaagcacctaatacagttgattataaaccattaaaggaaataggtatcaatttgtttaagggaggatttaaatggaataagggaccttag

SEQ ID NO: 8630 - protein, 282 aa, Unknown
  Obtained from environmental sample
  DOMAIN (8)...(247): tRNA synthetases class II (D, K and N)
  misc_feature (1)..(282): Xaa is any amino acid
MMAPNGGSVRAIKAVDASDMGRKKIDKLVEFVKTYNAKGLAWIAYKEEEIKSPISKFLKEEEINSIISKMDAKCGDLILIVADKDNVVLQSLGALRLQLAKDLEILKDNHEFNFVWVTEFPLVSFNEEENRYQAEHHPFTMPMDEDIEYLDKDPSRVRAKAYDIVLNGEELGGGSIRIHDSKLQEKVFEVLGFTKESAWERFGFLLEAFKYGPPPHGGLAYGFDRLVMFLCGTDNIKDVIAFPKNQNAYCPMTEAPNTVDYKPLKEIGINLFKGGFKWNKGP

SEQ ID NO: 8631 - DNA, 768 bp, Unknown
  Obtained from environmental sample
  misc_feature (1)..(768): n is a, c, g, or t
atgctgggagcggcaatcgttcatccggattttaaagaagtgatccccttagctccggagtttataatgaaacaagatggtgaaactaaaaacgattgtgagcgtaatgccgctaaacgattttttaaaaaactcaggcaggatcatccgcatctgcccttaattataaatgaagatgctttgagctctaatgcaccgcatattcgagaggctcaaaaatataatcttcgttttatattaggcgttaaagaaggtgaccattcctttctgtttgaacaaatacgcatagccgaaaaagaagaccggacaacaacttttgaaattgtcgatcaaaataattcggaaatgatccatcgtttccggtttcttaatcatgttcctctcaatgcatcaaatcaggatctattggtcaattttttggaatattgggagattacgccaaataaaacgaaacatttcagttggattaccgattttatcattgataaatccaatgcctatatactcatgagaggcggacgtgctcgctggaaaatcgaaaatgaaacctttaatacgttaaaaaatcaagggtatcatttcgaacataattttggcctcggtgagaaaaatttgagtcttatctttgccatgctcatgatgttagcttttctgacagatcanactcaacaactttcatgcaaattgttccaggcagcctggaaaaagaaagccgccaaaaaatacttgtgggaacagatgagaattttatttaagccttcttatttt

SEQ ID NO: 8632 - protein, 256 aa, Unknown
  Obtained from environmental sample
  misc_feature (1)..(256): Xaa is any amino acid
MLGAAIVHPDFKEVIPLAPEFIMKQDGETKNDCERNAAKRFFKKLRQDHPHLPLIINEDALSSNAPHIREAQKYNLRFILGVKEGDHSFLFEQIRIAEKEDRTTTFEIVDQNNSEMIHRFRFLNHVPLNASNQDLLVNFLEYWEITPNKTKHFSWITDFIIDKSNAYILMRGGRARWKIENETFNTLKNQGYHFEHNFGLGEKNLSLIFAMLMMLAFLTDXTQQLSCKLFQAAWKKKAAKKYLWEQMRILFKPSYF

SEQ ID NO: 8633 - DNA, 447 bp, Unknown
  Obtained from environmental sample
  misc_feature (1)..(447): n is a, c, g, or t
ttgaaacatactatgggtattttttctacctctatactaaactctatttgtgacaaaatggcaatcgctattaaaaataaagctccatcaataataaatgatgttttcacaccaagtaaacttactacaactccacctaatgccatacctgctgtaaaagttatagaccataccattgagtgtatctcatttgcttttataagtgcttcaccacttaatagttttggtaaaacagtcatcactgttgtaaagaatatagaggcacttcccatccgtataaaaagaaataacatcaaaagccatacatcttctatactattaatcaacaaaaatgctatggtcatactcatctctgtaataagaagtatcaacataagtttttttaccgctattctatctacaattgagccattaaacggagaaagaataacccctgggagaaaatga

SEQ ID NO: 8634 - protein, 148 aa, Unknown
  Obtained from environmental sample
  misc_feature (1)..(148): Xaa is any amino acid
MKHTMGIFSTSILNSICDKMAIAIKNKAPSIINDVFTPSKLTTTPPNAIPAVKVIDHTIECISFAFISASPLNSFGKTVITVVKNIEALPIRIKRNNIKSHTSSILLINKNAMVILISVIRSINISFFTAILSTIEPLNGERITPGRK

SEQ ID NO: 8635 - DNA, 864 bp, Unknown
  Obtained from environmental sample
  misc_feature (1)..(864): n is a, c, g, or t
gtgatcaaaaagtcagaaatgacagcagaaatagtaaaagatggtttaacatctcatatgttaaacggtgtaatggatcaaagagcattcttcttagaaaaaattacaaatctaaaagatgttgaaaaactttgggttgtaagatcaaaatctgtaactgatcaatacggagaggggttaatcaatgaaaaccctagagatgacatggataaagaagttctacgaacaggtaatatggtaaaaatgattactgaaaatgctgaagttgcaactttgcgtgttactgtaccttatgttgcttcgagttatggtaatccaaactgtttagagtgtcatactgttaatgagggagaggttcttggtgcaatcagcatggagttcaatatcggaacactcagatatacaggcgcattaacaatactaaaaatatttggaataaatcttatattccttattatcgccttgcttgctgtaaactattttattaaaccatatatgcacttctttgcaaaacttagagagacaatagacaatggtttaaatggtgatttcactcatgatttggatacttgtaagataaaaggtgatggagcagtagtagctgaaaagatgaataccctttttactaaactggatgatactttctatgagatcaaacactctttaaatacttttatgccaagaggcggaataaatcatgaagatccgttagaagaggcaagacatctaattagagagttgtcaaatgtatataaattcaaaaaaactattgaacttgatcgtgataaagaggaaatatatgatagattaggaacaattctatataaaaagtttaatattgaacattatgctctttacgaataa

SEQ ID NO: 8636 - protein, 287 aa, Unknown
  Obtained from environmental sample
  misc_feature (1)..(287): Xaa is any amino acid
MIKKSEMTAEIVKDGLTSHMLNGVMDQRAFFLEKITNLKDVEKLWVVRSKSVTDQYGEGLINENPRDDMDKEVLRTGNMVKMITENAEVATLRVTVPYVASSYGNPNCLECHTVNEGEVLGAISMEFNIGTLRYTGALTILKIFGINLIFLIIALLAVNYFIKPYMHFFAKLRETIDNGLNGDFTHDLDTCKIKGDGAVVAEKMNTLFTKLDDTFYEIKHSLNTFMPRGGINHEDPLEEARHLIRELSNVYKFKKTIELDRDKEEIYDRLGTILYKKFNIEHYALYE

SEQ ID NO: 8637 - DNA, 348 bp, Unknown
  Obtained from environmental sample
  misc_feature (1)..(348): n is a, c, g, or t
atgaatgaaaatattgtaaaagaagctttatcaaatgtaatatatccagggtttacaaaagatattgtttcatttggttttgtaaaagagataaatatagatggagatcaagcaaatatcactatagatataagttcaagtgctcctgaagttaaagcacagatccatgatgatgcaattgctgagcttaaacgagcaggagtttatagttttgatcttaatattattacacccaagatgcctcgtgagagctcatcaaaaggtaaaaatattgctccacaggttaaaaattttattatggttagtagtggaaaggggtggggttgtaaaatcaactacatctgttaa

SEQ ID NO: 8638 - protein, 115 aa, Unknown
  Obtained from environmental sample
  DOMAIN (1)...(70): Domain of unknown function DUF59
  misc_feature (1)..(115): Xaa is any amino acid
MNENIVKEALSNVIYPGFTKDIVSFGFVKEINIDGDQANITIDISSSAPEVKAQIHDDAIAELKRAGVYSFDLNIITPKMPRESSSKGKNIAPQVKNFIMVSSGKGWGCKINYIC

SEQ ID NO: 8639 - DNA, 576 bp, Unknown
  Obtained from environmental sample
  misc_feature (1)..(576): n is a, c, g, or t
gtggatttaaaaaaagcgttacaaaatgatggaattgaactggatgaactcttttttgagagagttaaaattttcaaagagcagctttttaagtggaataaaattcataatttaactggtgcaaaaaatgaggatcaggtagatcactttatctatgatgcgatctttcctatcagttttttaccaaagttagataatgttatggacataggaacaggtgcaggatttccaggtatgatcttagcatttggcatgaatgatacacacgttacacttgtagaacctttgaaaaaaagagcttcatttttacagtttataaaagcgactctaaatttgagtaatgtaacggttgagcctcaccgcgtagagcagttagagcctcgtaagtttgatatgattacatcacgcgccgtaacggatactaagatgcttttagatctctctacgccattttgcaaagatgaaacacttctgcttttttataagggtgaaagagtacttgatgagattgatcatagtttaaattataaaataatagagacaaaaaaacgacactatttgttgataaagaggtaa

SEQ ID NO: 8640 - protein, 191 aa, Unknown
  Obtained from environmental sample
  DOMAIN (18)...(187): Glucose inhibited division protein
  misc_feature (1)..(191): Xaa is any amino acid
MDLKKALQNDGIELDELFFERVKIFKEQLFKWNKIHNLTGAKNEDQVDHFIYDAIFPISFLPKLDNVMDIGTGAGFPGMILAFGMNDTHVTLVEPLKKRASFLQFIKATLNLSNVTVEPHRVEQLEPRKFDMITSRAVTDTKMLLDLSTPFCKDETLLLFYKGERVLDEIDHSLNYKIIETKKRHYLLIKR

SEQ ID NO: 8641 - DNA, 456 bp, Unknown
  Obtained from environmental sample
  misc_feature (1)..(456): n is a, c, g, or t
ttgggtttaaaaatgccaatagagttaaaagagactttgaaaatttgtgacagtatgtttgagtcttgtgatattgatttttatgagcttagtttaaagcctatagaaaatagtttttttgatgattatcaaaacattagattagttaatagttttttatttaatttctcaaaactccaagataaaatcggagcaaaactttttaaaaagatcttgtatgatttaaaagagatagatgatttttcagttccaatgatagatattttacatttacttgagaagttagaggtaattaaaaatcaagatgtgtgggatgagttaagagagataagaaactctctatctcatgaataccctttctcaattggcgagagaatagaaaatattcagctagctatgagaggttataaaaaattaaaagagatatatgccaacgttaagagtatctcaaaatga

SEQ ID NO: 8642 - protein, 151 aa, Unknown
  Obtained from environmental sample
  misc_feature (1)..(151): Xaa is any amino acid
MGLKMPIELKETLKICDSMFESCDIDFYELSLKPIENSFFDDYQNIRLVNSFLFNFSKLQDKIGAKLFKKILYDLKEIDDFSVPMIDILHLLEKLEVIKNQDVWDELREIRNSLSHEYPFSIGERIENIQLAMRGYKKLKEIYANVKSISK

SEQ ID NO: 8643 - DNA, 657 bp, Unknown
  Obtained from environmental sample
  misc_feature (1)..(657): n is a, c, g, or t
atgggaccaaatggttctggaaaaagcactctttctgcggtaattgcaggtagagaagattacgaaataactgaaggagaaatcatttacaaaggtgaaaacttacttgatttatctgtagaagagagagcaagtgcaggaattttcttaggatttcaatatcctatagagataccaggagtaagcatggtaaatttcattaaaacagctgtaaacgaacaacgaaaacatcaaggtttagatcctatgtctgcgtctaagtttttaaagctaatgcgtgagaaaaaagacttggttgaaattgattctaaacttacaaatagatcagtaaacgaaggcttctcaggtggtgaaaaaaagaaaaatgagatttttcaaatggcaatgttagagccaaaattagctattcttgacgaaactgattctggtttagatattgatgcacttaagattgttgctaatggggttaacaaactaaaaaaaccggacacatctactatagtaataacacattaccaaagattgctagattttatagttcctgactttgtacatattttatataatggtagaattgttaagtctgcaggaaaagaattagcactagaacttgaagaaaaaggatatgactggattaaaaaacaggttgacaattag

SEQ ID NO: 8644 - protein, 218 aa, Unknown
  Obtained from environmental sample
  DOMAIN (1)...(190): ABC transporter
  misc_feature (1)..(218): Xaa is any amino acid
MGPNGSGKSTLSAVIAGREDYEITEGEIIYKGENLLDLSVEERASAGIFLGFQYPIEIPGVSMVNFIKTAVNEQRKHQGLDPMSASKFLKLMREKKDLVEIDSKLTNRSVNEGFSGGEKKKNEIFQMAMLEPKLAILDETDSGLDIDALKIVANGVNKLKKPDTSTIVITHYQRLLDFIVPDFVHILYNGRIVKSAGKELALELEEKGYDWIKKQVDN

SEQ ID NO: 8645 - DNA, 957 bp, Unknown
  Obtained from environmental sample
  misc_feature (1)..(957): n is a, c, g, or t
atgatggctcggatcttgtacccctttacagaaagtgctagtgaaaatgcaaaagaatcatttataaaaacatacaatatgatggaagctaaagtaaaagatggttctatggatgataaaaaaatcactatagagattcctaaaacaacacatgttgagatagttgatagtaatatgcctatggatatgagtgctattagtgaaagtatcaataatatgatgggaaaaatggggaaagagaagataaaaaaagaggttactataaaagaagcaaaacaacaattaagagttcttgctagtgataaccttcttgataaagatgctttaaaacaagaggcagtaaacagatgtgagaatggtggtatcatttttcttgatgagatagataaaatagcaacgggaaactcaagtaaaaaccaagacccgagtaaagagggggtgcagcgagatttattaccaattgttgagggaagtagtgttcatacaaaatatggacagattaaaacggatcatatcctttttatagctgctggggcatttcatgtaagcaaaccaagtgatctacttccagaacttcaaggaagattccctttaagagtggagttaaatcctcttgatgaagaatcattatataagattcttacaaatacaaaaaattcacttttacgacaatatgaagctttactaaaagtagagggtgttaatttagagtttgaagatgatgcgattcgttcttttgcgaagctcagtgtgagtgcaaatgaaaaagctgaagatataggggcaagacgattacatactgtgatagaaaaagttttagaagatattagttttgatgcagatgaacatagtggagagacaatagtagttaaaaaagaattagttcttggaaaaattagaaaatattgctcnaaacgaaagataccgctcgatatattttataatgccataagataa

SEQ ID NO: 8646 - protein, 318 aa, Unknown
  Obtained from environmental sample
  DOMAIN (85)...(259): ATPase family associated with various cellular activities (AAA)
  misc_feature (1)..(318): Xaa is any amino acid
MMARILYPFTESASENAKESFIKTYNMMEAKVKDGSMDDKKITIEIPKTTHVEIVDSNMPMDMSAISESINNMMGKMGKEKIKKEVTIKEAKQQLRVLASDNLLDKDALKQEAVNRCENGGIIFLDEIDKIATGNSSKNQDPSKEGVQRDLLPIVEGSSVHTKYGQIKTDHILFIAAGAFHVSKPSDLLPELQGRFPLRVELNPLDEESLYKILTNTKNSLLRQYEALLKVEGVNLEFEDDAIRSFAKLSVSANEKAEDIGARRLHTVIEKVLEDISFDADEHSGETIVVKKELVLGKIRKYCSKRKIPLDIFYNAIR

SEQ ID NO: 8647 - DNA, 912 bp, Unknown
  Obtained from environmental sample
  misc_feature (1)..(912): n is a, c, g, or t
ttggtaaaactaaaatttgatgtattaaaaaacaaagataaagagtactcaaaaactaacttcataaatgtaaaattacctgatgataaagagacaattctttttgcaaatgctttacaaaaagagggaattgattatttactttatgcaaaagaagagagtttacaagatggtttaaaagttacatattttaatgatgaaatattagtaatcaatggtgaaaaatctttgtttccaaaatatgattataatttagataagaaatataacagctcaaaagagttttttgatgacaatggtggagtgataaaagcaacactagcttctagaaacaaaagaataaaaccaagtattgcagtatatttttcttatgctagtacaaatagtacaatttctgtaaatgttccaggaaaaggtttaaaagatattataaaagttccaaatattatttgtgatgtatcaaatgccctagatgaaatatcagcaatcgatgaaaatactcaaagattaactgaaaactataaaaagaaattctcacaaaattttgaaaaagagttaaaaaacaaagatgcaaatggttttgaagccatcttaaatctatgtgcttatatgttaggtatggaagactacttggagtttgaagatgcagcttttgcttataactctaaaagtggtattcaaatagatatgaagttagcaaaaatagatggngaaaactatttggactatagaagagttgtacaaagtattatgagttacaaaatggcagatgttgataatagaatgttagcctactctttttatgaaagcctaagtgatcttataaaagataatgtaacaaaaataaatagtgaactaaacacaaagatgttatcttatgtgaagatatgtttgctaataatattttattga

SEQ ID NO: 8648 - protein, 303 aa, Unknown
  Obtained from environmental sample
  misc_feature (1)..(303): Xaa is any amino acid
MVKLKFDVLKNKDKEYSKTNFINVKLPDDKETILFANALQKEGIDYLLYAKEESLQDGLKVTYFNDEILVINGEKSLFPKYDYNLDKKYNSSKEFFDDNGGVIKATLASRNKRIKPSIAVYFSYASTNSTISVNVPGKGLKDIIKVPNIICDVSNALDEISAIDENTQRLTENYKKKFSQNFEKELKNKDANGFEAILNLCAYMLGMEDYLEFEDAAFAYNSKSGIQIDMKLAKIDGENYLDYRRVVQSIMSYKMADVDNRMLAYSFYESLSDLIKDNVTKINSELNTKMLSYVKICLLIIFY

SEQ ID NO: 8649 - DNA, 939 bp, Unknown
  Obtained from environmental sample
  misc_feature (1)..(939): n is a, c, g, or t
ttgtttgaactttgttctaagtgtaaaaaagagtatgaaaatcccacaaatagaaggtaccatgcccaacctgtatcttgtgaaaagtgtgcccctcaagttagtctatatgataataaaaaaaataaactagcctcaaatattgatgccataaaacaaatagcccattttataaatagaggaaaaatagttgccataaaaggtatgggaggttttcatttagtatgtgatgctacaaatgaagatgcaataaaaagtttaagagaaaagaaaaatcgtccaacaaaaccttttgctgttatgtttaaaaatatccaagagataaaaaatcatacaatactttcacaaaaagaagaagagataatattatcaaaagaaaaacccatagtaatagtaaataaaaatgataacaaaaagatttgtgaaactgtggctcccagtatagatagacttggagttttcttgccatatacacctttgcattatttactttttagatatttagataatcctattattgccacaagtgcaaatttaaaagatgaaccaataataaaaagtgttgaggatatttttacaaaattatcaaatgtagttgagtatgtagttgattttaatagagagataataaatgcttgtgatgactctattgttcaagttgtgaataatgatatgcaaatattaagattagcacgtggttacactcccatatcatttaaaacagacaaaaaatttgataaaaatattttagcccttggagcaaatcaaaaaagctccataacaataggttttgaggataatataatatcttcaccttatataggggatttgaattcaatagtttcaatggattatttccaaagaagtgtagatacctttaaaaagttttatgattttaagcctgagattatanctcgagccgatctgatcactggctaa

SEQ ID NO: 8650 - protein, 312 aa, Unknown
  Obtained from environmental sample
  DOMAIN (4)...(38): HypF finger
  misc_feature (1)..(312): Xaa is any amino acid
MFELCSKCKKEYENPTNRRYHAQPVSCEKCAPQVSLYDNKKNKLASNIDAIKQIAHFINRGKIVAIKGMGGFHLVCDATNEDAIKSLREKKNRPTKPFAVMFKNIQEIKNHTILSQKEEEIILSKEKPIVIVNKNDNKKICETVAPSIDRLGVFLPYTPLHYLLFRYLDNPIIATSANLKDEPIIKSVEDIFTKLSNVVEYVVDFNREIINACDDSIVQVVNNDMQILRLARGYTPISFKTDKKFDKNILALGANQKSSITIGFEDNIISSPYIGDLNSIVSMDYFQRSVDTFKKFYDFKPEIIXRADLITG

SEQ ID NO: 8651 - DNA, 480 bp, Unknown
  Obtained from environmental sample
  misc_feature (1)..(480): n is a, c, g, or t
ttgaaattccttgatgatgacctattttcagaagtgtttgagcaacaattaaagagtcagctgataaaatttaatgagcattttgcagatacttctcagttgttatatggagaaaaatatgcattgaaatatgaaaaagagattatnagaaaagggcaacgtttttacaaattcagtgcctttaatcttaattttagttcaggaaaaaagcaaggggaaatttcttgttttgatattgcatatattttttttgcggatgagcaaaatgttaatggtatgcattttttactgaacgataaaaaggaattaatgcatgataatcaattagttaaaattgcaaatctagttaaaactagcaatattcaatttgtagcatctatattaaaagataaactaccaacagaactcaatagagatgaaaatttcattctcaaactatcagatgacgataagctgtttagaatagagaacaattcataa

SEQ ID NO: 8652 - protein, 159 aa, Unknown
  Obtained from environmental sample
  misc_feature (1)..(159): Xaa is any amino acid
MKFLDDDLFSEVFEQQLKSQLIKFNEHFADTSQLLYGEKYALKYEKEIXRKGQRFYKFSAFNLNFSSGKKQGEISCFDIAYIFFADEQNVNGMHFLLNDKKELMHDNQLVKIANLVKTSNIQFVASILKDKLPTELNRDENFILKLSDDDKLFRIENNS

SEQ ID NO: 8653 - DNA, 933 bp, Unknown
  Obtained from environmental sample
  misc_feature (1)..(933): n is a, c, g, or t
ttggagctgataaaaaaanttatttgggaagatccagaaaataaaaaagatatctataaattggttaaggattacttaatcgataataatattttgataactcttagattaaaagaaaacttagacaatgaagactcgctcgaagtagtaattgaacgcaatttcttaactagaaaaaaaatagtccgtaggataaatgggcaagattatccagaaaaagattttgaacctaaattattagagatctttttccctgctcatttagattctaaacctagcttcagacagattatttctcataatattcgttataaagatctcagtattgctaatactcttaaaactttagatatatatacatccaatgttgaatatgaaacattatatctattcctattaggttgcagctattctgaaggtgatactaagcaagaaattttacaaaagattaaacaggaagataattttagacgaagactcgaagcagttcaaacaaaatcagcatatgagacagctctatcactaataaataatgatataaagaagcttgatgaaagaaaatcacgcatgaatctaaacgagaactttgaggctgatctggatagaatgaacaaacttaagtatttaattaatttgattagcacagagttaagtaacctgaaaattaggtgcgatttaataattgatgcagaaaatgatctcacattagcatattcaaaaattgacttgaatcaattgaagttgatttataatcaagcaaaagtaaatatgggatcattacataaatcctttgaagacctttataattatcataaccaaatgataaaagagaaagctaaatatattactaaagaacttcctgaaataaagccaaataaaagaaaaaaatctaccttagagatatctgcacaagagaaagactttctgaagtaa

SEQ ID NO: 8654 - protein, 310 aa, Unknown
  Obtained from environmental sample
  misc_feature (1)..(310): Xaa is any amino acid
MELIKKXIWEDPENKKDIYKLVKDYLIDNNILITLRLKENLDNEDSLEVVIERNFLTRKKIVRRINGQDYPEKDFEPKLLEIFFPAHLDSKPSFRQIISHNIRYKDLSIANTLKTLDIYTSNVEYETLYLFLLGCSYSEGDTKQEILQKIKQEDNFRRRLEAVQTKSAYETALSLINNDIKKLDERKSRMNLNENFEADLDRMNKLKYLINLISTELSNLKIRCDLIIDAENDLTLAYSKIDLNQLKLIYNQAKVNMGSLHKSFEDLYNYHNQMIKEKAKYITKELPEIKPNKRKKSTLEISAQEKDFLK

SEQ ID NO: 8655 - DNA, 498 bp, Unknown
  Obtained from environmental sample
  misc_feature (1)..(498): n is a, c, g, or t
ttgacaggaaaacaggccgtagaagcagggcttaatcaaaccaaattgcgcaggatagccgtagttattgatgaggtagataggaaaacaaagaaaatatcaacaaaaacgataatattaataagcaacaacctaagctggtcagcagctacaattgtggagttgtataaacggaggtggcaaattgaaacattctttaaactaataaaacagaaccttcaaataaaaaactttttaggggtaaatgagaattcaaataaatctcaaatatttatagccctaataacatactttcttatagaattaatacgcaggaacataagtaaggtgaatcatagtttcgggcattttgtcacaataatcagggtatgtttgcttcaatacaaagtgcttcaatatgtagctaacgatattataattatggtaaaaaaagcaagagtgtatgacactaaaaatttagattcaaggcaaatgaaaatgaattttaatacatcataa

SEQ ID NO: 8656 - protein, 165 aa, Unknown
  Obtained from environmental sample
  misc_feature (1)..(165): Xaa is any amino acid
MTGKQAVEAGLNQTKLRRIAVVIDEVDRKTKKISTKTIILISNNLSWSAATIVELYKRRWQIETFFKLIKQNLQIKNFLGVNENSNKSQIFIALITYFLIELIRRNISKVNHSFGHFVTIIRVCLLQYKVLQYVANDIIIMVKKARVYDTKNLDSRQMKMNFNTS

SEQ ID NO: 8657 - DNA, 630 bp, Unknown
  Obtained from environmental sample
  misc_feature (1)..(630): n is a, c, g, or t
atgggctttcttccacggcataaaaatacaaaaaaatcagaaaaaccgttattggcacagatattaaaattgataccaaatcatattcttcaagactctatacggataaatcagacagataaaggttgttgggcatacaaaacgtatgatcaattagtggcaatgattttcggacagcttaataaatgcctgagtttaagagagattaacttaggtttaagtgttgatgagaaattaatcagagatttaaatttagttcaaagccctgcaaaatcaacaatgtcagatggtaattcaaatagggactggaaagtatatgagtatatctattttgagctcataaaatattataaaggtattttttcaaaacagccaggctataaagaaataactgaaatagagggtaagacaataaagctggttgatgctacaattatgagcgtatgtttgaaccttttcgattgngcaaagtatcggacagctaaaggtggtataaagatacacaccagtttagatgaaaggactctttttgccggatattatccatataacagaagcaaacttaccgacagacgtggtgtagatgagttcaaatatgcaaaagacacttatattgttgatggaagagaa

SEQ ID NO: 8658 - protein, 210 aa, Unknown
  Obtained from environmental sample
  misc_feature (1)..(210): Xaa is any amino acid
MGFLPRHKNTKKSEKPLLAQILKLIPNHILQDSIRINQTDKGCWAYKTYDQLVAMIFGQLNKCLSLREINLGLSVDEKLIRDLNLVQSPAKSTMSDGNSNRDWKVYEYIYFELIKYYKGIFSKQPGYKEITEIEGKTIKLVDATIMSVCLNLFDXAKYRTAKGGIKIHTSLDERTLFAGYYPYNRSKLTDRRGVDEFKYAKDTYIVDGRE

SEQ ID NO: 8659 - DNA, 582 bp, Unknown
  Obtained from environmental sample
  misc_feature (1)..(582): n is a, c, g, or t
gtgaaaataagtaatctaagagggatatataaaatgaaagtatgtaaatttggtggaagttcagtaaaagatgctacacaaatcagaaaagttataaaaatattacagcaagataaatcaagaaaagtggtagttgtttctgcacctggtagagatgacttacatgatcaaaagattacagatcatctattaaactatgcaaccaatggaaaacatttttcagaccacttaatagaagtagatgcacaacaaagttttgaagcaattattactaaatatgaaaagttatgtatagatttaggtattgataaaaataagattatagaaccattaaaaaaagatttagaaaatacaaaattaaaagatgaaaaaagggaggctttttgtctttcaagaggtgaacatcataatgccaaagtaatagagcaatttatgaaaaaatcaaagataaatgtaaaactaatgcttcctgaagattttgggtttatattaagtgaaaattttacagatggtaaagtattaaatgagtcatatgaaaatattgagagagattttagtatagaggaggatatcctttattag

SEQ ID NO: 8660 - protein, 193 aa, Unknown
  Obtained from environmental sample
  misc_feature (1)..(193): Xaa is any amino acid
MKISNLRGIYKMKVCKFGGSSVKDATQIRKVIKILQQDKSRKVVVVSAPGRDDLHDQKITDHLLNYATNGKHFSDHLIEVDAQQSFEAIITKYEKLCIDLGIDKNKIIEPLKKDLENTKLKDEKREAFCLSRGEHHNAKVIEQFMKKSKINVKLMLPEDFGFILSENFTDGKVLNESYENIERDFSIEEDILY

SEQ ID NO: 8661 - DNA, 390 bp, Unknown
  Obtained from environmental sample
  misc_feature (1)..(390): n is a, c, g, or t
atgtgggttatcaatccttttgatggtgaattgttatgggcaaaaatagaatcaatccatagggaaaattttgaaaaaaagatttatcatgaaaactattttggtatcgataaagagcaaaaagagatagtggattatgataataatgactttcaaataagaggtaaagcatatgatatattggtttatctctatcaaaatagatatagaccacccatatcaaaagatgagatgatctatgcattgtgggatgacccagagatggtttgtcaaaatgttattgaagtaaacatcaatcaaattagaagtaaattgaaaaaaagatttcatattgatatgatagatacggttagaaatagaggttataaacttaaaagtgaaaataagtaa

SEQ ID NO: 8662 - protein, 129 aa, Unknown
  Obtained from environmental sample
  DOMAIN (48)...(124): Transcriptional regulatory protein, C terminal
  misc_feature (1)..(129): Xaa is any amino acid
MWVINPFDGELLWAKIESIHRENFEKKIYHENYFGIDKEQKEIVDYDNNDFQIRGKAYDILVYLYQNRYRPPISKDEMIYALWDDPEMVCQNVIEVNINQIRSKLKKRFHIDMIDTVRNRGYKLKSENK

SEQ ID NO: 8663 - DNA, 420 bp, Unknown
  Obtained from environmental sample
  misc_feature (1)..(420): n is a, c, g, or t
atgtcagccattaccataaaggaattacggaaaacttataaaaatcttacggccctggacgggataagtcttgaagttgaaaaaggtgaactttttgcctacctgggtcccaacggtgccggaaaaaccaccaccatccggatactcaccggcatgacccgatttgagaaaggacaatgcaccatcaacgggtttgatatccgctcggatgaaaacagggcaaaatcacaatacggccttgtttcccaggcaacgaacctggatcangaactatcggtaaaagacaatctttttatccatggcctgatgtatggcatgaaggtttccgacatccaacaaaaaacagcagaaatgcttgcttacgttgatatgtccggaccggttgaaaagcccggggaaggtgttgtcccgccgttttaa

SEQ ID NO: 8664 - protein, 139 aa, Unknown
  Obtained from environmental sample
  misc_feature (1)..(139): Xaa is any amino acid
MSAITIKELRKTYKNLTALDGISLEVEKGELFAYLGPNGAGKTTTIRILTGMTRFEKGQCTINGFDIRSDENRAKSQYGLVSQATNLDXELSVKDNLFIHGLMYGMKVSDIQQKTAEMLAYVDMSGPVEKPGEGVVPPF

SEQ ID NO: 8665 - DNA, 513 bp, Unknown
  Obtained from environmental sample
  misc_feature (1)..(513): n is a, c, g, or t
atggggagaataaagagtatgggtcatacaaatagaagagcaatatatagtggtacatttgatcctataacaaatggtcacatggatatattaaaaaggggattaaaggtatacgatgagattattattgctgttgcgacatctagctcaaaaagaccaatgtttaaccttaatagtagagtaaaacttatacaagaagcgattaaagacctagatggacttaccgttgagtcatttgatactctcattgttgactttgcaaaaaagaaaaatgtgtataatattataagaggtttaagaactaacactgactttgaatatgaacttcaaatgtcttatgctaatagctctttagataaagatatcgatacagtatttttaatgccagctttaaaaaatgcatttgtaagttcctctattgttagagaacttatacgattcaatggtgactattcgcatctagtcccaacaaatatacaagatcaaataaaggaagaagtaaaatgtatgtaa

SEQ ID NO: 8666 - protein, 170 aa, Unknown
  Obtained from environmental sample
  DOMAIN (15)...(144): Cytidylyltransferase
  misc_feature (1)..(170): Xaa is any amino acid
MGRIKSMGHTNRRAIYSGTFDPITNGHMDILKRGLKVYDEIIIAVATSSSKRPMFNLNSRVKLIQEAIKDLDGLTVESFDTLIVDFAKKKNVYNIIRGLRTNTDFEYELQMSYANSSLDKDIDTVFLMPALKNAFVSSSIVRELIRFNGDYSHLVPTNIQDQIKEEVKCM

SEQ ID NO: 8667 - DNA, 579 bp, Unknown
  Obtained from environmental sample
  misc_feature (1)..(579): n is a, c, g, or t
gtgaggttaataatgaaagttgataaaagaaaactcatcctgaaagcggtggaagaagtaataaaaacaaaacgctttcatgaagttaaaatggaagatgttgccaaagaagctggggtcggtaaaggtacaatctatcgttactttcccaataaagatgaactatattttgaacttgccgtctccggatttgattccataaaagatgatgttttggagatatcttcttcaataagtaattatgcagagaagtttctaaaactaacccaaagaatggaaaccttctttctaaccagaaaaactatttctcgtgtaatgcgtgaaatagaaacaaggtatgaagaagataactctccccgctttttaataattcaacaacataaaatggatttaagaaaccagatagctgttgttatgcaggaagggctggaaaataatcttctctcacttccatttacttcggcacaatatgccgagttctggattcatcaattgataggattatctcattggcccaatgacattgccaaacctgaattgcaaacaattattgatctgcatttgaagaaatatttttaa

SEQ ID NO: 8668 - protein, 192 aa, Unknown
  Obtained from environmental sample
  DOMAIN (13)...(59): Bacterial regulatory proteins, tetR family
  misc_feature (1)..(192): Xaa is any amino acid
MRLIMKVDKRKLILKAVEEVIKTKRFHEVKMEDVAKEAGVGKGTIYRYFPNKDELYFELAVSGFDSIKDDVLEISSSISNYAEKFLKLTQRMETFFLTRKTISRVMREIETRYEEDNSPRFLIIQQHKMDLRNQIAVVMQEGLENNLLSLPFTSAQYAEFWIHQLIGLSHWPNDIAKPELQTIIDLHLKKYF

SEQ ID NO: 8669 - DNA, 651 bp, Unknown; identical to SEQ ID NO: 7285
  Obtained from environmental sample
  misc_feature (1)..(651): n is a, c, g, or t

SEQ ID NO: 8670 - protein, 216 aa, Unknown; identical to SEQ ID NO: 7286
  Obtained from environmental sample
  misc_feature (1)..(216): Xaa is any amino acid

SEQ ID NO: 8671 - DNA, 528 bp, Unknown
  Obtained from environmental sample
  misc_feature (1)..(528): n is a, c, g, or t
atggaaccaaatttaatttcccaatatataataagtatagcagcaatagttatttcaattgcatctttgatattcgccaaaagatcgtggtatcaaagcaataggcctatcgttgtcgcatatgttgaagaaaattcaatgggcattaattctgccacttttaatttggttgttagtaatactggaacaagacctgctattaatgtcagattaaaagcaaaagaagcaaatatcgaacagatatttgaagataaaattgataaggttactcaaactacaataaaaaattgcttcaaagaagacagtgaggtggcattgttaaaaaatgatgccaaaattgtaacttcttttggcagctttgaaggtacctatccaaatagaaaaggtatcaaatatgattcttggctaccaattcaaatcgaatacaaggatcttaattctaaaacatataaagaaatactctctttaaaaattagagggttagatggatttggcggggggatttgggaaagtgcaaataaaaaataa

SEQ ID NO: 8672 - protein, 175 aa, Unknown
  Obtained from environmental sample
  misc_feature (1)..(175): Xaa is any amino acid
MEPNLISQYIISIAAIVISIASLIFAKRSWYQSNRPIVVAYVEENSMGINSATFNLVVSNTGTRPAINVRLKAKEANIEQIFEDKIDKVTQTTIKNCFKEDSEVALLKNDAKIVTSFGSFEGTYPNRKGIKYDSWLPIQIEYKDLNSKTYKEILSLKIRGLDGFGGGIWESANKK

SEQ ID NO: 8673 - DNA, 690 bp, Unknown
  Obtained from environmental sample
  misc_feature (1)..(690): n is a, c, g, or t
atgcctcgctacggatgtatcaatgagcgtagaaatcagctacatgaggtcattcgcttatcgggtatgaatttgattattgatgatgcagatcatcctcttatcataaaagtagcttcaattcaacaagctcgtatgcaaatttattttatcgacaatgaagattacttccatcggaagtttacactttgtgataagaataataagttttataaagataatgacgaacgtgccattttctttagtcgtggagttttagaaacagtaaaaaaactgggatgggcaccaaatttagtgcattgtcatggttggtttaccagtcttactcccttgtatttgaaaaaagcgtttagcgataatccattatttacggatgcaaaagttgtttattcaatttatgatgatgatttttctgttagtttaaataaggatatggcagaaaaaatgaaaatggaaggtatcgaagatactgacttgatgcattttaaaaaaggaacttttgttaatttaaataaatcagccattgataatgctgatgcccttattattggcagcgaaaaaattaatagtgaggttgaagaatacctgaaaaaatcaggaaaaccatatctagaattccatcctgaagagacttatgtagaagcgtataataaattctacgatgagatcattggcgatattagtttataa

SEQ ID NO: 8674 - protein, 229 aa, Unknown
  Obtained from environmental sample
  misc_feature (1)..(229): Xaa is any amino acid
MPRYGCINERRNQLHEVIRLSGMNLIIDDADHPLIIKVASIQQARMQIYFIDNEDYFHRKFTLCDKNNKFYKDNDERAIFFSRGVLETVKKLGWAPNLVHCHGWFTSLTPLYLKKAFSDNPLFTDAKVVYSIYDDDFSVSLNKDMAEKMKMEGIEDTDLMHFKKGTFVNLNKSAIDNADALIIGSEKINSEVEEYLKKSGKPYLEFHPEETYVEAYNKFYDEIIGDISL

SEQ ID NO: 8675 - DNA, 1023 bp, Unknown
  Obtained from environmental sample
  misc_feature (1)..(1023): n is a, c, g, or t
atgggttatatagagatgacacctattcaagaagcaactattgagcatatattaaaaggtagtgatgttgttgcaaaagcaaaaacgggaagtggtaaaagtgctgcatttggtataccacttcttctaaatatagatgtgaaaaaatttaagccacaagttcttgttttgacaccgacaagagagttggctgatcaagtggctaatgagttaagaaatttggctaaatttacacaaaatataaaaattttaacactttgtggtggtgtaccagttagggcgcagatcagttcactgagttcaggtgcacatattttggtgggaactccaggacgtattagagatcatcagggtaaagagagtatagatctatctgaggtgaaaagtgttgtattggatgaagcagacaagatgttggatatgggttttttagatgaggttagtaaaattatctctaatatttcaaaagatagacaaactcttcttttctcggcaacatatcctagtgagataaataagatggtaaatcagcttatgaataagcctgttaaagttgaaattgatactctgcatgactctatagaagagcatttttacaactatggagagttagataagaatcgtgcacttcttaaaatatttggcacatttaagccaaaaagttcgattatattttgtcgcacaaagaatagtgttgatgaagtagatgaatttttatataacaacggtttttcatctacatcttttcactctgattatgatcagatagatagagatgcaatcttgatatcctttgcaaatatgagtagacctattttggtagcaactgatttagcagcaagaggcatagatattaaagatatagaaactgttataaactatgatcttccacgagatcgtgaaagctatacacatagaaataggaagaggtgcaagaagcaggtggcgaaggaaaaagccgcaacactttttaccaatagtgaaattaacagtttaaacaagttatttgaaaatgaagaaatt

SEQ ID NO: 8676 - protein, 341 aa, Unknown
  Obtained from environmental sample
  DOMAIN (4)...(169): Type III restriction enzyme, res subunit
  misc_feature (1)..(341): Xaa is any amino acid
MGYIEMTPIQEATIEHILKGSDVVAKAKTGSGKSAAFGIPLLLNIDVKKFKPQVLVLTPTRELADQVANELRNLAKFTQNIKILTLCGGVPVRAQISSLSSGAHILVGTPGRIRDHQGKESIDLSEVKSVVLDEADKMLDMGFLDEVSKIISNISKDRQTLLFSATYPSEINKMVNQLMNKPVKVEIDTLHDSIEEHFYNYGELDKNRALLKIFGTFKPKSSIIFCRTKNSVDEVDEFLYNNGFSSTSFHSDYDQIDRDAILISFANMSRPILVATDLAARGIDIKDIETVINYDLPRDRESYTHRNRKRCKKQVAKEKAATLFTNSEINSLNKLFENEEI

SEQ ID NO: 8677 - DNA, 810 bp, Unknown
  Obtained from environmental sample
  misc_feature (1)..(810): n is a, c, g, or t
ttgatggctgagagtggggtttggattatcttaggttgtataattttatatattgctttgataatttatatgacatttccgatttcacaatacagtattgaaaaagctggacaatttggagatagttttggagttttaaactctttattttcaggacttgcatttatcgcccttgtcattacaatttatttacagcaacaagatatgagagattcaaaaaaagaagtacataaacaaaattttgaaactacattttttaatctgattaaaattcataatgattcaatagcaaattttagagaaattcatatagcagaagataaagaaaagcattcgatgtatggaggggaagctatatctaattttttaaataactttaaattaggtggttctacagacttttatacttctgacgaaaacttatcaaaagaagaaaataaaaatctagctgataaagatagaaatattaaccctgaaaatgtaaagaataatattaaatcaaaactaggaagaaaaaatttaaagtttattgaaaatgtttattctattttaaatttaattgataggtcggaatttttagatgaaaaagataagagtttttatttggaaactcttcattctcaaatatcggacgaggaacttgtattaatattttattatacgcatgctaaacatagtaataaaaagttgttgttagaaaaatattgtttctttaaagatattgatgaacaattattagataattgggaagaagaaattaanatatataaaanagaagcatttgatgtaatattatggcaatatttataa

SEQ ID NO: 8678 - protein, 269 aa, Unknown
  Obtained from environmental sample
  misc_feature (1)..(269): Xaa is any amino acid
MMAESGVWIILGCIILYIALIIYMTFPISQYSIEKAGQFGDSFGVLNSLFSGLAFIALVITIYLQQQDMRDSKKEVHKQNFETTFFNLIKIHNDSIANFREIHIAEDKEKHSMYGGEAISNFLNNFKLGGSTDFYTSDENLSKEENKNLADKDRNINPENVKNNIKSKLGRKNLKFIENVYSILNLIDRSEFLDEKDKSFYLETLHSQISDEELVLIFYYTHAKHSNKKLLLEKYCFFKDIDEQLLDNWEEEIXIYKXEAFDVILWQYL

SEQ ID NO: 8679 - DNA, 693 bp, Unknown
  Obtained from environmental sample
  misc_feature (1)..(693): n is a, c, g, or t
atgaacattataagtaaatatttaaaagactttttcaacttatttttccccgatttatgtgtggtttgtaataatcatttagttaatcaggaaaatttaatttgtacaaagtgtttatataatttgcctaaaacaaactttcataaggagatagacaaccctgtttctcaattgttttggggtagagctaaagtcgagtatgctaccggatttttcttttttcataaagggagtgtttatcagaatatgatgcacaagtttaaatatcatggtaataaagaaataggatttgtattaggaaaatcgtttggatctcaaataaaaaatagtgtttttgatgaaatcgatacaattattcctgttccattacataaaagtaaattaaagaaacgggggtttaatcaaagtgagtggcttggaatgggtttgtcagaagcaatgcaaaagcctcttgatatagattcgctaattcgtgatgttaataccgaaacacaaacacgtaaatcacgatttgaacgatggaaaaatgtagaaaagatttttaagataaccgatgaaaatgctttaataggcaaacatattttacttgtagatgacgtagtaacaaccggatcaacaatggaagcttgtgtaaatgcaattttagaagtaaaagatacaaaagtgagtattgctgctttagctgtggcataa

SEQ ID NO: 8680 - protein, 230 aa, Unknown
  Obtained from environmental sample
  misc_feature (1)..(230): Xaa is any amino acid
MNIISKYLKDFFNLFFPDLCVVCNNHLVNQENLICTKCLYNLPKTNFHKEIDNPVSQLFWGRAKVEYATGFFFFHKGSVYQNMMHKFKYHGNKEIGFVLGKSFGSQIKNSVFDEIDTIIPVPLHKSKLKKRGFNQSEWLGMGLSEAMQKPLDIDSLIRDVNTETQTRKSRFERWKNVEKIFKITDENALIGKHILLVDDVVTTGSTMEACVNAILEVKDTKVSIAALAVA

SEQ ID NO: 8681 - DNA, 813 bp, Unknown
  Obtained from environmental sample
  misc_feature (1)..(813): n is a, c, g, or t
ttgtctttttctggtggttatcaaatccgtataaatcttgcaaaactacttataactgaaccaaatttattacttcttgatgagccaacaaattatcttgatatcctttcgcttagatggttaaaaaactttttaaaaaactttgatggagaggttatcttaatcacccatgatagagattttatggatgctgtttcaactcatactatggggatagtaagaaaaaatttatttactatcaaagggaatacatataagttttatgaacaactagcatctgatgatgaacaccatgaaaaacaaaaaattgcacaagataaaaagagaaaagaactagaagagtttattgcaaaaaataaagccagagcctcaacagcagcccaagcacaatcaaaagtaaaacttctagaaaagatggatgatatggattctatagtggatgaggctaatttagagtttgattttaactacaaagatacaccagcaaaagtattgttagaggtaaaagatttgagctttggatatacaagtgataatattttatttaaagatatctcttttactcttcaaaaaggggaaacattaggaatcataggtaaaaatggtaaagggaaatcgaccttattaaatactattgcaaaagagttaaaacagttaagtggaactgtggattaccatctatcaacatcttttggacattttggacaaacaaatattgcacacttaaatccaaacaatactattatggatgagatttatgtggtaaattctaaattagcagagtcaactgttcgaggtctcagccgaatctga

SEQ ID NO: 8682 - protein, 270 aa, Unknown
  Obtained from environmental sample
  misc_feature (1)..(270): Xaa is any amino acid
MSFSGGYQIRINLAKLLITEPNLLLLDEPTNYLDILSLRWLKNFLKNFDGEVILITHDRDFMDAVSTHTMGIVRKNLFTIKGNTYKFYEQLASDDEHHEKQKIAQDKKRKELEEFIAKNKARASTAAQAQSKVKLLEKMDDMDSIVDEANLEFDFNYKDTPAKVLLEVKDLSFGYTSDNILFKDISFTLQKGETLGIIGKNGKGKSTLLNTIAKELKQLSGTVDYHLSTSFGHFGQTNIAHLNPNNTIMDEIYVVNSKLAESTVRGLSRI

SEQ ID NO: 8683 - DNA, 741 bp, Unknown
  Obtained from environmental sample
  misc_feature (1)..(741): n is a, c, g, or t
atgatggctcngngntattttagctcgatattcatatggctcgatgccacgcttgcagttaaaatgaatcacgaaaaatttctggaaattgatgaatattataatcagattttaactaaccataatgttagtagggctgagtttgactcaagtgttaatttttatagtagaagatctggagaatttaaagagatttatgaagaggtaatgttcttattaagcaaaaaagaaggtgaaatatttgcattgccagatgatgaagaggatgaaattaattctgagtttgaggtggttgtaaaagggcttaacgattttgataaaaagcaatcatcttatttattctcaaaagaaagatctacagttgttgctttttcaggcagatattctatgtttgttggaaaggaaactagaaacagtgatgctatagaatttgtgattgatagaccaataaaagaaataaaaactattcttaagtttcaactgtctgtttatgatcatcgtgaaaatatttatccttcaattattatagaaattgttgatggtgaaaatcaaattcttcatagatcaatagatttaagaaagaatatggataaaaagggagaatggaattcaataaatattaatagtaaattaaggcttgcgaatactgaacgaaagggtatcttgaaaatttatttatcgaatgttcataattcagatatttttattgatgaccttaattataaaattgaagtgaaataa

SEQ ID NO: 8684 - protein, 246 aa, Unknown
  Obtained from environmental sample
  misc_feature (1)..(246): Xaa is any amino acid
MMAXXYFSSIFIWLDATLAVKMNHEKFLEIDEYYNQILTNHNVSRAEFDSSVNFYSRRSGEFKEIYEEVMFLLSKKEGEIFALPDDEEDEINSEFEVVVKGLNDFDKKQSSYLFSKERSTVVAFSGRYSMFVGKETRNSDAIEFVIDRPIKEIKTILKFQLSVYDHRENIYPSIIIEIVDGENQILHRSIDLRKNMDKKGEWNSININSKLRLANTERKGILKIYLSNVHNSDIFIDDLNYKIEVK

SEQ ID NO: 8685 - DNA, 951 bp, Unknown
  Obtained from environmental sample
  misc_feature (1)..(951): n is a, c, g, or t
ttggccggagcaggtagtgggaagactactaccattgtctctcgtttggcatatttagtagaagttcttggtattcctgcatctaatactttaactttaacttttactaataaagctgctaaagaaatgcgcgagagagcattggatatgatagaaaatgtttcctatcctccgctattgtgtacattccataaatttggtttgctatttttaaagtttaatatacatcttttaaatagacaaaataactttgttgtaatagatacagatgacaaaaaacgaattattaaaaaaataaatactgaaataccgactccacttatagcaagtgaaatttcaagatataaaaactcacttttaactccagatgatgcatataaacaagcagaacttttcaactatcagcagattgcaaaagtttatgaaaagtatgaagcatatcttcaagaaaacaatttagtagattttgatgatttaattgcacttacttatagacttttagatgaaaatcctgagttagcagaagccacatctaaaaagtaccagtacatcatgatagatgagtatcaagatacaaacgaactgcaactaaaacttcttcaaaagctatgttcttcacacaacaatatatgtgtagttggagatgatgaccagagcatctatggctggcgtggagctcatattcgaaatattatagagtttgaccaagactttgaaggtacttcagtctttaaactagaaaataattatcgttcaaaagaacctattttaaaagttgcaaatgctcttattgaacataatcgttctcgtttgggtaaaaagcttatagcaactcgcggaactggtgatgaagtaactgttctaaattctcatgatgaaaatggagagtcaagaaaaatagcccaaaaggttaaaaaacttttagattcaggtggcggaccaaagatatag

SEQ ID NO: 8686 - protein, 316 aa, Unknown
  Obtained from environmental sample
  DOMAIN (1)...(316): UvrD/REP helicase
  misc_feature (1)..(316): Xaa is any amino acid
MAGAGSGKTTTIVSRLAYLVEVLGIPASNTLTLTFTNKAAKEMRERALDMIENVSYPPLLCTFHKFGLLFLKFNIHLLNRQNNFVVIDTDDKKRIIKKINTEIPTPLIASEISRYKNSLLTPDDAYKQAELFNYQQIAKVYEKYEAYLQENNLVDFDDLIALTYRLLDENPELAEATSKKYQYIMIDEYQDTNELQLKLLQKLCSSHNNICVVGDDDQSIYGWRGAHIRNIIEFDQDFEGTSVFKLENNYRSKEPILKVANALIEHNRSRLGKKLIATRGTGDEVTVLNSHDENGESRKIAQKVKKLLDSGGGPKI

SEQ ID NO: 8687 - DNA, 690 bp, Unknown
  Obtained from environmental sample
  misc_feature (1)..(690): n is a, c, g, or t
gtgacaggattgctaatggataatattaaggtacttgaagagataggattaaaaaaagtctgcgatgcgacccatatagagcagaaatacttaaagtttatggtagatatggaatatgacaagttagaccatataaacacattaggatttgtaaaaatactctcaagagagtacaagttagatttgagttcttggattgaagcatttgaagaatactgggtggaaaatcgtcaagaaaatgaagatacgggactttttatagttgttgctgatgaaaagagtagtaaaaagttattaatttttgtattacttgttcttgtcgtagttacttgtagtatgcttttttcactttttcaagataaaattgatttatcaaattacatagatagccagaagactaattatgaacatacaccaatagttcaggaggcacaagcgtcattagatgaggcaaataagtcgtttgaagaggaagtattgtttgatgacacanatagtacatctaaagagatcgaagtagttgattattctaataatgatgttgtggaagagaaaaaaattgaaaaaatgtcgaagaagaaaagtaaaagtaaaatgaaagatgattttactgaaaaagtagtcaaagattttctcagaggctattttgattccaaattcacagctatgggttggtgtaaaatatcttga

SEQ ID NO: 8688 - protein, 229 aa, Unknown
  Obtained from environmental sample
  misc_feature (1)..(229): Xaa is any amino acid
MTGLLMDNIKVLEEIGLKKVCDATHIEQKYLKFMVDMEYDKLDHINTLGFVKILSREYKLDLSSWIEAFEEYWVENRQENEDTGLFIVVADEKSSKKLLIFVLLVLVVVTCSMLFSLFQDKIDLSNYIDSQKTNYEHTPIVQEAQASLDEANKSFEEEVLFDDTXSTSKEIEVVDYSNNDVVEEKKIEKMSKKKSKSKMKDDFTEKVVKDFLRGYFDSKFTAMGWCKIS

SEQ ID NO: 8689 - DNA, 759 bp, Unknown
  Obtained from environmental sample
  misc_feature (1)..(759): n is a, c, g, or t
atgacttttggaataactgctgctggagcaatccttcaatatatggatttaactgagcatcgtgatattaaacatattacaagaattgcaagaattgaggaagataaatatgtttggttagataaattcacaattcgaaacttagaactttttcatgccatgggtgaagatgcaaagtcacttctagatgttattgataaaactgtttcaccacctggttctcgacttatgaaacgttggttggcattgcctttaaaaaatgtaaattcaataaatgaaagactaagtttagttgagttttttataaagaatgaagaacttaaagagagtttaacaaagcttgtaaaacaggcaggtgatatggaaaggatgaattccaaaattgcttctcaaagaataaatcctcgtgatgttgttcagttaaaaaatgcactttatgcagttgatgaaattaaggagctttgtcaatcttctgataatgaaaatcttaaaaagcttgcagattctttaaatccgtgtattaatattagaggcaggattgaaaaagagattaaaaatgaaccttcaacagcaattcagaaaggaaatgttatagaagatggtgtttctgaagagttagatgaatatagacaaattgcattttcaggaaaagattatcttgaaaatatgaagaataagttagcaattgaatctggaatctcgtcattaaaaattggctttaataatgtgtttggatattattttgaggtaagaaaataa

SEQ ID NO: 8690 - protein, 252 aa, Unknown
  Obtained from environmental sample
  DOMAIN (35)...(230): MutS domain III
  misc_feature (1)..(252): Xaa is any amino acid
MTFGITAAGAILQYMDLTEHRDIKHITRIARIEEDKYVWLDKFTIRNLELFHAMGEDAKSLLDVIDKTVSPPGSRLMKRWLALPLKNVNSINERLSLVEFFIKNEELKESLTKLVKQAGDMERMNSKIASQRINPRDVVQLKNALYAVDEIKELCQSSDNENLKKLADSLNPCINIRGRIEKEIKNEPSTAIQKGNVIEDGVSEELDEYRQIAFSGKDYLENMKNKLAIESGISSLKIGFNNVFGYYFEVRK

SEQ ID NO: 8691 - DNA, 756 bp, Unknown
  Obtained from environmental sample
  misc_feature (1)..(756): n is a, c, g, or t
atgattcagttaaaaaatgaaaaaaaaataactgttggcttttgtgattatgactataaaaagtacaatgcaattatcaaatactacagagacgatctagtattctcactatttaaaacacaggcaattgctgaactttttgctccaaagaataaagaaaatcaaaaaaacatccttatctaccatgaagatccatcacaaaaatcaaccatggcaatagaactttttaatcgtggttacaacccaatagttgcacaaacattagaagagttcaatactaagagagttaataaaactgcctatgatatagtcatagaggatactatgcttggtacatcatctggaaactgtattgccggacgagtctcaggtaatgcaattatatatactctaacaagctttcttgatgcagaacttcaagatagcttcaatctttcatatcacaataactcattaaatgtaggatttagactatttatattcgatgcatttaatgttgtatctatgaatgtacatggattgaacttttttacaatgttatcaagtgcaggtgcagaatataatgcaactatagttatagtaggtatgaatttttcaaaagtaacagagtcatttaaaaatgatttggaagatgcaggaattctattttttcttgctatggaagatattcttggtaataaagagttaatgcgtgagttgggtggaagttcagcttcatcttctaaagttaaaaaggttatcacaaagccaatgtaa

SEQ ID NO: 8692 - protein, 251 aa, Unknown
  Obtained from environmental sample
  misc_feature (1)..(251): Xaa is any amino acid
MIQLKNEKKITVGFCDYDYKKYNAIIKYYRDDLVFSLFKTQAIAELFAPKNKENQKNILIYHEDPSQKSTMAIELFNRGYNPIVAQTLEEFNTKRVNKTAYDIVIEDTMLGTSSGNCIAGRVSGNAIIYTLTSFLDAELQDSFNLSYHNNSLNVGFRLFIFDAFNVVSMNVHGLNFFTMLSSAGAEYNATIVIVGMNFSKVTESFKNDLEDAGILFFLAMEDILGNKELMRELGGSSASSSKVKKVITKPM

SEQ ID NO: 8693 - DNA, 726 bp, Unknown
  Obtained from environmental sample
  misc_feature (1)..(726): n is a, c, g, or t
atgagtcaggttgatttaggtgaattagtaaaagcttcacaaatcgctgaaaaggatcctgctctaaaaagttatctaatttcactggtaaataatccatattttggttttgtacagcacgttacttctatatcacaaatctttggtattctaggtcaagcaaaagtcaagcaggtgctttacagttatatgatgtcacttttagatccatctcattggaagctgtttaaattaaataaaaataaatttcatcaacttcaagcaacactatcctctgagtggtcaaagatattaaattatgaaaatatagataataaagatatcactacatctatatcactacttcctgcaagtatcatagtttgtgaaaacctattcaaaaatattcaagatgatgtaaatctacttcgttctgctaaaaacttagactacagtacaattttaaaacgtttaacaaataaagatctatttgatgtaagtgagatgatagctcataagtggaatatgagtgatgcatctattgaaatagtaaaagctgcatcaggtaagaaaaagtctaaaaataaaaatctaaacagacttggaaagtggatgcatcttctactattttttatcttaagtaaaccagaatatatagaggcaggattaaacgatttcatagagttcaatgttgagtacgtggaagatgtctatgaaccgtttataaagctgatggaaatatcatga

SEQ ID NO: 8694 - protein, 241 aa, Unknown
  Obtained from environmental sample
  misc_feature (1)..(241): Xaa is any amino acid
MSQVDLGELVKASQIAEKDPALKSYLISLVNNPYFGFVQHVTSISQIFGILGQAKVKQVLYSYMMSLLDPSHWKLFKLNKNKFHQLQATLSSEWSKILNYENIDNKDITTSISLLPASIIVCENLFKNIQDDVNLLRSAKNLDYSTILKRLTNKDLFDVSEMIAHKWNMSDASIEIVKAASGKKKSKNKNLNRLGKWMHLLLFFILSKPEYIEAGLNDFIEFNVEYVEDVYEPFIKLMEIS

SEQ ID NO: 8695 - DNA, 1002 bp, Unknown
  Obtained from environmental sample
  misc_feature (1)..(1002): n is a, c, g, or t
atgagttctcaaagtgaatctgaagatattggttttattctctggctaaaaaagaacaagaaaaaccaattaaaacttagcagtaattatagaaagttgagaattcttaatcaggatatcagtaatgaaaagccagaagaaaacttcctcgggaaactagaacatcgtgcccaaatcttaaaaggaataattagaacatcaacctattacgaattagggtctggactagaagctgatcgcatctactcatatattgaagttaatgctggacaaggtatgtacaagtggaccgattacaataataatgagatcaaagaaatcaatgaattcgaaatttcaagctttaaggatgaagccaattacattcgcatttctaatatcacaaccaactacagaaaagtttatacaagtgaataccgccaaagcttcaatattcaaatgaagcgtctaaaggcaaattctaagcttgtaaaattcgcctctgcatttgggaatcgcttttcatacaaaattgccaagaagagcatcaataatgatttcgaactgtatggcaatccattctcttcaacacgaagcaatccgaatattattaacctaagctcatctctacaaaacacgctttcttatcacccaaagaaatcacacacgacttacgactatatctaccagaataatgaaagcaaactccttttgaataatggttttgaaagaagcgtattaaagcaaaatagcttacgtttgatttggagaaagcaagattggcaagttcataatcgtgttgacaaaggtgttaaaactcgcagcagtgaggtttactcaaacaaagactatgaattggattacattaaaaatgaaataaaaatcaaatatcaattcgggggaaactgtcaattagaatcgaattacctatttaaaactaaagaaaacaagctaaatattgggaaaatagaatttcatgactttaggataggagactcagttttctccggggaaaaaaaaaaa

SEQ ID NO: 8696 - protein, 334 aa, Unknown
  Obtained from environmental sample
  misc_feature (1)..(334): Xaa is any amino acid
MSSQSESEDIGFILWLKKNKKNQLKLSSNYRKLRILNQDISNEKPEENFLGKLEHRAQILKGIIRTSTYYELGSGLEADRIYSYIEVNAGQGMYKWTDYNNNEIKEINEFEISSFKDEANYIRISNITTNYRKVYTSEYRQSFNIQMKRLKANSKLVKFASAFGNRFSYKIAKKSINNDFELYGNPFSSTRSNPNIINLSSSLQNTLSYHPKKSHTTYDYIYQNNESKLLLNNGFERSVLKQNSLRLIWRKQDWQVHNRVDKGVKTRSSEVYSNKDYELDYIKNEIKIKYQFGGNCQLESNYLFKTKENKLNIGKIEFHDFRIGDSVFSGEKKK

SEQ ID NO: 8697 - DNA, 645 bp, Unknown
  Obtained from environmental sample
  misc_feature (1)..(645): n is a, c, g, or t
ttgaaagaaggctttgtcagtatcgaactggtcaatgccatgaaggacgcccgaagaggtaaaggtctgcctgtaaaaaagtctaaacccaaaggaaataatgattttctcggggacgaagcatcctatgttccggtaattgacgaggtatcatctcccaaaattaaaaaatataaagagccagcggaggcggaagagggtatacaacgtcaacgccaggccggtgatgactatttcatgatattggagcgaggacttttccgtaatcctgagttcaggaatatattcaaaggccctttctctgtatatgcttggctctggtccaatattgcaagaaaaggctggaaagacaaaaccggatatcctttaaaaagagattactatgacagggggtacttggcatacagcagcagtttgagtcagatcgggagagattgtttcatgaataaggataccgttaagtcctacatagttgaattttacaggaaaaagattatcaaacttgaacacctaacaccgacagggaaaaaacgtggtcaacatgtttatatcctcggtgaatggaaaacagttgatggagagataaatgaacaattttatctgaaccaggtgctgttatctggtaaggcggaaagtcggtggtaa

SEQ ID NO: 8698 - protein, 214 aa, Unknown
  Obtained from environmental sample
  misc_feature (1)..(214): Xaa is any amino acid
MKEGFVSIELVNAMKDARRGKGLPVKKSKPKGNNDFLGDEASYVPVIDEVSSPKIKKYKEPAEAEEGIQRQRQAGDDYFMILERGLFRNPEFRNIFKGPFSVYAWLWSNIARKGWKDKTGYPLKRDYYDRGYLAYSSSLSQIGRDCFMNKDTVKSYIVEFYRKKIIKLEHLTPTGKKRGQHVYILGEWKTVDGEINEQFYLNQVLLSGKAESRW

SEQ ID NO: 8699 - DNA, 543 bp, Unknown
  Obtained from environmental sample
  misc_feature (1)..(543): n is a, c, g, or t
ttgttttttggtaaatccgtgatgcaaaaaatggggcgacataaaattatgtttaaacataataaagaagcaaatacagggaaaatatatcttgatcgagccgaaaaattcctaaaaaatggaagtgtattcaaaaatcactatttagattacattttaactggtaatttctctaaaaatcttcattattatttaaaaaaagatacatttgacaatatcaaaaccaaacaaaaaattcatttttcaagcactgatattttaagttttttaaaatctaaaccagacaacagtatcaacaaatataacctctctgatatttttgaaagtttggatattgaggaaaccaacgcaatttttactgaaattttaagaacagcaacaaataatgcaagaataattttttggaataatcttgttgaacgaaatattccaagcgaattaaaatataattttttgaatgaaattgaattacaagaaaaactatcatcttcggacaaagtttttttctacgaaaagttttttatttacaaaatcacgaaataa

SEQ ID NO: 8700 - protein, 180 aa, Unknown
  Obtained from environmental sample
  misc_feature (1)..(180): Xaa is any amino acid
MFFGKSVMQKMGRHKIMFKHNKEANTGKIYLDRAEKFLKNGSVFKNHYLDYILTGNFSKNLHYYLKKDTFDNIKTKQKIHFSSTDILSFLKSKPDNSINKYNLSDIFESLDIEETNAIFTEILRTATNNARIIFWNNLVERNIPSELKYNFLNEIELQEKLSSSDKVFFYEKFFIYKITK

SEQ ID NO: 8701 - DNA, 465 bp, Unknown
  Obtained from environmental sample
  misc_feature (1)..(465): n is a, c, g, or t
atgaaaacaatagatttgttgattttagacgatgagcaaaatattctaaattctttaaagagactttttagaaaaattttttatgagatatatgtgacgaccgattataaagaagccctagagcaagtcagggtgaacaatataaaagtggttatgtccgaccaaaaaatgcccgatattagcggcgcagactttttgaaacaggttaaagatatgaaatcagatacagtaagaattttgtttacaggatattctgatataaaagcagctgaagatgctataaataagggagaagtttatcggtttattaataagccttgggatgattcagagcttaagaatatagttgcagctgcagtcgaaaaatttgatttaacgtataaaaatcaagagttaacggaatctttacagaagaaaaatgagggaattgttttctctaaatataaaattacaagagatgtataa

SEQ ID NO: 8702 - protein, 154 aa, Unknown
  Obtained from environmental sample
  DOMAIN (4)...(124): Response regulator receiver domain
  misc_feature (1)..(154): Xaa is any amino acid
MKTIDLLILDDEQNILNSLKRLFRKIFYEIYVTTDYKEALEQVRVNNIKVVMSDQKMPDISGADFLKQVKDMKSDTVRILFTGYSDIKAAEDAINKGEVYRFINKPWDDSELKNIVAAAVEKFDLTYKNQELTESLQKKNEGIVFSKYKITRDV

SEQ ID NO: 8703 - DNA, 618 bp, Unknown
  Obtained from environmental sample
  misc_feature (1)..(618): n is a, c, g, or t
gtgaaatcaattttttggatttttattatgattacatcactattcggctcaacagaaataaaagttgcatcatacaatgtagaaaatctatttgatctaaaattaaatgggggtgagtatgccgagtacacaccaaacacctcatggcagtggaacaaagataactacagaaaaaagttaaaaaatatatcaaaagtgatatctgatatgaatccagatatcatagcccttcaagaagtggagtctgcaactgctctaaaagatctaaaagatgaactaggacgtgcaggatgttattttaaatatagtgcaatagctgcaaaaaacactactgtcaaagttgcaattcttagtaaataccagatctcttactctaaagatatcagtgtaacgtctagcagaagaaatagatctattttagagacaaanatagatattaataatcatccgctatatgtttttacaaatcactggaaagcaaaatcagggccggagagcagacgaatagtatcagcaaaggctcttaaaaaaaggttaaatgagattgggcatgaaaatgagataatcctactncgtgattttcactcacactatgaaagagaacattaccttttatag

SEQ ID NO: 8704 - protein, 205 aa, Unknown
  Obtained from environmental sample
  misc_feature (1)..(205): Xaa is any amino acid
MKSIFWIFIMITSLFGSTEIKVASYNVENLFDLKLNGGEYAEYTPNTSWQWNKDNYRKKLKNISKVISDMNPDIIALQEVESATALKDLKDELGRAGCYFKYSAIAAKNTTVKVAILSKYQISYSKDISVTSSRRNRSILETXIDINNHPLYVFTNHWKAKSGPESRRIVSAKALKKRLNEIGHENEIILLRDFHSHYEREHYLL

SEQ ID NO: 8705 - DNA, 396 bp, Unknown
  Obtained from environmental sample
  misc_feature (1)..(396): n is a, c, g, or t
ttgctctggaactacataatcagttcctttttcctgaaaactatttttatattttgtaaaatatacaatatatacatcataaaactctttcaaataaccattaaacaaaggagcaattgtcccatgatctgtatattcttgttgatcggtgatatagagaagtttttttcttacactattactatttatcatgcatcatctcctaatataggctcttcttcaactagctcgttattaaaaagttgttcattaaagttacgccccaaatatttacatattgcctcgacatcacgtagagcatttcctaaacaactagtagcaccaggtgatggtgtcatgttaaagattatcccctcccctgtatttatagaagcttcacctaacatcaatttttga

SEQ ID NO: 8706 - protein, 131 aa, Unknown
  Obtained from environmental sample
  misc_feature (1)..(131): Xaa is any amino acid
MLWNYIISSFFLKTIFIFCKIYNIYIIKLFQITIKQRSNCPMICIFLLIGDIEKFFSYTITIYHASSPNIGSSSTSSLLKSCSLKLRPKYLHIASTSRRAFPKQLVAPGDGVMLKIIPSPVFIEASPNINF

SEQ ID NO: 8707 - DNA, 549 bp, Unknown
  Obtained from environmental sample
  misc_feature (1)..(549): n is a, c, g, or t
atgaaacccttagttagtatttgtataccattatataatcatgcaaaatatatagttaaacttttagattcaattttagaggatacttatgagaataaagagataattcttattaatgatggttcggtagataatagtgatgaaattgtaataaattggattaagagaaacaatacaattaatataaaatatatttatagagagaataagggattacattctactttaaatgaattattttcattatctaatggaaaatatattattaatattgctagtgatgattatcttattaataatacaatcaaaacaagagttgaaatattagaacaaaatttaaataaactaatgttaattggcgattgtatagttgttgataaaaataataatattattagtcaaagcgctagttttgattttcatcaaggaattaagtctaactatttcgatgataagggtttaaagaatgaaatattaagaaattgggctacagttggaccatcatacatgcttaataaagcaatatttgaaccaatagggtttttatga

SEQ ID NO: 8708 - protein, 182 aa, Unknown
  Obtained from environmental sample
  DOMAIN (6)...(180): Glycosyl transferase
  misc_feature (1)..(182): Xaa is any amino acid
MKPLVSICIPLYNHAKYIVKLLDSILEDTYENKEIILINDGSVDNSDEIVINWIKRNNTINIKYIYRENKGLHSTLNELFSLSNGKYIINIASDDYLINNTIKTRVEILEQNLNKLMLIGDCIVVDKNNNIISQSASFDFHQGIKSNYFDDKGLKNEILRNWATVGPSYMLNKAIFEPIGFL

SEQ ID NO: 8709 - DNA, 483 bp, Unknown
  Obtained from environmental sample
  misc_feature (1)..(483): n is a, c, g, or t
atggacataaaagataaaaacataaagtttaaagcagtcatttttgatttagacggtacattggttaattcacttcaggatatagcggacgccatgaatacggttcttaaaagttacaattacccgacgcatagctatgaaaaacatcgaagttttattggtagcggtattagaagtctcgtaagtaaatcgctgccactagcacataatgacgaacaagaagttgagcgttgtttacatgctatgattgaagtatatcgtgataattgcaccaataaaacaaaaccatacgatggtattattgaattactcgacaatttggtttctcgtgatataaagctaagtgtattatctaataaggctgatgagttaactaagaaaattacacatgtattattccctaactattttgatcctgtaattggtttaacttccgaatcgcttaaaaaacccaatcccttttacagttatagaaatcgctaa

SEQ ID NO: 8710 - protein, 160 aa, Unknown
  Obtained from environmental sample
  misc_feature (1)..(160): Xaa is any amino acid
MDIKDKNIKFKAVIFDLDGTLVNSLQDIADAMNTVLKSYNYPTHSYEKHRSFIGSGIRSLVSKSLPLAHNDEQEVERCLHAMIEVYRDNCTNKTKPYDGIIELLDNLVSRDIKLSVLSNKADELTKKITHVLFPNYFDPVIGLTSESLKKPNPFYSYRNR

SEQ ID NO: 8711 - DNA, 771 bp, Unknown
  Obtained from environmental sample
  misc_feature (1)..(771): n is a, c, g, or t
atgattgataaacaccttgcaaatcacaatttgccttatgctattgatattcatgggggtggagccgatttactgtttccacaccatgaaaatgaggcaagtcaaacaagatgttgtacctctcaagagttagcaaaatattggatgcataatggttttgtaaatatagatggggaaaagatgtctaaatcacttggaaatagtttttttctcaaagatgctttagataaatatgatggtgaagttatccgattttatatgttaagtactcattatagatctgatttgagttttaatgaagaagatttattaacaagtaaaaaaaggcttgataaactctatagagtaaaaaaaagagtttatggaacaactgcgagtattgtcaataaagatatacaaaaacaacttttagaatctttaaatgatgatatgaataccgcaaaagcgatggcttttttagatgaatatatctcaagtgttaatgactcgttaaataataatccaaaagacaaagctcttaaaaaagagtttatagcaactattgattttatctcatctcttttaggaattggagctcaagattgttttgagtattttcaatttgggattactgaagaggaaaaaagtagcattgaaaaacttataagtgatagaacaatagcaaaacaaaataaaaactttgaggaatcagataagataagagaaaaattaacagatatgggaatatctcttatggataccccaaatggaacaatgtgggagaaaaactaa

SEQ ID NO: 8712 - protein, 256 aa, Unknown
  Obtained from environmental sample
  DOMAIN (1)...(108): tRNA synthetases class I (C) catalytic domain
  misc_feature (1)..(256): Xaa is any amino acid
MIDKHLANHNLPYAIDIHGGGADLLFPHHENEASQTRCCTSQELAKYWMHNGFVNIDGEKMSKSLGNSFFLKDALDKYDGEVIRFYMLSTHYRSDLSFNEEDLLTSKKRLDKLYRVKKRVYGTTASIVNKDIQKQLLESLNDDMNTAKAMAFLDEYISSVNDSLNNNPKDKALKKEFIATIDFISSLLGIGAQDCFEYFQFGITEEEKSSIEKLISDRTIAKQNKNFEESDKIREKLTDMGISLMDTPNGTMWEKN

SEQ ID NO: 8713 - DNA, 897 bp, Unknown
  Obtained from environmental sample
  misc_feature (1)..(897): n is a, c, g, or t
atgatcagatcggctcgagaacatgaatttaatggaataattatagtaaatatgttaacaacaaatttatttgattcaattcgtagttcatcagcttttgaacattttattattgataaaaatggaaactatataatgcatcctgatgaccaatattcctttaataaatataaagggatttctagaacacttcgtcaagatttttctaaagatgcaattcaattattatctcatcctaatagatgtgattcttgttatgtgtatccattgaatgatattttgaacaatgaagataaagcaataatggtattaaaaccaaaagaatcttaccaagatgctttattatatgacaagttaaaagccacattttatattatactgttaagtatattagccagtttaattatggctttttatgcttctatacgaccagcgcaattacaaaaagcacttttactagcaaatgatgaactcaaaaggtttgcttcaattttagataagtatgtagtttcaaccaaaacaacaaaagatacaactattttagaagtgagtaatgcttttgaaaatgcaagtggatatagaaaagatgaacttatagggaagcctatgagtatcatcaaacaccctaatacacccaaagagttttttaaaaaatcttgggaaacaattttaaataaaggtgaatggagtggtgagatccaaaatagaaaaaaagatggcactgatttttggttagaacaaaacattatcgctgtcaaagatgatcaaggagaaattgaatcctttgtatcagtaggacaagatatcacttcaaaaaaagagttagagaaactctccctcatagataaactgacgggtgttttaatagaagaaaacttgatgatttttagagtatga

SEQ ID NO: 8714 - protein, 298 aa, Unknown
  Obtained from environmental sample
  DOMAIN (230)...(272): PAC motif
  misc_feature (1)..(298): Xaa is any amino acid
MIRSAREHEFNGIIIVNMLTTNLFDSIRSSSAFEHFIIDKNGNYIMHPDDQYSFNKYKGISRTLRQDFSKDAIQLLSHPNRCDSCYVYPLNDILNNEDKAIMVLKPKESYQDALLYDKLKATFYIILLSILASLIMAFYASIRPAQLQKALLLANDELKRFASILDKYVVSTKTTKDTTILEVSNAFENASGYRKDELIGKPMSIIKHPNTPKEFFKKSWETILNKGEWSGEIQNRKKDGTDFWLEQNIIAVKDDQGEIESFVSVGQDITSKKELEKLSLIDKLTGVLIEENLMIFRV

SEQ ID NO: 8715 - DNA, 546 bp, Unknown
  Obtained from environmental sample
  misc_feature (1)..(546): n is a, c, g, or t
atgaaactcaattataaaaaacttggtgaaggtccagcactaataatcgttcatggcttatatggaggccttgataattggcttacaatagccaaagaattagctagaactttcgaagtttttatagtcgatcaacgaaaccatggcaaatcgcctcatgatgattcccatacttataccgacctaaaaaatgatctccttgaatttatggacaatcataaaatagataaagctgttcttcttggacactcgatgggtggtaaaacagttatattttttgctgttgattatcctgaaagagtaagcagtttacttgtggttgatattgctcctaaaaattacagcaaaatttcagactacacgcctcaaacaatcaatcacgaacatttagtttcagtcattctcaatattgatttaaaccaatttaaatcgagaactgaaatcaatattgaattagctattcaaatcaaaagtgaaaaagttagacagttcttgttaaaaaactttgaaacgaaacgaggacaaaagcctttggatggaaattaa

SEQ ID NO: 8716 - protein, 181 aa, Unknown
  Obtained from environmental sample
  misc_feature (1)..(181): Xaa is any amino acid
MKLNYKKLGEGPALIIVHGLYGGLDNWLTIAKELARTFEVFIVDQRNHGKSPHDDSHTYTDLKNDLLEFMDNHKIDKAVLLGHSMGGKTVIFFAVDYPERVSSLLVVDIAPKNYSKISDYTPQTINHEHLVSVILNIDLNQFKSRTEINIELAIQIKSEKVRQFLLKNFETKRGQKPLDGN

SEQ ID NO: 8717 - DNA, 834 bp, Unknown
  Obtained from environmental sample
  misc_feature (1)..(834): n is a, c, g, or t
ttggtacaaaaacagacttatgaattactttcaaaatattttgaagaaaatcctttagaagcaaaagcaattgtttctaaatcacttatggctgctcgtggtcgtgaagctgctaaaaaagctagagagttaactcgtagaaaagattctatgagtgttggtactcttcctggtaaattggctgattgtcaaagtaaagatgcaagtatttgtgaactttacctggtggaaggggattctgcgggtggttcagctaaaatgggtcgtgatcgtgtttttcaagcgattttaccacttaaaggtaaaattttaaatgttgaaaaagctagattagaaaagattttaaaatctgatgaaataacaaatatgataactgccatgggttgtggaattggtgaagaatataatgaagataaacttcgttatcataaacttataattatgaccgatgcggatgttgatggatctcatattcaaactctgcttcttacatttttcttccgtcatttccgtgatgtagtagaaaaaggttatttatacctagcacaaccaccactttaccgttataaaaaaggtaaaaaagaaatttattttaaagacgatcgtgagatgaatgattatcttattgaaaatggaattgagtctttatctgttgagggtgttggacataatgacttagtatcgtactttagaatggttgatcactatagaggatctcttgttggcgtagagcgtaaatatgccttagttgatttaattccgccttttataaaaaaccctggactaataggtcctaatattcaacccatgtatgaaaaagttgaaaaattttag

SEQ ID NO: 8718 - protein, 277 aa, Unknown
  Obtained from environmental sample
  DOMAIN (101)...(182): Toprim domain
  misc_feature (1)..(277): Xaa is any amino acid
MVQKQTYELLSKYFEENPLEAKAIVSKSLMAARGREAAKKARELTRRKDSMSVGTLPGKLADCQSKDASICELYLVEGDSAGGSAKMGRDRVFQAILPLKGKILNVEKARLEKILKSDEITNMITAMGCGIGEEYNEDKLRYHKLIIMTDADVDGSHIQTLLLTFFFRHFRDVVEKGYLYLAQPPLYRYKKGKKEIYFKDDREMNDYLIENGIESLSVEGVGHNDLVSYFRMVDHYRGSLVGVERKYALVDLIPPFIKNPGLIGPNIQPMYEKVEKF

SEQ ID NO: 8719 - DNA, 882 bp, Unknown
  Obtained from environmental sample
  misc_feature (1)..(882): n is a, c, g, or t
ttgaaactcattataagagatgttgtatatgatttttcatttccaagaactgaaaataagataggattaggacacaaagagttttctgtaatagtgaatagtgatttaagctttgaagatgcatctagaagaagagattttactatgaattcaattgggtatgattatactaaaaaagagtttttagacccatataatggtacaaaagatataaaaaataaactattaaaacatatagatgataaaagttttattgaagatccattacgagtatatagagcaattcaattttgtggaagatttgaacttacaatagataaaaatacacaaaaactttgtgataatttagttaaaagtgaagagtttaaaacactctcaaaagaaagagtttttaatgaatatgaaaaattacttctttattcaaaaaaaccatccataggattacaacttttagttcaattaaatatcataaatatatctgctgaaatgatgaataatattgattatatggtaaagtataaaacgaaaaattataaagaaaatcttgtattaatgttttattttttatttgacactttgcttgatatatctgaaaataaacaacttctaaaagatattaaaaaacttcaaaaatttaaagtacctgagatatataaaaaagagttaatagatattaaaaacgaagcagaattaatctctaaaaaatataaaattatgaacaatatgccaaaaccatttttaatgggaaaagacttgataaattttggatataaacctagtgtgaagtttggagtagttttaaaaaaaatataccaaatctcacttgatggagagattggtagtaaaaaagaagcagagaaagtactctctactcttttataa

SEQ ID NO: 8720 - protein, 293 aa, Unknown
  Obtained from environmental sample
  DOMAIN (12)...(166): Poly A polymerase family
  misc_feature (1)..(293): Xaa is any amino acid
MKLIIRDVVYDFSFPRTENKIGLGHKEFSVIVNSDLSFEDASRRRDFTMNSIGYDYTKKEFLDPYNGTKDIKNKLLKHIDDKSFIEDPLRVYRAIQFCGRFELTIDKNTQKLCDNLVKSEEFKTLSKERVFNEYEKLLLYSKKPSIGLQLLVQLNIINISAEMMNNIDYMVKYKTKNYKENLVLMFYFLFDTLLDISENKQLLKDIKKLQKFKVPEIYKKELIDIKNEAELISKKYKIMNNMPKPFLMGKDLINFGYKPSVKFGVVLKKIYQISLDGEIGSKKEAEKVLSTLL

SEQ ID NO: 8721 - DNA, 375 bp, Unknown
  Obtained from environmental sample
  misc_feature (1)..(375): n is a, c, g, or t
atggtaaagttaaaacggaaaaattataaagaaaatctggtattaatgttttattttttatttgacactttgctgnatatatctgaaaataaacactttctaaaagatattaaaaaacttcaaaaatttaaagtacctgagatatataaaaaagagttaatagatattaaaaacgaagcagaattaatctctaaaaaatataaaattatgaacaatatgccaaaaccatttttaatgggaaaagacttgataaattttggatataaacctagtgtgaagtttggagtagttttaaaaaaaatataccaatctcaacttgatggagagattggtagtaaaaaagaggcagagaagttactctctactcttttataa

SEQ ID NO: 8722 - protein, 124 aa, Unknown
  Obtained from environmental sample
  misc_feature (1)..(124): Xaa is any amino acid
MVKLKRKNYKENLVLMFYFLFDTLLXISENKHFLKDIKKLQKFKVPEIYKKELIDIKNEAELISKKYKIMNNMPKPFLMGKDLINFGYKPSVKFGVVLKKIYQSQLDGEIGSKKEAEKLLSTLL

SEQ ID NO: 8723 - DNA, 468 bp, Unknown
  Obtained from environmental sample
  misc_feature (1)..(468): n is a, c, g, or t
gtgtggaactcgttgatattgaaacactcgtatagtctttttttctttttacttctttttttgcaaggatgtagtgataatgcgactgtaaatatttttgataaaaaaattactcaaaacaaaactgagtgtatgaggcttgtagtctttcctccagataaaaaaatcgaaaaaactttaaatgagctttacccttttaatgattcttgccctgtaaaactagaagtcaatacaaaaagttccatagtttgtaactctaatcaaaactctcaaagaaaagcactttctaacttccctacaagttatttaaagatgcaaatatctaaaaataacagtttgaaatatagttactatattgatttaagtgagagtgtaacaaccgatgatgtaaaaaatgcatttgagagaattaaaaaagatttgattcttaactacaacaaaataagattaaataactttaatgaataa

SEQ ID NO: 8724 - protein, 155 aa, Unknown
  Obtained from environmental sample
  misc_feature (1)..(155): Xaa is any amino acid
MWNSLILKHSYSLFFFLLLFLQGCSDNATVNIFDKKITQNKTECMRLVVFPPDKKIEKTLNELYPFNDSCPVKLEVNTKSSIVCNSNQNSQRKALSNFPTSYLKMQISKNNSLKYSYYIDLSESVTTDDVKNAFERIKKDLILNYNKIRLNNFNE

SEQ ID NO: 8725 - DNA, 648 bp, Unknown
  Obtained from environmental sample
  misc_feature (1)..(648): n is a, c, g, or t
atgaataaatgtaaaatctgccactgtaatacaagcgtaataaaagacgaaaaaacggataagatttatcatagatgcttaaactgcgactatatttttatggatgataaatactatctagatgcaagtcttgagaaaaagcattacgataatcataataataatttagaatcactcggttatgtgaaaatgtttgaaaagctcatagaagagtttgtgtctccagatgccaaagatataaaaacggcacttgactttggttgtggagagggtgaagttttacctattttactagaaagggttggcatctcttgtgataaatatgatttattttactttccaaaaaaagtatatgcagataaaaaatatgaccttatttgttgtacagaagttatagagcatctggttaatccactagatactattaaagaactactttctcatctaaataaagatgggtacctacttcttatgacttattttcatccaagtgatgatgaaaagtttttagaatggttttatataaaagatatgacgcatataggattttttagttttaaaacatttgaatatttaacaagtgaacttggacttaaaatagttaaaaataatagtaaaaacatagttctgttaaaaaacaatatttaa

SEQ ID NO: 8726 - protein, 215 aa, Unknown
  Obtained from environmental sample
  misc_feature (1)..(215): Xaa is any amino acid
MNKCKICHCNTSVIKDEKTDKIYHRCLNCDYIFMDDKYYLDASLEKKHYDNHNNNLESLGYVKMFEKLIEEFVSPDAKDIKTALDFGCGEGEVLPILLERVGISCDKYDLFYFPKKVYADKKYDLICCTEVIEHLVNPLDTIKELLSHLNKDGYLLLMTYFHPSDDEKFLEWFYIKDMTHIGFFSFKTFEYLTSELGLKIVKNNSKNIVLLKNNI

SEQ ID NO: 8727 - DNA, 858 bp, Unknown
  Obtained from environmental sample
  misc_feature (1)..(858): n is a, c, g, or t
atgaaaaaaataactaaaattcttcttatttttgcccttgttgcaatattttccggatgtgctgataaaaaagagaaggaacttgtttcacatgattcttcagtgggtaacaatgaaagaatcaaatcaagagagaagagaatacaggaaggttcttggtataaaccaaaaccaggaatttcttggcagtggcagttgcaaggggaagttgacactaagtttgatgtcgatatgtatgacgttgatcttgaatttgtgaaagttgaaacaatcgataggcttcatgaaaaaggaatcgaagttgtttgttatttctctgccggtagctgggaggattttagaagtgatgcaaaagatttttcaaaggaaataattggagagccactggacggttggccagatgaacattggttggatatttcaaattatgaaaaatttgcaaacatcatgactgcaaggcttgatgttgcagtcacaaaagggtgtgacggtgtcgatccagacaatgtgcacgcatatcaagcggaaagcggttttgagattagctacgaagaccaattaatctacaataaatggttggcaagtgaggctcataaaagaaatctttcgattggtttgaaatatgatattgaacaagtagatgagttggttgatcattttgattttgcaataaatgagaattgtttttattatcgagaatgtgataaattgttgccatttgttgaaaaaaacaaagcagtgtttggagttgaatatgagctggaaaccaatgaattttgcgataaagcaaataagatgaattttagctggttgagaatggaatatgatttaaatggaggtagaaatgccctgcgatga

SEQ ID NO: 8728 - protein, 285 aa, Unknown
  Obtained from environmental sample
  SIGNAL (1)...(19)
  misc_feature (1)..(285): Xaa is any amino acid
MKKITKILLIFALVAIFSGCADKKEKELVSHDSSVGNNERIKSREKRIQEGSWYKPKPGISWQWQLQGEVDTKFDVDMYDVDLEFVKVETIDRLHEKGIEVVCYFSAGSWEDFRSDAKDFSKEIIGEPLDGWPDEHWLDISNYEKFANIMTARLDVAVTKGCDGVDPDNVHAYQAESGFEISYEDQLIYNKWLASEAHKRNLSIGLKYDIEQVDELVDHFDFAINENCFYYRECDKLLPFVEKNKAVFGVEYELETNEFCDKANKMNFSWLRMEYDLNGGRNALR

SEQ ID NO: 8729 - DNA, 705 bp, Unknown
  Obtained from environmental sample
  misc_feature (1)..(705): n is a, c, g, or t
ttgacgataccttcgatcccaagttggtacctgcaggaagacaaactatcaggtataccaagaactatgcacttccaccagctgggactattctgggttcacctcctctatgatatgggctacatgcctgttatcagtactgagactgacgagaaaattgttggagccggtattgcagctatgacctgtgagacctgtttcccaatcaagctctcccacggacatacccttgccctcaaggacaaggttgattacctcttcatccctgaactcatcgagatgcagccatctgagaatgaccgtcgtggctactactgcccttatcagcaaggtaacttccatatgctgaaggcagctatcggcattgaagaagccaaatgtattcaccctgacattcatcttcaggctggtaaaaaaggaatgttcaagtcattcaaggaagaattcaaacgtctcaacctccacctcaaaggtttcgatgaggcatgggatacagcaagagcaactctcaccacattccaaaatgaattaaagagaattgggaaagcagcccttgaaaaactaggacctgacggtaaagctgttgtcgttatctcaagaccttacgctctttatgacacaagaacaaatctgaatctcttcaatacattctcaaaactggggcgcaacagcgattccattcgaattcctggatatccaggataa

SEQ ID NO: 8730 - protein, 234 aa, Unknown
  Obtained from environmental sample
  misc_feature (1)..(234): Xaa is any amino acid
MTIPSIPSWYLQEDKLSGIPRTMHFHQLGLFWVHLLYDMGYMPVISTETDEKIVGAGIAAMTCETCFPIKLSHGHTLALKDKVDYLFIPELIEMQPSENDRRGYYCPYQQGNFHMLKAAIGIEEAKCIHPDIHLQAGKKGMFKSFKEEFKRLNLHLKGFDEAWDTARATLTTFQNELKRIGKAALEKLGPDGKAVVVISRPYALYDTRTNLNLFNTFSKLGRNSDSIRIPGYPG

SEQ ID NO: 8731 - DNA, 459 bp, Unknown
  Obtained from environmental sample
  misc_feature (1)..(459): n is a, c, g, or t
atgacaacattcaacgataattttttaaaagcttgtagaagagaagaaacaccatacacaccactttggttagctcgtcaggcaggacgctaccaaaaggaatacatgaaaattaaagaaaagtacagtattattgaaatcagtaccattcctgaagtgagtgcagaggttactttgttgcctatcaaccaatttgaattagattcagccattatcttttctgatattttaattccactcggaccaatgggaataagctttgaatataaaaaaggttacggaccattaatccataacccaataagaactgttgctgatgtggaaaaacttaaagtagttgacccagcaacagaaatgtggtataccggtaaagcattaaccatcttgaaaggtgagttaaatgtgccctggtatggttttgntggaagctccgttacccttaccaagttacatgattga

SEQ ID NO: 8732 - protein, 152 aa, Unknown
  Obtained from environmental sample
  DOMAIN (3)...(152): Uroporphyrinogen decarboxylase (URO-D)
  misc_feature (1)..(152): Xaa is any amino acid
MTTFNDNFLKACRREETPYTPLWLARQAGRYQKEYMKIKEKYSIIEISTIPEVSAEVTLLPINQFELDSAIIFSDILIPLGPMGISFEYKKGYGPLIHNPIRTVADVEKLKVVDPATEMWYTGKALTILKGELNVPWYGFXGSSVTLTKLHD

SEQ ID NO: 8733 - DNA, 420 bp, Unknown
  Obtained from environmental sample
  misc_feature (1)..(420): n is a, c, g, or t
atgataaaaaacaatacgcaaatatcagaaaaagaaggagtcgcaattcaggataattaccttgaggtgaggaaggcatgcaaaaattgttcgaaaaaggatctgcttaggctcgaggatgcatttaactacgctaaagatgaatatgctgatagtcgaaaagaatcgggtgaactgaagataatgcacagtttatcggttgcacacatcgtggccaatgaaattggcttaaggtcaagctcagttatatcagctattcttcatgatatcatcgacaatcccgaccaggatatcaaaatagtaaacgagaagtttggagaagatgtagctacaattgtcaaaggatttaaaaagctttcgatgcttcactcccataaggtttccttttcaatcggaaaacttcaggaagctcttttttag

SEQ ID NO: 8734 - protein, 139 aa, Unknown
  Obtained from environmental sample
  misc_feature (1)..(139): Xaa is any amino acid
MIKNNTQISEKEGVAIQDNYLEVRKACKNCSKKDLLRLEDAFNYAKDEYADSRKESGELKIMHSLSVAHIVANEIGLRSSSVISAILHDIIDNPDQDIKIVNEKFGEDVATIVKGFKKLSMLHSHKVSFSIGKLQEALF

SEQ ID NO: 8735 - DNA, 528 bp, Unknown
  Obtained from environmental sample
  misc_feature (1)..(528): n is a, c, g, or t
atgagtgattttacaaaagagtttcaaaaagcttataagttaatcaatgagagtcactatattttaatagttacacatattaatcctgatgcagacactttatcgtcagcgttagctttgagtaattatatgtatagaaataatatcaatcataaagtatacaatagtagtaagtatctacctagaaatttagattttctaccacgatttgataaaattaccgatacagtacctaaaagttatgatcttattatttatgtagattgtggtgataaaagaagagttggttttgagtttaataatacttgtaaagttattaatatagatcatcaccaatccaatgataattatggagatataaatattgttgatttcgataaaggaagtaccgctgaactattatttggttttttcaaggataatgggataaaaataacaaaagagatggccccttgttatatattggtatttatgaggaaagtattgcttttactacccctagaactaaaagtaaaccttttggagtga

SEQ ID NO: 8736 - protein, 175 aa, Unknown
  Obtained from environmental sample
  DOMAIN (14)...(158): DHH family
  misc_feature (1)..(175): Xaa is any amino acid
MSDFTKEFQKAYKLINESHYILIVTHINPDADTLSSALALSNYMYRNNINHKVYNSSKYLPRNLDFLPRFDKITDTVPKSYDLIIYVDCGDKRRVGFEFNNTCKVINIDHHQSNDNYGDINIVDFDKGSTAELLFGFFKDNGIKITKEMAPCYILVFMRKVLLLLPLELKVNLLE

SEQ ID NO: 8737 - DNA, 714 bp, Unknown
  Obtained from environmental sample
  misc_feature (1)..(714): n is a, c, g, or t
gtggttttacgaggatatggaagagagtcaaaagggctctttgtagtatcacaaaatggaaagataaaagaaaatattcaaacaagtggtgatgaagctatgcttttagcaaagagcctaccaaaagccacgataattgtaagtgaaaatagaacagatggtgttctaaaagcaagagagttagggtgtaaagtggtttttttagatgatggatatagacatcatgagatagaaaagtttgatatactactacgaccaaaagaagaacctacaaatattttttgtcttcctagtggtggatatagagatactaaaatgatgtattcttttgctaatttagttttaaaagaggatgtggattttactagaacggttactttaaaaaaatcaaatgttatagtagaaaagttaccagaagatgtattacttgttactgctatatcaaaagcgtatagacttttagaatatctaccagaaaatatttcaacagttatttttgaagatcatcatactttcacacaagaagatattgatatgataactacaaaatatccaaaaagtgcaattattacaacagccaaagatatggtaaaactagagcagtttgatttacaagatatctacttaatggatttagaagtacaaatagatagtaagactatacaatcaattgaaaactatattacgcccaaatctgcagatgaggtgtattag

SEQ ID NO: 8738 - protein, 237 aa, Unknown
  Obtained from environmental sample
  DOMAIN (1)...(229): Tetraacyldisaccharide-1-P 4'-kinase
  misc_feature (1)..(237): Xaa is any amino acid
MVLRGYGRESKGLFVVSQNGKIKENIQTSGDEAMLLAKSLPKATIIVSENRTDGVLKARELGCKVVFLDDGYRHHEIEKFDILLRPKEEPTNIFCLPSGGYRDTKMMYSFANLVLKEDVDFTRTVTLKKSNVIVEKLPEDVLLVTAISKAYRLLEYLPENISTVIFEDHHTFTQEDIDMITTKYPKSAIITTAKDMVKLEQFDLQDIYLMDLEVQIDSKTIQSIENYITPKSADEVY

SEQ ID NO: 8739 - DNA, 600 bp, Unknown
  Obtained from environmental sample
  misc_feature (1)..(600): n is a, c, g, or t
atgactgtgaaagtactgtttttactatattttacgtttattatgctttattcaatcgatagagaaagttcagtagctggcttattttaccctaaaaataaaaatgagttatcaaatatagtagaaaaattactccgtgaaaaaagcactacagttgtagacgatatacgagctataatctctccgcatgcaggatatatctactctggtgatgttgcatcatcaatatatacaaatttaacctctgcaaatagatacaaaaatatatttttaattggaactagtcactacgtaaactttaatggtgcttctatctatgctataggggattacaaaactccacttggaactattaatgtaaataagaaattagccaactctcttatagaaaacagtaaagtatttacttttagatttaacgctcatgctaaagagcattccttagagacacaacttccttttttacaaaaaacacttaagtatgattttaaaattgttccaataatcattgctacagatgatttatcaactattaaagagattgcaaaagagttaaaaccatattttaataaagataacctttttataataagcaggtga

SEQ ID NO: 8740 - protein, 199 aa, Unknown
  Obtained from environmental sample
  DOMAIN (22)...(199): Protein of unknown function DUF52
  misc_feature (1)..(199): Xaa is any amino acid
MTVKVLFLLYFTFIMLYSIDRESSVAGLFYPKNKNELSNIVEKLLREKSTTVVDDIRAIISPHAGYIYSGDVASSIYTNLTSANRYKNIFLIGTSHYVNFNGASIYAIGDYKTPLGTINVNKKLANSLIENSKVFTFRFNAHAKEHSLETQLPFLQKTLKYDFKIVPIIIATDDLSTIKEIAKELKPYFNKDNLFIISR

SEQ ID NO: 8741 - DNA, 375 bp, Unknown
  Obtained from environmental sample
  misc_feature (1)..(375): n is a, c, g, or t
atgctacaaaagagggtagagctcaaaaccgtagaattatcgctatttttgagaactagtatgagtgaatttaaagatgttagcattgtaaaaaatgctaatgtatattttgatggaaaagtaacaagtagaactgtaaaattcagtgatggtactatcaaatcactagggattatgcttcctggtgagtatgaatttggtactgctgaagctgaaattatggagattatgtcaggtgatcttgatataaaacttccaaatgaagatagtttcaaaaaagttgtcggcggggagagcttcaatgtcgaagcaaactcaaaattcaatgttaaagtaaatactattactgattactgttgctcgtatattaaatag

SEQ ID NO: 8742 - protein, 124 aa, Unknown
  Obtained from environmental sample
  DOMAIN (30)...(123): Protein of unknown function (DUF1255)
  misc_feature (1)..(124): Xaa is any amino acid
MLQKRVELKTVELSLFLRTSMSEFKDVSIVKNANVYFDGKVTSRTVKFSDGTIKSLGIMLPGEYEFGTAEAEIMEIMSGDLDIKLPNEDSFKKVVGGESFNVEANSKFNVKVNTITDYCCSYIK

SEQ ID NO: 8743 - DNA, 444 bp, Unknown
  Obtained from environmental sample
  misc_feature (1)..(444): n is a, c, g, or t
atgaaaaataaaaaaatatcaccacaggcagttttagcattaaaagaggcattaattcatatctattggaaaaaaaatgacttgaaagattttctcaaactgacaataacaaactctttaattgtatctactatcaattgggacaatacaaaacgtgaagcagtttatgaattggttgaaagaatgattaatagattagatatttattatgatgacttaatatctttattaattggagtaacagattttactgatttttcacatttagattattgggatgaagatggaacaaaaaaagagaaggcaaaaaaaagcgtaaatagccttagagttcatacaaaaggatatatccaaatttcaaaagaaaaagaagaagcaattaagagaagaaatataagtgaacaaaaaatattagatagaaaaacactagaaaaggatatttga

SEQ ID NO: 8744 - protein, 147 aa, Unknown
  Obtained from environmental sample
  misc_feature (1)..(147): Xaa is any amino acid
MKNKKISPQAVLALKEALIHIYWKKNDLKDFLKLTITNSLIVSTINWDNTKREAVYELVERMINRLDIYYDDLISLLIGVTDFTDFSHLDYWDEDGTKKEKAKKSVNSLRVHTKGYIQISKEKEEAIKRRNISEQKILDRKTLEKDI

SEQ ID NO: 8745 - DNA, 375 bp, Unknown
  Obtained from environmental sample
  misc_feature (1)..(375): n is a, c, g, or t
atgttgaaaattttaatatattcatttatattagctgtaacaatacatgcaactgtattggaagataaagtacagtcaatagttggaaatcaaaattttcaaactcacaaaggtcttatagagtttttattgaaggatgagagtaaatttatccgtaatgataaaatagaatatttgaaactttttgaagtattacaacaaaatggacttttaaatttacgcttaaataatccaacagatataaaaatagaatttaagatggtaagtaaaaatataaaggcttacaaaattttaaatgatactttgcaatctttggggataagatatttttttacaaatagaatgactcaaaatactcaaaacgaactattatga

SEQ ID NO: 8746 - protein, 124 aa, Unknown
  Obtained from environmental sample
  misc_feature (1)..(124): Xaa is any amino acid
MLKILIYSFILAVTIHATVLEDKVQSIVGNQNFQTHKGLIEFLLKDESKFIRNDKIEYLKLFEVLQQNGLLNLRLNNPTDIKIEFKMVSKNIKAYKILNDTLQSLGIRYFFTNRMTQNTQNELL

SEQ ID NO: 8747 - DNA, 915 bp, Unknown
  Obtained from environmental sample
  misc_feature (1)..(915): n is a, c, g, or t
ttgacaccgttttatcaagaagtgtttaaaagtgtttatggtgtgggtatagctatgtcaatatggcaatcatcttggacaaaacttattatcaatggagttaacaaagatttgcttgctaaatttgataatgatgatgaaaaagttatagagtttcttgaagaaaataatctctttgacaaagggcatgatggacttacagcagatagaagttactctatgcttgtaaaagaaaatggtagctataaaagtgctgcatatatcactgcttttaaaaaagaggtaactgctgttattgatgcgcttgaagagtttgttgatagtttaatagaacttgaagatgaagtatataatcaaaaatgggaatatatccactaccttcaagcaatcatcacagcatttagtgaaagaagaactgagatgttagtttcaaaatgggctgatgtggatagtgcttggatgaagattacaactcctatacaaattggtcatccactagagtattatgaagatcattttagaaaagctgtagcactagaatgggatataagacttgttaatccatccatacaaaataacaatcaaagggtagaaaaaatcaaagctatgtttagtgagctttttgaaactattaaacaaaacaatgatgaaaaaagtatttatgatttttcattaaaaagtttagataaagtacaactctatctaggtcgtcctgcattgttttttggtgcagagttcaatggacttttttcagcacaagttgtaccaaatgatgagattgtatcggcaaaagaagggaaaaaaatatttgcatttagtgatgagatacttcaagggcaaagagcaaaaccatttttacgcctctctaaagagatttttgggcaaaagtttacctcagccataagccnnncttaa

SEQ ID NO: 8748 - protein, 304 aa, Unknown
  Obtained from environmental sample
  misc_feature (1)..(304): Xaa is any amino acid
MTPFYQEVFKSVYGVGIAMSIWQSSWTKLIINGVNKDLLAKFDNDDEKVIEFLEENNLFDKGHDGLTADRSYSMLVKENGSYKSAAYITAFKKEVTAVIDALEEFVDSLIELEDEVYNQKWEYIHYLQAIITAFSERRTEMLVSKWADVDSAWMKITTPIQIGHPLEYYEDHFRKAVALEWDIRLVNPSIQNNNQRVEKIKAMFSELFETIKQNNDEKSIYDFSLKSLDKVQLYLGRPALFFGAEFNGLFSAQVVPNDEIVSAKEGKKIFAFSDEILQGQRAKPFLRLSKEIFGQKFTSAISXX

SEQ ID NO: 8749 - DNA, 801 bp, Unknown
  Obtained from environmental sample
  misc_feature (1)..(801): n is a, c, g, or t
atggatcattctgatgtttcgctttatgtgatgacacctgaatttggtgctgctacgcaattagaaaaaattgacatgctcgattttgctgatgtagtagcccttaataaatttgataaacgtggagcgttggatgcattgagagacgtgaaaaaacaatacaagcgtaatcacatgctttttgaagcttcagatgacgatattcctgtttatggaacaattgcttcgcagtttaatgatccgggcatgaatgagctttacaaagtgattatggataaattggtagagaaaaccaaaacggatttgtcttcaactttcgagattaccaaagaaatgtcggagaaaatttttgttatcccaccgagtagaaaccgttatttgtctgaaattgcagaaaacaacagatcttacgataattgggtggacgaacaagtggctattgctgataagttatatgccatccacaatacattagaaattcttaaaggaaaagatgaaagcattgccaaggttttacaagcagaatttgattccttaaaacttaatttcgaccctaagaactggatacttattgaagaatggaacgacaaagtagctaaatacaaagctcctttttataaatttaaagtaagagacaaagaattatctattttaacccatacagaaagcttatctcatacgcaaatccctaaagttgccttaccaaaatataaaggctggggagatgtgttacgttggagtttgcaggaaaatgttcctggagaatttcttatacatctggattatttcggtttaacgtga

SEQ ID NO: 8750 - protein, 266 aa, Unknown
  Obtained from environmental sample
  misc_feature (1)..(266): Xaa is any amino acid
MDHSDVSLYVMTPEFGAATQLEKIDMLDFADVVALNKFDKRGALDALRDVKKQYKRNHMLFEASDDDIPVYGTIASQFNDPGMNELYKVIMDKLVEKTKTDLSSTFEITKEMSEKIFVIPPSRNRYLSEIAENNRSYDNWVDEQVAIADKLYAIHNTLEILKGKDESIAKVLQAEFDSLKLNFDPKNWILIEEWNDKVAKYKAPFYKFKVRDKELSILTHTESLSHTQIPKVALPKYKGWGDVLRWSLQENVPGEFLIHLDYFGLT

SEQ ID NO: 8751 - DNA, 654 bp, Unknown
  Obtained from environmental sample
  misc_feature (1)..(654): n is a, c, g, or t
ttgacactctcttattttattattcttttaattttaaaaaagttaataaggaatagtaatatgtctataaatgttggttgtagtcaacgaattaagccaaaacttttaagagaacaaaaaacagaagcattgttggtatttattcgtacaactttggaacaatattttaaagaactagatgacaataaaattagcgttaccataggaactcctgaaaatactctctatatcaataatatcttaagaaaacttttgaacaatattcagaagtgtgtagtaaattctacatacttaagaaatttgattatcaatggtgaaaaaaataaaactttcaaaatgatactcaaaactgaggaaccacttatagtttattataatagtattgttaaaagtatagaaataaatcttcctcatggtacaaattggataccggaacttatggttatagcacttttaagtgaatggattttagaagaggaacgctctgtgtatctttatccatttttagaagagatagactatatagatttattagaacgatacgatttagctagacttgatacaaagacacccaaaagagattattatggatatgtaccaactctcaactcaattaatacaaagcttaaaaacccaattttaaaattacacctc

SEQ ID NO: 8752 - protein, 218 aa, Unknown
  Obtained from environmental sample
  misc_feature (1)..(218): Xaa is any amino acid
MTLSYFIILLILKKLIRNSNMSINVGCSQRIKPKLLREQKTEALLVFIRTTLEQYFKELDDNKISVTIGTPENTLYINNILRKLLNNIQKCVVNSTYLRNLIINGEKNKTFKMILKTEEPLIVYYNSIVKSIEINLPHGTNWIPELMVIALLSEWILEEERSVYLYPFLEEIDYIDLLERYDLARLDTKTPKRDYYGYVPTLNSINTKLKNPILKLHL

SEQ ID NO: 8753 - DNA, 825 bp, Unknown
  Obtained from environmental sample
  misc_feature (1)..(825): n is a, c, g, or t
gtgatcagatcggctcgaggcagtgtcgatatttttgatattaacacacataaactggtacaacaaataaaagtagaaaaaataaaagattttatgggtgatgtgatagactcgaaagtttactctgtagataaaatcaacgataagattttagtgctttcacaagcaaaaaaaggtgctagaagaatccatttataccaaaataacaagcttgttcttattataccttacactcaaaaactttttattgccaaagctaaatttttagacaacaacaccatcataatgggacttttaagtaacgaaataatatcttacgatattgaaaaaacaactcaaaactatagagtacaagtatctcaatccaaattttcaaacttttcattaaatgaaaaaaaagatgaaataatcgtagcagatgaaagtggtgacttaagtatactaagcacaaaagacggatcacttaaaaaaatgttatctggtcaaaatctagataatgtttttcaagtagatattaaaaatggtattattgctacagctggtcaagatagaagaatggttatttatgatacaaaattaaactcaacttattataaaacagcaagttttcttatatatagtgtgggtctttctccaagcggtaaaagagtaggatatgcaagtgatgagaacaacaatgttacggttttcaatactgctagtaaaaaagttcttggaaaatttggtggtaataaaatgacactttacagtattctatttttagacgagaatacatttttaagttctagtgaggataaaacgattaatttctacacaataaaatag

SEQ ID NO: 8754 - protein, 274 aa, Unknown
  Obtained from environmental sample
  misc_feature (1)..(274): Xaa is any amino acid
MIRSARGSVDIFDINTHKLVQQIKVEKIKDFMGDVIDSKVYSVDKINDKILVLSQAKKGARRIHLYQNNKLVLIIPYTQKLFIAKAKFLDNNTIIMGLLSNEIISYDIEKTTQNYRVQVSQSKFSNFSLNEKKDEIIVADESGDLSILSTKDGSLKKMLSGQNLDNVFQVDIKNGIIATAGQDRRMVIYDTKLNSTYYKTASFLIYSVGLSPSGKRVGYASDENNNVTVFNTASKKVLGKFGGNKMTLYSILFLDENTFLSSSEDKTINFYTIK

SEQ ID NO: 8755 - DNA, 369 bp, Unknown
  Obtained from environmental sample
  misc_feature (1)..(369): n is a, c, g, or t
ttggttactggtgtaagagccaacagaaaagattcttttgtaaaaaatatgtcttcaaccattgcaaacggaattagacgttcgtttacccacgatggaatggatgatactggttgccctttaaaagtgataaaaactgattatgctaaaaacataccaatgtttaaaggattgcatcggtttttacctgctatgattttgttgcaaaatggaaaaattaaacaaattcctgtacaacactttccaagaattgcaggagaagcaaaatacggtttatggaaccgattgattggaccgctcatcgattgttttgcttatttatggatgaaaaagaaatacattaattacaaaattgaaaataaaggttaa

SEQ ID NO: 8756 - protein, 122 aa, Unknown
  Obtained from environmental sample
  misc_feature (1)..(122): Xaa is any amino acid
MVTGVRANRKDSFVKNMSSTIANGIRRSFTHDGMDDTGCPLKVIKTDYAKNIPMFKGLHRFLPAMILLQNGKIKQIPVQHFPRIAGEAKYGLWNRLIGPLIDCFAYLWMKKKYINYKIENKG

SEQ ID NO: 8757 - DNA, 675 bp, Unknown
  Obtained from environmental sample
  misc_feature (1)..(675): n is a, c, g, or t
atggagttttctgcgggtatgatagaattaaatatgatgaaaacttcaaataatgttgatgttgctctaacgtataaaaagtattatatcgatagagactatgaacagatagatttgtttcaactgattaaacaaacttataaggtcaaaaaagctatttatcctgggagttatatacatatttccccatcattcatctatccagaagtcgtttatatcgactctgataaaaatgctaaaaaatttttcaatagtgaagagcttatcccgtttattaataatagaaaagaatattctgaagattccaagattaagtattttggtattgattataagaaacaaatagatgagctaataaatggatatgaccttttaatatctcagtatgcaggatttatctctgatacatgtaaggagtatttgaaaattggtggaatattactagtgaataacagccatggagatgcgggtttagcgtcaattgatgaagattataaatttatttcagttgtccacaagtctggtggaaaatatcgattgtcacaaacttctttggaaaaatattttattccaaagcgagagatgatcgtcaccagagaaatgttattcaaatccggaaaaggtgttggctatactaaaaccgcacctttatatatttttcaacgtatttgttga

SEQ ID NO: 8758 - protein, 224 aa, Unknown
  Obtained from environmental sample
  misc_feature (1)..(224): Xaa is any amino acid
MEFSAGMIELNMMKTSNNVDVALTYKKYYIDRDYEQIDLFQLIKQTYKVKKAIYPGSYIHISPSFIYPEVVYIDSDKNAKKFFNSEELIPFINNRKEYSEDSKIKYFGIDYKKQIDELINGYDLLISQYAGFISDTCKEYLKIGGILLVNNSHGDAGLASIDEDYKFISVVHKSGGKYRLSQTSLEKYFIPKREMIVTREMLFKSGKGVGYTKTAPLYIFQRIC

SEQ ID NO: 8759 - DNA, 795 bp, Unknown
  Obtained from environmental sample
  misc_feature (1)..(795): n is a, c, g, or t
ttgcttaagagcaaggaaaaacatagattgttctttgagaatgctccaattggaattattcactatgataatgaaggtataattactgatgttaatgatgcgacgattactatttttggatcatcttatgaaaaacttgttggactggagtttgatgatctccctgataaaaaattttctaaagaagtttacaaatctttggctggcaagcctggatattttgaaggtgaatacatatcttataccggtaaaaaagctgtatacatcaaggctgactggattccaataaaaaaaagagacgaaattattgcaggggtcggaattattgaagacatcacccacagcaagcaggcagaagaatctttgataaaaagtgaggaacaatatcgtttaattacagaaaatgttgctgatataatatggacaacggatatgaattttaattttacttatatcagcccttcaatttaccagctgcgagggtacaccgttgaagaagggatgaagcagacaatcgaagaagttgttctgccagcatcacttgacaaactgatgaatttatttattaaaacattaaaacttattgaggccggtgataaaaaaggctttaaccctgttgaatttgaaatgcaacaattttgtaaagacggctctgttatatggaccagcaatcatgcaaggattttatcggattcacagaaacaaccggtaagcatacttggaataacacatgacattaccgatcacaaaaaggcagaagaagaaactttcaaatattatggagagtatgactga

SEQ ID NO: 8760 - protein, 264 aa, Unknown
  Obtained from environmental sample
  DOMAIN (207)...(249): PAC motif
  misc_feature (1)..(264): Xaa is any amino acid
MLKSKEKHRLFFENAPIGIIHYDNEGIITDVNDATITIFGSSYEKLVGLEFDDLPDKKFSKEVYKSLAGKPGYFEGEYISYTGKKAVYIKADWIPIKKRDEIIAGVGIIEDITHSKQAEESLIKSEEQYRLITENVADIIWTTDMNFNFTYISPSIYQLRGYTVEEGMKQTIEEVVLPASLDKLMNLFIKTLKLIEAGDKKGFNPVEFEMQQFCKDGSVIWTSNHARILSDSQKQPVSILGITHDITDHKKAEEETFKYYGEYD

SEQ ID NO: 8761 - DNA, 537 bp, Unknown
  Obtained from environmental sample
  misc_feature (1)..(537): n is a, c, g, or t
atggcaaatgtaaaaaaatatatggaacagcataagggcaatattgtaattaattcaaaaattggggagggtacaaaaatacaatcagtccttcctgttataaaaaaagagttaactgaaaaagagataatagaaatcaagaaggaaactttttattttgaaaagtatatcctcgttgttgaagatgaacaggctatttcaggcgtgcaatacaaaatattgacccatgaaccctgcaatcacaaagttgatatcgccgctactggtcagatggccattgacctgtttaacagaaataaatatgactttgtaagtttggattatattcttccgagggagttgaacggaatggatgtgtataagcatatcagacagacaaatgatactattccaatactctttgtgtctggcaatttagattttttagaatccattaaagagttaaagcataaagatccctgtgttgatcatgtttcaaaaccctgccagaataaagattatgtgaatgccattaatgatttactggaaaaaacataa

SEQ ID NO: 8762 - protein, 178 aa, Unknown
  Obtained from environmental sample
  DOMAIN (55)...(178): Response regulator receiver domain
  misc_feature (1)..(178): Xaa is any amino acid
MANVKKYMEQHKGNIVINSKIGEGTKIQSVLPVIKKELTEKEIIEIKKETFYFEKYILVVEDEQAISGVQYKILTHEPCNHKVDIAATGQMAIDLFNRNKYDFVSLDYILPRELNGMDVYKHIRQTNDTIPILFVSGNLDFLESIKELKHKDPCVDHVSKPCQNKDYVNAINDLLEKT

SEQ ID NO: 8763 - DNA, 882 bp, Unknown
  Obtained from environmental sample
  misc_feature (1)..(882): n is a, c, g, or t
atgtataaaccaccatatagtataacaagtaagatggtaaaccttatttcacaaataagtgaagagcttactaaaatagaatatagtaagatggatataaatactccactattaagaaaaaagaatcgtgttaaaactttggcaggaactcttgaaatagagggtaactttatgggtgaagagaaaattacagctattttagaaggaaaaaaagtattgggtacttatcaagagatacttgaagttgaaggtgccatcaatgcttacaaaaaatttgaaaactatagatatgatagtttagatgatttactaaaagcacataaaattttaatgaaagggattttaacaactgccggaagttttaggggtgtaaatgtaggagttggtagtaaagatggtgttagtcatgttgcaccgccttttagtatagttccaaatcttatgagtgagttgtttgattggttaaaaaatagtgaggaacatatgcttatcaaatcttgtgtatttcactatgaatttgaatttatccatccttttagtgatggaaatggcagaataggaagactttggcaaagtgtgatgctttataattggagagatgtttttgtagtgatgccaacagagagtatagtaagagataatcaagaaaactactataaggcgttagaagattctggaagcataggtgaatctacaccatttatagagtttatgctagaagttatattaaatactgtaantaaagtcggcaataaagtcggtaataaagtcggtaatatattaacggaaaatcaatttaaaatgatagaaaatattgaaaataatcctaaaatatcagcagctaaattatcggatatagtgggtatttcaaaaggaaaatag

SEQ ID NO: 8764 - protein, 293 aa, Unknown
  Obtained from environmental sample
  DOMAIN (103)...(228): Fic protein family
  misc_feature (1)..(293): Xaa is any amino acid
MYKPPYSITSKMVNLISQISEELTKIEYSKMDINTPLLRKKNRVKTLAGTLEIEGNFMGEEKITAILEGKKVLGTYQEILEVEGAINAYKKFENYRYDSLDDLLKAHKILMKGILTTAGSFRGVNVGVGSKDGVSHVAPPFSIVPNLMSELFDWLKNSEEHMLIKSCVFHYEFEFIHPFSDGNGRIGRLWQSVMLYNWRDVFVVMPTESIVRDNQENYYKALEDSGSIGESTPFIEFMLEVILNTVXKVGNKVGNKVGNILTENQFKMIENIENNPKISAAKLSDIVGISKGK

SEQ ID NO: 8765 - DNA, 723 bp, Unknown
  Obtained from environmental sample
  misc_feature (1)..(723): n is a, c, g, or t
atggatgaccctataatacgaggagtagcacattcaagaagtattatgcatgtatcaatactctcttctaaggtttcaagagataaactaaaagtcttatcaaaaaaattcaaaagtaggcttctatctattaatgatgtgtctgatgttactatttttggagattctgaacttttttacgaagtcttaatagatgagaaaaaagtaaatgcatacaatatctctctaaatgaagctatacgtgttttttcagaagtatcttatatttttcctctaggaaagatagaaaatcttaaaaaacaatactatatttctactcaaaatgataaaaaattctcgcatgaacttgaagagactatcttaaacataaatgatcaacaaattgcactaaaagacatagccaaaattactaaaaaatatgaagactctgcaacacttgcaagtatgaatggaaacaattctataacactcgcaatatcgcaaaatccaaaaggcgatgcagttaaaatagcagaagacattaaagaacttatatctaagatgaaggttgaaggtgttactttcagcgttagaatggataaatcaactgtaattaaagacagattaaatattgttatttccaatatactactaggcataatacttataacagttctaactgcaattttaattaatattcgtatagcatttatcatagctttgggtattccacatctttcataa

SEQ ID NO: 8766 - protein, 240 aa, Unknown
  Obtained from environmental sample
  misc_feature (1)..(240): Xaa is any amino acid
MDDPIIRGVAHSRSIMHVSILSSKVSRDKLKVLSKKFKSRLLSINDVSDVTIFGDSELFYEVLIDEKKVNAYNISLNEAIRVFSEVSYIFPLGKIENLKKQYYISTQNDKKFSHELEETILNINDQQIALKDIAKITKKYEDSATLASMNGNNSITLAISQNPKGDAVKIAEDIKELISKMKVEGVTFSVRMDKSTVIKDRLNIVISNILLGIILITVLTAILINIRIAFIIALGIPHLS

SEQ ID NO: 8767 - DNA, 501 bp, Unknown
  Obtained from environmental sample
  misc_feature (1)..(501): n is a, c, g, or t
atgagtgatttagtaaaacttaaaggtataacacaaaacttaacagtattgtatgtggaagatagtgctattctattaaaaagaatgagtacttttttaagtcatctttttaaagaagtatatcaagctcagaatggaaaagagggtttagaaagttataagcaaaataaacctgatattgttattacagatttaaatatgccagttatgagtggtcatgagatgataaaaaacctaaaacagatagaccaaaatatcaatataatagtagtttcagcgtactcagatacagaaaatttactagaatcaattcatttgggtgttgtggattttgtaccaaagcctgtggatagtaacctttttcaagaggtattgttaaaagttgcaacaaaagcagctcaagaaccaactaatactatttctacaaataaagtggatacagatccaaatgacgagatgtttaaaaaattgaatatgtatacaaaagtcataatcagatga

SEQ ID NO: 8768 - protein, 166 aa, Unknown
  Obtained from environmental sample
  DOMAIN (14)...(133): Response regulator receiver domain
  misc_feature (1)..(166): Xaa is any amino acid
MSDLVKLKGITQNLTVLYVEDSAILLKRMSTFLSHLFKEVYQAQNGKEGLESYKQNKPDIVITDLNMPVMSGHEMIKNLKQIDQNINIIVVSAYSDTENLLESIHLGVVDFVPKPVDSNLFQEVLLKVATKAAQEPTNTISTNKVDTDPNDEMFKKLNMYTKVIIR

SEQ ID NO: 8769 - DNA, 930 bp, Unknown
  Obtained from environmental sample
  misc_feature (1)..(930): n is a, c, g, or t
ttggctgagatgaaagatcactttggtgataatattatgcaattaagacctatggtacaagagattatgaaaaataaaactactctaataggctatgaaacaggacttcatgctacagcatttagaatacttatgcctttatataatgggaaagagtttttaggttccataggtattggtataaatccaaattattttattaatcagatatcagagttattaagtgaacaaggtatgttgtttttagaagatcaacatttaaagcttttttctacaaatattgattttaaaataggaaattatagattacaaacaaaaataagtgaaaaaacaaaagagttgcttaatgctttacctaaaggttattcattcgaagactctatacaaatcactttaaatgatagaatatattttatccattatgaaaatttaaaagactatgataatcgtacattaggaaaatatcttttctttgaagatattactgataggataaatagtcacaatactattagatggcagcttattgcaatagttgttttgtttattattattgtttttattttggtgagtggttctattatgaaattttcaagccaactcaataggttttatcaggatattataaatactactaaagagaatgaatcttatttaaaagcagtagaaaatggttcagaaaatctcatttttacaatatttaaaggggagatttttacagcaaatagaggtttcttagaatttatggagtataaaagtttagattcttttaaacaacaatataaatcaattggtgaactttttgttaaaagaactggctatttagatagaataatagatggtaaagattggtttaaatatgtggtggaaaaacctaatcaaatgcataaagttatttttcaaaaagattctcaagagtatgttttttag

SEQ ID NO: 8770 - protein, 309 aa, Unknown
  Obtained from environmental sample
  misc_feature (1)..(309): Xaa is any amino acid
MAEMKDHFGDNIMQLRPMVQEIMKNKTTLIGYETGLHATAFRILMPLYNGKEFLGSIGIGINPNYFINQISELLSEQGMLFLEDQHLKLFSTNIDFKIGNYRLQTKISEKTKELLNALPKGYSFEDSIQITLNDRIYFIHYENLKDYDNRTLGKYLFFEDITDRINSHNTIRWQLIAIVVLFIIIVFILVSGSIMKFSSQLNRFYQDIINTTKENESYLKAVENGSENLIFTIFKGEIFTANRGFLEFMEYKSLDSFKQQYKSIGELFVKRTGYLDRIIDGKDWFKYVVEKPNQMHKVIFQKDSQEYVF

SEQ ID NO: 8771 - DNA, 498 bp, Unknown
  Obtained from environmental sample
  misc_feature (1)..(498): n is a, c, g, or t
ttgatcnggcttatggcttgcgagtttttaaatgaatacatcaaaagctcgacaaaagagaaagtaaacttaagagaaatgatagaatcagttcttagacttatggatacagattttaataaaaataaaatcaaaatcatagacaactataagcaagatatagttctaatgacctatcaaaatcaactacgaaatcttttgatgatactggttgaaaatactataaaaacctttagaaatagagatataaaaaatccacaacttaaagtaagtactaccaaaaacggtaaaagtgtaaccataatagttgaagataatgcagggggaataatagaaaaacctatagataaaatctttgagagataccactctgcaagtgattctagcggtataggactttatttagcaaagtatgttttgatggaaaatttagatggagagataagtgttgaaaataatgatggtggggctaagtttattatgatactaaagtgttaa

SEQ ID NO: 8772 - protein, 165 aa, Unknown
  Obtained from environmental sample
  DOMAIN (58)...(165): Histidine kinase-, DNA gyrase B-, and HSP90-like ATPase
  misc_feature (1)..(165): Xaa is any amino acid
MIXLMACEFLNEYIKSSTKEKVNLREMIESVLRLMDTDFNKNKIKIIDNYKQDIVLMTYQNQLRNLLMILVENTIKTFRNRDIKNPQLKVSTTKNGKSVTIIVEDNAGGIIEKPIDKIFERYHSASDSSGIGLYLAKYVLMENLDGEISVENNDGGAKFIMILKC

SEQ ID NO: 8773 - DNA, 474 bp, Unknown
  Obtained from environmental sample
  misc_feature (1)..(474): n is a, c, g, or t
atgattgtaggtggtgcattcttgggtggaatagttggcggggtaattcttggtggcttgggagcgttaatggataaaaatggccatagagcggaggtatatagcgaaaacaacttggatgagatgaaaaagtatcttgaattcagatatgactccacccagaaagttactgatcttactatccccctcacgcatccggatgattatgctcaacatcaactctatgtgcatccttctcacaatccaaaatatctcgagtttaaggtgaaaggcaaagaatctgtttatggtgaattgcgacaggttaagaagaagaaaatctatgttctttccgatgaaaaaatttatgtaattcccaaaaagaagctcattggaattaaaaataatctgggtgaagatatctctctggaaaggatttcagataaggatttcaaatttttaaatttcaataaatatgaaacaattgtgttataa

SEQ ID NO: 8774 - protein, 157 aa, Unknown
  Obtained from environmental sample
  misc_feature (1)..(157): Xaa is any amino acid
MIVGGAFLGGIVGGVILGGLGALMDKNGHRAEVYSENNLDEMKKYLEFRYDSTQKVTDLTIPLTHPDDYAQHQLYVHPSHNPKYLEFKVKGKESVYGELRQVKKKKIYVLSDEKIYVIPKKKLIGIKNNLGEDISLERISDKDFKFLNFNKYETIVL

SEQ ID NO: 8775 - DNA, 405 bp, Unknown
  Obtained from environmental sample
  misc_feature (1)..(405): n is a, c, g, or t
atgcaaaaccagagagttgatgaaattgtcttacagattaaaaatctagaagatgaactgatagagacgctaaaagagaaagagagtgagtttttctataaaatagaaaatgagaagattaaatttgaaaaaagagtcatagctgagggtcgatcaaaaattatcagctcaattaaatatttgtcatctttttctgttttagcaatcttaacaatcccttttatttgggccatgattataccgattatgtttgctgatattttagtaaccatctaccaaagcatctgttttcccatctacaaaataccaaaagtcaaacgaagtgaatatgttattttggatagatataacctattttatctagatcaagttgagaagacaaactgcctatatgtgaatatttaa

SEQ ID NO: 8776 - protein, 134 aa, Unknown
  Obtained from environmental sample
  misc_feature (1)..(134): Xaa is any amino acid
MQNQRVDEIVLQIKNLEDELIETLKEKESEFFYKIENEKIKFEKRVIAEGRSKIISSIKYLSSFSVLAILTIPFIWAMIIPIMFADILVTIYQSICFPIYKIPKVKRSEYVILDRYNLFYLDQVEKTNCLYVNI

SEQ ID NO: 8777 - DNA, 828 bp, Unknown
  Obtained from environmental sample
  misc_feature (1)..(828): n is a, c, g, or t
atgggagcattggagtatgaacccattaatcataaagagaataataaatataatgttaatgttactgaattattagaagttgcaaaaaaagttttagagggtaaggaagatatctcttataatgatttagataaagatagtttgtctgatgtattgagaataggaacttctgttggtggagcacgagcaaaagctttgattgctattaaaaccgattccaataataaaattatagaaattagacctggagatatcattcaatcagaaggtttttcatattggattcttaaaattgatggagcaaatgaaaaaacattaggagaaggtgtaggtcttggaaaaatagaatatgcctattataagttggcaaaagaggcaggtctcgatatttctgatagtgatttgtacgaagaaaatggtaggtttcattttttgacaaaacgctttgatagaacaaataagggcgagaaaattcatatgcaaaccttaggggctttggcaggcattgattttagaattcaaaaggcaagtagttatgaaacattatttagggttatgaaaacgcttcaactaacttataaccaatttgagcaacaatataggcgagtgttatttaatgttatagcaagaaatcatgatgaccatgtaaaaaacttctcctttttaatgaataaagaaggaaaatggcaaatatctccagcctatgatatcacttatcagtataaagagggtggaaattggacaaatgttcaccaatcatccattaacggtaaatttgacaatttcacaagagatgatttgctaagtttaggtaaaacattggcataa

SEQ ID NO: 8778 - protein, 275 aa, Unknown
  Obtained from environmental sample
  misc_feature (1)..(275): Xaa is any amino acid
MGALEYEPINHKENNKYNVNVTELLEVAKKVLEGKEDISYNDLDKDSLSDVLRIGTSVGGARAKALIAIKTDSNNKIIEIRPGDIIQSEGFSYWILKIDGANEKTLGEGVGLGKIEYAYYKLAKEAGLDISDSDLYEENGRFHFLTKRFDRTNKGEKIHMQTLGALAGIDFRIQKASSYETLFRVMKTLQLTYNQFEQQYRRVLFNVIARNHDDHVKNFSFLMNKEGKWQISPAYDITYQYKEGGNWTNVHQSSINGKFDNFTRDDLLSLGKTLA

SEQ ID NO: 8779 - DNA, 594 bp, Unknown
  Obtained from environmental sample
  misc_feature (1)..(594): n is a, c, g, or t
gtgaatccaaaaaataaaataaaaccagcttcatattcggtatttctcatttttaccattgttggtttgtttttcaccttccattgtaataatttacagaatatatttgcatataatttgataacacaaaaaagacaaataatgaaagtagcagttacaacggcaagtggaaatttaggtggagaaataattaaggttttggttaatgaaattggtgcagataatgtaattggaattgcccgaactcctggaaaggcagaacatttaggtgttgaaataaaaagaggagattacaacaataaggaagattttaacaaagctctaaaaggggtagatgtggttttgttggtttcaggaatggatcacccagataatcgaattgggcaacaccgaaatgtaattaatgcagcaaaagtttgtggagttaaaaagatagtctatacaagcataattgggaaagatggctcatctacttttgatgcaattgttaaaagtaatcgccaaaccgaaaaagatattcaggatagtggactcgaatggtccattggcagaaatgggctgtatatagaacccgatgtggaatacatagattaa

SEQ ID NO: 8780 - protein, 197 aa, Unknown
  Obtained from environmental sample
  misc_feature (1)..(197): Xaa is any amino acid
MNPKNKIKPASYSVFLIFTIVGLFFTFHCNNLQNIFAYNLITQKRQIMKVAVTTASGNLGGEIIKVLVNEIGADNVIGIARTPGKAEHLGVEIKRGDYNNKEDFNKALKGVDVVLLVSGMDHPDNRIGQHRNVINAAKVCGVKKIVYTSIIGKDGSSTFDAIVKSNRQTEKDIQDSGLEWSIGRNGLYIEPDVEYID

SEQ ID NO: 8781 - DNA, 747 bp, Unknown
  Obtained from environmental sample
  misc_feature (1)..(747): n is a, c, g, or t
ttgacagttttgattagtggagctagcagcggcatcggtgctgctcttgcttcacactatgctttaaaaaactacaatcttattcttttagcaagaagtgaagataaacttcaaaatttaaaagaacaactacaaacatcaagcaacttcgttgatatatatataatagatctgacagattttgatgcactccatgagttagcaaaaaagatagatatcaaatacaataaaatagatattataattttaaatgcaggtatatcgataggacactctgctgagattactccatttaaagagtttaaaaaactctatgatacaaatgttctgagtgttcatgcacttctagaaccgcttattcattccatgaagaagcatcatggatcaaaagtagtctttatctcttcattagcctctattatctctatgcctagctctgttgcatactccagctctaaacgttcactaaatgcatatgctgagggtttaagatatcagttaaaaaaatatggtataaaagttataacaattctcccaggatttatagatactccactaactcaaaaaaatcaattcaaaatgccattttttatgagtttagataatggggtgaaagagatagtaggtgctatagagagaggaaaaagagtttatgcttttccaaaaagattctattttcttattaagctaacaactcttttacctcaatttatgagagataaaatagtttcaaaagtttataaatag

SEQ ID NO: 8782 - protein, 248 aa, Unknown
  Obtained from environmental sample
  DOMAIN (3)...(237): short chain dehydrogenase
  misc_feature (1)..(248): Xaa is any amino acid
MTVLISGASSGIGAALASHYALKNYNLILLARSEDKLQNLKEQLQTSSNFVDIYIIDLTDFDALHELAKKIDIKYNKIDIIILNAGISIGHSAEITPFKEFKKLYDTNVLSVHALLEPLIHSMKKHHGSKVVFISSLASIISMPSSVAYSSSKRSLNAYAEGLRYQLKKYGIKVITILPGFIDTPLTQKNQFKMPFFMSLDNGVKEIVGAIERGKRVYAFPKRFYFLIKLTTLLPQFMRDKIVSKVYK

SEQ ID NO: 8783 - DNA, 468 bp, Unknown
  Obtained from environmental sample
  misc_feature (1)..(468): n is a, c, g, or t
atgattattactttagaaaaaaaagcaattatatttacacttaaagatgattctattaatttaaaacctctgttgcattttgtaaataataactttaaaagagtgagacactttactcactctactgttattttaaatgaaaatgacgaagagatattaaaaaaatatcttataaaatgggcatataaaatttatcaaaaatgctatccatatagtgatagtgaacttttttcaaatttaattcaattatatgaactcccaattcatataataatttccagtaaaaaatctattactcagatggcagttataacaatagaccagattgattcacatgagatctcagtagcttgtaatcaaaaccatgagaggataattcaatattttaaattaatctataaagatgctatggtacgcaccatgaaaaaagaattttcagaattacaattaaaacgaaaagtcacctga

SEQ ID NO: 8784 - protein, 155 aa, Unknown
  Obtained from environmental sample
  misc_feature (1)..(155): Xaa is any amino acid
MIITLEKKAIIFTLKDDSINLKPLLHFVNNNFKRVRHFTHSTVILNENDEEILKKYLIKWAYKIYQKCYPYSDSELFSNLIQLYELPIHIIISSKKSITQMAVITIDQIDSHEISVACNQNHERIIQYFKLIYKDAMVRTMKKEFSELQLKRKVT

SEQ ID NO: 8785 - DNA, 813 bp, Unknown
  Obtained from environmental sample
  misc_feature (1)..(813): n is a, c, g, or t
atgaattttttaggagaaaaagcattagctaacaaaattgttaaattaaaaaaaggcgattgcccatatacattatttcttggagctggcgcatcttattcatctggcattcctctttcaagtaatttagtttttcaatggcaggagaaactctttgttgatttacaaaaaatagacaaaaaatacaaaacaattgattttagtaattggactaacagaaatacagaaagtgaggttgttgaatactcgaattataacaaatggaaagatggaaataacttcagaggagaggtgtctgattactctttgttatttagcactttataccaaactccaaaagaacgtcaattatttatagaagaattaattgacaataaaaaacctgcatttggttatttatttcttgctggtctcatttcagaacaacgctttaatcgcattctaactacaaattttgacgatctgttaagtgatgccttattcaagtattatgatattaagccaatttcctgtgcttttgactcaatggtatcggggataagaatagatagccaacgtccaanaatcataaagttacacggtgattttttatacgacaaccttaagaatataagaagtgagctcaggagtcttgattctaatatggaagaaaaaatgtcagagatgtgtaaggatagagggcttattgttggtgggtactctggtatggataaatctataaaaacccctttaatgagatgctccgcaaaacaggttatctggaaatgggaataccctgggtgttttaataaaagagaggtacggattataaaa

SEQ ID NO: 8786 - protein, 271 aa, Unknown
  Obtained from environmental sample
  misc_feature (1)..(271): Xaa is any amino acid
MNFLGEKALANKIVKLKKGDCPYTLFLGAGASYSSGIPLSSNLVFQWQEKLFVDLQKIDKKYKTIDFSNWTNRNTESEVVEYSNYNKWKDGNNFRGEVSDYSLLFSTLYQTPKERQLFIEELIDNKKPAFGYLFLAGLISEQRFNRILTTNFDDLLSDALFKYYDIKPISCAFDSMVSGIRIDSQRPXIIKLHGDFLYDNLKNIRSELRSLDSNMEEKMSEMCKDRGLIVGGYSGMDKSIKTPLMRCSAKQVIWKWEYPGCFNKREVRIIK

SEQ ID NO: 8787 - DNA, 834 bp, Unknown
  Obtained from environmental sample
  misc_feature (1)..(834): n is a, c, g, or t
atgcacaacttcagtgattttgaaataattgaaggcggttcaactcgtcaagagtcactaaagaatgcacttaaagaagtaaaaagcgactatgtcttagtaagtgacatcgctagagcttgtataagtgatgatttattagaaaaaatagttgattctcactcaaatgctgactcgattgttccctatctaaacgtcagtgacacaataacatacaataataaaacaatagagagagaacatgtaaaacgtattcaaactcctcaactttcacgtactgaaattctaaaaaaagcgcttgattgcgatcaagagtttaccgatgagagtagtgctatagttgcaattggtgggagtagagagtttgtggatggaagtgatgatgcccacaaaataacttttgtctcagatcttaacaaaataccatgtttacgtgcgccttcatctgatagcttgaacggtaacggttttgatgtacatgaatttgaagataacaagaagatgtacttaggtggagtagagatagattctccttttggttttaaagctcatagtgatggcgatgtagctattcatgcccttattgatgctcttttaggagctgctggcttgggcgatataggaatgttatttcctgactctgataatcaatataaaaatattgactctaaaaaactgctcgaaataacagtagataaattgactcaattcggatatataatcataaacagtgacataacaataattgcacaaacaccaagactgttaaactataaagacaaaatgaaaaatacgttaagtaaaataatgaaaattcccaaaatcaagggttaa

SEQ ID NO: 8788 - protein, 277 aa, Unknown
  Obtained from environmental sample
  DOMAIN (1)...(140): Uncharacterized protein family UPF0007
  misc_feature (1)..(277): Xaa is any amino acid
MHNFSDFEIIEGGSTRQESLKNALKEVKSDYVLVSDIARACISDDLLEKIVDSHSNADSIVPYLNVSDTITYNNKTIEREHVKRIQTPQLSRTEILKKALDCDQEFTDESSAIVAIGGSREFVDGSDDAHKITFVSDLNKIPCLRAPSSDSLNGNGFDVHEFEDNKKMYLGGVEIDSPFGFKAHSDGDVAIHALIDALLGAAGLGDIGMLFPDSDNQYKNIDSKKLLEITVDKLTQFGYIIINSDITIIAQTPRLLNYKDKMKNTLSKIMKIPKIKG

SEQ ID NO: 8789 - DNA, 327 bp, Unknown
  Obtained from environmental sample
  misc_feature (1)..(327): n is a, c, g, or t
gtgataagaaaattacttcttaaacttctttggctttatcagcgcttttttacccttattgggtttggaagctgtcgctactacccctcatgctcagagtatgcaaaacaacattttgagcaaaattccctacacaaagctttttataattcactgttgagagtactacgatgtaaccatttttttataggtggtattgaatatccagaaatctcaaattttcaacaaaagccaagcaatttaatgttaaattccgtaaaatactggttcgttccaaaagatgaaaaatatttttatattatcaaaaatttcaagtttaaaggttag

SEQ ID NO: 8790 - protein, 108 aa, Unknown
  Obtained from environmental sample
  DOMAIN (2)...(69): Domain of unknown function DUF37
  misc_feature (1)..(108): Xaa is any amino acid
MIRKLLLKLLWLYQRFFTLIGFGSCRYYPSCSEYAKQHFEQNSLHKAFYNSLLRVLRCNHFFIGGIEYPEISNFQQKPSNLMLNSVKYWFVPKDEKYFYIIKNFKFKG

SEQ ID NO: 8791 - DNA, 327 bp, Unknown
  Obtained from environmental sample
  misc_feature (1)..(327): n is a, c, g, or t
gtggtgatgaatgaggtaacaaaagaggataaatctgatgtaacatcagaacaattacacttacaagtattagaagtatttaagcgtcaaaaacttcgtggacaaaaagaacttaatggaaaacttaatgatgaggatataaaaaaatattgtactacttcaatagaagcacaaaatattttaaacctctctattgaaaagttttctctatcttttcgttctataaataaagtattaaaagtatcaagaacaatcgctgatttagataatagtcatacaatagaaaaacagcatattatagaagctttgagttatagaaagagatag

SEQ ID NO: 8792 - protein, 108 aa, Unknown
  Obtained from environmental sample
  misc_feature (1)..(108): Xaa is any amino acid
MVMNEVTKEDKSDVTSEQLHLQVLEVFKRQKLRGQKELNGKLNDEDIKKYCTTSIEAQNILNLSIEKFSLSFRSINKVLKVSRTIADLDNSHTIEKQHIIEALSYRKR

SEQ ID NO: 8793 - DNA, 795 bp, Unknown
  Obtained from environmental sample
  misc_feature (1)..(795): n is a, c, g, or t
gtgaaaaataaatgtttattaattattttactaagggtaattagtacttttttattggctgcagatacaaactttgcaacaaataaagaagcaactataaaatatagtcagggactatacagttataatcaaaaagattatgaaaactcatttaatatatttagtgaactagttgataaatatccaagtcatgaacttataaattattattatggaagaagtgcttttgagttaaaaaagtatgactttgcactagcagcttatgatagaatacttatctcaaagccagataatcacagagtacgactagaatatgcaagaacactttttttaatgcaatcatataaagaagcaaaaaaagagtttgaagctgttttagcttcacctattccacaaagtgttcgattaaatgttgaaaagtttttacaaatgattaaacaaaaagagaaaaactatattcttaatagagttgtaattgttggtttaggatgggataataatgttaataacaatacttatgaatcctatacagatatattgggtggattgagactcaataataatacagataaaagatctgatactgactttaaagcaattctagttggaaatttaatagttccaagcaagtcaaatgataaactttcatgggaaagtactggtgttatatataccaaagagcaaaaccactatcatgacaatgatatatttttaatttcactcgaaagtggaatcggatatacaaaccaaaaatataaaaatcttacctcttttacttatgaccatgttggttag

SEQ ID NO: 8794 - protein, 264 aa, Unknown
  Obtained from environmental sample
  SIGNAL (1)...(19)
  misc_feature (1)..(264): Xaa is any amino acid
MKNKCLLIILLRVISTFLLAADTNFATNKEATIKYSQGLYSYNQKDYENSFNIFSELVDKYPSHELINYYYGRSAFELKKYDFALAAYDRILISKPDNHRVRLEYARTLFLMQSYKEAKKEFEAVLASPIPQSVRLNVEKFLQMIKQKEKNYILNRVVIVGLGWDNNVNNNTYESYTDILGGLRLNNNTDKRSDTDFKAILVGNLIVPSKSNDKLSWESTGVIYTKEQNHYHDNDIFLISLESGIGYTNQKYKNLTSFTYDHVG

SEQ ID NO: 8795 - DNA, 474 bp, Unknown
  Obtained from environmental sample
  misc_feature (1)..(474): n is a, c, g, or t
atgttcacatcacaaagccaatcatttgaagatatgaggataaaacttctaaatctttacaaagattcaaaaatacttttaaaacatgaaaataaatctattctaaatattattcttgaaaatgaaaattttctaaccccaaataaaaaaatgcaatataaacaatatggtgattctgaatttatatctattggtcaatcaacagactatattaataaacttcttatagatcaatcaacaataaagttttctaataaagaggagaaagagtatttaacttataaatttgctataaaatctatagcaaaaacacctaaagatttttttagttttgtagaaaagctgaatcaacaaaaactttctataaccttagagtatccaatcgtatttagtaaaactaatgacggaattgagataaagtataatttatctgttcatcaaaaaaataaagagcaactacaacttagtaaataa

SEQ ID NO: 8796 - protein, 157 aa, Unknown
  Obtained from environmental sample
  misc_feature (1)..(157): Xaa is any amino acid
MFTSQSQSFEDMRIKLLNLYKDSKILLKHENKSILNIILENENFLTPNKKMQYKQYGDSEFISIGQSTDYINKLLIDQSTIKFSNKEEKEYLTYKFAIKSIAKTPKDFFSFVEKLNQQKLSITLEYPIVFSKTNDGIEIKYNLSVHQKNKEQLQLSK

SEQ ID NO: 8797 - DNA, 441 bp, Unknown
  Obtained from environmental sample
  misc_feature (1)..(441): n is a, c, g, or t
atgaaaaattcaaaggaaatttattttagacataactttagtgataaacttcttgaacaatatcaaagtgggatatctcatagttttgaatatttggaaaaagattttcactctttatttgataactttacaaaacaggtttttgagcagttgacaatctatgaatacaataaagatttaaatattgctatgagaattattgataaagatttaaaaataagaggtataatcatatcaaaagctacaagagatgaaatagtgcaaaaaaaagaagttgttatttcacacaaaattgcagtagctatagttgatgaaaaaatatatatagcaccatatcttaaaaacactatgacaaaagagtttaaagagagatgcagagtaaataaaattcctaataatataagaggatatctctctactttagataattttatttactaa

SEQ ID NO: 8798 - protein, 146 aa, Unknown
  Obtained from environmental sample
  misc_feature (1)..(146): Xaa is any amino acid
MKNSKEIYFRHNFSDKLLEQYQSGISHSFEYLEKDFHSLFDNFTKQVFEQLTIYEYNKDLNIAMRIIDKDLKIRGIIISKATRDEIVQKKEVVISHKIAVAIVDEKIYIAPYLKNTMTKEFKERCRVNKIPNNIRGYLSTLDNFIY

SEQ ID NO: 8799 - DNA, 810 bp, Unknown
  Obtained from environmental sample
  misc_feature (1)..(810): n is a, c, g, or t
atgtggaaaaagatgaaaacgcggaaagaactgacagatattgtatgtgaatcggtggaaactctggattcccttattaaaaatttgaaaaagactatgcagaaaaaaagtagtatacctttcgatgtaaaacagattattaatacactaaaacatctggaaaatagttttatggattccctttcacttgtttcacagttttatcctgttaatataaatgcaagagtggaagttgcgaaatgggacaatctaagtctgattggtaccgcaactgttgagatgtccaatactacagataaaataaatcgtgatatgcaggttgctcttaaattgataagggaaactacaaaaaaaattgaaacttctgttacttactattccaagggaaatgcagaggaaataatttcaattaatgatattaccagtagaataattgagtgttctaaaggactaaccggatccagtaaaattctatcaggtactctaaattccttttcggtatattcaaatacatttttttctcttctggatgattcagtacttgatattgaaagtttaaataaaataacaagtttaattagcaatattcgtaaaactcttgataattcaggaaaaactgtagaactccagaagaataagattctttctgaacttggtctggaaaaatgggaagtaaagaacagcaggctggaagaaattattaataaattcaccatatatacacataagcaaacagcagaagatatagcgggtattacggtagtaaagaaagtagaagccggtgaagctggtgagctaacacttttttag

SEQ ID NO: 8800 - protein, 269 aa, Unknown
  Obtained from environmental sample
  misc_feature (1)..(269): Xaa is any amino acid
MWKKMKTRKELTDIVCESVETLDSLIKNLKKTMQKKSSIPFDVKQIINTLKHLENSFMDSLSLVSQFYPVNINARVEVAKWDNLSLIGTATVEMSNTTDKINRDMQVALKLIRETTKKIETSVTYYSKGNAEEIISINDITSRIIECSKGLTGSSKILSGTLNSFSVYSNTFFSLLDDSVLDIESLNKITSLISNIRKTLDNSGKTVELQKNKILSELGLEKWEVKNSRLEEIINKFTIYTHKQTAEDIAGITVVKKVEAGEAGELTLF

SEQ ID NO: 8801 - DNA, 561 bp, Unknown
  Obtained from environmental sample
  misc_feature (1)..(561): n is a, c, g, or t
atgccgttgcctaaaaaacaaatttatgctttgtgtgactttgagttactacaaaagcataaaatatcttttcaagattatattcaaaaaatatctcaacataatatagtgtatatccaatatagagataaaattaattctaatgaaactcaaaaacacaatattatattacttaaatcacttataaatatccctattattatcaacgataaattagaacttttagagtttgcagatggattgcatttaggacaagaagattttgatactcttaaaaataaagtgttaaaaataaaaaatgatgagttagttttgaaacttttacgaaaaaaatatccaaataaaatttttggactttcaactcataatgaattagagatactagaagctaataagttagatttagattatattggattgggtgcatatcgagccacttctacaaaagatgtatctaatatgttaggagaaaatatctcttatctagcaaaaatatcgaaacatccagttggtgcaataggtggagttaaaattgaagataatataccaaatatctcctaa

SEQ ID NO: 8802 - protein, 186 aa, Unknown
  Obtained from environmental sample
  DOMAIN (5)...(186): Thiamine monophosphate synthase/TENI
  misc_feature (1)..(186): Xaa is any amino acid
MPLPKKQIYALCDFELLQKHKISFQDYIQKISQHNIVYIQYRDKINSNETQKHNIILLKSLINIPIIINDKLELLEFADGLHLGQEDFDTLKNKVLKIKNDELVLKLLRKKYPNKIFGLSTHNELEILEANKLDLDYIGLGAYRATSTKDVSNMLGENISYLAKISKHPVGAIGGVKIEDNIPNIS

SEQ ID NO: 8803 - DNA, 843 bp, Unknown
  Obtained from environmental sample
  misc_feature (1)..(843): n is a, c, g, or t
ttgtattttggcaatatgggttctgatacaaagccaaaacactacagctcatcaaatgaaattaaatgtaaaatcaattcctttcaaacatcaattctaaattatataaatgaaagtacattatgtgatttttttctaacccacaattttggaactagacagacaaaagggtttgggagcttttatcctgaaattattaataatgatgtagtaaaaataaatccaagctctttgacaagcaatagtcccttttggattaaagtagacactgttgacgatcagaaaatttttaaaacgattgattttttttggaaatggctcaaatctggaattaattataatagaggattatatgaacattctatattaaaattatttactgctgacaataaagaatttcggtgggaaaagaaaagaattaaagagcattttttaggcctagaatctgatacagacacaaagctattcgtaagagcattgcttggactagcagatagttttacttataaatgggttccaaaatctaaaagaaaagaaggtcaagtatatagtccaattgatttaacaataaatataaaacctaccgattcaaatattcaaagaaatcctgctccctttgtatttgcaccaataaaaaatcaaagtcatacgatgatttacatattacataatgaacatttttacactcaattacaaggggccgaatttaaattatcggttgacaaaatatctagcattaaattagaaacagaatttaaaagacctccaaaaaaagtatttgttaatacagaacatgatgacgctcttgaaattataaaaaaggcgcgaaatgcatttaagtaa

SEQ ID NO: 8804 - protein, 280 aa, Unknown
  Obtained from environmental sample
  misc_feature (1)..(280): Xaa is any amino acid
MYFGNMGSDTKPKHYSSSNEIKCKINSFQTSILNYINESTLCDFFLTHNFGTRQTKGFGSFYPEIINNDVVKINPSSLTSNSPFWIKVDTVDDQKIFKTIDFFWKWLKSGINYNRGLYEHSILKLFTADNKEFRWEKKRIKEHFLGLESDTDTKLFVRALLGLADSFTYKWVPKSKRKEGQVYSPIDLTINIKPTDSNIQRNPAPFVFAPIKNQSHTMIYILHNEHFYTQLQGAEFKLSVDKISSIKLETEFKRPPKKVFVNTEHDDALEIIKKARNAFK

SEQ ID NO: 8805 - DNA, 540 bp, Unknown
  Obtained from environmental sample
  misc_feature (1)..(540): n is a, c, g, or t
atgaaaaaaaatcttacaaactatatcgactttgctttttataatattgaacatgatgtggctattccacaaactcttccatttgcaattgagacaaatgaccaaagagttgcagataaaatagttttagaagttgcacaaagactagataaaactattaaatttatctcattagagaacaatactaaaattgaaccaaacgattttaaagatgagttactctatatttacgatttccactatgttaaaaaaagttcaaaagatttaatcctaaaaacaatagaaaattttgatgttatactctcatctttagaagatttaggagatatcccttatcctaagatagaattaaaaatagcgaataaactctcaacagttgattcaatacttacaattaacgattatgtaaaacttatggttaccagttttcaagacaagtatccagatacagaacttagtcgtagacttggaattagtagaaaatctctttgggaaaaaagaaaaaaatttggtatagagaaagataaaggtgataaatag

SEQ ID NO: 8806 - protein, 179 aa, Unknown
  Obtained from environmental sample
  misc_feature (1)..(179): Xaa is any amino acid
MKKNLTNYIDFAFYNIEHDVAIPQTLPFAIETNDQRVADKIVLEVAQRLDKTIKFISLENNTKIEPNDFKDELLYIYDFHYVKKSSKDLILKTIENFDVILSSLEDLGDIPYPKIELKIANKLSTVDSILTINDYVKLMVTSFQDKYPDTELSRRLGISRKSLWEKRKKFGIEKDKGDK

SEQ ID NO: 8807 - DNA, 477 bp, Unknown
  Obtained from environmental sample
  misc_feature (1)..(477): n is a, c, g, or t
atgagcagtaaaaaaatagcactatacccaggaacatttgatccaattacaaatggtcatctggatttaatatcaagagcttcaaaactttttgatgagatcataatagcagttgcccactcagaagataaaaaacctatgttcactcatgataaaagagttgaatttattgaaaaatgtactgctggaatgagtaatgtacgtgtagtaggttttaataatttaacagtagacatagcttctcaatataatgcgaagatactaattcgtggtctgcgtggtgttagtgattttgagtatgagttaaatctaggttacttaaatagctcacttgatgatcagatagagacaatctatatgatgccaaaactaaatcatgcatttgttagttcatctatcatcagaaacttacttagtttcaatggaaaaacatctcatcttctaccaaaagtcgtagaagagatgattaaaggatag

SEQ ID NO: 8808 - protein, 158 aa, Unknown
  Obtained from environmental sample
  DOMAIN (8)...(137): Cytidylyltransferase
  misc_feature (1)..(158): Xaa is any amino acid
MSSKKIALYPGTFDPITNGHLDLISRASKLFDEIIIAVAHSEDKKPMFTHDKRVEFIEKCTAGMSNVRVVGFNNLTVDIASQYNAKILIRGLRGVSDFEYELNLGYLNSSLDDQIETIYMMPKLNHAFVSSSIIRNLLSFNGKTSHLLPKVVEEMIKG

SEQ ID NO: 8809 - DNA, 582 bp, Unknown
  Obtained from environmental sample
  misc_feature (1)..(582): n is a, c, g, or t
ttgagctacatagcactagagggtattgatacggcaggaaaaagtacccagatatcaaatcttttaaaaatataccctgatgcgatttttacaaaagagcctggtggaacagatctgggtattaaaatcagagagttgcttctatttagcaatatagtaaatccaacaacagagcttttactatttttagctgatcgtgctgaacatataaaaagagtgatagaaccaaatatagagagactcattatctctgatcgttcagtaatttctggcatggcgtatgcacttgtgaaaaaagagttcactaaagagaaattagtagagttaaacaagtttgcaacaaacagtactctgccaaagtgtgtaatcatacttcaattaacaaaagaggagttagagtttagactctctcaaaaagagcatgacaaaattgagtcacgtggaagtgagtacctattagagattcaaaatgctcttatagatgcttgtaaaattttagatgttaagtatcacatgattgatgcttcaaaccaaatagaagatataacaaaaaaaattaaagatataatagatgaaatttag

SEQ ID NO: 8810 - protein, 193 aa, Unknown
  Obtained from environmental sample
  DOMAIN (6)...(186): Thymidylate kinase
  misc_feature (1)..(193): Xaa is any amino acid
MSYIALEGIDTAGKSTQISNLLKIYPDAIFTKEPGGTDLGIKIRELLLFSNIVNPTTELLLFLADRAEHIKRVIEPNIERLIISDRSVISGMAYALVKKEFTKEKLVELNKFATNSTLPKCVIILQLTKEELEFRLSQKEHDKIESRGSEYLLEIQNALIDACKILDVKYHMIDASNQIEDITKKIKDIIDEI

SEQ ID NO: 8811 - DNA, 888 bp, Unknown
  Obtained from environmental sample
  misc_feature (1)..(888): n is a, c, g, or t
ttgtcactgtacaagagttcaattttgtatgcactaccaaaagagatatttctaaaatatatgtatcaaaatgacgctttagagagttattttttctcaactatttcacaaaaattaaatagtagtatgcaaaatgaacaaaagaaaaagttattagattttgctatgtcaaaggttgaagatgcctatttacaaaaaccgatctatatagatgaaactgaaactatctatagtacagttgtacaactcactactaataatattcaatcaattttagttaaaagagcagacggtgagattggtattgtaacagactcaagttttgtaaaaaaagtacttcttaaaaggatggatgtagatggacctattagtcaaattacaacttacggtttaaaatatatagaagctacagactttttatttaatgcccaactacaaatggcaaaatacaatattaaaagacttgtggtaagaaaagagggtgagattgtaggtatattagatattgtgagtcttagtagcttttttgcttctcatacacactcaactagcatgttaatagaagaggctaaaactgttgaagagttaaaagaagctagtagtaagtttatacgaactattcgagtactgtatgaaaaaggggtaaaagtgagatatatctctaaattaatatctcaattaaataataaactatttcaaaagctctttgaacttactgcaccagaggaattgaaaacaaaatcagctttaataattatgggaagtgaagggagatctgaacaaatactacgaacagatcaggataatgcattgattttagcagatgattgtagtatggagtatgatgagattctgaaatatacccaaacttttacaaaacatctgtag

SEQ ID NO: 8812 - protein, 295 aa, Unknown
  Obtained from environmental sample
  DOMAIN (61)...(113): CBS domain
  misc_feature (1)..(295): Xaa is any amino acid
MSLYKSSILYALPKEIFLKYMYQNDALESYFFSTISQKLNSSMQNEQKKKLLDFAMSKVEDAYLQKPIYIDETETIYSTVVQLTTNNIQSILVKRADGEIGIVTDSSFVKKVLLKRMDVDGPISQITTYGLKYIEATDFLFNAQLQMAKYNIKRLVVRKEGEIVGILDIVSLSSFFASHTHSTSMLIEEAKTVEELKEASSKFIRTIRVLYEKGVKVRYISKLISQLNNKLFQKLFELTAPEELKTKSALIIMGSEGRSEQILRTDQDNALILADDCSMEYDEILKYTQTFTKHL

SEQ ID NO: 8813 - DNA, 639 bp, Unknown
  Obtained from environmental sample
  misc_feature (1)..(639): n is a, c, g, or t
ttggtttggctttgcaaccctaataatccagatggtcgtgttgttgagaagactttcctagaaacgcttcttaaaaacaacccgaattgcacttttgtagtggatgaagcctatatcgactttactgatgcgatttcatcggcaatagatttgcttgataattgtccgaatctgattttggtgaagtctctgactaaaaatttctcaatacctggcctgagattgggttatttaatcgcaaacaaggctatggtacagaatattcaatttttcaagcctccttggacggttaattctatagcaattgaggctggaaagtacattttacagaggaagcatcagttcttgcctcctgtaaagcaatacaaatcagatcaaaaggaatttgctgaaaaattggctcgaattcctggactggaaatatggccttctgaaacgtcctattttttgattgaactagagaaatcaacgtctttggagctaaaaaactacctaatttctaattttggactgctcattcgtgatgcgagcaactttcgaggcttgagtgaaaagtttattcgagtggcaacacttagcaaagaaaaaaaccaactattaatagacgcactgactcaatggagcaaattgaactcataa

SEQ ID NO: 8814 - protein, 212 aa, Unknown
  Obtained from environmental sample
  misc_feature (1)..(212): Xaa is any amino acid
MVWLCNPNNPDGRVVEKTFLETLLKNNPNCTFVVDEAYIDFTDAISSAIDLLDNCPNLILVKSLTKNFSIPGLRLGYLIANKAMVQNIQFFKPPWTVNSIAIEAGKYILQRKHQFLPPVKQYKSDQKEFAEKLARIPGLEIWPSETSYFLIELEKSTSLELKNYLISNFGLLIRDASNFRGLSEKFIRVATLSKEKNQLLIDALTQWSKLNS

SEQ ID NO: 8815 - DNA, 513 bp, Unknown
  Obtained from environmental sample
  misc_feature (1)..(513): n is a, c, g, or t
atgtttagtagattattaaaaaaaatttttaaattaataggaagaaaattatttaaaatgcagtgttttcaaaatagtgagttttattctttggataaatatcttgactatagagaatttagatatattatgatgatacatgaagtttataaaaaaatagaaaatgtaccaggacatataattgaactaggagtggcaagaggaagaaattctatattatttgccaatattataaaatcgtacaatgatgatagtagaaggtattatggttttgatacattttcaggttatacagaagaagatttaaaaaacaatacaaatctaagtagtgatacatggaaaaatagttatgagtttgttcattcaagaataagtagtaatggttatagtaatatagttacactaataaaaggtgacattaaaaaaactattccaaactttgttgataaaaataaagagattaaaatcgcaatagtatatatagattgtaatgcttatgaacctgcaatttga

SEQ ID NO: 8816 - protein, 170 aa, Unknown
  Obtained from environmental sample
  misc_feature (1)..(170): Xaa is any amino acid
MFSRLLKKIFKLIGRKLFKMQCFQNSEFYSLDKYLDYREFRYIMMIHEVYKKIENVPGHIIELGVARGRNSILFANIIKSYNDDSRRYYGFDTFSGYTEEDLKNNTNLSSDTWKNSYEFVHSRISSNGYSNIVTLIKGDIKKTIPNFVDKNKEIKIAIVYIDCNAYEPAI

SEQ ID NO: 8817 - DNA, 612 bp, Unknown
  Obtained from environmental sample
  misc_feature (1)..(612): n is a, c, g, or t
atgaaaaacttaggatttattcctgtacgaggtgggtcaaaaagactacctagaaaaaatcttatggatttaggtgggaaaagtatcactcatagagctattgatacggcacttgattcaggtgtatttacagatattatactttcaactgatgatgatgagataatagaacattgtaaaaagtatgtagaagagggtaaaattatcatagataaaagagatccctttttggcacaagacacttcaactgtgttgcaagtttctcttgagcttataaatcgtttaacaaaagagggaaaaacttacgatacatttacagctatgctagcaacttgtccatttaaaacatctgaatatataagatctggtatgaaaatgtatagtgaagatttagatgcagttttaagcgtagcagagtatgattttccttgggagtttgctatggatatggatgatgaatctctcataataccttcaatagacccatctccccttataacaaaaaatactagaacacaagatagaaaaaaagtttatcatcctaacggagctttttatatatgtaattggcaaaaatttttaaaaaatgaaaactttttaaaggaaaaataa

SEQ ID NO: 8818 - protein, 203 aa, Unknown
  Obtained from environmental sample
  DOMAIN (4)...(203): Cytidylyltransferase
  misc_feature (1)..(203): Xaa is any amino acid
MKNLGFIPVRGGSKRLPRKNLMDLGGKSITHRAIDTALDSGVFTDIILSTDDDEIIEHCKKYVEEGKIIIDKRDPFLAQDTSTVLQVSLELINRLTKEGKTYDTFTAMLATCPFKTSEYIRSGMKMYSEDLDAVLSVAEYDFPWEFAMDMDDESLIIPSIDPSPLITKNTRTQDRKKVYHPNGAFYICNWQKFLKNENFLKEK

SEQ ID NO: 8819 - DNA, 939 bp, Unknown
  Obtained from environmental sample
  misc_feature (1)..(939): n is a, c, g, or t
atgatccaaaacaatataattcatcagtcctatctgagtggagtaaaaaaactattattcctgggcagcacttgcatttatccaaaagaatgcccccaaccaatgaaagaagagtatttgttgacaagtcctttggaatataccaacgagccatatgcaatagcaaaaattacaggtataaaaatgtgcgaatcatacaacatacaatacggcaccaactacatttccgtaatgccaaccaacctctacggaccaaacgacaacttcaacctcgaaacatcccatgtcctcccggctctaatccgcaaaatacacctcggaaaatgcctcgaagaaaataattgggatgcccttcgcacagacctcaacaaacgccccatagaaggaataaacggtaataatacagaacaagaaatccttaacaaactcgagaagtacggcatccgctgccaaaatccgtgtaatccatcaaaatctgcgcaatccgtgctagacaatccgtgtaatccatcaaaatccgcggaatcagtgtcagtagagatctggggctccggcaaaccaatgcgcgaattcctctggagcgaagaaatggcagatgcctgtgtcttcttaatggaaaaggttaattttaaagacgtcatcctgaatgaagcgaagcgaaatgaaggatctcaaacaatagaggtacgcaatacgcatattaatatcggaacaggcaaagaaataaccatcaaaggtcttgctgaattagttaaagaaaaagttggatataaaggcgaactgcattttaatgtagaaaaacctgatggaacaatgcgaaaactaactgatgtgactaaactgcacgaactggggtggaagcataagattgagattgaagatggtatccaaaaatgtataattggaatccaaattagggcaaaatcggatgccaattaa

SEQ ID NO: 8820 - protein, 312 aa, Unknown
  Obtained from environmental sample
  misc_feature (1)..(312): Xaa is any amino acid
MIQNNIIHQSYLSGVKKLLFLGSTCIYPKECPQPMKEEYLLTSPLEYTNEPYAIAKITGIKMCESYNIQYGTNYISVMPTNLYGPNDNFNLETSHVLPALIRKIHLGKCLEENNWDALRTDLNKRPIEGINGNNTEQEILNKLEKYGIRCQNPCNPSKSAQSVLDNPCNPSKSAESVSVEIWGSGKPMREFLWSEEMADACVFLMEKVNFKDVILNEAKRNEGSQTIEVRNTHINIGTGKEITIKGLAELVKEKVGYKGELHFNVEKPDGTMRKLTDVTKLHELGWKHKIEIEDGIQKCIIGIQIRAKSDAN

SEQ ID NO: 8821 - DNA, 750 bp, Unknown
  Obtained from environmental sample
  misc_feature (1)..(750): n is a, c, g, or t
atgccaaatttattccttcccgatcgaattattcgagtcaatcaacttgattcaaccaattcatatgcattgcaattgcttaaagataccaatccgtcaggtggtactgtcgttatggcattaaatcagacagaaggccgcggacagcaaacaaatgcttgggaaagcgaaagtggcaaaaaccttaccattagtcttatacttcgtccagatttcattttagctcaagatcaatttcagatttcaatgcttatttctcttggtctttctgattacctgagaacttatacagagaatgttagaataaaatggcccaacgatatatatgttggtgataaaaagattgctggtgttctgattgaacaatccataatgggagctcacctgtcacattcggtatgtggtatcggtctaaatgtaaatcaggaggaatttacttcacatgctcctaatccaatatcccttaatattctaactaaaaagaattatcagctagaaacggaactaaagaaattattagtggcaatcgaaaagcgatatttccaacttatggataaagaaggaaaagaattagaagctgattacttaaaatccttgtattggataaataaaaaacacacgttcaaagatgaaaatggcaagtttaatggcaacattattggtatttcagaatttggtcaattacaaatcgaggataataagagggagattagaacatacaattttaaagaggtgagctttattaaatag

SEQ ID NO: 8822 - protein, 249 aa, Unknown
  Obtained from environmental sample
  DOMAIN (13)...(146): Biotin/lipoate A/B protein ligase family
  misc_feature (1)..(249): Xaa is any amino acid
MPNLFLPDRIIRVNQLDSTNSYALQLLKDTNPSGGTVVMALNQTEGRGQQTNAWESESGKNLTISLILRPDFILAQDQFQISMLISLGLSDYLRTYTENVRIKWPNDIYVGDKKIAGVLIEQSIMGAHLSHSVCGIGLNVNQEEFTSHAPNPISLNILTKKNYQLETELKKLLVAIEKRYFQLMDKEGKELEADYLKSLYWINKKHTFKDENGKFNGNIIGISEFGQLQIEDNKREIRTYNFKEVSFIK

SEQ ID NO: 8823 - DNA, 426 bp, Unknown
  Obtained from environmental sample
  misc_feature (1)..(426): n is a, c, g, or t
ttggtcaacgagataccggcaaagatagattttatagtaagacaaacacaacttgatatgtttcaagcacactttgatattgatgaaagatntattaaacatcttcaatctaaatatattgaggttataagagccaaagaaaaacaagatattttaaacctcaatccaaataaatactatttagtagatgcttttgtggaaagttatgggggtgaggggaagcgaatcgctttagattggtttgatgaagttgattgctctaaacttataattgcaggtggacttaatagtgataatttagaagaattaaaaggttataatttttatggagttgatgtcagtagtggtgttgaattatctaaagggaaaaaagataaacaaaaaatcataaactttataaataaagccaatgaattatcttcctaa

SEQ ID NO: 8824 - protein, 141 aa, Unknown
  Obtained from environmental sample
  DOMAIN (2)...(135): N-(5'phosphoribosyl)anthranilate (PRA) isomerase
  misc_feature (1)..(141): Xaa is any amino acid
MVNEIPAKIDFIVRQTQLDMFQAHFDIDERXIKHLQSKYIEVIRAKEKQDILNLNPNKYYLVDAFVESYGGEGKRIALDWFDEVDCSKLIIAGGLNSDNLEELKGYNFYGVDVSSGVELSKGKKDKQKIINFINKANELSS

SEQ ID NO: 8825 - DNA, 912 bp, Unknown
  Obtained from environmental sample
  misc_feature (1)..(912): n is a, c, g, or t
gtgacaccatttgatctgttttatatctttattgctctaaaaaatagtatagcaactctattttatgaaaatatgtttctctcttttgcattacaaaaagatttagagactatttcactaaatatttcaaaagatatctttgtaacatatgagcagatacaaaaaaatgagataaatttttcagatgttcactctaacttacttaatgagtacaaaaaagccgttgatatcagtaatattgtttcaaaatcaaatacaaaagggatcattacatatgttaatgataaattttgtgaaatcagcggatacactaaatctgaacttatcggtaagcctcactctatagtccgtcatccatcaatgcctagttcgatatttaaggaactttgggatgtaataaaagagaaacgtgcatggcatggtgtaatcacaaatatgaaaaaagatggacgtaagtatgtagtggactctacggtcatacctattttggatgttgatggagatatagtcgaatatattgctatacgacatgatgtaacagagtttgagcagacaaaagagcagctaggtacgctaaatcgtgctatgaaaaataaggtggatgagctatattccatgactgcaacattggaagaagaagcctctatagatgcattaacaggtgcatttaatcgttcaaaatttgagaaattttttgatcttgagatagagaaagctcagatgagccaaaatgtattgactatgatagtcttagatatagaccattttaaattaattaatgataattatggacatcacgttggtgatgatgttttaaaaaatatcgcatctcttgtgagtaaagctctaaaaagacagatgtatttgctagatggggaggcgaagagtttgttgtacttctaccagaactga

SEQ ID NO: 8826 - protein, 303 aa, Unknown
  Obtained from environmental sample
  DOMAIN (69)...(131): PAS domain
  misc_feature (1)..(303): Xaa is any amino acid
MTPFDLFYIFIALKNSIATLFYENMFLSFALQKDLETISLNISKDIFVTYEQIQKNEINFSDVHSNLLNEYKKAVDISNIVSKSNTKGIITYVNDKFCEISGYTKSELIGKPHSIVRHPSMPSSIFKELWDVIKEKRAWHGVITNMKKDGRKYVVDSTVIPILDVDGDIVEYIAIRHDVTEFEQTKEQLGTLNRAMKNKVDELYSMTATLEEEASIDALTGAFNRSKFEKFFDLEIEKAQMSQNVLTMIVLDIDHFKLINDNYGHHVGDDVLKNIASLVSKALKRQMYLLDGEAKSLLYFYQN

SEQ ID NO: 8827 - DNA, 897 bp, Unknown
  Obtained from environmental sample
  misc_feature (1)..(897): n is a, c, g, or t
gtgcaaaaagagtttgaggaagactcttttgatgaagaggaagatagacgaaattacattataaactcaaaattaaaagagattataaaaaatcctgatcaatataagccagtttccaatatgtggattattccagagtctcataaagatgaacttgtcagtgcatatagctctatgagtagtagtactaatgaaataagagagtttttaaaacataacttacatacacagtttttattaaaccatagagatataatcttttttttaagagaaaaaatatttatacgtgaatacacctctcctagaaaagttccagaaggtgcggacaaaaggtatgccggattagatcatgatgatgtagtaactctttataaaaaacattttcctgtaggtgtagaagataaaatagaggctatcttaccggaaatattaagtgataaactaaacttctctattatagataatgcaacatttattcgtgattttataccggtatttagatcgatggtagagattataatattagaacatggattagatttagatgatattacactagaaggtttaagtggttacattttaagaataaatttagatttgatacttctgatttgtgcccaagatctatttaaacatatagaaaatcgagatagaaatgcagaaaaatttataaaatattatagtgatgatgtagttatagattcaaaacataagagagtgcaaaaatatgcaatcgtagataaaaaaggtcaaaagtggaactacacatctatactatcaattattatacaaaataaagagtcagataaaaaaatattaagacaagaacaacagatagatatgattaaagggcgttttgatatgcgggaaataactatgagcaaaaaagaaatctga

SEQ ID NO: 8828 - protein, 298 aa, Unknown
  Obtained from environmental sample
  misc_feature (1)..(298): Xaa is any amino acid
MQKEFEEDSFDEEEDRRNYIINSKLKEIIKNPDQYKPVSNMWIIPESHKDELVSAYSSMSSSTNEIREFLKHNLHTQFLLNHRDIIFFLREKIFIREYTSPRKVPEGADKRYAGLDHDDVVTLYKKHFPVGVEDKIEAILPEILSDKLNFSIIDNATFIRDFIPVFRSMVEIIILEHGLDLDDITLEGLSGYILRINLDLILLICAQDLFKHIENRDRNAEKFIKYYSDDVVIDSKHKRVQKYAIVDKKGQKWNYTSILSIIIQNKESDKKILRQEQQIDMIKGRFDMREITMSKKEI

SEQ ID NO: 8829 - DNA, 969 bp, Unknown
  Obtained from environmental sample
  misc_feature (1)..(969): n is a, c, g, or t
ttggttacaatgttgggggaaaaattcactaaactcccattttggttcaaattgcaggataaaaagttttttcagatgatgagattgttggacccaaaaactgtaggaggaggtacctttttagagatacaacaatttttaagtgatagggtacaaacttactatacacaaaatagtgatgtagagttcttagagcaggtaaaaatattatatacccttaaacctttatctgatgaacaagtaaattcattgtatgaaactattatggtagatatagattatgaagctatcaatatagaacaataccttttaaaaataactcaaaaagaggatgctataaaacactcatttatagatcctcgaataaaaaaacaaaacaaaagtgctatgacttggattgtttttgctgctgttagtgtacttattgtacttggattaatttacacacaatatagttcatctcaagagagtagtaagcaaaaagtagaacaacaaaaacagatgcaaaaagttgcaaaaaaagaacctgtaacaccaaaggttattgagtttccaaatcatattcttacaaataaccatctattacaagatgtttatatgctatttgatatagttccttatgatgctgttttaaaagatttagagataacacaaaatagttcaacttatgtttgtatgttcacatcacaaagccaatcatttgaagatatgaggataaaacttctaaatctttacaaagattcaaaaatacttttaaaacatgaaaataaatctattctaaatattattcttgaaaatgaaaattttctaaccccaaataaaaaaatgcaatataaacaatatggtgattctgaatttatatctattggtcaatcaacagactatattaataaacttcttatagatcaatcaacaataaagttttctaataaagaggagaaagagtatttaacttataaatttgcataa

SEQ ID NO: 8830 - protein, 322 aa, Unknown
  Obtained from environmental sample
  misc_feature (1)..(322): Xaa is any amino acid
MVTMLGEKFTKLPFWFKLQDKKFFQMMRLLDPKTVGGGTFLEIQQFLSDRVQTYYTQNSDVEFLEQVKILYTLKPLSDEQVNSLYETIMVDIDYEAINIEQYLLKITQKEDAIKHSFIDPRIKKQNKSAMTWIVFAAVSVLIVLGLIYTQYSSSQESSKQKVEQQKQMQKVAKKEPVTPKVIEFPNHILTNNHLLQDVYMLFDIVPYDAVLKDLEITQNSSTYVCMFTSQSQSFEDMRIKLLNLYKDSKILLKHENKSILNIILENENFLTPNKKMQYKQYGDSEFISIGQSTDYINKLLIDQSTIKFSNKEEKEYLTYKFA

SEQ ID NO: 8831 - DNA, 642 bp, Unknown
  Obtained from environmental sample
  misc_feature (1)..(642): n is a, c, g, or t
atgaaagtatctattaaagagccaaaaaggcttccaaaaaccatgaacatgagagagataaaaaagatgctctcatgtgtctataaaatcaaaaatagtacagataaacataagtattcatacaaagcagtggtaagagatatatttatcatggagttgctgtttgcaactggcatgagagtatctgaagtcagtaatctgaaactctcagatatagatttaagatcaggaacagttaggattataggtaaaggagataaagagagaactatacagatctgtgatcaagaggtaaaaaaaatactaaaagagtatagagatctttttgatcatataagtgataaaaaagagttcttttttataaacagactgggtcaacaaatatcagaacaatcaataaggtttatgataaaaaagtatcaaaatatatcaggaataaaaaaacatataactccacatatgttcagacacactttcgccacaatgctccttgaagagggcgtagacatacgctacatacaacatattttaggacactcttccatatcaaccacacaaatatacacacaggtaaatctaaaacatcaaaagaaaatattgacaacaaaacacccccgaaggaatatgcagtttcaggagtga

SEQ ID NO: 8832 - protein, 213 aa, Unknown
  Obtained from environmental sample
  DOMAIN (15)...(198): Phage integrase family
  misc_feature (1)..(213): Xaa is any amino acid
MKVSIKEPKRLPKTMNMREIKKMLSCVYKIKNSTDKHKYSYKAVVRDIFIMELLFATGMRVSEVSNLKLSDIDLRSGTVRIIGKGDKERTIQICDQEVKKILKEYRDLFDHISDKKEFFFINRLGQQISEQSIRFMIKKYQNISGIKKHITPHMFRHTFATMLLEEGVDIRYIQHILGHSSISTTQIYTQVNLKHQKKILTTKHPRRNMQFQE

SEQ ID NO: 8833 - DNA, 915 bp, Unknown
  Obtained from environmental sample
  misc_feature (1)..(915): n is a, c, g, or t
atggctgggcttccttgctctgtgcgggtttgcccatgtggcgtccatggcaatttttgtagggggggtgacggcccttgcgcccaaacgaacggctgccatttccggggttgcaatcaaggctttgattgctgctacctttgcctgtctattaacggcctgtgtggccggtactttctactccgataccagtctgctgctgggaaattaaggaaaaatgtaatgggcttaacgccaccaatttattcaacaaatccggatatggataaattttgcgatcgccttaaaaaggggtgcgaaaaaataaaactggatattacccaggagcagatatccctgatggctgcccatgcggtggaattgatcgcatggaataaaaagataaatctgacgtccattgttgagcccctggccatggcggaaaaacatttcattgatgcccttgcggttcacccttttttggggcaggaaaaaatgataatggatatgggaacaggggggggatttccttccattcctctgaaaatctttaatcccgatcttgaatttgttttggtggattcatccagaaaaaaggtcagttttttaaaacatgtgatccgaactctggggctgaaaaatataaaggcccttcattcacgggtggaggatttagccaaagatgatacccatgcaggagcctatgatgctgtcatctcccgggcatttgccgggcttgaaaaatttgttgggttttcccttcccttgctcaaatcagaagggataatttatgcccttaaagggaaacatgcccccgacgaaatcaccccggaacttaggtctcaatttgagatcaggaccgatctctatcaactcccctttgaaaaatcggatcggtatatgggttcggttgaaaaaattataagaatccattaa

SEQ ID NO: 8834 - protein, 304 aa, Unknown
  Obtained from environmental sample
  DOMAIN (110)...(301): Glucose inhibited division protein
  misc_feature (1)..(304): Xaa is any amino acid
MAGLPCSVRVCPCGVHGNFCRGGDGPCAQTNGCHFRGCNQGFDCCYLCLSINGLCGRYFLLRYQSAAGKLRKNVMGLTPPIYSTNPDMDKFCDRLKKGCEKIKLDITQEQISLMAAHAVELIAWNKKINLTSIVEPLAMAEKHFIDALAVHPFLGQEKMIMDMGTGGGFPSIPLKIFNPDLEFVLVDSSRKKVSFLKHVIRTLGLKNIKALHSRVEDLAKDDTHAGAYDAVISRAFAGLEKFVGFSLPLLKSEGIIYALKGKHAPDEITPELRSQFEIRTDLYQLPFEKSDRYMGSVEKIIRIH

SEQ ID NO: 8835 - DNA, 804 bp, Unknown
  Obtained from environmental sample
  misc_feature (1)..(804): n is a, c, g, or t
ttggggactgggaagaaaaaaaggaatttccccgaatctggaccattcttgttttcgaacagggaaaagggctatgaaagaggttatttgcgccttggaataaggatttggaaaaaaaaattgccggacggaccccttaaagacgtccgccatacattggaatttattgtagaagaggccctgaccccaggccaggaacaaggtgtcaatgcccttccgaaaaccatagatatcctgctgggcagatatcaaaacgataaccaggccatggaatacctgagaaaaattgaatccaattcttctgttttgattaagcatgctgtcaatgtcacagcccttaccctgcaattttgtttttttcatcgatttcctgaatcagatacccggcaactggctatggccgctctcctccacgatatagggtgttctcagattgacaagctcctcatcgaaacaaataaacgactgaccgacgaacaatttaaagtttatcgcacccatcctgaaaagggccatgccatgattctccagagctctgattttgatacggccattcaaatggtggcattggaacaccacgaacgcattgacggcagcggttatccggcaggtttagaccgattgtcatcctatagccagctcatcggtctcatcgatagttatgaatctctcacctacagaagtaaactttttaggaaagcgaaaaaaccatttgatgccttaaatgttatcaaagaggacgtgttgaaaggcaaattctccaagggattgtttaaaaaattcacctcctgcctggtaaagtaa

SEQ ID NO: 8836 - protein, 267 aa, Unknown
  Obtained from environmental sample
  DOMAIN (103)...(224): HD domain
  misc_feature (1)..(267): Xaa is any amino acid
MGTGKKKRNFPESGPFLFSNREKGYERGYLRLGIRIWKKKLPDGPLKDVRHTLEFIVEEALTPGQEQGVNALPKTIDILLGRYQNDNQAMEYLRKIESNSSVLIKHAVNVTALTLQFCFFHRFPESDTRQLAMAALLHDIGCSQIDKLLIETNKRLTDEQFKVYRTHPEKGHAMILQSSDFDTAIQMVALEHHERIDGSGYPAGLDRLSSYSQLIGLIDSYESLTYRSKLFRKAKKPFDALNVIKEDVLKGKFSKGLFKKFTSCLVK

SEQ ID NO: 8837 - DNA, 696 bp, Unknown
  Obtained from environmental sample
  misc_feature (1)..(696): n is a, c, g, or t
ttgttcaaaacaactctaaaaacacttaccgaagacatttttgtgaaaataatggtagaagacaatcgttttaatccttcggaatnttcggaaatcataaaagtaactcgtcccgacacaattcgtccagcaccgccagtgttcaaaaaatacaaagtaaccgacacttgcatctatctcgaatggtcaaaaagcaacagtaaagatgttgtaaaccacataattttccgttcgttagcaggcaaagatgattggttggcggttgcaatattcgatacaatttacaatccaaattcattttgtgatacatcggcattgccaggaaaaatatatgattatgccataattgctgtcgatgaagttgacaataaatctgtaaaaggcaaaactttacaactccaaatgcgtaaaaaaagcatcgaaggagaaataaagaattttacggcaaatattaatcaaaatgcagaaaatattgagttaaattgggatttgccaaacaaaccaataaaatcaattctcatttatcgaaaaacaaacgacgggattctaaaaaagcaccaaactttttacgaatccacaacaaaatttaccgatacaaacgttcaaataaattcaaaatacgaatatcaaatcagaataatttaccaaaacggcaaaagttcacctttttcaaaaaaacaaatcataaattattga

SEQ ID NO: 8838 - protein, 231 aa, Unknown
  Obtained from environmental sample
  DOMAIN (141)...(224): Fibronectin type III domain
  misc_feature (1)..(231): Xaa is any amino acid
MFKTTLKTLTEDIFVKIMVEDNRFNPSEXSEIIKVTRPDTIRPAPPVFKKYKVTDTCIYLEWSKSNSKDVVNHIIFRSLAGKDDWLAVAIFDTIYNPNSFCDTSALPGKIYDYAIIAVDEVDNKSVKGKTLQLQMRKKSIEGEIKNFTANINQNAENIELNWDLPNKPIKSILIYRKTNDGILKKHQTFYESTTKFTDTNVQINSKYEYQIRIIYQNGKSSPFSKKQIINY

SEQ ID NO: 8839 - DNA, 711 bp, Unknown
  Obtained from environmental sample
  misc_feature (1)..(711): n is a, c, g, or t
ttgaaaatttttactctctcaaaaaccatgaatggcatgattaactccattagaaactcaagagtagcatacaaagtacaacatgatgaactgctagatcaaaaaaatattttacatcatcaagctcaccatgactatcttacaggactacctaatcgtattttatttaacgatcggctagaacaggctataaagaaatctgaacgtcgtgagaaaaagatggcacttttttttattgacctagatcattttaaagagattaacgactcactaggacatgaagtaggagataaaatattaaaagaggtaacaaagtttcttcaagagattattcgtaaagaagataccctttcgcgtttgggtggcgatgagtttacgataattgtagaagatttagaaaaaatagaagacgcatctgtatttgccaaaaagatgcttgatgttttaactagacctattacaatagatgataaacagctatatatctctagcagtatcggaattagtctatacccaaatgatggaaaaacagttcaagatctctttaagtatgcagatgctgccatgtacagagctaagtatgagggtagaaacaactttcaatactatagttctgaaatgacagaggctgcacttgagagagttgtcatggagacaaatctgagagatgcattaaactgtgaagagtttgtagtctcgagccgaatttga

SEQ ID NO: 8840 - protein, 236 aa, Unknown
  Obtained from environmental sample
  DOMAIN (38)...(199): GGDEF domain
  misc_feature (1)..(236): Xaa is any amino acid
MKIFTLSKTMNGMINSIRNSRVAYKVQHDELLDQKNILHHQAHHDYLTGLPNRILFNDRLEQAIKKSERREKKMALFFIDLDHFKEINDSLGHEVGDKILKEVTKFLQEIIRKEDTLSRLGGDEFTIIVEDLEKIEDASVFAKKMLDVLTRPITIDDKQLYISSSIGISLYPNDGKTVQDLFKYADAAMYRAKYEGRNNFQYYSSEMTEAALERVVMETNLRDALNCEEFVVSSRI

SEQ ID NO: 8841 - DNA, 516 bp, Unknown
  Obtained from environmental sample
  misc_feature (1)..(516): n is a, c, g, or t
ttgaagaagttgaagagattgtcaataggcaagtttatatggatatgggaaaaattatttcagatgaaactattatttaatttatttttaattgtattatttgcatttttatatattggatgcgattcaaatagtaatcaaaataagaagcaagtaagaatttgtccacaatgtaatatgaaattaccagatacaaatatacacacggctgatatgaaacacgatgataaaatagtatattttgatgatataggatgtatgatcttatgggcaaaaaaagaaaaaatagatttaaaaaaaacagaaactagaattttttcaaatgatacaaaaaaatatatagatccttttacagcaagttttgcaataaatgcaaaaacaccaatgttgtatggtttttctgcctatgaaaatgactgtaatgggtgtatcaaatttgaagaagttataacgaaaatgttaaggggtgaacatatggcaaatccaaaaattagaaaaaaaatactaggatattaa

SEQ ID NO: 8842 - protein, 171 aa, Unknown
  Obtained from environmental sample
  misc_feature (1)..(171): Xaa is any amino acid
MKKLKRLSIGKFIWIWEKLFQMKLLFNLFLIVLFAFLYIGCDSNSNQNKKQVRICPQCNMKLPDTNIHTADMKHDDKIVYFDDIGCMILWAKKEKIDLKKTETRIFSNDTKKYIDPFTASFAINAKTPMLYGFSAYENDCNGCIKFEEVITKMLRGEHMANPKIRKKILGY

SEQ ID NO: 8843 - DNA, 780 bp, Unknown
  Obtained from environmental sample
  misc_feature (1)..(780): n is a, c, g, or t
gtgaaaataagtaatctaagagggatatataaaatgaaagtatgtaaatttggtggaagttcagtaaaagatgctacacaaatcagaaaagttataaaaatattacagcaagataaatcaagaaaagtggtagttgtttctgcacctggtagagatgacttacatgatcaaaagattacagatcatctattaaactatgcaaccaatggaaaacatttttcagaccacttaatagaagtagatgcacaacaaagttttgaagcaattattactaaatatgaaaagttatgtatagatttaggtattgataaaaataagattatagaaccattaaaaaaagatttagaaaatacaaaattaaaagatgaaaaaagggaggctttttgtctttcaagaggtgaacatcataatgccaaagtaatagagcaatttatgaaaaaatcaaagataaatgtaaaactaatgcttcctgaagattttgggtttatattaagtgaaaattttacagatggtaaagtattaaatgagtcatatgaaaatattgagagagattttagtatagaggaggatatcctttatttagttccaggattttatggaattacaaaaaataaagagatagctgtgatgagtagaggtggtagtgatttaacaggtggagaattagcctatgcacttgatgctgatgtttatgaaaactggacggatacaaatggtgtgtatgaagtagatccaagagttatagaagatgctaatgtaataccaagacttacattttaa

SEQ ID NO: 8844 - protein, 259 aa, Unknown
  Obtained from environmental sample
  DOMAIN (11)...(259): Amino acid kinase family
  misc_feature (1)..(259): Xaa is any amino acid
MKISNLRGIYKMKVCKFGGSSVKDATQIRKVIKILQQDKSRKVVVVSAPGRDDLHDQKITDHLLNYATNGKHFSDHLIEVDAQQSFEAIITKYEKLCIDLGIDKNKIIEPLKKDLENTKLKDEKREAFCLSRGEHHNAKVIEQFMKKSKINVKLMLPEDFGFILSENFTDGKVLNESYENIERDFSIEEDILYLVPGFYGITKNKEIAVMSRGGSDLTGGELAYALDADVYENWTDTNGVYEVDPRVIEDANVIPRLTF

SEQ ID NO: 8845 - DNA, 441 bp, Unknown
  Obtained from environmental sample
  misc_feature (1)..(441): n is a, c, g, or t
ttgaaaagtggggatattatattccaaacttcaaaatcacaacagagtaaagccattcaattagcaactcattcgaaatatagtcacgttgggatagtttatgttgaagatgataatattttagtttacgaagctgttcagcctgtaaagttaacaccacttcacgaatggataaagcgtggcgaaaataaacactttgttgttaaacgcataaaagaatcgaacaagcttcttacaaatagtaatttaatgaaaatgaagtccgtcggagaaaagtttataggaaagaattatgacatttattttgagtggtcaaatgacaaaatttactgttctgaattagtttggaaaatttataaggaagcaatcggagttgaaataggaaaacttcaaactttaagtgaatttgacttagaagatgaaattgtaaaagaaaaataa

SEQ ID NO: 8846 - protein, 146 aa, Unknown
  Obtained from environmental sample
  DOMAIN (1)...(146): Protein of unknown function (DUF1105)
  misc_feature (1)..(146): Xaa is any amino acid
MKSGDIIFQTSKSQQSKAIQLATHSKYSHVGIVYVEDDNILVYEAVQPVKLTPLHEWIKRGENKHFVVKRIKESNKLLTNSNLMKMKSVGEKFIGKNYDIYFEWSNDKIYCSELVWKIYKEAIGVEIGKLQTLSEFDLEDEIVKEK

SEQ ID NO: 8847 - DNA, 522 bp, Unknown
  Obtained from environmental sample
  misc_feature (1)..(522): n is a, c, g, or t
atgatagaaaaaaaacttgatatcataacccatatagaaaacttaatggcacttttttgtagagaaaaaagtgtaatattagagggagatataaatcttcatcatactattataaaagagttagaaaattttgagttaaaaacaccattacaaatagcaaatttagatagtactttaaactatctacaaaagcaaggaaatatcaaaatatatgagatatatgaatttgtaaaaattataaaatattttcaatatctaaaaaaatttagctttggtggtaaactagaatcttggattgaaaaaattgttattcctattgagttagataaagttttacacgcttttgatgataaaggggaattgttatctgggtttaatgaagattttgatagggtaaatcaaagtttatatacaaatagagatgctataaaacaaaaactttatggtgtgataaatagtaaaaacctacaaccatacttagtagatcatcaggtgcatttagtacatggtgaacaaacataa

SEQ ID NO: 8848 - protein, 173 aa, Unknown
  Obtained from environmental sample
  misc_feature (1)..(173): Xaa is any amino acid
MIEKKLDIITHIENLMALFCREKSVILEGDINLHHTIIKELENFELKTPLQIANLDSTLNYLQKQGNIKIYEIYEFVKIIKYFQYLKKFSFGGKLESWIEKIVIPIELDKVLHAFDDKGELLSGFNEDFDRVNQSLYTNRDAIKQKLYGVINSKNLQPYLVDHQVHLVHGEQT

SEQ ID NO: 8849 - DNA, 393 bp, Unknown
  Obtained from environmental sample
  misc_feature (1)..(393): n is a, c, g, or t
ttgtcagatcggctcgagtacgatacagagtcgatttattgcaactctttttctccagcattttttcaggataaagatacaaaatataaacgccttcagttgatgttttttaaaaaagattcgcaaacatattgtgataactttttaacaaattgtggttttagtaaagaattagctagtaaatattttgaagagggaacatttgaagagctagaagaattactaacttatgaatggggtcaagaaaaattacaaaaattaattgataaaaatataaaaatagagatctacttaggaagtgatgataagattattgatgcaaatgttgcattagagttttttaaacagtttggtgaagtatattttataaaagaaaaggggcatatcttatga

SEQ ID NO: 8850 - protein, 130 aa, Unknown
  Obtained from environmental sample
  misc_feature (1)..(130): Xaa is any amino acid
MSDRLEYDTESIYCNSFSPAFFQDKDTKYKRLQLMFFKKDSQTYCDNFLTNCGFSKELASKYFEEGTFEELEELLTYEWGQEKLQKLIDKNIKIEIYLGSDDKIIDANVALEFFKQFGEVYFIKEKGHIL

SEQ ID NO: 8851 - DNA, 810 bp, Unknown
  Obtained from environmental sample
  misc_feature (1)..(810): n is a, c, g, or t
ttgagaaaagttgctcgtaaagacaaacttaacggacaaactcccgaacaagtgttattaggaatgctttataatccgagacattggcaagagcaacctatgatttatatcaacagaaacatagagcaactccaaaaagaattaaatgccaaaaataattacgctactttcttcgatttttttgaccatgattttaattatgtattgagcgaacaagtaaaagaagctaccagaaaaaaaccaggagaacgctctaaatatgatgatgaagtaattaaagtagatgaaagaattaacatttgctacatggtttacgaaggaggtttattacgacttttccctaaacataaagaccctaacgacacttggtatagctttttagattacaaaaaatttgaaacacacgattctatttttgtaaaatcattcttaccactttatttcaacgctattcatcaatcgttagatgaaaacgattggcaaattgccgatagcaccttaaaatacttagatgattaccaaaagaaatttggagcttcagtttacccaagtgaaacagaaataaatgttgaagtagcttacaacaaaatcaatattttcaatcttttatttaagcattatgctatcattggtatcttaatgctcatcttcttatttatggatattttcaatcctaaaaaatggaaaactacagccataaatgcactaagtattatactgtttatacactttatagcccatacaggcggattgcctgctcgttggtatattcaagacatgctccttggagtaacggttatgaatctatga

SEQ ID NO: 8852 - protein, 269 aa, Unknown
  Obtained from environmental sample
  misc_feature (1)..(269): Xaa is any amino acid
MRKVARKDKLNGQTPEQVLLGMLYNPRHWQEQPMIYINRNIEQLQKELNAKNNYATFFDFFDHDFNYVLSEQVKEATRKKPGERSKYDDEVIKVDERINICYMVYEGGLLRLFPKHKDPNDTWYSFLDYKKFETHDSIFVKSFLPLYFNAIHQSLDENDWQIADSTLKYLDDYQKKFGASVYPSETEINVEVAYNKINIFNLLFKHYAIIGILMLIFLFMDIFNPKKWKTTAINALSIILFIHFIAHTGGLPARWYIQDMLLGVTVMNL

SEQ ID NO: 8853 - DNA, 411 bp, Unknown
  Obtained from environmental sample
  misc_feature (1)..(411): n is a, c, g, or t
ttgatgaaaatcctaattttaactataacaacaacagctattttatgtgctaatgaatatgtagttattacaaataaaaacctaaatattgacttacttactcaactacaggtaaaggcaatatttctaaagaagaacctcatcgtaaatgataaaaagatggttcccataaatctgcttgcatcagatcagatacgagcctcttttgaaaaaaatattcttcacatgtcaagatcaagactaaaatctttttggacaaaagagcactaccaaggacagcgtgcacctctaaatatgaaatctagcagaagtgtcatagcctttgttaaaaaaatagatggagctatcggctatgtaccacttagtgatgcagatgattctataaaaacagtatataaatggagtgaataa

SEQ ID NO: 8854 - protein, 136 aa, Unknown
  Obtained from environmental sample
  SIGNAL (1)...(17)
  misc_feature (1)..(136): Xaa is any amino acid
MMKILILTITTTAILCANEYVVITNKNLNIDLLTQLQVKAIFLKKNLIVNDKKMVPINLLASDQIRASFEKNILHMSRSRLKSFWTKEHYQGQRAPLNMKSSRSVIAFVKKIDGAIGYVPLSDADDSIKTVYKWSE

SEQ ID NO: 8855 - DNA, 450 bp, Unknown
  Obtained from environmental sample
  misc_feature (1)..(450): n is a, c, g, or t
atggctaaagttctaatagtagatgatgaggcgatgaatagaaaagtagcttcaaagattttacataaagagggttttgaaaccatagaggcgtgtgatggaaatgaggcgttagagattttaaaagagcagagagtcgatctgattttaatggatttgatgatgcctaacatggatggatttgaagcaactcacattatcaaatcagatgagaagctctcttccatccctcttatcataatctccgcactatcagataaaaactccattacaaagggtttggagcttggtgcaaatgagtacctgactaaaccttttgatcttgttgagtttcgtcttcgcataaaanatggtgtaaaactaggagagtatcaaaactttttaaagataacgaggcatttttaccaacagcagttgacgataaaactgcaaaactctcactcgcactaa

SEQ ID NO: 8856 - protein, 149 aa, Unknown
  Obtained from environmental sample
  DOMAIN (2)...(123): Response regulator receiver domain
  misc_feature (1)..(149): Xaa is any amino acid
MAKVLIVDDEAMNRKVASKILHKEGFETIEACDGNEALEILKEQRVDLILMDLMMPNMDGFEATHIIKSDEKLSSIPLIIISALSDKNSITKGLELGANEYLTKPFDLVEFRLRIKXGVKLGEYQNFLKITRHFYQQQLTIKLQNSHSH

SEQ ID NO: 8857 - DNA, 693 bp, Unknown
  Obtained from environmental sample
  misc_feature (1)..(693): n is a, c, g, or t
atgagtttaggcaaaacatacgatatcaaaagagccacatcagtgatatcaggaagctttgaagatatcaattataaaatagatgtaaatacatacgaaagaacacaagtagatacactagagctaaatgatattgcatcttgtaagatgttactaactcgtccaattgcagtagactcatataaagacaatcgtcttacaggaagttttataatagtagatagaatcacaaacgatactgtaggtgctggtatgattgtagatgtttctaaaagagaaacagacaagattaaagacgaaaatatatttaacatatggaatgataaaaaacaaatcatacacaaagaggaacaatatataaaatttaatgaaagggatatattgtttttaagtgtaggtcaaaatattggatatgaacagtttggaaaaggtgaagagtatttaagaccggtattagtttataaaaagtttaacagtagaacatttttaggtattccattgtcctctaaacaaaaagatgggagttattacttttcgtttaattataaaaaagatataacaagcacagcaaatttttcacaaattaagactcttgatataaaaagagctaaatatagaagtggaacgattgatgaacaagatttcaaaaaattaagtgataagttaatacatttattaaaagttaccccttaa

SEQ ID NO: 8858 - protein, 230 aa, Unknown
  Obtained from environmental sample
  misc_feature (1)..(230): Xaa is any amino acid
MSLGKTYDIKRATSVISGSFEDINYKIDVNTYERTQVDTLELNDIASCKMLLTRPIAVDSYKDNRLTGSFIIVDRITNDTVGAGMIVDVSKRETDKIKDENIFNIWNDKKQIIHKEEQYIKFNERDILFLSVGQNIGYEQFGKGEEYLRPVLVYKKFNSRTFLGIPLSSKQKDGSYYFSFNYKKDITSTANFSQIKTLDIKRAKYRSGTIDEQDFKKLSDKLIHLLKVTP

SEQ ID NO: 8859 - DNA, 315 bp, Unknown
  Obtained from environmental sample
  misc_feature (1)..(315): n is a, c, g, or t
atgaaactgtcaaaacgtaaactaaaacgtgtatcaaattatatactgaaaaataaattttggcttacaattgtcctcttccttttttggatagttgtattagatcaaaacaatatttttcaattattgacttatgatagagatattaatgacttgaaaaatcaaaaagaatacctaaataataaaattattgaagactcaactaaattatatgaattaaggacggatgataaatctcttgaaaaatttgcaagagaagaatactttatgcacaaatctaatgaagaagtttttgttattaaagaagtcgaataa

SEQ ID NO: 8860 - protein, 104 aa, Unknown
  Obtained from environmental sample
  DOMAIN (19)...(103): Septum formation initiator
  misc_feature (1)..(104): Xaa is any amino acid
MKLSKRKLKRVSNYILKNKFWLTIVLFLFWIVVLDQNNIFQLLTYDRDINDLKNQKEYLNNKIIEDSTKLYELRTDDKSLEKFAREEYFMHKSNEEVFVIKEVE

SEQ ID NO: 8861 - DNA, 432 bp, Unknown
  Obtained from environmental sample
  misc_feature (1)..(432): n is a, c, g, or t
gtggacgctgggataaagtaccaaagatattgcagcgatagaacttgtacttcagcagtgaataaaagtttaacatttcatagaaaacaaaaatttaaaacaaagttagaacaaaaagtgtatgatgtagttttaaaagcacaacaaatagcaattagtaaagcaagagctggtatgaaagctagtcaaatagataaactcactcgtaatattatagaaaaagcagggtatggaaaatattttgtccatagtactggtcatggagtagggttagatatccatgaatatccaacaattaatagtagaaatgatgttattatagaaaataatatggtttttacaattgaaccaggtatctatcttggtgagcaatttggtgtgagaattgaagatacagttgttatgaaaaatggtcgtgcagagatcctctaa

SEQ ID NO: 8862 - protein, 143 aa, Unknown
  Obtained from environmental sample
  DOMAIN (2)...(143): metallopeptidase family M24
  misc_feature (1)..(143): Xaa is any amino acid
MDAGIKYQRYCSDRTCTSAVNKSLTFHRKQKFKTKLEQKVYDVVLKAQQIAISKARAGMKASQIDKLTRNIIEKAGYGKYFVHSTGHGVGLDIHEYPTINSRNDVIIENNMVFTIEPGIYLGEQFGVRIEDTVVMKNGRAEIL

SEQ ID NO: 8863 - DNA, 621 bp, Unknown
  Obtained from environmental sample
  misc_feature (1)..(621): n is a, c, g, or t
atgattgaaaatagaattattatttatagctttagtcaaatagcttctaaaatagctattactttacgagaaaaaaagtacaatgtgctgattgttgaagatgatgaagatttagcacaagaagcaaaaaaatctggatttgaaaccaaaacactctctctaatggaggatgaaaacattattgaacttggattagataaagatcatattaaagcttttttttgtttaggaaataataaaaatacaaatttatttatcacactaagtgttagaaacttaaataaagatataaaaataatctctttatcttctacaaaagaggataataaaactttacttcttgctggtgcaaataaaactataaacccttatgaaataggtgctcttagaatattcagatctcttcataaacctattattcaagatatactagataatattttatttagttcatcaaatatagaaattgcagagtttacaatacaaaaagattctatttttaatggtatttatctagaagatttaaaaaaaattcataaaaaaaatattataatccttggtattcaagataaagaacttagtgataaatttatctttttttccacagggattaacccataa

SEQ ID NO: 8864 - protein, 206 aa, Unknown
  Obtained from environmental sample
  DOMAIN (5)...(123): TrkA-N domain
  misc_feature (1)..(206): Xaa is any amino acid
MIENRIIIYSFSQIASKIAITLREKKYNVLIVEDDEDLAQEAKKSGFETKTLSLMEDENIIELGLDKDHIKAFFCLGNNKNTNLFITLSVRNLNKDIKIISLSSTKEDNKTLLLAGANKTINPYEIGALRIFRSLHKPIIQDILDNILFSSSNIEIAEFTIQKDSIFNGIYLEDLKKIHKKNIIILGIQDKELSDKFIFFSTGINP

SEQ ID NO: 8865 - DNA, 789 bp, Unknown
  Obtained from environmental sample
  misc_feature (1)..(789): n is a, c, g, or t
gtgattctaagtatttgtgatttaatgaggctaaatggtataggagaaaaaacagctttgttattgcttaaagctactgaaattaattcgatcagtgagcttaaggcaaatattagtggtgatataaacgttgctgctgaaaatctgtatcataaaataatgatatatcaagcaaataacaaagatagttcaaatacactgatttataagaacaaaatatatgatattttaaatcaggctactcaagttgatgccaatgatataaatgcagaaagtgatgttaaatctaattttcgtacttttataattgatcgagaaaaaaaatcatttgatttaacaaaatccttttatctaaagctaacattatcatttgtaatatttacactcatatcatatgcaatagtcttttcgatcaatattcatggaatttcacatataaggaatgttgaaggagtaactaagggattcatagattcgataatttggctttctatttatcctaacgtactaacatttcattattctcttgttatggtgggtattatgtttatattctttaaggttaacaatatatctactctaataattgataagtatctaatattaaaattatttaatcggtaccatgacataaaattctatagaaaaatatctgaatataaagtagattcctataaaaaatatcataatttagcaatattaatttttctatgtctcatggttatgataatttcacatatccgaaaaggaatgtccgtttatgaatttgttgaacttatcctcttttag

SEQ ID NO: 8866 - protein, 262 aa, Unknown
  Obtained from environmental sample
  misc_feature (1)..(262): Xaa is any amino acid
MILSICDLMRLNGIGEKTALLLLKATEINSISELKANISGDINVAAENLYHKIMIYQANNKDSSNTLIYKNKIYDILNQATQVDANDINAESDVKSNFRTFIIDREKKSFDLTKSFYLKLTLSFVIFTLISYAIVFSINIHGISHIRNVEGVTKGFIDSIIWLSIYPNVLTFHYSLVMVGIMFIFFKVNNISTLIIDKYLILKLFNRYHDIKFYRKISEYKVDSYKKYHNLAILIFLCLMVMIISHIRKGMSVYEFVELILF

SEQ ID NO: 8867 - DNA, 834 bp, Unknown
  Obtained from environmental sample
  misc_feature (1)..(834): n is a, c, g, or t
atgacagaacaaaaaatgcaattgccggaagactgggtgttaactactttaggtaaagcttttaaatgggggagtggaggcacgcctaaaaaaggcaaccctgcattttataatggtgacattccttggcttatcattgccgatcttaatgatgggtatgtttcagagtcaaaaactaatatcactgaattaggattaaatagtagctcggctaaattagtacctgaaaattcaattttattggcaatgtatggttcgattggaaagttaggtatttcaacgaaacccttggcaactaatcaagcgatagcattcacaactccaataagtgatgatcccaaatacctattttattatttaatgacagttaaaaataggttagcaaaactagggaagggagctacacaattaaatatcagtcaaacagtaattaaagcctttccctatgtaagagctcctctcgaacaacaaaaacaaatcgtagcgaaaattgaagagttgttttcgcatattgatgcggggattgaaagcctaaaaaccgccaaagaaaaactcaaacaatatcgtcaatccgttttaaaagccgccgtcaccggcgaactcaccaaagactggagggaagccaataaagacaatatcgaacccgccgaccaactgctaaaacgcatccaaaccgaacgccgccaacgctgggaacaacagcaactagaacaattccaagccaaaggcaaaccacccaaaaacgacaaatggaaagagaaatataaagagcctgaatttattgattcctcaatatctataaatggttggtgcttagtttctcttgaacaatag

SEQ ID NO: 8868 - protein, 277 aa, Unknown
  Obtained from environmental sample
  DOMAIN (12)...(169): Type I restriction modification DNA specificity domain
  misc_feature (1)..(277): Xaa is any amino acid
MTEQKMQLPEDWVLTTLGKAFKWGSGGTPKKGNPAFYNGDIPWLIIADLNDGYVSESKTNITELGLNSSSAKLVPENSILLAMYGSIGKLGISTKPLATNQAIAFTTPISDDPKYLFYYLMTVKNRLAKLGKGATQLNISQTVIKAFPYVRAPLEQQKQIVAKIEELFSHIDAGIESLKTAKEKLKQYRQSVLKAAVTGELTKDWREANKDNIEPADQLLKRIQTERRQRWEQQQLEQFQAKGKPPKNDKWKEKYKEPEFIDSSISINGWCLVSLEQ

SEQ ID NO: 8869 - DNA, 555 bp, Unknown
  Obtained from environmental sample
  misc_feature (1)..(555): n is a, c, g, or t
atgcccaaaattgatccgcagctcagaatcattgttgatatgcataattctaactggataaaaattttccttgttaggctcgatttacaatttccaatggaggagtcagagtattgggattgggataattatatttcaaccattgtggacgcgttgtcgacaatcaaacatagtggtgctctaatcacattgcgtgaacatgttttacaggtttacgatgacatcccatctaaatttggtaatcttctagtaatgcaagcaatttcctattcttatttgtttgccgaaccatcagttaaaaagcaaggtattgatgaggcgagaaaaatactcgtttcagcaaaaaaacaaatagatgataacaatataatttcagatgctcagcgagaatatcttatgattttcaatttcaaatcggtgctggttcttgctggtgaaactggttctaaaaatgatttcaagctagcatccatcagttttagtgcaattaagaattctatttcacggtccataataattgataaaatccctttgctgacattagaatgcaaatag

SEQ ID NO: 8870 - protein, 184 aa, Unknown
  Obtained from environmental sample
  misc_feature (1)..(184): Xaa is any amino acid
MPKIDPQLRIIVDMHNSNWIKIFLVRLDLQFPMEESEYWDWDNYISTIVDALSTIKHSGALITLREHVLQVYDDIPSKFGNLLVMQAISYSYLFAEPSVKKQGIDEARKILVSAKKQIDDNNIISDAQREYLMIFNFKSVLVLAGETGSKNDFKLASISFSAIKNSISRSIIIDKIPLLTLECK

SEQ ID NO: 8871 - DNA, 873 bp, Unknown
  Obtained from environmental sample
  misc_feature (1)..(873): n is a, c, g, or t
ttgaatttatggagactttccatgaatagtacggttttagttgttgatgataactcggttaatatagatgtattggtagatcttttacataaatatgatgttgttcccgccattgatgctaaaagcgcgttacagatagttctagaagaggagatagatttaatcttattggatattatgatgcctgttatggatggatttgaagtttgtaaaatcttgaaaaatagcaaaaatagcaaaaacattccaataatttttttaagtgcaaaagagtctccatcggatattcaaagaggatttgacttaggtgcagttgattacataacaaaaccgtttaatccaagtgagcttttagcgcgtgtaaatacacatcttgaacttcgtgcatatcaaagaagcttgcaagataaagttgatgaagaggttgaaaaaaatagattaaaagaacaacaactctatcaaaaatcaaaacaagcggctattggtgaactggtaatgcatatagctcatcagtggaagcaacctctctcagaactaggatctattaatactctactttactgcaaaactaaaatcagatatacctatctccccagaaggagtatcttaagaccatttattccgttcagaaaagaattattgattttttttgaagggaaaccggtaaaatcccatttgaaaaaattttttccgttacctttccaaaaaataaaagggggaaattttttttttatatccctcaaaagggggaaaaaaaaagggttcctttttccaaatttaccaaggtggcctaacactttaagaatttttggaaaaaaaaatttggaaaagttaaaaaaattgaaaatttcccaccctgggaaaaagaggtaa

SEQ ID NO: 8872 - protein, 290 aa, Unknown
  Obtained from environmental sample
  DOMAIN (10)...(129): Response regulator receiver domain
  misc_feature (1)..(290): Xaa is any amino acid
MNLWRLSMNSTVLVVDDNSVNIDVLVDLLHKYDVVPAIDAKSALQIVLEEEIDLILLDIMMPVMDGFEVCKILKNSKNSKNIPIIFLSAKESPSDIQRGFDLGAVDYITKPFNPSELLARVNTHLELRAYQRSLQDKVDEEVEKNRLKEQQLYQKSKQAAIGELVMHIAHQWKQPLSELGSINTLLYCKTKIRYTYLPRRSILRPFIPFRKELLIFFEGKPVKSHLKKFFPLPFQKIKGGNFFFISLKRGKKKGFLFPNLPRWPNTLRIFGKKNLEKLKKLKISHPGKKR

SEQ ID NO: 8873 - DNA, 555 bp, Unknown
  Obtained from environmental sample
  misc_feature (1)..(555): n is a, c, g, or t
ttgatatttcttaaaatttataaggtaaattatttaatggaagataaaactaaaaaaagtgacgatatagttcctttaaaaaaagtaaataataaaaagaattatagacctaatgtagcggcaatagttttatcctcttcttatccctctacttgcgagatttttatagcttcacgaatagatgtggaagatgcatggcaatttccacaaggtggaatagacaaaggtgaaacacccaaagaggctttatacagagagttaaaagaagagatagggacaaatgatgtacaaattgtagcagaatttcctcaatgggttagttatgattttccgccagctgttgcttcaagaatggcaccttatgatggtcaaacacaaaagtactttttagtaaagttaagaaaaggtgcaaaaataaatattaaaacaaaaattccagaatttagtcaatataagtttgtacaaactgaaaagctacatgattatattacttttttcaaaagaactgtatataaaaaagtattaaaatattttaaaaaagagggttatatttaa

SEQ ID NO: 8874 - protein, 184 aa, Unknown
  Obtained from environmental sample
  DOMAIN (35)...(177): NUDIX domain
  misc_feature (1)..(184): Xaa is any amino acid
MIFLKIYKVNYLMEDKTKKSDDIVPLKKVNNKKNYRPNVAAIVLSSSYPSTCEIFIASRIDVEDAWQFPQGGIDKGETPKEALYRELKEEIGTNDVQIVAEFPQWVSYDFPPAVASRMAPYDGQTQKYFLVKLRKGAKINIKTKIPEFSQYKFVQTEKLHDYITFFKRTVYKKVLKYFKKEGYI

SEQ ID NO: 8875 - DNA, 516 bp, Unknown
  Obtained from environmental sample
  misc_feature (1)..(516): n is a, c, g, or t
gtgatcatcaaagatttacctatagaccatattagtgcttatagtcttactatagaggaggggactaaattttttaataaaagtaatgtacaagtagaaaatatagaattagctcaatacctctttgatcaattaaactctttgggattcaatcaatatgagatatctaattttgctttaaataataaagctagaagtaaacacaaccttggatattggcaatataaagagtatttaggagttggaagtggagctgttggttgtatcgatgcccaaagactatattcatcaaaagatattcaaaaatatatagataatccacttcaatacgaagaggtagaaaaattatcatcagaagatattgcaatagaaaaaactcttctgggatttcgcagtattgtaggtgttacaatatcattgttcaataatgaacaaaaaaagaaacttaatgatttagtaaaagaaaaaaagttaatacaaaaaggaaacagagtctattcaaataattttatttag

SEQ ID NO: 8876 - protein, 171 aa, Unknown
  Obtained from environmental sample
  DOMAIN (70)...(165): HemN C-terminal region
  misc_feature (1)..(171): Xaa is any amino acid
MIIKDLPIDHISAYSLTIEEGTKFFNKSNVQVENIELAQYLFDQLNSLGFNQYEISNFALNNKARSKHNLGYWQYKEYLGVGSGAVGCIDAQRLYSSKDIQKYIDNPLQYEEVEKLSSEDIAIEKTLLGFRSIVGVTISLFNNEQKKKLNDLVKEKKLIQKGNRVYSNNFI

SEQ ID NO: 8877 - DNA, 351 bp, Unknown
  Obtained from environmental sample
  misc_feature (1)..(351): n is a, c, g, or t
atgctcgcgggtaccaaaaccaagtctaaggttaaatacacgctggaagttataaactctttcagattgaagaatcaattctttagcgtcaatattgtttccggtaatagcattaaagatctctatgtagttttctctatgctcaggaacttttgctggttcagcttgttcgccattgttagccggttcaatatcgttccagggaagtttacacaagccttgaagaccgaaccaggtacggaacattgggaagtagtgaagagcttcagctttatctgcaaatgtaggaatctggttattaaccatatccataaagataagccaggcttcatcatgctgggcaccctttaa

SEQ ID NO: 8878 - protein, 116 aa, Unknown
  Obtained from environmental sample
  misc_feature (1)..(116): Xaa is any amino acid
MLAGTKTKSKVKYTLEVINSFRLKNQFFSVNIVSGNSIKDLYVVFSMLRNFCWFSLFAIVSRFNIVPGKFTQALKTEPGTEHWEVVKSFSFICKCRNLVINHIHKDKPGFIMLGTL

SEQ ID NO: 8879 - DNA, 402 bp, Unknown
  Obtained from environmental sample
  misc_feature (1)..(402): n is a, c, g, or t
atgagaatggtggatggtgattttccggattataagagagtaatacccgataaaggtaataatgcagcgattataaataaaaacttatttttacacgctttaaaaagaatatctattttatcaagtgaaaaatctaaaggagttaaaataaatttaaaaaatgattcactaactcttacctcttcaaaccctgatttaggtgatgcaaaagaagaaatagatataatttatagtggtgatgatatttcgataggattcaatgcaaaatatataatagaaatattacaggttataaaaaatgaaaatataatttttaacttgaaagataatatttcaccaggaagaataaatccagaaggagatgaagatcatctttcggttataatgcctatgcgtttataa

SEQ ID NO: 8880 - protein, 133 aa, Unknown
  Obtained from environmental sample
  DOMAIN (12)...(132): DNA polymerase III beta subunit, C-terminal domain
  misc_feature (1)..(133): Xaa is any amino acid
MRMVDGDFPDYKRVIPDKGNNAAIINKNLFLHALKRISILSSEKSKGVKINLKNDSLTLTSSNPDLGDAKEEIDIIYSGDDISIGFNAKYIIEILQVIKNENIIFNLKDNISPGRINPEGDEDHLSVIMPMRL

SEQ ID NO: 8881 - DNA, 738 bp, Unknown
  Obtained from environmental sample
  misc_feature (1)..(738): n is a, c, g, or t
atgtttgtgtgcagcagtcgcgagattgcttaccgcttctggcaggaagtaatcgcgctgcgcccgcagtggaatgaggttctgattgctgaagaaggcagcgaactgagtgagcaggaacgcaaagagatcaagccgatggaacggatcaagatgatcatgacccgcggtaaagatgacccgaaagagctctatgagatgctcggcaccaaagaataccgtaaagaactggaccgtcagtttaagaatgccaaatccaactttaaaatcgccattgtggtggatatgtggctcaccggctttgatgtacccttcctcgataccatttatgtcgataaaccgattcagcgccataacctgatccagaccatctcaagggtaaaccgtaagtttgaaggcaaagaaaaaggcctggtggtcgattacatcggaatcaaaaaacagatgaatatggcgctggcacactacaataaagccgaccagcagaattttgaagagattgctcagtctgtggttgtggtgaaagatcacctcgatttactgggtaaaatcttccacaaattcgatatcaggccttactttaacggaactcctctggagcagcttaattgcctgaatatggcggcggagtttgtgcagattaccgacaagatcgaaaagcgttttatggcgctggtaaaacgtttaaaagccgcctttcgatatttgcagtggctccgaatccattactcaggatga

SEQ ID NO: 8882 - protein, 245 aa, Unknown
  Obtained from environmental sample
  misc_feature (1)..(245): Xaa is any amino acid
MFVCSSREIAYRFWQEVIALRPQWNEVLIAEEGSELSEQERKEIKPMERIKMIMTRGKDDPKELYEMLGTKEYRKELDRQFKNAKSNFKIAIVVDMWLTGFDVPFLDTIYVDKPIQRHNLIQTISRVNRKFEGKEKGLVVDYIGIKKQMNMALAHYNKADQQNFEEIAQSVVVVKDHLDLLGKIFHKFDIRPYFNGTPLEQLNCLNMAAEFVQITDKIEKRFMALVKRLKAAFRYLQWLRIHYSG

SEQ ID NO: 8883 - DNA, 513 bp, Unknown
  Obtained from environmental sample
  misc_feature (1)..(513): n is a, c, g, or t
ttggtgtttttaattacaccgggaggtttttggggaggtagttcttctacttttggaggtactaaagaggaagaaagtaaaagtattttgttagaacctaatgaagccttaaaaattgcagggtttacaaaaagctatgggaacggtcttgaagatgtaatgcttattgaaattgatactgttgttgctaatcatcaatttactttagatactataaatgattttatgcctttaaaaatagatgacttaacttcttggaagcctgactctgaaaaaaaagtgcttatttttcctaacccttctacttcttttgccaactttgatatatctaaaattaaagcggaaaaaatactaattacaactatttttggacaaactgtatatgaagcaaatatctcaaataaagaattattgcaaattaattttgaaaaattttcagcaggaatttatagtgtgcaattttatagtaaaaacaagcttattgaagcacaaaaattaattattagcaattaa

SEQ ID NO: 8884 - protein, 170 aa, Unknown
  Obtained from environmental sample
  misc_feature (1)..(170): Xaa is any amino acid
MVFLITPGGFWGGSSSTFGGTKEEESKSILLEPNEALKIAGFTKSYGNGLEDVMLIEIDTVVANHQFTLDTINDFMPLKIDDLTSWKPDSEKKVLIFPNPSTSFANFDISKIKAEKILITTIFGQTVYEANISNKELLQINFEKFSAGIYSVQFYSKNKLIEAQKLIISN

SEQ ID NO: 8885 - DNA, 399 bp, Unknown
  Obtained from environmental sample
  misc_feature (1)..(399): n is a, c, g, or t
ttgattccaacactaagtgtaaaagacaatatacttttacctctagtaccaacaaatccagatgaaaaagaagcacttaataaattaaatcaagtgatggaaaaatttgatataagccataaacaaaatatgattgtaagaaatttatcaggaggggagcaacaaagagttgcaatagcaagagctcatataaatgatccaaaaattataattgcagatgagccaactgcaaatcttgatgaaaaactttcacttaattttatagagattttacgaaaattaaaacaatcaaataaaacaattattgtagctactcacgatcctttgttttttaatcttgattttgtagataaaattatagagataaaaaatggtactattggagatatacacgaatga

SEQ ID NO: 8886 - protein, 132 aa, Unknown
  Obtained from environmental sample
  DOMAIN (1)...(125): ABC transporter
  misc_feature (1)..(132): Xaa is any amino acid
MIPTLSVKDNILLPLVPTNPDEKEALNKLNQVMEKFDISHKQNMIVRNLSGGEQQRVAIARAHINDPKIIIADEPTANLDEKLSLNFIEILRKLKQSNKTIIVATHDPLFFNLDFVDKIIEIKNGTIGDIHE

SEQ ID NO: 8887 - DNA, 783 bp, Unknown
  Obtained from environmental sample
  misc_feature (1)..(783): n is a, c, g, or t
atgagctttgatctaaattttgaacaactgcaacaaaaactaaaaaaggtactaaacccctctcgattcagatttgtaattatcttatacccaaatacaaatatgataaaagagattaaagatcacatatctaaaacctacccaaaaagtttagtgactgacttaaagctcaaaggtaaatcatatcaagatatctcaaatgaactatataaaaacaatgagggttttatttacatagataattttgaagagattttaaacaatcctgatctatataacggcttcaaccaaagacgagatagaatcgcttcacataacatcaaccttatctgctttatctctctatatcaaaaagaggaactcttcacaaaagcactaaatgtcatccctgatctctgggagtttaaaaacactgttttagaactgcaaaaagatgaaaaaagtgatgcactagcaggtgtgaaaatttcagagtcatcttcttacagctccataggcggactcacaacaaaagataaaaaagtagagcttgagaggttactgaaaaaactagaagttactgaaagtagtgaactgaaattaaatcttctttaccaaatagctacaatttatagagatattggagattataaaaaagccttagaatttcaactaaaagagttagaaataagagaaaaagtattaggagataaaaatcctgatttagcaaaaaactataataatatctctacgatttaccgagttattggagagttagacagagcccttagaattttcacttaa

SEQ ID NO: 8888 - protein, 260 aa, Unknown
  Obtained from environmental sample
  misc_feature (1)..(260): Xaa is any amino acid
MSFDLNFEQLQQKLKKVLNPSRFRFVIILYPNTNMIKEIKDHISKTYPKSLVTDLKLKGKSYQDISNELYKNNEGFIYIDNFEEILNNPDLYNGFNQRRDRIASHNINLICFISLYQKEELFTKALNVIPDLWEFKNTVLELQKDEKSDALAGVKISESSSYSSIGGLTTKDKKVELERLLKKLEVTESSELKLNLLYQIATIYRDIGDYKKALEFQLKELEIREKVLGDKNPDLAKNYNNISTIYRVIGELDRALRIFT

SEQ ID NO: 8889 - DNA, 954 bp, Unknown
  Obtained from environmental sample
  misc_feature (1)..(954): n is a, c, g, or t
ttgagaaggttggggatctctcttcaaatattaacttttttaaaccccagaatttcactcgatttcaactctttagatatctcatcttatccatcttatgatgagctctacggggcactatcaaaaaaatacggtgtttcatttgagatgatggaattttttaacggtggaagttcggctatcttttcactattttctcatctgaaactgcaaaagtgtgttatctactctcctgcttatttggagtataaaaaagctgcgcatatttttggctatgagactcagcttataaatcgatttaaaaatatttatgagtcggttgagaaaagctctctggttatttttgtaaatccatctactcctgatgggaaggtttatgatattgaggcactttttaagagttgggtagaggcagatgcaactgttttagtggatgaatcttttttagattttacgccacatgagagtgttacaaagtatctaaaagagtatgagaaactctacatattaaaatcactcacaaagttttactcttcagcgggtatcagagtagggctgatactctcaaatgaaaaaaatatagcaactattaaaaaaagtgagccactatggaaaatatctcagtttgactcttactacattcaagaggctctaaaagatagtgagtttgaaaagataactaaaagtgtgacagatgaaaatagagagtatttggttagtgaacttttttctcatgaagttgtagaaaaagtgcatgagagttgtgcgaactacatcttaataaaactaaaaaatatgagcgcccaaaaactccaagagatcttaaatgaagagaaaatcatgataagagattgctctaactttgattttttagatgagtctcatgtgagagttgcggtaaaaagcaaagagagcatagataaatttttaagagtgttagagggctgtaagtga

SEQ ID NO: 8890 - protein, 317 aa, Unknown
  Obtained from environmental sample
  DOMAIN (42)...(317): Aminotransferase class I and II
  misc_feature (1)..(317): Xaa is any amino acid
MRRLGISLQILTFLNPRISLDFNSLDISSYPSYDELYGALSKKYGVSFEMMEFFNGGSSAIFSLFSHLKLQKCVIYSPAYLEYKKAAHIFGYETQLINRFKNIYESVEKSSLVIFVNPSTPDGKVYDIEALFKSWVEADATVLVDESFLDFTPHESVTKYLKEYEKLYILKSLTKFYSSAGIRVGLILSNEKNIATIKKSEPLWKISQFDSYYIQEALKDSEFEKITKSVTDENREYLVSELFSHEVVEKVHESCANYILIKLKNMSAQKLQEILNEEKIMIRDCSNFDFLDESHVRVAVKSKESIDKFLRVLEGCK

SEQ ID NO: 8891 - DNA, 801 bp, Unknown
  Obtained from environmental sample
  misc_feature (1)..(801): n is a, c, g, or t
ttgtatctttttcccggtgaaaacataacaatggaaaaatttcggaccaagctgggaattgcaggtatagacagtgtaaatagaattgctgaagagatggcaaggggtaatactcgggaagtacttgaacttactgatgaagctctaatgggtggtgtttcaatagaccagttaattattgattttacaagttatttcaggagtattctttttcttaaacataatatactaaaggaatccttgctgggatctaatccttcaatattttctaaagaagttatatcagcatttacagtttcccagatagaacaggcaattgaattactttttaagctttataaggatatcaggttttcgcttaaccagagatttgaactggaacttatttttagccgcttatcatctttaaagacatatatctcgccaaatgaaatttttaacaggatagagggcattaaaacagaacttaagaatggatctatttctgttgagcaaaagcctcaagctgtagagagcaaatctgaaggattatctgcagagattattgcaagtattattcaatctatacggaaaaataaacttgctctggcctctgctttggaaaaggctacttcctggaaattaaatggaactaatcttcaattatcttttgattccacatattcagggaatgcagttaagggagatattctaataattaaaaaagaagcctcggagatattaaataagaaaattaacattgaagtttctatagaaaatccttcatccagcggaagttcagataaggtggatgaagattag

SEQ ID NO: 8892 - protein, 266 aa, Unknown
  Obtained from environmental sample
  misc_feature (1)..(266): Xaa is any amino acid
MYLFPGENITMEKFRTKLGIAGIDSVNRIAEEMARGNTREVLELTDEALMGGVSIDQLIIDFTSYFRSILFLKHNILKESLLGSNPSIFSKEVISAFTVSQIEQAIELLFKLYKDIRFSLNQRFELELIFSRLSSLKTYISPNEIFNRIEGIKTELKNGSISVEQKPQAVESKSEGLSAEIIASIIQSIRKNKLALASALEKATSWKLNGTNLQLSFDSTYSGNAVKGDILIIKKEASEILNKKINIEVSIENPSSSGSSDKVDED

SEQ ID NO: 8893 - DNA, 876 bp, Unknown
  Obtained from environmental sample
  misc_feature (1)..(876): n is a, c, g, or t
atgatagtnggcgattccctgcgtttaggtcaagtgctcataaactttcttggaaactctgtaaaattcacaatggatggcgaagtcagactccatgttaagcaagttgctaattttgctgacacaatgactttagagtttattgtaacagacacggggattggtatgacgcaaaagcaaattgaaaacgcttttacatcatacaatcaagcagatgtctcaacgtcaagaaaatttggaggaacggggctgggactctctatatcaaaacaacttgtagagatgatgcatggtaaaattaaactcagcagtcaaaaagacgagggaaccacatttaacttcactataccctttcaaattccaaatgtacaaaacaaacgacactatcgacttccttcaaagtcacttttaaacaaacgcatacttattgtagattcatcaaaatacaacacgctttctttaacaaaagctttctcttactttaactataaatgtcacattattcctgcgtttgaagaggcgctattagagtatgcgatgcattttcatattatcattattcatcaggatagactctcaagatttgctataaaaaagatacacgacctaaagaaaaatgctattggagatacaaaagttgttctccttaacgagcttcatagccgttttcattcagaacttattgatactataaaaattgatgcttattttaaaacgcccttcacgcaacaaagcatactgaagcttattatagacctctatgcttcaccgaatcttgatgcgcactctagaaaaaagagtctaaaagataaactaatagaactcactccaaaaaaagttcttgttgccgaagacaatcttttaatcacaaagtaa

SEQ ID NO: 8894 - protein, 291 aa, Unknown
  Obtained from environmental sample
  DOMAIN (4)...(119): Histidine kinase-, DNA gyrase B-, and HSP90-like ATPase
  misc_feature (1)..(291): Xaa is any amino acid
MIVGDSLRLGQVLINFLGNSVKFTMDGEVRLHVKQVANFADTMTLEFIVTDTGIGMTQKQIENAFTSYNQADVSTSRKFGGTGLGLSISKQLVEMMHGKIKLSSQKDEGTTFNFTIPFQIPNVQNKRHYRLPSKSLLNKRILIVDSSKYNTLSLTKAFSYFNYKCHIIPAFEEALLEYAMHFHIIIIHQDRLSRFAIKKIHDLKKNAIGDTKVVLLNELHSRFHSELIDTIKIDAYFKTPFTQQSILKLIIDLYASPNLDAHSRKKSLKDKLIELTPKKVLVAEDNLLITK

SEQ ID NO: 8895 - DNA, 819 bp, Unknown
  Obtained from environmental sample
  misc_feature (1)..(819): n is a, c, g, or t
atgagaaaagagaatgagtactatgccaataaggatttaatctccaatgaaaaaataaaacagatagaactctcacttgaaagtaaagataagtttttatctcacagcagtcatgaacttcgcacgccaatgacagcaatacttgggcttacgcatttagttcttgaaaatgatcttcctaagtttcaaagggagtatatagaaaaaatacagttatcggctgaacatcttgtaaacattgttaatgatattttagacatctctaaaattgaagctggaaaattaaaacttgaacaagcagagtttaatatcaatgaaactctcgattatgtcttaaatatcatctccattcaagccaaaaaaaatggtgtaaaaattaaacttgaagttgatgatgatgttccttcaatgatagttggcgattccctgcgtttaggtcaagtgctcataaaccttcttggaaactctgtaaaattcacaatggatggcgaagtcagactccatgttaagcaagttgctaattttgctgacacaatgactttagagtttattgtaacagacacggggattggtatgacgcanaagcaaattgaaaacgcttttacatcatacaatcaagcagatgtctcaacgtcaagaaaatttggaggaacggggctgggactctctatatcanaacaacttgtagagatgatgcatggtaaaattaaactcagcagtcaaaaagacgagggaaacacatttaacttcactataccctttcaattccaaatgtacaaaacaaacgacactatcgacttccttcaagtcactttttaa

SEQ ID NO: 8896 - protein, 272 aa, Unknown
  Obtained from environmental sample
  DOMAIN (28)...(93): His Kinase A (phosphoacceptor) domain
  misc_feature (1)..(272): Xaa is any amino acid
MRKENEYYANKDLISNEKIKQIELSLESKDKFLSHSSHELRTPMTAILGLTHLVLENDLPKFQREYIEKIQLSAEHLVNIVNDILDISKIEAGKLKLEQAEFNINETLDYVLNIISIQAKKNGVKIKLEVDDDVPSMIVGDSLRLGQVLINLLGNSVKFTMDGEVRLHVKQVANFADTMTLEFIVTDTGIGMTXKQIENAFTSYNQADVSTSRKFGGTGLGLSISXQLVEMMHGKIKLSSQKDEGNTFNFTIPFQFQMYKTNDTIDFLQVTF

SEQ ID NO: 8897 - DNA, 672 bp, Unknown
  Obtained from environmental sample
  misc_feature (1)..(672): n is a, c, g, or t
ttgctctatccgaagagaaaggatgaagcggaaatcatttacagtgaaatctcacatgtagacagcttaatagacaactttaaaaatccaaatagaaaccctcaaatagcgataagcgtagatatgcttgacactggaatagatgtaccggagatattaaacctcgtcttttttaaacctataaaatcaaaaattaaattttggcagatgataggcagaggaacgagactttgtcctaatctacttggagagaacaaagataaacagagttttaatatatttgatttttgtgccaatttttcatattttgacattcatgctaaaggcttgccatctcaaaaaagcagttctttaaaagagagactttttttaaaaagagtgggaattcttaaaattatgaaaaaaagtgatttacatgatgagatgcttatgattgtaaaatcacaagtgtatgcactagattcaagtgagtataatctaaaaaaacataggcatattatagaagagttacaaagtagtgatttagagtatattacagatgatgtttacaataatttaaagggttgtgccgaatatatcgaagatgaaatcaattttgaagtttcaagatttcagatgcttatttttgatgcacaagaggcaattttaaaagacaaagagaataaagcataa

SEQ ID NO: 8898 - protein, 223 aa, Unknown
  Obtained from environmental sample
  DOMAIN (2)...(78): Helicase conserved C-terminal domain
  misc_feature (1)..(223): Xaa is any amino acid
MLYPKRKDEAEIIYSEISHVDSLIDNFKNPNRNPQIAISVDMLDTGIDVPEILNLVFFKPIKSKIKFWQMIGRGTRLCPNLLGENKDKQSFNIFDFCANFSYFDIHAKGLPSQKSSSLKERLFLKRVGILKIMKKSDLHDEMLMIVKSQVYALDSSEYNLKKHRHIIEELQSSDLEYITDDVYNNLKGCAEYIEDEINFEVSRFQMLIFDAQEAILKDKENKA

SEQ ID NO: 8899 - DNA, 468 bp, Unknown
  Obtained from environmental sample
  misc_feature (1)..(468): n is a, c, g, or t
ttggatgagtatattgaagcattgcgagttataaaagagcttgaaagtacgaatctcataactgatgatgatataagtgaaatcaagtatcatgtttttgatcttgaaaaaatagttgaagataagatgaacagcaatgacgattttaatcttttgattcatgatattcttaaaagttctaaaaaagaagtagctaacaaaatacttgataatttcatatcttccggtagttatacgcaaaagcaaatagaacttatcaataaaattaaaaatatactgtttggcaaaaagtatgcaaacattcatgactctttgataaatgtaaaagaggtattgtttagtgatattcatccattggcgaatgattttggatatttaagtgagcaagaacaaaatgatattttcaatgttattcatttgatagatagagttgatgatagtgcaaatacttctctctacgtaacatga

SEQ ID NO: 8900 - protein, 155 aa, Unknown
  Obtained from environmental sample
  misc_feature (1)..(155): Xaa is any amino acid
MDEYIEALRVIKELESTNLITDDDISEIKYHVFDLEKIVEDKMNSNDDFNLLIHDILKSSKKEVANKILDNFISSGSYTQKQIELINKIKNILFGKKYANIHDSLINVKEVLFSDIHPLANDFGYLSEQEQNDIFNVIHLIDRVDDSANTSLYVT

SEQ ID NO: 8901 - DNA, 795 bp, Unknown
  Obtained from environmental sample
  misc_feature (1)..(795): n is a, c, g, or t
ttgccttatgtaaatattgggaattttgggggaagttgtttggtatctaaatacaaagcatcccttgatagacaattcaaaattatagactatctagtacatcaaaatatagaaaaactagtatgtttatcaagtgtagatggatgtagaatagcatttggtataggaatacctatagtaaacttttatgacataccactttctgaccataaggaaaatttcaaaaaagctatacctcaagcaaggttaacaataccaatagcaactaaaatgtttaaaccctttgtagtaccaaatgatgttattagaagatttggtcttgatgaggaacaaatctttgactataattttattgatcctcttatttggttaaataactttaagtatgatgaggattatgtgaaagaatctttagcttcttataatattaattatacaaaaaaaacaattgtaataagagaagaagagtataagtcaagttatgtagataagaaataccctttcctttatgaagctttagaggagcttcataatacacttaatgcgaatataattattatcccaagatatgaaagtgcttatctaaaaaaagagtttccttttgcaattattttagaagagaaaataaaaatacaacacctgttaaaatatgcagacctttttattggtggtggaggtactcttaatacggaagcttgtttcttagggacacctactatctctacgagaagttttatttgtcactatgacaaatggcaaatagataatgaacttatggtttgggtacaaaaataa

SEQ ID NO: 8902 - protein, 264 aa, Unknown
  Obtained from environmental sample
  DOMAIN (1)...(264): Protein of unknown function (DUF354)
  misc_feature (1)..(264): Xaa is any amino acid
MPYVNIGNFGGSCLVSKYKASLDRQFKIIDYLVHQNIEKLVCLSSVDGCRIAFGIGIPIVNFYDIPLSDHKENFKKAIPQARLTIPIATKMFKPFVVPNDVIRRFGLDEEQIFDYNFIDPLIWLNNFKYDEDYVKESLASYNINYTKKTIVIREEEYKSSYVDKKYPFLYEALEELHNTLNANIIIIPRYESAYLKKEFPFAIILEEKIKIQHLLKYADLFIGGGGTLNTEACFLGTPTISTRSFICHYDKWQIDNELMVWVQK

SEQ ID NO: 8903 - DNA, 762 bp, Unknown
  Obtained from environmental sample
  misc_feature (1)..(762): n is a, c, g, or t
ttggatgagccatcgttggattatatttctaagtataagccagatattgtagttaaaggaaaagaacatgaaaataaagataatccagaactcgaaatcatcaataattatgggggaaagttactttttagttcgggagagattgcattttcatcaattgatcttttaaaagaggagtttttaaatacgaactacaaagtaaatcacaatcaaaagtatttcaatagacataattttgatttgatagatctaaaaagaatcgtagaaaaatttgcaaaactcaatgttttgattataggggatactattgttgatgagtatatcacttgtgaacctttaggtatgagtcaagaagaccctactatagttgtaagtccattggtccatgataagtttataggaggggcagccatagtggcaagtcatgcgaaaactttaggagcaaatgtaaaatttatctctgtaataggagatgatgaaaaccatacctttgttaaaaataatttagaaaaactcaatatagatttatctttatatgtagatagtacgagaccaactaccttaaaacaaagatttcgagctaaaaataaaacactattaagagtaaatcatctgaaacaacatgggataagtaaagatatacaaaatgatataatacaaaatattgaaaaggatataaaagatatagacttgattatattttctgattttagttatgggtgttttaactcactctcttatagaaaacatttcaccaactag

SEQ ID NO: 8904 - protein, 253 aa, Unknown
  Obtained from environmental sample
  misc_feature (1)..(253): Xaa is any amino acid
MDEPSLDYISKYKPDIVVKGKEHENKDNPELEIINNYGGKLLFSSGEIAFSSIDLLKEEFLNTNYKVNHNQKYFNRHNFDLIDLKRIVEKFAKLNVLIIGDTIVDEYITCEPLGMSQEDPTIVVSPLVHDKFIGGAAIVASHAKTLGANVKFISVIGDDENHTFVKNNLEKLNIDLSLYVDSTRPTTLKQRFRAKNKTLLRVNHLKQHGISKDIQNDIIQNIEKDIKDIDLIIFSDFSYGCFNSLSYRKHFTN

SEQ ID NO: 8905 - DNA, 849 bp, Unknown
  Obtained from environmental sample
  misc_feature (1)..(849): n is a, c, g, or t
atgtgccaggaccacatcaaaaaagacaatgaactcttaaagatcaataagaccctgaatgatcttgtcgttttttccaaaacagaccgaaaagggcgcatcctctatgtcagccatgctctggtagaactcagcgggttctcacgcgacgaacttatcggaaaagagtacaaagacttagcgcacgaagacatgaacgacctgactttcaacagtatgtggactcaagtcttctctaaaaacacctgggaaggcgaaatacacaataaacgcaaagacaatagctcctattgggtgagaatgacgctcatccctgaccttgatgagaaaggcgagatcaccggttttagcgcctacgccgaagatatcactgataacaaggcgcttaaacacgaaaaagagaaaacacaacaggcactggagtttaaaagccagttcctctccaacatgtcacatgagatccgcacacccctcaacgggatcatcggctttagctatatggcacttaagaccgatttgaatgcacggcaaaaagatatcatgcagaagatacgttctacctccaacatcctgctgggtgtcatcaacgatattctggacatatccaagatagaagcgggcaagatggagatcgagacaagagcgttcaaccttcgctacctgatcgaaaacctggaaggtatcttttcagaaaaagccaacgaaaaaggcatctcacttgtcataagctatgaagacatctcgacttacgactttgccggagatgaacaaagactctctccaatactgatcaatctgctcaataccgccctcagtttacacaccggggcgtcgtccacttgcgcataa

SEQ ID NO: 8906 - protein, 282 aa, Unknown
  Obtained from environmental sample
  DOMAIN (13)...(75): PAS domain
  misc_feature (1)..(282): Xaa is any amino acid
MCQDHIKKDNELLKINKTLNDLVVFSKTDRKGRILYVSHALVELSGFSRDELIGKEYKDLAHEDMNDLTFNSMWTQVFSKNTWEGEIHNKRKDNSSYWVRMTLIPDLDEKGEITGFSAYAEDITDNKALKHEKEKTQQALEFKSQFLSNMSHEIRTPLNGIIGFSYMALKTDLNARQKDIMQKIRSTSNILLGVINDILDISKIEAGKMEIETRAFNLRYLIENLEGIFSEKANEKGISLVISYEDISTYDFAGDEQRLSPILINLLNTALSLHTGASSTCA

SEQ ID NO: 8907 - DNA, 552 bp, Unknown
  Obtained from environmental sample
  misc_feature (1)..(552): n is a, c, g, or t
ttgttgaaactaaactttattgttatgctaaaaaaaataggtcttgcattgtttgctattttcgtaattattcaattttttagaattgataaaaccaatcctgaagttattgctgaaaatgattttttatatgtcgttggagcttctgatgatgttgctcaaattattaaaacttcttgttatgattgtcattctaacactacccaatatccttggtatagtaatgttgctcctatttcttggtggctaaaagaccatattaatgaagcaagaaaagaacttaatttttctgaatgggaaacttttgaacataagcgtaaactaaaaaaactaaaagaagctgccgaagagttagaggaaaaagaaatgcctttaacatcttataccattactcatggcgatgctaaattatcccgacaacaaagagaattactaatcaattggtttaaagaacatttaacttattttgaagaaagagaaactactgctgaaagaaaaccgaaaagtgaccttaccttggataatggcaaaaaaatggattggctaatgtga

SEQ ID NO: 8908 - protein, 183 aa, Unknown
  Obtained from environmental sample
  misc_feature (1)..(183): Xaa is any amino acid
MLKLNFIVMLKKIGLALFAIFVIIQFFRIDKTNPEVIAENDFLYVVGASDDVAQIIKTSCYDCHSNTTQYPWYSNVAPISWWLKDHINEARKELNFSEWETFEHKRKLKKLKEAAEELEEKEMPLTSYTITHGDAKLSRQQRELLINWFKEHLTYFEERETTAERKPKSDLTLDNGKKMDWLM

SEQ ID NO: 8909 - DNA, 750 bp, Unknown
  Obtained from environmental sample
  misc_feature (1)..(750): n is a, c, g, or t
ttgtgctgtcaattgttttcgcaagaagcaacagtttttatagaagcagaggagcaagtgttgtttcaattggcgataaatgaaaaaaagcaaaccgaaacttatgtctctaaagttcaattaattgggctaaataaacagcaaaattataaactcactttcaattttaaagatgatacacttcagtataccactagcatttatataatggatgatggtgtttcgcaacattatgtgctgaaaaataataaattgaagttgctaaaagtgttgtttcctccacatcaacagcaagtagatagttcggtttttactatccaactaaaagaaaaaatagtagctgtaattcctgaaacaaaagatacaactgaaacggaaaaagactctttagctcaaaaagttccttttgatgattattaccgaatgcctgattatgaaggagaaattggttgtccgtggccacttaaagatgaggatttgaatgaggtgaaactaaaaattaataacttaagcattgacgatagaaaaatagatgtttatagcgattttagacaatcgacattagatttttgtattactatggaacagttaagaagcataataattttgtttgaatacgatgaatttaaaatggaaattgtaaaaaattcattcccatttgtttatgataaagataatatattacttttggaaaaagattttagttatcagaattcttatgagcaactaanaaaagaacttggcatttaa

SEQ ID NO: 8910 - protein, 249 aa, Unknown
  Obtained from environmental sample
  misc_feature (1)..(249): Xaa is any amino acid
MCCQLFSQEATVFIEAEEQVLFQLAINEKKQTETYVSKVQLIGLNKQQNYKLTFNFKDDTLQYTTSIYIMDDGVSQHYVLKNNKLKLLKVLFPPHQQQVDSSVFTIQLKEKIVAVIPETKDTTETEKDSLAQKVPFDDYYRMPDYEGEIGCPWPLKDEDLNEVKLKINNLSIDDRKIDVYSDFRQSTLDFCITMEQLRSIIILFEYDEFKMEIVKNSFPFVYDKDNILLLEKDFSYQNSYEQLXKELGI

SEQ ID NO: 8911 - DNA, 702 bp, Unknown
  Obtained from environmental sample
  misc_feature (1)..(702): n is a, c, g, or t
atgaacagtctgcatgaaaaccgcttcggttccgtcggtaagcctttgggtgatgcaaaattcaaactggccgaagatggggaattactcgttaagggttcggcggtcatgcgtggttattaccaagatgaaaaagcgaccgaagaggcgtttattgatggttggtttaagaccggtgatattgccagaattgatgacgagggatacatttacattgtcgatcgaaaaaaagagatcatcgtcacggctggtggaaaaaacattccaccacaaccactggaaaacagcctcaaactggataaatacatctctcaagcctatatccatggtgacaaaaaaccctacctgatcgcggttctaacccccaacctggagcgcttgattgagttcggccatgaaaaacatatcgattatctgggagtcgacgatctggtcgccaacgatctagtacagcaactatttgttgaacggatcgctcaattcaataagaaccttgctgcctatgaatcaatcaaaaaattcatcttgcttccgcgtgaattctccgcagaggggggagaattgaccccgacaatgaagctgaaacggaaagcgatctacaacacctataaagataaaatcgaacaactatatctgcacaatggcaacggccagaacgcccagccacaatctgaaaatggaggaaaaaatgaggcaaattaa

SEQ ID NO: 8912 - protein, 233 aa, Unknown
  Obtained from environmental sample
  misc_feature (1)..(233): Xaa is any amino acid
MNSLHENRFGSVGKPLGDAKFKLAEDGELLVKGSAVMRGYYQDEKATEEAFIDGWFKTGDIARIDDEGYIYIVDRKKEIIVTAGGKNIPPQPLENSLKLDKYISQAYIHGDKKPYLIAVLTPNLERLIEFGHEKHIDYLGVDDLVANDLVQQLFVERIAQFNKNLAAYESIKKFILLPREFSAEGGELTPTMKLKRKAIYNTYKDKIEQLYLHNGNGQNAQPQSENGGKNEAN

SEQ ID NO: 8913 - DNA, 393 bp, Unknown
  Obtained from environmental sample
  misc_feature (1)..(393): n is a, c, g, or t
atgaaagaaggaaaaacatcaataccatcatgggcctttgtcttgataggcgcaagcatgatggtctactcaaaattcatagaatcaaaagcagaacacacatcccttgcattctttttttatattggacttgccgtagttatcattggacttggaaaagttgctttgaaaatgaccagcaaaaaagaagaaaaaacagtgaagaaagaaaaacaaaattataatcaaaacttacaagaaaaactacgacaacaacaaatggcatggaacaaagatcaagaaagacaacaacaacaaacaggaagacaccaatacatcaaatgcgctcattgtggcacaccaaactacgccgaaagtgacttctgcggaaaatgcggtaaaagaatacgctaa

SEQ ID NO: 8914 - protein, 130 aa, Unknown
  Obtained from environmental sample
  misc_feature (1)..(130): Xaa is any amino acid
MKEGKTSIPSWAFVLIGASMMVYSKFIESKAEHTSLAFFFYIGLAVVIIGLGKVALKMTSKKEEKTVKKEKQNYNQNLQEKLRQQQMAWNKDQERQQQQTGRHQYIKCAHCGTPNYAESDFCGKCGKRIR

SEQ ID NO: 8915 - DNA, 336 bp, Unknown
  Obtained from environmental sample
  misc_feature (1)..(336): n is a, c, g, or t
atgaaggctctaattattgggtttgggtctatagggcaaagacattttaaaatattatctaaattaaaaaatataaaaaagtgtcacatagtttcaaaacaaaagattaaaaatataaaaatattttcatctttagaagatgttgatttaaatgattatgcttatatcataattgcatcaaaaacctttctacattttgaacaactaaaatatatagaaagaaatactgaaaataaaattatattggttgaaaaacctttatttatgacaaatcaaaaactatgtattaaaaataataaagtctttgttgcttacaatagacgttttatccaataa

SEQ ID NO: 8916 - protein, 111 aa, Unknown
  Obtained from environmental sample
  DOMAIN (1)...(105): Oxidoreductase family, NAD-binding Rossmann fold
  misc_feature (1)..(111): Xaa is any amino acid
MKALIIGFGSIGQRHFKILSKLKNIKKCHIVSKQKIKNIKIFSSLEDVDLNDYAYIIIASKTFLHFEQLKYIERNTENKIILVEKPLFMTNQKLCIKNNKVFVAYNRRFIQ

SEQ ID NO: 8917 - DNA, 408 bp, Unknown
  Obtained from environmental sample
  misc_feature (1)..(408): n is a, c, g, or t
atgcttgatttatcaactgatgaaaaaagtattataaaacaaaatagatttattgaaatttggaaagataaagaagtatttgcctatattaaaagtttagataatagatggtataacgatttagatgaagatttacaaaacaaatctcattatcaatcacaatattgcgaatttccatggacttctttaacgattatggcaaatggtaatattgttccatgtactcaagattatgatgctgaaatggtatttgggaatataaaaactgattcgcttgaagatatctggaatggtgcaaagtatgaagaattcaggcaatggcatattactggtgatttccctaaaggaaataaatgtaatgataaatgtgatttgaaaaaaatatatcactatatagataaagaataa

SEQ ID NO: 8918 - protein, 135 aa, Unknown
  Obtained from environmental sample
  misc_feature (1)..(135): Xaa is any amino acid
MLDLSTDEKSIIKQNRFIEIWKDKEVFAYIKSLDNRWYNDLDEDLQNKSHYQSQYCEFPWTSLTIMANGNIVPCTQDYDAEMVFGNIKTDSLEDIWNGAKYEEFRQWHITGDFPKGNKCNDKCDLKKIYHYIDKE

SEQ ID NO: 8919 - DNA, 705 bp, Unknown
  Obtained from environmental sample
  misc_feature (1)..(705): n is a, c, g, or t
ttgggatttttaatatcttattttataatgtgtgcagtaggatataagcttattaaaatgtttatgaaaccaattcaaaacgagagaaaaagattagataactttatcaaagatactacacatgaacttaacactcctattactgctattatgatgtgtgcaaataaagactctattggaaatccaaaaaatatggagagaatatatcttagtgcaaagcgaatatcggaaatttataaagaccttacatatatgtttttaaaaaaagagagtaaaaaaaatataactactatacaaatagatgagataattaaaaatgaattagagtattttacattgttagctagtaaaaaagatataaagatagaagcagaattagaaacaaccctaatagagatctatgatgaagactttaaaagaatatttagtaacttggtatcaaatagtataaagtataataaaagaggtggaaaagtatctataactcttaaaaataaaatactaatcgtaaaagatactggaataggtatatctaaagagaaacaaagtaatattttcaaaagatattacagagctacttccctagaaggtggttttggtatgggattgaatatcgtttataatatagcaaaagagtatgaatttacaatagatatgcaatcagatttaaatataggtactacttttactatttacttttcataa

SEQ ID NO: 8920 - protein, 234 aa, Unknown
  Obtained from environmental sample
  DOMAIN (31)...(91): His Kinase A (phosphoacceptor) domain
  misc_feature (1)..(234): Xaa is any amino acid
MGFLISYFIMCAVGYKLIKMFMKPIQNERKRLDNFIKDTTHELNTPITAIMMCANKDSIGNPKNMERIYLSAKRISEIYKDLTYMFLKKESKKNITTIQIDEIIKNELEYFTLLASKKDIKIEAELETTLIEIYDEDFKRIFSNLVSNSIKYNKRGGKVSITLKNKILIVKDTGIGISKEKQSNIFKRYYRATSLEGGFGMGLNIVYNIAKEYEFTIDMQSDLNIGTTFTIYFS

SEQ ID NO: 8921 - DNA, 531 bp, Unknown
  Obtained from environmental sample
  misc_feature (1)..(531): n is a, c, g, or t
atgataaaagaaaaagtaatgaaagagcataatttacaaaaagattttatagaacaaatcacagggaaaatagatgtcaaaaaagactctataggtgtgtataaatatcttgtttataataacttttttgatgtgataagtacctcttttccaattttttataaaatactccaacaaaagaatctcgaaaaagagtttgaagaatctctgtatgaatttatccaaacaagtgccttctctccttttatttggaagttgtcaaacgaatatagaaaatttataaaatcatctcagttttttcatactttagaatatagagatgaacttttactatttgaatatagtgagttatatatttttatgcaaaaaaagtctaagaaacagctagaaaagttttctctaaaaaatcattataaactttcacataaagtgatactccaaaaatataactataattttttgactatgaatttagaagagaaacaaaaaacatatattttagggtattttgattataaattagaaaggtag

SEQ ID NO: 8922 - protein, 176 aa, Unknown
  Obtained from environmental sample
  misc_feature (1)..(176): Xaa is any amino acid
MIKEKVMKEHNLQKDFIEQITGKIDVKKDSIGVYKYLVYNNFFDVISTSFPIFYKILQQKNLEKEFEESLYEFIQTSAFSPFIWKLSNEYRKFIKSSQFFHTLEYRDELLLFEYSELYIFMQKKSKKQLEKFSLKNHYKLSHKVILQKYNYNFLTMNLEEKQKTYILGYFDYKLER

SEQ ID NO: 8923 - DNA, 648 bp, Unknown
  Obtained from environmental sample
  misc_feature (1)..(648): n is a, c, g, or t
gtgaatacaaatgatagcaatgtaaaagttgtaaatagtacaaaaccgatgctattgtcactttttggaattattagttttataacgctattttttctatacatgggttatttgcaccataaagatgtgttagagttaattttaaaagaggaacaaaacgtagcatctaaaatctatcataatacatttaacaacgtagggaaacgttatgaaataatcgctaaaaatatattaatgaatgaacagattgtagatgcttttgaaaaaaaagatagaagtaaacttttaagcttaactgctccaatatataaaaaattatcacaagagaatcaatatttgaggataatgcattttcacacaaaagagacagtgagttttttgagacttcatactcctgataagtatggtgatgaccttagccctattagacatatgattaataaagtaaataaattacatattaaacaagtgggaatggaagttggaaggtatggagtctattatagagtagctcttccagtttttaataaaaatggaaattatctaggtgcatttgagttgggtattaatatcaactatattttagacacattcaacaaagattatggctttcaaagtattttgcttttgaaaaaaggatatttttga

SEQ ID NO: 8924 - protein, 215 aa, Unknown
  Obtained from environmental sample
  misc_feature (1)..(215): Xaa is any amino acid
MNTNDSNVKVVNSTKPMLLSLFGIISFITLFFLYMGYLHHKDVLELILKEEQNVASKIYHNTFNNVGKRYEIIAKNILMNEQIVDAFEKKDRSKLLSLTAPIYKKLSQENQYLRIMHFHTKETVSFLRLHTPDKYGDDLSPIRHMINKVNKLHIKQVGMEVGRYGVYYRVALPVFNKNGNYLGAFELGININYILDTFNKDYGFQSILLLKKGYF

SEQ ID NO: 8925 - DNA, 624 bp, Unknown
  Obtained from environmental sample
  misc_feature (1)..(624): n is a, c, g, or t
atgttaacagttgcactaccaaaagggcgtatagccgaagagacattagagatatttaaaactatnttcggtgaaaattttgaatttaatgatagaaaactaattttagagacagaaaattttaaatttttgctagtacgtaatcaagatgttgcgacatatgtttatcatcaggcagctgatatcggggtagtaggaaatgacacactggatgaacaaggtcttgatgtaattagacttcttgatttagagcgtggaaagtgtaaagttgcaattggtatgaaaaacggtgaaaaacttgatcttactaagccggagttgaaagtggcgacaaagatggtaaatatcacaaaacgctactttgcagagcgcgctgtggctgctgatattatcaaactctatggctctattgaattggctcctttagttggcttagctgatatgatcgtagatattgtagatacaggtgctacgatgaagcaaaatggcttagaagttgttgagactatcatggactcatcgactcaccttattgcaaataaaaacagcttttttgagaaaaaaggcgaaattttagatatatatgaaaaaatagaaaaagtcgttgttgatagtcgtaaatag

SEQ ID NO: 8926 - protein, 207 aa, Unknown
  Obtained from environmental sample
  DOMAIN (46)...(202): ATP phosphoribosyltransferase
  misc_feature (1)..(207): Xaa is any amino acid
MLTVALPKGRIAEETLEIFKTXFGENFEFNDRKLILETENFKFLLVRNQDVATYVYHQAADIGVVGNDTLDEQGLDVIRLLDLERGKCKVAIGMKNGEKLDLTKPELKVATKMVNITKRYFAERAVAADIIKLYGSIELAPLVGLADMIVDIVDTGATMKQNGLEVVETIMDSSTHLIANKNSFFEKKGEILDIYEKIEKVVVDSRK

SEQ ID NO: 8927 - DNA, 417 bp, Unknown
  Obtained from environmental sample
  misc_feature (1)..(417): n is a, c, g, or t
gtgcacctcatcaaatttgtagtagcaatgtttgatttagattattttaaaaaaatcaatgataattatggacatattgctggagataaagtgttacaagaatttattattattgttaaatctcatattagaaattcagatattattattcgatatggtggggaagaatttgtattaatcttacccgcaataactactaaagatgcctataatgttttagaaaaaattcgaaaaagtttcgagaattttactctctcttttgaaaataataatattaatacaactgtaagtataggtatgattgaaattgaagctaaagatagttataataagcatttattggaagaatatatccatttagctgatacaaagctatacaaagcaaagcaaaatggaagaaataatatcaagaaataa

SEQ ID NO: 8928 - protein, 138 aa, Unknown
  Obtained from environmental sample
  DOMAIN (1)...(135): GGDEF domain
  misc_feature (1)..(138): Xaa is any amino acid
MHLIKFVVAMFDLDYFKKINDNYGHIAGDKVLQEFIIIVKSHIRNSDIIIRYGGEEFVLILPAITTKDAYNVLEKIRKSFENFTLSFENNNINTTVSIGMIEIEAKDSYNKHLLEEYIHLADTKLYKAKQNGRNNIKK

SEQ ID NO: 8929 - DNA, 525 bp, Unknown
  Obtained from environmental sample
  misc_feature (1)..(525): n is a, c, g, or t
atgagagtaatagaaatctttaaagagataacaaaaatcccccgatgtagtggtacttttgaaccatttataaactatataaaagagtttgcaacaaaaaataactatatatgtaaagtggatagtgcaaacaatatattatgttataaagagaatacaaaaatagaattatgtttacaatcacactatgatatggtgtgtttagaagatgggaaaataccaactattatagaagaagatggttatttaaaagcaaaagattctacacttggagctgacaatggaatagggtgtgcttatatgttagctttgatggaagagggggaaagtgtagagctacttttcacaagtgatgaagaggttggactaataggggcaaacaatatagaaattgaacttcaatcatcaaaaatgttaaatcttgatagtgaagcgcaaggtgaaatttgtataggatgtgctggtggaattgatatatttgggataaataacaaaggtgaatatctaaaaaacaaagacccataa

SEQ ID NO: 8930 - protein, 174 aa, Unknown
  Obtained from environmental sample
  DOMAIN (56)...(135): Peptidase family M20/M25/M40
  misc_feature (1)..(174): Xaa is any amino acid
MRVIEIFKEITKIPRCSGTFEPFINYIKEFATKNNYICKVDSANNILCYKENTKIELCLQSHYDMVCLEDGKIPTIIEEDGYLKAKDSTLGADNGIGCAYMLALMEEGESVELLFTSDEEVGLIGANNIEIELQSSKMLNLDSEAQGEICIGCAGGIDIFGINNKGEYLKNKDP

SEQ ID NO: 8931 - DNA, 789 bp, Unknown
  Obtained from environmental sample
  misc_feature (1)..(789): n is a, c, g, or t
ttgaccaaaattattttaatgaataaagtaagatgctttttattgttttgtttttcccttttgtcgttcgcgtttaatgctcaagagtctcaaataagacttactggagaaatatatgatacgctcaaccgaaaaggagtggagcatgctattgtgatggcgataagaattaaggattctgttttaactggttacactagatcagattgggaaggtaaattcaaattggacatccctagagacacctttcaagtattgataacttctccaaaatttgaggaaagagaatattacatttttggtaatgaaagtaccaaggatttagattttgggcgaattgttttgccggagaaaggagaacaacttaaagagtatgttgttttttcaaataatgctccgatttatttcaatggagataccttagtaatggtagcagattcttttaagacagctgcaaatgcaaatgtagaagacctttttaagaaattgccagggtttgatgttgacaaatcaggtaaaattgttgtgcatggaaaagaggtcagcaaggtttatgtagacggagatgagttttttggcactgaccctacggttgcaactaaaaacttgccagcaggagccattgagaacgtccaagtatatgaccaaaaaatagagggagacaatacagatgaaacggagaaagtgatcaatctaacgctaaaagaagatgctaaaagaggaatgtttggtaaaaataatgggtggcacaaaattttcaaaaatatttataaggggagaagcccttag

SEQ ID NO: 8932 - protein, 262 aa, Unknown
  Obtained from environmental sample
  misc_feature (1)..(262): Xaa is any amino acid
MTKIILMNKVRCFLLFCFSLLSFAFNAQESQIRLTGEIYDTLNRKGVEHAIVMAIRIKDSVLTGYTRSDWEGKFKLDIPRDTFQVLITSPKFEEREYYIFGNESTKDLDFGRIVLPEKGEQLKEYVVFSNNAPIYFNGDTLVMVADSFKTAANANVEDLFKKLPGFDVDKSGKIVVHGKEVSKVYVDGDEFFGTDPTVATKNLPAGAIENVQVYDQKIEGDNTDETEKVINLTLKEDAKRGMFGKNNGWHKIFKNIYKGRSP

SEQ ID NO: 8933 - DNA, 939 bp, Unknown
  Obtained from environmental sample
  misc_feature (1)..(939): n is a, c, g, or t
atggcttctagaaatcatttttcagcctggttaattgcccatggtgagattacgttagcaaaacgattgagaccacttaagctatcaaatttctcaagacctgatagatttcgacgttatctccggatgagtttgagagatgtgagaaataaaaagaatcgcggtcaagtacttcattttgataaaaacagcatcgatcttgattgtcaggttgttaaacttgctgaaggaactctaggaggaaaaggtcgtggtcttgcctttttaaataaacttttactggccttggatttaaacaagcatttcccggatattcctattaagattcccaaaacatttatcgtaggttctaacgagtttgataacttttttgaaaccaacaacataaaagaaaaaattcttaaccttcctgtagataaaaagattctattcaaatactggaatgataattccgatgctgctaatcttctcaataggattactgcaacagatgaggagataaaaaagattttcatcaatggtgaattaagcgataagttgaaattcaatctttatcagcttctggaagtaatcaacactcctttggcaatccggtcatccggacttttggaggattcccaatcacagccttttgccggcatatatcanacctttatgattccaaataatgagaaagatatagaccttcggcaccagaaacttatggatgcaataaaactagtgttctcttctgtttatttaaagagtgctcgccaatacatccgcagtataaattttaaagttgaagatgagaaaatggctgtaataatccaagaagttattggctcgagatttgaagacctttactatcctaatatttcaggtgtagctcaatcctataactattatcctacggcacatatgactaatcgtgatggtattgatgcaagggacccttag

SEQ ID NO: 8934 - protein, 312 aa, Unknown
  Obtained from environmental sample
  misc_feature (1)..(312): Xaa is any amino acid
MASRNHFSAWLIAHGEITLAKRLRPLKLSNFSRPDRFRRYLRMSLRDVRNKKNRGQVLHFDKNSIDLDCQVVKLAEGTLGGKGRGLAFLNKLLLALDLNKHFPDIPIKIPKTFIVGSNEFDNFFETNNIKEKILNLPVDKKILFKYWNDNSDAANLLNRITATDEEIKKIFINGELSDKLKFNLYQLLEVINTPLAIRSSGLLEDSQSQPFAGIYXTFMIPNNEKDIDLRHQKLMDAIKLVFSSVYLKSARQYIRSINFKVEDEKMAVIIQEVIGSRFEDLYYPNISGVAQSYNYYPTAHMTNRDGIDARDP

SEQ ID NO: 8935 - DNA, 330 bp, Unknown
  Obtained from environmental sample
  misc_feature (1)..(330): n is a, c, g, or t
ttgttatgccgattagcagtagacaaacgagttacaaaaactcagaaagcctttattggggctattatcgcttatctaataatgcctttggatttcatccctgattttataccagttgttggatacattgatgatcttgttttggctgttttcgggctcaatatgattcttaatgaacttgataagagtgttcttatgcagaattggaacggggaagaggacataataactcttcttgcaaaaatcactaaaacagctgaagattttttggacaataagatcctttccaaaatcaagggctggattaataaatcatataagaagaattaa

SEQ ID NO: 8936 - protein, 109 aa, Unknown
  Obtained from environmental sample
  DOMAIN (3)...(60): Protein of unknown function (DUF1232)
  misc_feature (1)..(109): Xaa is any amino acid
MLCRLAVDKRVTKTQKAFIGAIIAYLIMPLDFIPDFIPVVGYIDDLVLAVFGLNMILNELDKSVLMQNWNGEEDIITLLAKITKTAEDFLDNKILSKIKGWINKSYKKN

SEQ ID NO: 8937 - DNA, 309 bp, Unknown
  Obtained from environmental sample
  misc_feature (1)..(309): n is a, c, g, or t
ttggtattggccaaggggtgttttagggtgttggtttttgggtttcaaaaggttggttttggaaaaacttacggactaattgttacctggatggtgaagctaaggataaagctaaatattgtcttaccagaaagttacaaaacagaactacttggaagtattaacgcaagaagtttacaaaatttcatctctttacgaagtagtaaaagtgctttatgggagataagagatttagctaaactattatttgattcacttccacaagatcatcaatacttatttgatgattgtatcctaagtgataattaa

SEQ ID NO: 8938 - protein, 102 aa, Unknown
  Obtained from environmental sample
  misc_feature (1)..(102): Xaa is any amino acid
MVLAKGCFRVLVFGFQKVGFGKTYGLIVTWMVKLRIKLNIVLPESYKTELLGSINARSLQNFISLRSSKSALWEIRDLAKLLFDSLPQDHQYLFDDCILSDN

SEQ ID NO: 8939 - DNA, 738 bp, Unknown
  Obtained from environmental sample
  misc_feature (1)..(738): n is a, c, g, or t
atgggttcaagaatcaacactgttatgcaaacttgtttttttgcaataagtggaatacttcaaaaagatgaagcgattgaaaaaatcaaagactcaattcataaaacttatggaaataaaggtgattctattgtaaaaatgaattatgctgctgttgatagcagtttagaaaatctttttgaagtaaaagttccatcacaaatttcaagtgacattgaacttaaaagtgttctcaaaggtgaattatctccttttgttgctaatgttattcaaaaaatcacagaatataaaggtgatgatattcctgtttctgatataccagcagatgggacttggccaacagggacaacacagtatgaaaaaagaaatatagcacaagaggttcctgtgtgggatgctgatacttgtatccaatgtaataaatgtgttttggtctgtccacattctgtaattcgttcaaaagtatttgataaaacattactgcaaaatgcacctgatggttttaattacaaaaaagcaaaagggaaaaactttggggaaaatgatgtatttaatatctcagttgccgttgaagattgtactggttgtgaactatgtgtagaaacttgtcctgcaaaaaacaaatctcaaacaaatctcaaagctatcaatatgaaaacacaacttcctataagagaagaagggattgagcaatgggattattttctttctttaccaatgtaccaagagaacaactag

SEQ ID NO: 8940 - protein, 245 aa, Unknown
  Obtained from environmental sample
  DOMAIN (186)...(209): 4Fe-4S binding domain
  misc_feature (1)..(245): Xaa is any amino acid
MGSRINTVMQTCFFAISGILQKDEAIEKIKDSIHKTYGNKGDSIVKMNYAAVDSSLENLFEVKVPSQISSDIELKSVLKGELSPFVANVIQKITEYKGDDIPVSDIPADGTWPTGTTQYEKRNIAQEVPVWDADTCIQCNKCVLVCPHSVIRSKVFDKTLLQNAPDGFNYKKAKGKNFGENDVFNISVAVEDCTGCELCVETCPAKNKSQTNLKAINMKTQLPIREEGIEQWDYFLSLPMYQENN

SEQ ID NO: 8941 - DNA, 447 bp, Unknown
  Obtained from environmental sample
  misc_feature (1)..(447): n is a, c, g, or t
ttgaaaacgaagactaaaaagatgaaactgagtaaattaatattgtaccttttgcttacttgtgcagccatctcatttatttatccattttattggatgattattgcttcgctcacacctgaatcgcaaataagtgatttcactcttgttccacaagaaattacttttaataattatttggtaatgtttcagaaaattccaatttggaaatcgttgttcaatagtttattcgttgcggcaagttctactcttggagttttaattttcggatcaatgattggatatgcccttggaaaactggaattcaaaggtcgtgacttactattttttattattattttcacaatgaccctaccctttcaaattactcttattccaaattatattttaatggtaaaatttaattgggtaaatagttttgcagcccttatgttcctgcctaaatag

SEQ ID NO: 8942 - protein, 148 aa, Unknown
  Obtained from environmental sample
  misc_feature (1)..(148): Xaa is any amino acid
MKTKTKKMKLSKLILYLLLTCAAISFIYPFYWMIIASLTPESQISDFTLVPQEITFNNYLVMFQKIPIWKSLFNSLFVAASSTLGVLIFGSMIGYALGKLEFKGRDLLFFIIIFTMTLPFQITLIPNYILMVKFNWVNSFAALMFLPK

SEQ ID NO: 8943 - DNA, 579 bp, Unknown
  Obtained from environmental sample
  misc_feature (1)..(579): n is a, c, g, or t
atgaaaatagttattgctagcccattatttccaccagaaactgcaaagtcgggagtctacagcaaaaaattagcccaacaactaagtaagtccaacaaaataaaaattgttacttatgctaatgaagctgaagctgtaaatggagcaaaaattataaagattaaaaaaagacaggcactcccctgtcgattattttggtacacaatttctctcttgaaagaaagtaaaacagccgatgttattctggtgcaaaattcattggcttgcattattcctgctgcaataataaataaattaagcacagtgaatataattgtaattgttacagaagatgagattcagaaaagaattaatcaaaacgatcttgtgtataaaaattctaaaaacttttcaaacttcaacttcagcaaaataaaaattaaaattatagaacatctacaaaaaacaactttgaataaatttcagaatattatttgccactcagattgccttgaaaaacttctaacagataattacaaaattaacaaaaataaaattacaaatattccagctccaaaaaccaagcctataaatgcctga

SEQ ID NO: 8944 - protein, 192 aa, Unknown
  Obtained from environmental sample
  misc_feature (1)..(192): Xaa is any amino acid
MKIVIASPLFPPETAKSGVYSKKLAQQLSKSNKIKIVTYANEAEAVNGAKIIKIKKRQALPCRLFWYTISLLKESKTADVILVQNSLACIIPAAIINKLSTVNIIVIVTEDEIQKRINQNDLVYKNSKNFSNFNFSKIKIKIIEHLQKTTLNKFQNIICHSDCLEKLLTDNYKINKNKITNIPAPKTKPINA

SEQ ID NO: 8945 - DNA, 489 bp, Unknown
  Obtained from environmental sample
  misc_feature (1)..(489): n is a, c, g, or t
atgaaatcaaaagatataatggatcatcattatattatggaaattgcagatttcgaatggaaaaaagcacaaagacaaaagcaagacaaaggatatatgggaagaatgtcatttcctgaaaactttgaaaagccatcaagaacagtaatggcaactatgtcttgctcgtcaagagaatccatgatttatccttataaacaaaaagaagataggtacagactaccaacagtcagagagattgcttgtcttatgagttaccctttggattatagattttacgggaagagtaaaagtattaaatacaaacttgttggaaactctgtacctccaaaaatgtcttttgcaattgctaatgcaatatcaattgcaaataatttaaaaacacttaataaatatcaaccaattgagtttgacgatagccaggaagattttaaaaatttaaatggagatatttttcatattattatagaaaaagaaaaagacccctag

SEQ ID NO: 8946 - protein, 162 aa, Unknown
  Obtained from environmental sample
  misc_feature (1)..(162): Xaa is any amino acid
MKSKDIMDHHYIMEIADFEWKKAQRQKQDKGYMGRMSFPENFEKPSRTVMATMSCSSRESMIYPYKQKEDRYRLPTVREIACLMSYPLDYRFYGKSKSIKYKLVGNSVPPKMSFAIANAISIANNLKTLNKYQPIEFDDSQEDFKNLNGDIFHIIIEKEKDP

SEQ ID NO: 8947 - DNA, 900 bp, Unknown
  Obtained from environmental sample
  misc_feature (1)..(900): n is a, c, g, or t
ttgtactgctattgcatttataaaagtggttcttgggttgccactggtagctatgacagtaaagtcagagtgacaaacatatacgcagcaaataaaacagttgatttagtcggtggtcatacgggatatgttaaatttattaactttatctcagacaatagattagttaccattgataaaaatggtggtgcggttgtttgggactatgttaatggaaaaatgataaaacagctaaagggaattgactctgatcctacatctgttacatttatttatgatgacaactttatgcttgtctctactatactaaaaacaattgctctttttaatctaaagaactatgaatatttgacaagaaacttcatcaaagttggtgatgttgttacagatttcagttacctacctgaactagaactattagtagttgcaacagctttaaatgatttgagaacttacgatcttaaatcagatgagagtattttacaacagctggttattgagaaaaattttgtccaggcatataaacttttggatgaaaatccaacactatatatttcacctatttataaaactttagaagccatatgggataaaatttacaaagaagcttatgtacagttagagaaattaaatattcaaggtgctaaagatctatttgaaccatataaaggtatccctgcgaaaacaaactatatacaaaatttactgaacgattttgcagaatttcaaaaatttgtaaactttgtagagacaaaaaagtttgcattagcatatcagcttgcatttaaatatcccacatacaaagagtcaaaatattacactgttatggaagaagagtggaatacacaaatggataaagtcaaagtacttattaccaacatggagattctacagaactag

SEQ ID NO: 8948 - protein, 299 aa, Unknown
  Obtained from environmental sample
  misc_feature (1)..(299): Xaa is any amino acid
MYCYCIYKSGSWVATGSYDSKVRVTNIYAANKTVDLVGGHTGYVKFINFISDNRLVTIDKNGGAVVWDYVNGKMIKQLKGIDSDPTSVTFIYDDNFMLVSTILKTIALFNLKNYEYLTRNFIKVGDVVTDFSYLPELELLVVATALNDLRTYDLKSDESILQQLVIEKNFVQAYKLLDENPTLYISPIYKTLEAIWDKIYKEAYVQLEKLNIQGAKDLFEPYKGIPAKTNYIQNLLNDFAEFQKFVNFVETKKFALAYQLAFKYPTYKESKYYTVMEEEWNTQMDKVKVLITNMEILQN

SEQ ID NO: 8949 - DNA, 711 bp, Unknown
  Obtained from environmental sample
  misc_feature (1)..(711): n is a, c, g, or t
atgaaagacaaagacttagcaattgtttttaaacttatagttcaatatccatttctaaaagagttagatgactactataaattagaacaaatggaagctattttatatgataaagcagttgcatcatcaataacaaaaaactatgcaacaacaagaaaacttgccaaagagttattagactttccaaatttcaaagaagaggccaaacatatatatgaaaatgtttctaagacaatcctttttatgaaacacttcaaagctaaagactacactaagatgctagaggtgattgaaaaagcaccattcttagaagatacaaaagagtttatctcatttaataaaacatggcttgaagctctctcaaatgctgaaaaatacgctgcaaaaggtgttattagcggtattttagactcttttaaagagtttattgatattgaagagagaataaataaaattggatcgataatatctatggtatatctgcaacagctgaagatgatatctaaaaagtatcatccaaagcctaaattgattctaaaattcataaacagatatatagatatatttggcaatgatgactccatagactctttgttaaaatataacgagacggagtactctatcgcttatgataaatcagagatcaaccagttagagccaagcttcaaaagatggagagagatagaattacctgaaaaaatatatgaataa

SEQ ID NO: 8950 - protein, 236 aa, Unknown
  Obtained from environmental sample
  misc_feature (1)..(236): Xaa is any amino acid
MKDKDLAIVFKLIVQYPFLKELDDYYKLEQMEAILYDKAVASSITKNYATTRKLAKELLDFPNFKEEAKHIYENVSKTILFMKHFKAKDYTKMLEVIEKAPFLEDTKEFISFNKTWLEALSNAEKYAAKGVISGILDSFKEFIDIEERINKIGSIISMVYLQQLKMISKKYHPKPKLILKFINRYIDIFGNDDSIDSLLKYNETEYSIAYDKSEINQLEPSFKRWREIELPEKIYE

SEQ ID NO: 8951 - DNA, 876 bp, Unknown
  Obtained from environmental sample
  misc_feature (1)..(876): n is a, c, g, or t
atgattgagtcaattgagattgttaagaacaatgcttctgtcagtgttggctccggggctatggctggggcaattataattacaacaaagcaaatgaatcataattttaaacattcaatctggggcaaacaggagtttggttcttttggtttcgataaggaaactattgggacagagaatcaaatacgaagcctaaatcttcaattacttctctctcgactccattctgataatgattacaaataccaaacaagagtctatgcaaacaaaccatcagagactggaaggcgagtgaataacgcaaaagatatctatgatatcaatcttaaagctcagttaaataatcaacttgttcaaactacctattcaggcatctatgaacaatttgaaaagcaactacctggtggttacaattttgagatgcactatgataaggcacttcagaccggatacttgagtcgtcacaatctgaagcttaagacaaaatgggggatagagcatacaaattattggcaccaatcattttcggactatgataacacaaagtcatcaacaacatcttcatttctgaaatctcataatgacaataaactcacaaagtatggttcaatattgaactggttaaaaaagaatgaaacaacttcgattaacatcaagattgaaataggtaatgaggaatattcttcaaaagactttgtaattgatgcaaattctgtatcaaagaaagagaatagcttttatgccggatctcttgcctatgggattaaaccacagcttggagagtatttgtttgagctagatggctcccttcgctatgataactacaaactattcgatgaatttatctcatatcgcctttacggtggagttctctaa

SEQ ID NO: 8952 - protein, 291 aa, Unknown
  Obtained from environmental sample
  misc_feature (1)..(291): Xaa is any amino acid
MIESIEIVKNNASVSVGSGAMAGAIIITTKQMNHNFKHSIWGKQEFGSFGFDKETIGTENQIRSLNLQLLLSRLHSDNDYKYQTRVYANKPSETGRRVNNAKDIYDINLKAQLNNQLVQTTYSGIYEQFEKQLPGGYNFEMHYDKALQTGYLSRHNLKLKTKWGIEHTNYWHQSFSDYDNTKSSTTSSFLKSHNDNKLTKYGSILNWLKKNETTSINIKIEIGNEEYSSKDFVIDANSVSKKENSFYAGSLAYGIKPQLGEYLFELDGSLRYDNYKLFDEFISYRLYGGVL

SEQ ID NO: 8953 - DNA, 303 bp, Unknown
  Obtained from environmental sample
  misc_feature (1)..(303): n is a, c, g, or t
gtggcaaaccggacaggatattgggaaatacccgggatatcagcctccgaaagcgtttggaacaaaaatttcaacaggttcataaaatggaagccttgggaaccctgtccgggggcattgcccatgattttaataatatactgtcgtcaatcctgggatttacggaacttgcaagggggggaaacattgatgaaacaacaaaaaaaagcctggataaggtcctttctgcaggtatcagagcccgtgatcttatcaatcatatcaaaatttttagccgccgggcagatgtacaaaaagagttaa

SEQ ID NO: 8954 - protein, 100 aa, Unknown
  Obtained from environmental sample
  misc_feature (1)..(100): Xaa is any amino acid
MANRTGYWEIPGISASESVWNKNFNRFIKWKPWEPCPGALPMILIIYCRQSWDLRNLQGGETLMKQQKKAWIRSFLQVSEPVILSIISKFLAAGQMYKKS

SEQ ID NO: 8955 - DNA, 378 bp, Unknown
  Obtained from environmental sample
  misc_feature (1)..(378): n is a, c, g, or t
ttggtgaaaataattgaaaagttagaaactacaaacgatacaatgttgctatctaaactctatgaacagcatagtaaaataataggtgaattggaacaattagatatttttgatgaagcaattattaaatctaaagggataataactaaagagaagcgaaaagagttatttgaaaagcttaaagaggttttgcacacaaaacgacctaaaaatattgaaaaggtactactggaaatagaccagtatcagattaatattgaggaagaaaataatttgaatatgataaaagaatatacagaaaaatttgattttcaaaaggctttggattgtttgtcattgtatgaagaaaactatttaaatcataaaaaaggaaaataa

SEQ ID NO: 8956 - protein, 125 aa, Unknown
  Obtained from environmental sample
  misc_feature (1)..(125): Xaa is any amino acid
MVKIIEKLETTNDTMLLSKLYEQHSKIIGELEQLDIFDEAIIKSKGIITKEKRKELFEKLKEVLHTKRPKNIEKVLLEIDQYQINIEEENNLNMIKEYTEKFDFQKALDCLSLYEENYLNHKKGK

SEQ ID NO: 8957 - DNA, 870 bp, Unknown
  Obtained from environmental sample
  misc_feature (1)..(870): n is a, c, g, or t
atggcaaaagaaaataaaatagatgtaattttaaatatagcaaaaactcctgaacgattaaaatttttgacatatagtaataaagcatatatcagtactactgatgtgttatttgtaaatgaaaatagtgagtataaaaaattaactactttacaagatatggatggacaaactatagcagtaatcaaaggtttttttgaagatgaacttttgaaaaaatattatccaaagattaatgttataaaagttggtagttcccttgaagcactacaggcagtttctactggaaaagcagatggaacactctttgatatgtataatgtggcctcatatcttattagtgaatactctattaataatgtaaaaccaatttttgaagtaaaagacccaagactgagtattgatctgtttatagctactagtaaacaaaatatcatactttatgaaatattacaaaaagcacaaaatagtattactgaagatgaagtattaaaaataaaaaagaaaatgttaaagtcaaatagtatttatactaataatcaggacttcttaacattagaagaacagaactatatttctagtaatagagtgataaaaatgtgtaataaccatgactttgccccaatagagtttgtaaatgagtttattgaaaatggtacacaaaataatcataaagttgatgggatagcaattgatgtgataaaatctttagaaactatacttgatatncaatttgagcatgttcatacatctagttggattgaatcgttacaatatttaaaagagaaaaaatgtgatattttaccagctgctgcaaaaacaaaagagagagtagcttatgcaaattttaacacacctttctctctttaa

SEQ ID NO: 8958 - protein, 289 aa, Unknown
  Obtained from environmental sample
  DOMAIN (1)...(173): Bacterial extracellular solute-binding proteins, family 3
  misc_feature (1)..(289): Xaa is any amino acid
MAKENKIDVILNIAKTPERLKFLTYSNKAYISTTDVLFVNENSEYKKLTTLQDMDGQTIAVIKGFFEDELLKKYYPKINVIKVGSSLEALQAVSTGKADGTLFDMYNVASYLISEYSINNVKPIFEVKDPRLSIDLFIATSKQNIILYEILQKAQNSITEDEVLKIKKKMLKSNSIYTNNQDFLTLEEQNYISSNRVIKMCNNHDFAPIEFVNEFIENGTQNNHKVDGIAIDVIKSLETILDXQFEHVHTSSWIESLQYLKEKKCDILPAAAKTKERVAYANFNTPFSL

SEQ ID NO: 8959 - DNA, 663 bp, Unknown
  Obtained from environmental sample
  misc_feature (1)..(663): n is a, c, g, or t
atgtatcaaaatgcagaaataataaaatctgaagttttaaaatatgcacaaaatacaacagttaactatgaggaactaaaagcaaaattagaagaaaagggaattacaataaatagccataattttgaaaaattaaaatacttatatcacataatgacatacctaaaaccaggtaatcactacaagtatataaaaacagcaagctttggaaaactattagaaaatccaacactaggaaaactaaaaggggattgtaaccaaatagtaacactatatgccgcattatacagccttaaatttgacataaatgatttaaaaataaagctacttcctaatcatgtttgccttcatttcaacggtgttgatatagaagcaacaaatggaacatttcaaaaatacaaaggcaaaacaattctaccaattacagaaattatatcaacaaatatgctcgacataagtgacttcagagaaaaaacacaaaaaatttcaacaagaaatttcattgaaagtgcaaagctttcatataaaataagttcgttaaaagaacttgtaacaaaaaacctaaaaacagggtacacaaatatgggcatcgaaagtttaaacaaaaatgatttcaaaactgcactattctttttcaaaaaagcccaagaatcaagaaattaa

SEQ ID NO: 8960 - protein, 220 aa, Unknown
  Obtained from environmental sample
  misc_feature (1)..(220): Xaa is any amino acid
MYQNAEIIKSEVLKYAQNTTVNYEELKAKLEEKGITINSHNFEKLKYLYHIMTYLKPGNHYKYIKTASFGKLLENPTLGKLKGDCNQIVTLYAALYSLKFDINDLKIKLLPNHVCLHFNGVDIEATNGTFQKYKGKTILPITEIISTNMLDISDFREKTQKISTRNFIESAKLSYKISSLKELVTKNLKTGYTNMGIESLNKNDFKTALFFFKKAQESRN

SEQ ID NO: 8961 - DNA, 666 bp, Unknown
  Obtained from environmental sample
  misc_feature (1)..(666): n is a, c, g, or t
ttgccgggggccgtcatggacaaactgctggaagcatttagcggcgtggtggtcgaggcttatggattaacggaatgcagcatgggggcgacaaacaatcctccaagaagggatgccattcgtctgggttctatcggactgccggtttatgatacacagataaagattgcaaataagagtactggtgaaaatcagcccatgggagaagagggtgaagtttgcataaagggcccccaggtgatgcagggatactggaaccggcctgacgccacagcagaggtgctcaaagatggctggctgtataccggagatgtcggcaggatggatgaagacggatttgtttttatcacggatcggattaaggatatgattatttacaagggatacaatgtttatccccgggagctggaagaggtgatttttaagcatccggcagtggaacaatgtgccgtggttggaaaaccggattttaaggtgggtgaatatcccattgcatttgtcaagctggttgaagggggcaatgtaaaagagtccgaactaattgaatttacaaacccgaaggtggcggggtacaaaaaaataagagagattgtttttgtcgatgaaatgccagtcagtggtgcagggaaggtgttaaaaagggtgctgcgaaagcaatttgaatag

SEQ ID NO: 8962 - protein, 221 aa, Unknown
  Obtained from environmental sample
  misc_feature (1)..(221): Xaa is any amino acid
MPGAVMDKLLEAFSGVVVEAYGLTECSMGATNNPPRRDAIRLGSIGLPVYDTQIKIANKSTGENQPMGEEGEVCIKGPQVMQGYWNRPDATAEVLKDGWLYTGDVGRMDEDGFVFITDRIKDMIIYKGYNVYPRELEEVIFKHPAVEQCAVVGKPDFKVGEYPIAFVKLVEGGNVKESELIEFTNPKVAGYKKIREIVFVDEMPVSGAGKVLKRVLRKQFE

SEQ ID NO: 8963 - DNA, 462 bp, Unknown
  Obtained from environmental sample
  misc_feature (1)..(462): n is a, c, g, or t
atgattaaacctaaaattatttctggtggacaaacgggagttgatcagggtgcacttgattttgctctcgattatgatttcgattgtggaggtttttgtactaaaggtcgaaaaagcgaaaagggcactattccatttaaatatcccttaacagaattagattcagaaaaggaaatagatcgaacgcgaaaaaacatattggaatctaatgcaacagtaattgtaaaagatgaaactgaatttggtgaaggaactataaataccattaagttttgtcagcagttttcaaagccttatttaacttacgatgtaatttacgatcctataaattacgagatgttccaaaattggttgctggaaaataatgttacaattcttaatgtagcaggtaatcgttcaagtgatagccctgggattaagggtgaagcatataatttgttagagagattgtttaacatctaa

SEQ ID NO: 8964 - protein, 153 aa, Unknown
  Obtained from environmental sample
  misc_feature (1)..(153): Xaa is any amino acid
MIKPKIISGGQTGVDQGALDFALDYDFDCGGFCTKGRKSEKGTIPFKYPLTELDSEKEIDRTRKNILESNATVIVKDETEFGEGTINTIKFCQQFSKPYLTYDVIYDPINYEMFQNWLLENNVTILNVAGNRSSDSPGIKGEAYNLLERLFNI

SEQ ID NO: 8965 - DNA, 471 bp, Unknown
  Obtained from environmental sample
  misc_feature (1)..(471): n is a, c, g, or t
ttggtttgcgatttcgtattttggagtcaaataaaacaattaatgagttatagaattaaactttcgtatgaagaagagtctgaaataaaaggacttattaaggaaaataaaaataaaaagaacgttttaaaaagagcttattgcattttattaaaaaatgaaggtcaaaaaaatgaaaatataactagacttttagaaattcatgaagatacaattgctgattggactaaaatatatattcaaaaagggataactggcttgattaatttcaagtactcggaaagaagaaaatcaaaacttcatccttataaaaataagataaagcgtatggcttctgcaaaaaaaatcaaaacaatagagcagttgcagcataaagtaaaagataatcttggtattgatatagaatatagttggttttataggtattgtaaaaaatatgggatttataatgtgctaaaagatacaaaatga

SEQ ID NO: 8966 - protein, 156 aa, Unknown
  Obtained from environmental sample
  misc_feature (1)..(156): Xaa is any amino acid
MVCDFVFWSQIKQLMSYRIKLSYEEESEIKGLIKENKNKKNVLKRAYCILLKNEGQKNENITRLLEIHEDTIADWTKIYIQKGITGLINFKYSERRKSKLHPYKNKIKRMASAKKIKTIEQLQHKVKDNLGIDIEYSWFYRYCKKYGIYNVLKDTK

SEQ ID NO: 8967 - DNA, 711 bp, Unknown
  Obtained from environmental sample
  misc_feature (1)..(711): n is a, c, g, or t
atgtntgttacaaatcttggtcaactttactggttaaaagtttatagaatcccagaaggtggaagaactgcaaaaggaaaagctgttgtaaatcttattaatttaagagaagatgaaaaaattatggcaattatccctacaacagattttgacgattctaaatctttagcattctttactaaaaatggtgttgtaaaaagaacagcattaagtgactttagtaatataagaagtaatggtgttagagctatagttcttgatacagatgaagatggaaatgttatagatgagattgtaacagcttctattactttccctgagtcaaaatatctaatgatatttacagctcttggtcaagttataagatttgagattgataaaacaagaaatcaaggtagaactactagaggtgttagaggtattaagtttaaagaccctaaagattatgtagtagatgcagatgttattgaagatgaacaacaagaacttttaacagtaagtgaaaatggtgttggtaaaagaacagaggttgaagcatatagacttacaaatagagctggaagtggtgtaatttctatgaaactctcaccaaaaactggtaaaactgtagttggaaatgttattgttgatgaagaccaagacttaatggcattaacatcaattggtaaaatgataagagttgatatgcaaactattagaaaagcntggtag

SEQ ID NO: 8968 - protein, 236 aa, Unknown
  Obtained from environmental sample
  DOMAIN (53)...(102): DNA gyrase C-terminal domain, beta-propeller
  misc_feature (1)..(236): Xaa is any amino acid
MXVTNLGQLYWLKVYRIPEGGRTAKGKAVVNLINLREDEKIMAIIPTTDFDDSKSLAFFTKNGVVKRTALSDFSNIRSNGVRAIVLDTDEDGNVIDEIVTASITFPESKYLMIFTALGQVIRFEIDKTRNQGRTTRGVRGIKFKDPKDYVVDADVIEDEQQELLTVSENGVGKRTEVEAYRLTNRAGSGVISMKLSPKTGKTVVGNVIVDEDQDLMALTSIGKMIRVDMQTIRKAW

SEQ ID NO: 8969 - DNA, 987 bp, Unknown
  Obtained from environmental sample
  misc_feature (1)..(987): n is a, c, g, or t
atggcttggcactgttcagaagtaagcacagaattgataaatttatccgctatattgaacttacccaagggaacagaacattttttaagtgatattcatggagaatatgatacttttaatcacttcttaaaaaatggaagtggtgtaattagagataaaattagtataattttcaaagataagtccgaatcagacaaagatcaactcgccttttttgtatattatccaaaacaaatgataaagaaatatgaaggaattatcaaagaagctgaatttgattcttttttaagaaagagattagtagatttaattgttctaagtaattatctatctcaaaagtataccaagtcaaaaataagaaaaacactaccaaaacaatttgtgtatattattcaagaactaatatttgaaaatagtaatcatactgataaaatcgagtattacaacacaatacttgatgcaatatttcacacaaaaagagagcgtaattttttcattgagttagcaagatttattcagagattaacaattgatagattacacattgttggtgatatatttgacagaggtccatcagcacatcttgtaatcaataaaatgataaattatcattcaattgatattgagtggggtaatcatgacataatatggatgggtgctgcttcaggtagtgaactttcaatttgtaatgtaataagaaattccgctaaatatagtactttagaaacattagaagaaggatatggtattaatcttgtacctcttgctagattcgcatctaaggtttatggtgacgacccatgtacttcatttatccctcgaactcatgatataaataaagaaactgacaatagtgattttatagctaagatacataaagctataaccataataccgtttaaattagaacccgaggtagtaaaaagaaatcctcattttaatatggatgatcgtttactattagataaaaaagattttagaaatggt

SEQ ID NO: 8970 - protein, 329 aa, Unknown
  Obtained from environmental sample
  DOMAIN (7)...(329): Firmicute fructose-1,6-bisphosphatase
  misc_feature (1)..(329): Xaa is any amino acid
MAWHCSEVSTELINLSAILNLPKGTEHFLSDIHGEYDTFNHFLKNGSGVIRDKISIIFKDKSESDKDQLAFFVYYPKQMIKKYEGIIKEAEFDSFLRKRLVDLIVLSNYLSQKYTKSKIRKTLPKQFVYIIQELIFENSNHTDKIEYYNTILDAIFHTKRERNFFIELARFIQRLTIDRLHIVGDIFDRGPSAHLVINKMINYHSIDIEWGNHDIIWMGAASGSELSICNVIRNSAKYSTLETLEEGYGINLVPLARFASKVYGDDPCTSFIPRTHDINKETDNSDFIAKIHKAITIIPFKLEPEVVKRNPHFNMDDRLLLDKKDFRNG

SEQ ID NO: 8971 - DNA, 495 bp, Unknown
  Obtained from environmental sample
  misc_feature (1)..(495): n is a, c, g, or t
gtgaaaataagtaatctaagagggatatataaaatgaaagtatgtaaatttggtggaagttcagtaaaagatgctacacaaatcagaaaagttataaaaatattacagcaagataaatcaagaaaagtggtagttgtttctgcacctggtagagatgacttacatgatcaaaagattacagatcatctattaaactatgcaaccaatggaaaacatttttcagaccacttaatagaagtagatgcacaacaaagttttgaagcaattattactaaatatgaaaagttatgtatagatttaggtattgataaaaataagattatagaaaccattaaaaaaagatttagaaaatacaaaattaaagatgaaaaaagggaggctttttgtctttccagaggtggacatcataatgcccaagtaatagagccatttttgaaaaaatcaaaaaaaaatggaaaactaaggcttcccggaaaattttggggttttttttaa

SEQ ID NO: 8972 - protein, 164 aa, Unknown
  Obtained from environmental sample
  misc_feature (1)..(164): Xaa is any amino acid
MKISNLRGIYKMKVCKFGGSSVKDATQIRKVIKILQQDKSRKVVVVSAPGRDDLHDQKITDHLLNYATNGKHFSDHLIEVDAQQSFEAIITKYEKLCIDLGIDKNKIIETIKKRFRKYKIKDEKREAFCLSRGGHHNAQVIEPFLKKSKKNGKLRLPGKFWGFF

SEQ ID NO: 8973 - DNA, 363 bp, Unknown
  Obtained from environmental sample
  misc_feature (1)..(363): n is a, c, g, or t
ttggggataaatacttatcattttccaacggataaagatgatattgcagttttagtagatcaagagtgtctaaaggggaatattaatattttncgaaggcagatagaaaagagaattaaaacagacaacatcactgtaacatataatctttctattatcactattgtgggaattggactcaaagagaatagttttgctatagtagatgctatatgggcattaaaagaaaacaacatctcatttgacctttttgatatgagtccatctaaaatctcttttcatataggtgtttctcaaaatattgcggatgttgctttacaaaccctttatgataatcttttaaagaaagaagaaataagttga

SEQ ID NO: 8974 - protein, 120 aa, Unknown
  Obtained from environmental sample
  misc_feature (1)..(120): Xaa is any amino acid
MGINTYHFPTDKDDIAVLVDQECLKGNINIXRRQIEKRIKTDNITVTYNLSIITIVGIGLKENSFAIVDAIWALKENNISFDLFDMSPSKISFHIGVSQNIADVALQTLYDNLLKKEEIS

SEQ ID NO: 8975 - DNA, 654 bp, Unknown
  Obtained from environmental sample
  misc_feature (1)..(654): n is a, c, g, or t
atgtttccaaattttaataaaaaaaatgagaaagaaactcaatcaaatgtagataaaaatttaaagatgatgagtatttcggctattgtattaatagtattatttttatatacacttacaaaagcagataatgtgatacatgggtcaagttattatgtaggggttggctttttatttatacttttaattttaacatttgcattacaaaaatataaagataaaattcgtaaaaaattagggacaagtagattttcgagtgaattggaaaaagcacaagaggaaacacctacaaatgaaaagagcaaagtaaaacaaaaagaggaagtgacatcacaaattacacctataagttctaatatcacttttaaagatgtagcagggattgagagtattaaagaggagcttgaagaggtagttgactttttgaatcatccaaaaaaatatcaaaaacataatatctctttaccaaaaggtgttttacttgtaggacctccaggtgttgagaaaaccctcattgccaaagcggttgctggtgaagctgatgttccatttttttaccatagtgcagctagttttgttcatatctatggtggtatgggagcaaaaagagttcgagaattttttattgccgcaaaaagcaaaagccccttctaa

SEQ ID NO: 8976 - protein, 217 aa, Unknown
  Obtained from environmental sample
  misc_feature (1)..(217): Xaa is any amino acid
MFPNFNKKNEKETQSNVDKNLKMMSISAIVLIVLFLYTLTKADNVIHGSSYYVGVGFLFILLILTFALQKYKDKIRKKLGTSRFSSELEKAQEETPTNEKSKVKQKEEVTSQITPISSNITFKDVAGIESIKEELEEVVDFLNHPKKYQKHNISLPKGVLLVGPPGVEKTLIAKAVAGEADVPFFYHSAASFVHIYGGMGAKRVREFFIAAKSKSPF

SEQ ID NO: 8977 - DNA, 513 bp, Unknown
  Obtained from environmental sample
  misc_feature (1)..(513): n is a, c, g, or t
ttgcaaactttagtaaatgaatcattactaaatatgataaaaagagatggcaacacagttttagaagaagatatagcaattgcaaaacaaaaaattcaacatggtaaaaaacagatacatttacttaatgaggaacaaaaagatattttagctacttatcaagcgggtaaagcatttatcacaaaatcaaaagtaaacctttttgaaaatgggatagtgcaagaggatttaatctatccctcacttacccaactacaaaatcaaattaaaaaatatttagctggtagtatcgctttagaggtgataaaaggtgaatcatatattgtctttgaagatgagataaaagaagcatataaaatagctcataatctagtagatgtatataagatgaaaacttcacaagagagcgtgattcaaaaagcaaaagatgatttaaaagatgaaatatctgcaaatataaaagttgtaaaagagttaaaagagaaacttttaaaggatgaagttgtattttag

SEQ ID NO: 8978 - protein, 170 aa, Unknown
  Obtained from environmental sample
  misc_feature (1)..(170): Xaa is any amino acid
MQTLVNESLLNMIKRDGNTVLEEDIAIAKQKIQHGKKQIHLLNEEQKDILATYQAGKAFITKSKVNLFENGIVQEDLIYPSLTQLQNQIKKYLAGSIALEVIKGESYIVFEDEIKEAYKIAHNLVDVYKMKTSQESVIQKAKDDLKDEISANIKVVKELKEKLLKDEVVF

SEQ ID NO: 8979 - DNA, 789 bp, Unknown
  Obtained from environmental sample
  misc_feature (1)..(789): n is a, c, g, or t
atggctgagggattagtctatttatgggtagaagattataaaaacataaaaaagcagggctttaacttctctcctaagtttgagtgtaaatatgatgatgtaactcatgaagtaactataaatgaaaaagagcacataaaagatttttttggtgagaatataaatgttactgccatagttggagagaatgggagtgggaagagtagtgtacaggaaattattaatcatattatcttagaacaagatatacgttctgatgagttaataaaatcaatattattttatattgatgaaaatattgtttatgctattcaaagttgtaaaacaattttggatgaacacaataaatataatttaaagaacttaattattaaaaatgataagtttaaaatatatgaagaagattatgttaacacatcttttaaattaaaaatacatcattttttatttgataattttatacattttgacttttcttataaatatccaaactatcaacaaaaatacagagaatttaaaaatggaattcaaactaaatatgatgaagagtattggaattcattagcaaaaggacatttaattgctttttctttaatagaaaagtacatacatctatttacacttaatgaaaattattttttatttttaggaaaggcttttttatatgatactgtagaaataaatataaatgataatttagagcatattaaacatgaatatgattcaataatagattatgtatctacttcaagtaagttaaaaaataatgaaacaaaaatatatttttaa

SEQ ID NO: 8980 - protein, 262 aa, Unknown
  Obtained from environmental sample
  misc_feature (1)..(262): Xaa is any amino acid
MAEGLVYLWVEDYKNIKKQGFNFSPKFECKYDDVTHEVTINEKEHIKDFFGENINVTAIVGENGSGKSSVQEIINHIILEQDIRSDELIKSILFYIDENIVYAIQSCKTILDEHNKYNLKNLIIKNDKFKIYEEDYVNTSFKLKIHHFLFDNFIHFDFSYKYPNYQQKYREFKNGIQTKYDEEYWNSLAKGHLIAFSLIEKYIHLFTLNENYFLFLGKAFLYDTVEININDNLEHIKHEYDSIIDYVSTSSKLKNNETKIYF

SEQ ID NO: 8981 - DNA, 456 bp, Unknown
  Obtained from environmental sample
  misc_feature (1)..(456): n is a, c, g, or t
atggaacgggtaaagaaaattaaaaaactacatattattataaattcacactcaccttttatattatcagacctgccaaaagagagtgtaatatttttaaaaaaagatgagctaactggttattgtaaaaatgtaagtgatacagaaaatataaacccattcggagcaaatatccacactctgctctctcatggcttttttatgaaagatggacttatgggagagtttgcgaaagagaagatagataaagcgataaaatatctgaatcagaaatctttattaaaagaggaaatagattattgtgaagatatcatctctattgtcggtgagccgattattaaaaagcaacttcaaaaaatgttagatagtaagagattatctgaaattgaacaaattaaagaagaaataaaaagacttgaagatagaatgacttcaatatggaaaaatagtaaatag

SEQ ID NO: 8982 - protein, 151 aa, Unknown
  Obtained from environmental sample
  misc_feature (1)..(151): Xaa is any amino acid
MERVKKIKKLHIIINSHSPFILSDLPKESVIFLKKDELTGYCKNVSDTENINPFGANIHTLLSHGFFMKDGLMGEFAKEKIDKAIKYLNQKSLLKEEIDYCEDIISIVGEPIIKKQLQKMLDSKRLSEIEQIKEEIKRLEDRMTSIWKNSK

SEQ ID NO: 8983 - DNA, 468 bp, Unknown
  Obtained from environmental sample
  misc_feature (1)..(468): n is a, c, g, or t
atgtttaaagaaaaaattaaaaagaagatgatagggattgcacctgcaccgaaacttgtaaaaattcactattcacctcttgaatcaatctcttttgcttatgacaaaacactggaagctagtaaaataatatttttaggggtgcaaaaacttatccaaggaattgtacctcatagtgaaataggaggagttataagtataggtacggtcataagtgatgctagtgcttcaagctttgtagcacttttaactattactgcacttatctctgtaaacctgggtgttttaaatctcctccccattccagcacttgatggtggacatattatgtttaatctttatgagatgataacaggacttaaacctagtgaaaagatgttaataaatctcactattggtggctgggttatattattgggacttatgagtttggggctttataatgatatcaatagattattagggtag

SEQ ID NO: 8984 - protein, 155 aa, Unknown
  Obtained from environmental sample
  DOMAIN (1)...(149): Peptidase family M50
  misc_feature (1)..(155): Xaa is any amino acid
MFKEKIKKKMIGIAPAPKLVKIHYSPLESISFAYDKTLEASKIIFLGVQKLIQGIVPHSEIGGVISIGTVISDASASSFVALLTITALISVNLGVLNLLPIPALDGGHIMFNLYEMITGLKPSEKMLINLTIGGWVILLGLMSLGLYNDINRLLG

SEQ ID NO: 8985 - DNA, 735 bp, Unknown
  Obtained from environmental sample
  misc_feature (1)..(735): n is a, c, g, or t
atgatcgttaatcataattataactatataaaaagtttgattgaaaaaggacagctcacagctaaagcaataaaacaaaaaggttatcttgatgaaaaaaatagcaactggtttttctggcttgcagataaagactttctaaatgttataaattcattggataaagattttatagatgtttttagtaatgctaatttactagaagatctcgatagcttaagagaagaatgtctttctggtcgtgaaaacattcattttaaaacatttaaaaatactattaaagaatatgctgggatttcaaaacagtggaatgttttttggaaacattctaattggaatgaaccatcttcatcttcatcacaaaaatctcattttcctaatgcaactaataaaattaatctaattacaaaagaaatattgttgcttgaaaatagctataatgagtctaggggggtcttgttgatttcttatattgtagctggtttttttatgggtatgatttttgggtctattgcatattctttgataggcgttagtgctcttcttataggaggaattattggtggtagtatttttggagttttatataatgttgtttttgctaaatcggatacagatatgatggaaaattcaatagagattgtaaattctgcagaaaatatttctgatctagaagacgccagaaaaatttactacagcatgctaaataaacgccaataccttaaatccttttaa

SEQ ID NO: 8986 - protein, 244 aa, Unknown
  Obtained from environmental sample
  misc_feature (1)..(244): Xaa is any amino acid
MIVNHNYNYIKSLIEKGQLTAKAIKQKGYLDEKNSNWFFWLADKDFLNVINSLDKDFIDVFSNANLLEDLDSLREECLSGRENIHFKTFKNTIKEYAGISKQWNVFWKHSNWNEPSSSSSQKSHFPNATNKINLITKEILLLENSYNESRGVLLISYIVAGFFMGMIFGSIAYSLIGVSALLIGGIIGGSIFGVLYNVVFAKSDTDMMENSIEIVNSAENISDLEDARKIYYSMLNKRQYLKSF

SEQ ID NO: 8987 - DNA, 783 bp, Unknown
  Obtained from environmental sample
  misc_feature (1)..(783): n is a, c, g, or t
gtggcattctgggatatgcaaatatctaaaaaaaggaaggtgccaatttggaagaaattcatgtttgatgaattttttcaaatacgggcatctggcattaaggctcaatacaatgatttcgaaatcttaggtggtaatttaaaacttcttaatcaaaatgatattgatataaaatttaccacagataacacaattttttattttgtaataaataaaaaagttgttgctgtatatgagttgagtgataagattaaagatggtgcttatgagttgatatctgatttaaaaaagagaaatattaaaactgttatgctaactggtgacaatgagcatagtgctaagaaagtcgcatctgaagttggaattagtgagtttagatatgaacaaactccagaacataaatctgagtatataaataaacttcatgagcaaaaaagaaccgtagttatggttggagacggtgtaaatgatattttggcactagcaagagctgacataggtatcgtgatgggaagtggaagtgatatagctattgatgttggtgatgttgtactattaaatgatacattaaaatcgttgcaagatgcttttaaaattagtcgtactacctatggactaattaaacaaaatctatttatatcattagtctacaatgctactacaataccactcgcaatggcaggatatgttatacctttagtagcggcaatatcaatgtcaatcagttcacttttagttgttggaaactcaatgagaataagatacaaatggaaacaaaattaa

SEQ ID NO: 8988 - protein, 260 aa, Unknown
  Obtained from environmental sample
  DOMAIN (17)...(174): haloacid dehalogenase-like hydrolase
  misc_feature (1)..(260): Xaa is any amino acid
MAFWDMQISKKRKVPIWKKFMFDEFFQIRASGIKAQYNDFEILGGNLKLLNQNDIDIKFTTDNTIFYFVINKKVVAVYELSDKIKDGAYELISDLKKRNIKTVMLTGDNEHSAKKVASEVGISEFRYEQTPEHKSEYINKLHEQKRTVVMVGDGVNDILALARADIGIVMGSGSDIAIDVGDVVLLNDTLKSLQDAFKISRTTYGLIKQNLFISLVYNATTIPLAMAGYVIPLVAAISMSISSLLVVGNSMRIRYKWKQN

SEQ ID NO: 8989 - DNA, 705 bp, Unknown
  Obtained from environmental sample
  misc_feature (1)..(705): n is a, c, g, or t
ttggttgtgtgctgctanagcgaaatgatggaaaatagtttccctaaaaattttaaaaaaggtatttctacttttcaaataattatattattaattgttggatattatgtttggggctatgttgaggataattacctttataaagacaccccaaagtatttagtaaagtttaaagatgcaataaaagatttttcagaacaaaaagatacagtaaaaaaaacatataaagatgcgattgaagcaaaagatgaagcaaaaaaagtaaaatatgtttttaaaaatgaatcaactaaagattttattagaaaatgggaaactactcaaagtgaagtagttacattaaaagagaaatttgaagtgtataaagaggaaactgaaaactttgtagataaacttgatgaaaatttagatcaaattaaagatgatgaagccctaaaagatagaatgagagagtttagtaagaaaaaagcgaaactaatggcaaaaaatattatcaaaatagaacaaaatattgaaaaattagacagatcaataacaaaaggaaataaccttattgtcgcacttaaaactgtaagttcatttaatgttttatccgatgatgcaaaagagtttgattctatattaaatgattctagtgatgtctttgtatcaattgactctttggttgatgaaggtattaaagttcttgatgacgagcttaaatag

SEQ ID NO: 8990 - protein, 234 aa, Unknown
  Obtained from environmental sample
  misc_feature (1)..(234): Xaa is any amino acid
MVVCCXSEMMENSFPKNFKKGISTFQIIILLIVGYYVWGYVEDNYLYKDTPKYLVKFKDAIKDFSEQKDTVKKTYKDAIEAKDEAKKVKYVFKNESTKDFIRKWETTQSEVVTLKEKFEVYKEETENFVDKLDENLDQIKDDEALKDRMREFSKKKAKLMAKNIIKIEQNIEKLDRSITKGNNLIVALKTVSSFNVLSDDAKEFDSILNDSSDVFVSIDSLVDEGIKVLDDELK

SEQ ID NO: 8991 - DNA, 816 bp, Unknown
  Obtained from environmental sample
  misc_feature (1)..(816): n is a, c, g, or t
atgaattcaattgctaaactttctgatagagcgctactcgttattctcgatggatttggaatcaatcccgatgactatcataatgcgatcaagcacgcgaataagcccaatattgatcgtctatttaaagaatatcccatgacgacgattgaagcaggtggagtaaaagttggactgcccaaaggtgttattggaaactcagaagtgggccatatgaatcttggtgcaggtaagccagttcgacaagaccttgtccgaatcaatgaagccattgaaaatggaacttttagtgatcttcctcttctcaaagatttaaaagatactgctcgcagaaacgggggtcgcattcatgtaatgggtcttctctccgacggaggcgttcactcccatatcaaccatatcaaagaagtctttcgtgccttaaataaagaaggtgatctacaaatcttttttcatgctttcatggatggccgagatacggccaaagatgtcggcggaaactatgttgaagaattattaaaagagccaggatttaaatttgcttccatgcagggaagaagtatcggaatggatcgcgatagaagatgggaaaaaattaaaaaggcctatgatacattcacaggttttgggaatgttgaaaatattgaacctctagaatacttaaagcgtgaatatgaccaaggtcgctttgatgaattcattgatcctattctgttcaacgaaaaatatgccatgaaaaaagatgattctgtttttatggttaacttttgngccggatcgtggcattcaaatgaccaaagccctaaccgaacctaa

SEQ ID NO: 8992 - protein, 271 aa, Unknown
  Obtained from environmental sample
  DOMAIN (8)...(268): BPG-independent PGAM N-terminus (iPGM_N)
  misc_feature (1)..(271): Xaa is any amino acid
MNSIAKLSDRALLVILDGFGINPDDYHNAIKHANKPNIDRLFKEYPMTTIEAGGVKVGLPKGVIGNSEVGHMNLGAGKPVRQDLVRINEAIENGTFSDLPLLKDLKDTARRNGGRIHVMGLLSDGGVHSHINHIKEVFRALNKEGDLQIFFHAFMDGRDTAKDVGGNYVEELLKEPGFKFASMQGRSIGMDRDRRWEKIKKAYDTFTGFGNVENIEPLEYLKREYDQGRFDEFIDPILFNEKYAMKKDDSVFMVNFXAGSWHSNDQSPNRT

SEQ ID NO: 8993 - DNA, 444 bp, Unknown
  Obtained from environmental sample
  misc_feature (1)..(444): n is a, c, g, or t
atgttagaagttttcaatgtatctaaaaagtttgataaaactgaagtactaaaaaatataaatatatccatgcaacaaggtgagatcatctccttgttaggtaaaagcggaagcggaaaaagtactatattaaatattatagctgggtttgaagaagctgatagcggctcttgtatctataacaaaaaaacaatttttagtcgggatgttttttgtgaaccgcaagataggcatattggtttcgtatttcaaaactatgcactcttcccacatcttaatattgcaaaaaatatagcatttggtattagtggcaaatctagaccatatcaaaaagagagagttatacaacttcttacgttgatgaatatgtccggtatggaaataagtatcctcatcaatttagcggcggaaaacagcagcccattgccctggcaagatttttag

SEQ ID NO: 8994 - protein, 147 aa, Unknown
  Obtained from environmental sample
  DOMAIN (27)...(147): ABC transporter
  misc_feature (1)..(147): Xaa is any amino acid
MLEVFNVSKKFDKTEVLKNINISMQQGEIISLLGKSGSGKSTILNIIAGFEEADSGSCIYNKKTIFSRDVFCEPQDRHIGFVFQNYALFPHLNIAKNIAFGISGKSRPYQKERVIQLLTLMNMSGMEISILINLAAENSSPLPWQDF

SEQ ID NO: 8995 - DNA, 369 bp, Unknown
  Obtained from environmental sample
  misc_feature (1)..(369): n is a, c, g, or t
ttgatgaatatgtctggtatggaaaataagtatcctcatcaaattagcggcggacaacagcagcgcattgccatggcaagagttttagcaagagatagtgaacttattttatttgatgaagctttctcaagcatagactctacactaaaatcaaaaattatgacggagataaaagagattataaaatcaaatcataaaacagcaatctttgttacacactgcccaaaagaggcatttgaactaagtgataagatcgcatacatagaaaatggagaaattatccaatacgatacaccagtaaatatatgtaaaaacccatcaacagaatcaatatcaaaagtattttcagaatgtgggatacttttataa

SEQ ID NO: 8996 - protein, 122 aa, Unknown
  Obtained from environmental sample
  DOMAIN (1)...(91): ABC transporter
  misc_feature (1)..(122): Xaa is any amino acid
MMNMSGMENKYPHQISGGQQQRIAMARVLARDSELILFDEAFSSIDSTLKSKIMTEIKEIIKSNHKTAIFVTHCPKEAFELSDKIAYIENGEIIQYDTPVNICKNPSTESISKVFSECGILL

SEQ ID NO: 8997 - DNA, 666 bp, Unknown
  Obtained from environmental sample
  misc_feature (1)..(666): n is a, c, g, or t
ttgaaaataatttcaggaattccaattgagcaggaaataactttggatacaatttcaactgaaaatattacagaaaataaaccttcgcatggcagctttttattggaaaaactaccggattatcaattgctcggaaaacagaatgaactcagcgaacttcagattgaggccagtaaatcagaatattatccaaacctggctgcattcgggcagtttagctattcaagctatgccaccaaatttcagtttaaaaattttaacaacatgaatacaattgggcttcaggccacaataccaatttttagttcaggtatgcgaaaacaaaaacttcttcaatcgcaatttaagcttgagcaaaacttggaagattttaaactgaacagcaagtatttaataaccaattataaaaatgctaccaactcgttattgtcggcctggtcgaaccttcagaatcaaaaggaaaacaaggaattggcaaacaaggtgtatgaccaggtaaaactccaatttgacgaaggcatggcttcattgacagatttattaaatgttgaaacttcactgctggatgctgaaaggttatttttcgatcaacttattagatatgcacaagctaaagttgatttgctgaaaactaccggagaacttaaatcgcttatcaacaattaa

SEQ ID NO: 8998 - protein, 221 aa, Unknown
  Obtained from environmental sample
  DOMAIN (35)...(213): Outer membrane efflux protein
  misc_feature (1)..(221): Xaa is any amino acid
MKIISGIPIEQEITLDTISTENITENKPSHGSFLLEKLPDYQLLGKQNELSELQIEASKSEYYPNLAAFGQFSYSSYATKFQFKNFNNMNTIGLQATIPIFSSGMRKQKLLQSQFKLEQNLEDFKLNSKYLITNYKNATNSLLSAWSNLQNQKENKELANKVYDQVKLQFDEGMASLTDLLNVETSLLDAERLFFDQLIRYAQAKVDLLKTTGELKSLINN

SEQ ID NO: 8999 - DNA, 378 bp, Unknown
  Obtained from environmental sample
  misc_feature (1)..(378): n is a, c, g, or t
ttgatttgccatattattttaccaaaaaatatcattatggcaaaagctaaaatacttacaaaagaagaaatgtatcaagaaaatattattgcagtaaaatatgtaaaagggacacgggattatgaaatttgtggggggatgtctgataagcaagaatatattaccaaagaaataaagcgggtgcaatatcttaaaatatgctggaattgtggctgtgcttatgagagtaataagtataactcatttgcctgcaatacgaaatgcagacaaagtcttatttataagtttaatcgtggattaaaatctcctgtaagaatggagtttcacttgaagacaaaaaatgtggagcggctgaaggatatacatggatatttgtaa

SEQ ID NO: 9000 - protein, 125 aa, Unknown
  Obtained from environmental sample
  misc_feature (1)..(125): Xaa is any amino acid
MICHIILPKNIIMAKAKILTKEEMYQENIIAVKYVKGTRDYEICGGMSDKQEYITKEIKRVQYLKICWNCGCAYESNKYNSFACNTKCRQSLIYKFNRGLKSPVRMEFHLKTKNVERLKDIHGYL

SEQ ID NO: 9001 - DNA, 330 bp, Unknown
  Obtained from environmental sample
  misc_feature (1)..(330): n is a, c, g, or t
atgaaaacattgacaaacattcagtcatacaataaatacttattagagaatattgtaagcaatatatttccttgttatgatctctggactttgcgttcatacgaaaatcgaaagtttgaacataattctggatattgtacagaaacagagaagttttctcaatttatttctagatatgccgaacaagataagtcaccagaattattgttagttattggaaatggggaaaagaaatatcctaccattatgctaaacacaagtaaaaagtatatgataatcaaatttgatgctcaaacagaatacttaggcgaaccattgattttttcttaa

SEQ ID NO: 9002 - protein, 109 aa, Unknown
  Obtained from environmental sample
  misc_feature (1)..(109): Xaa is any amino acid
MKTLTNIQSYNKYLLENIVSNIFPCYDLWTLRSYENRKFEHNSGYCTETEKFSQFISRYAEQDKSPELLLVIGNGEKKYPTIMLNTSKKYMIIKFDAQTEYLGEPLIFS

SEQ ID NO: 9003 - DNA, 924 bp, Unknown
  Obtained from environmental sample
  misc_feature (1)..(924): n is a, c, g, or t
gtgtcagatgtatcgttgcacgattgtaataaatggtatagtgaaacaactggcactcccttgtatgatataaaattaaaacacaaatggcaatcctatttaaattgtatggaacaaggaatgcccattaaaaaaatagcaaaagaattaaatataagcgtacagacaagctttgattggcgacataaagtgttaagttccctatccgagtttaagccatctgaattatcaaacgaagtagaatgtgatgaattagagttagctcttagccttaaaggaagtaggaacatcgacagaaaacccagaaaaagaggaacagattttaagagaaatattggaaaagataaagtcacaacagtacaagtggtaacagcagtacagagaaatggagcgaaatttcttacggcagttgaaacaaaacgtcttagcaaagaagatatagaaaaggtgtttgatggaaagttagcagataatactatattaataacggataaacatccatcctacaaagcctttgcaaaagacaattcagaaattaagcacaaagctctacttgcaaaagaccatgtagataaaaacgataaatcaatacatctacaaaaagttaataatacacacaaacaagtaaggaattttctaaaacctttcaatggtgtaagttcaaaatatctgcaaaactatttaaactggtatgcctatattgataaaatcagaaacagtaaaaccatgattaagcaatggtttatcaccatgctgttgacagatccagcatatggtttatatgagttgtttaaacaaaatgctgttatatttagaactaacccaatatacctaataaactatgaaaaaactttacaaaccttcagccaaacaataaaatactttttaaaaaaaattgggaagccaaaaattttccctggttaa

SEQ ID NO: 9004 - protein, 307 aa, Unknown
  Obtained from environmental sample
  misc_feature (1)..(307): Xaa is any amino acid
MSDVSLHDCNKWYSETTGTPLYDIKLKHKWQSYLNCMEQGMPIKKIAKELNISVQTSFDWRHKVLSSLSEFKPSELSNEVECDELELALSLKGSRNIDRKPRKRGTDFKRNIGKDKVTTVQVVTAVQRNGAKFLTAVETKRLSKEDIEKVFDGKLADNTILITDKHPSYKAFAKDNSEIKHKALLAKDHVDKNDKSIHLQKVNNTHKQVRNFLKPFNGVSSKYLQNYLNWYAYIDKIRNSKTMIKQWFITMLLTDPAYGLYELFKQNAVIFRTNPIYLINYEKTLQTFSQTIKYFLKKIGKPKIFPG

SEQ ID NO: 9005 - DNA, 510 bp, Unknown
  Obtained from environmental sample
  misc_feature (1)..(510): n is a, c, g, or t
ttgaccctattacgtgaagccaaatcagtagaagttatcgagtttatagaaagattaggagcacaattacgcttaatattctctaagaaaacaggaagttactcagctatttttagcaaaggactttcaactcttaagcccgaagatcttattaaaattacagaagaaacacttgttgtacttcgcaataatactgaaagagttgctatttatggagtaacaaacgaaaagatagcagacttagaaactcttataaatgagtttagtgtattgcacatcaaccaaaaaggtagaacgcaaagtttaagtaactttaccgaagaccgtattgatcttagaacagatgtttataatttgctgcaatacatctcaggagtaggacgagcttattggaaaaggaacaaaaaatcaagatatgatgactatgttcttcaaaaactaaaagctaaacccgtagccaaggctacggaaacaaccgaagaagtagaacacgtttctacaaacttctaa

SEQ ID NO: 9006 - protein, 169 aa, Unknown
  Obtained from environmental sample
  misc_feature (1)..(169): Xaa is any amino acid
MTLLREAKSVEVIEFIERLGAQLRLIFSKKTGSYSAIFSKGLSTLKPEDLIKITEETLVVLRNNTERVAIYGVTNEKIADLETLINEFSVLHINQKGRTQSLSNFTEDRIDLRTDVYNLLQYISGVGRAYWKRNKKSRYDDYVLQKLKAKPVAKATETTEEVEHVSTNF

SEQ ID NO: 9007 - DNA, 621 bp, Unknown
  Obtained from environmental sample
  misc_feature (1)..(621): n is a, c, g, or t
gtgggtggggagttgataatctcttatggaacttattttggtgtgcctgtagtgaacgaatatggagcttcagaattagatcttatcgcgtttcaaaacctaaaggatgaatggcaagttaatagtgaaacactatatatagaaattttagatattaatgataatgttttaccttatggtgaagagggcagaattgttgttacgtccttatgcaataaagcacacccttttattagatacgaccttggagatattggtgtgttatctaaagacagtacatttagaaaaccaattctaaaaaaactaattggaagaacaaatgacattatcgttttgccgagtggtaaaaaggctgctggactgaccttttattacattaccaaaagcgtcatagaaaacgatggaaatgtcttagaatttgtagttgaacaaacgcttttagatgcttttaaaattagttatgttggtaaatcagagctttctgaagcaaagaaaacagttattactaatgaagttatacgttatttagaacctaatattaccattacttttgagtggcttgaaaagctccaccgctcaacttctggaaaattaaaacaatttacatcacatttaaaataa

SEQ ID NO: 9008 - protein, 206 aa, Unknown
  Obtained from environmental sample
  misc_feature (1)..(206): Xaa is any amino acid
MGGELIISYGTYFGVPVVNEYGASELDLIAFQNLKDEWQVNSETLYIEILDINDNVLPYGEEGRIVVTSLCNKAHPFIRYDLGDIGVLSKDSTFRKPILKKLIGRTNDIIVLPSGKKAAGLTFYYITKSVIENDGNVLEFVVEQTLLDAFKISYVGKSELSEAKKTVITNEVIRYLEPNITITFEWLEKLHRSTSGKLKQFTSHLK

SEQ ID NO: 9009 - DNA, 876 bp, Unknown
  Obtained from environmental sample
  misc_feature (1)..(876): n is a, c, g, or t
ttggtttatgcgtttgaaggattttttagaagtataaatatagaagtttcagtaacgcttaattatcttatatatacatttttagctataagctttgtaaaactattaagctattatattttaaaaagtattagggtatatctcaaaggaaacttaagaaatattattgtcataggagatggagaaagtgttaatgcattaaagaaaatatttagagaaaagaaagaattaggttataatataaaggctgtgtttagcaatactcaagatgaaaataattcaggagatattgaagatagttttacttatttagcgaagaataatgataatatagatgaaatatactgttcaattgctgatctgtcagagaaagaactcaatgaatatgtaagatatgctaatataaatcactgtaacattaagtttattcctaatactaaaaaactaatcaataaacgttataaaactgattattacaattacattcctgtattatctatacaagaggttgctctcaacaatgaagtaaacaaatttattaaacgtgtatttgatattgtttttgctctgctaataatcatttttatattacctgtgatttctattattttgtttgttttaattaagttagagtctaaaggaccattgttttataagcataaacgaacaggcattaattacaaagcattctattgttataaatttagatctcttaccacaacccaagagtctaaaggtacttatgtaagacaaaatgatacgcgtgtgactacgataggtaaatttattagacgaaacagtattgatgagttaccgcagtttgtaaatgtattaaaaggtgaatgtctgttgtgggtccaagaccacatatgttaa

SEQ ID NO: 9010 - protein, 291 aa, Unknown
  Obtained from environmental sample
  DOMAIN (181)...(290): Bacterial sugar transferase
  misc_feature (1)..(291): Xaa is any amino acid
MVYAFEGFFRSINIEVSVTLNYLIYTFLAISFVKLLSYYILKSIRVYLKGNLRNIIVIGDGESVNALKKIFREKKELGYNIKAVFSNTQDENNSGDIEDSFTYLAKNNDNIDEIYCSIADLSEKELNEYVRYANINHCNIKFIPNTKKLINKRYKTDYYNYIPVLSIQEVALNNEVNKFIKRVFDIVFALLIIIFILPVISIILFVLIKLESKGPLFYKHKRTGINYKAFYCYKFRSLTTTQESKGTYVRQNDTRVTTIGKFIRRNSIDELPQFVNVLKGECLLWVQDHIC

SEQ ID NO: 9011 - DNA, 858 bp, Unknown
  Obtained from environmental sample
  misc_feature (1)..(858): n is a, c, g, or t
gtgtttagtgatactatcaatacaggtatttatataattgaacctgaaattttaaactatataccacatggtgaaaactttgattttgcaaaagacctcttcccgacattgatgacaaatgatatagcactttggggatatagtgcccaaggatattggagagatgtgggaaatccacaaagttatcgagaggtatatgatgatatttttaaaggtcttattacacttccttataaaggtgaaaaaataacttttgaaaatggagttgcatatatagaagatggggtaacacttcatgaaaaaataagaatcaatggcactgtaattattggaaaagattcaaaagtagctgaaggtgtgacactaagcaatgtatcaataggtgctaatgtaaaaataaaaaaacattctgaaatatctaatagtgttttttgggataatatcgccgtaggacaaaaagtgattatccacaatagtgctatttgtaatgacaatatcatcaaagatgaagtaaaagcaaattttggtgttattatggctgaacattgtgagattggaaaaaaagttagctttgaaaaagatattatgatgtggcctgataaaattatcgatgctaactctgttgtaagtaataatgtaatttggggaaataaatacaaagcttctatttttgaagatgggaaagtaattggtagaactaacattgaactatctcctgatatcagtgtaaaactcgcagaatcttttgggtcaattttaacaattggaagcaaagtatatatctcaagagattatcataaaagttccagaatgttaaaaagagcatttttatcagggattctcttcacagggaattga

SEQ ID NO: 9012 - protein, 285 aa, Unknown
  Obtained from environmental sample
  misc_feature (1)..(285): Xaa is any amino acid
MFSDTINTGIYIIEPEILNYIPHGENFDFAKDLFPTLMTNDIALWGYSAQGYWRDVGNPQSYREVYDDIFKGLITLPYKGEKITFENGVAYIEDGVTLHEKIRINGTVIIGKDSKVAEGVTLSNVSIGANVKIKKHSEISNSVFWDNIAVGQKVIIHNSAICNDNIIKDEVKANFGVIMAEHCEIGKKVSFEKDIMMWPDKIIDANSVVSNNVIWGNKYKASIFEDGKVIGRTNIELSPDISVKLAESFGSILTIGSKVYISRDYHKSSRMLKRAFLSGILFTGN

SEQ ID NO: 9013 - DNA, 861 bp, Unknown
  Obtained from environmental sample
  misc_feature (1)..(861): n is a, c, g, or t
gtgatgagacactgtttagcaaatgatgaaaaaatagcagcaggggtacatnttagacaatctgtagaagaccctgcaaatacagaaattgtactttacacaagtgaaggattagctatagattcaaaattagctaaatctattgagcgaattttctttagagaaaacttcagacgagtggactatacagagattggtgagatttcaaacaaaaaaaatattaacaatagatatctaagtgccgtaatagaaaaacttgatttaactatctttaaaaacaataacttaaaaatagcagtagatatgatgtttggctcaactgcagatatctatcctaaaattatgaatcatcttggaattgaaaatattctactcaatggttatcatgatgagaaaagtttgtctaaaatgccaaattgtgtaacaaaatcacaaaaagatatggcaaatatggtaaaagctatgaatctagattgtggatttttaatctatccaaatggtcaaaaatttcaaattattgatgatgagggtgaacttgtttatgactatatcactttacttgtgatattatgtttacttgatttgacaactgaaaaaagattaaaaatatttttaccagcatgggctcctgattgtatcgagtataataacttagatatcacgagaggaaaactcaacaacctaaaagctactgacttaagagagtataacttaatagcaactaccgatggacattttgcatttagtgagtttggtttgaatcgagatgcggtattttcaagttttaaaatacttgaactacttcaaaaatctggaaaaacactctctaatataattgcacatatcccatatttgctataa

SEQ ID NO: 9014 - protein, 286 aa, Unknown
  Obtained from environmental sample
  DOMAIN (76)...(170): Phosphoglucomutase/phosphomannomutase, alpha/beta/alpha domain II
  misc_feature (1)..(286): Xaa is any amino acid
MMRHCLANDEKIAAGVHXRQSVEDPANTEIVLYTSEGLAIDSKLAKSIERIFFRENFRRVDYTEIGEISNKKNINNRYLSAVIEKLDLTIFKNNNLKIAVDMMFGSTADIYPKIMNHLGIENILLNGYHDEKSLSKMPNCVTKSQKDMANMVKAMNLDCGFLIYPNGQKFQIIDDEGELVYDYITLLVILCLLDLTTEKRLKIFLPAWAPDCIEYNNLDITRGKLNNLKATDLREYNLIATTDGHFAFSEFGLNRDAVFSSFKILELLQKSGKTLSNIIAHIPYLL

SEQ ID NO: 9015 - DNA, 483 bp, Unknown
  Obtained from environmental sample
  misc_feature (1)..(483): n is a, c, g, or t
ttgtgngtggagtctctaattgtttttaatttaattggaatggcttctgcttctagaggactgtctattagtaagggttttgaaaataaagaagtttttattgaagaaataaaagctttaaaagaatatgttgaaattgttcgatctgctggagggagattcgttagtttttcaaactatcctattaatctttttgttttatttttgtttttgccaatgttttttattcttccctttcgtaataagttatccagcattattaataagggtagaggagataaacttaaagatttagatgaaattgattattataatggggcggttgtgagtcttgctaagaaaattgaattagagaaagcagaaaagctagataaaattgattcgccttctttagagattaatattatgaaaggaatttcaaaaaaagcgtttattaatcagaaaatatattggagagttttagaaaaatttaagaagttttaa

SEQ ID NO: 9016 - protein, 160 aa, Unknown
  Obtained from environmental sample
  misc_feature (1)..(160): Xaa is any amino acid
MXVESLIVFNLIGMASASRGLSISKGFENKEVFIEEIKALKEYVEIVRSAGGRFVSFSNYPINLFVLFLFLPMFFILPFRNKLSSIINKGRGDKLKDLDEIDYYNGAVVSLAKKIELEKAEKLDKIDSPSLEINIMKGISKKAFINQKIYWRVLEKFKKF

SEQ ID NO: 9017 - DNA, 396 bp, Unknown
  Obtained from environmental sample
  misc_feature (1)..(396): n is a, c, g, or t
atgattagattaatagcagtacaacttctcttagtaacttttttgctaagtgaagatttagatataaaaaaacttcaaaatgagtttattaaaaatgtgattgaacttaatgtttataaaaaaagatattctcaatttcttgacaaaaagtgtcaaacagattatatctgtttgcaagaacagatacaaagactcaaaacttgggaaagtgttcaaaatgataatatactaaaaaaacttcttaagaaaaaacttttaaaaacactttatgataaagagtattgggaaaaagttttaccnaaaataacacanacaaatataaatcttaaagagagtcagttcgtcagtattattgacctaaaaaaaccatacttcatagttgcacttttgggataa

SEQ ID NO: 9018 - protein, 131 aa, Unknown
  Obtained from environmental sample
  misc_feature (1)..(131): Xaa is any amino acid
MIRLIAVQLLLVTFLLSEDLDIKKLQNEFIKNVIELNVYKKRYSQFLDKKCQTDYICLQEQIQRLKTWESVQNDNILKKLLKKKLLKTLYDKEYWEKVLPKITXTNINLKESQFVSIIDLKKPYFIVALLG

SEQ ID NO: 9019 - DNA, 909 bp, Unknown
  Obtained from environmental sample
  misc_feature (1)..(909): n is a, c, g, or t
atgcttttaactcagaccaacaagcctgtcgggaaaattattcagtatgaagataatttgtttgtaagagcacatccttttcatagttatttacaactgataaacaacattaacattgataattatgttgcaggtgtagtagaagccgaagtgggtaaaagtccaccggaggaatattttaaattgcaagctattatttgccgtacttatgcgttgaaaaatattaacaagcaccaaactgaaggttttagtttgtgcgacaaagtacattgccaggcttaccacggaaagccaaaatcggaacaaataaaacaatcggcattgcttacttctaacacggtaattgtagatagcgacattaatttaattactgcaaccttttattcaaattgtggtggacaatctgctaattctgaagaagtttggcatcaggaattatattacttacgttcggtaaaagattctttttgtttgaatgaaaacaattccatttgggagaaaaaaatagctaaaaacgagtgggcaaattatttgataacgaatggttatcctaaagaaattttgaaagacagttgtcattttgagtatttccaaatagggagagaacgcttttttgaaaagcaaaatgtgcaaataccttttgtaaaagtacgaaccgattggaagctaaaatcggcacagtttgatgtaaaaactgaaggtaattttgtagtgttgcagggtaaaggttttggacatggggtaggtctttgccaagaagggaccatgcctatggcaaaaatgggttatacttacgcagaaatcttactttattattaccaaaaatgtcacctgggtagatttagaatccgctcgactttttttaaaggccgagtttttaaaggaaataaatttggttttgccttttag

SEQ ID NO: 9020 - protein, 302 aa, Unknown
  Obtained from environmental sample
  misc_feature (1)..(302): Xaa is any amino acid
MLLTQTNKPVGKIIQYEDNLFVRAHPFHSYLQLINNINIDNYVAGVVEAEVGKSPPEEYFKLQAIICRTYALKNINKHQTEGFSLCDKVHCQAYHGKPKSEQIKQSALLTSNTVIVDSDINLITATFYSNCGGQSANSEEVWHQELYYLRSVKDSFCLNENNSIWEKKIAKNEWANYLITNGYPKEILKDSCHFEYFQIGRERFFEKQNVQIPFVKVRTDWKLKSAQFDVKTEGNFVVLQGKGFGHGVGLCQEGTMPMAKMGYTYAEILLYYYQKCHLGRFRIRSTFFKGRVFKGNKFGFAF

SEQ ID NO: 9021 - DNA, 840 bp, Unknown
  Obtained from environmental sample
  misc_feature (1)..(840): n is a, c, g, or t
atgaattacaaatcatttttagcattaacagcagctgtaattatttctttttcagctcaatctcaagacaaagctgttgtaaaaaaagcagcaagtttatttgataaatataactttattgaagcacttgatgagtatcttgcacttttagaagaaactcctgacgatatgatgtttaactacagggttggggtttgttatttaaatactaatattgataaatctaatgctgttagttatttagaaaaagttgtaaaaagcgaaaaaccaaatccaactgctttttatttattaggaagagcttaccattatgcttatcgttttagtgatgctattaacatgtttgagcaatttagagaaataaataaaggggatgtaatttctgtagaagatgttgctaagcaaattgaatattgttacaatgcgacagaattaatgaaatttcaattagatgtttcttttaataatttaggaaatcaaattaactctcctggaccagattattatccatttgtacctcaagatgaatcttttattgtttacaattctaaaagagatgacggaagtttaaaaatggataacggcaattatttttctgaaatatatatttctaaagctaaaactggtgaatttcaaaaggcaagaaaattagatcanaatattaatatgcttaatggaaatgaagaggttgttggtttatcggctgacggtaagtatattcttttttatttcgaaaatgataaccactatggtgatttatttattgcagaattagttgatgaaaaggtaatcaatttagaaaacctaccgtctgagattaatcttcagaaccggaaatag

SEQ ID NO: 9022 - protein, 279 aa, Unknown
  Obtained from environmental sample
  SIGNAL (1)...(19)
  misc_feature (1)..(279): Xaa is any amino acid
MNYKSFLALTAAVIISFSAQSQDKAVVKKAASLFDKYNFIEALDEYLALLEETPDDMMFNYRVGVCYLNTNIDKSNAVSYLEKVVKSEKPNPTAFYLLGRAYHYAYRFSDAINMFEQFREINKGDVISVEDVAKQIEYCYNATELMKFQLDVSFNNLGNQINSPGPDYYPFVPQDESFIVYNSKRDDGSLKMDNGNYFSEIYISKAKTGEFQKARKLDXNINMLNGNEEVVGLSADGKYILFYFENDNHYGDLFIAELVDEKVINLENLPSEINLQNRK

SEQ ID NO: 9023 - DNA, 729 bp, Unknown
  Obtained from environmental sample
  misc_feature (1)..(729): n is a, c, g, or t
atgcttaaacggatgaaatttggaacacaaagtgagcgttttttaaaacaaataatcgatcccaatcaacttcatttatcctttgaagatttggctcaagaatcagaaataaaccctgatgaagagaagcctgtaaaggaattaattacataccaaagaacaaaaaagaaacacaacggacgcaataaattacccgaaaatcttcctgttaaagaaattgtaattgagccagaagaatcaaccgaaggcttaacaagaattggtgaagaaaaaactgaaattctggaatacacaccaggtaactttttcaaaattgtaatcatcagacccaaatatgccaaagaaaataatagcggaattttaattgccgatataccttcgcgcccaattgaaaaatgtttggctggcaactttttactagcttcaatattgatcaataaatatgttgatcacttacctctttatcgccaacagcaaatatttaaacgaagagacattcaaatagcaccttcaaccatcgatagttgggtggccaaactaggttatttactcgaacctctttacaatgccatggtcgaatatgtcaagcattcatcatatatacaagccgatgaaacacccacaagggtactcgacaaaaacaaaaaaggcaagtcgcatcggggatattattgggtttaccattcaccgcttaagcggatggttatttttgatttaccaaaaaagtag

SEQ ID NO: 9024 - protein, 242 aa, Unknown
  Obtained from environmental sample
  DOMAIN (84)...(239): Transposase IS66 family
  misc_feature (1)..(242): Xaa is any amino acid
MLKRMKFGTQSERFLKQIIDPNQLHLSFEDLAQESEINPDEEKPVKELITYQRTKKKHNGRNKLPENLPVKEIVIEPEESTEGLTRIGEEKTEILEYTPGNFFKIVIIRPKYAKENNSGILIADIPSRPIEKCLAGNFLLASILINKYVDHLPLYRQQQIFKRRDIQIAPSTIDSWVAKLGYLLEPLYNAMVEYVKHSSYIQADETPTRVLDKNKKGKSHRGYYWVYHSPLKRMVIFDLPKK

SEQ ID NO: 9025 - DNA, 822 bp, Unknown
  Obtained from environmental sample
  misc_feature (1)..(822): n is a, c, g, or t
atgacagatcggctgagttgggtttttgatatctttgatgattttagatattttgtagagatagctttaactcttgaagctttggtattttctgtagcactttctgataaaataaatcaactagaacagaaaaaaaacgaagcaaatatggagcttatcttaaatcaacaattagaacaacaaagactagaatatcaagtaaaagagaaaacaaaagagttacaacacgcttttgaggagaaaaacttacttctaaaagaactcaatcatagagttaaaaacaatatgcaaactattatctcactaatacgactacaaaccaatgagataaaagaggagtctatcaaaaagatatttgaaacaacttacaatagaataaatgctatgagtaaactgcatgaactttttgacagtaaagacaaactctctaatataaatgcaaatatatatcttcaaaatcttattgatgaacttaaaagtggttttgaaagtgaaaatataaaaataaattttgatatacaaacaactatcaagatagaagatgctgtttattgtggacttattgtcaatgaactggtgacaaactctttaaaatatgcttttccagataataatgggactataaatatacaatttatagaacaatctgataactatatactcagtatagaagataatgggataggctataatcaacaaaacacactagctaatttaggattaactcttatcaatactttagcaacaaaacaactcanagggacaattcaaaaagatactacaaatggtgttcatgtagttgtagtatggagtaaaaaatga

SEQ ID NO: 9026 - protein, 273 aa, Unknown
  Obtained from environmental sample
  DOMAIN (180)...(273): Histidine kinase-, DNA gyrase B-, and HSP90-like ATPase
  misc_feature (1)..(273): Xaa is any amino acid
MTDRLSWVFDIFDDFRYFVEIALTLEALVFSVALSDKINQLEQKKNEANMELILNQQLEQQRLEYQVKEKTKELQHAFEEKNLLLKELNHRVKNNMQTIISLIRLQTNEIKEESIKKIFETTYNRINAMSKLHELFDSKDKLSNINANIYLQNLIDELKSGFESENIKINFDIQTTIKIEDAVYCGLIVNELVTNSLKYAFPDNNGTINIQFIEQSDNYILSIEDNGIGYNQQNTLANLGLTLINTLATKQLXGTIQKDTTNGVHVVVVWSKK

SEQ ID NO: 9027 - DNA, 303 bp, Unknown
  Obtained from environmental sample
  misc_feature (1)..(303): n is a, c, g, or t
atgacctttgttgcagtatttaataaagaattaggctttggtgtaagaattaattttaatataattgacttaccatatttcatggagtggaaatctatggctagtaatgattatgttattggttttgagccatctaattcatctgtttatggacgagcttttcatgagagtgaaaatagtattccatccattggtccctatgagaaaaaaactgtttcatggtcatttgaaataattaaagatgaaaatgaaaaaattgaattgatagaaaaaataaaagattttacgaataaagaggtataa

SEQ ID NO: 9028 - protein, 100 aa, Unknown
  Obtained from environmental sample
  misc_feature (1)..(100): Xaa is any amino acid
MTFVAVFNKELGFGVRINFNIIDLPYFMEWKSMASNDYVIGFEPSNSSVYGRAFHESENSIPSIGPYEKKTVSWSFEIIKDENEKIELIEKIKDFTNKEV

SEQ ID NO: 9029 - DNA, 981 bp, Unknown
  Obtained from environmental sample
  misc_feature (1)..(981): n is a, c, g, or t
atggtcagaatcggctcgagagatgagaagaattacaaaaaacaatttgatctcacagaaattgcagtattagagcgaaaagttggaccaattaaagcagatattaaaataggacttgtatcagatgatgataataaaattgtaaactctttagaaaaattaactaaagaattaaaatcaattgaagggacaaaatctgttgcaaattcagctaaatttggaattgatgagattaaactcaaagtaaactcttatggggaacaattaggtataacagaatcaagtattggaatatatttatcaaacctttatttaacaaagaaaaaatcagtctcttttgatgtaagagatatgcttgatattaaaatagaatcactcaataaagacgattttgaaaactttaaaaatacaccaatacctataaataatggaactgtacgacttaatgaagtttgtgattttgttataaaaaaatcatttgaacaactcacaaaagataatggtgaaaaaaacttctatatctatgcaaatgtggatacaaaaatagtgacatccacagaagttatggaaaaaattcaaccacttctagatgagattaaaaaaaatggtgttaaaatagttcttaaaggggaagctaaaaagaaaaaagagttggcggctgatatgcttgcagctgccctattagcacttactcttataatgctctctatgttatatctgtttaactcatttagagaaactgctattttaatgtctgtaataccattttcatttttaggggttttaatagggcatgctcttttgggactaaatctctctatgccttctattattggagcactaggactagcgggagttgttataaatgatggtattattatgatgacctatctaaagaaagctaaaactattgaagatgtatttatacgagctacgaaaggtttagacccaattgttttaacaaccataacacacttatag

SEQ ID NO: 9030 - protein, 326 aa, Unknown
  Obtained from environmental sample
  misc_feature (1)..(326): Xaa is any amino acid
MVRIGSRDEKNYKKQFDLTEIAVLERKVGPIKADIKIGLVSDDDNKIVNSLEKLTKELKSIEGTKSVANSAKFGIDEIKLKVNSYGEQLGITESSIGIYLSNLYLTKKKSVSFDVRDMLDIKIESLNKDDFENFKNTPIPINNGTVRLNEVCDFVIKKSFEQLTKDNGEKNFYIYANVDTKIVTSTEVMEKIQPLLDEIKKNGVKIVLKGEAKKKKELAADMLAAALLALTLIMLSMLYLFNSFRETAILMSVIPFSFLGVLIGHALLGLNLSMPSIIGALGLAGVVINDGIIMMTYLKKAKTIEDVFIRATKGLDPIVLTTITHL

SEQ ID NO: 9031 - DNA, 360 bp, Unknown
  Obtained from environmental sample
  misc_feature (1)..(360): n is a, c, g, or t
atgaaagaacttcttagcggcgagtgtgatctgacatctgtagataatatagttattcaacttcacaaaactgctattaatgcgttacaatatatctataattgctttatatctatagatagttgtgatgttgaagatatctatagaaaagtgatggtagaagagagtaaaaatgatgacctctttgctcttttagaaaaagagatcttaactaccattatgcatgaaggggagttgtctgctgattatgtaaaagcactggcaaccttacgtaaattagagcgtagtggagatagaagcgtaaatattgccaacttaatgctatttgcaaaagttggtggaagtataaagagttattag

SEQ ID NO: 9032 - protein, 119 aa, Unknown
  Obtained from environmental sample
  DOMAIN (18)...(107): PhoU family
  misc_feature (1)..(119): Xaa is any amino acid
MKELLSGECDLTSVDNIVIQLHKTAINALQYIYNCFISIDSCDVEDIYRKVMVEESKNDDLFALLEKEILTTIMHEGELSADYVKALATLRKLERSGDRSVNIANLMLFAKVGGSIKSY

SEQ ID NO: 9033 - DNA, 375 bp, Unknown
  Obtained from environmental sample
  misc_feature (1)..(375): n is a, c, g, or t
atgacaaaaccttttaatataaaagagcttattttaagagtcaaagccatacttaaacgcacaaaaaaaggtgtaaaaaatggtaatgtagcttatagagatatacttttaaatctaaataatcatcaaacctttgtagacaaaaaagaggttttactaacaaagttagagtttaacctgcttcatacacttattttaaatcaacacaatgttttagatcgtgattatctgctagaaaatgtttggggtggtgatgatgtttatcaagatagaacagtaaatgtagctattaaccgcctaaaagagaagatagatcctacaaaagagaaagattatattaagacagtaagaggggttggctacacactgtgttaa

SEQ ID NO: 9034 - protein, 124 aa, Unknown
  Obtained from environmental sample
  DOMAIN (48)...(123): Transcriptional regulatory protein, C terminal
  misc_feature (1)..(124): Xaa is any amino acid
MTKPFNIKELILRVKAILKRTKKGVKNGNVAYRDILLNLNNHQTFVDKKEVLLTKLEFNLLHTLILNQHNVLDRDYLLENVWGGDDVYQDRTVNVAINRLKEKIDPTKEKDYIKTVRGVGYTLC

SEQ ID NO: 9035 - DNA, 417 bp, Unknown
  Obtained from environmental sample
  misc_feature (1)..(417): n is a, c, g, or t
atgattgattacagaactcatatcgacaaaggttctatgttcaacaccccaccagcattcacaatttacgtaattggtgaagttctgaagcacattgaaaaaatgggcggactggttgagatggaaaaacgcaacatcgaaaaagctgactgtctttacaacatcttcgacagttcagagttcttcaacggaactgtagttcctgaagatcgttccctcatgaacattcctttccgtcttcctaccgaagaacttgaaaagaaattcatcgctgaagcaactgccaaaaacatgatcggtcttaaaggccatagatctgtaggtggatgccgtgcttctgtttacaattcacagaaactcgaagctactaaagctttagctaaattcatgcttgaattcgaaaaaaacaacaaataa

SEQ ID NO: 9036 - protein, 138 aa, Unknown
  Obtained from environmental sample
  misc_feature (1)..(138): Xaa is any amino acid
MIDYRTHIDKGSMFNTPPAFTIYVIGEVLKHIEKMGGLVEMEKRNIEKADCLYNIFDSSEFFNGTVVPEDRSLMNIPFRLPTEELEKKFIAEATAKNMIGLKGHRSVGGCRASVYNSQKLEATKALAKFMLEFEKNNK

SEQ ID NO: 9037 - DNA, 795 bp, Unknown
  Obtained from environmental sample
  misc_feature (1)..(795): n is a, c, g, or t
atgntcaggatcggctcggagttcggtgcagatttggcagtacctaaaggtgtgattaccgccgaaaataaaagagtagatgcaattcttatagcaaactctaaagagttgaaaatactctctaaaaaagagttggctcagccttttggattgaaaaatttagcattagagataaaaaaatatctgcatattaaaaacaataaaacaaaaattatgggtgtgattaatgcaaacgatgatagtttttttaaagagagccgattcaatgaagatagtgcgatagataagatagagtctatgatagaagatggtgctgatattatagatttaggtgcactctcatcacgtcctggaagtgtgcaaattagtgaagatgaagagctttcacgtataaaatatattttagatactatctataagaaaaaactgtttgaaaaaatagagtttagtatagacagttatactccaaaagttgtaaattatgcactggatagcggatttaaaatagtaaatgatataggaggttttgaatctgatgagttgtgtgctcttgctgctcaatatgatgcaacagctgttattatgcatatgcagggtaatcctcaaaccatgcaagtgaatccccaatataattcagttttagatgatataagcactttttttagtgtgagagtagataagttagatagttatggtgttaaaaatatagtattagatgtgggaataggatttggaaaaaccttgaatcataatttagaattaattaaaaatcttgaacactttttaaaagtttga

SEQ ID NO: 9038 - protein, 264 aa, Unknown
  Obtained from environmental sample
  DOMAIN (74)...(264): Pterin binding enzyme
  misc_feature (1)..(264): Xaa is any amino acid
MXRIGSEFGADLAVPKGVITAENKRVDAILIANSKELKILSKKELAQPFGLKNLALEIKKYLHIKNNKTKIMGVINANDDSFFKESRFNEDSAIDKIESMIEDGADIIDLGALSSRPGSVQISEDEELSRIKYILDTIYKKKLFEKIEFSIDSYTPKVVNYALDSGFKIVNDIGGFESDELCALAAQYDATAVIMHMQGNPQTMQVNPQYNSVLDDISTFFSVRVDKLDSYGVKNIVLDVGIGFGKTLNHNLELIKNLEHFLKV

SEQ ID NO: 9039 - DNA, 894 bp, Unknown
  Obtained from environmental sample
  misc_feature (1)..(894): n is a, c, g, or t
atgcaaaaggctttttacatattgattttactatctgtttcactgtctagctttggccagcggaaggataagaatatggaggaatctttgcaacaagaaggaatagatgatatagaagctttatcgtctaaagactttccttacatcgaacggtttcatcaggctgtaagagaaaaaatggctggtaatttagaagagtcaaaaaaactctataaagtttgccttgaagagaacccaaatgatgacgctgtttattttggacttggagaaattgcacgcgaccagaaaatgaaaactgaagcacttcagtattttcaaaaagcagctgagatagatccgggaaatatcttttatacgcaggaggtggcatatattcaatatgagaaagcagactttgaagatgctatcccaaattttaaaaagcttactgagcacgaaccaagaaatattgattggctctatggttatggacaggttttggtgtatagcaagaattatgaggaagcaatagcaacctttaacaagttgcaagatcaggtagggattattcctgaaataatgataatgaaagcagacttatatcaagaactaagtcaggacgaanaggcggaagagacattactccagcttaaaaaagaatttcctcaaaacatagaagtgttaaaaacagttattggtttttatgaagaaagaggaaatcaagaaaaagcgattcaattgataaaggagctggttgaaaacgaaccggagaatggagtcgctcaatttattttggcgcaggaatatattcgcaaggaggatagagaaggttttttaaacgctttaccctcaataattgcaagtcctgaatgtcaagtccctgagaaaatgcggttattaaaacacatggtatcc

SEQ ID NO: 9040 - protein, 298 aa, Unknown
  Obtained from environmental sample
  SIGNAL (1)...(19)
  DOMAIN (82)...(115): TPR Domain
  misc_feature (1)..(298): Xaa is any amino acid
MQKAFYILILLSVSLSSFGQRKDKNMEESLQQEGIDDIEALSSKDFPYIERFHQAVREKMAGNLEESKKLYKVCLEENPNDDAVYFGLGEIARDQKMKTEALQYFQKAAEIDPGNIFYTQEVAYIQYEKADFEDAIPNFKKLTEHEPRNIDWLYGYGQVLVYSKNYEEAIATFNKLQDQVGIIPEIMIMKADLYQELSQDEXAEETLLQLKKEFPQNIEVLKTVIGFYEERGNQEKAIQLIKELVENEPENGVAQFILAQEYIRKEDREGFLNALPSIIASPECQVPEKMRLLKHMVS

SEQ ID NO: 9041 - DNA, 333 bp, Unknown
  Obtained from environmental sample
  misc_feature (1)..(333): n is a, c, g, or t
ttgcaacttgttaaaggttgctattgcttcctcataattcttgctatacaccaaaacctgtccataaccatagagccaatcaatatttcttggttcgtgctcagtaagctttttaaaatttgggatagcatcttcaaagtctgctttctcatattgaatatatgccacctcctgcgtataaaagatatttcccggatctatctcagctgctttttgaaaatactgaagtgcttcagttttcattttctggtcgcgtgcaatttctccaagtccaaaataaacagcgtcatcatttgggttctcttcaaggcaaactttatagagtttttttga

SEQ ID NO: 9042 - protein, 110 aa, Unknown
  Obtained from environmental sample
  misc_feature (1)..(110): Xaa is any amino acid
MQLVKGCYCFLIILAIHQNLSITIEPINISWFVLSKLFKIWDSIFKVCFLILNICHLLRIKDISRIYLSCFLKILKCFSFHFLVACNFSKSKINSVIIWVLFKANFIEFF

SEQ ID NO: 9043 - DNA, 492 bp, Unknown
  Obtained from environmental sample
  misc_feature (1)..(492): n is a, c, g, or t
gtgaacttaaaaaagatactcaataattatggctccaaaaaagagccatttttttttatgattagttatgatttaaaaaactatgaagtgattccattaaaagatattccaaaagatattcaatataaaataaattcaaaagagctattttcaaaaaaaaatcaaacaataacaaaaacaccaataagttatgaaaactatttaacaaaatataactccatacaaaatgagataaaaaatggaaatacctatcttatcaatctaacaacaccaacaaaagtgaacggaaaattagatttaaaaaatatctatgataatgcaaatagcaaatataaattgttgtataaaaatcaatttatttgtttctcacctgaaagtttttgtacaattgatgaaaacaaaatctacacctatccaatgaaaggtacaatagatgccaatataaaaaatgcaaaagagttaattctaaaagatcccaaagaatttagctga

SEQ ID NO: 9044 - protein, 163 aa, Unknown
  Obtained from environmental sample
  misc_feature (1)..(163): Xaa is any amino acid
MNLKKILNNYGSKKEPFFFMISYDLKNYEVIPLKDIPKDIQYKINSKELFSKKNQTITKTPISYENYLTKYNSIQNEIKNGNTYLINLTTPTKVNGKLDLKNIYDNANSKYKLLYKNQFICFSPESFCTIDENKIYTYPMKGTIDANIKNAKELILKDPKEFS

SEQ ID NO: 9045 - DNA, 714 bp, Unknown
  Obtained from environmental sample
  misc_feature (1)..(714): n is a, c, g, or t
atgaaaaaaatggtgcaaaatttatccttacaagtaagaaggagttggaaagtgaataatttaaaaaatttaagaatattatttttagaagataacttggtatttgcagaacatacaatctattttttagagctttatgctaaagaggtgattcactgtactaatatgcaagatgctttgagtttgttccatatggaacaaattgatattattattagtgatctaaaggttgaagatggattggctttacattttattgagcaaattagggttgataataaagaggttccaattgttgtgttaagtgcacataaagatgaagaatttttgctaaaagcaatccctttagggctcacctcttatgaagttaagcctattaattttactgattttaaaagtttacttaataaatgtgctcaagctattaacagtaaaaatttattacttataaaagatgatattttttatgattatgacacaaagtctatttataaaaatcaagaggagatacttttgagtaaaaaagaatctctatttgttgagttactcataaaaaataaaaatagtattacaagtaaagatgatatcaataattttatttgggaaaatgaaattatgagtgaatcggcattgaaaaactttttgttaagagtaagaaaaaaagttggaaaagattttttttatacaattcagaatataggatatagattataa

SEQ ID NO: 9046 - protein, 237 aa, Unknown
  Obtained from environmental sample
  DOMAIN (167)...(237): Transcriptional regulatory protein, C terminal
  misc_feature (1)..(237): Xaa is any amino acid
MKKMVQNLSLQVRRSWKVNNLKNLRILFLEDNLVFAEHTIYFLELYAKEVIHCTNMQDALSLFHMEQIDIIISDLKVEDGLALHFIEQIRVDNKEVPIVVLSAHKDEEFLLKAIPLGLTSYEVKPINFTDFKSLLNKCAQAINSKNLLLIKDDIFYDYDTKSIYKNQEEILLSKKESLFVELLIKNKNSITSKDDINNFIWENEIMSESALKNFLLRVRKKVGKDFFYTIQNIGYRL

SEQ ID NO: 9047 - DNA, 423 bp, Unknown
  Obtained from environmental sample
  misc_feature (1)..(423): n is a, c, g, or t
atgcatatgattattacacaaactgctggtggcgtagtccaaaaccataaaaaagaagttttagttgtgtctcaaagaaataatgtatggtcccttccaaagggacatatcgatccaggagaaaacaaactagaggcagcaatcagagaaatctatgaagagtctggcataaaggaagaaaacctagttatgataaaagaactaggaagctatgacagatataaaatttccaaaataggaaatgatgataaatcagaattaaaaactatacatttattccttttcaaatcttctcaacttgaattggcacctatagatcctgaaaaccccgaggcaatatgggtaaaaaaagaagaagtttcaaaattacttacccaccaaaaggataaagatttttttgatagtctttctgaacttatctaa

SEQ ID NO: 9048 - protein, 140 aa, Unknown
  Obtained from environmental sample
  DOMAIN (5)...(139): NUDIX domain
  misc_feature (1)..(140): Xaa is any amino acid
MHMIITQTAGGVVQNHKKEVLVVSQRNNVWSLPKGHIDPGENKLEAAIREIYEESGIKEENLVMIKELGSYDRYKISKIGNDDKSELKTIHLFLFKSSQLELAPIDPENPEAIWVKKEEVSKLLTHQKDKDFFDSLSELI

SEQ ID NO: 9049 - DNA, 432 bp, Unknown
  Obtained from environmental sample
  misc_feature (1)..(432): n is a, c, g, or t
ttgttttccaaaagaagtataagaagtcactttctaatacaactccttgtcgcttcggcgacacttattttcatattctcttctgctctttattttatgattcaagaatctatttatgatgaaaaaaaaactgaactcctgcaatttgcacaaaatatatgctcatataattcactggctaaaactttacaaaatgaagctgatgcagttttaggattatcagttgaactaatcagcataaaagataaagaacaacacttagattggtacataatttcaaaagacaaaagtacatttttaacacttatttatccatatagcattgaaaattatagttacttaaaagttagtaaagatgtaacaaatactcagcaccttttgaaaaaaataattagatcaattgttataaataaatatacttggttttggtaa

SEQ ID NO: 9050 - protein, 143 aa, Unknown
  Obtained from environmental sample
  misc_feature (1)..(143): Xaa is any amino acid
MFSKRSIRSHFLIQLLVASATLIFIFSSALYFMIQESIYDEKKTELLQFAQNICSYNSLAKTLQNEADAVLGLSVELISIKDKEQHLDWYIISKDKSTFLTLIYPYSIENYSYLKVSKDVTNTQHLLKKIIRSIVINKYTWFW

SEQ ID NO: 9051 - DNA, 888 bp, Unknown
  Obtained from environmental sample
  misc_feature (1)..(888): n is a, c, g, or t
atgaatatatttccatttaaaaaaaagcttaaatccaaaatagagtcagaattaaggaaactaccttgggacctggattctgaaaaaatcacgcaattactagaaccgacaattggagttaaaactaaaaagacaagttcaaaaatcggtattggaaaatcgaaatttggaggattacctgatttaggaaaagaaatggaatggccaaatctaaatggttttccgtttggctttttaggacaaataaatctatctgaaattaagttcgacaagttaaattctcttccagaaaatggtttattattatttttcttttcgacaaaccaagatgattatcgatatgaaaatctaaaagatatgcatcgtgtaatcttcattgaaaaactatcgaatttagaacaaagaaactatcctgaaaaatatagcgatttggcaaaatttaatgaatgcgagattgaatatttcgagcaattcagtttgccatcatttcaaaactataaaatcctagatttaaattttacggatgaagatgataatttactatttgaagcgtcagaaattataaatgaattaacatcagctgaagaagaaattggacatcagatattgggaaatgctcaagctgtacaaggagatgtaaactatccttgggctttacaatctattggacataaactaaaaactttatcagaattaaatataacagaccaaaatagagttttagaaaatcaaaaaaacataagacttttattgcaaatcgatatgtctgataatacacctaatttctcgggttttggtgctagtggtggattttatttcggaatagcagaaaaagatttagcaaatggaaattttgaaaaaacgtattttggactacaaaactcctaa

SEQ ID NO: 9052 - protein, 295 aa, Unknown
  Obtained from environmental sample
  misc_feature (1)..(295): Xaa is any amino acid
MNIFPFKKKLKSKIESELRKLPWDLDSEKITQLLEPTIGVKTKKTSSKIGIGKSKFGGLPDLGKEMEWPNLNGFPFGFLGQINLSEIKFDKLNSLPENGLLLFFFSTNQDDYRYENLKDMHRVIFIEKLSNLEQRNYPEKYSDLAKFNECEIEYFEQFSLPSFQNYKILDLNFTDEDDNLLFEASEIINELTSAEEEIGHQILGNAQAVQGDVNYPWALQSIGHKLKTLSELNITDQNRVLENQKNIRLLLQIDMSDNTPNFSGFGASGGFYFGIAEKDLANGNFEKTYFGLQNS

SEQ ID NO: 9053 - DNA, 708 bp, Unknown
  Obtained from environmental sample
  misc_feature (1)..(708): n is a, c, g, or t
atgactgactataaaaactttttaggttttggaattgcaggcaactttgctctgcacctcgaacaagccggagagattgaagattttaaagaccttgaagttgaagataaaaatggtcctaaaggagtttttcctttttacatcaaagataaaaaaggacaacttggagtctatcctctctcatcatcacttataaaccttcctacttttgaggcaaatatacaagcagaacctgaagtaggtctgctttgtaaattagagtatcttgatggaaaagttacaaaaatcatacctcaatatgcaactccgtataacgactgctcaattcgtaaagagggtgctaaaaaaataagtgaaaagaaaaactggggtgaaaattctaaaggaattggcgcaaaactgatcgaaatagatagttttgaaagtggcgggattttagacagataccgcatagcatcatttttgattcgtgatggcgtagtaactccatatggtgaagatactgaagttgtaggttatagctattttcatgacaagcttttagagtgggtaaaaaatcagctaaattctcaaatagatgtaggacctttagagccagtaagtgagtacattaaagaacctggctatcccacagatatgataattagcataggtgcaaccagatacactccttttggagagagcacattccttaaaaagtggagatga

SEQ ID NO: 9054 - protein, 235 aa, Unknown
  Obtained from environmental sample
  misc_feature (1)..(235): Xaa is any amino acid
MTDYKNFLGFGIAGNFALHLEQAGEIEDFKDLEVEDKNGPKGVFPFYIKDKKGQLGVYPLSSSLINLPTFEANIQAEPEVGLLCKLEYLDGKVTKIIPQYATPYNDCSIRKEGAKKISEKKNWGENSKGIGAKLIEIDSFESGGILDRYRIASFLIRDGVVTPYGEDTEVVGYSYFHDKLLEWVKNQLNSQIDVGPLEPVSEYIKEPGYPTDMIISIGATRYTPFGESTFLKKWR

SEQ ID NO: 9055 - DNA, 639 bp, Unknown
  Obtained from environmental sample
  misc_feature (1)..(639): n is a, c, g, or t
ttgagtagagatatttttactaaggatggttggtttagaactggagatgttgggtatttggatggtaatgattatttatttgtgataggaagacttgataatatgattatcggatcgaacggtagaaatatttacccagaagaaatagagcaggtggtggatggatatgattttgtaaaggaatcggtattaagaagttgtgaaggcaaacttatgttagaagttgtgcttgaagatcattttaaacaagataaaaatattcttaaggatgttaaaaaaagtatttttgataattttggaggattgttgagaatatgtgaagtcgttgaaaatataaataagttggagcgaacaagcagtagtaaaattgtaagaaaaaatactcaaataaaaaataatattgttggttgcgaagtgttgggttttgtgtttagtgcttggaaaaaggttgtgggtaaaagcgatgttaatgagagtgatagtcttttagatcagggtgctgattccttggatatcgtggagtttcataagataattgaagagagatatccaggaagtttgttgatttctgagatttatatcaatccttcagttgaggcaattggtggtattatagtagaaaaaaataagaataaataa

SEQ ID NO: 9056 - protein, 212 aa, Unknown
  Obtained from environmental sample
  misc_feature (1)..(212): Xaa is any amino acid
MSRDIFTKDGWFRTGDVGYLDGNDYLFVIGRLDNMIIGSNGRNIYPEEIEQVVDGYDFVKESVLRSCEGKLMLEVVLEDHFKQDKNILKDVKKSIFDNFGGLLRICEVVENINKLERTSSSKIVRKNTQIKNNIVGCEVLGFVFSAWKKVVGKSDVNESDSLLDQGADSLDIVEFHKIIEERYPGSLLISEIYINPSVEAIGGIIVEKNKNK

SEQ ID NO: 9057 - DNA, 606 bp, Unknown
  Obtained from environmental sample
  misc_feature (1)..(606): n is a, c, g, or t
atggagtcaaagtggcagacgacgcttaccatagagatgaaagaaaacggccgcgtggcggcaaactatcttatccgttcacatcatatgnctgagagttttacggctactatcctaagagaaggcaaagagatcaccatagatatccccctcaaaggccttgtctcgctcatccattttgaacatgaacagcgtccccaatattatatcttcggcggtcttgtatttatgcctttgactaaaaactacctctacgaatgggggaaaagctgggtacaaaaggccccggtccgttttgtcgatatcgttaaaaacgaaaacttcccctcgaaagagcgacgtgagatcgtatttttacagagtatcttagccgatagagaaaacgcaggctacggactctctcatgctatcgttcaaaaagtaaacggcatcaagatcgactctttttcccgtctggtcgacagtattgaagacagtaaagaaaaagaggtgaagataacgttgcaaggcggaagcatcatcgtccttaacaaagaaaaagcattagaagccaatacccgtctgctcaaacgttacggcatcaaaaactatgcttatcaaaggtag

SEQ ID NO: 9058 - protein, 201 aa, Unknown
  Obtained from environmental sample
  misc_feature (1)..(201): Xaa is any amino acid
MESKWQTTLTIEMKENGRVAANYLIRSHHMXESFTATILREGKEITIDIPLKGLVSLIHFEHEQRPQYYIFGGLVFMPLTKNYLYEWGKSWVQKAPVRFVDIVKNENFPSKERREIVFLQSILADRENAGYGLSHAIVQKVNGIKIDSFSRLVDSIEDSKEKEVKITLQGGSIIVLNKEKALEANTRLLKRYGIKNYAYQR

SEQ ID NO: 9059 - DNA, 1014 bp, Unknown
  Obtained from environmental sample
  misc_feature (1)..(1014): n is a, c, g, or t
ttgtggctcggaaatggaattgcacacaaggtatgcataaaattgtctcttttggaggtcgatanctatctttctaaaacagctgcaactaatggttatcaaggatttaaagggcttgattggtatggacatattatggttccattggagcatgcctttttagaggatcaaagtaatttagagatttcagaagatattcttcaagctatattacaatatggagatagtttttcagacgaattaaaacagataccaatacaagcaaatcagatacaagaaaaccttaaccgtgcagtatggaatggaaatgtatctcaaagtaaagatagtgaatcagataaaggtttttcaagacttcttttaaatgagattgctaaaacaggagaagagacaaaaaacatttttaaatcttctattataaatcttactaaaacaattatactcaatgacactatctctatagcttcacttatgatagacattatggatagaaacctttacgaaagagctaatgactgtagatggtgggcattaaattcagaatttagaactattttagataataatattataacaagtgatctcaaaaataaactttcttctacattatcatatataaataacttatacacagtatatacaaacctatttatttatgataaaaatggagttatcttagctgtttcacaaaacaaccaagagcatctaatagggaaaaaactagatactctttggtcaaataaaacattgagtatgaaagattcttcaaaatactgtgtttcagattttgagtcaactgatttgtatgataataaaccaacatatatctacaatgctccaatagaatcatctaaaagtgagaatacaattgtaggtggaaagggaatagtatttgactcagagatagaatttaaagcaatgattgatgaatcgatgcccagaactgtaaaagatgaagtaaaaaatggtgtattgggagtatttccaacaaaaaataaaaccttaatctcttcc

SEQ ID NO: 9060 - protein, 338 aa, Unknown
  Obtained from environmental sample
  misc_feature (1)..(338): Xaa is any amino acid
MWLGNGIAHKVCIKLSLLEVDXYLSKTAATNGYQGFKGLDWYGHIMVPLEHAFLEDQSNLEISEDILQAILQYGDSFSDELKQIPIQANQIQENLNRAVWNGNVSQSKDSESDKGFSRLLLNEIAKTGEETKNIFKSSIINLTKTIILNDTISIASLMIDIMDRNLYERANDCRWWALNSEFRTILDNNIITSDLKNKLSSTLSYINNLYTVYTNLFIYDKNGVILAVSQNNQEHLIGKKLDTLWSNKTLSMKDSSKYCVSDFESTDLYDNKPTYIYNAPIESSKSENTIVGGKGIVFDSEIEFKAMIDESMPRTVKDEVKNGVLGVFPTKNKTLISS

SEQ ID NO: 9061 - DNA, 570 bp, Unknown
  Obtained from environmental sample
  misc_feature (1)..(570): n is a, c, g, or t
gtggagattttaaaaatgagggggatcatttttctcttcaataaaaaggaagcaaatatacctatagaaacctcaaaaccaaagctcctagttaatgatgtagtaaaaaccaaatgtgatgattgtcaagagatggctacttttagaattggaagtaaataccttggttcatattgtaaagatgtagttcagtctgtaagtattgataaattagagactgccatcaaccttgatgatacaaattgcttcaaagggacaattatccataataaaatggcagtaagtgttcttgatatttcatcatttattaaagaacctgtggatacaaattataatgagattgtaattgtagattatgaagatagccaagagcaccactttgtaggactcttagtaagtaaattagaaaatatcgttgatatagaaacaaaaaaactaaaaccacttgaacaaaatcttatcactggtggtgcattgattcaaagtattgtatcagtagaacaaaacggagataataagctcttaactatcctagatattaaaaagcttgcaaataaacttactaactag

SEQ ID NO: 9062 - protein, 189 aa, Unknown
  Obtained from environmental sample
  DOMAIN (44)...(188): CheW-like domain
  misc_feature (1)..(189): Xaa is any amino acid
MEILKMRGIIFLFNKKEANIPIETSKPKLLVNDVVKTKCDDCQEMATFRIGSKYLGSYCKDVVQSVSIDKLETAINLDDTNCFKGTIIHNKMAVSVLDISSFIKEPVDTNYNEIVIVDYEDSQEHHFVGLLVSKLENIVDIETKKLKPLEQNLITGGALIQSIVSVEQNGDNKLLTILDIKKLANKLTN

SEQ ID NO: 9063 - DNA, 642 bp, Unknown
  Obtained from environmental sample
  misc_feature (1)..(642): n is a, c, g, or t
atgaaaacaaagagtacactacaaacttcacaattgaataatcacaaaaatacaaaaaattatactattgctatcataggtgcaggagcttctggacttcttgcatctatttttttagccaaaaaaaactactccgtaacaatttttgaaaaaaacaataaagttggtaaaaaacttttagcaacaggaaatggaagatgtaatgttacaaatgaaaacatatcattaaacaacttttattcccattcagatattcaacaaatcaaccctattttagaaaacttcaactataaaaaatgtaaaaatttttttaatagtattggagtagagtttgtcaataatgagataggaagagtttatcctatgtcacaaaactcttctagtattgtggatagtcttgagtatgaagctctcaatagtggtgtagaaattgagcttaatagtaaaattgaaaatattacttacgatgggcaatattatattataaacagcaaaaaatatgacaaacttataattgccactggaagtactgctatgcctaaacttggtggtgataaaagtggttatgattttgcgaaacaatttcacctttctactaataacccttttgcatcccttgaacagaatgtaagtgacaataaa

SEQ ID NO: 9064 - protein, 214 aa, Unknown
  Obtained from environmental sample
  misc_feature (1)..(214): Xaa is any amino acid
MKTKSTLQTSQLNNHKNTKNYTIAIIGAGASGLLASIFLAKKNYSVTIFEKNNKVGKKLLATGNGRCNVTNENISLNNFYSHSDIQQINPILENFNYKKCKNFFNSIGVEFVNNEIGRVYPMSQNSSSIVDSLEYEALNSGVEIELNSKIENITYDGQYYIINSKKYDKLIIATGSTAMPKLGGDKSGYDFAKQFHLSTNNPFASLEQNVSDNK

SEQ ID NO: 9065 - DNA, 537 bp, Unknown
  Obtained from environmental sample
  misc_feature (1)..(537): n is a, c, g, or t
ttgattggtatagggattattggtttagtttttttattttatggtgtttataaaaaatatcttttcttttttcataagctacttattttgaaagttccaattataagtgaggttttaaaagattactatttttatagactttttttattaatatcaataattgtaaattctaaatatcagtttcaagttgcaatagaaaatagtcaaaatcttataccaaatctttatgttaaaaaaatgattcaaacaattattagtgatattaaaaatggtacttcaatctctaaagcttttgaaaaaacaaaacttttagactctttaacaattcagttactcttcacagctgaacacactgcttcttatgaaacaattttagatgatataacactttattataaacaaaaatttcaaactagtttaaaattattttcatcttatatagaaccaattattgtatttgttattgccttggttgtattgtggctcatgttagcaattatgacacctatttggaatatgagttcttttttatcgtaa

SEQ ID NO: 9066 - protein, 178 aa, Unknown
  Obtained from environmental sample
  DOMAIN (45)...(169): Bacterial type II secretion system protein F domain
  misc_feature (1)..(178): Xaa is any amino acid
MIGIGIIGLVFLFYGVYKKYLFFFHKLLILKVPIISEVLKDYYFYRLFLLISIIVNSKYQFQVAIENSQNLIPNLYVKKMIQTIISDIKNGTSISKAFEKTKLLDSLTIQLLFTAEHTASYETILDDITLYYKQKFQTSLKLFSSYIEPIIVFVIALVVLWLMLAIMTPIWNMSSFLS

SEQ ID NO: 9067 - DNA, 351 bp, Unknown
  Obtained from environmental sample
  misc_feature (1)..(351): n is a, c, g, or t
ttgggcttgatggtatgtcaacaaaaagctcagtcgctatatcatcatagcttcaaaaattccagaaaatataaaatctgcaaaattttaaatagaaaagatattttaaaaatagttcatactataaaaaatctagaatttaacatcatagatacaaaaggttttgaaacttgcgaagtgtgtgcaggtggagttattcttgatgaaatcaacctacacactatggaatcaaaactacaaaaagatttatacttcatcggtgaagttttagatgtagatggggattgtggtggatataatctccattttgcttgggccagtgggtatactttggcacagaatttacgataa

SEQ ID NO: 9068 - protein, 116 aa, Unknown
  Obtained from environmental sample
  misc_feature (1)..(116): Xaa is any amino acid
MGLMVCQQKAQSLYHHSFKNSRKYKICKILNRKDILKIVHTIKNLEFNIIDTKGFETCEVCAGGVILDEINLHTMESKLQKDLYFIGEVLDVDGDCGGYNLHFAWASGYTLAQNLR

SEQ ID NO: 9069 - DNA, 495 bp, Unknown
  Obtained from environmental sample
  misc_feature (1)..(495): n is a, c, g, or t
atgaaatataaaattttagatattaatagtgtaaaagagtttgtttttaatattaataatgtaaaggagtatttagcagtatcttctttggcagaattaacatcaagtgaaattggtgatggaaatcttaactttgtctatattgtttctaataagtttgatgctactaaatctttaattgtaaaacaagctgttccatatcttagatgtgtgggtgaagagtttcctctttcaagagagagaatgacttatgagataagagcattactaaaatatcaagaaatatgcagtgaatatatccctaaaatatattatagtaatgaagctatgagtatagttgttatgcaaaatctttcagagcatattattttaaggaaaggacttattcaacaccattattattataattttattgaacatattacaacatttttagctaagagtttattttttacatcttccttatcacttgatagtaaagcaaaaagagactga

SEQ ID NO: 9070 - protein, 164 aa, Unknown
  Obtained from environmental sample
  misc_feature (1)..(164): Xaa is any amino acid
MKYKILDINSVKEFVFNINNVKEYLAVSSLAELTSSEIGDGNLNFVYIVSNKFDATKSLIVKQAVPYLRCVGEEFPLSRERMTYEIRALLKYQEICSEYIPKIYYSNEAMSIVVMQNLSEHIILRKGLIQHHYYYNFIEHITTFLAKSLFFTSSLSLDSKAKRD

SEQ ID NO: 9071 - DNA, 513 bp, Unknown
  Obtained from environmental sample
  misc_feature (1)..(513): n is a, c, g, or t
ttgacaaagatgatgacgatgtggacagtgatggcgttgacaaaagttattaaaaaagttgctatccttataggaattttacttatagctctcatggcagattttaatttttttataaattttgatattgcactgctcagtgctttttttattatgttgggttccatgtacagttactactctttagtgcaaagaaaagttgatgagtatgatgatgaagcgttagagagtgatactattgagaaacttgaagatccatatgatctttatagtgaagatatggtaattgatgagaatatagatataaaagatgttataaaagaggaaaaaaagagaatcaaatctcaaaaaagtatgcaaaatattaaaaagtcttcatcagcactattttcaatatatagaggtttgccatatatagttttgaatattaggcttttattggacttaacaataatcatttgcttattgattttaccatactgggggtggaataggggttggaataagcaatag

SEQ ID NO: 9072 - protein, 170 aa, Unknown
  Obtained from environmental sample
  misc_feature (1)..(170): Xaa is any amino acid
MTKMMTMWTVMALTKVIKKVAILIGILLIALMADFNFFINFDIALLSAFFIMLGSMYSYYSLVQRKVDEYDDEALESDTIEKLEDPYDLYSEDMVIDENIDIKDVIKEEKKRIKSQKSMQNIKKSSSALFSIYRGLPYIVLNIRLLLDLTIIICLLILPYWGWNRGWNKQ

SEQ ID NO: 9073 - DNA, 420 bp, Unknown
  Obtained from environmental sample
  misc_feature (1)..(420): n is a, c, g, or t
atgccaacttttaaatttgcaaagaatagacctgtcggagagattgtaaatgtatatactcttattgatctatgtattagttcaaactccataaactcaaatactaaattctttaaagagtttgatccaactattccagagattcgtctgaatgtaaatctatttataaaattattgaataaagtctatgaaagtttaagtgaaaatagtgaaataactacaataatctcgtttaaagtaggtgaatatattaagtttgatggagtcaaacactctctatttactgtagaagtaaaaggagagttgtttaaaaactcttatgaacatgtaattttggaactgtgtgaaaaaaatggtttctcttcaaatattaaaagtggtgcaatacttataaatatacctatgattacagagcagtag

SEQ ID NO: 9074 - protein, 139 aa, Unknown
  Obtained from environmental sample
  misc_feature (1)..(139): Xaa is any amino acid
MPTFKFAKNRPVGEIVNVYTLIDLCISSNSINSNTKFFKEFDPTIPEIRLNVNLFIKLLNKVYESLSENSEITTIISFKVGEYIKFDGVKHSLFTVEVKGELFKNSYEHVILELCEKNGFSSNIKSGAILINIPMITEQ

SEQ ID NO: 9075 - DNA, 432 bp, Unknown
  Obtained from environmental sample
  misc_feature (1)..(432): n is a, c, g, or t
ttggatattgcactgctcagtgctttttttattatgttgggttccatgtacagttactactctttagtgcaaagaaaagttgatgagtatgatgatgaagcgttagagagtgatactattgagaaacttgaagatccatatgatctttatagtgaagatatggtaattgatgagaatatagatataaaagatgttataaaagaggaaaaaaagagaatcaaatctcaaaaaagtatgcaaaatattaaaaagtcttcatcagcactattttcaatatatagagttttgccatatatagttttgatattaggctttattggacttaacaataatcatttgcttatgattttaccatacttgggtggaataggggttggaatagcagtaggatatatctttggaaaagatatattttctactactgctctgtaa

SEQ ID NO: 9076 - protein, 143 aa, Unknown
  Obtained from environmental sample
  misc_feature (1)..(143): Xaa is any amino acid
MDIALLSAFFIMLGSMYSYYSLVQRKVDEYDDEALESDTIEKLEDPYDLYSEDMVIDENIDIKDVIKEEKKRIKSQKSMQNIKKSSSALFSIYRVLPYIVLILGFIGLNNNHLLMILPYLGGIGVGIAVGYIFGKDIFSTTAL

SEQ ID NO: 9077 - DNA, 462 bp, Unknown
  Obtained from environmental sample
  misc_feature (1)..(462): n is a, c, g, or t
atgataggaaaagtagttcctaattatttaaacaagtttcctcctactcgcttacaacatggattagctgtaaacattggttccttaaaaactgacagtaacagcacttgggcaaaatattataactttccgcaaacaggtatttctttgttttattcgtctatcggcaatgagaaaatttttggagatgaatacagcattactacttttattgcttttaatatttttaatcagaaagaaaaaccaatttattttaaattaagtttaggagctgcctattttactactttttacgatagtatttccaacagaagaaatgtaaatatcggttctccttttaaatggtcgtttctagcaggagcatataaaacaataagtgaaaaaccaggtatgaacttaaaattaggacttattttttctcatgcttccaacgggcatacacaattacccaacttggattaa

SEQ ID NO: 9078 - protein, 153 aa, Unknown
  Obtained from environmental sample
  misc_feature (1)..(153): Xaa is any amino acid
MIGKVVPNYLNKFPPTRLQHGLAVNIGSLKTDSNSTWAKYYNFPQTGISLFYSSIGNEKIFGDEYSITTFIAFNIFNQKEKPIYFKLSLGAAYFTTFYDSISNRRNVNIGSPFKWSFLAGAYKTISEKPGMNLKLGLIFSHASNGHTQLPNLD

SEQ ID NO: 9079 - DNA, 636 bp, Unknown
  Obtained from environmental sample
  misc_feature (1)..(636): n is a, c, g, or t
atgaaagntaacgttttagaaacatataaaaaaatatgtatagatgcacaagaagcctatgaaaatgatgggaaaaaagagacagttaatggtgagaaaataaataaaataataggtggattaaagatatttattaaaggtatccaaaaatcactattaagtgaaataaaagaggcaaccagtatagttttaagaatcgatgctatagctaatcaagctaatgaattaattgcatcggcagcactgaaaggtgaaaattcaccatcagaagtacaaatgtcaggtgattatacagaagaagtttctgctagcgtttcttttgaagatgaaactacatgtgaaaataatttaccatttaataattcaaaaggttcaagtgataagattataaaaagcacagacatatcaaagttaaataataaaaaaactagagggcaagggattggcaagataaattgggcagatgaacttgatattaaagataatagcgatgaggatacagtaactataaatgattttgatttgttagaaaatttagaggaaggaactattgataaccaaaagatagaacagttacccccaaaataccgacaaatataccaactaaatgataaaaacaaagaacatttaaagtag

SEQ ID NO: 9080 - protein, 211 aa, Unknown
  Obtained from environmental sample
  misc_feature (1)..(211): Xaa is any amino acid
MKXNVLETYKKICIDAQEAYENDGKKETVNGEKINKIIGGLKIFIKGIQKSLLSEIKEATSIVLRIDAIANQANELIASAALKGENSPSEVQMSGDYTEEVSASVSFEDETTCENNLPFNNSKGSSDKIIKSTDISKLNNKKTRGQGIGKINWADELDIKDNSDEDTVTINDFDLLENLEEGTIDNQKIEQLPPKYRQIYQLNDKNKEHLK

SEQ ID NO: 9081 - DNA, 879 bp, Unknown
  Obtained from environmental sample
  misc_feature (1)..(879): n is a, c, g, or t
atgaattaccctttttttaatagggatggcttttcaatagtaggtgataaatttttaaataaaaatataggtgaaatccaaactgataatgatctagatttagacattactgttgaggagatatctgttaaaattaaaaaatcaactattcagattgaggatcccaaagcaatactacaagaatattcaaacgacgatactgatgagctttacggacttaaagacataagtgacgccgctaatgatttagtggaagatgatgaacataatgttgatgtacctataaataagtttaatgaaattaatcctgaaaatactaatacaaaagaatttcaaaacgaaggatgggggaaaaaatacactgagaattcacgaaaagtacaagatcaacttggaattaaaggccaagaagttgaaactgataaacgacttataacgcttttaggtaaagcagaattcaaaaaacttttaaaagaaaagaatcctacacaagagttaacaaaattactaaataaacataataattttgactacactgatacagatcatcaaaaattattaaaaaagtttgttaaaaaaattaaagttaaaagtattagctatgaagatataggtaattttatggaagcaatagatccgttggctaaattaaagactgaggcttttgtagaaatatttgagattttcctaaataaattttctaaatacagagagtatgataaagaagaattgatgaaaagttgcatacttaatacattaacttcagcatatgataaagaacctagcataattgatttaataaaggaaaaaaatcgaaaaaaatatagtccaacctgggagttggcatataaagtattaaaaaaattaggggaaatctaa

SEQ ID NO: 9082 - protein, 292 aa, Unknown
  Obtained from environmental sample
  misc_feature (1)..(292): Xaa is any amino acid
MNYPFFNRDGFSIVGDKFLNKNIGEIQTDNDLDLDITVEEISVKIKKSTIQIEDPKAILQEYSNDDTDELYGLKDISDAANDLVEDDEHNVDVPINKFNEINPENTNTKEFQNEGWGKKYTENSRKVQDQLGIKGQEVETDKRLITLLGKAEFKKLLKEKNPTQELTKLLNKHNNFDYTDTDHQKLLKKFVKKIKVKSISYEDIGNFMEAIDPLAKLKTEAFVEIFEIFLNKFSKYREYDKEELMKSCILNTLTSAYDKEPSIIDLIKEKNRKKYSPTWELAYKVLKKLGEI

SEQ ID NO: 9083 - DNA, 402 bp, Unknown
  Obtained from environmental sample
  misc_feature (1)..(402): n is a, c, g, or t
gtgaaatggtattataccattaccatgataacaaaagactcaatagaaaacttaaaatctcaccttgatgttgttgacattatatctcagtttattgagttaaaaaaaagtggagcaaattttaaagcgtgttgccctttccacggagaagatacaccttcatttgttgtaagtccacaaaagcagatttaccactgttttggttgtggtgtgggtggagattctataaaagttgtgatggagtatgaaaaacttttcctacccagaagctatagagaaaatttagcttccatgtcaaaatgtatcattnacaatattgataatggatgccaaaaaaaagtagaccttattcaatttattaccaaaagtaaaataaatcccctaatccaaaaaattttttaa

SEQ ID NO: 9084 - protein, 133 aa, Unknown
  Obtained from environmental sample
  DOMAIN (10)...(108): CHC2 zinc finger
  misc_feature (1)..(133): Xaa is any amino acid
MKWYYTITMITKDSIENLKSHLDVVDIISQFIELKKSGANFKACCPFHGEDTPSFVVSPQKQIYHCFGCGVGGDSIKVVMEYEKLFLPRSYRENLASMSKCIIXNIDNGCQKKVDLIQFITKSKINPLIQKIF

SEQ ID NO: 9085 - DNA, 378 bp, Unknown
  Obtained from environmental sample
  misc_feature (1)..(378): n is a, c, g, or t
atgcccacagatagacaattaaaattatatgttgagtctaatgttacacctattttaaaagagtatttacccacaactaaagatgcagaaaaaaatttagaaaagtatatttctaaaaaacaaataccaaatagtgattctttggttgaagattttgttgaatatgatttaaacaaatataaactaatcctgaataagatgaaagatatgcttaatttaagttcaaaatatgaacgagattggcaaaaagaaattcttgaaataatccttttattatatccaaaatatatttattcatttgaaggaactttagttaaatactttaataagtttttgtacaaagaaagaaagaaggttttaagatattatgttagttga

SEQ ID NO: 9086 - protein, 125 aa, Unknown
  Obtained from environmental sample
  misc_feature (1)..(125): Xaa is any amino acid
MPTDRQLKLYVESNVTPILKEYLPTTKDAEKNLEKYISKKQIPNSDSLVEDFVEYDLNKYKLILNKMKDMLNLSSKYERDWQKEILEIILLLYPKYIYSFEGTLVKYFNKFLYKERKKVLRYYVS

SEQ ID NO: 9087 - DNA, 705 bp, Unknown
  Obtained from environmental sample
  misc_feature (1)..(705): n is a, c, g, or t
atggaaccactaaatacacaaacagaacaatcaaaacaaagtgataatagtttagtatatatacttctttttatcattgttgtactattaggatatataggatatgttcatggtacaaaagagattgtgaaaaaagaccatataaaagaaaactatattaaaaaagatgatgtatcatttgatactttacctttgtatacacaagataaatatgtattaaagtctctttatgactataaagtaaatgaattagaaacaaaaaaccttacaattttgaaaaaattagaagaggctatagttaaaaaagaaccacaagttgtagaaaaaattatagcagcagaaaaagcaacacatacaagaatggatacaagtattgagttgataccaaaggaacaaaatataggttcacaaaccgtatctaaatctacagttagtgatagtactaaaacgaaaacatatacttgtaaaacattaaatagtagtagtgaatatataaccaaatattgtaaaaagcaactaatcaaatttttagatgaaaataaagatgccaaaagatttgaagtgataggtttgattgataaacaagaatttaaattagtagaaaaattagaagatgtttatgggaaaacaaaaagttggaaatctttcctaatatgcacaacacggactttcaaaacaaagagtgataaaaagctagttgggtaa

SEQ ID NO: 9088 - protein, 234 aa, Unknown
  Obtained from environmental sample
  misc_feature (1)..(234): Xaa is any amino acid
MEPLNTQTEQSKQSDNSLVYILLFIIVVLLGYIGYVHGTKEIVKKDHIKENYIKKDDVSFDTLPLYTQDKYVLKSLYDYKVNELETKNLTILKKLEEAIVKKEPQVVEKIIAAEKATHTRMDTSIELIPKEQNIGSQTVSKSTVSDSTKTKTYTCKTLNSSSEYITKYCKKQLIKFLDENKDAKRFEVIGLIDKQEFKLVEKLEDVYGKTKSWKSFLICTTRTFKTKSDKKLVG

SEQ ID NO: 9089 - DNA, 702 bp, Unknown
  Obtained from environmental sample
  misc_feature (1)..(702): n is a, c, g, or t
atgacaaaacaagaaaaattaaaaaaacaaataaagaaaacaattaaagatattgaatccattgaaattcaaggggcaacaaatgttgctaaagaaactgtaaaattagttgctttatttctacaaactttcaaaaaaggcgaaaaacctgaaaatatcataaaaaaaattgggccatttattgaaaagattgcttatttaagaattacagaaccactagctcgtaatggtctaaaatatattatttttaatctaaataaaaagagatataaaactgaccaagaattaattaaagaagggaaaaagatagtagaggacttcctaaaaatgattgatagtcataaagataagattgccaaaactggtgaaaaattaatcaagaaaaaccaaaatgtttttacacattgtcactcatcaatggtaatgagtattttaaaagctgcttacaaaaaaagaaagttcaaagtattcaatgatgaaacacgtccattattgcaggggcatttaacaagcaaagaattaagatctgcaaaaatcccaaatactattttagtggacggtgcatccccctatgtaataagtcattttagtggacgagaattaatgatggatcaagtttttcttggaactgatgcaattgctttagatggaagttgtgtaaataaaataggaagttacggagtttctttatcagcattttag

SEQ ID NO: 9090 - protein, 233 aa, Unknown
  Obtained from environmental sample
  DOMAIN (8)...(233): Initiation factor 2 subunit family
  misc_feature (1)..(233): Xaa is any amino acid
MTKQEKLKKQIKKTIKDIESIEIQGATNVAKETVKLVALFLQTFKKGEKPENIIKKIGPFIEKIAYLRITEPLARNGLKYIIFNLNKKRYKTDQELIKEGKKIVEDFLKMIDSHKDKIAKTGEKLIKKNQNVFTHCHSSMVMSILKAAYKKRKFKVFNDETRPLLQGHLTSKELRSAKIPNTILVDGASPYVISHFSGRELMMDQVFLGTDAIALDGSCVNKIGSYGVSLSAF

SEQ ID NO: 9091 - DNA, 636 bp, Unknown
  Obtained from environmental sample
  misc_feature (1)..(636): n is a, c, g, or t
atgattccacaactaaataaatatgaactaaaattcccggatgcttctaaagcgaatacagatgggatactagcctggggaggggatttaactccttcaagactaacttatgcttatcaaaatggcatctttccatggtttaacaacgaagatcccattatatggtggtcaccaaatcccagattaattatggaactagctgattttaagataagtaagtccctaaaaaaaagtatgaaaaagtttgactacaagtttgatacaaactttgaagaagtaatgctcagatgctcaacagtagaaagaaatgatcagactggcacctggataagccaagacataatcgaagcatatacaacacttcatgctatgggaagagcacattctattgagagttatcaggacggagctctagttggtggtttatatggtgtagttgtaggaaaagttttctgtggtgaatctatgtttgcagaggtgagtgatgcttccaaatcgtcttatgctattttaattaaacatttaaaaaagtggggatatgactttatagattgtcaagtaccaacagaacatttaaaaagtctaggtgctaaagaagttgcaagagagtattttttagatagattagaaaagtaa

SEQ ID NO: 9092 - protein, 211 aa, Unknown
  Obtained from environmental sample
  DOMAIN (31)...(202): Leucyl/phenylalanyl-tRNA protein transferase
  misc_feature (1)..(211): Xaa is any amino acid
MIPQLNKYELKFPDASKANTDGILAWGGDLTPSRLTYAYQNGIFPWFNNEDPIIWWSPNPRLIMELADFKISKSLKKSMKKFDYKFDTNFEEVMLRCSTVERNDQTGTWISQDIIEAYTTLHAMGRAHSIESYQDGALVGGLYGVVVGKVFCGESMFAEVSDASKSSYAILIKHLKKWGYDFIDCQVPTEHLKSLGAKEVAREYFLDRLEK

SEQ ID NO: 9093 - DNA, 315 bp, Unknown
  Obtained from environmental sample
  misc_feature (1)..(315): n is a, c, g, or t
atggacactataaataacaatatttctactccacaagctgaagcggtattaataaacaaagaaaatattgcaactttactctttccaaaagaggatgttttattaactcttgaagataaaaaagaaagattaaaaaagattgaaagagcaatgcatttgggaaacaataaaattaaagtaaaaattatatttcaggatgttgatggtaaaaaagtagttgatacttctatttggggaattacagaacagaatattattttaaaaggaacaactataattcctataagaagtattcatgaaattaaatttttctaa

SEQ ID NO: 9094 - protein, 104 aa, Unknown
  Obtained from environmental sample
  misc_feature (1)..(104): Xaa is any amino acid
MDTINNNISTPQAEAVLINKENIATLLFPKEDVLLTLEDKKERLKKIERAMHLGNNKIKVKIIFQDVDGKKVVDTSIWGITEQNIILKGTTIIPIRSIHEIKFF

SEQ ID NO: 9095 - DNA, 447 bp, Unknown
  Obtained from environmental sample
  misc_feature (1)..(447): n is a, c, g, or t
atgtctcatcttttaaataactacttagacttttatacaagaaaaataaaactctacaacaactctttcaatctagaactacttgaatttttaaacttttttgaagatatattaaaaacaaataatgtcaaaatagtcaataaaattgatacagagcttgataaaagtatagagattaaanatagtcgtatcatactttataatcttatagaagttcttttatatctagggaaaaattgtctcttagaagataatattgaagtgttactaaaaaataaccaagaacagctagaatataaacttgaagtagttataactggtcttgatataaaaaagcgagaaactatagaagggtattattcttattttgagaagcaagtaggtagttttttctcctctttaaatataaaaatagataaaacaatgataataaaaatggaaatttaa

SEQ ID NO: 9096 - protein, 148 aa, Unknown
  Obtained from environmental sample
  misc_feature (1)..(148): Xaa is any amino acid
MSHLLNNYLDFYTRKIKLYNNSFNLELLEFLNFFEDILKTNNVKIVNKIDTELDKSIEIKXSRIILYNLIEVLLYLGKNCLLEDNIEVLLKNNQEQLEYKLEVVITGLDIKKRETIEGYYSYFEKQVGSFFSSLNIKIDKTMIIKMEI

SEQ ID NO: 9097 - DNA, 930 bp, Unknown
  Obtained from environmental sample
  misc_feature (1)..(930): n is a, c, g, or t
ttgataaaatacaaaattttcaaagcacaatacacagggataaaagaaccaccaaaactttataacttctcttctagttacaaagcatatgaagaaccaaagttaaaacactataaaaatgaagaggagcttttagaggaaaaacttatagaggctatccaagaaagtatcttaaatcaatgtgctattataaatagttcaaatgatattatctatatcaaaggggatataccttatttacgacactcagatgggagacttacaaataatatttttaagctggttccagatgagatatctttagagttacgaagtgctatcaatgaaactaataaatccaaagagaaaaaaagcactacctttagacccataaaaatatttgaaaatattatacgctacttacgagttgtagtgatgcctataaaagatgataaaaatgatgattggctcaatgtattattttttcaaggtgaagaggcacaaaatatacgaggatatatctcaacaagtgatgagtcaagtgatatagcccaaaaactaaccctagagcttgatagcacaaaatctcatctacaaaatgtgattgaggagttagaaacttcttatgaggagatgcaaagtttaaatgaagagcttcaaagtagtaatgaagagttgcaaagtagtaatgaggaacttgagaccacaaatgaagagcttcaaagtacaaacgaagagttacaaacagcttacagtgaactaagagttctttatgaagataaagataaaagaacaaaacagctagaggagttagctcttactcttgggaaaagaacagaanactttagaaaacaaaaagagataacagaagctattatcaacacagctcccataccaatttctatgggggataagatgggaattttacttttgcaaataactttgccttag

SEQ ID NO: 9098 - protein, 309 aa, Unknown
  Obtained from environmental sample
  misc_feature (1)..(309): Xaa is any amino acid
MIKYKIFKAQYTGIKEPPKLYNFSSSYKAYEEPKLKHYKNEEELLEEKLIEAIQESILNQCAIINSSNDIIYIKGDIPYLRHSDGRLTNNIFKLVPDEISLELRSAINETNKSKEKKSTTFRPIKIFENIIRYLRVVVMPIKDDKNDDWLNVLFFQGEEAQNIRGYISTSDESSDIAQKLTLELDSTKSHLQNVIEELETSYEEMQSLNEELQSSNEELQSSNEELETTNEELQSTNEELQTAYSELRVLYEDKDKRTKQLEELALTLGKRTEXFRKQKEITEAIINTAPIPISMGDKMGILLLQITLP

SEQ ID NO: 9099 - DNA, 654 bp, Unknown
  Obtained from environmental sample
  misc_feature (1)..(654): n is a, c, g, or t
atgatagaagtttataatgcaataacaaatattgcaaatcaaattgaaaaaaatgtttttatagattacaacaattttactagtgaaacaaaaactgaacagcaaatacatgaagatgtatataaatactgttcagatgttatagaaactgaatttgaatacctaaaaaatgtaaaaagtatcatagggaaagataaaaaacaattttgtagtattaatgaaaatgggaaatatattgttagttttgtagctattgataatattgaacttcttgatttaaacttttctcttggaactatttttggtatctatgaaaatgaatttgaagcagataatttaaaagctgctatttatatcacctatggtccaacttttcaacttgtatttgcttcaaaagatgaaggggtaaaatacttctcaaatgaacatggggaatttatccaacaagatccattactacttaatagttgtggaaagataaactcaactgctggaaaagcaagtgaatttactactgaacataaagcacttttagatagctttttcaatgaagggtatagattaagagtgagtaactctctttgtcttgatacccatcaaattttatttaaaaaacggtggaatttattcaagtccagcaactgtatcaaatga

SEQ ID NO: 9100 - protein, 217 aa, Unknown
  Obtained from environmental sample
  misc_feature (1)..(217): Xaa is any amino acid
MIEVYNAITNIANQIEKNVFIDYNNFTSETKTEQQIHEDVYKYCSDVIETEFEYLKNVKSIIGKDKKQFCSINENGKYIVSFVAIDNIELLDLNFSLGTIFGIYENEFEADNLKAAIYITYGPTFQLVFASKDEGVKYFSNEHGEFIQQDPLLLNSCGKINSTAGKASEFTTEHKALLDSFFNEGYRLRVSNSLCLDTHQILFKKRWNLFKSSNCIK

SEQ ID NO: 9101 - DNA, 927 bp, Unknown
  Obtained from environmental sample
  misc_feature (1)..(927): n is a, c, g, or t
ttgttagatgttatgttaccgggcatgttaccgggcatggatggatggaatatcctgcggcaaatccaagcagatagtaccataaataagattcctgtgcatatgctttctgccagcgaaactacaattgatgcaaaagctaagggtgcgattggatttatgcagaaaccagcatatccagaaaaaatatttgaagcttttacaaaactaaatgagcaagtagataataatattaagcaactgttattggttgatgatgatagtgttttaaatgagttaatcgtggaactctttaaggatcaaaacatcactatcaccatagctgtgaccggaaaacaggctcttgaagaattaactaacaattcttttgatcttatcattattgaccttaacctgccggattacgatggaaaggatcttgtcgccgaaattagcaatattcttaaaataacaattcctataattgtgtatactggaactgaagttaatgaagaagatgagtatcaacttcgcaaatcaactaactctataattgtaaaaggtataaagtctcatgaacgtcttttggatgaaacagctctctttttacatcaggtagaggatagcaaaaatatgctagattcttctgttccgactataagcagtggagataacaaggttcttgaaggcaagattgtgttggtggtagatgatgatatgcgaaacgtatttgctgtctcgcacgttttagaacagatggggatggaagtgctgagagcaagtaatggtcaaaaggcaattgaaatgctgcttgctaataaaaaaatagatctagttttgatggatattatgatgcctataagggatggatacgaagccatgaaaaagataaaaaagaatacctttttccataagttaccaataattgctttaacggctaggctatga

SEQ ID NO: 9102 - protein, 308 aa, Unknown
  Obtained from environmental sample
  DOMAIN (224)...(307): Response regulator receiver domain
  misc_feature (1)..(308): Xaa is any amino acid
MLDVMLPGMLPGMDGWNILRQIQADSTINKIPVHMLSASETTIDAKAKGAIGFMQKPAYPEKIFEAFTKLNEQVDNNIKQLLLVDDDSVLNELIVELFKDQNITITIAVTGKQALEELTNNSFDLIIIDLNLPDYDGKDLVAEISNILKITIPIIVYTGTEVNEEDEYQLRKSTNSIIVKGIKSHERLLDETALFLHQVEDSKNMLDSSVPTISSGDNKVLEGKIVLVVDDDMRNVFAVSHVLEQMGMEVLRASNGQKAIEMLLANKKIDLVLMDIMMPIRDGYEAMKKIKKNTFFHKLPIIALTARL

SEQ ID NO: 9103 - DNA, 357 bp, Unknown
  Obtained from environmental sample
  misc_feature (1)..(357): n is a, c, g, or t
ttgggattaaaaaatgatagtgttgttgttagttttaaaactaaaaaagaatctgactacggtaatattatattgaaaatggatgtaaattttaaaccnccttatattttgaaattgcttagaaacaacaaaattattgatgaaaaatacataagcaacagtcaaaatattaattacacttttttaaccccgggcgattatgatttgcatttaattgttgatgaaaatgataataaaaaatgggatacaggtaattatttaaaaacccaacaacccgaaacagtaattcattaccaaaaagccataaaaattcgtcctaattgggataatgaaatcatttggaatattaggctttag

SEQ ID NO: 9104 - protein, 118 aa, Unknown; identical to SEQ ID NO: 8260
  Obtained from environmental sample
  misc_feature (1)..(118): Xaa is any amino acid

SEQ ID NO: 9105 - DNA, 768 bp, Unknown
  Obtained from environmental sample
  misc_feature (1)..(768): n is a, c, g, or t
ttgagattttggattatatcaaacattccggtcagcaatttaaagatcttaatctcaaaggggaaattgtggaaaatgacccctttgcgtattctcatgcaatctggtcgcaagggaaccggtggggggacgcctgcctttttttatgatatgatttaccttttcaggcaattttcaggacatgaagatccaaaaccaggcaaaagtgaaattatagaatggatggacaggtattcttccggccttgatccggaagttgtttgtctgagaaaaaaaaataaactcagaatattaaaaatcattattaaaataattgatgaaagaagaataaaaagcaagcggttcagttttaaacgagggatgtccaggcaaaaaaagatggccctttccaaaatatggtggaatgattacaaatttcatctaaaatttgcagttcgaacccctgaagatctgaatgaaatgcttgatttctcccttgaccgggaaattatggacactttgaaacaggcccagaaagttggaattcccatatttgtcaatccatattacctgtcgcttctggacacacaggcatctgttgtttccctgggtgccgatcttgccatccggcaatatatgctttattcaaaagagctggtcaacgaattcggcaatatcaacgcatgggaaaaagaagatgttgtgaagccaggaaaacccaatgccgctggctggatcatcccggacgattgtatccacagacgatacccggattgttgccatttttaa

SEQ ID NO: 9106 - protein, 255 aa, Unknown
  Obtained from environmental sample
  misc_feature (1)..(255): Xaa is any amino acid
MRFWIISNIPVSNLKILISKGKLWKMTPLRILMQSGRKGTGGGTPAFFYDMIYLFRQFSGHEDPKPGKSEIIEWMDRYSSGLDPEVVCLRKKNKLRILKIIIKIIDERRIKSKRFSFKRGMSRQKKMALSKIWWNDYKFHLKFAVRTPEDLNEMLDFSLDREIMDTLKQAQKVGIPIFVNPYYLSLLDTQASVVSLGADLAIRQYMLYSKELVNEFGNINAWEKEDVVKPGKPNAAGWIIPDDCIHRRYPDCCHF

SEQ ID NO: 9107 - DNA, 951 bp, Unknown
  Obtained from environmental sample
  misc_feature (1)..(951): n is a, c, g, or t
ttgtctataccaaagataataaaaaggagcatttcaatgaatgataaacaaataaaactaacccaaaacttacaagtaaaatattcaaaattcattaacaaacacactttttctctcaaaaaaacttcagtaaaatttgtgaaagatattacaaatggaattattaaatctcaaagttgcattgttcggcaaatagcacagaatctatcagaaaacattagccttaaaaaaactcaagaacgccttacttatcagcttgataacgacaaagagcttgaaaaacttagaaaaaatattttgatccataacagccgaaaattaaacaagaaaagtttgattatcattgatccaagcgacatcacaaaaccaaatgcgattaaaatggaagggttaagtaaggttcgggatggtaacaatgggaaatataaacccggctatgaagtaatcgatattgttggagtaaatcagtcaggctctcaaacttcaatattccctattttttctgatattcatagcgagaagataggattagatacgcttaagaataagatattcgataggattctagacatcattatttattcaaacaattcaggcgtatttgttatggatagagggtttgatgataaaagagtaattcaggaattatgtagtcatgatgcttccttcattattagaatgaaaagaaatcgaaatattttctacaaagatagccttatgaatattgcgaaagtcggcgataaaattgagaaaaaacacatctttgaagtatgtaagaaaacaactatcaaagctggtatgggtgaaataggaatacctctaagtcggcatacagttaaaaatccagaacaggcaaaagttcatcctgtatcagcagaaatatctacaaaaccacaaatggaaggattcccaaaggaaatttttacttcaatttctttaccaattcaaata

SEQ ID NO: 9108 - protein, 317 aa, Unknown
  Obtained from environmental sample
  misc_feature (1)..(317): Xaa is any amino acid
MSIPKIIKRSISMNDKQIKLTQNLQVKYSKFINKHTFSLKKTSVKFVKDITNGIIKSQSCIVRQIAQNLSENISLKKTQERLTYQLDNDKELEKLRKNILIHNSRKLNKKSLIIIDPSDITKPNAIKMEGLSKVRDGNNGKYKPGYEVIDIVGVNQSGSQTSIFPIFSDIHSEKIGLDTLKNKIFDRILDIIIYSNNSGVFVMDRGFDDKRVIQELCSHDASFIIRMKRNRNIFYKDSLMNIAKVGDKIEKKHIFEVCKKTTIKAGMGEIGIPLSRHTVKNPEQAKVHPVSAEISTKPQMEGFPKEIFTSISLPIQI

SEQ ID NO: 9109 - DNA, 411 bp, Unknown
  Obtained from environmental sample
  misc_feature (1)..(411): n is a, c, g, or t
ttgtacttcgagatgaataaacgtagttggaaatacctggaaatcgaaaaggtacgattttccgaaagactggattacactatccaattggatgaaacctgtagaagttatgtaatccccccactcattttacaaactctggtagaaaatagtgtaaagcacggcatatctcccaaaatagaaggtggaaagatcaatgtctctgttcaaaacaaagataataacatcgaaataaaaatagaagataacggtgtgggaatacaagcggatgtgcaggaaggttttggattggatgctgtaaaaaacatcttaagattacaatataaaaatcatgaatttgaaatgaaaaatgaaaacggtgtgaagataagagtcttgattcctaaaatggaaattggcgatgaagtttaa

SEQ ID NO: 9110 - protein, 136 aa, Unknown
  Obtained from environmental sample
  DOMAIN (37)...(130): Histidine kinase-, DNA gyrase B-, and HSP90-like ATPase
  misc_feature (1)..(136): Xaa is any amino acid
MYFEMNKRSWKYLEIEKVRFSERLDYTIQLDETCRSYVIPPLILQTLVENSVKHGISPKIEGGKINVSVQNKDNNIEIKIEDNGVGIQADVQEGFGLDAVKNILRLQYKNHEFEMKNENGVKIRVLIPKMEIGDEV

SEQ ID NO: 9111 - DNA, 384 bp, Unknown
  Obtained from environmental sample
  misc_feature (1)..(384): n is a, c, g, or t
atggagatggttgtgaaatataaagcggttattgtcgaagatgaaaaactagctcgagagcgtttgaagctgttattgcaaaaacatgaagatgtaattgaaatattggcagaagcagccaacggtaaagaaggattggagttgatcaattcgttcaaaccagatttgatcttccttgatattcaaatgccgggcttaaccgggtttgaaatgctgcagaagctggatgaaattcccttggttatcttcaccacggcatacgatgattatgccctggaagcttttgaaaccaatacaatagatttatttattgaaaaccgatcgcccccgaaaggtttggaaaaacctatcccgaaaattaccggcaaatgggcagaaaattaa

SEQ ID NO: 9112 - protein, 127 aa, Unknown
  Obtained from environmental sample
  DOMAIN (7)...(125): Response regulator receiver domain
  misc_feature (1)..(127): Xaa is any amino acid
MEMVVKYKAVIVEDEKLARERLKLLLQKHEDVIEILAEAANGKEGLELINSFKPDLIFLDIQMPGLTGFEMLQKLDEIPLVIFTTAYDDYALEAFETNTIDLFIENRSPPKGLEKPIPKITGKWAEN

SEQ ID NO: 9113 - DNA, 720 bp, Unknown
  Obtained from environmental sample
  misc_feature (1)..(720): n is a, c, g, or t
atgtacactataaatatagcttcacttagtaatatggatcaagctaaagtacttgttagggagtatggtatttatgacaatagttttgtatttaaatatggctctgatttagagtggataaaggttatgtatggagtttattcaaattattcagatgcatctgaggcattaaaagagttaaaagatttaagagatatatattatccagtgattgaaaaaatttctaaaaagcaagaactgtataaaaaatataacactggttcaagtatgcctaaaataaattcaaaaaaagctccatctacagagctagctaaagaagagaagtttgttaaagctatatatttaatgacagtaagtaaagctgaaagagcagaagagttaaaaaagatctactctcaatataaaaactataaatatatagatgtctcagctgataactcaggtacttttagtgtagtaagacgtgttaaagagggtgaaaattcgaaagaaattttaaatgatattcgaaaaacatttaaagatgcatggattgtattagatgaatcttcatccatggagtcagttaaagagaaagaagtagaactggttatagaagatgaactagttgaagtggatgaaaaagaagaagagtttgttgaagaagataagaaagaagtagaactagttatagaagaagagctagttgaattggaagagaaaagaagtagagttagttaa

SEQ ID NO: 9114 - protein, 239 aa, Unknown
  Obtained from environmental sample
  misc_feature (1)..(239): Xaa is any amino acid
MYTINIASLSNMDQAKVLVREYGIYDNSFVFKYGSDLEWIKVMYGVYSNYSDASEALKELKDLRDIYYPVIEKISKKQELYKKYNTGSSMPKINSKKAPSTELAKEEKFVKAIYLMTVSKAERAEELKKIYSQYKNYKYIDVSADNSGTFSVVRRVKEGENSKEILNDIRKTFKDAWIVLDESSSMESVKEKEVELVIEDELVEVDEKEEEFVEEDKKEVELVIEEELVELEEKRSRVS

SEQ ID NO: 9115 - DNA, 816 bp, Unknown
  Obtained from environmental sample
  misc_feature (1)..(816): n is a, c, g, or t
atggaaaatttagaagaatatattgtcttccaactgctaacgcgtataaaaaaatcattgtcatttaatgataaaatctattttctgtttgatggtgataaaatttttgaaaaagcaagaaaacttgaaacaattgtaaaaaatattctagaacaagatatgatagatatagactttatatttgatactttcgaacttagcatcaataaaaaacttgtaatgcaagaagtcgctccaaatataacaaatcctgaggataatacaaaattccctataggtacatttttcgcagtctctcaaaagatgaaacttttaattgctatagataaaaaagttatccaaaaaacaatccaagtaattaaagaagaaaatattgttcatgatatagccgttaatgtatccatgttgtctattgaagataatagattcatatcatggctaaatggtgaattgctatacaattcagatgtaacaaaatatcttgtatttagtataaatacacagactgttgcaaataattttactacttttaaatcttttatagagacaatccataaatatgaatctaaagttttattaaaaagatttacttttgatgatatctctaaggataaattagagactttagatgttgattttattagaattgatcaaaacttttgtaccgctatagaaggtaatcatgctaaaataaatacgattaaatctctcatattgtatggtcaaaaaaatgatgttgtaattcttggtgataacataagggagaattatgatgttgaatttgttgagggattaggcttgtatgcaacaagttga

SEQ ID NO: 9116 - protein, 271 aa, Unknown
  Obtained from environmental sample
  DOMAIN (46)...(271): EAL domain
  misc_feature (1)..(271): Xaa is any amino acid
MENLEEYIVFQLLTRIKKSLSFNDKIYFLFDGDKIFEKARKLETIVKNILEQDMIDIDFIFDTFELSINKKLVMQEVAPNITNPEDNTKFPIGTFFAVSQKMKLLIAIDKKVIQKTIQVIKEENIVHDIAVNVSMLSIEDNRFISWLNGELLYNSDVTKYLVFSINTQTVANNFTTFKSFIETIHKYESKVLLKRFTFDDISKDKLETLDVDFIRIDQNFCTAIEGNHAKINTIKSLILYGQKNDVVILGDNIRENYDVEFVEGLGLYATS

SEQ ID NO: 9117 - DNA, 309 bp, Unknown
  Obtained from environmental sample
  misc_feature (1)..(309): n is a, c, g, or t
atggctgctgtttatttcgacgatttcagcgtcatggatattgtggactttgtcttcatagtgatcggagtcattgggttgatgggatacgcgtatgcattgcgcattggctcggcaggattctggaggctgttcctgccagtgtttgtactctgggatctattctttcgtttcatcataatgaggcctgactcggaggtcgacatcacctcctactaccttatcctttgcatcctatttctgtttctcatcccacagtacatcgcggtctatcgctatcagcgtgagctacagctgagtcagacctag

SEQ ID NO: 9118 - protein, 102 aa, Unknown
  Obtained from environmental sample
  misc_feature (1)..(102): Xaa is any amino acid
MAAVYFDDFSVMDIVDFVFIVIGVIGLMGYAYALRIGSAGFWRLFLPVFVLWDLFFRFIIMRPDSEVDITSYYLILCILFLFLIPQYIAVYRYQRELQLSQT

SEQ ID NO: 9119 - DNA, 444 bp, Unknown
  Obtained from environmental sample
  misc_feature (1)..(444): n is a, c, g, or t
atgagtctcgctgagtttattcattccgcagtaaaaaacggtaaacaaattaccttattaaaaaacgattttttaaaacttggcggaactacagataccaatatttactttgtagaaagtggaagtctctgcgtttttgttatggacgaagaagaagagcaaattattcgctttgggtataacaacgatttaattgtttccttagattcttttctaacagaacaagcatctgatttttatatacaggcaataaaaaagtcaaaaattagggtaattcccaaacagcagtttataggttttgttaatgagagtagcgagaataaacaaatgtggattttcctgcttgaagagttggtacttcagcaaattgaaagaaaaaaagatatcctttaccaactcgcccaaagaaagatattaccgaagtggctgaaaagaaaatccccc

SEQ ID NO: 9120 - protein, 148 aa, Unknown
  Obtained from environmental sample
  misc_feature (1)..(148): Xaa is any amino acid
MSLAEFIHSAVKNGKQITLLKNDFLKLGGTTDTNIYFVESGSLCVFVMDEEEEQIIRFGYNNDLIVSLDSFLTEQASDFYIQAIKKSKIRVIPKQQFIGFVNESSENKQMWIFLLEELVLQQIERKKDILYQLAQRKILPKWLKRKSP

SEQ ID NO: 9121 - DNA, 339 bp, Unknown
  Obtained from environmental sample
  misc_feature (1)..(339): n is a, c, g, or t
atggaaaatttcgttcgtaaaaattatttgcttattaccccaccgctttctcgtgatttagcaattcatactttaacggcaatagtgattaggtttattcccaccaaaaatataaaaatttacccattaaacaagaaaagttatcggttaagtgttatttggttaattgtagttaaccccaagctccaacggagcgtaatttttacagcgttgagtgtagctcaatgcaaacaacaacacacctctgatgttgtactctcgctgctatcgcaaacttcgaacaacatcttctcctctcaagaggagaaaggttgtattaaaccagaagattcccgataa

SEQ ID NO: 9122 - protein, 112 aa, Unknown
  Obtained from environmental sample
  misc_feature (1)..(112): Xaa is any amino acid
MENFVRKNYLLITPPLSRDLAIHTLTAIVIRFIPTKNIKIYPLNKKSYRLSVIWLIVVNPKLQRSVIFTALSVAQCKQQHTSDVVLSLLSQTSNNIFSSQEEKGCIKPEDSR

SEQ ID NO: 9123 - DNA, 756 bp, Unknown
  Obtained from environmental sample
  misc_feature (1)..(756): n is a, c, g, or t
atgagcagaggaatgaaacttaccttgaagcagataacaggtatcaaaaacctagtttcagcatcaatctcaaacttacttgctacagatgtttccatagttgaccaagatggtatacctttgggagatgaagatggtggagcttttgaaggagagttagtaaaatctcaaattaaatataaaaaagagtttgagagaaatatagaagataaaataattaatgttttagcacctatagtaggaggaattgataaggttgttgcgaaagtaacaattgattttgattttgctaggatagatagtgttagtgaagtatatgatccaaactcagttccaagaagcgaacaaacagtagaagaaaaaaaagagggaaagagtcctgaagatgttggaggggttcctggagcagttagtaacattggaccagttcaaggtctagaaagtaataaaataaaagaaaaatacgaaaaaagttcttcaactatcaattatgaaatttctaaaaaagtgacaaatacaaaaggtgaatttgctattataaaaaggttaagtaccgcagttgtagttgatggtaattatcattttgatacagatgaaaatggaaaaagtacagganaactaanatatatagcacttagtgatgctcaaatgaattctataaatgcaatagtaaaacagaccgttggtttttatgaaaatagaggtgatgaagtaacagtaagtaatttcgagtttaaacctcttcaaaaagatgga

SEQ ID NO: 9124 - protein, 252 aa, Unknown
  Obtained from environmental sample
  misc_feature (1)..(252): Xaa is any amino acid
MSRGMKLTLKQITGIKNLVSASISNLLATDVSIVDQDGIPLGDEDGGAFEGELVKSQIKYKKEFERNIEDKIINVLAPIVGGIDKVVAKVTIDFDFARIDSVSEVYDPNSVPRSEQTVEEKKEGKSPEDVGGVPGAVSNIGPVQGLESNKIKEKYEKSSSTINYEISKKVTNTKGEFAIIKRLSTAVVVDGNYHFDTDENGKSTGXLXYIALSDAQMNSINAIVKQTVGFYENRGDEVTVSNFEFKPLQKDG

SEQ ID NO: 9125 - DNA, 333 bp, Unknown
  Obtained from environmental sample
  misc_feature (1)..(333): n is a, c, g, or t
ttggaagatgaaagtggttatgtggcaacaggcaagctttttgaaaagttttctcctgatgtcataattggattcaatgaccctgtagctatcggggcttatagatatctcaagaagaataagataagagttccgcgagatgttgcgctttgtggattcagtgatttgaaatcttcacgcctcttggaagttccgcttacaacagtttcagaggcgaccacagaaatgggtgtccgagcctttgagattctaaagaatctgattgagagccctaattgtgagattcagaaggttaaactcaaagcagagctccaaataagagactctgcctaa

SEQ ID NO: 9126 - protein, 110 aa, Unknown
  Obtained from environmental sample
  misc_feature (1)..(110): Xaa is any amino acid
MEDESGYVATGKLFEKFSPDVIIGFNDPVAIGAYRYLKKNKIRVPRDVALCGFSDLKSSRLLEVPLTTVSEATTEMGVRAFEILKNLIESPNCEIQKVKLKAELQIRDSA

SEQ ID NO: 9127 - DNA, 369 bp, Unknown
  Obtained from environmental sample
  misc_feature (1)..(369): n is a, c, g, or t
atgcattttttcagttttgatacaatacatggctctagtaacagaaatgcggcaagggtgctaatacaggcgatcaaatcacttaaaaatggatatgatatcggtatgactccggatggtccaaaaggaccaagacgtgaagttgctgatggaattgtagtcatgtcacaaaaaacaaaaagtgacatagttacttttaattgtgttccaagcagctattggcagttaaagagttgggataaatttgtcattcctaagccgtttggcgagcttgatttttatgttggcgaaccattcagtgttgatggtttaagcattgaagaggcaaaaaaagttgtgaaagagagactcttgattcatgcaatctaa

SEQ ID NO: 9128 - protein, 122 aa, Unknown
  Obtained from environmental sample
  DOMAIN (1)...(47): Domain of unknown function (DUF374)
  misc_feature (1)..(122): Xaa is any amino acid
MHFFSFDTIHGSSNRNAARVLIQAIKSLKNGYDIGMTPDGPKGPRREVADGIVVMSQKTKSDIVTFNCVPSSYWQLKSWDKFVIPKPFGELDFYVGEPFSVDGLSIEEAKKVVKERLLIHAI

SEQ ID NO: 9129 - DNA, 804 bp, Unknown
  Obtained from environmental sample
  misc_feature (1)..(804): n is a, c, g, or t
atggagagtataaaggaagttaaattatacaatgagtttatagtcaataaacttaatataaaagaaaataatttcaaggatatattatattatcttgaacaatacaatgatgcaattaatcaaacaaatctagttagaaaatttgattcaaatggaaaaataataaatacaaataataagtttataaaaactttaggaatgtattctttagcaaaccaattaaaagagataaattcttttgatgttataaaaaatacaacatcttcaagtgataaattttttaacaatttaattatttatgaaaatcaaaaccaaaaaagctatattgaatctacatatatacccatatataagtatgatcaaacactattagaagtattagaaataagttatgatgtttctgaagtctataaactcaatgaagagatacaaaaaacacaagaaacggttatatatatgttaggaacattgatagagagtcgttcaaaagagacctcaaatcatctaaaaagagtagctttatatggagaaataatagggaaagcttatgggcttgatgacaaacaaatggagcttatgaaaatctcttcacctttacatgatataggtaaaattggtattcctgatcatattttaaataaaccatcatcactaagtgatgaagaatatagagttgtaaaagagcattctaaaataggctatgagatacttaaaaactcaaatagagatattttacaaatagcagcagttattgcttattcacatcatgagaattgggatggaacaggttatcctcaaaattaa

SEQ ID NO: 9130 - protein, 267 aa, Unknown
  Obtained from environmental sample
  DOMAIN (165)...(266): HD domain
  misc_feature (1)..(267): Xaa is any amino acid
MESIKEVKLYNEFIVNKLNIKENNFKDILYYLEQYNDAINQTNLVRKFDSNGKIINTNNKFIKTLGMYSLANQLKEINSFDVIKNTTSSSDKFFNNLIIYENQNQKSYIESTYIPIYKYDQTLLEVLEISYDVSEVYKLNEEIQKTQETVIYMLGTLIESRSKETSNHLKRVALYGEIIGKAYGLDDKQMELMKISSPLHDIGKIGIPDHILNKPSSLSDEEYRVVKEHSKIGYEILKNSNRDILQIAAVIAYSHHENWDGTGYPQN

SEQ ID NO: 9131 - DNA, 816 bp, Unknown
  Obtained from environmental sample
  misc_feature (1)..(816): n is a, c, g, or t
ttgatggctggtcatacttccattagatctttttcggatcgaacagagttggattataaaaaagaattatcgaacaaagaattaaaaaaacttcttagacaatattctgttctcgattatgtggattctggtattctttctgatgtactaattgaagaacttattacaaatgcaattaaacatggcgaaaatgaaccggggatggaatctgataagccatgtacatggatttcctctaggctcgtaaaagccactaaaacttctttgaaggaatatccaaaatggttacaacctacatataaaactcttgtaggaaaacattatttagaaatagttttatgtgattctggtattggtgtttatgaacaattaaaagattttaccccaagcggggttttttcaaataagccatctattaaatcaattttagattatgcctttgataagtactcatcctcttcaagaaaattgagaactgaattagaccatttaccaagaggattgttctgggtttatgatttggttcgtcaatatggaggagccctaacaattcgaagtaatgggtattatatgggatatgattttttaaaccacagaaaaactcctcatcttttagatttatgggatgacacaggaaagtgtcataatgtcaaaggaactttaattcaattgatattaccagaagtagatgtaaaacctataaatattaatacaacattggttaatttacacaaaatagacccaatagtaatcgtaatagatcctcctgtagataataccccaatagagaagtatgttaaaaaagtagcaaaatga

SEQ ID NO: 9132 - protein, 271 aa, Unknown
  Obtained from environmental sample
  DOMAIN (45)...(229): Histidine kinase-, DNA gyrase B-, and HSP90-like ATPase
  misc_feature (1)..(271): Xaa is any amino acid
MMAGHTSIRSFSDRTELDYKKELSNKELKKLLRQYSVLDYVDSGILSDVLIEELITNAIKHGENEPGMESDKPCTWISSRLVKATKTSLKEYPKWLQPTYKTLVGKHYLEIVLCDSGIGVYEQLKDFTPSGVFSNKPSIKSILDYAFDKYSSSSRKLRTELDHLPRGLFWVYDLVRQYGGALTIRSNGYYMGYDFLNHRKTPHLLDLWDDTGKCHNVKGTLIQLILPEVDVKPININTTLVNLHKIDPIVIVIDPPVDNTPIEKYVKKVAK

SEQ ID NO: 9133 - DNA, 489 bp, Unknown
  Obtained from environmental sample
  misc_feature (1)..(489): n is a, c, g, or t
gtggaaaattattcctacattatggttattggttataatattaatgattgcggcagcttattattttccaatacctactcaaggattatcatgaaactaaataaaacatcacagtatgcgataagagttatggttcttatctcaaataatcatgaaaaagatcttttaagtgccaaatatatcgcgcaagagttatcaattccatacaaatatctaacctctattatgactcagcttgcagatgctggcttgattaactctacaagaggaaaatttggaggatactctttaaataaagagacatcagcaattaaaatcatagatatactagaagctgttaaagagtctatggatggtaaaaattgtcttcttggcatcggtctatgcagtgatggtgagaagtgtgccatgcatgaccaatgggttgaacctaagaaagtcctattaaatatgcttaattcaactacactttttgatcttcaatcgtaa

SEQ ID NO: 9134 - protein, 162 aa, Unknown
  Obtained from environmental sample
  DOMAIN (31)...(152): Transcriptional regulator
  misc_feature (1)..(162): Xaa is any amino acid
MENYSYIMVIGYNINDCGSLLFSNTYSRIIMKLNKTSQYAIRVMVLISNNHEKDLLSAKYIAQELSIPYKYLTSIMTQLADAGLINSTRGKFGGYSLNKETSAIKIIDILEAVKESMDGKNCLLGIGLCSDGEKCAMHDQWVEPKKVLLNMLNSTTLFDLQS

SEQ ID NO: 9135 - DNA, 435 bp, Unknown
  Obtained from environmental sample
  misc_feature (1)..(435): n is a, c, g, or t
atgaaagcaatgatttttgcagcaggcttgggaactcgccttcgcccattaacaaatgatattccaaaagctcttgttccttacaaaggcaaacctcttttgcaacttactattgaaaatatttcatcgtatggatttgatgaaataattgtaaatattcatcattttgcacccaaagttgtagattttcttgaaagaaatgactttttcggaaaaaacatcattatttcagatgaagccgaacttttacgtgatacaggcggaggacttttttatgctaaagattacttcaaaaatgaacctttttttagtcataatgttgatattttaggttcttttaatctgaaaaaactttatgataatcatcgaaagaacaactcaataacaacattagctgttcaaaatagagagtcttcaagacgacttttattttaa

SEQ ID NO: 9136 - protein, 144 aa, Unknown
  Obtained from environmental sample
  misc_feature (1)..(144): Xaa is any amino acid
MKAMIFAAGLGTRLRPLTNDIPKALVPYKGKPLLQLTIENISSYGFDEIIVNIHHFAPKVVDFLERNDFFGKNIIISDEAELLRDTGGGLFYAKDYFKNEPFFSHNVDILGSFNLKKLYDNHRKNNSITTLAVQNRESSRRLLF

SEQ ID NO: 9137 - DNA, 789 bp, Unknown
  Obtained from environmental sample
  misc_feature (1)..(789): n is a, c, g, or t
atgaaaataaaaacnggaatattaactcttccacgaggtttaatgagaggagtaattgaacttttttcccaaaataaccttgatacaacttatgttgataaaagattttataaagaggttgcatttcctaaaataacttatcaattacgaccagaacaaaaaaaggctatagagcaaatatcaaaaaaagatttctctttatgtgttgcccctccaggttttggaaaaacacttttaggtgctaaaatgatagaggtgagaaatgtaaatacactggtaattgtcaataaaaatatgttgctagatcaatggattgaaagatttgtaaattattttggatattcaaaaaaagatattggatatttaggaaaagggaaaaataaactaaacaattcccttgatgtggcaactatgcaaagtttaaaaaataatctagaattaatcaaaaattattcatttgttattgttgatgagtgtcaccatataccagcactcacttttgaaaaaattataaagcaattttgtggaaaatatatcttaggactgagtgcaacaccaaatagaaaagatgggatggaaccacttatttatcaacagttaggttcaatagcatatgaggtaaaaagtaaaaaagtatttacaaataaattaaaaatagtagaaactgattttataagtaatgtggataattttgcagacttagtaaacgaaatgataaatgatgagaagagaaataatgtaatcatagagcaaattatccaatacaaagatagaaaaattttactttaa

SEQ ID NO: 9138 - protein, 262 aa, Unknown
  Obtained from environmental sample
  DOMAIN (49)...(191): DEAD/DEAH box helicase
  misc_feature (1)..(262): Xaa is any amino acid
MKIKTGILTLPRGLMRGVIELFSQNNLDTTYVDKRFYKEVAFPKITYQLRPEQKKAIEQISKKDFSLCVAPPGFGKTLLGAKMIEVRNVNTLVIVNKNMLLDQWIERFVNYFGYSKKDIGYLGKGKNKLNNSLDVATMQSLKNNLELIKNYSFVIVDECHHIPALTFEKIIKQFCGKYILGLSATPNRKDGMEPLIYQQLGSIAYEVKSKKVFTNKLKIVETDFISNVDNFADLVNEMINDEKRNNVIIEQIIQYKDRKILL

SEQ ID NO: 9139 - DNA, 699 bp, Unknown
  Obtained from environmental sample
  misc_feature (1)..(699): n is a, c, g, or t
atggaaaatattgataaagaactaaaaactttatatgaacaaaaagaacagctagagaagcaaattgagtttttagaaaataaaaaacaatctagcataaaaagttatatagtattaaatgatgctatatatatagaaacatcccatttatcaaaaaagctaattgaatctttagaacaattagcaacctttgaaaatcctcaaataaaaactttacaagctttgcgaaaacccatttataatacccctagatatcttaaaagttatgaaaataaaaacggaatattaactcttccacgaggtttaatgagaggagtaattgaacttttttcccaaaataaccttgatacaacttatgttgataaaagattttataaagaggttgcatttcctaaaataacttatcaattacgaccagaacaaaaaaaggctatagagcaaatatcaaaaaaagatttctctttatgtgttgcccctccaggttttggaaaaacacttttaggtgctaaaatgatagaggtgagaaatgtaaatacactggtaattgtcaataaaaatatgttgctagatcaatggattgaaagatttgtaaattattttggatatttcaaaaaagatattggatatttaggaaaagggaaaaataaactaaaccattcccttgatgtggccactatgcaaagtttaaaaataatctag

SEQ ID NO: 9140 - protein, 232 aa, Unknown
  Obtained from environmental sample
  DOMAIN (135)...(228): Type III restriction enzyme, res subunit
  misc_feature (1)..(232): Xaa is any amino acid
MENIDKELKTLYEQKEQLEKQIEFLENKKQSSIKSYIVLNDAIYIETSHLSKKLIESLEQLATFENPQIKTLQALRKPIYNTPRYLKSYENKNGILTLPRGLMRGVIELFSQNNLDTTYVDKRFYKEVAFPKITYQLRPEQKKAIEQISKKDFSLCVAPPGFGKTLLGAKMIEVRNVNTLVIVNKNMLLDQWIERFVNYFGYFKKDIGYLGKGKNKLNHSLDVATMQSLKII

SEQ ID NO: 9141 - DNA, 654 bp, Unknown
  Obtained from environmental sample
  misc_feature (1)..(654): n is a, c, g, or t
gtgaatgtagcgctaatctatgaggtcccattggttgtttggggagaggatattgcctttgaatttggaggtaaagatagtggtagtaagccatcagcggtagaaattgataaaaatgacttgattaaagaaaagacaatacacgattggcttggggaagatatctctgagcgagatgtttttttctatgaatatcccgattatgaaaaaattaaagaagcgggtattcgtagcatctatctaggccattttgtgcgttggtatggacgagacaattttaatattgtcaaaaagagaggctttagcgtccgtgaggacggcccgctatctggtaattatctcgattatgacaacattgatgagaagctttgtgagatcaatatctggtttaaataccttaaatttggtttctggcgtgcaacggatcagtgctgttacgatatatggaatgatacgttaagcagggatgacgctgtagacattgtgaatcgtttaagtgctgagtttccaaaggagtattttcaagactttttacgttttcatctgattacggaagatgagttttgggaagtagttgaacggtttagaaacaaagatgtctgggagatgcgtgaaggacagtgggaattgaaaaataagttgggaaaagtataa

SEQ ID NO: 9142 - protein, 217 aa, Unknown
  Obtained from environmental sample
  misc_feature (1)..(217): Xaa is any amino acid
MNVALIYEVPLVVWGEDIAFEFGGKDSGSKPSAVEIDKNDLIKEKTIHDWLGEDISERDVFFYEYPDYEKIKEAGIRSIYLGHFVRWYGRDNFNIVKKRGFSVREDGPLSGNYLDYDNIDEKLCEINIWFKYLKFGFWRATDQCCYDIWNDTLSRDDAVDIVNRLSAEFPKEYFQDFLRFHLITEDEFWEVVERFRNKDVWEMREGQWELKNKLGKV

SEQ ID NO: 9143 - DNA, 966 bp, Unknown
  Obtained from environmental sample
  misc_feature (1)..(966): n is a, c, g, or t
gtgatatatgatacaaattgccaatcaagtcttatctataaagcggcagatatcaaaaagttttcattaaaattactccataaattaagagctgcaacaattgataaattacaatctacagatattgaaactgctattgcgtatgcaacacatagttccggagttttaatcaatgtttatagtaaagcagcagcttatacacaagagagcgatctagtttctttaaaagttattcaagataatgatggatttgacactgtacaaggtgatgttttattaagtacaataggtgtagatgcaggaaaagttgaaaacatttgtgatgaagttttaatagaagctagttatatagatccaagttatctctcgcaaaccgtttttgataagaaaagagaaacaggggatatatattatagagcatcaagaggaagtgaaccaaatttagattttggtatagattctgttatcactttactatctgaaaatggtgcaacaatttataatggtagtaaacactttatcaatgatataaagcaaaatacaattaatattaataataaacaacttaataaaatcataggacaaaatatagagccaagtcgtgtgagtcaaatacttacatcacttggtttttttgtaaaacaagatggtcaagacactattaatgtaactattccaacatttagacatgatgtaaataatattgcagatataacagaagagattgttagaatcataggaattgatcaaattcaatcaaaaccacttttgattcaagagttaaataatatcaatgtaagctctaatattttacaaatcaaaaatcacttacgatcacaagctatagcaaatggtttttttgaaactataacttatgtatttgccaataaagagttattagaaaaatataatttttccaggtggtataaaataaaaaagaaatttttaaatccaattgtaaattga

SEQ ID NO: 9144 - protein, 321 aa, Unknown
  Obtained from environmental sample
  DOMAIN (179)...(248): tRNA synthetase B5 domain
  misc_feature (1)..(321): Xaa is any amino acid
MIYDTNCQSSLIYKAADIKKFSLKLLHKLRAATIDKLQSTDIETAIAYATHSSGVLINVYSKAAAYTQESDLVSLKVIQDNDGFDTVQGDVLLSTIGVDAGKVENICDEVLIEASYIDPSYLSQTVFDKKRETGDIYYRASRGSEPNLDFGIDSVITLLSENGATIYNGSKHFINDIKQNTININNKQLNKIIGQNIEPSRVSQILTSLGFFVKQDGQDTINVTIPTFRHDVNNIADITEEIVRIIGIDQIQSKPLLIQELNNINVSSNILQIKNHLRSQAIANGFFETITYVFANKELLEKYNFSRWYKIKKKFLNPIVN

SEQ ID NO: 9145 - DNA, 765 bp, Unknown
  Obtained from environmental sample
  misc_feature (1)..(765): n is a, c, g, or t
atgtcaataatagatacacattgtcatcttgataatatacaataccaagatgacatagatgatgttatacaaactgcattacaaaatggtgttgaagcttttttaataccaggtgcagatcctcatgacctagaaaaatctgtagctttaagtgaaaaatatgatgaagtgttttttgctgttggtgttcacccttatgattgtgaaaaatttgatttagcaattttagaaaagtatgtaacccatcctaagtgtatagctgtaggagagtgtggtttagattattttagactccctcttgatgaagatgaaaagcaacaaaatatacaacttcaaaaagatatcttcaaagcacaaatagagtttgcaaaaaaggtgaaaaaacctcttatagttcatatacgggatgcttcagatgatagtagaactattttaatagaatcagaagcttgcgaagttggaggtgttctacattgctataatgcaagcgaacacttacttgttttgagtgagcataacttttattttggaataggtggagtagtaacttttaaaaatgcaaaaaaactagtagaggtattgccaaaaattccactagaaaaactgcttattgaaacagattcaccttatttacacctcacccttcagaggaacacaaatacacctgcgtatacaaatatcatagcagaaaaagtctctgaaatcttaaaaaaattccaaaaagagattgaaaatcttactacaagttatggcaaagcctttatt

SEQ ID NO: 9146 - protein, 255 aa, Unknown
  Obtained from environmental sample
  DOMAIN (1)...(251): TatD related DNase
  misc_feature (1)..(255): Xaa is any amino acid
MSIIDTHCHLDNIQYQDDIDDVIQTALQNGVEAFLIPGADPHDLEKSVALSEKYDEVFFAVGVHPYDCEKFDLAILEKYVTHPKCIAVGECGLDYFRLPLDEDEKQQNIQLQKDIFKAQIEFAKKVKKPLIVHIRDASDDSRTILIESEACEVGGVLHCYNASEHLLVLSEHNFYFGIGGVVTFKNAKKLVEVLPKIPLEKLLIETDSPYLHLTLQRNTNTPAYTNIIAEKVSEILKKFQKEIENLTTSYGKAFI

SEQ ID NO: 9147 - DNA, 516 bp, Unknown
  Obtained from environmental sample
  misc_feature (1)..(516): n is a, c, g, or t
gtggttttagatttttttagactccctcttgatgaggatgaaaagcaacaaaatatacaacttcaaaaagatatcttcaaagcacaaatagagtttgcaaaaaaggtgaaaaaacctcttatagttcatatacgggatgcttcagatgatagtagaactattttaatagaatcagaagcttgcgaagttggaggtgttctacattgctataatgcaagcgaacacttacttgttttgagtgagcataacttttattttggaataggtggagtagtaacttttaaaaatgcaaaaaaactagtagaggtattgccaaaaattccactagaaaaactgcttattgaaacagattcaccttatttaacacctcaccctttcagaggaacacgaaatacacctgcgtatacaaatatcatagcagaaaaagtctctgaaatcttaaaaaaatcaaaaaaagagatagaaaatcttactacaagtaatgcaaaagccttatttaaagagtttgatagataa

SEQ ID NO: 9148 - protein, 171 aa, Unknown
  Obtained from environmental sample
  DOMAIN (1)...(167): TatD related DNase
  misc_feature (1)..(171): Xaa is any amino acid
MVLDFFRLPLDEDEKQQNIQLQKDIFKAQIEFAKKVKKPLIVHIRDASDDSRTILIESEACEVGGVLHCYNASEHLLVLSEHNFYFGIGGVVTFKNAKKLVEVLPKIPLEKLLIETDSPYLTPHPFRGTRNTPAYTNIIAEKVSEILKKSKKEIENLTTSNAKALFKEFDR

SEQ ID NO: 9149 - DNA, 843 bp, Unknown
  Obtained from environmental sample
  misc_feature (1)..(843): n is a, c, g, or t
gtgtatgattatgatgataatatgagttttgaggataaaataaaaaaactacttattgagattcttttaggtcgtttttatgataaaaaaaaatctgtagatatgtatccaaaaagcaaacctttagatactaattatacactcctaaaaccctctatggaacaaaacccttatatacagcaaaatcaacaaacacaacaaggtaatgtgaattctcaactcattgggatagtatttaatcataaagaggagtattatcaaaagcaaacagtagattttaatacctctttaaaagttaatacacctaataaatcttttactattgatctttcaatctcttattcacaagagctatacgaagctcatagttccaaactagtagttggggaagaagctacaaaagatccattggtaattaactatggtgaagatattaacccatttgaaaacataagtgaattaaaatttgaatttgatttagataaggatggaagtactgatttaatacctatgttaaaacaaggtgctggatatctagcattggataaaaacaacaatggttcaatagatgatggaagtgaactttttggaacagaatcgggaaatggatttaaagatttagcacaatatgatagtgacaataacaactggatagatgagaatgatgaagtctttaataagttaaaaatttggcaaaaagatgatgcaggtggcaacaagttagtctcgctagttgacctcaatattggagctatctatttaggagatgtacaaaggggttttaaataccaaaatggtattaataatactgaagctatacaaaaaataatggtatttttctaa

SEQ ID NO: 9150 - protein, 280 aa, Unknown
  Obtained from environmental sample
  misc_feature (1)..(280): Xaa is any amino acid
MYDYDDNMSFEDKIKKLLIEILLGRFYDKKKSVDMYPKSKPLDTNYTLLKPSMEQNPYIQQNQQTQQGNVNSQLIGIVFNHKEEYYQKQTVDFNTSLKVNTPNKSFTIDLSISYSQELYEAHSSKLVVGEEATKDPLVINYGEDINPFENISELKFEFDLDKDGSTDLIPMLKQGAGYLALDKNNNGSIDDGSELFGTESGNGFKDLAQYDSDNNNWIDENDEVFNKLKIWQKDDAGGNKLVSLVDLNIGAIYLGDVQRGFKYQNGINNTEAIQKIMVFF

SEQ ID NO: 9151 - DNA, 774 bp, Unknown
  Obtained from environmental sample
  misc_feature (1)..(774): n is a, c, g, or t
atgaaaaaaagagttaggggcagttttcttgcaccgtttggtacaaatttatatgtgattatagatatagcaaatgagagtgaagactctattaaagatcttgtacgtcgctcagtttatttacacaaacagtttaaacatgacctctatttgaaagtcataaatgcaaataattttgaagtacttgagtatataaaaacatttaataacacgaatgtcatagttgatgtaaactatagtttatcatctatagatgatatcatattacaagatatcaatatgtatcatgtaggtttggtagttgtctctaaagctagttttgaacaacgtaaaatgaggaagattctgtttgaaggaagagttcctgttcttaagattgcaaataaatcagtctcaaaacttaaagaggcagtagctattatttctgataataaagagttagaaaaggtggctacaactatttttgatatctccatgcagttagacttgaatatggaaatatataactatacattagaacatcaagagtcaaaaatacagacaatagagcattttaataatctctctacaatcttttcaaaatctattaaagtttttgagaatgaaaaaaatcctcttagactattaaaaaaacgagaaaattttctacactgtctaccatttacatcaaaaattgcacagtaccgtattagtacaattttttcaaccgacagtgacatgctttattaccttcttaacgattatcatcagatctttattccttcgcaaatttaa

SEQ ID NO: 9152 - protein, 257 aa, Unknown
  Obtained from environmental sample
  misc_feature (1)..(257): Xaa is any amino acid
MKKRVRGSFLAPFGTNLYVIIDIANESEDSIKDLVRRSVYLHKQFKHDLYLKVINANNFEVLEYIKTFNNTNVIVDVNYSLSSIDDIILQDINMYHVGLVVVSKASFEQRKMRKILFEGRVPVLKIANKSVSKLKEAVAIISDNKELEKVATTIFDISMQLDLNMEIYNYTLEHQESKIQTIEHFNNLSTIFSKSIKVFENEKNPLRLLKKRENFLHCLPFTSKIAQYRISTIFSTDSDMLYYLLNDYHQIFIPSQI

SEQ ID NO: 9153 - DNA, 921 bp, Unknown
  Obtained from environmental sample
  misc_feature (1)..(921): n is a, c, g, or t
ttgaatatgggtttctttctttggtactggacaaaaggcataaaaggatattttactatttggaataatttctttctcattttttggaatttttttagtgtaaaacatcttttttctacacttttctcggcctggaaaaaagacttaacaccaaaggattggataggactccatcctattttggaggctcagcgatttgccgtaaacataatttttagattcttcggagcaatcgttcgttttgttgttgcgtcatttggaatcttagttgtctttggaatcttagttgcgggttttttatttatgatagtctgggggctggctcctgtgatctttgttttctcaattattggcatgacacttggaggaaagttgtatggctttgcattacttgcgattgtcttgtttcttattgtcaccatgttgacgtatttggaagataaaaaaagaccatatcacgagcttccaatcgaaaaattaccaaaatttccttggtttaaaagggtcgctcaaagatttggaatagttccgggcgatttaacggcagggatactttctgataaggaaaaattagttgatttcttaaaaaaatatgatgtatctattgatgagtttaatttgattttgaagtgggaaatggatttgcaagtagctaaagaaaaagagaataaattttggctagtagagaatttgcgaaaatcagttccacttggaaaaggttgggaatatggctatacagtaacaattgaccgccatgccctagaattgtccaattatgacccaactgaatatcggttagtgttaccaattgggtatgatcaggaaattgaaatgtcgaaattggttttggcaaaagaagagcaaaacaatttctttaatgggaggtcaggagtggcaaactcagccaatctgtcctggtaa

SEQ ID NO: 9154 - protein, 306 aa, Unknown
  Obtained from environmental sample
  misc_feature (1)..(306): Xaa is any amino acid
MNMGFFLWYWTKGIKGYFTIWNNFFLIFWNFFSVKHLFSTLFSAWKKDLTPKDWIGLHPILEAQRFAVNIIFRFFGAIVRFVVASFGILVVFGILVAGFLFMIVWGLAPVIFVFSIIGMTLGGKLYGFALLAIVLFLIVTMLTYLEDKKRPYHELPIEKLPKFPWFKRVAQRFGIVPGDLTAGILSDKEKLVDFLKKYDVSIDEFNLILKWEMDLQVAKEKENKFWLVENLRKSVPLGKGWEYGYTVTIDRHALELSNYDPTEYRLVLPIGYDQEIEMSKLVLAKEEQNNFFNGRSGVANSANLSW

SEQ ID NO: 9155 - DNA, 450 bp, Unknown
  Obtained from environmental sample
  misc_feature (1)..(450): n is a, c, g, or t
ttgataatgattaaaggtatatttctagatttttatggaactctggtagaagaagatgatcaaattattaatttaatactttctaagtttattgataatgatattgaaaagaagaattctataataaaaaaatggagcaagttgttctcagaattagtgaaagaatcaaataaaggcaatttccatactttacacaacattgaggaaaaaagtctcagaatgatatttagtgattatgaaatacaagcagatttaaatgctgaattgaaaaaaatctataattattggtctaatcccaaacctgataaaaatatgtataaatttctatctgaattagatatcccattctatatcgtttcaaatgctgatgataaagatataagtgattcaattgaaactctaagcatcagaccaaaagattggataacgagtgaagaagcaaaatcataa

SEQ ID NO: 9156 - protein, 149 aa, Unknown
  Obtained from environmental sample
  misc_feature (1)..(149): Xaa is any amino acid
MIMIKGIFLDFYGTLVEEDDQIINLILSKFIDNDIEKKNSIIKKWSKLFSELVKESNKGNFHTLHNIEEKSLRMIFSDYEIQADLNAELKKIYNYWSNPKPDKNMYKFLSELDIPFYIVSNADDKDISDSIETLSIRPKDWITSEEAKS

SEQ ID NO: 9157 - DNA, 753 bp, Unknown
  Obtained from environmental sample
  misc_feature (1)..(753): n is a, c, g, or t
ttggcttgctattacaatgacaaaaagggacgtatgtgtacccccatcgggacggtcatagcagtttttattattgcaaaattttggttgttgagcgataggatggtcgttaaacaggtcaaggaaaattcatatattcaatatttttgtaatgttccagatgaagaattgttgttgtttatgcatcccagcaacctgagtaaattgcgaaaacgttttggtgttgagggcatggaggcgatagattccatcattttcaatctgctgcgggttgccaaagtcatcacgaatgacagtatgctgattgattcgacggttttgcccaataatatcatttatccaacagatatcggattgatgttcaaagcgtttaaaaaaatgaaacaggttgccaacaggtgtaatatccttatttggtgggatgaacaggaggttaatcaattatggcgcgaatacaatctaaatcgaaaaaagactgaaatcagcaactttttttttgagtttatattgatcttctccactgcgttacaaaaatttgaaaaacttgttcaaacgcttgatgattctgataaaaataaagaaaaagccctgcggctcttaaacctcctgatattgttccaaaagcagaatgaacaaaaacttgcaggagaaagatatatttcaaatcggattgtttccttagatgaaccggaggctcgccctattaacaagggtaaaaaacatccaaagtgtgaattttggaagcacccttga

SEQ ID NO: 9158 - protein, 250 aa, Unknown
  Obtained from environmental sample
  misc_feature (1)..(250): Xaa is any amino acid
MACYYNDKKGRMCTPIGTVIAVFIIAKFWLLSDRMVVKQVKENSYIQYFCNVPDEELLLFMHPSNLSKLRKRFGVEGMEAIDSIIFNLLRVAKVITNDSMLIDSTVLPNNIIYPTDIGLMFKAFKKMKQVANRCNILIWWDEQEVNQLWREYNLNRKKTEISNFFFEFILIFSTALQKFEKLVQTLDDSDKNKEKALRLLNLLILFQKQNEQKLAGERYISNRIVSLDEPEARPINKGKKHPKCEFWKHP

SEQ ID NO: 9159 - DNA, 732 bp, Unknown
  Obtained from environmental sample
  misc_feature (1)..(732): n is a, c, g, or t
atgagatgtaataaacaggatatatatatgtcatttgaaaaattagggcttatcaagccattgcttggagctattaaagagttaggttatgaacatccaacgcttatacaaaaaagagctattcctttagtcttagcaaagagcgatatttttgctactgctcagaccgggacaggaaaaactgctgcttttgctcttcctatcttgcaaaaactcagaaacactactgctgatgaaaacagagctattagagctgtgattctttcaccaactcgtgaactttctatccagatacacgaagatgtgaaaaactactctaagcatatgagtattactagtgctatattagtcggtggcaaagatatagagtctcaacagcgtatgcttaaacaaggtgttgatgttgttataggaactcccggacgttttatggagcttatggaaaaaggtttagacttttcaaaaatagaagtgtttgtagttgatgaagcagatagaatgctggacatgggtttttcaaaagagataagaaaaattcacttacaacttccaaaaagacaccagactctgcttttctccgcaacatacagtgacaaagttaaaaagctttcaaaacaaatcttactaaaccggcttttcattgaaactgctaaaaaaaacactacagttgacactaacaatcaagttgcttacactggtgaaactgaaaaaaaaacggaacctgtagcctaa

SEQ ID NO: 9160 - protein, 243 aa, Unknown
  Obtained from environmental sample
  DOMAIN (31)...(198): Type III restriction enzyme, res subunit
  misc_feature (1)..(243): Xaa is any amino acid
MRCNKQDIYMSFEKLGLIKPLLGAIKELGYEHPTLIQKRAIPLVLAKSDIFATAQTGTGKTAAFALPILQKLRNTTADENRAIRAVILSPTRELSIQIHEDVKNYSKHMSITSAILVGGKDIESQQRMLKQGVDVVIGTPGRFMELMEKGLDFSKIEVFVVDEADRMLDMGFSKEIRKIHLQLPKRHQTLLFSATYSDKVKKLSKQILLNRLFIETAKKNTTVDTNNQVAYTGETEKKTEPVA

SEQ ID NO: 9161 - DNA, 579 bp, Unknown
  Obtained from environmental sample
  misc_feature (1)..(579): n is a, c, g, or t
ttgaaatttactataattatagaatataaacaaagggcaaaaagcatggaagataagtcgtctttgcaaaatacattgatacagattagagctttagaagatttcaatcgaactgtagataatccaaatgtaaaactaataaactatataaagactatggaagaatatgtatattctacaaaaacagataaacaaggcattattagtgatgtcagcgattctttttctagattgacaggctactcaagagatgaacttattggtaaaagtcataatctaataaaaagtccagagatgaaagatagtttttttacaaatatgtggcagacaatattaaaagaagaagtttgggaaggtaacattcaaaatatcaagaaggatggcactcttttttggatggctgtaattatttttcctatttatgctataaataaagaactattaggctactcagcattacgtcataatataactgatactaaagaacttgctcataaagcaatacatgatggactaactggtctatataatagacgctactatgatgaagtcattgagagagaactattacctgcttaa

SEQ ID NO: 9162 - protein, 192 aa, Unknown
  Obtained from environmental sample
  DOMAIN (118)...(160): PAC motif
  misc_feature (1)..(192): Xaa is any amino acid
MKFTIIIEYKQRAKSMEDKSSLQNTLIQIRALEDFNRTVDNPNVKLINYIKTMEEYVYSTKTDKQGIISDVSDSFSRLTGYSRDELIGKSHNLIKSPEMKDSFFTNMWQTILKEEVWEGNIQNIKKDGTLFWMAVIIFPIYAINKELLGYSALRHNITDTKELAHKAIHDGLTGLYNRRYYDEVIERELLPA

SEQ ID NO: 9163 - DNA, 645 bp, Unknown
  Obtained from environmental sample
  misc_feature (1)..(645): n is a, c, g, or t
gtgtattttatggggattgatttagcttggagtgccaatcacttatcgggggttgctctcatagaagatgatgaggttcttttttgtgatactatggattcattagaagagattgtacagtttatagaaaaatatccagatgcaaaagtaggggttgatgcccctttatctattccaaatcaaataggcaatagggaaattgaaaaactatttttaaaagactatagttcaaagaaactgggtgtatatcctgtaaatagaaacctacttgaaaatgacttgggtattattcgttcagaaaaactagtagatatgatacctcaaaaacttggtttaaatatttttgaagtatacccacatgtgacaatactagaatgctttcatggaaaagttttaccgtataaaagaaaaaaagacagagatataaactttataaaagagcaacttaatattttgcaaaattatcttattgctactgtaaaaggtaactttgcagttgatatatataaattaaaaggaaagagtcttaagaatcatgaagataaactagatgcaattgtttgtgcttatactttggcatattgtgaaaaaaatccttataaactatacggagatatttttatagtaccacagaataaagaatga

SEQ ID NO: 9164 - protein, 214 aa, Unknown
  Obtained from environmental sample
  DOMAIN (1)...(182): Protein of unknown function (DUF429)
  misc_feature (1)..(214): Xaa is any amino acid
MYFMGIDLAWSANHLSGVALIEDDEVLFCDTMDSLEEIVQFIEKYPDAKVGVDAPLSIPNQIGNREIEKLFLKDYSSKKLGVYPVNRNLLENDLGIIRSEKLVDMIPQKLGLNIFEVYPHVTILECFHGKVLPYKRKKDRDINFIKEQLNILQNYLIATVKGNFAVDIYKLKGKSLKNHEDKLDAIVCAYTLAYCEKNPYKLYGDIFIVPQNKE

SEQ ID NO: 9165 - DNA, 372 bp, Unknown
  Obtained from environmental sample
  misc_feature (1)..(372): n is a, c, g, or t
atgctactcaaatgctatgaatggcaaatcaaaaatatattcgaaaggacaacaatgaatgacgaattagttcaaaaaattcggtctaacccgaaatacaaagaattagtaagtaaaagaactggttttgcagtaaaactaggaattttagtattagcaatattttatacatatatattaactattgcatttaaccctacatttttaggaacaaaacttggagatgatggagttatgacaattgcatttcctattgcagcagggataattatagtaagttttattacaactttaatctacgtaagaagagcaaatagtgagtttgaagacttaacaaatgctataaaagatgatgtaaaggatgaattataa

SEQ ID NO: 9166 - protein, 123 aa, Unknown
  Obtained from environmental sample
  DOMAIN (19)...(121): Protein of unknown function, DUF485
  misc_feature (1)..(123): Xaa is any amino acid
MLLKCYEWQIKNIFERTTMNDELVQKIRSNPKYKELVSKRTGFAVKLGILVLAIFYTYILTIAFNPTFLGTKLGDDGVMTIAFPIAAGIIIVSFITTLIYVRRANSEFEDLTNAIKDDVKDEL

SEQ ID NO: 9167 - DNA, 639 bp, Unknown
  Obtained from environmental sample
  misc_feature (1)..(639): n is a, c, g, or t
ttggataaaaccaaatggcaaacttctttttattggggaggaagaaattacgaaaatgacattgtttattatggggaaaaccaatttgaattttcagattcatccttattaattaaagctgaaaaaaaagaagaaaaaagtggtattccatatacttccggattaatagattgccatttttcttttaagcaacaatatggttattttgaaattagaagcaaaaatccaacaggcacaggtttttggccggcattttggttggtaagcaccgaacaatggcctccagaaatagatatttttgaattttatacaagtcaccccaataattggagtacttcgcaacattggaaaaccaaaggaggaaaaaataaacgtcaaaccaaaaactataaaattgatgatgatgcttcagcagattttcaaatttatgccgtagaatggacaccaaaaaaaatcacttggtactacaacaataaaaaatttagaacagcaaaaagaggggttaaaaccatgaattttcctatgcacattattattagtaatgcggtaagcgaaatgaaagaaatgaatttagacgaagcaattttccccaactattttgaaatagattatgttagggtttacaaaagaaatgaatga

SEQ ID NO: 9168 - protein, 212 aa, Unknown
  Obtained from environmental sample
  DOMAIN (16)...(206): Glycosyl hydrolases family 16
  misc_feature (1)..(212): Xaa is any amino acid
MDKTKWQTSFYWGGRNYENDIVYYGENQFEFSDSSLLIKAEKKEEKSGIPYTSGLIDCHFSFKQQYGYFEIRSKNPTGTGFWPAFWLVSTEQWPPEIDIFEFYTSHPNNWSTSQHWKTKGGKNKRQTKNYKIDDDASADFQIYAVEWTPKKITWYYNNKKFRTAKRGVKTMNFPMHIIISNAVSEMKEMNLDEAIFPNYFEIDYVRVYKRNE

SEQ ID NO: 9169 - DNA, 594 bp, Unknown
  Obtained from environmental sample
  misc_feature (1)..(594): n is a, c, g, or t
atgggattatcaattgcaattacagttatattctttcttgctgtaattttaattttggtgagtatgcttctgttcgtaaaagcaaagctatctccagctggtaaattaaaaattactataaatggtgagaaagaacttgaagtcaatggaggtgatactttgttaactactttgagtaataatggaatttatcttccgtctgcttgtggtggaggtggtacatgtattcagtgtacttgccaagttcatagtggtggaggaagtatacttccaacggaagagcctcatttttctagaaaggaaattaaagaaaactacagactaggatgtcaggttaaagtgaaggaagacatggaactcgaactccctgaagaaatcatgggaattaaagagtgggaagcggaagttgtgtctaactataacgttgcatctttcattaaagagtttattgttcagattccagaagatatggattataaagcgggtggatatatccagattcgcgttcctccttgtgttgtcgactttaaagattttgacattgaagcacatcctgaagatcacaaaggtgagccagataaatttaaggcctga

SEQ ID NO: 9170 - protein, 197 aa, Unknown
  Obtained from environmental sample
  DOMAIN (38)...(116): 2Fe-2S iron-sulfur cluster binding domain
  misc_feature (1)..(197): Xaa is any amino acid
MGLSIAITVIFFLAVILILVSMLLFVKAKLSPAGKLKITINGEKELEVNGGDTLLTTLSNNGIYLPSACGGGGTCIQCTCQVHSGGGSILPTEEPHFSRKEIKENYRLGCQVKVKEDMELELPEEIMGIKEWEAEVVSNYNVASFIKEFIVQIPEDMDYKAGGYIQIRVPPCVVDFKDFDIEAHPEDHKGEPDKFKA

SEQ ID NO: 9171 - DNA, 471 bp, Unknown
  Obtained from environmental sample
  misc_feature (1)..(471): n is a, c, g, or t
atgaactacataattttattacttattccaatttttttatattcgaaaatgttaaatattggagatcaaattggactaatagagattagtgatcaaaaaggtaaaatacataaattaaaagagtctcagactttagttgttacatgggatagatatactacctccatagcaaataactattttgataaaaatagagatatttttaaaagtaataatctaattatgattgtagatgtttctcaaaccccctcaggaataatgaacttatttgtcttgccaaaaatgagaagttatgatcatgatattttattatcagatgatgaagcttttaatttaacacttccgtatagtgatcatagagttacgattatacacattgaaaaaagaaaagtgaaagatattaaatttgtagatgatgaaattaaactgggtgaatatttacggaaaaccgtaaatagaggtattaattaa

SEQ ID NO: 9172 - protein, 156 aa, Unknown
  Obtained from environmental sample
  misc_feature (1)..(156): Xaa is any amino acid
MNYIILLLIPIFLYSKMLNIGDQIGLIEISDQKGKIHKLKESQTLVVTWDRYTTSIANNYFDKNRDIFKSNNLIMIVDVSQTPSGIMNLFVLPKMRSYDHDILLSDDEAFNLTLPYSDHRVTIIHIEKRKVKDIKFVDDEIKLGEYLRKTVNRGIN

SEQ ID NO: 9173 - DNA, 660 bp, Unknown
  Obtained from environmental sample
  misc_feature (1)..(660): n is a, c, g, or t
atgttggatcgtaggtattttcgaggggcagagcgaaaaggatttaaagtagaggttttagatcatcaagctggagatgaagctggaattaaagatgtgagttttattatctctggaattaatgcttatgggtatttaaaaactgaaaatggtatccatagacttgtacggataagtccttttgatagtaatgcaaaaagacatacctcatttgcttcagtgatggtaagtccagagattgatgataatatcgatattgaaatagaagataaagatatcagagtagatacctatagagctagtggagctggtggtcagcatgttaataagactgaaagtgctataagaattacacatatagaaacaaacattgttgtgcaatgtcagaatgatagaagccaacataaaaataaagcaagtgctatgaagatgttaaaatctcgtctttatgaactagaattagagaagcaagcagctgaaaaaaaaggtatttcaaaaagtgaaatagggtggggacatcaaattagaagttatgtgatgcaaccataccagcaaattaaggatacaagaagtaatataggttacagtaatgtggatgctatacttgatggtgatttagataaaatgatagaagatgttctaatcgcccaaagtcaataa

SEQ ID NO: 9174 - protein, 219 aa, Unknown
  Obtained from environmental sample
  DOMAIN (1)...(49): PCRF domain
  misc_feature (1)..(219): Xaa is any amino acid
MLDRRYFRGAERKGFKVEVLDHQAGDEAGIKDVSFIISGINAYGYLKTENGIHRLVRISPFDSNAKRHTSFASVMVSPEIDDNIDIEIEDKDIRVDTYRASGAGGQHVNKTESAIRITHIETNIVVQCQNDRSQHKNKASAMKMLKSRLYELELEKQAAEKKGISKSEIGWGHQIRSYVMQPYQQIKDTRSNIGYSNVDAILDGDLDKMIEDVLIAQSQ

SEQ ID NO: 9175 - DNA, 732 bp, Unknown
  Obtained from environmental sample
  misc_feature (1)..(732): n is a, c, g, or t
ttgtacaatggtggatcttcgccttttatagtttctatctcaaaggcaaaatatagactcggttacgctcatcaaaaagataaaaaagcgtataaccttttaagtgactatgttccctatgcaacatcaaaaatcgactcgtacaattaccaaatcatgtcaattttaagacctttgagtgaaaaaaaattctccctctttcctgtttataaagtctcagatgaggttcttggaaaaacgaaagtacctgcaaaaacttatgcgctaaactttggtactggaggtttggaaaaactgcttgaatatgaaaaatatatagagcttgtgagatatatatatgaaaaatacaactatattccactagtagtcttaaatccaggacaagagtatctacaagagagttttatagaagattatttactgccaaataaaattccatatatacaattgggacttttatccattgaagaggtagctgcgcttttgataaaaagtagttttgtaattactccagacactggaattatgcaccttgcatttgctgttgacgcatttgtctacacgccatttacttatacaaatcctgacttggtagaccttggcagtgaaaagtttatacctgtgtatgagcattttgaagctggcgctttgggtcaaaaacaagacattaagataactaccttactacaaaaagccgatcttctttttgagaagttaaaccatgaaaactaa

SEQ ID NO: 9176 - protein, 243 aa, Unknown
  Obtained from environmental sample
  DOMAIN (4)...(233): Glycosyltransferase family 9 (heptosyltransferase)
  misc_feature (1)..(243): Xaa is any amino acid
MYNGGSSPFIVSISKAKYRLGYAHQKDKKAYNLLSDYVPYATSKIDSYNYQIMSILRPLSEKKFSLFPVYKVSDEVLGKTKVPAKTYALNFGTGGLEKLLEYEKYIELVRYIYEKYNYIPLVVLNPGQEYLQESFIEDYLLPNKIPYIQLGLLSIEEVAALLIKSSFVITPDTGIMHLAFAVDAFVYTPFTYTNPDLVDLGSEKFIPVYEHFEAGALGQKQDIKITTLLQKADLLFEKLNHEN

SEQ ID NO: 9177 - DNA, 792 bp, Unknown
  Obtained from environmental sample
  misc_feature (1)..(792): n is a, c, g, or t
atgaaaactaaaaacgttttagaactttgtctctcacccgatgcaggtggtttagaactctacatggtgaaactctctcatttcttggctactaaaacaaatactgtaagcgtaatcaacgaatcgggtaaattagaaaaatattatgagaataaatcttataagtatgagaaaataaaacgccataccacgcttctttcctttttgaatgcaagaaaactagcaaaaattatagatgagaataagattgaactcgtacattttcattggacaaaggatttgcctgtttgcgttttggctaaatacttctctaaacaaaaacctaaaattgttcaaacgcggcatatgaacatgactcgttttaaggatgatttttatcataagtttttatataaaaatatagatgggatgatagccgttactgataaagtaaaagagcagatagagaagtttattcccaaagagataagaccaaaaataaagagaatctatataggaagccaaaaagctcaaaaaatatctcaagagaaaaaagaggcgctgaaagaaaagtatgctcttaaagactcttttgttgtgggaatggtgggtagaatagaagaagcaaaagggcagtatctactcatagaagctctagatgaacttataagtggtggactagacgtaaaagcgttaatagttggacacgctatggatgaggcctatttaaaactcctaaagagcaatgttaataagcttaaccttgagagtaaagtcgcatttacaggtttacaacagaagctcaagagctag

SEQ ID NO: 9178 - protein, 263 aa, Unknown
  Obtained from environmental sample
  misc_feature (1)..(263): Xaa is any amino acid
MKTKNVLELCLSPDAGGLELYMVKLSHFLATKTNTVSVINESGKLEKYYENKSYKYEKIKRHTTLLSFLNARKLAKIIDENKIELVHFHWTKDLPVCVLAKYFSKQKPKIVQTRHMNMTRFKDDFYHKFLYKNIDGMIAVTDKVKEQIEKFIPKEIRPKIKRIYIGSQKAQKISQEKKEALKEKYALKDSFVVGMVGRIEEAKGQYLLIEALDELISGGLDVKALIVGHAMDEAYLKLLKSNVNKLNLESKVAFTGLQQKLKS

SEQ ID NO: 9179 - DNA, 621 bp, Unknown
  Obtained from environmental sample
  misc_feature (1)..(621): n is a, c, g, or t
atgtttccatttggtaaaagtactcaacttaaaatcattgttccacctatgcctaaatcgtgttcagctaataagaaaaaggttaatgagaagattgagcttcttcatgttgaaagagtaacacaaggaaaaggtttgaaagaggcgctactggcttgtaaaactttagtagaacataatattgattttaatcttgatagctatggagggatggctgataaatataagaatgagtttgagaattttgttgacacactaaaatataaaggctcttttcatctatgtggatttacaaataatatctatgacgaataccctaaacatgatatcttcatattccccacaaaaggcgaagggtttggcaatgtaatgatggaagcaatcgcacatggaattataatcttatcttttgacaatacggctataagtaactttaaagagatgggtttttatatgcatcttgttgaagatggagatgttcaagctctaagtcagaggttattattcatagctcaaaatttaaaagaagaggtattactttctcaaaaaaatattcctatagcacaagatattttttcagcacaaagagaagcacaagaatatatagagcttttagtgtag

SEQ ID NO: 9180 - protein, 206 aa, Unknown
  Obtained from environmental sample
  DOMAIN (18)...(187): Glycosyl transferases group 1
  misc_feature (1)..(206): Xaa is any amino acid
MFPFGKSTQLKIIVPPMPKSCSANKKKVNEKIELLHVERVTQGKGLKEALLACKTLVEHNIDFNLDSYGGMADKYKNEFENFVDTLKYKGSFHLCGFTNNIYDEYPKHDIFIFPTKGEGFGNVMMEAIAHGIIILSFDNTAISNFKEMGFYMHLVEDGDVQALSQRLLFIAQNLKEEVLLSQKNIPIAQDIFSAQREAQEYIELLV

SEQ ID NO: 9181 - DNA, 432 bp, Unknown
  Obtained from environmental sample
  misc_feature (1)..(432): n is a, c, g, or t
atgattaaaattttatatataaatagtcattctgcagattatgtacaggatttgacatatagtggtttagttaaaaaactgggtgtacaaaatattgttgatgtaaaatggaataaaaaatttcacattaattataaaaaatatccaaagaacttgggacatattgaaaattcactgtttccatcattttttaatcgcttaaatagtaattatgatgcaatatttgtaggtgcatcaaaagtagactgttttgaagaatatataaaaatagcagcaaatattgataaaaatattcctgttatttttatagatggtggtgatggttatggtatagggtcagatttaactgtttatggacgtccagaactatatgaacaatcacagaaaattcgtccatttgattatatatttaaaagnagaatatctaattga

SEQ ID NO: 9182 - protein, 143 aa, Unknown
  Obtained from environmental sample
  misc_feature (1)..(143): Xaa is any amino acid
MIKILYINSHSADYVQDLTYSGLVKKLGVQNIVDVKWNKKFHINYKKYPKNLGHIENSLFPSFFNRLNSNYDAIFVGASKVDCFEEYIKIAANIDKNIPVIFIDGGDGYGIGSDLTVYGRPELYEQSQKIRPFDYIFKXRISN

SEQ ID NO: 9183 - DNA, 432 bp, Unknown
  Obtained from environmental sample
  misc_feature (1)..(432): n is a, c, g, or t
ttgaaaaaatcatcttttcacagcaaggaaataatgtttatgaaagcaccaaccgcagtaatttgtttttcaccaaatagtggtggtatggagttggcagcacttaaactatccaaaactctaagtaaatatatagacttaactctaataatgcaaacagacaagttcatgcacaaacaatgtctcagtaatcctgactatagcgatataaaatttgaaaccgtaaagtttaatattgcattaagcccatcaattatttatcatgcccgtagaataataaaaagagaaagccttaaaaaatataatcctttgttggtgcatccgaacctaaaaaccattatactttggcttttctttaggtttaaaacatccaaccttggattgttaaaacattggaacctaccaaaatcaaaatccctaaaaaagaatttc

SEQ ID NO: 9184 - protein, 144 aa, Unknown
  Obtained from environmental sample
  misc_feature (1)..(144): Xaa is any amino acid
MKKSSFHSKEIMFMKAPTAVICFSPNSGGMELAALKLSKTLSKYIDLTLIMQTDKFMHKQCLSNPDYSDIKFETVKFNIALSPSIIYHARRIIKRESLKKYNPLLVHPNLKTIILWLFFRFKTSNLGLLKHWNLPKSKSLKKNF

SEQ ID NO: 9185 - DNA, 837 bp, Unknown
  Obtained from environmental sample
  misc_feature (1)..(837): n is a, c, g, or t
ttgaagcagaaaacttactcccaggtggaagtgcgaatggactatttgatggtcccatttcagactaaaaatatgaaaaaagttttttttaaaacctttgggtgtcgtaccaatatttttgacactcaaataatgatgagtaatctaaaagattttcaaactacccaagatgaaaaagaagcagatatggtggtaataaactcctgtacagtaacaaatagtgcagatagtacagctagaaactatataagctctttacaaaaacttcctaaaaaaccaagagtaatatttacaggatgtggagtatggacaaaaggggaaaatctctttaatgaaaataaaatagatgcactctttggacatagtgaaaaagagaaaattaatacacttcttaaagatgatacacgattttttcaagcaggggatttaaaacatatagatgaaacaattattgaaaaaatggttgggaaaagtagagcatttgtaaaaattcaagaggggtgtaactttcgatgtagttattgtattatcccatttgttagaggtgattctagaagttatgatgaggctaaaatattagaacaaattaccactttggcttcaaatggttttggtgagtttatacttacaggaacaaatcttggttcttatggaaaaggtgttgaggggcgagatggtttagcaatacttcttaaaaaaatatctcanataagaggggtaagacgaattcgtcttggaagtgttgaacctatacagattactgatcaatttaaagagatactaactgaaccttggatgggaaaacatctcccatattgcatttgcacatacaaataa

SEQ ID NO: 9186 - protein, 278 aa, Unknown
  Obtained from environmental sample
  DOMAIN (27)...(120): Uncharacterized protein family UPF0004
  misc_feature (1)..(278): Xaa is any amino acid
MKQKTYSQVEVRMDYLMVPFQTKNMKKVFFKTFGCRTNIFDTQIMMSNLKDFQTTQDEKEADMVVINSCTVTNSADSTARNYISSLQKLPKKPRVIFTGCGVWTKGENLFNENKIDALFGHSEKEKINTLLKDDTRFFQAGDLKHIDETIIEKMVGKSRAFVKIQEGCNFRCSYCIIPFVRGDSRSYDEAKILEQITTLASNGFGEFILTGTNLGSYGKGVEGRDGLAILLKKISXIRGVRRIRLGSVEPIQITDQFKEILTEPWMGKHLPYCICTYK

SEQ ID NO: 9187 - DNA, 786 bp, Unknown
  Obtained from environmental sample
  misc_feature (1)..(786): n is a, c, g, or t
ttgacagtgcattcaattgtagcaggagcaaccggaggtgggaaatccatcgcagcccaggttttaattgaagaagccctaaagcaaaatatttgtgtaatagtttttgatccaacagctcaatggtcaggaatgcttagaaaactagaggataaaaaaatgtttggatattacaaaaaatttggaatgaaaaaaactgacgcaagaggatttcctggaaatattagagcaataaaagatgcaagacaaataattagtgtagaaaaattcttccaaccaggtcatatccaaatcttaacactaaacaaactccaaccaaaagatatggatatagtagtagcaaacgttattcgtgagatttttaagtccgacccaaaagaatatccaacacttagaacattgttagtatttgacgaaattcatagaatccttccaaagttcggaggttcaggtgaaggttttattcaaattgaaagagcatgccgagaatttcgtaaatggggttacggagtttgtttaatctctcaggttttatcagattttgcaggtcaaattaaagctaacatttctacagaaatacaaatgagaacaagagatgaaggagacttaaaccgaatcaaaacaaaatacggagaagaatttttacaatccttagttaaagcctcagttggagtgggtatgtttgtgaatccagcatataaccacgcaagtccttatttcgtaaactttagaccaatactccacaatacaagaagactttcagatgaaagaattggaaagatataa

SEQ ID NO: 9188 - protein, 261 aa, Unknown
  Obtained from environmental sample
  misc_feature (1)..(261): Xaa is any amino acid
MTVHSIVAGATGGGKSIAAQVLIEEALKQNICVIVFDPTAQWSGMLRKLEDKKMFGYYKKFGMKKTDARGFPGNIRAIKDARQIISVEKFFQPGHIQILTLNKLQPKDMDIVVANVIREIFKSDPKEYPTLRTLLVFDEIHRILPKFGGSGEGFIQIERACREFRKWGYGVCLISQVLSDFAGQIKANISTEIQMRTRDEGDLNRIKTKYGEEFLQSLVKASVGVGMFVNPAYNHASPYFVNFRPILHNTRRLSDERIGKI

SEQ ID NO: 9189 - DNA, 402 bp, Unknown
  Obtained from environmental sample
  misc_feature (1)..(402): n is a, c, g, or t
atgatcgatattgattgtttcaaactgttcaatgacaactatggacacgacatgggagatgactgcctgaaaaacgttgcaaaagagcttaccataacagcaaaaagaccaactgattttgttgcaagatatggaggggaagaattttgctgtattcttcccaactcgtgtattaacaaagcatctgagtttgctgaacaattgaggagcagtatagaaaacttaaatataccacacacgttctctcctgtttgcaataaagtaaccataagccttggagttgccatgattattccaacaatagaaaaatcatatgatttgttaattaaaaacgctgaccaggctttatataaagcaaaattcaatggtaagaactgtcataaatgcaaggactctttctaa

SEQ ID NO: 9190 - protein, 133 aa, Unknown
  Obtained from environmental sample
  DOMAIN (1)...(126): GGDEF domain
  misc_feature (1)..(133): Xaa is any amino acid
MIDIDCFKLFNDNYGHDMGDDCLKNVAKELTITAKRPTDFVARYGGEEFCCILPNSCINKASEFAEQLRSSIENLNIPHTFSPVCNKVTISLGVAMIIPTIEKSYDLLIKNADQALYKAKFNGKNCHKCKDSF

SEQ ID NO: 9191 - DNA, 591 bp, Unknown
  Obtained from environmental sample
  misc_feature (1)..(591): n is a, c, g, or t
ttgccggaatgggcaaagaattttgaaaaaaactactcttactatctctcaaaatttgagtacaacaatgttgctgatttaggcattaaggcgatcgaagaatcgactttattgaaaattttatatagcaaattaatggttcagctacaaaaatttgatgaccaacttatattcgataaaatgtggcttgttgaaacctctttctctgactcttgcgagaatgcattaccttatatccctcatattgataaaaaaagatatattaaagctatgatttatatagacgatgtaggtattgatgacggaccgttgacagtcgctagctctaacccagaggactatgagcctttaagagactcactgaaaaaaaattataaagctgaaaaggctaattgggtttcaaatttgtcaagtgatcatttttctaaatgtttggggagtgctggaacaacaatattctttgatactaatacaccacattttgctggaaatgtaaaaaagggccatacaaggagagtgattcgtttcgatttttatagaaaaagttggcacaaacctccaatgtttaagaagttaaaattttgggaataa

SEQ ID NO: 9192 - protein, 196 aa, Unknown
  Obtained from environmental sample
  misc_feature (1)..(196): Xaa is any amino acid
MPEWAKNFEKNYSYYLSKFEYNNVADLGIKAIEESTLLKILYSKLMVQLQKFDDQLIFDKMWLVETSFSDSCENALPYIPHIDKKRYIKAMIYIDDVGIDDGPLTVASSNPEDYEPLRDSLKKNYKAEKANWVSNLSSDHFSKCLGSAGTTIFFDTNTPHFAGNVKKGHTRRVIRFDFYRKSWHKPPMFKKLKFWE

SEQ ID NO: 9193 - DNA, 456 bp, Unknown
  Obtained from environmental sample
  misc_feature (1)..(456): n is a, c, g, or t
atgaaaattatatccatcaataagtttttttggaaaaaaggtgggagtgaagcggtattctttggtgaaaaagaattacttgaatcacatgggcatcaggttatcccgttttcaatgcgcgcagacgaaaacttggaatcggaatacgccgattattttgttgaaaatgttgattattcttcacccaaattgagtagtaaattaagtgcggcggcaaagataatttattcttttgatgcgcgaagaaaaatggagtcgctactttcaaatgtggatgctgacattgcacatttccatatctttcaacatcagatttcaccttccgtatttgggccactaaaaaaacgaaatattccactggtcctaacgctacatgatttaaaaccgatttgtccaaatttccaaatgtttgttgatggccccctgtgttggcaatgtaaaagccggcaagtttaa

SEQ ID NO: 9194 - protein, 151 aa, Unknown
  Obtained from environmental sample
  misc_feature (1)..(151): Xaa is any amino acid
MKIISINKFFWKKGGSEAVFFGEKELLESHGHQVIPFSMRADENLESEYADYFVENVDYSSPKLSSKLSAAAKIIYSFDARRKMESLLSNVDADIAHFHIFQHQISPSVFGPLKKRNIPLVLTLHDLKPICPNFQMFVDGPLCWQCKSRQV

SEQ ID NO: 9195 - DNA, 834 bp, Unknown
  Obtained from environmental sample
  misc_feature (1)..(834): n is a, c, g, or t
gtggggcaatttaccccttttgatgaagaaactataagttcgttatttgtccaagatgattataaatttaatgataaattatcactcataggaaatgcaaagtttgataaatttaaaagagatggtggattagatgattttactagtgagcattatagagtaggggctatttataccccttttaaaaaatttggaataaagagtttttatacaaaaacctctttagctcctactttttataatatagattatgcagatatcactgatagtaatagctacaatatgaaaaatcaagaatacaaatactatagtgtagagggagtatatgccgatgaaaaatcacgatttagtatcctatatactaatgtaaaaatagaaaactttatatactttagtccagttggttttatcaatattgacgaccatacaattaaaacacaaaattggatttttgattatacttatgagttgtctgcaaagcataaactgcaattaaactattatagaacaagtttgagtgagacactaaataattcaagcaaaggtggatatataaaattcacaggtgagtttgataaatttgattattttacttcattaatttatagaaatggttatagttttacaacagtaaatgttccaaatagttataactttaatttaggtgccacttatcacttttcgaaagatatatctataagtttaaaaggggaaaatctccttaataaatccacaaaatccctttataaagatggactatttgatacaggtacaaacttcgctttagaggattatcaaagagaagtaactcttagtatgaagtgggtgttttaa

SEQ ID NO: 9196 - protein, 277 aa, Unknown
  Obtained from environmental sample
  misc_feature (1)..(277): Xaa is any amino acid
MGQFTPFDEETISSLFVQDDYKFNDKLSLIGNAKFDKFKRDGGLDDFTSEHYRVGAIYTPFKKFGIKSFYTKTSLAPTFYNIDYADITDSNSYNMKNQEYKYYSVEGVYADEKSRFSILYTNVKIENFIYFSPVGFINIDDHTIKTQNWIFDYTYELSAKHKLQLNYYRTSLSETLNNSSKGGYIKFTGEFDKFDYFTSLIYRNGYSFTTVNVPNSYNFNLGATYHFSKDISISLKGENLLNKSTKSLYKDGLFDTGTNFALEDYQREVTLSMKWVF

SEQ ID NO: 9197 - DNA, 366 bp, Unknown
  Obtained from environmental sample
  misc_feature (1)..(366): n is a, c, g, or t
atgaaaatcgcatttgcatcaaaagataatattcatgtaaaccaacattttggttggtgtgagatgttttatatttatgaaatttctgaagacgattatgaacttgttagtgaagttgactcttcattgaagtttgatgatgagatagataaattagagtataaaatcaattgtcttgaagatagtgatatagtttatgtatcacaaatagggcccaaagctgccaatatggtacaaaagtgtggtatctatccaatgaagtcatctcatgaggctgagagaatagaagatgtgataaaatcattacaaaagatgatgcaagatagtgctccactttggttaaaaagaatacttttaaaaaaataa

SEQ ID NO: 9198 - protein, 121 aa, Unknown; identical to SEQ ID NO: 7408
  Obtained from environmental sample
  DOMAIN (9)...(104): Dinitrogenase iron-molybdenum cofactor
  misc_feature (1)..(121): Xaa is any amino acid

SEQ ID NO: 9199 - DNA, 315 bp, Unknown
  Obtained from environmental sample
  misc_feature (1)..(315): n is a, c, g, or t
gtgtttgtcatgtatattggaaaatgtccctattgcgatgcgagcatgattatggaacagaagattgtacaaggacggaatacaaaagtttactcttgtgaaaatgcaaaatttataaccgaagatggagaagtttttgagtccggtggaagttgtaactatagaatatggggtaattcactttttaaaatatggaaaaaagagggattggaatttaaagagggtgagaaaaattactttactgatgaaaccaatttgttagtaaccactgccccaagcaaaagttggacaagaggtattaaaaaaatatcttaa

SEQ ID NO: 9200 - protein, 104 aa, Unknown
  Obtained from environmental sample
  misc_feature (1)..(104): Xaa is any amino acid
MFVMYIGKCPYCDASMIMEQKIVQGRNTKVYSCENAKFITEDGEVFESGGSCNYRIWGNSLFKIWKKEGLEFKEGEKNYFTDETNLLVTTAPSKSWTRGIKKIS

SEQ ID NO: 9201 - DNA, 708 bp, Unknown
  Obtained from environmental sample
  misc_feature (1)..(708): n is a, c, g, or t
gtgccccacgagataaattttgatttgactatccaagagttagttttaaaggaccttaaccatgacactagtaagctaaatgatttagtaaaaactacaaataaaaatcttgaaacattacaaacttctactaaaaatgctcaagaagcaattgtgagtaaagatacaaaaaaacttggaaaaataagtcaagatcttgatgaaatgaaaaaaaagatacagttcttacaacaagaattgttctcagatacattaacaaaagcatataatagaaaatggtttgatatgcaatatgttcataataacaagtttaaagaagatggttttttagcatttattgatttaaataaatttaaacaaattaatgattcatatggtcacttggtaggagatatggttttaaaatatttaagcaattttttaaaaaaagaggttacttttaaacatagacatgtaataagatatgcaggagatgagtttttactgttaatagatgataaaacatcatacaaaaaagtaagtgaagagttaaatcatatacaagaaaaactaacaaaacaaaaattaaaaataaaaagttctgataatattacatttacttttggtttttcttatggtttagtagagtttaaaaataatgatttagtagataaaattattgaagatgctgatggaaaaatgtatgaggacaaacaaaagtccaaatag

SEQ ID NO: 9202 - protein, 235 aa, Unknown
  Obtained from environmental sample
  DOMAIN (76)...(235): GGDEF domain
  misc_feature (1)..(235): Xaa is any amino acid
MPHEINFDLTIQELVLKDLNHDTSKLNDLVKTTNKNLETLQTSTKNAQEAIVSKDTKKLGKISQDLDEMKKKIQFLQQELFSDTLTKAYNRKWFDMQYVHNNKFKEDGFLAFIDLNKFKQINDSYGHLVGDMVLKYLSNFLKKEVTFKHRHVIRYAGDEFLLLIDDKTSYKKVSEELNHIQEKLTKQKLKIKSSDNITFTFGFSYGLVEFKNNDLVDKIIEDADGKMYEDKQKSK

SEQ ID NO: 9203 - DNA, 360 bp, Unknown
  Obtained from environmental sample
  misc_feature (1)..(360): n is a, c, g, or t
gtggtaattgattctcaaaaaaaattaccatcagaaaacaatttttcatttgaaaaaattagagatcaatattctaatataagtgagatgtcaagatttatagtaaataaaaaagaaaaagggctaggattagaatttaagtatttatttagaggagtttatcacctatttataaataatcaaatagatattatcctttctggattaaaaagggaacactataaattatattcaaaatttggaggagtacatattgaagaagaattgaagtcttatggaagcttttctaccccttgtttaatactttcttgggacccatcaaaagtatctccattttttaagaaagcttttttaaaataa

SEQ ID NO: 9204 - protein, 119 aa, Unknown
  Obtained from environmental sample
  misc_feature (1)..(119): Xaa is any amino acid
MVIDSQKKLPSENNFSFEKIRDQYSNISEMSRFIVNKKEKGLGLEFKYLFRGVYHLFINNQIDIILSGLKREHYKLYSKFGGVHIEEELKSYGSFSTPCLILSWDPSKVSPFFKKAFLK

SEQ ID NO: 9205 - DNA, 339 bp, Unknown
  Obtained from environmental sample
  misc_feature (1)..(339): n is a, c, g, or t
ttgtcatattcatgtcaaaaaagagatttaatagggggtagcaaaatgaaggaattagatcatcaagaaaagaagatattattggaattagtaagaaatcccagaatttcagataatcaaataggaaagaacacaggtatccctgtaaaaacagtaaataggaaaagaaagattcttgaacaaaaaaatattttaagttatttttcattcattaattatggagaaaagggtactggtttatttgattcacaatatctttatttaattaaattaaaatttggtattacaactaaacaagttacagaaaaatttccttatttaatgacaaatccagtttaa

SEQ ID NO: 9206 - protein, 112 aa, Unknown
  Obtained from environmental sample
  misc_feature (1)..(112): Xaa is any amino acid
MSYSCQKRDLIGGSKMKELDHQEKKILLELVRNPRISDNQIGKNTGIPVKTVNRKRKILEQKNILSYFSFINYGEKGTGLFDSQYLYLIKLKFGITTKQVTEKFPYLMTNPV

SEQ ID NO: 9207 - DNA, 444 bp, Unknown
  Obtained from environmental sample
  misc_feature (1)..(444): n is a, c, g, or t
ttgaacatattcatagaaatacctacttggttaggtgatgctgttatggcgacacctgctattgagaatattatcgaaaagtatccaaatgcaaagctaataatttttggttcttttgtatcaacatcactttttaaataccatccaaatgttaaaaaaatcattattgatgaaacaagaaaagagggattccgatatttaaatttatataaagtttccaaagatattgatgtagatttggcatttagttttcgaaaaaacttcactactaaatttctattttattttttaactgctaaagaaaaatttatctatacaagattagataaaaagttagatatacatcaagtgataaggtataatgatttcataaatagaagtttagagttatcaactgatccaaagaatttgaaaatatatacaaagccatcttcagatttctag

SEQ ID NO: 9208 - protein, 147 aa, Unknown
  Obtained from environmental sample
  misc_feature (1)..(147): Xaa is any amino acid
MNIFIEIPTWLGDAVMATPAIENIIEKYPNAKLIIFGSFVSTSLFKYHPNVKKIIIDETRKEGFRYLNLYKVSKDIDVDLAFSFRKNFTTKFLFYFLTAKEKFIYTRLDKKLDIHQVIRYNDFINRSLELSTDPKNLKIYTKPSSDF

SEQ ID NO: 9209 - DNA, 507 bp, Unknown
  Obtained from environmental sample
  misc_feature (1)..(507): n is a, c, g, or t
ttgtataatagtattgtaaattatgagaaaagagtacttatgaacaatctatcaatcaaatggaaactaacacttgctattgcaattatagttttagtaatgtcggctattttagttagtcttagtatatatgatataaaaaaaacctctagtgatgacacaaaactttttaaagaaaaagcttttagtgcaaaacaagatgaattaaaatcaaatatagacatagttttaaaaactatcgattctttttatgagagaacatcaaaagaaaaagtcaaactagaagttcaagagaaacttgtaactcaagcacaaatgttagaaaatatcttaaaccaatattatctaaaacatcaaaatagtaaaacagtacaatcagaacttatcgatatcgttaaaaatagtaaatatggtaaaagtggttatttttggataaataacactgatgcaaaaatggttatgcatccaattaaaccaagtcttgatggaaaagattatctaatttaa

SEQ ID NO: 9210 - protein, 168 aa, Unknown
  Obtained from environmental sample
  misc_feature (1)..(168): Xaa is any amino acid
MYNSIVNYEKRVLMNNLSIKWKLTLAIAIIVLVMSAILVSLSIYDIKKTSSDDTKLFKEKAFSAKQDELKSNIDIVLKTIDSFYERTSKEKVKLEVQEKLVTQAQMLENILNQYYLKHQNSKTVQSELIDIVKNSKYGKSGYFWINNTDAKMVMHPIKPSLDGKDYLI

SEQ ID NO: 9211 - DNA, 744 bp, Unknown
  Obtained from environmental sample
  misc_feature (1)..(744): n is a, c, g, or t
gtggtttggaagtgtttcgtcgggaattcaaaaaagtggaaagaagatattcttgaaaagctaatcaccattgatcatcaacagatcaaattttttgctaaaagggtaggtcgggaaggtgatgctcatttggttgagtttagctgggaccctttcagcctaacgttttctcaacttcttgaatcggctggattggtgccattaccaccctatttaaatcgtgaagccgagaaagaagataaagatcgatatcagactatttatgcccagtatgatggttcggttgcggctcctacagccggattacattttactgatgaggtattcaagagattatctaataaaaaaatatcaaccgatgaagtgactttgcatgtaggtgcaggaacttttaagcctgtttcttcaaccagtatcggtgaacatgaaatgcataccgagaaaatcattattcgtaaatcaaccattgaaaatcttatacaaaataaaaatcaaaaaataatactagttggaactacaaccacccgatctatcgagagtttgtactggtttggagtgaaagttttggtggatcaatcaacggaatttattattaagcaatgggatccgtatcaggaaaaatatcagataaataanaacccaacgcaggttttagaagcagttttagattttatgaatcaggaaagaattggaagaattgcatggcngaacccagttgatgattgcgccggcttatcaatttaa

SEQ ID NO: 9212 - protein, 247 aa, Unknown
  Obtained from environmental sample
  DOMAIN (1)...(136): Queuosine biosynthesis protein
  misc_feature (1)..(247): Xaa is any amino acid
MVWKCFVGNSKKWKEDILEKLITIDHQQIKFFAKRVGREGDAHLVEFSWDPFSLTFSQLLESAGLVPLPPYLNREAEKEDKDRYQTIYAQYDGSVAAPTAGLHFTDEVFKRLSNKKISTDEVTLHVGAGTFKPVSSTSIGEHEMHTEKIIIRKSTIENLIQNKNQKIILVGTTTTRSIESLYWFGVKVLVDQSTEFIIKQWDPYQEKYQINXNPTQVLEAVLDFMNQERIGRIAWXNPVDDCAGLSI

SEQ ID NO: 9213 - DNA, 783 bp, Unknown
  Obtained from environmental sample
  misc_feature (1)..(783): n is a, c, g, or t
atgaagaaaaaaattcttatcgttggtggtggtactgctggtactatgaccgcaaataatcttgcaaaaaaactgatgcctgagattgatagagatgaagttgagataacaatgatctctaactcaaaatatcactattatagaccaggtgcaatgtatgttgcttttcacaaatcagaagggcatgaatttgttagagaacaaagatctcttttaatgcctgaaattaatttcattattgatgaagcagttgaaatcaataaagataataactatattaaaacaaaaagtggtacgaagtattcttatgattttatagtattagctacaggttgtgaagcagcaccccaaagaatccctggactcaaagagggtggagattggttttatacttatgaaggtgcaaaacaacttgctaagaagtttcaaaatattaaaaaagggaaagtactagttacagtaaattttccaaaaactcctgatattccacatcaatgtggtattgcgccagttgagacgacaattatgcttcatgattacttgacagaaaaaggtgtaagggatgatgttgaaatcacatatacatatccgacagaagcacaaagtgtaaaaaatggactatttttacaggagcctacttcaaaagttttacctgctatttttgatggtattggggtaaaacataaaacaggctttacattaaataaagtcgatgctgcaaataaaatagcttattcagaagaggggaagagtagagttgattttaattcacacccggcataa

SEQ ID NO: 9214 - protein, 260 aa, Unknown
  Obtained from environmental sample
  SIGNAL (1)...(17)
  DOMAIN (4)...(260): Pyridine nucleotide-disulphide oxidoreductase
  misc_feature (1)..(260): Xaa is any amino acid
MKKKILIVGGGTAGTMTANNLAKKLMPEIDRDEVEITMISNSKYHYYRPGAMYVAFHKSEGHEFVREQRSLLMPEINFIIDEAVEINKDNNYIKTKSGTKYSYDFIVLATGCEAAPQRIPGLKEGGDWFYTYEGAKQLAKKFQNIKKGKVLVTVNFPKTPDIPHQCGIAPVETTIMLHDYLTEKGVRDDVEITYTYPTEAQSVKNGLFLQEPTSKVLPAIFDGIGVKHKTGFTLNKVDAANKIAYSEEGKSRVDFNSHPA

SEQ ID NO: 9215 - DNA, 876 bp, Unknown
  Obtained from environmental sample
  misc_feature (1)..(876): n is a, c, g, or t
atgaattcttatgattcatcggatataacagaagatattcaatatcaagataaattaaaaaaacaagtagagattgaagtagctaaaagaagtgaacaacatgaagttatgtgtcatcaatcaagatttgcagcaatgggagagatgatagactctattgctcatcagtggagacaacctcttaatagtttggggattattattcaaggattaagacatatctctactcaaaaaaatattgatgtaaagtttttaaaagagatagaagttgagattatggagaaagtaaactatatgtctcaaacaattgatgattttagtatgttctttagaatatccaaacaaaaagagaagtttgatattttgcaaagtattcaagatgcaataagacttatagatattcaattgaaaaataatcatatagtttttgatataaatgtagatgataatcttgatttaaatgtactaggttttgtaaatgagtttcgccaagtagtattaaatatgattcataatgcaatgatggcaatagtaacaagtaaccaaaaaagtggaaagatagagatacttattaaaagtaatagaaaaaacttacatatagagattagtgataatggtggaggaatttcaaaagaaaatatgccaaaaatattcaatccatactttacaacaaaagataaagggagtggtataggactttatatgtcaaaagttattattgaaaatcatatggatggattattagcagtaaaaaataaaaaagatggtgcgcagtttaccattatgttaccacaaggaaaaatagatggaagcgatacacaaaagattacaatccttaactttaccaatagcctgaaaaagatgagactactttaa

SEQ ID NO: 9216 - protein, 291 aa, Unknown
  Obtained from environmental sample
  DOMAIN (157)...(266): Histidine kinase-, DNA gyrase B-, and HSP90-like ATPase
  misc_feature (1)..(291): Xaa is any amino acid
MNSYDSSDITEDIQYQDKLKKQVEIEVAKRSEQHEVMCHQSRFAAMGEMIDSIAHQWRQPLNSLGIIIQGLRHISTQKNIDVKFLKEIEVEIMEKVNYMSQTIDDFSMFFRISKQKEKFDILQSIQDAIRLIDIQLKNNHIVFDINVDDNLDLNVLGFVNEFRQVVLNMIHNAMMAIVTSNQKSGKIEILIKSNRKNLHIEISDNGGGISKENMPKIFNPYFTTKDKGSGIGLYMSKVIIENHMDGLLAVKNKKDGAQFTIMLPQGKIDGSDTQKITILNFTNSLKKMRLL

SEQ ID NO: 9217 - DNA, 957 bp, Unknown
  Obtained from environmental sample
  misc_feature (1)..(957): n is a, c, g, or t
ttgataatcccacccttaaaatttagaacaattcgtgagaagattttcaaagaaaaattagatgaaaagggtttttcaaatttcaaatggaaattttcaaaattcgtgaatgctcctacaggcttgattgcaaagttatcatcaacggtaagtgagtccggtggacgaagtagtaaagataaaacatatatcaaaattgatccatttcctgcttatgtcggaatgaaaagcttatctcgaagctggaaaaaagttggtacaaaaaatcaatttgaatttattttattagatcctgaaggtaatgaagttgttggggaaaatattactgttcgaatttacagaaatcgctatcgttggtggtgggattatgataatgacaagaaacattttaaagacaatatcgatacagaacttttgcaagagatgaaatttgttagcaaatctgagccaacaacctttgaatttactcctctcgaatacggtaaatattttgtggaagtaacacataatacatcaaaagatgaaggtcattctacaggggaatttttctggggaagctattggggtaatccttctatcaagatgcaggatgcaggaataattagcttggattctgataagcaaaagtataatctcggagatattgcaaatattcgttttgatgcacccgaaaatagttcaatattggtttcattggaaaaaggtgataatattattgatgaatattgggtaaaagggaagggtggaaaacaagaaattcaagtgccaataaccaaagaaatggtaccaaatatttattgctcgatttcaataattcaacctcacagccaagctgaaaatgatagaccaattcgttcttacggaatcattcctatcaatgtatttgatgaaaattcttttcagaaaattaccctaaatactccaaaagtgcacagccaaagaaaatctcggctataa

SEQ ID NO: 9218 - protein, 318 aa, Unknown
  Obtained from environmental sample
  misc_feature (1)..(318): Xaa is any amino acid
MIIPPLKFRTIREKIFKEKLDEKGFSNFKWKFSKFVNAPTGLIAKLSSTVSESGGRSSKDKTYIKIDPFPAYVGMKSLSRSWKKVGTKNQFEFILLDPEGNEVVGENITVRIYRNRYRWWWDYDNDKKHFKDNIDTELLQEMKFVSKSEPTTFEFTPLEYGKYFVEVTHNTSKDEGHSTGEFFWGSYWGNPSIKMQDAGIISLDSDKQKYNLGDIANIRFDAPENSSILVSLEKGDNIIDEYWVKGKGGKQEIQVPITKEMVPNIYCSISIIQPHSQAENDRPIRSYGIIPINVFDENSFQKITLNTPKVHSQRKSRL

SEQ ID NO: 9219 - DNA, 828 bp, Unknown
  Obtained from environmental sample
  misc_feature (1)..(828): n is a, c, g, or t
atgatctggaatacttctaattttgatgttggaggagtgcaatattcatcaaaaggcattcgtgcatacagctataccgaaagaggagtttatcgtccgggtgatcacatcaatctttctatgatttttcgtacaaaaactgcatctttgaaagataatcatccagttaaaatagaattgaaaaatccccgtaatcaagtaattcaaaccaaaattcttaaagatggaaaagatggtttttataattatagttttgaaactgacgcaagtgaccccaccggagattggagtgtaaaaatagtagttggtggaagcgtattctatcacaagataaaaattgagacagtcgttgctgagcgattaaagctagaaatgattcccaaagctgaaaagatttcttatgatatgaaagaattagaactcgattttcaagcaaattatttgtttggagctccagcttcaaaactcaattgtgaagtagatgtagaagtcttcaaaaatccatctctcttcaaaatccctatatataaatcatttatttttgataatccaaccataaaatttagaacaattcgtgagaagattctcaaagaaaaattagatgaaaaagggtttatcaatttcaaatggaaattttcaaaattcgtgaatgctcctacaggcttgattgcaaagttatcatcaacggtaagtgagtccggtggacgaagtagtaaagataaaacatatatcanaattgatccatttcctgcttatgtcggaatgaaaagcttatctcgaagctggaaaaaagttggtccaaaaatcaatttgaatttattttattag

SEQ ID NO: 9220 - protein, 275 aa, Unknown
  Obtained from environmental sample
  DOMAIN (3)...(186): Alpha-2-macroglobulin family N-terminal region
  misc_feature (1)..(275): Xaa is any amino acid
MIWNTSNFDVGGVQYSSKGIRAYSYTERGVYRPGDHINLSMIFRTKTASLKDNHPVKIELKNPRNQVIQTKILKDGKDGFYNYSFETDASDPTGDWSVKIVVGGSVFYHKIKIETVVAERLKLEMIPKAEKISYDMKELELDFQANYLFGAPASKLNCEVDVEVFKNPSLFKIPIYKSFIFDNPTIKFRTIREKILKEKLDEKGFINFKWKFSKFVNAPTGLIAKLSSTVSESGGRSSKDKTYIXIDPFPAYVGMKSLSRSWKKVGPKINLNLFY

SEQ ID NO: 9221 - DNA, 762 bp, Unknown
  Obtained from environmental sample
  misc_feature (1)..(762): n is a, c, g, or t
atgaaccttgcagcaaatgcaacacatgcaatgaaagcgcatggggggactctttcgttgtcacttgcaaacagccctgcgacagaaaaattcgatgtaccgcatattatattcacaatcagtgatagcggcaccggaattaacagaaagaacaaagagaaaatatttgatccattctttactactaaagcaattggtgaaggtacaggcttaggtcttgccgtagtccatggtattgtcaaaagccacaatggccaaattgattttgagagccagctgtctcgtggaagtactttttccattcgaatccctacaattccggatacatttgtctcccaaccctcaattgagccatccagccagaaaagtaatggcgaaaaaatattaatagttgatgatgagcccgcagttggacagatcttacaaagaattttgaacaaagctggttacagtacaacatgctttaccagcagccgaaaagcattgctccattttagcaaggatccaactgcgtatgatcttcttcttacagattacattatgcctgacatagatggttctgaattggcgatgttaatggtgcagaaaaataaaaaccttgaggtaataatctgcacaggtcacattggatctctagggaaagttggtgatacaaaaagatacccgactaatttcctttacaagcctataaaacagggagaattactcangtcagtacgagaagtgtttaacagccataaatggaagagaagagaccagtaa

SEQ ID NO: 9222 - protein, 253 aa, Unknown
  Obtained from environmental sample
  DOMAIN (126)...(247): Response regulator receiver domain
  misc_feature (1)..(253): Xaa is any amino acid
MNLAANATHAMKAHGGTLSLSLANSPATEKFDVPHIIFTISDSGTGINRKNKEKIFDPFFTTKAIGEGTGLGLAVVHGIVKSHNGQIDFESQLSRGSTFSIRIPTIPDTFVSQPSIEPSSQKSNGEKILIVDDEPAVGQILQRILNKAGYSTTCFTSSRKALLHFSKDPTAYDLLLTDYIMPDIDGSELAMLMVQKNKNLEVIICTGHIGSLGKVGDTKRYPTNFLYKPIKQGELLXSVREVFNSHKWKRRDQ

SEQ ID NO: 9223 - DNA, 504 bp, Unknown
  Obtained from environmental sample
  misc_feature (1)..(504): n is a, c, g, or t
gtgaaacctatgtatagagaatccttaaaaggaaaatggaaacatgaaatggaaaagatgtcaccatttctcaatttattcattatgatcgggatgttgggttcaagtctttttggattatatgcatattgcgatctttcaaaaagcgcaggtttgtctttaaatgaatttattaaaattgttccagaacaaattatcgatcaaggcgtcaaaaattcaactatagttttaataactgagagtggcattgagattgaaaggggtatgcatactccaaacttccaaaaattaagacaagctgtagcagcaaaaaaagtcactaacatttggcttggtgaaaatttgaagattcctaaaatattcaactggcttttgccagatgaagtgcctccattttatcaagtagctactgataatgagattataatttcatataatgatatgattaaagaccataaagctaaaatcataaccggatattatttcggccataaaccnnnataa

SEQ ID NO: 9224 - protein, 167 aa, Unknown
  Obtained from environmental sample
  misc_feature (1)..(167): Xaa is any amino acid
MKPMYRESLKGKWKHEMEKMSPFLNLFIMIGMLGSSLFGLYAYCDLSKSAGLSLNEFIKIVPEQIIDQGVKNSTIVLITESGIEIERGMHTPNFQKLRQAVAAKKVTNIWLGENLKIPKIFNWLLPDEVPPFYQVATDNEIIISYNDMIKDHKAKIITGYYFGHKPX

SEQ ID NO: 9225 - DNA, 468 bp, Unknown
  Obtained from environmental sample
  misc_feature (1)..(468): n is a, c, g, or t
atgtcattgaatacagaacactatctgtccattgccaggggaatcattaccgattccccgccggatttaaaaaccttgcaggatatttgcgaaataccggatgaagccgtcttcaaccttttgccgggggcggatctgattcgcaatttccataaagggaaaaaaattcatctgtgcaccatctgcaatgcaaagtccggtaaatgcccggaagactgtgggttttgtccccagtctgtattccatcagactcaaattgaaaattatgggctacttggggaaaaaaaactcacccagatccccaaaagccttactgataaaccggtgaaccggtattcggttgttaccagcggacggggattgagttcccatgaagtggatctggtggcccaggcatttttaagccttgaaaaaaaaaaggctatcctattgtgcttccttagggatcatccaggatcgagattttga

SEQ ID NO: 9226 - protein, 155 aa, Unknown
  Obtained from environmental sample
  misc_feature (1)..(155): Xaa is any amino acid
MSLNTEHYLSIARGIITDSPPDLKTLQDICEIPDEAVFNLLPGADLIRNFHKGKKIHLCTICNAKSGKCPEDCGFCPQSVFHQTQIENYGLLGEKKLTQIPKSLTDKPVNRYSVVTSGRGLSSHEVDLVAQAFLSLEKKKAILLCFLRDHPGSRF

SEQ ID NO: 9227 - DNA, 786 bp, Unknown
  Obtained from environmental sample
  misc_feature (1)..(786): n is a, c, g, or t
atggcgaagatggaagtagctctagaagtacaggtgctgaaggggaaagatgtttatgtagaagtgcctttgggaacaattgctaaagatggtgaaacaggtgaggttttatttgaaataactgaagatggtgaagagcaaatcttacttaaaggaggtagaggcggattaggaaattctcattttaaatcatcaaccaaccaagctccaagatatgcacaacccggtgaagatggtcaggaagcatggaaaatattagaattaaaagtattggcagatgttggtttggtgggctttcctaatgctggaaaatcgacattattgtcggtattgagtgctgcaaaaccagaaattgctaattatccatttactactttagtgcctaatttaggaattgtttcttacagagactatcgttcttttgtgatggcagacattcctggaattattgaaggagctcacgaaggcaaaggtttaggaattagatttttaagacatatagaaagaaatgcggtattgttgtttttaattcctgccgatagcaaaaacattaatgaggaatacgaaattctattaaacgaattgaaagcgtataatccggaattattagataaagacagaatattagctgtttctaaatccgatatgttggatgatgaactaaaagaagaaattgaaaaagacctaccggaagttcctcatttatttatttcttctgttgcccaacaaggcttactagaacttaaagatttactttggaaatacattaacaaaggagaagagtaa

SEQ ID NO: 9228 - protein, 261 aa, Unknown
  Obtained from environmental sample
  DOMAIN (1)...(217): GTP1/OBG family
  misc_feature (1)..(261): Xaa is any amino acid
MAKMEVALEVQVLKGKDVYVEVPLGTIAKDGETGEVLFEITEDGEEQILLKGGRGGLGNSHFKSSTNQAPRYAQPGEDGQEAWKILELKVLADVGLVGFPNAGKSTLLSVLSAAKPEIANYPFTTLVPNLGIVSYRDYRSFVMADIPGIIEGAHEGKGLGIRFLRHIERNAVLLFLIPADSKNINEEYEILLNELKAYNPELLDKDRILAVSKSDMLDDELKEEIEKDLPEVPHLFISSVAQQGLLELKDLLWKYINKGEE

SEQ ID NO: 9229 - DNA, 540 bp, Unknown
  Obtained from environmental sample
  misc_feature (1)..(540): n is a, c, g, or t
atgggtaagataacaattaaggataaaacctttaaaccatacatttctgctgaagagctgcaaacttctataagtaaagttgctaatgaaattaatacgcactacagtggtaaatcgcctatttttattggggtattaaatggttcgtttatgtttatgagcgatttgctgaaagaaataaacctgcaatgtacagtttcttttgtaaagttagcttcttatgaaggaactaccaccacaggaaaagtaaacgagttaattgggttaaatgaagacttagctgggcaagatattattttggtggaagacattgtagatactggaaatactttggttaagttgtatgatattttacaaaataaaaaagtaaattctataaaaattgcttcattgctttttaaacctgaggcttaccacaaaccttatccgattgattatattggaaaagaaattccaaatgcttttgtattgggctacggattagattatgatggctatggtagaaaccttagctccatttatgtgttggatgaagaatag

SEQ ID NO: 9230 - protein, 179 aa, Unknown
  Obtained from environmental sample
  DOMAIN (9)...(152): Phosphoribosyl transferase domain
  misc_feature (1)..(179): Xaa is any amino acid
MGKITIKDKTFKPYISAEELQTSISKVANEINTHYSGKSPIFIGVLNGSFMFMSDLLKEINLQCTVSFVKLASYEGTTTTGKVNELIGLNEDLAGQDIILVEDIVDTGNTLVKLYDILQNKKVNSIKIASLLFKPEAYHKPYPIDYIGKEIPNAFVLGYGLDYDGYGRNLSSIYVLDEE

SEQ ID NO: 9231 - DNA, 675 bp, Unknown
  Obtained from environmental sample
  misc_feature (1)..(675): n is a, c, g, or t
gtggggctcggaagctatggtgaaacggcttggttttattctaggggacgatgttttgaaaaaaacggtaaattacatgttttcggttcaacggaagatatcacagagaggaaacagtctgaacaggaattaaaagaaagtgaagaaaaattaaatcaaattattgatacctctcctattggaatatgtacggttgacgagcttgggaaatttacaacaacaaacatggcctatgaacagatgttggggtattccaaagaagaatgcaaagagctttccattttcgatgtgacgcatccaagtgatcgtcccaagaataaaaaattgttccagtcaatgatctctcaaaaagttaatggattttcaatggagaaaagatatattcgcaaggatggtgtgatcattaacgtggctgtccacgcaaccggtattgcaaatgctgatgaaaacataaaattcggaaccgcatttatagttgacataacagaacgaaaattggcagaagaagaacttaaaaaacaccgcgaacatctggaagaaatggtgcaaacaagaaccaatgaactggaagaaaaaaataagaaactggatgatgctatgaaagtatttgtaggtagagagctcatgataagagaccttcaaaaaaggttaaaagctttgggtggaaaattatga

SEQ ID NO: 9232 - protein, 224 aa, Unknown
  Obtained from environmental sample
  DOMAIN (122)...(164): PAC motif
  misc_feature (1)..(224): Xaa is any amino acid
MGLGSYGETAWFYSRGRCFEKNGKLHVFGSTEDITERKQSEQELKESEEKLNQIIDTSPIGICTVDELGKFTTTNMAYEQMLGYSKEECKELSIFDVTHPSDRPKNKKLFQSMISQKVNGFSMEKRYIRKDGVIINVAVHATGIANADENIKFGTAFIVDITERKLAEEELKKHREHLEEMVQTRTNELEEKNKKLDDAMKVFVGRELMIRDLQKRLKALGGKL

SEQ ID NO: 9233 - DNA, 420 bp, Unknown
  Obtained from environmental sample
  misc_feature (1)..(420): n is a, c, g, or t
atgtcaaaattatattttaatacaaagcttcttggtttatttacaatacttggggttataacctcaagttttacattttatctattttctaattttaacaaagataattatattgagttgattgtaattgtttttataggttcaactttagtatctctttttcttagttatatattctcaaattataataaaaaatcacaagaaagtcttaataataaattggcattaaaaacaaaagaacttgaaaaatcattgtttttagttgataagtatattattagaactactactgatacacgaggtgttataacaagtgcaaatgaagctttttgcgatatttcaggctacacagaagaagaactaattggaaaaccacattcgattatacgagatccagatatgcncaaaggaagcatttaa

SEQ ID NO: 9234 - protein, 139 aa, Unknown
  Obtained from environmental sample
  misc_feature (1)..(139): Xaa is any amino acid
MSKLYFNTKLLGLFTILGVITSSFTFYLFSNFNKDNYIELIVIVFIGSTLVSLFLSYIFSNYNKKSQESLNNKLALKTKELEKSLFLVDKYIIRTTTDTRGVITSANEAFCDISGYTEEELIGKPHSIIRDPDMXKGSI

SEQ ID NO: 9235 - DNA, 576 bp, Unknown
  Obtained from environmental sample
  misc_feature (1)..(576): n is a, c, g, or t
atgaaaaatgattcgtttaaaatattgaggggtatagatagaattgctaatatcattgaatctatgaaagaggtatcacaagttgcaagtgagaaaaaagacttagttaatatatacagcacacttgtgactgctttaattgtgagtcataattctattaatcaaattacaaatgtttatttaaatggtgagaaatttgatattaatacagataaaaataaatttatttttaattcaaaagtacaaaaacaaagaattgaacaagtttggatagtgataattaaaaatgccttagatcaactcatctatattgatgattttgataatagaaaattatcaattgatattaacaatatagagaaccatgtagttgtacagtttaaagataatggtggtggaattaagaaagatattttagaaaatatattcgaaccttttgtaagttttaaagaacatggtggaattggggttggtttaaacattgcaaaaaaaattatagaagatcaagatggagagatttcagcatacaatgaagataatggtgctgtttttgaggtaaaattaaaactatattaa

SEQ ID NO: 9236 - protein, 191 aa, Unknown
  Obtained from environmental sample
  DOMAIN (81)...(191): Histidine kinase-, DNA gyrase B-, and HSP90-like ATPase
  misc_feature (1)..(191): Xaa is any amino acid
MKNDSFKILRGIDRIANIIESMKEVSQVASEKKDLVNIYSTLVTALIVSHNSINQITNVYLNGEKFDINTDKNKFIFNSKVQKQRIEQVWIVIIKNALDQLIYIDDFDNRKLSIDINNIENHVVVQFKDNGGGIKKDILENIFEPFVSFKEHGGIGVGLNIAKKIIEDQDGEISAYNEDNGAVFEVKLKLY

SEQ ID NO: 9237 - DNA, 315 bp, Unknown
  Obtained from environmental sample
  misc_feature (1)..(315): n is a, c, g, or t
atgttgttaagcgaatttgaaaaactaatacacttacatgagcttatactaaagcagagaacaggcacacctgaagaacttgctatgcgtatgggtatatctagagcatgtttatttagatatatagaaaaattaaaaggttttggagcagaaataaaatacaacagaacacgtaatggttataaatataaaaatgattttaaattaaaaattaccttagaaaccaacgaaatgaagaaagttttaggcggaaaaaataatttaaacttttttccttccgtctcatttaatgagacggaagaggtgttaatttga

SEQ ID NO: 9238 - protein, 104 aa, Unknown
  Obtained from environmental sample
  misc_feature (1)..(104): Xaa is any amino acid
MLLSEFEKLIHLHELILKQRTGTPEELAMRMGISRACLFRYIEKLKGFGAEIKYNRTRNGYKYKNDFKLKITLETNEMKKVLGGKNNLNFFPSVSFNETEEVLI

SEQ ID NO: 9239 - DNA, 639 bp, Unknown
  Obtained from environmental sample
  misc_feature (1)..(639): n is a, c, g, or t
atggcaagaaaagaacgattaacagaatctggatattatcatgtcatcaatcgtggggtagagagaagatctgtatttttagatgaagaagattatcatcaatttttagacttaatgttagtaattgctaaagagtataatttgattatacattcttactgtctcatgagtaaccattaccatatattattagaaactaaagacaacaatatatcaaaagcaatccaatttttaaatgataaatacgctaaatattttaataaaaaatatgaaagagtaggtcatttgtggcaaggaagatttaaatcgtactatctatttgatgatatacatttttggtatgtgagtaaatatatagaacgaaatccattaaaagcaaatatagtaaataaaatagaaaactatgtgtatcaatcatacttccagtggaaaaacaactcaaaatattacttacttttaaaaaactctaagatactagaaatgaatctagaagattatgaagtttttataagttctgacattgaaagcgaaatattagaaaaaatttatgatatacaaaagtctgttaaaatagatggaaaaacaaagattttaaacaagagaatagaaacttttttttatatagatccaggaatttga

SEQ ID NO: 9240 - protein, 212 aa, Unknown
  Obtained from environmental sample
  DOMAIN (52)...(101): Protein of unknown function (DUF1568)
  misc_feature (1)..(212): Xaa is any amino acid
MARKERLTESGYYHVINRGVERRSVFLDEEDYHQFLDLMLVIAKEYNLIIHSYCLMSNHYHILLETKDNNISKAIQFLNDKYAKYFNKKYERVGHLWQGRFKSYYLFDDIHFWYVSKYIERNPLKANIVNKIENYVYQSYFQWKNNSKYYLLLKNSKILEMNLEDYEVFISSDIESEILEKIYDIQKSVKIDGKTKILNKRIETFFYIDPGI

SEQ ID NO: 9241 - DNA, 372 bp, Unknown
  Obtained from environmental sample
  misc_feature (1)..(372): n is a, c, g, or t
atgactttaaaagaagcaaaactactttttatatatgatggatcaaccactcagacaaataccgaaaactttttaaaacagagggtcttatcacttgtttgtgatacatcattcaatatagacgaaactgtattatctcanataaatatcatattaataaaacagctaggttcaagcaaagagatagaacaactcataaaaacattaagtaaaattaatgaatctatacaaatcattattatagattctgagaaaaaaatcgaatcttacaaaaaaagcgttggagataaagtgtatgcctatctgccactgcctttagataaaacactttttcccagttcattaaaaactgcagctcaaacttataaagag

SEQ ID NO: 9242 - protein, 124 aa, Unknown
  Obtained from environmental sample
  misc_feature (1)..(124): Xaa is any amino acid
MTLKEAKLLFIYDGSTTQTNTENFLKQRVLSLVCDTSFNIDETVLSXINIILIKQLGSSKEIEQLIKTLSKINESIQIIIIDSEKKIESYKKSVGDKVYAYLPLPLDKTLFPSSLKTAAQTYKE

SEQ ID NO: 9243 - DNA, 300 bp, Unknown
  Obtained from environmental sample
  misc_feature (1)..(300): n is a, c, g, or t
atggctagtgcttttatagcagaaaatggaaactcttcaattaaaggcttgatactagcaggttgtagaaataatggcggtggattactgtcttgttcaaataatattgagatgatagatttacccatattagatgtttggggtgcaaaaaataaaaaagatagaaaagcagcatctcaaagagaaaatttcatatctgatacttatactcaagtgaaagtaaatggatcaaatcatgtatttaaaggctatgattcagagttaagtgatattgttatgaaatggatagaaaaaaactaa

SEQ ID NO: 9244 - protein, 99 aa, Unknown
  Obtained from environmental sample
  misc_feature (1)..(99): Xaa is any amino acid
MASAFIAENGNSSIKGLILAGCRNNGGGLLSCSNNIEMIDLPILDVWGAKNKKDRKAASQRENFISDTYTQVKVNGSNHVFKGYDSELSDIVMKWIEKN

SEQ ID NO: 9245 - DNA, 543 bp, Unknown
  Obtained from environmental sample
  misc_feature (1)..(543): n is a, c, g, or t
atgaaaaaaaaagttttaatattacatggttggggtggaagccatgagccccattggcaatggtggttaagtaatgaactactaaaagatgaatatgagatttcatttccatcttttccaaatgaagagttaccaaactttaacgagtggttaaattttttgaaaaatgaatttgataaatttcaacctgatattgtagtgtgtcattcactagctaatattctatggtttcattttgttgaaaaatttcctataaaagagctagaaaaattgatgcttgtagcacccgtaagaaaagattgtaaaataaaagagctacaaacatttttcccttatcctattccaaaagatttaaaagctaaagagataataatggttgcaagtgataacgatatttatttaaatgtccaagaggcaatagagttacaaagtcaactcaatgtggggctaaaaatacttgaaaatgctggtcatataaatgctgatagtggctttggagaacttccttgtgcagtagattggataaaaagagaaattgaatag

SEQ ID NO: 9246 - protein, 180 aa, Unknown
  Obtained from environmental sample
  DOMAIN (5)...(178): Protein of unknown function (DUF1234)
  misc_feature (1)..(180): Xaa is any amino acid
MKKKVLILHGWGGSHEPHWQWWLSNELLKDEYEISFPSFPNEELPNFNEWLNFLKNEFDKFQPDIVVCHSLANILWFHFVEKFPIKELEKLMLVAPVRKDCKIKELQTFFPYPIPKDLKAKEIIMVASDNDIYLNVQEAIELQSQLNVGLKILENAGHINADSGFGELPCAVDWIKREIE

SEQ ID NO: 9247 - DNA, 627 bp, Unknown
  Obtained from environmental sample
  misc_feature (1)..(627): n is a, c, g, or t
atggaatttataacaaaagccatcacaaaaaataaaggtaaaacctttataacaaaagatgagcttgaagcaactgtagctatgggagaggaagctggaatacttaaagaaaaagagttacatattatagaaaatatttttgaacttcgagatataaaagtaaaagatatctacacacctagaaatgttatgttcactatctctgaagatattttgttagagagtttaactaaaagtgataaaacagttatagaacttgaaaagatgaaagaatactcaagaatacccatatttaaaaaagatattgatgagattgttgggattgttttttcaaaagagtatttttatgaatttatagaaaatagattagaaaacaaacaagatattataaaatcagtatttaaagtacataagaatatccctatttctaaacttctagatctttttatctcaagaaaagagcatctatttattgtagttgataactatgaccaaacagcagggatagtaactcttgaagatgctatagaaactcttttaggtttggagattgttgatgaatttgacaataattctaatatgagagagttagcaaaaagcttaaagtttttaaaaaacaatatttaa

SEQ ID NO: 9248 - protein, 208 aa, Unknown
  Obtained from environmental sample
  DOMAIN (127)...(180): CBS domain
  misc_feature (1)..(208): Xaa is any amino acid
MEFITKAITKNKGKTFITKDELEATVAMGEEAGILKEKELHIIENIFELRDIKVKDIYTPRNVMFTISEDILLESLTKSDKTVIELEKMKEYSRIPIFKKDIDEIVGIVFSKEYFYEFIENRLENKQDIIKSVFKVHKNIPISKLLDLFISRKEHLFIVVDNYDQTAGIVTLEDAIETLLGLEIVDEFDNNSNMRELAKSLKFLKNNI

SEQ ID NO: 9249 - DNA, 678 bp, Unknown
  Obtained from environmental sample
  misc_feature (1)..(678): n is a, c, g, or t
ttgaaactaaaaaggcttatgtcggttgttttgactataggaatactatcattcatatttatcatttatttttacggcttacaaaaagattttacaaagcatcatagagagtttcttattgctgtaaatacattggaaaactcatatcttgacttagagcataaaatactgcaaaactcaatttacgcttacaataatctagatgaaatctcatcttcgacaaatagtgttgaaaatgaatttaaaaacttaacagagacgcatatactcaaatataaagagtataaagatattaaaataaatctagatatacttaaagagaaaatcaacttaaatatacaaaacatagatgaatatctcatgctaaatgccggtataaaaaactcactagtctatttaagttcttatatagaaaaagcagcttttttagaagaacaagataaaaatctttatataaaagctatacaaattttaaaacacttcaatgatgcaaaaagaatacaggatttagactatataaataaaaaatgttttttactaagttcaaaatcacaaagtatacaaacacaaaattttattgtcagctttaacaatcactctaaatatctagcaagaaaatatccaatatttttaaaaataacaccactattccttcccataagatccctagacctttag

SEQ ID NO: 9250 - protein, 225 aa, Unknown
  Obtained from environmental sample
  misc_feature (1)..(225): Xaa is any amino acid
MKLKRLMSVVLTIGILSFIFIIYFYGLQKDFTKHHREFLIAVNTLENSYLDLEHKILQNSIYAYNNLDEISSSTNSVENEFKNLTETHILKYKEYKDIKINLDILKEKINLNIQNIDEYLMLNAGIKNSLVYLSSYIEKAAFLEEQDKNLYIKAIQILKHFNDAKRIQDLDYINKKCFLLSSKSQSIQTQNFIVSFNNHSKYLARKYPIFLKITPLFLPIRSLDL

SEQ ID NO: 9251 - DNA, 879 bp, Unknown
  Obtained from environmental sample
  misc_feature (1)..(879): n is a, c, g, or t
atgtacgataatttgacagatttgtataatcgaaaagcatttataaagcagctcaaaaaaacaaaaaaaccgctactacttcttatagatatagacggttttaaatatataaatgacatctatggaaatgttgtaggtaatcttgtacttaaaaagttgtcagaaattttaaaaaaagagtttgaaagtattttagatactggtgtttatcgtcttgccggagatgaatttggaattttatttaaagatatctcaagtaaaaaggcactagaaatcgccaagaaccttgagaataaaatatcaaattataattttataataagtgatttaactctgcatctacatgtaagtattgcaagtaactccgttactcctattctagaaaatgcagacttagccttaaaacttctaaaagacaatccgatgaaaagggtgatagagtacaatgaaagtctaaactttaaaatggatgtaaaagaaaacatgcatacaattgagcagataaaatatgctgtagaagaggatagaatcgttccattctttcaaccaatagtcaatctaaaaacattaaaaatagagaagtatgaagcccttgccagactaaaactaaaagatggtacttttttaccaccatttaagtttttaggtttatccaagcaaagttcatactaccattttattacacttcagatgattgaaaaaactttcaacatgtccaaaaaatttcctcagtataggttttccataaatatttctatgactgacatacaaaatactaaattaacgaagatgctctttaatactctagatgcaaatcttgaagtagcatctagactagatattgagtactctcgagccgaatctgatcattgggnttaa

SEQ ID NO: 9252 - protein, 292 aa, Unknown
  Obtained from environmental sample
  DOMAIN (160)...(286): EAL domain
  misc_feature (1)..(292): Xaa is any amino acid
MYDNLTDLYNRKAFIKQLKKTKKPLLLLIDIDGFKYINDIYGNVVGNLVLKKLSEILKKEFESILDTGVYRLAGDEFGILFKDISSKKALEIAKNLENKISNYNFIISDLTLHLHVSIASNSVTPILENADLALKLLKDNPMKRVIEYNESLNFKMDVKENMHTIEQIKYAVEEDRIVPFFQPIVNLKTLKIEKYEALARLKLKDGTFLPPFKFLGLSKQSSYYHFITLQMIEKTFNMSKKFPQYRFSINISMTDIQNTKLTKMLFNTLDANLEVASRLDIEYSRAESDHWX

SEQ ID NO: 9253 - DNA, 972 bp, Unknown
  Obtained from environmental sample
  misc_feature (1)..(972): n is a, c, g, or t
atgaatatggatgggaaacttctggagtatagtaaaatggctttaaatcttcttgaatatgatgaagatgagatgaaagaactttacatatatgattggaatgtcgagtattcaaaagaagagttaaaagagattatgaaaaatatctcaaatacaccaattattacagaaacaatccataaacgaaaaaatggttctctatatgatgcatcaattactagtataaaaattgagattgcaggggtggagtatatatattcttctgttagggatataacgaaacaaaaagaggaatcaaaaaatatattagaacaaaaaattgagtttgaaacaattttcaatacttcaaaagatggtatagccatattagatatagaatcaaattttataaatttcaatcaagcgtatttggaaatgacaggatttgcaagagaagagttacttacaaaatcttgtattgaacttacatcacctgaagatagacaaaaatgtatagataccttatctttgattttaaaagtaggatatattgaaaactatcaaaaaatttgtattgtaaaagatgataaaagaatagtaaccaatatgagtatctctttgttaccagataaaaatagaattcttgtggttacaaaagatataacagcgttaaaaatgctagaagagcaatcaaaactagcttcaatgggtgagatgatagggaatatagcacatcaatggagacaaccactctctgttatatctacgggtgcaacgggtatgaaaatacaaaaagagtatggtttattagatgatgcaatcttctacgaaacatgtgatattattgatgaaaatgtacaatatctctcaaaaactattgatgattttagaaactttattagaggtgatgttacatttaaactagttgctattagtgaagtattagaagataccttaaatcttctaaaagcatccctttcaaatcattataaa

SEQ ID NO: 9254 - protein, 324 aa, Unknown
  Obtained from environmental sample
  DOMAIN (228)...(298): His Kinase A (phosphoacceptor) domain
  misc_feature (1)..(324): Xaa is any amino acid
MNMDGKLLEYSKMALNLLEYDEDEMKELYIYDWNVEYSKEELKEIMKNISNTPIITETIHKRKNGSLYDASITSIKIEIAGVEYIYSSVRDITKQKEESKNILEQKIEFETIFNTSKDGIAILDIESNFINFNQAYLEMTGFAREELLTKSCIELTSPEDRQKCIDTLSLILKVGYIENYQKICIVKDDKRIVTNMSISLLPDKNRILVVTKDITALKMLEEQSKLASMGEMIGNIAHQWRQPLSVISTGATGMKIQKEYGLLDDAIFYETCDIIDENVQYLSKTIDDFRNFIRGDVTFKLVAISEVLEDTLNLLKASLSNHYK

SEQ ID NO: 9255 - DNA, 381 bp, Unknown
  Obtained from environmental sample
  misc_feature (1)..(381): n is a, c, g, or t
atgaataaaaaagttttagtagttgatgatagctcaacgatgagaaaaataataaaaaatgtgttgattgaacttggcatttatgatgagtttataacagaagctgtggatggtgttgatgctttaggtaaagtaaagtcaaataattttgatcttatattaacagattggaatatgcctaaaatgaatggcttaactcttgtacaaaacttaagacaacttccaaaaagtgaacatactcctattgtaatgataacaacagagggttgtagagaagaggttgtatcagcattaaaaagtggtgtaaataactatatagttaaaccttttaatgcagaggttttaagaaataaattagaacctatgttaaataaaatataa

SEQ ID NO: 9256 - protein, 126 aa, Unknown
  Obtained from environmental sample
  DOMAIN (3)...(126): Response regulator receiver domain
  misc_feature (1)..(126): Xaa is any amino acid
MNKKVLVVDDSSTMRKIIKNVLIELGIYDEFITEAVDGVDALGKVKSNNFDLILTDWNMPKMNGLTLVQNLRQLPKSEHTPIVMITTEGCREEVVSALKSGVNNYIVKPFNAEVLRNKLEPMLNKI

SEQ ID NO: 9257 - DNA, 576 bp, Unknown
  Obtained from environmental sample
  misc_feature (1)..(576): n is a, c, g, or t
atgacctctacaattgaaactggttgcgatgtttgggtaagctttcatgataatcccaaaagaaaactcaaatatacattagaacttacaaaattgtataatcaatatatttgtacaaacacaaatgtagcaaataagatagcaatagaagcaatacaaaatgggataattaaagagttacacaattataaaactttaaagccagaacaaaaatatggacaaaatagtcgcatagatatcttacttgagaatgaaaatgaaaagtgttatgtagaggtaaaaagtgtcactttaaaaatagaagataatttggcatttccagactctattacttcaagaggagagaaacatctcaatgaactagcacaaatggcaaaagatggtcatagggcagtgatgttatatataattcaaagaactgataatctcccatttagaattgcaagtgaaattgataaaaaatattatgagagttttttaaatgtcactaaaaaaggtgtagaagtattagtctatcaatcaagtatctcacaaaaggagatatttatagatagaaaattaaattttaaaatttag

SEQ ID NO: 9258 - protein, 191 aa, Unknown
  Obtained from environmental sample
  DOMAIN (1)...(188): Sugar fermentation stimulation protein
  misc_feature (1)..(191): Xaa is any amino acid
MTSTIETGCDVWVSFHDNPKRKLKYTLELTKLYNQYICTNTNVANKIAIEAIQNGIIKELHNYKTLKPEQKYGQNSRIDILLENENEKCYVEVKSVTLKIEDNLAFPDSITSRGEKHLNELAQMAKDGHRAVMLYIIQRTDNLPFRIASEIDKKYYESFLNVTKKGVEVLVYQSSISQKEIFIDRKLNFKI

SEQ ID NO: 9259 - DNA, 561 bp, Unknown
  Obtained from environmental sample
  misc_feature (1)..(561): n is a, c, g, or t
atgaataagaatttttttaaaaacccttattatcttatcggtgtattgtttgttattatatcttttttagtttttttactttatataatatttcaatatgaaaaaaatattgaaaaagatatgttcacaatagcaacaacagatgtattacatattactcaaaataaagcagaccatattacaaaaattttaagatatagcgatgattatataaatgatataaaaaaagatacacagttacaaaaaagattagagatgcaactcaaaaatcttataacaccaaatatcaaatatgcatatttgttatataaagatagaaaaaatacttttagatttttagtggatggttctcccatagatgaaaaagcgatgattaatgaaaaactagatatcacaagtgataaatggtttgagctttatgaagcaaaattaccagttattattaaacatacatacttacaaaaactttcacttagttatttagttccccatatgtataaagaggaagtaaaattagtgttagttattgacttttcagttgataagttaccccaagaataa

SEQ ID NO: 9260 - protein, 186 aa, Unknown
  Obtained from environmental sample
  misc_feature (1)..(186): Xaa is any amino acid
MNKNFFKNPYYLIGVLFVIISFLVFLLYIIFQYEKNIEKDMFTIATTDVLHITQNKADHITKILRYSDDYINDIKKDTQLQKRLEMQLKNLITPNIKYAYLLYKDRKNTFRFLVDGSPIDEKAMINEKLDITSDKWFELYEAKLPVIIKHTYLQKLSLSYLVPHMYKEEVKLVLVIDFSVDKLPQE

SEQ ID NO: 9261 - DNA, 729 bp, Unknown
  Obtained from environmental sample
  misc_feature (1)..(729): n is a, c, g, or t
atgctgagttttatcgtttttgattctacggtggattcccgaagtcgcacaagtcaaagagcaggaggcgaaagatgtgctggctcaatttttgacctttacgtcaagaaagatctggtcgatttcctcaaagttgaccggattaaacatgccaaaacactcattcgttatctggcagttaaccatggacaagagaccaagtatagtcagttggcacaggttgcagctatagatgaaaaaaccgccaaaaattatgtagaaatccttacggagacatttatcgttacggttcatcctccatggtttacaaatcgcaacaaagaattagtgaaaacgccaaaaatctattttctggataatggagttcgaaactttttcatcaataactttaatcaacatgatatgcgtcaggatagcccctttttgtttgaagggtatgtgatatctgaactcatcaaggcgggaatgacaagcgaccagatcaaattctggcgcaccaaaaatcgacaggaagttgatctgattattgaatcgggtggcagggtaagacctgttgagattaaatacaagaaacgattaaagtcttccgactataagggactaaaaaattatcagaaaacctatcccgactgtcttcagccttttatggtcaatctgacaagtaatttactttccagtgggatgcagaatatgtcaccatttgatattggacatcgtctggggaagtga

SEQ ID NO: 9262 - protein, 242 aa, Unknown
  Obtained from environmental sample
  misc_feature (1)..(242): Xaa is any amino acid
MLSFIVFDSTVDSRSRTSQRAGGERCAGSIFDLYVKKDLVDFLKVDRIKHAKTLIRYLAVNHGQETKYSQLAQVAAIDEKTAKNYVEILTETFIVTVHPPWFTNRNKELVKTPKIYFLDNGVRNFFINNFNQHDMRQDSPFLFEGYVISELIKAGMTSDQIKFWRTKNRQEVDLIIESGGRVRPVEIKYKKRLKSSDYKGLKNYQKTYPDCLQPFMVNLTSNLLSSGMQNMSPFDIGHRLGK

SEQ ID NO: 9263 - DNA, 435 bp, Unknown
  Obtained from environmental sample
  misc_feature (1)..(435): n is a, c, g, or t
atgaataatcaagaaagtaaaaagttaactattaagaatctaagtatttactcaccttcaatattaaataggcgtattgatttggatgaaacaataaagtgtaaaaacacaatatattataaacatgagaatgaggatattgatgttgatagctttctacactttcctattattttaaataatgatggttcactatggaaagaagggaacctatatttattagataaattaaaaagttatacaaaaccatctcctaaaacattagcttcaattgcaaaagatttaaaggactttaaaaactatttcgatattgaaaaaataaattacctagcagctccgaggaagcttcaaggacctgtatatgtataccgtggatatttacaaaaactattaaatgaacagaaactatcttctaacgtaataagaagaaaatga

SEQ ID NO: 9264 - protein, 144 aa, Unknown
  Obtained from environmental sample
  misc_feature (1)..(144): Xaa is any amino acid
MNNQESKKLTIKNLSIYSPSILNRRIDLDETIKCKNTIYYKHENEDIDVDSFLHFPIILNNDGSLWKEGNLYLLDKLKSYTKPSPKTLASIAKDLKDFKNYFDIEKINYLAAPRKLQGPVYVYRGYLQKLLNEQKLSSNVIRRK

SEQ ID NO: 9265 - DNA, 477 bp, Unknown
  Obtained from environmental sample
  misc_feature (1)..(477): n is a, c, g, or t
atgggacgcttttaccttgcgatcatcaacatccccttaaaagacaatatcattgtagacaagcctattggcagaaacgggacaaaccgtctcaagatggctgttgtcgaaggtgctaaagcgtccaagaccgagtttgcaaaactctacccgagcaaagacgaaaaaagtgagcttattgcctgtaaactctacagtggccgtacccatcagatccgcgttcacctcgagagtataggccgcgggatcatgggtgaccatttatacggatttaagagcaaagaagataaaatcagcgatattttcctgcatgcgtacatattgtatttcgtgcatcctacatctgggaaaaagatggagtttatcgcacctattcatgagagcatgagcaattatctggaagaaaattttgatatggagtttataaatgaagcaattgatactaccgattttagccgccactttaattctatttag

SEQ ID NO: 9266 - protein, 158 aa, Unknown
  Obtained from environmental sample
  DOMAIN (1)...(78): RNA pseudouridylate synthase
  misc_feature (1)..(158): Xaa is any amino acid
MGRFYLAIINIPLKDNIIVDKPIGRNGTNRLKMAVVEGAKASKTEFAKLYPSKDEKSELIACKLYSGRTHQIRVHLESIGRGIMGDHLYGFKSKEDKISDIFLHAYILYFVHPTSGKKMEFIAPIHESMSNYLEENFDMEFINEAIDTTDFSRHFNSI

SEQ ID NO: 9267 - DNA, 309 bp, Unknown
  Obtained from environmental sample
  misc_feature (1)..(309): n is a, c, g, or t
atgccgcatatccagattcaacgttttaaagaggtcggtttcccatttacgcacgacgggattgactttgactttatcgctaccaatgtcaactatcccgacgacaggcttatctgcgcaaagagtgaggagaagacctttcttcttcaggtgaagcagggacaggagaactggcttttaaaaagtgacaaggtcacacgcgtctcgccaaatcttcatatcaaaaaagcgatccaggcctatgccgacaaggcaggtctggagatccttttttccaatctgcacctcagccgatctgtcatgggttaa

SEQ ID NO: 9268 - protein, 102 aa, Unknown
  Obtained from environmental sample
  misc_feature (1)..(102): Xaa is any amino acid
MPHIQIQRFKEVGFPFTHDGIDFDFIATNVNYPDDRLICAKSEEKTFLLQVKQGQENWLLKSDKVTRVSPNLHIKKAIQAYADKAGLEILFSNLHLSRSVMG

SEQ ID NO: 9269 - DNA, 567 bp, Unknown
  Obtained from environmental sample
  misc_feature (1)..(567): n is a, c, g, or t
atgttcaaaaatgtcagggcgactacggttgagccaaaaaagatacacatttcatggaaggcaaacagcgaaaaagatctggccttttataatatctaccgttccagttcgagtaacggaagttatgactattatgtcaaactcaatgagaccgagttcatagatgagatagacgaagacggtaaaaactacttctatcagatcacagcagttgacaaagatggcttagagagcccgtttcagacgaatccgattcacggaagcaccttggcaaaaccgcttgctccaagtttcatcgatgctatagtaaaaaacagctcagccgtactgcgctggaaaaacaatgataaccgcacaaagagctacacggtgatcaaaacgaccaaagagagctggatcagctccactgtgcaagagatcacagggatcatagggacaagctatacggtcaaagacctcaaacctgatgtccaataccagttccaagtgatggccgttgatgcttataacatcgcctctaaaccgactgaaccggctgatgtccttttttcaacaccgaacaggtag

SEQ ID NO: 9270 - protein, 188 aa, Unknown
  Obtained from environmental sample
  DOMAIN (3)...(81): Fibronectin type III domain
  misc_feature (1)..(188): Xaa is any amino acid
MFKNVRATTVEPKKIHISWKANSEKDLAFYNIYRSSSSNGSYDYYVKLNETEFIDEIDEDGKNYFYQITAVDKDGLESPFQTNPIHGSTLAKPLAPSFIDAIVKNSSAVLRWKNNDNRTKSYTVIKTTKESWISSTVQEITGIIGTSYTVKDLKPDVQYQFQVMAVDAYNIASKPTEPADVLFSTPNR

SEQ ID NO: 9271 - DNA, 342 bp, Unknown
  Obtained from environmental sample
  misc_feature (1)..(342): n is a, c, g, or t
atgggagagatggaaaaatccaacaatctgatagtcatggtaatgatccatgtccaccaaaggatacaaaataatatgaaacaaacgattacaattaaaaatatatgtgattcaattaagaatagaaatgttattgaatttttttacaaagatcataaacgtattgttaaacctcatattgttggtatacttaataatggttctactgtcttaagtgcatatagaataggcgggtacagcaaatcaaatgattcaagcccttggcgatattttaaaattgttgaaatgtcaagattaaaaattacagatgaaaattttgataaaacagggaatgggttataa

SEQ ID NO: 9272 - protein, 113 aa, Unknown
  Obtained from environmental sample
  misc_feature (1)..(113): Xaa is any amino acid
MGEMEKSNNLIVMVMIHVHQRIQNNMKQTITIKNICDSIKNRNVIEFFYKDHKRIVKPHIVGILNNGSTVLSAYRIGGYSKSNDSSPWRYFKIVEMSRLKITDENFDKTGNGL

SEQ ID NO: 9273 - DNA, 801 bp, Unknown
  Obtained from environmental sample
  misc_feature (1)..(801): n is a, c, g, or t
atgttaaggtttcgacaaaagtggatagcccaaaaaaatcaagaaagtaacaggtcgttgataatttgttttgaagaacccgaaatctacttacatcctagtgcagctaatcaaatgagaaatattttatataaattaagcgattcaaattcccagataattgcttcaacccattcgccatttatgattgatctatctagaaaaccaagacagatacttaatagactggttactaaagataatgaagtagttgctgtaccatttactgtaacggattcatttaatagtttacataatgatgataagacatatgttaaaatgcttcttaaaattgatagctatatctcaagagccttttttacaaagcatgttgttatagttgagggggatactgaagatattttattaaaagaaactcttaaaagattacccgaagacgactatttaaaaatttatgctaattttgagatcattaaagctagaggaaaagcagctataataagcttagttaaatatctagtttcaatggatattaaacctattgtagtacatgatagagatagtggtaatgagaatgctttgaaatataatgagcctataaagaatgcaattggcgataatggaaggatagttttaatgaaagaaaatgtagaagatgaaataggttatgaagcaacatatgaaaagccttttaaagcatatcaacaaactattgtatggcatagttggaatgatataccagataactggagaactaagatgaaggaaatttttggagattttatctcgagccgattctga

SEQ ID NO: 9274 - protein, 266 aa, Unknown
  Obtained from environmental sample
  misc_feature (1)..(266): Xaa is any amino acid
MLRFRQKWIAQKNQESNRSLIICFEEPEIYLHPSAANQMRNILYKLSDSNSQIIASTHSPFMIDLSRKPRQILNRLVTKDNEVVAVPFTVTDSFNSLHNDDKTYVKMLLKIDSYISRAFFTKHVVIVEGDTEDILLKETLKRLPEDDYLKIYANFEIIKARGKAAIISLVKYLVSMDIKPIVVHDRDSGNENALKYNEPIKNAIGDNGRIVLMKENVEDEIGYEATYEKPFKAYQQTIVWHSWNDIPDNWRTKMKEIFGDFISSRF

SEQ ID NO: 9275 - DNA, 498 bp, Unknown
  Obtained from environmental sample
  misc_feature (1)..(498): n is a, c, g, or t
atgatgcctataggaagacaagttcaacctgaatctactgaagagagattagaactttataaaaaaagagattgtttggagaattatgaaattgtaaaacaacgatttttaaactatagacttcttaatggaaaaatcacaatcaataaagaggtaatcccatcatattttttatgctattcaacattaaaaaacaaaagtactgcagggagaattgaaaagtcaatcaaaaatatccattatcttaatcgcgatgaagtaaaaatcatctctttagaatattttaatactattgctaatacaaactatacctctatttatgaacttatatacaatccactcaattttgaagctgaagtaagtttaagaaaccaacttactcaaaacccatatgatcttagttgtataatagttatagaaaagattcttgatgaaaaaatagaagtatcttgtaactcaaaagtttttgaagatgtaaaagaaactattatagtatga

SEQ ID NO: 9276 - protein, 165 aa, Unknown
  Obtained from environmental sample
  misc_feature (1)..(165): Xaa is any amino acid
MMPIGRQVQPESTEERLELYKKRDCLENYEIVKQRFLNYRLLNGKITINKEVIPSYFLCYSTLKNKSTAGRIEKSIKNIHYLNRDEVKIISLEYFNTIANTNYTSIYELIYNPLNFEAEVSLRNQLTQNPYDLSCIIVIEKILDEKIEVSCNSKVFEDVKETIIV

SEQ ID NO: 9277 - DNA, 432 bp, Unknown
  Obtained from environmental sample
  misc_feature (1)..(432): n is a, c, g, or t
atgaatacaaaaagcatatataagcaattctcacagaagcttatatttgcaacttcattttttgttattgtattatcccttattttttatggttttacaaaagctacaatttatgaagagatctctgaagagctcttaaaagatgcaaaacttattgttacacttgcacaaaacaaaacaaatgatcacgataatttacgagtattagttaatgatgatacaacaattgaagttgtaactatctctgtcgttccaaaactaaactacaaaaaatataaaattgataataaccattttatggaattaatataccctatgagtttagaaaataaccaatacctaaaattaactagaaatataaattcttcccataaaatgttaaataaaatatttagtaacttattatttttaggtactggtggtcttatttga

SEQ ID NO: 9278 - protein, 143 aa, Unknown
  Obtained from environmental sample
  misc_feature (1)..(143): Xaa is any amino acid
MNTKSIYKQFSQKLIFATSFFVIVLSLIFYGFTKATIYEEISEELLKDAKLIVTLAQNKTNDHDNLRVLVNDDTTIEVVTISVVPKLNYKKYKIDNNHFMELIYPMSLENNQYLKLTRNINSSHKMLNKIFSNLLFLGTGGLI

SEQ ID NO: 9279 - DNA, 840 bp, Unknown
  Obtained from environmental sample
  misc_feature (1)..(840): n is a, c, g, or t
atgccgcaacgcagaatgtcttcatcaattcctgttatggtacatcattataaagcgaatactgaatatcctattaatgatatacccgaatcactttcagaggattttacttttaaagaagaaaaagaaacatacaatgatttacaaaaaatactaaataattgggataatagttttattgattcaaaatataataaatttattgaaattataaataaagaaaaaaaagaaatcggtaaagtaaagattcttgtgtttgcatttttcaaagacacattaagataccttgaaaagcgactaacttatgaaggaattaaatgtttaagaattgatggcagtgttccaattgatacaagacttaatcatatcgaattttttaaagatgacgaaacaatagaaatattactgtcatcaattgttggtggtgaaggattggattttcaattctgtaatacaattttcaattatgatcttccttggaatccaatggaaatggaacaaagaattggtagaattgatagaattggacaaaaatcaaaaagattatacatacataatttatttattaaagattcaattgaagaacgaatacttgagagattatatacaagaattgagatttttaagcactcaattggagatttgcaaccaataattggtaaaattactacagcattaaataaaattgttttctcaaaagaatatacacttgaagaagaagaaaggaatattcacgaatttgagcttgctacacaaagagaaattagagagtttcaccaaattgaacaaaattctgctcagntcattggtacagacaaattctttgaaaatcaaaattga

SEQ ID NO: 9280 - protein, 279 aa, Unknown
  Obtained from environmental sample
  DOMAIN (99)...(176): Helicase conserved C-terminal domain
  misc_feature (1)..(279): Xaa is any amino acid
MPQRRMSSSIPVMVHHYKANTEYPINDIPESLSEDFTFKEEKETYNDLQKILNNWDNSFIDSKYNKFIEIINKEKKEIGKVKILVFAFFKDTLRYLEKRLTYEGIKCLRIDGSVPIDTRLNHIEFFKDDETIEILLSSIVGGEGLDFQFCNTIFNYDLPWNPMEMEQRIGRIDRIGQKSKRLYIHNLFIKDSIEERILERLYTRIEIFKHSIGDLQPIIGKITTALNKIVFSKEYTLEEEERNIHEFELATQREIREFHQIEQNSAQXIGTDKFFENQN

SEQ ID NO: 9281 - DNA, 678 bp, Unknown
  Obtained from environmental sample
  misc_feature (1)..(678): n is a, c, g, or t
atgcttgatagtatggaaaatagtagaagtgatttagtaaaacaaaaaaatgaaatttcagatcttcttagtgaagttgaatatttgatgcaacaaaatgatagtgtatattttgaaacaataaaatccctggctaatacaattgatgctaaggatagttataccggtggtcattgtgatcgggtagataaatatgccatgttaattggtaaagaatatggtctttcaagagaagaattaacaaatctttcctatgcctctcttcttcacgatataggtaagataggaataccagaaaagataataactaaggttggaaaacttaatgattatgagtttgaggaaataaaaaaacatccaggtcttggctatgaaattattaaggatattaactttttaaaaaattcaagggatgcaattcttcatcaccatgaacgaattgatggaactggatacccagatgggttaagagatgatgaaatatcaattttgactaggataatatcaattgctgattcttttgatgctatgacatcagatagatcatatagaaaggcattaacaaaagaagctgttataaaggaattaataaaaaataaaaattatcaatttgacggtgaactcgtagatatattattagaacttattgaaggtgggaagatagattttaataaataa

SEQ ID NO: 9282 - protein, 225 aa, Unknown
  Obtained from environmental sample
  DOMAIN (55)...(177): HD domain
  misc_feature (1)..(225): Xaa is any amino acid
MLDSMENSRSDLVKQKNEISDLLSEVEYLMQQNDSVYFETIKSLANTIDAKDSYTGGHCDRVDKYAMLIGKEYGLSREELTNLSYASLLHDIGKIGIPEKIITKVGKLNDYEFEEIKKHPGLGYEIIKDINFLKNSRDAILHHHERIDGTGYPDGLRDDEISILTRIISIADSFDAMTSDRSYRKALTKEAVIKELIKNKNYQFDGELVDILLELIEGGKIDFNK

SEQ ID NO: 9283 - DNA, 783 bp, Unknown
  Obtained from environmental sample
  misc_feature (1)..(783): n is a, c, g, or t
atgatagttattgagatgaatccaagagtttcaagaagttctgcacttgcttcaaaagctacaggatatcctatagcaaaagttgcaactctacttgcagttggttttacacttgatgagattgaaaatgatatcacaggaactacagcatcatttgaaccagtgattgattatgttgtaacaaaaattccaagatttacatttgaaaaatttccaaaagcaaactctacacttactacaggtatgaagagtgttggtgaagttatgtctatggggagaacatttaaagagtctttccaaaaagcattatgttcacttgaaactggactttgtggatttgatccaatcaaaggtgatattgaattaatcaaaaaagagattcgaagaccaaattgtgatagatatatctacttaatgcaaggtatgcgagaaggtttaagtgataaagatatctttgagttatcaaaaattgatccatggtttttaaatcagtttagagaaattcacgatatggaagtaaaaattaaaagtgaagcatcagcagttctacaaaatgaagaacttttaagaagagcgaaaacttttggatttagtgataaaatgatctctttacttattggttgtaaagaaactgaagtatatgatgcaagaaaagcacttagtataaactttgaatacaatgaagttgatacttgtgcagctgagttcaaagcattgacaccatatcttttatctacaacaaatatctcttcattgccacaaaaagccaaaagagaaatctga

SEQ ID NO: 9284 - protein, 260 aa, Unknown
  Obtained from environmental sample
  DOMAIN (123)...(247): Carbamoyl-phosphate synthetase large chain, oligomerisation domain
  misc_feature (1)..(260): Xaa is any amino acid
MIVIEMNPRVSRSSALASKATGYPIAKVATLLAVGFTLDEIENDITGTTASFEPVIDYVVTKIPRFTFEKFPKANSTLTTGMKSVGEVMSMGRTFKESFQKALCSLETGLCGFDPIKGDIELIKKEIRRPNCDRYIYLMQGMREGLSDKDIFELSKIDPWFLNQFREIHDMEVKIKSEASAVLQNEELLRRAKTFGFSDKMISLLIGCKETEVYDARKALSINFEYNEVDTCAAEFKALTPYLLSTTNISSLPQKAKREI

SEQ ID NO: 9285 - DNA, 678 bp, Unknown
  Obtained from environmental sample
  misc_feature (1)..(678): n is a, c, g, or t
ttgcttttccgaaggaatagcctacactacacatggtctgtttttcaggatatacaaggcttaatcaatttaatgggcggaaaaaagaaattcatttctactttggatggcgtatttagtatgccaccaaaattcgataattcttattatggttttactattcatgaaattcgtgaaatgcaaatcataaatatggggaattatgcacatggaaatcaaccccttcagcatatgatctacttgtacaattatgcagggcaagcttggaaaactcagctacatgttagagaagtaatggatcgcttatatacaccacaatctgatggctattgcggcgacgaagataatggacaaacttcggcttggtatatttttagtgcaatgggtttctatcctgtttgtcctggaactgacgaatatgtatttggctctccttcatttaagaaaataactttaaatttagaaaatgggaaaacatttagtataaattctcctgagaattcttcagaaaatatttttgtaaataaaattaagcttaataacaaaaactataaacttaatttcataaaacatcaagacatccttaatggaggaaaactagactttaaaatgtcgaaaaaaccaaattttaaaaggggcacggaaaaaggaagttacccttcgtctatgtcaaaataa

SEQ ID NO: 9286 - protein, 225 aa, Unknown
  Obtained from environmental sample
  misc_feature (1)..(225): Xaa is any amino acid
MLFRRNSLHYTWSVFQDIQGLINLMGGKKKFISTLDGVFSMPPKFDNSYYGFTIHEIREMQIINMGNYAHGNQPLQHMIYLYNYAGQAWKTQLHVREVMDRLYTPQSDGYCGDEDNGQTSAWYIFSAMGFYPVCPGTDEYVFGSPSFKKITLNLENGKTFSINSPENSSENIFVNKIKLNNKNYKLNFIKHQDILNGGKLDFKMSKKPNFKRGTEKGSYPSSMSK

SEQ ID NO: 9287 - DNA, 483 bp, Unknown
  Obtained from environmental sample
  misc_feature (1)..(483): n is a, c, g, or t
gtggcaaatggaaattacacccttttagcaaaatctatcgatcatgaaaaaggctatatgcattaccctcaaaaaaatattcctaccataagtcaggctcgttatcgtgaacttattattaaatcacgatatgtcacaattcctgtgtttcataaggaacaaataaattttcaagatgatattataaaccctaaagaagaaataattaaccatacctaccatttttcaaagggaacccttattctgaaaaaaataaaattaccaaagcttaatcccaatggaaacgtatttataacattaacaaattggtcaaatggcgatgcttacgacagaacaggttgtgtatttacccttgctgatgataataaaaaatcgatattagcagctttaaaaaatggtctaaaagaattacccatttatatggataataagggcacagaatatcaaggcgtaatcagtaccaataattatactgtcccatag

SEQ ID NO: 9288 - protein, 160 aa, Unknown
  Obtained from environmental sample
  misc_feature (1)..(160): Xaa is any amino acid
MANGNYTLLAKSIDHEKGYMHYPQKNIPTISQARYRELIIKSRYVTIPVFHKEQINFQDDIINPKEEIINHTYHFSKGTLILKKIKLPKLNPNGNVFITLTNWSNGDAYDRTGCVFTLADDNKKSILAALKNGLKELPIYMDNKGTEYQGVISTNNYTVP

SEQ ID NO: 9289 - DNA, 759 bp, Unknown
  Obtained from environmental sample
  misc_feature (1)..(759): n is a, c, g, or t
atgaccgaattgcttcaagggaaggatatggttatagaacaaatcctaacacgaatagaggaactctcttctttaaataaaaaatttggtggggtaaaagaggctttagagtataaaaaagagaaagaaaaagaactagaagggtatgaaaatatctcttttgagaaagctattttagaaaaaaatatcaaaaagttatctcttgaactagatactttagctaaaactgtttcaacaaaaagaaaagagaacttaccacttctagaatcaaaaataaatgaatacctaaagtttttatatcttgaaaatcttcaaataaatatggaaactaaaggtttagatacaagtggtattgatactatagaatttacacttaacaatacaaaactagataaaataagtagtggtgagttcaatcgtcttcgtcttgctcttctaactgccagaagtcactacgagatagatacaaatgggatactatttttagatgagatagatgcaaatttaagtggaaaagagtctgcaagtattgcacaagttttaaataaactttcacaaaactatcagatatttgctatctcacaccaaccacaactaagtgctacagctcaccaacatttcttagtaaaaaaagagaacaatatctcttgtgtaaaacctttaaacaaagaggaaagaatcaatgagattgcaagaatgataagtggggaaaatatcactactgaggctttagagttttctaaacaacttttacagtag

SEQ ID NO: 9290 - protein, 252 aa, Unknown
  Obtained from environmental sample
  DOMAIN (72)...(212): ABC transporter
  misc_feature (1)..(252): Xaa is any amino acid
MTELLQGKDMVIEQILTRIEELSSLNKKFGGVKEALEYKKEKEKELEGYENISFEKAILEKNIKKLSLELDTLAKTVSTKRKENLPLLESKINEYLKFLYLENLQINMETKGLDTSGIDTIEFTLNNTKLDKISSGEFNRLRLALLTARSHYEIDTNGILFLDEIDANLSGKESASIAQVLNKLSQNYQIFAISHQPQLSATAHQHFLVKKENNISCVKPLNKEERINEIARMISGENITTEALEFSKQLLQ

SEQ ID NO: 9291 - DNA, 603 bp, Unknown
  Obtained from environmental sample
  misc_feature (1)..(603): n is a, c, g, or t
ttggggtgcaaattgattagtagattttacttagaaaactatttgtcatttgaacaaatagagttagagtttcaaaaaggtttagtagtatttacaggacctagtggtgctggaaaatcagttttgatgagttcaattttagctttatttggtgcaactgattctaaagctcttgtaagtgaagtattacttgaagatttaaaaattgaagatgaaggatatgggatagaaaatgaggatgatataattatcaaacaaaacacctctacaaaaactagatattttttaaataatcaaatcatctcaaagaaaaatctcaaagatttcacaacaactttttctaaacaccttcacctaaaagatacaagtgattttgatagtgagaagattattgcatttttggattttttaacctctgtaaatgatagttcttatagagcaattttaaatgaatttcaaacaaaatatgaggaatatcatactttacaaaagaagtttacaaaaatacaaaatgatgaaaaagaacttgatgatttaatagaatataccaaattcgagatagagaaaattgtaaaacttgatcccaaagaggacgagtattaa

SEQ ID NO: 9292 - protein, 200 aa, Unknown
  Obtained from environmental sample
  misc_feature (1)..(200): Xaa is any amino acid
MGCKLISRFYLENYLSFEQIELEFQKGLVVFTGPSGAGKSVLMSSILALFGATDSKALVSEVLLEDLKIEDEGYGIENEDDIIIKQNTSTKTRYFLNNQIISKKNLKDFTTTFSKHLHLKDTSDFDSEKIIAFLDFLTSVNDSSYRAILNEFQTKYEEYHTLQKKFTKIQNDEKELDDLIEYTKFEIEKIVKLDPKEDEY

SEQ ID NO: 9293 - DNA, 375 bp, Unknown
  Obtained from environmental sample
  misc_feature (1)..(375): n is a, c, g, or t
atgtttagtacaagggcgatagatagagttaaggttatagaaaaaaaaattaactttatagaggcaattgtagaacaatatggctcagtcattaaagcattagaagatgaacaaaattcaagagcttcaatattaatgcacttaacctctattgcagaacagtttgataaactactacataatggtgaactggagatattagctttttttgaaaagcaagatattaaaggtagttatgagttaagaaactttatagcctatgattatgaaggagttgatctttacactgtagaagatgttataaatgagcgtcttggtgtaattagcaacagtgtaaaaaaatttttaaaagtgcaactagaaggtaataattga

SEQ ID NO: 9294 - protein, 124 aa, Unknown
  Obtained from environmental sample
  misc_feature (1)..(124): Xaa is any amino acid
MFSTRAIDRVKVIEKKINFIEAIVEQYGSVIKALEDEQNSRASILMHLTSIAEQFDKLLHNGELEILAFFEKQDIKGSYELRNFIAYDYEGVDLYTVEDVINERLGVISNSVKKFLKVQLEGNN

SEQ ID NO: 9295 - DNA, 894 bp, Unknown
  Obtained from environmental sample
  misc_feature (1)..(894): n is a, c, g, or t
atgaattacccgcataataatttttatgagatgctctcaagtagtgagaaagaacacggatcacgtccagttatttttatagatgaaaaaaaaataacatactctgagtttaaaaaagatgtggataagtttgcttcatatctacaacacaacggtatcaaaagaggtgataaaatagctcttattttgccaaactgtgatgagtttgtaacggcaattttttctgctactgccataggagccgtagtagttccactcaatcctcaattaaaagctagagagtatgaatatattttaaataactgcgaagcaaaactgctaattacctcaaaaatgttgaaaaaagaggtctcaaatttaaagttgattactccattaactgaagttatctgggtagatggtgaagatggaatcaaatttagtgacacattaacttaccctcagagtgattataatctatcatattcatctattgatgaattggctgttattatatatacatcaggcactactggtaacccaaaaggtgtaatgctatcatttaaaaatatcttctcaaatattataggtggaagtgaactctttgagttaactaaaaaagatcgttttattgtatatctgcctatgtctcatgcgtttagcttttctatcatgatcatgttgccgttttataatggagcatccatggtggttatgcgctctatcttaccattttcaaatatcataaaacaggttcttcttaaacgagtaaccatctttttaggtgttcctgatgtctataattcactcattaaagcaaaacttccatggtactttatgtggtttaatgctattcgtatttttattagcggagcatcacctttaagtgaagataccttaaacagaattccataa

SEQ ID NO: 9296 - protein, 297 aa, Unknown
  Obtained from environmental sample
  DOMAIN (33)...(297): AMP-binding enzyme
  misc_feature (1)..(297): Xaa is any amino acid
MNYPHNNFYEMLSSSEKEHGSRPVIFIDEKKITYSEFKKDVDKFASYLQHNGIKRGDKIALILPNCDEFVTAIFSATAIGAVVVPLNPQLKAREYEYILNNCEAKLLITSKMLKKEVSNLKLITPLTEVIWVDGEDGIKFSDTLTYPQSDYNLSYSSIDELAVIIYTSGTTGNPKGVMLSFKNIFSNIIGGSELFELTKKDRFIVYLPMSHAFSFSIMIMLPFYNGASMVVMRSILPFSNIIKQVLLKRVTIFLGVPDVYNSLIKAKLPWYFMWFNAIRIFISGASPLSEDTLNRIP

SEQ ID NO: 9297 - DNA, 585 bp, Unknown
  Obtained from environmental sample
  misc_feature (1)..(585): n is a, c, g, or t
atgggattaccaggtgagagtatggaaagctttggtgaaaacttagataaattatccgctataacgcaatgtgaaatacagcttggagtattaaaaaaactctcaggcacaacacttaatagacacgatgaacaatatggtatggtctatagtgatattccaccttatgatatattagcaaacaatttaatcccttttgaaacgatgcaaaaacttaaaagatttgcaagattttgggatattgtttataacagtggaaactttataaaaacttttgaactcttagtaaaagatagaagtgtctttgaaactttttatagttttagtgaatggctctactctcaaacattttccacttggcaaatatcacttgatagagttgctaagtttttatttgattttatagtagaaaaccaaggcttagagaaacaaaaagtagcagatatacttgtagaagatattttaaaagtaaatggtagaagactcccaaaatttttaagagaatatagtgatatacgcattctttcaaataatgaagatacaaaagatatagaaaataaaaacaaaagacaacaaaaaaggtaa

SEQ ID NO: 9298 - protein, 194 aa, Unknown
  Obtained from environmental sample
  misc_feature (1)..(194): Xaa is any amino acid
MGLPGESMESFGENLDKLSAITQCEIQLGVLKKLSGTTLNRHDEQYGMVYSDIPPYDILANNLIPFETMQKLKRFARFWDIVYNSGNFIKTFELLVKDRSVFETFYSFSEWLYSQTFSTWQISLDRVAKFLFDFIVENQGLEKQKVADILVEDILKVNGRRLPKFLREYSDIRILSNNEDTKDIENKNKRQQKR

SEQ ID NO: 9299 - DNA, 750 bp, Unknown
  Obtained from environmental sample
  misc_feature (1)..(750): n is a, c, g, or t
atgcaggaacacacgcagcaggtgttgttatctcaaatgaagctttatggaaaaaaacaccatctttttaaaccatcaggacttgatacattagctacacagtacaatggaaaatatgtagaagatgtagatttaatcaagtttgacttcttgggattgaaaactcttacagttatagagggtgcattacaacttattgaaaaaagagatgggagaagaataaactttattgaagaagatgtgaatgataaaggtgtttatgatctaattcaaacaggacatacaatagggttgtttcaaatagaatcttcaggtatgcaagatttaaataggcgactaaagccgtctaactttgaggatattatcgccgtgcttgcactttatagaccaggtcctatggagtctgggatgcttgatgactttattgatagaaaacatggacgagcagagataaactatttttatgatgagtttaatgaaccgcttcgtccaatattagaacctacctatggggttattgtttatcaagaacaagttatgcagattgttcaagttattggtggattttcccttggtggtgcggatttagttcgtcgtgctatggggaaaaagattaaagaagagatggatagactaaaaggtgaatttgcagatggtggtgtaaaaaaagggtataaccgtcaacactgtgaagagctttttgatttgattgtaaagtttgctgggtatggatttaataaaatcacatag

SEQ ID NO: 9300 - protein, 249 aa, Unknown
  Obtained from environmental sample
  misc_feature (1)..(249): Xaa is any amino acid
MQEHTQQVLLSQMKLYGKKHHLFKPSGLDTLATQYNGKYVEDVDLIKFDFLGLKTLTVIEGALQLIEKRDGRRINFIEEDVNDKGVYDLIQTGHTIGLFQIESSGMQDLNRRLKPSNFEDIIAVLALYRPGPMESGMLDDFIDRKHGRAEINYFYDEFNEPLRPILEPTYGVIVYQEQVMQIVQVIGGFSLGGADLVRRAMGKKIKEEMDRLKGEFADGGVKKGYNRQHCEELFDLIVKFAGYGFNKIT

SEQ ID NO: 9301 - DNA, 663 bp, Unknown
  Obtained from environmental sample
  misc_feature (1)..(663): n is a, c, g, or t
ttgctggaatcaggtaaatggacttctgaaaaattaaaaccatttttgataaaacataatatagaaacttcgtttataaattctaataacaataaaatagatattaaatcacattgttttagacatacttttgctaagattgcagtatcagaaaacaagatcaatcctgtcattatacaaacacattttaaacatctttctattgaaatgactatgcattatttaaacgtatcgaaagatgagcttaagaagacatatttagaacaactattaaaaacaaatggaatatactcaagaggtgaggaaggtaaaaagtttgagaaggcactatcggcagctagaacagaaaatgatctaggtaaagtattaaataacttatcaaaaatttttggagtttctcccctaccctttggactgtgtatttatgactttaaacgtggatattgtccaaatttgggagtacaaagttgctatgtcataggatgtagtcattttgttacgaataaagaatttctacctacttttgaacatgaaagacaagtagttaaaggtcaaattaaacattgtaaaattaataacaatataatagaactaaaaaaagcaaattttgaattatctaaaatagaaaatatcatttgggaaataaaggaaaagtatggctaa

SEQ ID NO: 9302 - protein, 220 aa, Unknown
  Obtained from environmental sample
  misc_feature (1)..(220): Xaa is any amino acid
MLESGKWTSEKLKPFLIKHNIETSFINSNNNKIDIKSHCFRHTFAKIAVSENKINPVIIQTHFKHLSIEMTMHYLNVSKDELKKTYLEQLLKTNGIYSRGEEGKKFEKALSAARTENDLGKVLNNLSKIFGVSPLPFGLCIYDFKRGYCPNLGVQSCYVIGCSHFVTNKEFLPTFEHERQVVKGQIKHCKINNNIIELKKANFELSKIENIIWEIKEKYG

SEQ ID NO: 9303 - DNA, 786 bp, Unknown
  Obtained from environmental sample
  misc_feature (1)..(786): n is a, c, g, or t
atgaatagaattttattacatacaattaaaagacatcaatattatccaacaccggcagaactggttcatgacatccttgaatattttaaaaaagaattctcggatatggaagaaatcaatttcctggaaccttgcgccggtgatggtgctatctgcagagaagtaaaaatgtttttcaataatcttgaaaaatcagtaaatattcattgcgttgaaatagaagatatctttaaaagcagtcttaaaggacaaggctttcatgtaatcggcagtgattttgaacaatttgaaaccatcccgttttatgatcttatatttatgaacccaccgttctcgaagggagcaacatttctcttaaaagcctatgatttattgaacgctgatggaaaagtcatttgtatcttaaactcacaaaccattaaaaatccgtgcaataaagacagggagttattgaaaaacctgattgctcgggttggagatgttaaatatttaaccaatgctttttctgagtcaaaccgtaaaaccgatattgaaatcgcagtggtctatcttagaaaacctttatatgaaaacgagtttgattttttcggtggtgttcaaacagaaatcttgagcgatgaggaaaaaatacgagaacagctcaaggacaaggttaatagcagccaactcatttcatttgataaggtggattatgcaataaacgtttacaggagttctgtacagcaaatttttacagggattgaacaatcaatagcaaaaaaacagctcagccacacagcccnntaa

SEQ ID NO: 9304 - protein, 261 aa, Unknown
  Obtained from environmental sample
  misc_feature (1)..(261): Xaa is any amino acid
MNRILLHTIKRHQYYPTPAELVHDILEYFKKEFSDMEEINFLEPCAGDGAICREVKMFFNNLEKSVNIHCVEIEDIFKSSLKGQGFHVIGSDFEQFETIPFYDLIFMNPPFSKGATFLLKAYDLLNADGKVICILNSQTIKNPCNKDRELLKNLIARVGDVKYLTNAFSESNRKTDIEIAVVYLRKPLYENEFDFFGGVQTEILSDEEKIREQLKDKVNSSQLISFDKVDYAINVYRSSVQQIFTGIEQSIAKKQLSHTAX

SEQ ID NO: 9305 - DNA, 342 bp, Unknown
  Obtained from environmental sample
  misc_feature (1)..(342): n is a, c, g, or t
atgtataaaaatgtttttgataaagaattagccagtggtataacttataatggatatatgttttatggtcaatgtgactatttagtagaacaatattcaaataatatagcactacaactagcaaatggtgaggatatccaaaaaatatattttgatgaatatgattttaaagagtgtagtaattttttatctcaatcatctttatttagtgcaaataatatcttgcttataaagagtgttaaaactatccctaaaaaagaggtggatgctcttcttgatatttgttcaacaaatagtgatagcaaagtgattttttgctgtatcggggaaacagatttttaa

SEQ ID NO: 9306 - protein, 113 aa, Unknown
  Obtained from environmental sample
  misc_feature (1)..(113): Xaa is any amino acid
MYKNVFDKELASGITYNGYMFYGQCDYLVEQYSNNIALQLANGEDIQKIYFDEYDFKECSNFLSQSSLFSANNILLIKSVKTIPKKEVDALLDICSTNSDSKVIFCCIGETDF

SEQ ID NO: 9307 - DNA, 648 bp, Unknown
  Obtained from environmental sample
  misc_feature (1)..(648): n is a, c, g, or t
ttgcaagagcaattttcaacattttgtaacaaaaaccacttcaaagatatggagcaagctatcgaatattttaccgtgtttggtggacttgatgaacaaatagatacaactattcctatagaaaaatcaattgaagagttaattttagatgagtataaatattatagaaaccaagtagctgacctttgtacttcagatccattattacaagctattttaagtggtgttgcacttggtgatagaagaacaaactctgcatttagaagagcacaagtttcttttaaaaatggtatggagtgtgtagatgaattaagggatatgggtgtattaaaagtggagtcaactatgcaccacctcacaaaccaagcaaatcaaggggatatatctaaaaaacttatcatcactacaccatttttacgattttggtttgcgtttgtatctccctatattcaaaggaatacgagatggggattacaaagagtttttcaccaaacttcaaaaatcaaaaagaaggaattccccaaactacattttttcaagcaacttttgtccatggagtattgtaaaaagaaaccaagttttccaagaaaaaaaaaccttatcccttttaagggggacccgggtaagaaattattttgtgggaattga

SEQ ID NO: 9308 - protein, 215 aa, Unknown
  Obtained from environmental sample
  misc_feature (1)..(215): Xaa is any amino acid
MQEQFSTFCNKNHFKDMEQAIEYFTVFGGLDEQIDTTIPIEKSIEELILDEYKYYRNQVADLCTSDPLLQAILSGVALGDRRTNSAFRRAQVSFKNGMECVDELRDMGVLKVESTMHHLTNQANQGDISKKLIITTPFLRFWFAFVSPYIQRNTRWGLQRVFHQTSKIKKKEFPKLHFFKQLLSMEYCKKKPSFPRKKNLIPFKGDPGKKLFCGN

SEQ ID NO: 9309 - DNA, 633 bp, Unknown
  Obtained from environmental sample
  misc_feature (1)..(633): n is a, c, g, or t
atgtttttacctacaacaaaagaagagatgaaccagcttggttggtctggctgtgatgtaatacttataagtggagatgcttatatagatagcccatttattggtgttgctgttgtggggagaatgttagaaaaacttggatacaaagttggtatcataggtcaacctgatataaatagtgatacagatataaaaagacttggtgagcccagactctattggggggttagtggtggaagtattgactcaatggttgcaaactacaccgcaacaaaaaaatttcgaaatactgatgattatacccctggtggaaaaaatacaaaaagacctgatcgtgctgttttaatatatacaaacttaatacgaagatattttaaaaatactgtacctattgttctaggaggtatagaagctagtttacgaagagttacacactatgactactggcaaaataaactcaaaaaaccaattttatttgatagtaaagcagatattatcatctatggtatgggtgaaattgctttaagagaactcacaattgcacttgatagtggtaaagagtacaaaaatatacgaggtatctgttatatagcaaaagaggcagttgaagattatcatcaactccctgtttga

SEQ ID NO: 9310 - protein, 210 aa, Unknown
  Obtained from environmental sample
  misc_feature (1)..(210): Xaa is any amino acid
MFLPTTKEEMNQLGWSGCDVILISGDAYIDSPFIGVAVVGRMLEKLGYKVGIIGQPDINSDTDIKRLGEPRLYWGVSGGSIDSMVANYTATKKFRNTDDYTPGGKNTKRPDRAVLIYTNLIRRYFKNTVPIVLGGIEASLRRVTHYDYWQNKLKKPILFDSKADIIIYGMGEIALRELTIALDSGKEYKNIRGICYIAKEAVEDYHQLPV

SEQ ID NO: 9311 - DNA, 843 bp, Unknown
  Obtained from environmental sample
  misc_feature (1)..(843): n is a, c, g, or t
ttggtagttaatattgatgattttaaagagattaatgacttctttggacaagcagtaggagatcgtgttcttatatctttttcaaaaaaattatctaatataattacaaaaaagtctaatattacacttatacatatttctggtgatgaatttgccttgttttttgcaaaaaaaccctctaaagatcagtttgtagagttcacaacaacacttcttgaaaaagttgaaaaaatgattttttatcatgaaaataatgaattaactttacgggtaactattggtggtgcttatcaaattcaagaagctttagaaaaagcagatattgctttaaaatcagcaaaaaaacaggggaaagattttttactttatgatgaaactttaaatgttgaacaacaatataaaaacaatatggagtggacaaagaaaatcaacttagctattgaaaatgataaaataagtgctttttttcaacctatatttgataataaaacaaataaactcgtaagtgctgaatgtttaattcgtttaattgatgacgatagtaacattataactccatatcactttttaactattgcaaaaaaaagtaagctttactctaaactaacaaagataatgattcaaaaaagttgtcaatactttgaacatttagattgtgatttttctattaacttatcggttgaagatatactcgatattgagattactgaatatatctcacataatataaaaaaatacaatgtaagtaaaaaaattatatttgaacttttagaaacagaaggtattgaaaactatgaagaggtttcttcttttaataatgagatgaaatccctagggtggtag

SEQ ID NO: 9312 - protein, 280 aa, Unknown
  Obtained from environmental sample
  DOMAIN (135)...(279): EAL domain
  misc_feature (1)..(280): Xaa is any amino acid
MVVNIDDFKEINDFFGQAVGDRVLISFSKKLSNIITKKSNITLIHISGDEFALFFAKKPSKDQFVEFTTTLLEKVEKMIFYHENNELTLRVTIGGAYQIQEALEKADIALKSAKKQGKDFLLYDETLNVEQQYKNNMEWTKKINLAIENDKISAFFQPIFDNKTNKLVSAECLIRLIDDDSNIITPYHFLTIAKKSKLYSKLTKIMIQKSCQYFEHLDCDFSINLSVEDILDIEITEYISHNIKKYNVSKKIIFELLETEGIENYEEVSSFNNEMKSLGW

SEQ ID NO: 9313 - DNA, 504 bp, Unknown
  Obtained from environmental sample
  misc_feature (1)..(504): n is a, c, g, or t
atgagtataaaaaacaaaaaaatcaataaacaatcaaatcagtcaaaacagattaagtatgcatctttttctaaaagagccattgcttttattacggatctttttatgataggcattcctattagtattattataatgcttctttttggatacgatgcggtacatagtgctggaggagtagaccttttggtagatcctgaaaatgccaaaaaaaatgcaccctcacctgttagctctatcgcacagatagtactgtcatttgtagcatatatacttttttggaaaaaaggtggtcaaacacctggtaaaaagatgtttagtataaaagtagtagatagcacaacattagaaactgcatcatggttaaagttgattatacgttttataagttacttcatatcaatgctgacaattataggtttctttattggagtcctacgcaaagataacaggactctacatgatctgctaagtggtacagctgtaatagtttgtgaagagtag

SEQ ID NO: 9314 - protein, 167 aa, Unknown
  Obtained from environmental sample
  DOMAIN (20)...(164): RDD family
  misc_feature (1)..(167): Xaa is any amino acid
MSIKNKKINKQSNQSKQIKYASFSKRAIAFITDLFMIGIPISIIIMLLFGYDAVHSAGGVDLLVDPENAKKNAPSPVSSIAQIVLSFVAYILFWKKGGQTPGKKMFSIKVVDSTTLETASWLKLIIRFISYFISMLTIIGFFIGVLRKDNRTLHDLLSGTAVIVCEE

SEQ ID NO: 9315 - DNA, 711 bp, Unknown
  Obtained from environmental sample
  misc_feature (1)..(711): n is a, c, g, or t
atggtttatcagccacaaattaaactatcaactaaaaagatatgttcattagagtctttaataagatgggagtctaaagagttgggttttatatctcctgctgtttttataccaatagcagaaaagagaggcttaattacggaagtaggaaattggataattgacgaagtgtgcaagcagataaataggtggctagagttaaaaaatgatattttcagagtctcaattaatatctcatcagcgcaaattacagataaaagagcactagaaaatatcatctcaattattgaaaagaacagagttgatcttaaatatatagaactagagtttacagagactatgcttcttagcattgataaagagactcaacagtatatgaagattttacagcatcgcggtattacctatgccatagatgattttggtacaggctattcatccatgtcttcacttagacaaataaaagctgataagttaaaaatagatatggagtttatacaagatgtacttgatgataaagatgatcaagagataataaaagcaactattgcactaggacatgcactaaatatgcagattgttgctgagggtgcagaagagttagatcaggtgaaaattttacaagagtatggatgtaatataattcaaggttattattacgctaaaccaatgatgccagaaatgatagagtttgataaaatatttaaataa

SEQ ID NO: 9316 - protein, 236 aa, Unknown
  Obtained from environmental sample
  DOMAIN (2)...(223): EAL domain
  misc_feature (1)..(236): Xaa is any amino acid
MVYQPQIKLSTKKICSLESLIRWESKELGFISPAVFIPIAEKRGLITEVGNWIIDEVCKQINRWLELKNDIFRVSINISSAQITDKRALENIISIIEKNRVDLKYIELEFTETMLLSIDKETQQYMKILQHRGITYAIDDFGTGYSSMSSLRQIKADKLKIDMEFIQDVLDDKDDQEIIKATIALGHALNMQIVAEGAEELDQVKILQEYGCNIIQGYYYAKPMMPEMIEFDKIFK

SEQ ID NO: 9317 - DNA, 534 bp, Unknown
  Obtained from environmental sample
  misc_feature (1)..(534): n is a, c, g, or t
atgccaggaagcagaaagggagagataacaaagcttatgcctctatacaaagagataattacgcaaatagatgaagaacctattttaataataccccctcattttaatgatgaatatataaaagaagtttatggagatatcagtgattttaccatatcaaaagagactcataaaactcttcaagaggttgattttgcatttatttgtagtggaacagctaccctggaagcagctcttataggaaccccttttgttttaaactatattgctaaaaaattagattattttataggaaataacttagtaaaaatcaactttattggacttgcaaatatcttctttgaaaaaatgggcaaagagccaatccataaagaatatgttcaagaaaatgtaacagttgaaaacctattaaatgaatataaaaatctcaacagagaaaagtttttagaaaattctaaaattttaagagagtatttaaaacatggaagtagtaaaaatgttgcagatattctttgtaaaactacaaatcaatag

SEQ ID NO: 9318 - protein, 177 aa, Unknown
  Obtained from environmental sample
  misc_feature (1)..(177): Xaa is any amino acid
MPGSRKGEITKLMPLYKEIITQIDEEPILIIPPHFNDEYIKEVYGDISDFTISKETHKTLQEVDFAFICSGTATLEAALIGTPFVLNYIAKKLDYFIGNNLVKINFIGLANIFFEKMGKEPIHKEYVQENVTVENLLNEYKNLNREKFLENSKILREYLKHGSSKNVADILCKTTNQ

SEQ ID NO: 9319 - DNA, 318 bp, Unknown
  Obtained from environmental sample
  misc_feature (1)..(318): n is a, c, g, or t
gtgaagggggttatagtaaaagaccccaactttaaactatcatacaggaagaagtccccatatattaaaagtaaaaaagcccaagatatggagggtatagttattggacataactatagaaaagatggtagaactttaaaaagtttgaaaatcaaattacacaatggtgtagtgtttaatcttggaggaggatttagtgataaacaacgactaaaacctcctcaaataggtggaaaggttactttcaaattttataactttacaaaaaatggtaaacctaaatttgcgagttttttgaggataagagaaaaagagtaa

SEQ ID NO: 9320 - protein, 105 aa, Unknown
  Obtained from environmental sample
  misc_feature (1)..(105): Xaa is any amino acid
MKGVIVKDPNFKLSYRKKSPYIKSKKAQDMEGIVIGHNYRKDGRTLKSLKIKLHNGVVFNLGGGFSDKQRLKPPQIGGKVTFKFYNFTKNGKPKFASFLRIREKE

SEQ ID NO: 9321 - DNA, 639 bp, Unknown
  Obtained from environmental sample
  misc_feature (1)..(639): n is a, c, g, or t
gtgcaaacaaatgactcacaaataagaagctcaaatcacttaacagtagaagccttagctaaaaaacatggttgtgaagtaaaccaaatgggtatagtaaaagatgataaagaatctattacaaacttattaaaaacagctctacagagttcagatattgttgtaacaactggtggagtgagtgttggggattatgattttgtaaaagatgttattattgaagatttaaggtgtgagatattatttcaaggggcaaatatcaaaccagggaaacctattttatttgctcgcaaagataataagtttatcataggacttccaggatttgcatactctagtacagtaacttgtatactctatgttctaccacttatttttaaactaaaaaattcaaatgaatcgttacagatagttgaagcaatcatcgatgaaagctttccaatgaagtttgataaaactacttttagtgcttgtaatgttcactattgtaatggtgagtatcatattgattttgatgggaaaagaaaagggactagtgctattttaacgaatatgttgggtagtcctgggttgcttatgcaagatgttgggagccagtctttgaataaaggggatagagttaaggttattttactttaa

SEQ ID NO: 9322 - protein, 212 aa, Unknown
  Obtained from environmental sample
  DOMAIN (3)...(120): Probable molybdopterin binding domain
  misc_feature (1)..(212): Xaa is any amino acid
MQTNDSQIRSSNHLTVEALAKKHGCEVNQMGIVKDDKESITNLLKTALQSSDIVVTTGGVSVGDYDFVKDVIIEDLRCEILFQGANIKPGKPILFARKDNKFIIGLPGFAYSSTVTCILYVLPLIFKLKNSNESLQIVEAIIDESFPMKFDKTTFSACNVHYCNGEYHIDFDGKRKGTSAILTNMLGSPGLLMQDVGSQSLNKGDRVKVILL

SEQ ID NO: 9323 - DNA, 657 bp, Unknown
  Obtained from environmental sample
  misc_feature (1)..(657): n is a, c, g, or t
ttgggcaatataaagaaaggaaaaataacgtacganagaagacaaaacttatataagactttgggggaacgagcaaagcaatggataaaagaaaaagatagaattaagattgaagtttttgaactaacattcacagattctgcgtcattatttggattgaagcctaccgatattgcagatcctacaccatggggaacaaacagaaatactgtatatagagacttgaataccactcgtttttacagcatcagagacatgtggggcgaagatgtgcacattgaagatgaacttcctaaccgcgattggaaaatgacagatagtaaaaggaacatagctggttttgattgtcgaaaagctttttggcaagtagatgacactactaggatttacgcttggtattgtgaagaaatcattccaactattggccctgagcgttttcatggtttgcctggcgcaattctcggaatagcaagtgaggatggaggaacggtttattttgctactaaaattgatttctatcagcctaaacccgaagagttagaaataaaaaaatccaaaaaggtacagaccatggaagaaacaagggagcagatagaaatagctgcgagtaaaagtaagtggttgaaagttaatgttgatcattactttatttggtag

SEQ ID NO: 9324 - protein, 218 aa, Unknown
  Obtained from environmental sample
  misc_feature (1)..(218): Xaa is any amino acid
MGNIKKGKITYXRRQNLYKTLGERAKQWIKEKDRIKIEVFELTFTDSASLFGLKPTDIADPTPWGTNRNTVYRDLNTTRFYSIRDMWGEDVHIEDELPNRDWKMTDSKRNIAGFDCRKAFWQVDDTTRIYAWYCEEIIPTIGPERFHGLPGAILGIASEDGGTVYFATKIDFYQPKPEELEIKKSKKVQTMEETREQIEIAASKSKWLKVNVDHYFIW

SEQ ID NO: 9325 - DNA, 486 bp, Unknown
  Obtained from environmental sample
  misc_feature (1)..(486): n is a, c, g, or t
gtggaattccacaatggcaaaaccatgacggcagaagatgtgattttttccatcaaccaccatctcagtaaagaatccaaatctgcagcaaaaggcaatttaggaagtatcgtaaatataaaagcggacggaaagaatgaagttgtttttgaactttccggaggcagcgctgactttccctttatcctgggtgattatcacttgagcatttgtccggccggaaccaagggtgtcgaatttgaaaagggaataggcacaggcggttatatcctggaaaattatgaacccggtgtcagggcctcttcaaaacgcaaaccgaattattggaaagaaggaccagcacactttgatgaaattaagacgatttccatcgctgactcaaacgccagaacaactgccttaaaaacgcatcaaatagactatatggaatcgggttggactttaaaacccgtccattctattgaaaaaaaaatgccccggccttaa

SEQ ID NO: 9326 - protein, 161 aa, Unknown
  Obtained from environmental sample
  DOMAIN (44)...(142): Bacterial extracellular solute-binding proteins, family 5 Middle
  misc_feature (1)..(161): Xaa is any amino acid
MEFHNGKTMTAEDVIFSINHHLSKESKSAAKGNLGSIVNIKADGKNEVVFELSGGSADFPFILGDYHLSICPAGTKGVEFEKGIGTGGYILENYEPGVRASSKRKPNYWKEGPAHFDEIKTISIADSNARTTALKTHQIDYMESGWTLKPVHSIEKKMPRP

SEQ ID NO: 9327 - DNA, 468 bp, Unknown
  Obtained from environmental sample
  misc_feature (1)..(468): n is a, c, g, or t
atgagttttaacgctgaaaacctaaaaaagatagatgagttaaaaacaagatatccaaaacctcaggcactctctctgcctctgctttggatgtcgcagtatcaagatggatttatttcacttgaagccataaaagagattgcagaacattgtgaagttccacccatggagatctacaaggttgctactttttacactatgtttaatcttgaaaaagttggaaagtatcatattcagctctgtaaaacactctcatgtaaactaaactcaaaagatgagatactgagctccataaaagagatgctaaacattgaggtaggcaacacaacggatgataatctcttcactctcaatcaagttgagtgtttaggctcatgtggaagcgcacctgtcatgcagataaatgatatctactatgagaatctcacgccacaaaaagtagaaaagattttaaaggagcttaaatga

SEQ ID NO: 9328 - protein, 155 aa, Unknown
  Obtained from environmental sample
  DOMAIN (1)...(155): Respiratory-chain NADH dehydrogenase 24 Kd subunit
  misc_feature (1)..(155): Xaa is any amino acid
MSFNAENLKKIDELKTRYPKPQALSLPLLWMSQYQDGFISLEAIKEIAEHCEVPPMEIYKVATFYTMFNLEKVGKYHIQLCKTLSCKLNSKDEILSSIKEMLNIEVGNTTDDNLFTLNQVECLGSCGSAPVMQINDIYYENLTPQKVEKILKELK

SEQ ID NO: 9329 - DNA, 642 bp, Unknown
  Obtained from environmental sample
  misc_feature (1)..(642): n is a, c, g, or t
atgaatgaacctataaaaatattaattgcagacgaccaccaaatgtttattgatggtattaaatctttattaagaaaagaagctggaatacagtttattggagaggtaaataatggtaatgatgcttttgagtttttaaaaaaccatgtggtagatttagtaattgcagatattagcatgccgggaatagatggaattgaactgacaaaaaaaataaaacagttttatcccgaagtaaaagtattagtgatttctatgcatgatgataaacaaataataagtgaaattttattggcagaagccgaaggatatatcttaaaaaacacagggaaagctgaattaattactgccataaagaatataaatgaaggcagcactcattatagtaaagaagtactttctataatgatgaagcaggtaaaaaagcaagaagctaccaacaaagaaattaagttacttacagaaagagaattagaaatactaagtctcatcgttcaagaatattcaactgttgccattgccgagcgactttttattagtccgaggacagttgatacacaccgtaaacacatcatgcaaaaaacaaattcaaaaacaataattggattaatcaaatttgcattttacaatggattaatctaa

SEQ ID NO: 9330 - protein, 213 aa, Unknown
  Obtained from environmental sample
  DOMAIN (150)...(207): Bacterial regulatory proteins, luxR family
  misc_feature (1)..(213): Xaa is any amino acid
MNEPIKILIADDHQMFIDGIKSLLRKEAGIQFIGEVNNGNDAFEFLKNHVVDLVIADISMPGIDGIELTKKIKQFYPEVKVLVISMHDDKQIISEILLAEAEGYILKNTGKAELITAIKNINEGSTHYSKEVLSIMMKQVKKQEATNKEIKLLTERELEILSLIVQEYSTVAIAERLFISPRTVDTHRKHIMQKTNSKTIIGLIKFAFYNGLI

SEQ ID NO: 9331 - DNA, 822 bp, Unknown
  Obtained from environmental sample
  misc_feature (1)..(822): n is a, c, g, or t
gtgggagctcaatgtaatgttgattctgcatcatattttgctgaattatcatcaaaacacactgaattgggtttaaagagttttgataaaggagattttgtttctgctttagatcatttttttatttcattaagaatttgtgaaaaaacaaatgaccaacaaaagatggctcaattatacaacaacatatctgctacttacaataatacagaaaagtacaatttggcagaaacctatgctaaaaaagcgattttaataaataaaaaattaggtaataaaaaagaattggccaatgctctaaattcactaggtaacgtgtactacatggagatgaaggattcactttctttagattgttataaggaatctataaaatatagattgatgataaacgactctgcagggcttttcagccaatataagaatataggtgctttatattatgaaataggagatacggcaaaagctattcaaaatttagagaaaagtatattattccttaaggttattgacgacaaagcagaatggtttagttcttacctaactttcgcagaactttatatttattctggtaatttaagcaaaggcaaaacttatcttgacagttgtactttactagtgtcagaagtgaaatctattcaaatgattgatgattattattatgctaattatatgtattataaaaagttaaaaaactttgaatttgcactggtaaactatgttaattatataaattataaggatagtgttgaaaatattgaaaaacatcaacaaatttcccgaaatagaaacaaaataccaaaccgaaaaaaaaagagctga

SEQ ID NO: 9332 - protein, 273 aa, Unknown
  Obtained from environmental sample
  misc_feature (1)..(273): Xaa is any amino acid
MGAQCNVDSASYFAELSSKHTELGLKSFDKGDFVSALDHFFISLRICEKTNDQQKMAQLYNNISATYNNTEKYNLAETYAKKAILINKKLGNKKELANALNSLGNVYYMEMKDSLSLDCYKESIKYRLMINDSAGLFSQYKNIGALYYEIGDTAKAIQNLEKSILFLKVIDDKAEWFSSYLTFAELYIYSGNLSKGKTYLDSCTLLVSEVKSIQMIDDYYYANYMYYKKLKNFEFALVNYVNYINYKDSVENIEKHQQISRNRNKIPNRKKKS

SEQ ID NO: 9333 - DNA, 603 bp, Unknown
  Obtained from environmental sample
  misc_feature (1)..(603): n is a, c, g, or t
atgtttttaggggatgttgctaaaaagaatacttctaaaataacctttgcagaccaaaaagtaacagacgtttttaaaagtgatttacaaggaagctatcaatcaaagaatatcataacggtattacaaacaatcaaagaacttcaacaaaaagggtataaaatttccaaaaagcagattcaagacggcttattacatgttgttaagaataccggattattagggcgttggcaacagatacattcaaaccctaaagttatttgcgatacggcacataataaagatggattagcatatgttatgaaacaagtttcagaacaagattttgaaacattacatgttgtgtttggcgttgttaatgataaagatttagtatctattatgcatttattacccaaaaaggcaatttattatttctgtaaacctaatataccacgtggtttagatgctcatgttttaaaggatgatatgaatacatatggttttcaaggtgacgcttatcattcagtaaatgaggcatataaggaagctttgagtagggcgaacagcaatgattttatatttgttggtggaagcacatttgttgttgcagaaataatttaa

SEQ ID NO: 9334 - protein, 200 aa, Unknown
  Obtained from environmental sample
  misc_feature (1)..(200): Xaa is any amino acid
MFLGDVAKKNTSKITFADQKVTDVFKSDLQGSYQSKNIITVLQTIKELQQKGYKISKKQIQDGLLHVVKNTGLLGRWQQIHSNPKVICDTAHNKDGLAYVMKQVSEQDFETLHVVFGVVNDKDLVSIMHLLPKKAIYYFCKPNIPRGLDAHVLKDDMNTYGFQGDAYHSVNEAYKEALSRANSNDFIFVGGSTFVVAEII

SEQ ID NO: 9335 - DNA, 591 bp, Unknown
  Obtained from environmental sample
  misc_feature (1)..(591): n is a, c, g, or t
atgaattacttgagtaggaaatcgaaagaggcgcctaaaattagaaaagagatgatctttgcagttgtcttttcagtaattgtatttagtggaacatacggtaaaatttttccattttcatttgtgattgatttaggtgaggagataactgattcctggtcgaatgaaaataacgagcctccaattccacatgctgaggaattatcaattgcagagtttgcgcgaattcaaaaaattccagtggaaaaatatcaacaacttcttaagcaaaatggatacttggtttcagacacttcaactacactacagcaaattgctgaccaatataatgttaccccaagtgcaattggaaaagttattccgaatagtagcgcggttagttcaaccagtacttccatttataaatcaggttcaaggtatgggagaaaactattatccgaaatcattaaagaaaataatttaaattggaaagagagtattgcaaaattgaattcaaatggaattgttattgaaaatgatgacaaacttaagaatattgcaaatgataatagtgttttaccaatcgatattataaaaatattggaattgtga

SEQ ID NO: 9336 - protein, 196 aa, Unknown
  Obtained from environmental sample
  misc_feature (1)..(196): Xaa is any amino acid
MNYLSRKSKEAPKIRKEMIFAVVFSVIVFSGTYGKIFPFSFVIDLGEEITDSWSNENNEPPIPHAEELSIAEFARIQKIPVEKYQQLLKQNGYLVSDTSTTLQQIADQYNVTPSAIGKVIPNSSAVSSTSTSIYKSGSRYGRKLLSEIIKENNLNWKESIAKLNSNGIVIENDDKLKNIANDNSVLPIDIIKILEL

SEQ ID NO: 9337 - DNA, 300 bp, Unknown
  Obtained from environmental sample
  misc_feature (1)..(300): n is a, c, g, or t
atgaaaataacgagcctccaattccacatgctgaggaattatcaattgcagagtttgcgcgaattcaaaaaattccagtggaaaaatatcaacaacttcttaagcaaaatggatacttggtttcagacacttcaactacactacagcaaattgctgaccaatataatgttaccccaagtgcaattggaaaagttattccgaatagtagcgcggttagttcaaccagtacttccatttataaatcaggttcaaggtatgggagaaaactattatccgaaatcattaaagaaaataatttaa

SEQ ID NO: 9338 - protein, 99 aa, Unknown
  Obtained from environmental sample
  misc_feature (1)..(99): Xaa is any amino acid
MKITSLQFHMLRNYQLQSLREFKKFQWKNINNFLSKMDTWFQTLQLHYSKLLTNIMLPQVQLEKLFRIVARLVQPVLPFINQVQGMGENYYPKSLKKII

SEQ ID NO: 9339 - DNA, 504 bp, Unknown
  Obtained from environmental sample
  misc_feature (1)..(504): n is a, c, g, or t
atggtggtctccaatcctcgatttgttttagatatcaatgatttacatatctcaaaaaatttaaaaaaaacaataagaaaaaaaatctttgaagtaaaatttgatataaactttgaacaagtaatcaaagagtgtgcaaaagcaaaaagaccagatcaagagggtacttggataactactgatatgcttgaagcatattgtgatttacataaagctggatttgcccatagttttgaatcttatgaagatggcaagttagttggtggtggctatggtgtggttattggtgatatcttttgtggagagtcaatgtttgctcttaaaagtgatgccagtaaagtagcttttgtagcactagttgagagactaaaaaataatggatttagtttaattgatagtcagatttatacagaatatttagcttcctttggagcaaaagagataccacgagatacctatttatccttagtagaaaaagcattacataatccaaaaaacttttaa

SEQ ID NO: 9340 - protein, 167 aa, Unknown
  Obtained from environmental sample
  DOMAIN (1)...(150): Leucyl/phenylalanyl-tRNA protein transferase
  misc_feature (1)..(167): Xaa is any amino acid
MVVSNPRFVLDINDLHISKNLKKTIRKKIFEVKFDINFEQVIKECAKAKRPDQEGTWITTDMLEAYCDLHKAGFAHSFESYEDGKLVGGGYGVVIGDIFCGESMFALKSDASKVAFVALVERLKNNGFSLIDSQIYTEYLASFGAKEIPRDTYLSLVEKALHNPKNF

SEQ ID NO: 9341 - DNA, 465 bp, Unknown
  Obtained from environmental sample
  misc_feature (1)..(465): n is a, c, g, or t
atgaataactcggtagaaacagcagcacgtcaacatgccgtaaatctatatcaccagggtctgaaagtaagcgaaatatgccagcaagtgaaccgtagtagaacctggttctacaaatggctttatcggtatcaatcaggtcaaccaaactggtatgaggatctttcgaagacaccacataaaatcgccaataaaacaccagccaaattagtcaaagtaatcttgaaaatccgtaaagatctcgaagaaacaaaaagatcacggaccagtgcaaaaactatccaaaatcgcttgatgattctgggatgggatcctttacccatccgaacaatcaatcgtatcctgaaacagcatcatagctcttgtaagaagcaacccggtccccaaggaaacaaagccaccaatctaatttccaatcagccttttaaacaaccatccctgtttgaaaatatcccagcgggatga

SEQ ID NO: 9342 - protein, 154 aa, Unknown
  Obtained from environmental sample
  misc_feature (1)..(154): Xaa is any amino acid
MNNSVETAARQHAVNLYHQGLKVSEICQQVNRSRTWFYKWLYRYQSGQPNWYEDLSKTPHKIANKTPAKLVKVILKIRKDLEETKRSRTSAKTIQNRLMILGWDPLPIRTINRILKQHHSSCKKQPGPQGNKATNLISNQPFKQPSLFENIPAG

SEQ ID NO: 9343 - DNA, 867 bp, Unknown
  Obtained from environmental sample
  misc_feature (1)..(867): n is a, c, g, or t
ttggctttaaataaatttacagagtattataataaagataatactctgttactctttttgaattttgaagcttctatgatagatgaagatattgattctagttttttacacaatgtagataactgcaatatcccttatcaaaatattattatagagataaaagaagacagtgttaaaaataactatgccctagaaaagtttgttgtaaaatacagagagttagattttttaattggtgtggatgattttggcactggctattccagttttgataggcttgctttaattaagccagatattgtaaagcttgatcgatctttaatatatgatattgataaaaactacataaactcagagattcttacttctatagcaaatatgtgtcataaaataggtgctgtagttttagctgagggtgttgaaaagaataatgaaatagtaacttgtatgacaaaagacatagatatttatcaaggttttttcttttcaaaagcacaaaatagcattgataaaaatataaatgatatagtagtagataaaatagagataattcacaaagaatataaactattactaaaagagtattacgaaaaagagaaaaaacttttaaaaagatcaaaaaaaatcattaaaaaaacattagatattttaaatagtaatacacaagattatagaaaacagataacacaaataattaaaaacgataatcacatagaagcgatataccttcttgatttagagagtggattacaaattggggagacaattatagaagagataaatcaaagatggtatacagccctacaagtgatggacatgaccatagttttaaagagtattatttatatccaaagactccaaaaataa

SEQ ID NO: 9344 - protein, 288 aa, Unknown
  Obtained from environmental sample
  DOMAIN (2)...(165): EAL domain
  misc_feature (1)..(288): Xaa is any amino acid
MALNKFTEYYNKDNTLLLFLNFEASMIDEDIDSSFLHNVDNCNIPYQNIIIEIKEDSVKNNYALEKFVVKYRELDFLIGVDDFGTGYSSFDRLALIKPDIVKLDRSLIYDIDKNYINSEILTSIANMCHKIGAVVLAEGVEKNNEIVTCMTKDIDIYQGFFFSKAQNSIDKNINDIVVDKIEIIHKEYKLLLKEYYEKEKKLLKRSKKIIKKTLDILNSNTQDYRKQITQIIKNDNHIEAIYLLDLESGLQIGETIIEEINQRWYTALQVMDMTIVLKSIIYIQRLQK

SEQ ID NO: 9345 - DNA, 432 bp, Unknown
  Obtained from environmental sample
  misc_feature (1)..(432): n is a, c, g, or t
atgatttcagtagcaacaaaagagaatacaaaagagctttttaaccttgaaagttctgtattttccaaagatgattttggactaagtgtaggttctttttattaccacataaaaagaaatcatctttttgtttataaacaagataataaaattgtgggatatattttgtggctaaaaagaaaaaacaattatagactctactctttgtgtataaaaaaagagtttcaaggtcagggtattgcaacaaaacttttagaatattcttttaaaatattagaaacaaaaagtttcactttagaggtaaaaactataaataaaagtgccataaaactttatgaaaaaaacaatttcaaaatcaaaaaagttttaaagaactactatcctaacaatattgatgggtatttgatgtatcgaagttcaaatggcatttag

SEQ ID NO: 9346 - protein, 143 aa, Unknown
  Obtained from environmental sample
  DOMAIN (43)...(118): Acetyltransferase (GNAT) family
  misc_feature (1)..(143): Xaa is any amino acid
MISVATKENTKELFNLESSVFSKDDFGLSVGSFYYHIKRNHLFVYKQDNKIVGYILWLKRKNNYRLYSLCIKKEFQGQGIATKLLEYSFKILETKSFTLEVKTINKSAIKLYEKNNFKIKKVLKNYYPNNIDGYLMYRSSNGI

SEQ ID NO: 9347 - DNA, 438 bp, Unknown
  Obtained from environmental sample
  misc_feature (1)..(438): n is a, c, g, or t
ttgtataattcaaaaaaaataaatttgaggaaaaaaatgaaaacgaaaaaacaaattgtagagtcatattatgaaaatctatggaataagcaagataaaacttacatagataagttattcgatgacaatattgtttttagaggttctttaggaattgaaactagaggaaaagagggctttatagaatactttgatatgataacaactgcaataccaaatttgtatcatgggattgaagtattgattgttgaagataatcaagtagctgttcgagctgtgtataatggtacacataagggaaaattatttgattttgaagcaacaaataatagaataaaatataatggtgcatcattttttaaaattgaaaatgaaaaaatagttgagatttgggttcttggggacttaaatgttttatataaacaattaggaaaataa

SEQ ID NO: 9348 - protein, 145 aa, Unknown
  Obtained from environmental sample
  DOMAIN (29)...(143): Protein of unknown function (DUF1486)
  misc_feature (1)..(145): Xaa is any amino acid
MYNSKKINLRKKMKTKKQIVESYYENLWNKQDKTYIDKLFDDNIVFRGSLGIETRGKEGFIEYFDMITTAIPNLYHGIEVLIVEDNQVAVRAVYNGTHKGKLFDFEATNNRIKYNGASFFKIENEKIVEIWVLGDLNVLYKQLGK

SEQ ID NO: 9349 - DNA, 315 bp, Unknown
  Obtained from environmental sample
  misc_feature (1)..(315): n is a, c, g, or t
atgtctgtacttcttgaatttgcgatgttcccaacagataaaaccggtgatagtgctagcgagtcggtaagtaaaattattgagatgattaataaaagcggtgcaacatataaattaaccgcaatggggactattgttgaaaccgaaacactggaagaggctttagacattgtaaataggtcatatcaggtgcttgagccattctcaaatagggtttattcgagtattaatttagatattagaaaaggtaaatcagatcgcttaaatcaaaaaattgaatctattgaatccagaattgggaaagtaaatcagtaa

SEQ ID NO: 9350 - protein, 104 aa, Unknown
  Obtained from environmental sample
  DOMAIN (3)...(96): Domain of unknown function DUF77
  misc_feature (1)..(104): Xaa is any amino acid
MSVLLEFAMFPTDKTGDSASESVSKIIEMINKSGATYKLTAMGTIVETETLEEALDIVNRSYQVLEPFSNRVYSSINLDIRKGKSDRLNQKIESIESRIGKVNQ

SEQ ID NO: 9351 - DNA, 345 bp, Unknown
  Obtained from environmental sample
  misc_feature (1)..(345): n is a, c, g, or t
atgattaaacgtacaacaggcattttattgttgatttttatttccatttttgctttctcgcagaaaaaggttaaaattgatttaaattcttcaaaacaaacattaaagaataaggaagttgtacaagatatttcgaatggaattataatttcggaaacaattacttcaatagaatttgtagagaaagaaacaaaagaaggaacttttgttgagctttactcagacagaatgactaagagtttcgataaaggaaaaccaaacctacctctaataagtcgattaatagatattcctttaaataagaaacccattgtaaaaatcgtgacttacgatgaaaaatcataa

SEQ ID NO: 9352 - protein, 114 aa, Unknown
  Obtained from environmental sample
  SIGNAL (1)...(18)
  misc_feature (1)..(114): Xaa is any amino acid
MIKRTTGILLLIFISIFAFSQKKVKIDLNSSKQTLKNKEVVQDISNGIIISETITSIEFVEKETKEGTFVELYSDRMTKSFDKGKPNLPLISRLIDIPLNKKPIVKIVTYDEKS

SEQ ID NO: 9353 - DNA, 513 bp, Unknown
  Obtained from environmental sample
  misc_feature (1)..(513): n is a, c, g, or t
ttgttagattataatcgcttaaagcatggcgacgaacatgagctacacacccagcccgttttgcccatcatcaaagaatccttggcatcccataaactgttgctcaaacagaaacagattcaggtaacattaccgaaacaggactgccctgggcgcgtaaacaaagcgttattacaacgggcgttaagcaaccttatttccaatgcatctgtttacggttgcgaaaagggactactcaaaatcacattagcgtctcaagatagtcagctcaaaatagagatcgggaacaccggcccggagattcctgactcggatttagcacaactgtttgatccattttatcaaggtgtcaataagcgccaaggatcggtcaaaggctccggtatcggtttaagtatcgcccgtgaatccatcaaagtgatgggtggtcatttagaacttcacagcaataaggatggttttgtcagctttatgatcagtattccaaaccaaggtaaaatatcccatgagtaa

SEQ ID NO: 9354 - protein, 170 aa, Unknown
  Obtained from environmental sample
  DOMAIN (53)...(164): Histidine kinase-, DNA gyrase B-, and HSP90-like ATPase
  misc_feature (1)..(170): Xaa is any amino acid
MLDYNRLKHGDEHELHTQPVLPIIKESLASHKLLLKQKQIQVTLPKQDCPGRVNKALLQRALSNLISNASVYGCEKGLLKITLASQDSQLKIEIGNTGPEIPDSDLAQLFDPFYQGVNKRQGSVKGSGIGLSIARESIKVMGGHLELHSNKDGFVSFMISIPNQGKISHE

SEQ ID NO: 9355 - DNA, 699 bp, Unknown
  Obtained from environmental sample
  misc_feature (1)..(699): n is a, c, g, or t
atgaaagatttttatgaacaacttatagaacatgaccttaatccatatttactatttgactcgagcggaaaggttaaaagctataataaagaagcagaatttttactcaactttgtaagtattaaagaactatttcaattagctgtttcaaatgctagtttaaattttggttttaaccataaatatatatcgttaaaatacaacaagcaatcatattacgccatacttgtagggtatgcaaatgatgatgagatagcacttcgactttataaagtagtatcaaacaccacccatactataaaagatgataaacttaaactagtaaatatttttagtttaatagatttatcaaaaaatagtaccctattacattcaaaactcaatataaatgagctgtatgatatctctatacctgaaattaaaataaatattaatgattttttattatgtttaaatgaatgtttttcaacctttaaagagaaacaaaacatctcactacaagtttatattaaaactggtgaatatgagatcataaatcaaaagaaatgtaaaattgtagcattagaatttatctctgaagaaaatctctcttttgataaaagtaatgaaaaaaaccttgaaacgaaagcacttaaatcaaatgcaaatgtattttttgaccataactctatcaaattagaacttccaatgatactctaa

SEQ ID NO: 9356 - protein, 232 aa, Unknown
  Obtained from environmental sample
  misc_feature (1)..(232): Xaa is any amino acid
MKDFYEQLIEHDLNPYLLFDSSGKVKSYNKEAEFLLNFVSIKELFQLAVSNASLNFGFNHKYISLKYNKQSYYAILVGYANDDEIALRLYKVVSNTTHTIKDDKLKLVNIFSLIDLSKNSTLLHSKLNINELYDISIPEIKININDFLLCLNECFSTFKEKQNISLQVYIKTGEYEIINQKKCKIVALEFISEENLSFDKSNEKNLETKALKSNANVFFDHNSIKLELPMIL

SEQ ID NO: 9357 - DNA, 408 bp, Unknown; identical to SEQ ID NO: 7255
  Obtained from environmental sample
  misc_feature (1)..(408): n is a, c, g, or t

SEQ ID NO: 9358 - protein, 135 aa, Unknown; identical to SEQ ID NO: 7256
  Obtained from environmental sample
  misc_feature (1)..(135): Xaa is any amino acid

SEQ ID NO: 9359 - DNA, 855 bp, Unknown
  Obtained from environmental sample
  misc_feature (1)..(855): n is a, c, g, or t
atggctcggcatttcactgatatactatcagcatcaacatttttatatgataaaacaaagcctcaagaagtatttaataaacatttagaacttgctgaaaaagaaaaatatccatatttttgtattgcagatgaaaatttttgtcaccctggctggcatattgaagtccaaacagcgttagagagaatgcttgaagtattaggaaaagatgatacggatgtagtacttattataagagaacaatgggattatttgagatcattctataaaaatatgataagaacaagtagtttccctcattcttatcaatatttttgtgaatatgttcttgatcatcacaatagttttttaatgccctatttaagatatgataaacttatagaaggtttaaataagattactccaaatttaaaagttataacgctttcagaattttcaaaaaagcaatcttggattcataaagaattaaatattaaaactggcataagtaaacattctaacaaagctttacctgattcttggatggaatggaaaaggagagagtcatttacaaaaaatatttataagcaagatgcctattataatagagttttttggccaacatataggaaaaaaattctcgatcaacctgatttgtttaaatcgttgaaaaatgaaatggataaaaaatataattatgaaacatggatcaaatataggctattccaagtaaaaaacttcttctttaaatataaaatagattatagtgttagtgatgaagtatataaaaatttagatgtaatatttaaaaaaagtaatttgaaaataaaagaagaattcaatatcaatattattgaatcaaagaataataaataa

SEQ ID NO: 9360 - protein, 284 aa, Unknown
  Obtained from environmental sample
  misc_feature (1)..(284): Xaa is any amino acid
MARHFTDILSASTFLYDKTKPQEVFNKHLELAEKEKYPYFCIADENFCHPGWHIEVQTALERMLEVLGKDDTDVVLIIREQWDYLRSFYKNMIRTSSFPHSYQYFCEYVLDHHNSFLMPYLRYDKLIEGLNKITPNLKVITLSEFSKKQSWIHKELNIKTGISKHSNKALPDSWMEWKRRESFTKNIYKQDAYYNRVFWPTYRKKILDQPDLFKSLKNEMDKKYNYETWIKYRLFQVKNFFFKYKIDYSVSDEVYKNLDVIFKKSNLKIKEEFNINIIESKNNK

SEQ ID NO: 9361 - DNA, 300 bp, Unknown
  Obtained from environmental sample
  misc_feature (1)..(300): n is a, c, g, or t
gtgggttatgaatttatcaatataaaaacagaaaaaataggagcttttgaaatctacaaagcggaattaaaaaaagacaatgaaattttacaaactgcttggtggtttgataatggtcaagaaaaaatcatcagccaattagagtggcgttggaaaacagctttgggcaatgaaccttatcgactaattaatgttacagccatttcagaagaagcacttaatggtcaaattaacgagctattattagttaatttatttcagcaacctaaaaatgaaatagtgttggatagtaaaagttag

SEQ ID NO: 9362 - protein, 99 aa, Unknown
  Obtained from environmental sample
  misc_feature (1)..(99): Xaa is any amino acid
MGYEFINIKTEKIGAFEIYKAELKKDNEILQTAWWFDNGQEKIISQLEWRWKTALGNEPYRLINVTAISEEALNGQINELLLVNLFQQPKNEIVLDSKS

SEQ ID NO: 9363 - DNA, 390 bp, Unknown
  Obtained from environmental sample
  misc_feature (1)..(390): n is a, c, g, or t
gtgataacaaaaactcctgaagtggtaaataaaacagttagagctatcataagtggaggagataaaatagatgcaataaactattttgaatcagaatatactttaaagaaaaatagaaaaatagctgataaaatttttaaagaatatgattttatgttaacaccaacaacgggaacaatttataaaatagatgaggtaaatgcagaccctatacagctcaatacaaatcttggatactatacaaattttatgaatttacttgatctgtctgcgattgctgtacctgcaggattgagagaaaatggacttccctttggagtaactatagttgctgataattttgaagaagagaaactattagcttattcaagtaagtatctagaggtttaa

SEQ ID NO: 9364 - protein, 129 aa, Unknown
  Obtained from environmental sample
  misc_feature (1)..(129): Xaa is any amino acid
MITKTPEVVNKTVRAIISGGDKIDAINYFESEYTLKKNRKIADKIFKEYDFMLTPTTGTIYKIDEVNADPIQLNTNLGYYTNFMNLLDLSAIAVPAGLRENGLPFGVTIVADNFEEEKLLAYSSKYLEV

SEQ ID NO: 9365 - DNA, 420 bp, Unknown
  Obtained from environmental sample
  misc_feature (1)..(420): n is a, c, g, or t
atggataagaaaaaaataattggattagtagttggagcaataacttttatattggtttatgttagtgtccaacaaatagtatttaaatctccttcattcgataagcaaatgatgcaaaccgctagcgaactaaataaatcttgccctattatggttgatagtgaaacaagacttgataatgctttggcacttcctgaaaacacatttcagtacaactatacattaataaacatgaataaagaagatatggatgtttcagaagttgaaaacttcttacagccaaacatattaaacagtataaaaacaaacccagatctaaaagcttttagagacaatgatgtaactatggtttacaactataaagacagtaatggtaatcatttgtttaaattaatctttgaaccatcccaatataaataa

SEQ ID NO: 9366 - protein, 139 aa, Unknown
  Obtained from environmental sample
  misc_feature (1)..(139): Xaa is any amino acid
MDKKKIIGLVVGAITFILVYVSVQQIVFKSPSFDKQMMQTASELNKSCPIMVDSETRLDNALALPENTFQYNYTLINMNKEDMDVSEVENFLQPNILNSIKTNPDLKAFRDNDVTMVYNYKDSNGNHLFKLIFEPSQYK

SEQ ID NO: 9367 - DNA, 483 bp, Unknown
  Obtained from environmental sample
  misc_feature (1)..(483): n is a, c, g, or t
atgatagaaaaaaaatcttatgcgaaagtaaatatctttttaaaaatagctggtaagagagacaactatcacgagatagtatcaagatttgtacgagtgcatagtctttatgatgttgtacgatttgaaaaaggtgagtttgataaatttactttagagggtgtttttggttgtgagacagaaaaaaacactatttataaagcatacttagaattatacagtatgtttaagaatatagaagaaatatttaagaattataaagtagtagtagagaagaatataccagaatttgcaggtcttggtggtggaagtagtaactgtgcaatttttatgctcatggtaaatatacttggcaacttaaaacttagccctgatgagttagcttctattggagcaaagattggtgcggatgttcctttttttatttatgagtatgatagtgcaaatgtaacaaggatttggggaagttgtagaaaagtttga

SEQ ID NO: 9368 - protein, 160 aa, Unknown
  Obtained from environmental sample
  misc_feature (1)..(160): Xaa is any amino acid
MIEKKSYAKVNIFLKIAGKRDNYHEIVSRFVRVHSLYDVVRFEKGEFDKFTLEGVFGCETEKNTIYKAYLELYSMFKNIEEIFKNYKVVVEKNIPEFAGLGGGSSNCAIFMLMVNILGNLKLSPDELASIGAKIGADVPFFIYEYDSANVTRIWGSCRKV

SEQ ID NO: 9369 - DNA, 483 bp, Unknown; identical to SEQ ID NO: 8127
  Obtained from environmental sample
  misc_feature (1)..(483): n is a, c, g, or t

SEQ ID NO: 9370 - protein, 160 aa, Unknown; identical to SEQ ID NO: 8128
  Obtained from environmental sample
  misc_feature (1)..(160): Xaa is any amino acid

SEQ ID NO: 9371 - DNA, 627 bp, Unknown
  Obtained from environmental sample
  misc_feature (1)..(627): n is a, c, g, or t
atggctgaggtggtaagttgtcaaaaagagatactaccatttagtaaagatgaagtatcaaaaatactaaatcaagctgatacatggttctcaaactttctagcagctggattttatacaggtgctagaactggtgaactcatagctttaaaatggcaaaatgtagatttgaaaaacaaaaaaatatacatagattccacaagaggtcaaggtggagaaggtacaacaaaaactggtaagtcaagatatgtacctatatttgatatgttagtaccatatttagaaaagcaacaaagattaactggtatgaaaagatatgtattcttaacaccaggtggaaaaaatcttcaagcttcaactatatatagatttttttgggaaccactattaagacaactcaatataccgtatagaaaaatatacaccactagacatacatttgctactactatgttagcaagtggaaagtttagtttaaatcaaattgcaagtatgatgggtcactcagatatcaacactttgatacaacattataacaaattcatagatagtgaatctatgaaaatagacacaaacatagatgttttttgtaacagtttttgtaacggtgtctcaataagtgcctaa

SEQ ID NO: 9372 - protein, 208 aa, Unknown
  Obtained from environmental sample
  DOMAIN (14)...(188): Phage integrase family
  misc_feature (1)..(208): Xaa is any amino acid
MAEVVSCQKEILPFSKDEVSKILNQADTWFSNFLAAGFYTGARTGELIALKWQNVDLKNKKIYIDSTRGQGGEGTTKTGKSRYVPIFDMLVPYLEKQQRLTGMKRYVFLTPGGKNLQASTIYRFFWEPLLRQLNIPYRKIYTTRHTFATTMLASGKFSLNQIASMMGHSDINTLIQHYNKFIDSESMKIDTNIDVFCNSFCNGVSISA

SEQ ID NO: 9373 - DNA, 450 bp, Unknown
  Obtained from environmental sample
  misc_feature (1)..(450): n is a, c, g, or t
atgaaacatatactatttataactcttttctttttaactagcttatttgctttatcgccattttccctagagggtgtaaatgatgtaaatctcaaagttattgataaaagtaaactaactacaaaagaaaatttagaaaagataaaacatgatctcaaatacaatttagaaaaacttggaatcaaaacaaaaagtgagaacttttcaaactttattgttaaaattcaaggtatgaaaacaaaaactagttatgtgatgcatattagtatgtttatcgttgaagatacagtatctgcaagagataaaactacagaaactatgagtatcacttactacaaagatgacttttttgattctaattcaaaagagatacaaactgatatttatgaatctattattcactatctcctttcagattttcttgaacaatttaaagaagaaaatagttaa

SEQ ID NO: 9374 - protein, 149 aa, Unknown
  Obtained from environmental sample
  SIGNAL (1)...(17)
  misc_feature (1)..(149): Xaa is any amino acid
MKHILFITLFFLTSLFALSPFSLEGVNDVNLKVIDKSKLTTKENLEKIKHDLKYNLEKLGIKTKSENFSNFIVKIQGMKTKTSYVMHISMFIVEDTVSARDKTTETMSITYYKDDFFDSNSKEIQTDIYESIIHYLLSDFLEQFKEENS

SEQ ID NO: 9375 - DNA, 336 bp, Unknown
  Obtained from environmental sample
  misc_feature (1)..(336): n is a, c, g, or t
atgaccaaggcaaaagcaaaagcattcaaacttaataaccctttgatgttggtccttgtaacaacaacttgtccttggtgtgaaaaactcaaaaaacaaacattaaacaaaaaaataataaataattatgtatcacaacactttataccagtaatactcaacaaagacaaaggggaataccctgtaggtaaatttacagccaaagtagtccccactgtatttttcatagattctaaaactgaaactattattgatagctcttatggttacaaatcaaagaaaaaatttttaaatattttagaaaaaatagattctaatcaaaaaggtaaatcatga

SEQ ID NO: 9376 - protein, 111 aa, Unknown
  Obtained from environmental sample
  misc_feature (1)..(111): Xaa is any amino acid
MTKAKAKAFKLNNPLMLVLVTTTCPWCEKLKKQTLNKKIINNYVSQHFIPVILNKDKGEYPVGKFTAKVVPTVFFIDSKTETIIDSSYGYKSKKKFLNILEKIDSNQKGKS

SEQ ID NO: 9377 - DNA, 303 bp, Unknown
  Obtained from environmental sample
  misc_feature (1)..(303): n is a, c, g, or t
ttggtcgtgtgttcttatggtcatcataataaaattgccttcagccactttattttcaggtattggattaagagtaaattttgcttttttgtcgggcagactaaaatttcgttctctggcaccattaggcaaataaaaaccacttggttgttgcactttttcattaaagttttcaaaaccgggaatagttgcagcaatgtggtctcttactatattataatcatccttcattgcggtccaatttataggactgtttttaaaagtagcatttgcaattccagcaataatagcatgttcgcttaa

SEQ ID NO: 9378 - protein, 100 aa, Unknown
  Obtained from environmental sample
  misc_feature (1)..(100): Xaa is any amino acid
MVVCSYGHHNKIAFSHFIFRYWIKSKFCFFVGQTKISFSGTIRQIKTTWLLHFFIKVFKTGNSCSNVVSYYIIIILHCGPIYRTVFKSSICNSSNNSMFA

SEQ ID NO: 9379 - DNA, 714 bp, Unknown
  Obtained from environmental sample
  misc_feature (1)..(714): n is a, c, g, or t
atggaagttaattatgtggttaaaatgccaataactaattcggtaaaattatttaacgactatggctatatcaacttagacaagctaaaaggaaatgcctttataaaatgtgactatggtaaagtaaccacgaaagaacttttaggaaattctaattatattaaaatggattataccaaaaacagttattttgaatatataaataacggctcaattgaagcagattacagtgagtttaccgtcgccaaagccaaagatttaaaccttgaggctgactataccacctctgttattgaaattgcagaaaatgtagtttacgaatgtgattacggatcgcttaaaatcgataacatcaataatgttgatggtagtggtgattatttggctttaagactgggtactatttttaaaactgctataataaaagcagattatggatctataaaaatagaccgtgtcacttcgaatacaaaaaaactagatatcgatacagaatttgttggtataaccgtgggtattgataacaattacaattttgacttttatatcgatattgattttgggtcattaaaggctactgaagactttcattttactgagaaaaacactgataattttggcaagaaatatataggttatcacggtacacccaattctaacaattcggttaatataagctccgaatatggtagcattacatttaaaaatcaataa

SEQ ID NO: 9380 - protein, 237 aa, Unknown
  Obtained from environmental sample
  misc_feature (1)..(237): Xaa is any amino acid
MEVNYVVKMPITNSVKLFNDYGYINLDKLKGNAFIKCDYGKVTTKELLGNSNYIKMDYTKNSYFEYINNGSIEADYSEFTVAKAKDLNLEADYTTSVIEIAENVVYECDYGSLKIDNINNVDGSGDYLALRLGTIFKTAIIKADYGSIKIDRVTSNTKKLDIDTEFVGITVGIDNNYNFDFYIDIDFGSLKATEDFHFTEKNTDNFGKKYIGYHGTPNSNNSVNISSEYGSITFKNQ

SEQ ID NO: 9381 - DNA, 666 bp, Unknown
  Obtained from environmental sample
  misc_feature (1)..(666): n is a, c, g, or t
gtgaataacaaaaagataacaatactatttgatttagatggtactttaatagatagtacagaagcaatattagaatcatttcattatgcttttagaaaacaaggttttaattttagtggagatgatgaggagataaaaagtcatatagggtatccattggatattatgtttgctaatttaggagttgaacaaagtagagttatggattttgtagagagttataaagaaaattatagagaaatttcagaagagaagacaattttactagaatctgcaaaggaatcagtccaagaagcagcaaaatttgcaagacttggagtggttactacaaaaactacacaatatagtataccattgttaaaaaatttgggtgtttttgaatattttgagacaataattggtcgtcaagaggtgaaaaatccaaaacctgacccagaaccgattcaagttgcactaaaaaacatgggaataaagccttctagagaggttttcatgataggagatacaaaattggatttgattgcagcaaaccgcgctaatattagtagttgtggggtattgtgcggatatggttataagaaagagttatgttgctacacacctcttgtaaccaccaatgctttagaagcggtaaatttaattaaaagcaccatttctaaagcataa

SEQ ID NO: 9382 - protein, 221 aa, Unknown
  Obtained from environmental sample
  DOMAIN (5)...(189): haloacid dehalogenase-like hydrolase
  misc_feature (1)..(221): Xaa is any amino acid
MNNKKITILFDLDGTLIDSTEAILESFHYAFRKQGFNFSGDDEEIKSHIGYPLDIMFANLGVEQSRVMDFVESYKENYREISEEKTILLESAKESVQEAAKFARLGVVTTKTTQYSIPLLKNLGVFEYFETIIGRQEVKNPKPDPEPIQVALKNMGIKPSREVFMIGDTKLDLIAANRANISSCGVLCGYGYKKELCCYTPLVTTNALEAVNLIKSTISKA

SEQ ID NO: 9383 - DNA, 396 bp, Unknown
  Obtained from environmental sample
  misc_feature (1)..(396): n is a, c, g, or t
atgcagatagtaccaaagtcagctggagtagatacatggaagtttctgaaaaatagcgatgggatgccctcacgtgcgtacttgtttaatgaaaaaaataatatcgagatggggagtgcatatctacacattgtagataccaaatatcttaaagagattaaaaatcctatttcacgtgaatactgcaccatagcagcctacaacactggtagcggaaatgttttaaaagctttttacaaaaactacagaagtaacagatctcatgcaacagatataattaactctttgacaccatcagaagtttactcaaaactaagatcatccctaccttacgacgagacaagaagatatgttcaaaaagtgactactgctaagaaaaagtatattaatatttag

SEQ ID NO: 9384 - protein, 131 aa, Unknown
  Obtained from environmental sample
  misc_feature (1)..(131): Xaa is any amino acid
MQIVPKSAGVDTWKFLKNSDGMPSRAYLFNEKNNIEMGSAYLHIVDTKYLKEIKNPISREYCTIAAYNTGSGNVLKAFYKNYRSNRSHATDIINSLTPSEVYSKLRSSLPYDETRRYVQKVTTAKKKYINI

SEQ ID NO: 9385 - DNA, 327 bp, Unknown
  Obtained from environmental sample
  misc_feature (1)..(327): n is a, c, g, or t
atgatgcaaaagactaaaatcatagaagcagaaaaacttgatcactcacgagtctcttttggctctagtgtcacactagaagatttagatagtggaaatgagtgtagatacacaatttgtggtgttttagagagtgaaccagacaataacctaatctctatacatgcgccaatttcacgagccatgataggtaaaagtgaaggtgatgattttgtagtaaatctgccaaatggaaaaaaagagtatgaaattgttaaaatcgagtatattcctattttttcattgaaaaaagttattaaaactgagaaagagtttggttttcactaa

SEQ ID NO: 9386 - protein, 108 aa, Unknown
  Obtained from environmental sample
  DOMAIN (13)...(89): Prokaryotic transcription elongation factor, GreA/GreB, C-terminal domain
  misc_feature (1)..(108): Xaa is any amino acid
MMQKTKIIEAEKLDHSRVSFGSSVTLEDLDSGNECRYTICGVLESEPDNNLISIHAPISRAMIGKSEGDDFVVNLPNGKKEYEIVKIEYIPIFSLKKVIKTEKEFGFH

SEQ ID NO: 9387 - DNA, 657 bp, Unknown
  Obtained from environmental sample
  misc_feature (1)..(657): n is a, c, g, or t
ttgtataatagtattgtaaattatgagaaaagagtacttatgaacaatctatcaatcaaatggaaactaacacttgctattgcaattatagttttagtaatgtcggctattttagttagtcttagtatatatgatataaaaaaaacctctagtgatgacacaaaactttttaaagaaaaagcttttagtgcaaaacaagatgaattaaaatcaaatatagacatagttttaaaaactatcgattctttttatgagagaacatcaaaagaaaaagtcaaactagaagttcaagagaaacttgtaactcaagcacaaatgttagaaaatatcttaaaccaatattatctaaaacatcaaaatagtaaaacagtacaatcagaacttatcgatatcgttaaaaatagtaaatatggtaaaagtggttatttttggataaataacactgatgcaaaaatggttatgcatccaattaaaccaagtcttgatggaaaagatttatctaatttaaaagaccctaatggtaaaaaattttttatagagatggttaacctttctaaaaacaactcgcaagggtttgtagattatcaatggccaaaaccaggatttgataaaccacaagataaagtttcttatatttttacatttaaaccaatttaa

SEQ ID NO: 9388 - protein, 218 aa, Unknown
  Obtained from environmental sample
  misc_feature (1)..(218): Xaa is any amino acid
MYNSIVNYEKRVLMNNLSIKWKLTLAIAIIVLVMSAILVSLSIYDIKKTSSDDTKLFKEKAFSAKQDELKSNIDIVLKTIDSFYERTSKEKVKLEVQEKLVTQAQMLENILNQYYLKHQNSKTVQSELIDIVKNSKYGKSGYFWINNTDAKMVMHPIKPSLDGKDLSNLKDPNGKKFFIEMVNLSKNNSQGFVDYQWPKPGFDKPQDKVSYIFTFKPI

SEQ ID NO: 9389 - DNA, 441 bp, Unknown
  Obtained from environmental sample
  misc_feature (1)..(441): n is a, c, g, or t
atggtaataaatgagaagttagttttggaaatcacaaagaaattaaaaattacaaaaaagcaagttgaaacagtattaaaccttttaaatgagggaaatacagttcctttcatcgcacgttatcgtaaggagcaaacagatgctcttgatgaagaacaaatcagagatattaataaagagtacgaatataaagtaaacttgttaaaaagaaaagaagatgtaattagattaattgatgaaaaaggactgttaactgatgagttaaaacaagagattttagcatctgaaaagttagttgaaattgaagacatttatcgtccttacaaagagaaaaagaaaactaaagcaactattgcaattaaaacaggattaaaaccactgtcagattatattttcggttttccaatggaaggttctttagaagaagaagctttaaaataa

SEQ ID NO: 9390 - protein, 146 aa, Unknown
  Obtained from environmental sample
  misc_feature (1)..(146): Xaa is any amino acid
MVINEKLVLEITKKLKITKKQVETVLNLLNEGNTVPFIARYRKEQTDALDEEQIRDINKEYEYKVNLLKRKEDVIRLIDEKGLLTDELKQEILASEKLVEIEDIYRPYKEKKKTKATIAIKTGLKPLSDYIFGFPMEGSLEEEALK

SEQ ID NO: 9391 - DNA, 366 bp, Unknown
  Obtained from environmental sample
  misc_feature (1)..(366): n is a, c, g, or t
atgaaggcgataaaatccatgagctctctgatcaagaccaatgactgcaaattgttattatgccattcacaaactccccgttgcctgcttcacccccgcccccaaaaagcatctgccgacatgtttgatttgcccttggattattttctggaagccggtttttcaattgaccaggtttcttttgaaatcatggagggtgaaaaaaatcacacccattgtattttaaacaaagcccggtatggggattacggcaccattgtgattggaagacgtcgtttgacagcggtgaaacaactattctcgaacagggtcggcaacaaaattttcagaaacgcagacaaccatgttgtctggattgttcaataa

SEQ ID NO: 9392 - protein, 121 aa, Unknown
  Obtained from environmental sample
  misc_feature (1)..(121): Xaa is any amino acid
MKAIKSMSSLIKTNDCKLLLCHSQTPRCLLHPRPQKASADMFDLPLDYFLEAGFSIDQVSFEIMEGEKNHTHCILNKARYGDYGTIVIGRRRLTAVKQLFSNRVGNKIFRNADNHVVWIVQ

SEQ ID NO: 9393 - DNA, 399 bp, Unknown
  Obtained from environmental sample
  misc_feature (1)..(399): n is a, c, g, or t
atgaagtttaagcactacatattacttttcggattattgagtgcttttttcaaaacttcaaacacttttgcccaacaaattttaactccgattggaactgactttaaagataaggtgatcgaaagacaacgcgattcaacttcgcttttccttggaaatggattttttcctgttacttatgaagaaagtggttacgatctaccttcgaaagacacctctaaaggttggataaaaaggaaattatttcaagaacattttattcaaattgaacacaaagactactttcttgccctagatcccggtttgaatgcttcattaggggaagatcctttacaaaatacagggggaaagattgtttccaaatacaagaaggcgtaccagcttttggagaactcttga

SEQ ID NO: 9394 - protein, 132 aa, Unknown
  Obtained from environmental sample
  misc_feature (1)..(132): Xaa is any amino acid
MKFKHYILLFGLLSAFFKTSNTFAQQILTPIGTDFKDKVIERQRDSTSLFLGNGFFPVTYEESGYDLPSKDTSKGWIKRKLFQEHFIQIEHKDYFLALDPGLNASLGEDPLQNTGGKIVSKYKKAYQLLENS

SEQ ID NO: 9395 - DNA, 831 bp, Unknown
  Obtained from environmental sample
  misc_feature (1)..(831): n is a, c, g, or t
atgaaattctatagtacaaatgatagaaatctctctgtcagttttaaagaagctgtcgtaaaaggacttgctcctgatggggggctattctatccagaaagcttgcctcagctcgacaaatcatttataaagaatctaccaaatttgtcattagctgaaattggatatgacatttcaaaacattttttaggtgatgatattcctttagataaattaaaggaaatatgcgacgatgctctaaacttccctactcctctcgtttctttagagccaaacgtttattcgtttgagttattccatggacctagctgtgcttttaaagacgtaggcgcacgttttatgtccagatgtctaagttattttgcaaaagagagtaaagaaaaaatcaccatcctagctgcgacttcaggtgatacaggtagtgccgttgcacacggattccttggtattaaaaatattgatgttgtcattttatacccatctggaaaggtaagccaaattcaagagcaacaattaacgacacttggcaacaatataactgcactagaaattgatggtagctttgatgattgccaagctcttgtaaaaaaggcatttcaggacgatgagttgaataaacaaatgaagctaagctctgcaaactcgattaatattgcacgtttgattcctcagagtttctactatttttatgcctacggtcagttgaaaaaacagaataaaaatcttgtcatttcagttccgagtggcaactacggtaaccttactgcaggtttaatcgctaagcaaatgggcttaccaatcaaaagatttatagcctctcaaatgaaataa

SEQ ID NO: 9396 - protein, 276 aa, Unknown
  Obtained from environmental sample
  DOMAIN (77)...(276): Pyridoxal-phosphate dependent enzyme
  misc_feature (1)..(276): Xaa is any amino acid
MKFYSTNDRNLSVSFKEAVVKGLAPDGGLFYPESLPQLDKSFIKNLPNLSLAEIGYDISKHFLGDDIPLDKLKEICDDALNFPTPLVSLEPNVYSFELFHGPSCAFKDVGARFMSRCLSYFAKESKEKITILAATSGDTGSAVAHGFLGIKNIDVVILYPSGKVSQIQEQQLTTLGNNITALEIDGSFDDCQALVKKAFQDDELNKQMKLSSANSINIARLIPQSFYYFYAYGQLKKQNKNLVISVPSGNYGNLTAGLIAKQMGLPIKRFIASQMK

SEQ ID NO: 9397 - DNA, 579 bp, Unknown
  Obtained from environmental sample
  misc_feature (1)..(579): n is a, c, g, or t
gtgggaaaaacctcgctaggaaaatctgttgcagaagcattaggtagaaaatatgtacgaatgtcgttaggtggattaagagatgaagcagaaattagaggtcacagaaaaacctacattggagcaatgccgggaagaattattcaaagcttaaaaaaagtagagtcttctaaccctgtttttgttttagatgaaattgataaagttggagcaagccatcaaggcgacccttcatcagctttactagaagttttagacccagaacaaaatgaaaatttttatgacaactttttagaattagattacgatttatctaaaatcttattcattgctactgctaattcattatcaaccatacagcctgcacttagagaccgaatggaaattattgaaatgaacggctatactgttgaagaaaaagtagaaattgcaacaaggcatttaattcctaagttggtaaaaaaccacgggcttgaaaaaaatcaattacaaattcctaaaaaagtaattgaaaaaattgcaagtgaatatactagagaatcaggagttagaaatctagagaaaaatttagcaaggtaa

SEQ ID NO: 9398 - protein, 192 aa, Unknown
  Obtained from environmental sample
  DOMAIN (2)...(187): ATPase family associated with various cellular activities (AAA)
  misc_feature (1)..(192): Xaa is any amino acid
MGKTSLGKSVAEALGRKYVRMSLGGLRDEAEIRGHRKTYIGAMPGRIIQSLKKVESSNPVFVLDEIDKVGASHQGDPSSALLEVLDPEQNENFYDNFLELDYDLSKILFIATANSLSTIQPALRDRMEIIEMNGYTVEEKVEIATRHLIPKLVKNHGLEKNQLQIPKKVIEKIASEYTRESGVRNLEKNLAR

SEQ ID NO: 9399 - DNA, 720 bp, Unknown
  Obtained from environmental sample
  misc_feature (1)..(720): n is a, c, g, or t
atgagaaagtatattctaagtgttataggactgtgtcttatatctaccttaacaattaatgcccagtcgatccaagagaaatacaagaaagctgaagagtttctttcttggaatctttcagaaaaattatattccttaactgttaacccgcaatggatagatgaaagttcaaatttttggtttcttgatcaaaagaaatcaaagaaggaatttattcttgtgaattcaaagaagaaacgcatgtctgccgcttttaatcataagaagatggctgatgctctcacaagtcaattgggtagaataatctcagctgatagtctgccctttaattacatcaaatttattaatcattataaaggtatccgctttaaaattaaaagcaaaacctatagttgtgatttgaaatcatacgtgctcaaagtacaagagaaggaggagaaagaaaaaagaaacccttttgaatcatcgtctcctgataaaaagtggaaagtaatagtgaaagattttaatctttatttactagaaattgattcaaaagaagaatttcagctaactaaagatggcaaagagaactttagntatgggttcttcatatcatggtatagatttgatgaagtaggagtcgatgagaaaataaaaagaagacctttgtatgtaagttggtcacctgatcaaaacgttttgctggaaatagacttgatagaaggaatattggaaagc

SEQ ID NO: 9400 - protein, 240 aa, Unknown
  Obtained from environmental sample
  misc_feature (1)..(240): Xaa is any amino acid
MRKYILSVIGLCLISTLTINAQSIQEKYKKAEEFLSWNLSEKLYSLTVNPQWIDESSNFWFLDQKKSKKEFILVNSKKKRMSAAFNHKKMADALTSQLGRIISADSLPFNYIKFINHYKGIRFKIKSKTYSCDLKSYVLKVQEKEEKEKRNPFESSSPDKKWKVIVKDFNLYLLEIDSKEEFQLTKDGKENFXYGFFISWYRFDEVGVDEKIKRRPLYVSWSPDQNVLLEIDLIEGILES

SEQ ID NO: 9401 - DNA, 315 bp, Unknown
  Obtained from environmental sample
  misc_feature (1)..(315): n is a, c, g, or t
ttgaatgatagtaaaacgaatttttttaaagtgattgataaagattctgctattggtgttatacgtctagattttttgtcagaaaacaataaaacagtagcagaaatatctttaactattgatcctacatattcaggtaaaggatatgctaagcgatctatcaataaaatagtgaatgaaacgaacgtagatatcctccatgctgtgatacataaaatgaatatagcttcgcaaaaagtttttctatcaaatgattttaaatatcatagcgcgtatcgcccaaacttcgatttgtatacctattataaggattga

SEQ ID NO: 9402 - protein, 104 aa, Unknown
  Obtained from environmental sample
  DOMAIN (9)...(87): Acetyltransferase (GNAT) family
  misc_feature (1)..(104): Xaa is any amino acid
MNDSKTNFFKVIDKDSAIGVIRLDFLSENNKTVAEISLTIDPTYSGKGYAKRSINKIVNETNVDILHAVIHKMNIASQKVFLSNDFKYHSAYRPNFDLYTYYKD

SEQ ID NO: 9403 - DNA, 738 bp, Unknown
  Obtained from environmental sample
  misc_feature (1)..(738): n is a, c, g, or t
atgcaatcagacaatgattcgtcacaggcatcactttttggagaagcagaaagtgcaattcaaatcaaaagaccagaacctcctcccggcgaagcaaaatggactcaacttcaagaattaaataaagaaaaagaatatattggtatatacctgtcagatcatcctttatcaaaaaacaaacatataattgatgcgaataccaacacacaacttgcagatttgtcaaatttgagtaattttgtaggcaaagaaatcaaagttgcaggaattgtaaatggagcagaacatcgctttacaaaaactggaaaaccttggggaacactttcaatagaagactttagtggaacacataatattgctcttttttcaaaacaatacgttgaatttaagaattatatggacaaaggcttcaaactttttattattggaaaagtagaacctcgttttcataatcctgagcaaattgatttcaaaatcaaacaaataaaactacttgatgatatggaagttggagctttagctataaaattacaaataaaagatgtttcaaatacactgatttcaaaaatagatactctttttgaaaaaaataaaggaaaatctgatttgaaattcttagtttttgaccctgaatcgaaaatatgggttcaaatgacttcaaaaaatcataaaattganataaacagtgatgttttagattatttaaaaaatgaaaacattgtttataaactgttttaa

SEQ ID NO: 9404 - protein, 245 aa, Unknown
  Obtained from environmental sample
  misc_feature (1)..(245): Xaa is any amino acid
MQSDNDSSQASLFGEAESAIQIKRPEPPPGEAKWTQLQELNKEKEYIGIYLSDHPLSKNKHIIDANTNTQLADLSNLSNFVGKEIKVAGIVNGAEHRFTKTGKPWGTLSIEDFSGTHNIALFSKQYVEFKNYMDKGFKLFIIGKVEPRFHNPEQIDFKIKQIKLLDDMEVGALAIKLQIKDVSNTLISKIDTLFEKNKGKSDLKFLVFDPESKIWVQMTSKNHKIXINSDVLDYLKNENIVYKLF

SEQ ID NO: 9405 - DNA, 597 bp, Unknown
  Obtained from environmental sample
  misc_feature (1)..(597): n is a, c, g, or t
atgacagaagctgaaataaaaaatattcatattatacaaagtagaaatgttagatatttaaaaagagtgcaaaaaaatatgactctggatataaatcattatctaattaaaaatgacgattttcaagtgagtattaaaacaaaactttattctcttttatattcagcactttccgaagcacaatttactcagattattcatactccttttggtttcctttattcagaaatattaaaaattaaaaaagaaagaagtcttgctgatagttggtatttgatgatagatttggctttgaaaaaagttggaaattggaatacaaatactgatttaggagttaaaagaaccaaactaaaacaaataataacagaatacatagaaaaacctcaagaattaaggaataaaattgctcacggacaatggttatttgcattaaatagcaagaatacaaatgaaaatccatccacaaccgagagaataaataacttagatgttgtagaaatatctatttggtttgaagttcatcaatatctttgttttattattcgtgatcttattcaatctcctaaaaaaacttttcacaatgattttttggattaa

SEQ ID NO: 9406 - protein, 198 aa, Unknown
  Obtained from environmental sample
  misc_feature (1)..(198): Xaa is any amino acid
MTEAEIKNIHIIQSRNVRYLKRVQKNMTLDINHYLIKNDDFQVSIKTKLYSLLYSALSEAQFTQIIHTPFGFLYSEILKIKKERSLADSWYLMIDLALKKVGNWNTNTDLGVKRTKLKQIITEYIEKPQELRNKIAHGQWLFALNSKNTNENPSTTERINNLDVVEISIWFEVHQYLCFIIRDLIQSPKKTFHNDFLD

SEQ ID NO: 9407 - DNA, 957 bp, Unknown
  Obtained from environmental sample
  misc_feature (1)..(957): n is a, c, g, or t
gtgatcatttatgcttatattcaatggggtataaaatgtgtaaaaaaattcaacggaatgttttccttttctttatatgataattttaaaaagaagctttatcttgcaagggaccgatacggtatcaaaccactttattatacggtaacccgttcgcacaatgatcacaaaacatttttgtttgccagtgaagtgaaatcgcttctggaatatagggactaccggatagatatggattgtgaagccctcatggagtattttactttccagaatattttttcggatcgtaccctttacaaagatatctgtttgcttccaccagggcatttcatagagatagatcttaataatacaaatagaattaatgacgtgagatgtattccaaaagcacaatactgggattttgattttaaagaacccagcaaggtcaaagatgaaaatgaatatcttgaagaacttaacaggctttttgtccaggccgttcaacggcaattggtcagtgacgtggaaatagggagctaccttagcggaggtatggacagcggatctatctcctgtattgctgctaaccataataaggatttaaaaactttcactgtcgggtttgatttgaacagtatttctggaatggagatggcctgtgatgagaggcatgttgctgaatatctttcatatttatacaagactgaacactatgaaatggttttaaaatcaggtgatatggagcgttgcctcccccagtttacctggcaccttgaagagccccgggtaggtcagagttatccaaatttttatgcatcaaaacttgccggaaattttgttaaagttgttcttggtggtaccggtggagatgaattgtttggcggttatccctggcggtattaccgggccgttgtaaataagattatgaagattacttcgataaatatatctgttcggcagcggaaagtgagaaaa

SEQ ID NO: 9408 - protein, 319 aa, Unknown
  Obtained from environmental sample
  DOMAIN (152)...(316): Asparagine synthase
  misc_feature (1)..(319): Xaa is any amino acid
MIIYAYIQWGIKCVKKFNGMFSFSLYDNFKKKLYLARDRYGIKPLYYTVTRSHNDHKTFLFASEVKSLLEYRDYRIDMDCEALMEYFTFQNIFSDRTLYKDICLLPPGHFIEIDLNNTNRINDVRCIPKAQYWDFDFKEPSKVKDENEYLEELNRLFVQAVQRQLVSDVEIGSYLSGGMDSGSISCIAANHNKDLKTFTVGFDLNSISGMEMACDERHVAEYLSYLYKTEHYEMVLKSGDMERCLPQFTWHLEEPRVGQSYPNFYASKLAGNFVKVVLGGTGGDELFGGYPWRYYRAVVNKIMKITSINISVRQRKVRK

SEQ ID NO: 9409 - DNA, 579 bp, Unknown
  Obtained from environmental sample
  misc_feature (1)..(579): n is a, c, g, or t
atgcgatgtatgttatgtgaaaaattcagtttttcacatatctgcaaagagtgtcgcaataattttttaactccttctatctacaaaagaaaaattttaaataaaatagatgttatctcattttataaatatagtgatattgagtcacttcttcacacaaaacacactgagctaggttattacatttatagtatattggctgatgtcgctatgaaaaagttctcacgagagtttaattttagtgaagatgttgcaattatagcagtggatgatcatgtaagacatggatactcccatactgcaattttatcaaaagccttaagtaatttaaatttacacacaaaaactagaaaactaagagctaaaaatcagacaaaatattcggcaaaaagttaccagtttagattaaatagtccaagagattttcagtttgaaacttttaaacagagtaatgtaatagttgtagatgatataattacaacttcattaacactcagtgaggctgtaagtgtgttagagagtaattcgaaagatgttcttttttgtttaacattggcagatgcagatttaaaggattaa

SEQ ID NO: 9410 - protein, 192 aa, Unknown
  Obtained from environmental sample
  misc_feature (1)..(192): Xaa is any amino acid
MRCMLCEKFSFSHICKECRNNFLTPSIYKRKILNKIDVISFYKYSDIESLLHTKHTELGYYIYSILADVAMKKFSREFNFSEDVAIIAVDDHVRHGYSHTAILSKALSNLNLHTKTRKLRAKNQTKYSAKSYQFRLNSPRDFQFETFKQSNVIVVDDIITTSLTLSEAVSVLESNSKDVLFCLTLADADLKD

SEQ ID NO: 9411 - DNA, 753 bp, Unknown
  Obtained from environmental sample
  misc_feature (1)..(753): n is a, c, g, or t
atggctaagaaaaaagcatttgcatgcttttgtaaacaagaagaattaatgactgataaatatagtggaaaatgtttaaatgtgagtgaagatgaacttctaaacaataaccttccttttacaataagaatcaaaaaaccaaaagatacaattcactttacagatatgattcaaggcaatattagttttactagcaatgatgtagatagttttgtaataatggataaagagaagtatccaacatataactttgcatgtgctactgatgatatgattcaaggtataaaatatataattagaggtgaagatcatatctcgaacacaccaaaacaagagttaattagaaagtcaattggttatgaagaagagataaaatatgctcatttacctatcttactaaattcaaatggcaaaaaaatgaggaaagatgatgaggaaagtagtgtaaaatggcttttaaaccaaggttatatgcctgaagccatcatgaactatctgattcttttaggcaataaagttcctactgaaattttttcttttacagaagctctaacttggtttgaactgaaaaatatctcanaatcttcagcaaaattcgatattgacaaattacgttttatcaaccgcgaacatataaaactagtagaagatgtagaactttctaaacgcataggttactcttgtgcaagtataggaaaactagccaaactttataccaaagaggctagcaccacagctaaaataaaaaggtaa

SEQ ID NO: 9412 - protein, 250 aa, Unknown
  Obtained from environmental sample
  DOMAIN (2)...(206): tRNA synthetases class I (E and Q), catalytic domain
  misc_feature (1)..(250): Xaa is any amino acid
MAKKKAFACFCKQEELMTDKYSGKCLNVSEDELLNNNLPFTIRIKKPKDTIHFTDMIQGNISFTSNDVDSFVIMDKEKYPTYNFACATDDMIQGIKYIIRGEDHISNTPKQELIRKSIGYEEEIKYAHLPILLNSNGKKMRKDDEESSVKWLLNQGYMPEAIMNYLILLGNKVPTEIFSFTEALTWFELKNISXSSAKFDIDKLRFINREHIKLVEDVELSKRIGYSCASIGKLAKLYTKEASTTAKIKR

SEQ ID NO: 9413 - DNA, 720 bp, Unknown
  Obtained from environmental sample
  misc_feature (1)..(720): n is a, c, g, or t
ttgtcgaatatagctttatcactaggatcgtgttttactattgctaaggagtatttactttttaacgcctctgcaaccttaactataagagtggtttttccactatttgatggaccgctaaaagcgatagctaaagagctcataatttgccttacatgtataatatatgcgattatatcaaaatgtggcataaattatgataaaattcattttcaaaggacaataatgaaatatagaattttatcaattttactaatatcttttttatttataggatgctctcaaaaaattaatatatacgctaaaccaacagatgttttacatgaacaagcattaactcagacacaaaaagtaactataaaatctggtacaataataaaagcatatattactgcaacatatataaatcaaatagggcacaaatttgtgggtgtgaatcacgaagttgagaaattcatagttagtatttatattcctagtgagcaacgacaagaactttataatgagatattttttattataaatggaaatgaagagagttgcgtaacaactatgaaaaaagataatccattattgaaattaattccaggatcaaatccttggagcaggtattattatgtagaagctccaatagagataagaagcaaaactataacttttagttttaaaacttttgatgataagagtactgttttgttattttcaaaagattatctttaa

SEQ ID NO: 9414 - protein, 239 aa, Unknown
  Obtained from environmental sample
  SIGNAL (1)...(15)
  misc_feature (1)..(239): Xaa is any amino acid
MSNIALSLGSCFTIAKEYLLFNASATLTIRVVFPLFDGPLKAIAKELIICLTCIIYAIISKCGINYDKIHFQRTIMKYRILSILLISFLFIGCSQKINIYAKPTDVLHEQALTQTQKVTIKSGTIIKAYITATYINQIGHKFVGVNHEVEKFIVSIYIPSEQRQELYNEIFFIINGNEESCVTTMKKDNPLLKLIPGSNPWSRYYYVEAPIEIRSKTITFSFKTFDDKSTVLLFSKDYL

SEQ ID NO: 9415 - DNA, 765 bp, Unknown
  Obtained from environmental sample
  misc_feature (1)..(765): n is a, c, g, or t
atgaaaaaagcaatagttttaatgaatatgggtggtccaaataatcttgatgaagtagatgtttttttaaaaaatatgttcaatgacaaatatatcataggagctccccaaccaataagagctatgattggttggattatacgaaaaaagcgtcttaaagaagcacaacacaactatagtttattaggtggtgtttctccaattgttggtcacacaaaaagattaaaaagacgattggaaaatattgtagatgctgatatttttcatgtgatgcgatatactcccccttttgctcatgaagtgatccaaagagtgcaagggtatgatgaaatttatgcaattcctatgtatcctcactactcatcaactactacaaaatcaagtattgaagacttaatcaaagaagcaaaaagatataatattgaaaaaaagattaaaactatagatgaatattatgcagatcctttatacaacaaagctattgttgaaagaattaaagagtctttagatgatgataatagtgaaaattttactttaatattctcagctcatggtcttacacaaagaattatagataaaggtgatttatatcaaaaacatattttagcaaatgtagaagttgcaaaaaaagagttagaatctcaaggaatcaagttcaaaaatatagaagtagcttatcaatcaagactgggtccaatggagtggctgcgtccatatttggaagataaacttgaagaggttgaaaaacaaataaaaaagttataa

SEQ ID NO: 9416 - protein, 254 aa, Unknown
  Obtained from environmental sample
  DOMAIN (2)...(254): Ferrochelatase
  misc_feature (1)..(254): Xaa is any amino acid
MKKAIVLMNMGGPNNLDEVDVFLKNMFNDKYIIGAPQPIRAMIGWIIRKKRLKEAQHNYSLLGGVSPIVGHTKRLKRRLENIVDADIFHVMRYTPPFAHEVIQRVQGYDEIYAIPMYPHYSSTTTKSSIEDLIKEAKRYNIEKKIKTIDEYYADPLYNKAIVERIKESLDDDNSENFTLIFSAHGLTQRIIDKGDLYQKHILANVEVAKKELESQGIKFKNIEVAYQSRLGPMEWLRPYLEDKLEEVEKQIKKL

SEQ ID NO: 9417 - DNA, 933 bp, Unknown
  Obtained from environmental sample
  misc_feature (1)..(933): n is a, c, g, or t
ttgacgccgggatcaatcagtgatatacacttggttaaagagttgaaatctaaactaaaacaagctcaaataaaagcttctataaaagtaaatacagtattgctagagttttactgggaacttggcaatgagatagttgagaaacaaaaaaacagcacttggggaagtgggttcttacagcaacttagtgatgatttgatggcagaatttcccgatatgaaaggattttcttatagaaatttaagggcgataaaacaatggtatatgttttattcaaattggccacaacttgtggccaaattagaaaatgaaaaagggcaacaagctgttgcccttttagacaatgaaaatacgaaacaagttgtttctcaattgacacaaatcccatggggacataatagagccataatctcaaaatgtaaagatacccaagaagcacttttttatgtaaacaaaaccatagaaaatggttggagtagaagtgtcttagtacaccaaatagagagtgacctatatacaagaagtggcaaagctatatcaaactttgaagtaactttgccaaaagaacaatcagacttagcccatgaacttataaaagacccatataactttgactttttaactctaagtgaaaatttcaaagagaaagaactcgaatcgggcttattggaacatatcacaagttttttattagaacttggaagtggatttgcttttgttggaaaacaaaaaaatcttaaagtcggtcaaaaagatttttacattgacttgcttttctatcatataagaatgcattgttatgttgtagttgagctaaaaactgttgattttgaaccagagtttgcagggaaactaaacttttatattaaagccattgatgaacagataaaaacaaaagaggataaacctactattggtatattattatgntag

SEQ ID NO: 9418 - protein, 310 aa, Unknown
  Obtained from environmental sample
  DOMAIN (11)...(310): Protein of unknown function (DUF1016)
  misc_feature (1)..(310): Xaa is any amino acid
MTPGSISDIHLVKELKSKLKQAQIKASIKVNTVLLEFYWELGNEIVEKQKNSTWGSGFLQQLSDDLMAEFPDMKGFSYRNLRAIKQWYMFYSNWPQLVAKLENEKGQQAVALLDNENTKQVVSQLTQIPWGHNRAIISKCKDTQEALFYVNKTIENGWSRSVLVHQIESDLYTRSGKAISNFEVTLPKEQSDLAHELIKDPYNFDFLTLSENFKEKELESGLLEHITSFLLELGSGFAFVGKQKNLKVGQKDFYIDLLFYHIRMHCYVVVELKTVDFEPEFAGKLNFYIKAIDEQIKTKEDKPTIGILLX

SEQ ID NO: 9419 - DNA, 408 bp, Unknown
  Obtained from environmental sample
  misc_feature (1)..(408): n is a, c, g, or t
atgaagaatttaaaattatcttatattcttattatcgcccttactcttttaagttcgtgtcaatgttatggatcgaacctgaagacgacctatatgcaagaactcaaagcaatttctaaaattaaaggaaatggaagtaatgaattattcactctgattcgcgcgacctcaagtgagttagaaaaagattggtcaaaagaacttgcccaagagctagctcgtgttttcaatgaacttctcaatgttaacgaaaactactttctcgttgaattgattgggccagttgtacaaaagagatcaaaagaatttattcccattttaaataaggccttatctaaaaagaatagtaagctctacaaagagatgcttgagatggataagaacgaagaaaaacatggaaatggttag

SEQ ID NO: 9420 - protein, 135 aa, Unknown
  Obtained from environmental sample
  misc_feature (1)..(135): Xaa is any amino acid
MKNLKLSYILIIALTLLSSCQCYGSNLKTTYMQELKAISKIKGNGSNELFTLIRATSSELEKDWSKELAQELARVFNELLNVNENYFLVELIGPVVQKRSKEFIPILNKALSKKNSKLYKEMLEMDKNEEKHGNG

SEQ ID NO: 9421 - DNA, 780 bp, Unknown
  Obtained from environmental sample
  misc_feature (1)..(780): n is a, c, g, or t
atggcctcagatataatcaacaaggcccttaattcaggacttcaagaagttaatcagatgaatcctccgggagctcctgatgaattggtttctaaatttgtttgggccttatcccttggagaagtcagttataagaatgagcatttactcttaggattagatgctcgttttgatgatcccacccttgctgagaagaaaccattaagtacacaatacttagcgcctcaaagtggagacttattgaaggggacatatccaaattctgactttattttcagtttaaatgagggtgtccttaatagagtcattcaactaagtactcttcgcggatactttgatcagattgacctagactcaggtgaagcgattaagctcgttaaaactccctatctttcattgaaaaatggtaaaggtaaaatgccactagaaattgaatatcaagtaacaggtttttctgctgtatttgttaagaatcccattcatattaagtttgacttgaatcttgattttccagtggatagtgaaggaaaagtctctatgcaagtggaatcgattgatgtaaatagctctagtgtggaagataagtatattcgcttatttggctctaaagttcgctcggcggttaaagatacacttgctgaagttaatagtgatctgaaaggatatctattaacagatgatattcctattcctgatgacctagcaggtattaaacttcaaaagataggaacagagattgataatggtcatctcttaatttattcacagtataataattaa

SEQ ID NO: 9422 - protein, 259 aa, Unknown
  Obtained from environmental sample
  misc_feature (1)..(259): Xaa is any amino acid
MASDIINKALNSGLQEVNQMNPPGAPDELVSKFVWALSLGEVSYKNEHLLLGLDARFDDPTLAEKKPLSTQYLAPQSGDLLKGTYPNSDFIFSLNEGVLNRVIQLSTLRGYFDQIDLDSGEAIKLVKTPYLSLKNGKGKMPLEIEYQVTGFSAVFVKNPIHIKFDLNLDFPVDSEGKVSMQVESIDVNSSSVEDKYIRLFGSKVRSAVKDTLAEVNSDLKGYLLTDDIPIPDDLAGIKLQKIGTEIDNGHLLIYSQYNN

SEQ ID NO: 9423 - DNA, 789 bp, Unknown
  Obtained from environmental sample
  misc_feature (1)..(789): n is a, c, g, or t
ttgtgtccttattgctcttttcataagttaaaatttgaagaggaaaaagcaagagagtactttaaaactttacgaaaagagatgaatattgcaaaatctatgggatatgattttatctcactttatattggtggtggaaccactactattttgcctgatgagttagtaaaaacaattgattatgcaaaagaactttttagtataaaagatgtttcttgtgagggtgatcctttgattgatgatactcttgttacattattatcaaaaaaagtagatagattatcagtaggggttcaaacaactaatgatgagatgttaaaaaaaattaaaagatataaaaagtttggttcttcaaaaacacaattagaaaatattacaaaagcaatagggaagttttcaattgtaaacacagacttaatttttaatcttccaagtcaaacccaaaagatgttagaggatgatttagatgagattataaagttaaatcctgaacaaatatcagtctaccctttgatgtattccccatctgttaaaaagaaaatagaaaaaaatataggaaagttacacaatgaaaatgagataaatttttataatatcataatggacaaattacaaaagaattataatcaaatatcatcttggacttttgcaaaaaaaaatattcacacttttgatgagtatgttgtagagtataacgaatatataggactaggctctgggtcatttagttttatagaagatactttatatatcaatactttttctttagaaaaatacaaaaaatggtag

SEQ ID NO: 9424 - protein, 262 aa, Unknown
  Obtained from environmental sample
  misc_feature (1)..(262): Xaa is any amino acid
MCPYCSFHKLKFEEEKAREYFKTLRKEMNIAKSMGYDFISLYIGGGTTTILPDELVKTIDYAKELFSIKDVSCEGDPLIDDTLVTLLSKKVDRLSVGVQTTNDEMLKKIKRYKKFGSSKTQLENITKAIGKFSIVNTDLIFNLPSQTQKMLEDDLDEIIKLNPEQISVYPLMYSPSVKKKIEKNIGKLHNENEINFYNIIMDKLQKNYNQISSWTFAKKNIHTFDEYVVEYNEYIGLGSGSFSFIEDTLYINTFSLEKYKKW

SEQ ID NO: 9425 - DNA, 684 bp, Unknown
  Obtained from environmental sample
  misc_feature (1)..(684): n is a, c, g, or t
ttgggagatggtaaaaaaatagtggggaatacaacttattgtacctttccaatagaagcacaatcaaaaccaaaagttgggggatatttttctccctctatagaaaaaatactctcgctcaaaccagatattgttattttgcaaaaaagtagcatcaaactctcaaaaaagcttgaatctttagggattaaaacaaaagttgtacagcttacaaccttgcaagatatcaaagatactatcaatgagatagggatagtattagaaaagcaaacaaaagcaaatgagatacttacaactcttgaaaataaacttactcaaattcaaaatatagtaaaagataaaaagatactatttgttatcggtcataatttaaaacttgaaagtagaatctttgtagcgggtcaaaacctctattttgatgatattatcgttaaaagtggaaatagaaatgcatttcaaagtaatcgctcaggtcagcctattttaaatatggaaaatctcattgcaaccaatgcagatatagtgatacttctagcgccatttacaaaacaaaaagaacttacccaggaacagttaatacaaccatggctcanactccctataaatgcagctaaaacaaaagccatctatgtgttagataaagagtatgcgggaattagtagtcatagacttatttacttttaa

SEQ ID NO: 9426 - protein, 227 aa, Unknown
  Obtained from environmental sample
  DOMAIN (1)...(216): Periplasmic binding protein
  misc_feature (1)..(227): Xaa is any amino acid
MGDGKKIVGNTTYCTFPIEAQSKPKVGGYFSPSIEKILSLKPDIVILQKSSIKLSKKLESLGIKTKVVQLTTLQDIKDTINEIGIVLEKQTKANEILTTLENKLTQIQNIVKDKKILFVIGHNLKLESRIFVAGQNLYFDDIIVKSGNRNAFQSNRSGQPILNMENLIATNADIVILLAPFTKQKELTQEQLIQPWLXLPINAAKTKAIYVLDKEYAGISSHRLIYF

SEQ ID NO: 9427 - DNA, 462 bp, Unknown
  Obtained from environmental sample
  misc_feature (1)..(462): n is a, c, g, or t
gtgtatgatgattttatgagtgtagaggagtttttagagataaataaactctatagctataaaagcatcgatgaagtgttaagattagtaaactgtgagtatataaaaaataaaaaatgcaaaaacttaagtagcggtgaatcacaactcttacttctatcaagtgctattttacacaatgctaaatatactatctttgatgaaccaacctcaaaccttgatcctcaaaagataaaaaatagttttcatattttacaagatgaagatatattacaaaacaaaataatcatcacacataatcttaacttagcttataaattaggatatgatatcttgtatataaaagatggggctatagctttttatgatagtagtgaacgattttttagtgatgaaaacttacagcttttttttaagaatagtgttaaaaaatgtgatgacaacatagtggtgagtttatga

SEQ ID NO: 9428 - protein, 153 aa, Unknown
  Obtained from environmental sample
  DOMAIN (1)...(117): ABC transporter
  misc_feature (1)..(153): Xaa is any amino acid
MYDDFMSVEEFLEINKLYSYKSIDEVLRLVNCEYIKNKKCKNLSSGESQLLLLSSAILHNAKYTIFDEPTSNLDPQKIKNSFHILQDEDILQNKIIITHNLNLAYKLGYDILYIKDGAIAFYDSSERFFSDENLQLFFKNSVKKCDDNIVVSL

SEQ ID NO: 9429 - DNA, 747 bp, Unknown
  Obtained from environmental sample
  misc_feature (1)..(747): n is a, c, g, or t
ttgaaacaaatatcaaataacattagaaaaaatattttgcatattgcatatttatcagggtcaccacatgtaggctctgccctaagttgtacagatatattggctactttgtactttgatatattaaagctagaagattatgaaaatagagatctctttttgttatcaaaagcacattctgctatggccttatattctacgatgtatgaaaaaggttttttgacaaaagaagagttagagggatattatcaaaataatggaacattaccagcacatacagataaaaatacaaatccatatatagagataagtgccggaagtttaggacatggactgccaatggctttaggtatggcacactccttaaaacttaaaaaaagtgatagaaaagtgtttgttcttatgggagatggagaatcacaagagggaagtgtttgggaggcggcgatgttagcacctcatttgaatctagataatttaactgtatttattgatagaaataatcttcaagggtatggaagagcgagtgatattttatcttatgaaccaatagatgataaatttaaagcatttaactgggaagtattaagagttgatggacacaaccataatgccattaaggaagctgtagaatttaaaacggataaacccaaaatgattatttgtgatacaacaaaagggaaagatgtaagttttatggaagataagcttatttggcactattatgtggttactgatgagatttaa

SEQ ID NO: 9430 - protein, 248 aa, Unknown
  Obtained from environmental sample
  DOMAIN (2)...(248): Transketolase, thiamine diphosphate binding domain
  misc_feature (1)..(248): Xaa is any amino acid
MKQISNNIRKNILHIAYLSGSPHVGSALSCTDILATLYFDILKLEDYENRDLFLLSKAHSAMALYSTMYEKGFLTKEELEGYYQNNGTLPAHTDKNTNPYIEISAGSLGHGLPMALGMAHSLKLKKSDRKVFVLMGDGESQEGSVWEAAMLAPHLNLDNLTVFIDRNNLQGYGRASDILSYEPIDDKFKAFNWEVLRVDGHNHNAIKEAVEFKTDKPKMIICDTTKGKDVSFMEDKLIWHYYVVTDEI

SEQ ID NO: 9431 - DNA, 573 bp, Unknown
  Obtained from environmental sample
  misc_feature (1)..(573): n is a, c, g, or t
atgaaagaagagatacaaagtagtgaaaaacttctacaagagtacaaaaaagttgtagatgcaggtgcgattgtctctaaaacagatgtaagaggaaaaattacttatgcaaatgagcaattttgcaaaatttcaggttattcattagatgaactgataggaaaaaatcataatattgtaagagatccagatgttgcggcagatatttatagagatttatgggagactataaaaagaaaagagacatggaaagggaagattaaaaatcgtgctaaaaatggctctagttactatgttaacgcgattgtaattcctattttagacgagagtgacgaagttattgagtatgtcgctttaagacaggatattacagagcttgaagagttaaataattttttagaaaaacgagtaaatgaagagggtgaaaaaaacagaaaaaaagatgaagagagtatctcaatacaaacttcatttttagaaaatagtcccaaaccctatcggttgtctataaaaaatgacataggttcagtatgccaaattctaaagtttttaacctttaataaaaaaaaaagg

SEQ ID NO: 9432 - protein, 191 aa, Unknown
  Obtained from environmental sample
  DOMAIN (13)...(75): PAS domain
  misc_feature (1)..(191): Xaa is any amino acid
MKEEIQSSEKLLQEYKKVVDAGAIVSKTDVRGKITYANEQFCKISGYSLDELIGKNHNIVRDPDVAADIYRDLWETIKRKETWKGKIKNRAKNGSSYYVNAIVIPILDESDEVIEYVALRQDITELEELNNFLEKRVNEEGEKNRKKDEESISIQTSFLENSPKPYRLSIKNDIGSVCQILKFLTFNKKKR

SEQ ID NO: 9433 - DNA, 747 bp, Unknown
  Obtained from environmental sample
  misc_feature (1)..(747): n is a, c, g, or t
atggaggtaggaagaaacatttttgaaattttagtcaatgatatcccatatatcgatgatacagttgcaaaaatgtatacatttaataatattactttagtagagtatcaaaaattaaagataagacactataacgaaagattagaagattttattaaaaaacttaataagaataagtatgaaaacagagattctcttgttaaagatgatgaaaaaatcaaaagagttcttaactcaaaagagaaagaagttttaaaaagatctcgtgataatgtacaaattagctcagctgagtatagtcaagatatagatgcctatatattagaggagatagaagagctctctgaaatagagatagagataaatgagttaattagactattcaacaacgagaaaagtgttgactttttaggtgttatttctataaaattttttaaatatgcatctactgtttcactattgatagattttgaagatctctcttttgcaataaaatctttaggagatttactgcaaacaattaaagtagatgatcttgatgatacaaaatataaaaaaatagagttatatttgttaaatattttgcttgatctatcaaattggagacgaactatatttatcgatagaagagcgaatgatattcactatttagatagttcactatttagtacaatattgcaatttgagctaatttttaatgatgcagaagttattaacgatggtgatgatgactttgaatttttttga

SEQ ID NO: 9434 - protein, 248 aa, Unknown
  Obtained from environmental sample
  misc_feature (1)..(248): Xaa is any amino acid
MEVGRNIFEILVNDIPYIDDTVAKMYTFNNITLVEYQKLKIRHYNERLEDFIKKLNKNKYENRDSLVKDDEKIKRVLNSKEKEVLKRSRDNVQISSAEYSQDIDAYILEEIEELSEIEIEINELIRLFNNEKSVDFLGVISIKFFKYASTVSLLIDFEDLSFAIKSLGDLLQTIKVDDLDDTKYKKIELYLLNILLDLSNWRRTIFIDRRANDIHYLDSSLFSTILQFELIFNDAEVINDGDDDFEFF

SEQ ID NO: 9435 - DNA, 738 bp, Unknown
  Obtained from environmental sample
  misc_feature (1)..(738): n is a, c, g, or t
atggagggtaaaacatattgggataatgctttagaaaaatgtcaagaaaatggtgcactatatttaagctgggaagatgatgaaaaatatatgaaagagcataaatatttttctgattatcaccatttaaatcaaaaaggaagtctgatttttaatgaagatatgctcaaaagattaataaaaaacaaaaaaacaaaattaattccaaatgtacaaagtttaatttcgagcatgaatgattataatatactcagatataaaaatatatattatgcaataccacaaaaattagtaaatgtggatctagaaaatgacgatttatcgaaatttaaaggtattgttataagtaagagtctgtctgatttggaagagaagattaaaaatagtgtgccaattttaatctctagcatatatgattataatatagttaaatatcaaaatcaatattatgcaataccacaaagattagggaaaattgagcttgagcatgatgacttgtcaaaatttaaaagtattattataagtaagcaactatctggtttggaagaagagattaaaaacagtgtgccaattttaatctcaagtataaataattataatattgttaaatatcgaaacaaatattatgcaataccacaaaaattaggaaaagttgattttgtgactgatgacttatcaaaatttaaagggattattatcagtgaagaactatctagtttggaagaagaggtaaaataa

SEQ ID NO: 9436 - protein, 245 aa, Unknown
  Obtained from environmental sample
  misc_feature (1)..(245): Xaa is any amino acid
MEGKTYWDNALEKCQENGALYLSWEDDEKYMKEHKYFSDYHHLNQKGSLIFNEDMLKRLIKNKKTKLIPNVQSLISSMNDYNILRYKNIYYAIPQKLVNVDLENDDLSKFKGIVISKSLSDLEEKIKNSVPILISSIYDYNIVKYQNQYYAIPQRLGKIELEHDDLSKFKSIIISKQLSGLEEEIKNSVPILISSINNYNIVKYRNKYYAIPQKLGKVDFVTDDLSKFKGIIISEELSSLEEEVK

SEQ ID NO: 9437 - DNA, 738 bp, Unknown
  Obtained from environmental sample
  misc_feature (1)..(738): n is a, c, g, or t
atgcctaaaaactataagttaaatcttgactatatagaacagtttgaaactatcactattaatttagaggggtatctctcctcttttgagtttaaaattattcaagatgtttctaaagttgttgatacttttatcaatatcacctttaatcaatacaatcaaaaaaacaaagaactttttgatgcattaaaagataagttacaaatagattatagttatacaatagatttaactaatatgaaaatagttgaggaaaaagaggatcaaaagcaaaaacaaaatatagtaatatctccactttcatctcaacttgaacaaatagcatttataaaataccatattacgaagatggtgcaaaatggaattgaaccagaaaatatagcagtagttgtacctaatgaacaaatagcaacatctcttgagctttttgatgatgaacactattttaactttgcaatgggaagaacaattggacaaaataagattacaaaagttgtaaagcttcttaataaaatattgataaattttgaaccaaaagatttagaaaaatttaaattcttaggaattaaagagaatgattttgtaaatatatttagagacaattggaataaagttcttactaaagagatatttgaaaatatattaaattatctttttctttttgaagaggatgaagaggttttagaaaaactagagcatttaaaaatttcacttgatattttactttttacaatatag

SEQ ID NO: 9438 - protein, 245 aa, Unknown
  Obtained from environmental sample
  misc_feature (1)..(245): Xaa is any amino acid
MPKNYKLNLDYIEQFETITINLEGYLSSFEFKIIQDVSKVVDTFINITFNQYNQKNKELFDALKDKLQIDYSYTIDLTNMKIVEEKEDQKQKQNIVISPLSSQLEQIAFIKYHITKMVQNGIEPENIAVVVPNEQIATSLELFDDEHYFNFAMGRTIGQNKITKVVKLLNKILINFEPKDLEKFKFLGIKENDFVNIFRDNWNKVLTKEIFENILNYLFLFEEDEEVLEKLEHLKISLDILLFTI

SEQ ID NO: 9439 - DNA, 531 bp, Unknown
  Obtained from environmental sample
  misc_feature (1)..(531): n is a, c, g, or t
ttggcagctataaaacttcatattgaaaacattagatacgaatctcctcataccgaagaactcaacaccatttcaaaaattctaaaagatactattcaggatttaagaaccatttgctatgaaactttacctttggtactttatgatcatggactaaagaaagctgttcaagatttaatttctaaaaatatctctactcagttagatattaatctaaagtgtgatgaccatctacctgaattaaacaaacatcttaatactgctatatttagaataattcaagagtttgtttctaacacagttaaacacggaaaagcatcgctcataaacataaatatttctgtagtggaagaaaatattttaattgaattaaaagacaatggaataggttttgaaattgctgatttatccgttaataatggtcatggaattcagaatattaaaagtagagtagaatcttttgcaggaactttagtgatggagagtgctctaaaaaaaggcacatcattttctattttaatcccttattaa

SEQ ID NO: 9440 - protein, 176 aa, Unknown
  Obtained from environmental sample
  DOMAIN (84)...(176): Histidine kinase-, DNA gyrase B-, and HSP90-like ATPase
  misc_feature (1)..(176): Xaa is any amino acid
MAAIKLHIENIRYESPHTEELNTISKILKDTIQDLRTICYETLPLVLYDHGLKKAVQDLISKNISTQLDINLKCDDHLPELNKHLNTAIFRIIQEFVSNTVKHGKASLININISVVEENILIELKDNGIGFEIADLSVNNGHGIQNIKSRVESFAGTLVMESALKKGTSFSILIPY

SEQ ID NO: 9441 - DNA, 309 bp, Unknown
  Obtained from environmental sample
  misc_feature (1)..(309): n is a, c, g, or t
atgcgacatcttttaattttcttttcattaataaccttattttcttgtggagagataaaaaaagaagcatctatttctgaaaatacatcagaacatattcgttatgcaaaaggatttaatattgagtatcacgaanattataaaatagttaaaatcctccagccttggaaaggagaaaacaaaaccataaactatgtgttgtatgaaaatgaaaaacccgaaaatattgaaggaattttcattaaaacgcccataaaatcaattggtttgtttaagcctaactcatttagccttttattggaaaattaa

SEQ ID NO: 9442 - protein, 102 aa, Unknown
  Obtained from environmental sample
  misc_feature (1)..(102): Xaa is any amino acid
MRHLLIFFSLITLFSCGEIKKEASISENTSEHIRYAKGFNIEYHEXYKIVKILQPWKGENKTINYVLYENEKPENIEGIFIKTPIKSIGLFKPNSFSLLLEN

SEQ ID NO: 9443 - DNA, 696 bp, Unknown
  Obtained from environmental sample
  misc_feature (1)..(696): n is a, c, g, or t
atgcttaaaataaatgatttagaagtcttttatggccttatcaaaggtgtaaaaggaataagctttgaagtaaagaaaggtcaaattgtttctttaataggttcaaatggagcagggaaaacatcaactttagaatcaatagtaaatgatgttaagaaaaaaggaactattctttttgataatttagatatttcaaaatttccaacacataagattgttcaaagtggtatttcacttgttccagaaggaagaagagtttttataaatttaactatagatgaaaaccttagaatgggtgcttttaacaatgatgatagatatgaagagttaagagaacatgtttatactctttttccaaggcttgtagctaaaaaagaacaattagcaggaaccatgagtggaggggaacagcaaatgcttgcaattgctagagctttgatgagttcaccaaagcttcttatgcttgatgagccttctttaggacttgcacctaagataattggagaactttttgagacaattataaaacttaaagatgaaggtattaccatattgttggttgaacaaaatgcctatgcagctttagaagtttcagattatagttatgttttagaaaatggaaagattgctttagaagggcaaggaagcgaacttttaaaatcaaatgagataaaagcaaagtatttaggtgcttaa

SEQ ID NO: 9444 - protein, 231 aa, Unknown
  Obtained from environmental sample
  DOMAIN (27)...(207): ABC transporter
  misc_feature (1)..(231): Xaa is any amino acid
MLKINDLEVFYGLIKGVKGISFEVKKGQIVSLIGSNGAGKTSTLESIVNDVKKKGTILFDNLDISKFPTHKIVQSGISLVPEGRRVFINLTIDENLRMGAFNNDDRYEELREHVYTLFPRLVAKKEQLAGTMSGGEQQMLAIARALMSSPKLLMLDEPSLGLAPKIIGELFETIIKLKDEGITILLVEQNAYAALEVSDYSYVLENGKIALEGQGSELLKSNEIKAKYLGA

SEQ ID NO: 9445 - DNA, 594 bp, Unknown
  Obtained from environmental sample
  misc_feature (1)..(594): n is a, c, g, or t
atggaaatgatttccaaaatgaatattcctcttccttcaaaaaaagaacaagaaaaaatcgcctcttttttaacttctattgataaaaagattgaacaattatcaaaaaaagatgagttgttggagtcttataaaaaaggtgtgatgcaaaaaatattttcccaagagattagattttccccaaaggggacttcttcgcaagctcagggcgaagatgatggaagtgtttatcctgattgggaagagaaaaagtttaattatatttttgaacgaataatgacaaaaaatatagaagataataaaaatgttttaacaatttctgcacaacaaggattaatcaatcaagaaaaatattttaataaatctgtatcagcaaaagatgtaacgaattattatctattagaaaatggagatttcgcatataataaaagttattctaatggctatccaatgggtgcaattaaaagattaaatagatatgaaaaaggtgttgtctcaacattgtatatttgttttagaattaaaaagaaatatgatggaagtttttatgaacaatattttaataatggcttattaaataaaggagttacataa

SEQ ID NO: 9446 - protein, 197 aa, Unknown
  Obtained from environmental sample
  misc_feature (1)..(197): Xaa is any amino acid
MEMISKMNIPLPSKKEQEKIASFLTSIDKKIEQLSKKDELLESYKKGVMQKIFSQEIRFSPKGTSSQAQGEDDGSVYPDWEEKKFNYIFERIMTKNIEDNKNVLTISAQQGLINQEKYFNKSVSAKDVTNYYLLENGDFAYNKSYSNGYPMGAIKRLNRYEKGVVSTLYICFRIKKKYDGSFYEQYFNNGLLNKGVT

SEQ ID NO: 9447 - DNA, 384 bp, Unknown
  Obtained from environmental sample
  misc_feature (1)..(384): n is a, c, g, or t
ttgaagggaggtatagagctttggaaagttggagggaaaagatatcgaaactttggaatgggtaacggtaggatgaatttgctaaacgagcaaaaaacagagacgcttaatattttggatgttagaaaagatggagaatacgtatcctcacatattgtagatgcgcaacatctatcgctagacctcatcaatgaaaaaatgaacgaagtaagtaaggataaaacttattatgtgcattgtgcaggtggataccgctctgtaattgctgcttccatattaaaagcgagaggttttcataacctgatagacgttgacggtggatttgcagccataaaacaaaccgatattgagacaacagattttgtttgtccttcaaccttataa

SEQ ID NO: 9448 - protein, 127 aa, Unknown
  Obtained from environmental sample
  DOMAIN (24)...(114): Rhodanese-like domain
  misc_feature (1)..(127): Xaa is any amino acid
MKGGIELWKVGGKRYRNFGMGNGRMNLLNEQKTETLNILDVRKDGEYVSSHIVDAQHLSLDLINEKMNEVSKDKTYYVHCAGGYRSVIAASILKARGFHNLIDVDGGFAAIKQTDIETTDFVCPSTL

SEQ ID NO: 9449 - DNA, 303 bp, Unknown
  Obtained from environmental sample
  misc_feature (1)..(303): n is a, c, g, or t
gtgacaacagatgggaggttaaaacaacataccgattataatccaaatccagatctaggcgatttagaatgtgtaatattagataaagactctaatattcttgaaacctattctataaaaaacccgttattaaaaattgttgagtacatcaacgattctggacattttgaaaagaaaatactgaatttagattacgcacaattttctttaaaattgcaattaaacgctaaagctgcatatgcagtaattcacgagattaaccctaacggaaacatcaaacttaagacgactaaaattgaataa

SEQ ID NO: 9450 - protein, 100 aa, Unknown
  Obtained from environmental sample
  misc_feature (1)..(100): Xaa is any amino acid
MTTDGRLKQHTDYNPNPDLGDLECVILDKDSNILETYSIKNPLLKIVEYINDSGHFEKKILNLDYAQFSLKLQLNAKAAYAVIHEINPNGNIKLKTTKIE

SEQ ID NO: 9451 - DNA, 429 bp, Unknown
  Obtained from environmental sample
  misc_feature (1)..(429): n is a, c, g, or t
atgaaaattgtaacatacgccattgccttaaccttaactattggcctactgtcttgcgctagtacacttctggcttctgaagaagaacccacagtcctagaagcacctcagttactttttttaaactatgaaatgaaaacatatggaaataaaaagtcgatttcacttatcaaccaagtgacaacagatgggaggttaaaacaacataccgattataatccaaatccagatctaggcgatttagaatgtgtaatattagataaagactctaatattcttgaaacctattctataaaaaacccgttattaaaaattgttgagtacatcaacgattctggacattttgaaaagaaaatactgaatttagattacgcaccaatttcctttaaaattgcaattaaaacgctaaagcctgcattatgcaggtaa

SEQ ID NO: 9452 - protein, 142 aa, Unknown
  Obtained from environmental sample
  misc_feature (1)..(142): Xaa is any amino acid
MKIVTYAIALTLTIGLLSCASTLLASEEEPTVLEAPQLLFLNYEMKTYGNKKSISLINQVTTDGRLKQHTDYNPNPDLGDLECVILDKDSNILETYSIKNPLLKIVEYINDSGHFEKKILNLDYAPISFKIAIKTLKPALCR

SEQ ID NO: 9453 - DNA, 891 bp, Unknown
  Obtained from environmental sample
  misc_feature (1)..(891): n is a, c, g, or t
atgaatagtgaagatagtttgatacaaatagaacttaatgttttacaagatatagctacaataatagccgattcaagaggacaaatagtagagtctttagaaaagtgtctaaaaatactcaaaaaaaatcttgatttagaaaattgtgttatatataaattagaagatgatatgttaaacatatttgcttctatagattttaataagcaccaaaaaattatatcagaatatagactaggtgagggtgctacaggtttagctgcaaagagtatggaacctgttgttattgaaaatgtacataatgatatattatttttaaataaatctggaaatagaagtagtgatactatttcatatatcgcagttcctatgattgtagaacatgaaacaattggtgtgttagcaactaatcttacaaaatccacaaaaatagattttgatgatactgtgagaatactatcaattattagttctttatttgctcaaagtatgtattcacattttgtcttagaagatgagaaagagaagttaaaagatcttaaacagtattataaaatggagtgggattcaaaagtgcataattttggtgacataattggcgagagtaagaagatgaaggatgtctatagagttattgagcgaattgcgcanagtgatgtgactattcttgtaagaggtgaaactggaactggtaaagagctagtagcagctgcaatacataaaagaagtcgcagagcagaagagccattttgtaaaataaactgtgcagctataactgatagtttactagaaagtgagctatttggacatgaaaaaggtgcattacagatgcgaaagagactagaaaggggcgatttgagcctgcagataaggggactttattttagatga

SEQ ID NO: 9454 - protein, 296 aa, Unknown
  Obtained from environmental sample
  DOMAIN (28)...(164): GAF domain
  misc_feature (1)..(296): Xaa is any amino acid
MNSEDSLIQIELNVLQDIATIIADSRGQIVESLEKCLKILKKNLDLENCVIYKLEDDMLNIFASIDFNKHQKIISEYRLGEGATGLAAKSMEPVVIENVHNDILFLNKSGNRSSDTISYIAVPMIVEHETIGVLATNLTKSTKIDFDDTVRILSIISSLFAQSMYSHFVLEDEKEKLKDLKQYYKMEWDSKVHNFGDIIGESKKMKDVYRVIERIAXSDVTILVRGETGTGKELVAAAIHKRSRRAEEPFCKINCAAITDSLLESELFGHEKGALQMRKRLERGDLSLQIRGLYFR

SEQ ID NO: 9455 - DNA, 606 bp, Unknown
  Obtained from environmental sample
  misc_feature (1)..(606): n is a, c, g, or t
ttgggnccgtttatggccggagaagattatatgaaagacaagctaaagcacataactaactttgaaaataaacttcccaagattcattctcaactagcgattgagacattgaaaaatccttataattttgattttttagagttaagagatcatcatgatgaaaaagagcttgaagatgctttggtggataatattactaattttttagttgagttgggacaaggttttgcttatcttggaagacagtataagctaatagttgatggcaatgagtttaaaatcgatttgcttttttatcatgtaaaacttcattgttatgtggtagttgagcttaaaactgttgattttaaaccagaatttgcaggtaagctaaacttttatatctcagcagttgatggtgaactaaaatcaaaagaggacagcccaacaatagggatactaatatgcaaatcaaaaaatgatacgatagtggagtattctttaaaagatataaataaaccaatggggataagtgagtatgaactcacaaaagtattgcctgaaaatttcaaatcatcgcttcctagtatagaagagatagaagctgaacttggagatatgagatga

SEQ ID NO: 9456 - protein, 201 aa, Unknown
  Obtained from environmental sample
  DOMAIN (6)...(190): Protein of unknown function (DUF1016)
  misc_feature (1)..(201): Xaa is any amino acid
MGPFMAGEDYMKDKLKHITNFENKLPKIHSQLAIETLKNPYNFDFLELRDHHDEKELEDALVDNITNFLVELGQGFAYLGRQYKLIVDGNEFKIDLLFYHVKLHCYVVVELKTVDFKPEFAGKLNFYISAVDGELKSKEDSPTIGILICKSKNDTIVEYSLKDINKPMGISEYELTKVLPENFKSSLPSIEEIEAELGDMR

SEQ ID NO: 9457 - DNA, 999 bp, Unknown
  Obtained from environmental sample
  misc_feature (1)..(999): n is a, c, g, or t
atggccggagataggatctcagttgattatgttcggttaattggaaaagttttaggtattcaagttgagtttataaccggtaaaacttgggaagaatcattagtgatgttaaaaaacaaacaactcgacttaattcctggtgtagcaattactgaagagagaaagaaatttattacctatacagatataaacaattttaattatcaagtagcattaggggtaataaaagagagtggtataaactcttttgatgatttaaaagagaaaactatctctgtgttaaaaaatacatttcttcaccgtattttacaagataaatatccaaatcaaaagttattagctactccaactgttaaagaagctgtagaagctgttgcgtctgggaaagcagatgctgtaatagataatttggcaacggtagagtattataaaaatagtggatggctaggaaacttaaaaacattaaagatggaccaagtagcacatatccctcaaaatacgggtgcatattttggaattgctaaagataattatctcttaaagtcaattttagagaaagcaaactcctctttatcttttaatgagcttctttcattacaaaaaaagtggttaaatgttaagtctgaaaatactattcaatggaatgatgaagaactagcatatcttaaacaaaaaaaagaactcaaatattgtatcaatccaaattggttaccatttgaaaaaatagagaatgaacaacatattggtatgacatctcaatatataaaagagtttgaaaagaacttacctatctcaatgaagatatataaaacgcaagagtggacagatacaatagaatctgctaaaaatagaaaatgtgattttgtaacaattatgatggataccaatgagagaagaaaagagtttagcttcaccacaaatattatggatataccttttagttatcgcaaccaaaacaaaataaacctttttataaaggaaaatttcagaatgtgttaa

SEQ ID NO: 9458 - protein, 332 aa, Unknown
  Obtained from environmental sample
  DOMAIN (1)...(206): Bacterial extracellular solute-binding proteins, family 3
  misc_feature (1)..(332): Xaa is any amino acid
MAGDRISVDYVRLIGKVLGIQVEFITGKTWEESLVMLKNKQLDLIPGVAITEERKKFITYTDINNFNYQVALGVIKESGINSFDDLKEKTISVLKNTFLHRILQDKYPNQKLLATPTVKEAVEAVASGKADAVIDNLATVEYYKNSGWLGNLKTLKMDQVAHIPQNTGAYFGIAKDNYLLKSILEKANSSLSFNELLSLQKKWLNVKSENTIQWNDEELAYLKQKKELKYCINPNWLPFEKIENEQHIGMTSQYIKEFEKNLPISMKIYKTQEWTDTIESAKNRKCDFVTIMMDTNERRKEFSFTTNIMDIPFSYRNQNKINLFIKENFRMC

SEQ ID NO: 9459 - DNA, 864 bp, Unknown
  Obtained from environmental sample
  misc_feature (1)..(864): n is a, c, g, or t
gtggtagatgagaatgttttaacttcaacaacagacaaaagaggagtaataacttatgtatcgcaagccttttgtgatattagtgggtatacaaaagcagaacttatagggaaaagacataatattataagacatccagataccccaaaagaattatttgaagatttatggtcgacgattacatctggaaaaacttggaaaggtgagattaaaaataaaaataaaaatggaacattctactgggttgatgctgttatctcacctatatttgatgatgataaaaatataacaggatacactgcaatcagacatgatattaccaataagaaacttgttgaagagttatctatcaaagatgagttaactaaactttataataagcgatattttaatgaagtatttgaaaaagagctcaatagagcaaaaagagataatcatacttttggtttaatgatattagatattgatttttttaaacaatataatgataattacggtcatcaaaaaggtgattatgtattagaagaggttggtaaagagttgcaaaaaatatgtcagcgctcttctgatattgcgtatagaattggtggagaagagtttgctattacctttacacaatattttgaggaagatgcagttaagtttgcaaaactagttaatgagagtatagaagctttaaatcttgaacataaatataataaggcaagtgactatataactgtatctattggtctttatactgatagtggtgaaaaactagctaacatgaaagagatttaccattttgcagacttggcactttatcaagcaaaagaaagtggtcgtaatcaagctattctatataaagataaagatttaagttag

SEQ ID NO: 9460 - protein, 287 aa, Unknown
  Obtained from environmental sample
  DOMAIN (67)...(109): PAC motif
  misc_feature (1)..(287): Xaa is any amino acid
MVDENVLTSTTDKRGVITYVSQAFCDISGYTKAELIGKRHNIIRHPDTPKELFEDLWSTITSGKTWKGEIKNKNKNGTFYWVDAVISPIFDDDKNITGYTAIRHDITNKKLVEELSIKDELTKLYNKRYFNEVFEKELNRAKRDNHTFGLMILDIDFFKQYNDNYGHQKGDYVLEEVGKELQKICQRSSDIAYRIGGEEFAITFTQYFEEDAVKFAKLVNESIEALNLEHKYNKASDYITVSIGLYTDSGEKLANMKEIYHFADLALYQAKESGRNQAILYKDKDLS

SEQ ID NO: 9461 - DNA, 666 bp, Unknown
  Obtained from environmental sample
  misc_feature (1)..(666): n is a, c, g, or t
atgatagagcgtttttaccttaaaaattatctcagttttgaagaagttgaactagatcttgatccagggcttattgtctttaccggtcctagcggaagcggtaaatctattttgatgaactccatattggcatcttttggatttgcagatgcagaagcagcactgagcgaagccactgtttgctggaagattgatgaagatgctacaggtatagtcaacagtgagagtaatgtatttcgtcaaataaaaaaagagaaagttcgatattttataaattcacaaactatttcaaaaaaatcgatcaaggagttctcttctcagagactgagacatctatctttaaaagattatagtgattttgatcaaagctcactacttaatctactggataattatggctcaaacaaaaaattaaaaaaagagctagagatatatagaaataattttatagagtataaaaaagttttaaaagagctgcaaattatagaagatgagcagagaaagataactgaactaaaagagtttgcagagtttgaaataaataaaatagatgaagccacacctacagttggagaagatgaagaacttctagagataaaaaagatgctctctaaaaaaagagaagatngggggagaggatatctcaagcagaaagttattttttaa

SEQ ID NO: 9462 - protein, 221 aa, Unknown
  Obtained from environmental sample
  DOMAIN (1)...(134): RecF/RecN/SMC N terminal domain
  misc_feature (1)..(221): Xaa is any amino acid
MIERFYLKNYLSFEEVELDLDPGLIVFTGPSGSGKSILMNSILASFGFADAEAALSEATVCWKIDEDATGIVNSESNVFRQIKKEKVRYFINSQTISKKSIKEFSSQRLRHLSLKDYSDFDQSSLLNLLDNYGSNKKLKKELEIYRNNFIEYKKVLKELQIIEDEQRKITELKEFAEFEINKIDEATPTVGEDEELLEIKKMLSKKREDXGRGYLKQKVIF

SEQ ID NO: 9463 - DNA, 579 bp, Unknown
  Obtained from environmental sample
  misc_feature (1)..(579): n is a, c, g, or t
ttgatgcataaatattggggtagaaaggctcataatgtaattaatgattatattaattactttactaatgaaggagatactgtattagatccatttatgggaagtggtgttacaattatagaaagtttaaaattaaatagaaaagctataggtattgatataaatcctatgtcttcatttattgtaaaaaactcaattagtaaaatagattttttagaatttgaaaaagaatataataaaattttcaacaaaatttttgataaatacaactatctttatgaaacgaattgttcaatatgcaacaagccatccacaatagaaactaccatttgggaaaatgatgaaattcaaagagttaaaggtatttgcaaagaacatgctacttttattaaaaatgtgcaaaaagttgatttagataattattcaaattgtactagcttaaaaaataaactgttaaatgataaaaagatctcatttcctactgacaatattatgaaatatgttaaaaggagtggtcgagaaaaaataaatgaactatttaatgatagagcattaattatattatcaggattaatttga

SEQ ID NO: 9464 - protein, 192 aa, Unknown
  Obtained from environmental sample
  misc_feature (1)..(192): Xaa is any amino acid
MMHKYWGRKAHNVINDYINYFTNEGDTVLDPFMGSGVTIIESLKLNRKAIGIDINPMSSFIVKNSISKIDFLEFEKEYNKIFNKIFDKYNYLYETNCSICNKPSTIETTIWENDEIQRVKGICKEHATFIKNVQKVDLDNYSNCTSLKNKLLNDKKISFPTDNIMKYVKRSGREKINELFNDRALIILSGLI

SEQ ID NO: 9465 - DNA, 723 bp, Unknown
  Obtained from environmental sample
  misc_feature (1)..(723): n is a, c, g, or t
ttgccaatggtaaatatatgggcagaaaaaattgcaaataatttaacaggttattttaaggattataagtttccagaaagaaaatttgaatttttaagcaccatagatatagacaacgcttttgcaattaaacacaaaggcttttggagaactgttggtggtttagcaaaatctttagctaagcctcaaaccttaaaacacagagtagatgtgttgtgggacaaaacttcagatccatatgatacttatgattatcaggatgaaatacaccataaatacaatgttcgtccgacttatttttttttaataggaaattatgcttcatttgataaaaatatagcttttgataatgaaagttttcagcatttaattaaaaaaataactataacaaatactgttggtttacacccttcatacaaatctaatagtaatattgaattactaaaagaagaaaaattacgattggaaaacattgtggaaaagaaaataacaaaaagccgacaacactttttaaagttaagctttccatcaacgtacagaaatttaattgccattggaattaatgaggattataccatgggatatgcagaaaatagtggttttagagcaagtatttgttctcccttttatttttttgatgtagaaaaaaataaagccaacggctttaaaaatattccattttgtgtgatgggaagcgggtttaaaatacctatcaaaatttga

SEQ ID NO: 9466 - protein, 240 aa, Unknown
  Obtained from environmental sample
  misc_feature (1)..(240): Xaa is any amino acid
MPMVNIWAEKIANNLTGYFKDYKFPERKFEFLSTIDIDNAFAIKHKGFWRTVGGLAKSLAKPQTLKHRVDVLWDKTSDPYDTYDYQDEIHHKYNVRPTYFFLIGNYASFDKNIAFDNESFQHLIKKITITNTVGLHPSYKSNSNIELLKEEKLRLENIVEKKITKSRQHFLKLSFPSTYRNLIAIGINEDYTMGYAENSGFRASICSPFYFFDVEKNKANGFKNIPFCVMGSGFKIPIKI

SEQ ID NO: 9467 - DNA, 699 bp, Unknown
  Obtained from environmental sample
  misc_feature (1)..(699): n is a, c, g, or t
atggataaatttgcaactctcacagggcgtagctataaactttttgattatctaggtgcaattgatgctacaaaaattattgttgtaatgggttcaggggctagtgctgttgatgaaactatagaacatctcctagaagatggacaaaaagttggtatgataaaagtgagacttgctttacctttttgtgttgatagttttataaaagcgattccaaaaactgtaaaagcaatagccgttcttgatagaacaaaagaatcaggaagtattggtgagcctctttatcatgatgtagttacagccctttttgaatcgcaaaataaactagagtttcctatgcctaaaatcataggtggaagatatggtatctcatctaaagaatttacaccaagtatgattaaaactatttttgatgaattagagaaaccaacaccaaaaaatcactttacaattggtatcaatgatgatgttacacattcaagtttagattatgataaaaatctcattatggaaaataaagagcaatatgaagctgtattttatggacttggaagtgatggaactgttggggcgaacaaaaactctattaaaattatagggatggagacagagaattatacacaaggatattttgtctatgattcaaaaaaatctggttctatgacaacttcccatttacgatttggtcaaaaccaataa

SEQ ID NO: 9468 - protein, 232 aa, Unknown
  Obtained from environmental sample
  misc_feature (1)..(232): Xaa is any amino acid
MDKFATLTGRSYKLFDYLGAIDATKIIVVMGSGASAVDETIEHLLEDGQKVGMIKVRLALPFCVDSFIKAIPKTVKAIAVLDRTKESGSIGEPLYHDVVTALFESQNKLEFPMPKIIGGRYGISSKEFTPSMIKTIFDELEKPTPKNHFTIGINDDVTHSSLDYDKNLIMENKEQYEAVFYGLGSDGTVGANKNSIKIIGMETENYTQGYFVYDSKKSGSMTTSHLRFGQNQ

SEQ ID NO: 9469 - DNA, 543 bp, Unknown
  Obtained from environmental sample
  misc_feature (1)..(543): n is a, c, g, or t
atgaaaacaaaaattttaatcatagaagatgagacaatagttgctcttgatattaaaagtgccttggcaaatctaggttatgtagtaacttcaatagctacaaatcatacagaagcatttatgagtattgaagaaaatatacctaatataattttaacagatatcaacctagaaaatagtatagatgggattgagatagttcaagagatacaaaaaacaaaaaatatccctgtgatatatttaactgcatttagtgatgatgatacaatcaatagagctatccaaaccaatcctgtaggctatctactcaaaccatttcaaacaaatgagttaaaatcaacgattcttttagctatatataaatcaaaacaaccccttacacaaaccacacacaatagatataaatatttgggcaataactacttttatgatgaagagaagaaaaaattatattttaaaagagtggagataaagttaactcaaaaagagagtatattattagatattttataccaaggaaaaggaaatatagtaccattttga

SEQ ID NO: 9470 - protein, 180 aa, Unknown
  Obtained from environmental sample
  DOMAIN (3)...(123): Response regulator receiver domain
  misc_feature (1)..(180): Xaa is any amino acid
MKTKILIIEDETIVALDIKSALANLGYVVTSIATNHTEAFMSIEENIPNIILTDINLENSIDGIEIVQEIQKTKNIPVIYLTAFSDDDTINRAIQTNPVGYLLKPFQTNELKSTILLAIYKSKQPLTQTTHNRYKYLGNNYFYDEEKKKLYFKRVEIKLTQKESILLDILYQGKGNIVPF

SEQ ID NO: 9471 - DNA, 393 bp, Unknown
  Obtained from environmental sample
  misc_feature (1)..(393): n is a, c, g, or t
atggtttatgattttgatgaaaaacctgaactaaatatcactccattagttgatgtaatgttagttctactagcaattttgatggtaattactccaaatgttgtttatgaagagttaataaaattgccgcaaggttctgcacaaaagcagatttctaaaatttctcctgttcatattaagattaataaagatggtgagatagttataaataaagataaatttttactgaactcttttggtgataatttctatatgtatgcacaaaatcttgataaaaaagcttcagttatgattagtgcagataaatcactagactatggtttagttatgactgttttaggtgcggttaaacaggccggattcacagaagtctctttagctaccaatggttaa

SEQ ID NO: 9472 - protein, 130 aa, Unknown
  Obtained from environmental sample
  DOMAIN (4)...(130): Biopolymer transport protein ExbD/TolR
  misc_feature (1)..(130): Xaa is any amino acid
MVYDFDEKPELNITPLVDVMLVLLAILMVITPNVVYEELIKLPQGSAQKQISKISPVHIKINKDGEIVINKDKFLLNSFGDNFYMYAQNLDKKASVMISADKSLDYGLVMTVLGAVKQAGFTEVSLATNG

SEQ ID NO: 9473 - DNA, 915 bp, Unknown
  Obtained from environmental sample
  misc_feature (1)..(915): n is a, c, g, or t
atgaagaggatttttgtcgtgaaatatctgatgttggacataataggagtctataaaacagatcgacttggaactccattgattgaaactgtaacatatccagaattatttacacctgatgaattagccgaagcagcacaagttattcgttttttgaatcgttcaacgggtaaagttagaattggtcctggtagtggaagagaagacgtaaatgttagctgtaaaggtgggtcgagagtggaaataaaaggtgtttcttatataaaagatattccagaattatctcataatgaagcttttagacaagtgtctttgctccagctaagagataaactactattgaaaattaagaatcatgataattggtcaattactcatacagaacttgatattcgagattttgattttgaacctgttaaagaaaatattcaaaaattaaagttgtttgcagttaatttgtcgcaatttgaaggtgttttatctcattttacccaaccaaaaaaatcttttgcagatgaaataaaaggcagattaaaagtaatagcctgtcttgaatctccaaatatgttccattcagaagagttagaagctccttatgagaactatgaaaaagattttgaaaaaattgcttctaatcttaatgccaagtctggtgatgcacaaattgtattttgggcaaatcaagacgatgtaaaaacagcattggaaactattgaggaacggtgcttaatggtctttgaaggtgttcccgaagaaacaagaaaatcattcagagatggaacaactatttttgaaagagttttgccaggagccgatcggatgtatcctgatactgattctgctcctattcctctcgaaaattcgtacattgaggatttaagaaaaaaaatccagtggatatgggtccgagcataa

SEQ ID NO: 9474 - protein, 304 aa, Unknown
  Obtained from environmental sample
  DOMAIN (1)...(109): PET112 family, N terminal region
  misc_feature (1)..(304): Xaa is any amino acid
MKRIFVVKYLMLDIIGVYKTDRLGTPLIETVTYPELFTPDELAEAAQVIRFLNRSTGKVRIGPGSGREDVNVSCKGGSRVEIKGVSYIKDIPELSHNEAFRQVSLLQLRDKLLLKIKNHDNWSITHTELDIRDFDFEPVKENIQKLKLFAVNLSQFEGVLSHFTQPKKSFADEIKGRLKVIACLESPNMFHSEELEAPYENYEKDFEKIASNLNAKSGDAQIVFWANQDDVKTALETIEERCLMVFEGVPEETRKSFRDGTTIFERVLPGADRMYPDTDSAPIPLENSYIEDLRKKIQWIWVRA

SEQ ID NO: 9475 - DNA, 654 bp, Unknown
  Obtained from environmental sample
  misc_feature (1)..(654): n is a, c, g, or t
atgaaacaattgtcattgattcctaaaatgaaattgccaaaaaaaacaactttgaaagattatatgacaacagaagaattttcagcttttaattcatttgttatcgatactctaaaaattaaatcaagcatttataatgtctgtttagcatacaaaccttttttttcgtattctctaatacttaatgaaattatttatgggaaaaagattgtatacgaacaatatttttcagacaaagcaaagcaaaataaaatgaaaattataggtttggaaactattgaatttcaaattagtttgattgatagtatttcaataaaagaccaaattcctatgtttttgtatgattacaaaaaagaaaaacaaactgatttaaaatcagaatacgataaaactttgtctttatataaaatgcaagacttaaatggaattgcaaatttagagagcgaaacagatgaatcagatgattatttttatcaaaagtttttggttgatagaaatttggactggattggaaaaataaaagcaattctcaagaaaaaatcagcttttatagctgttggagcggcacatttaccaggcgaaacaggtgttttacaacttttaaggaatgaaggatatactgtaaatgcagtttgttcaagtaataatcattaa

SEQ ID NO: 9476 - protein, 217 aa, Unknown
  Obtained from environmental sample
  DOMAIN (2)...(206): GumN protein
  misc_feature (1)..(217): Xaa is any amino acid
MKQLSLIPKMKLPKKTTLKDYMTTEEFSAFNSFVIDTLKIKSSIYNVCLAYKPFFSYSLILNEIIYGKKIVYEQYFSDKAKQNKMKIIGLETIEFQISLIDSISIKDQIPMFLYDYKKEKQTDLKSEYDKTLSLYKMQDLNGIANLESETDESDDYFYQKFLVDRNLDWIGKIKAILKKKSAFIAVGAAHLPGETGVLQLLRNEGYTVNAVCSSNNH

SEQ ID NO: 9477 - DNA, 858 bp, Unknown
  Obtained from environmental sample
  misc_feature (1)..(858): n is a, c, g, or t
atggatgcaaatctggttgaagaggttgaaagatttcaaactgctgatgactgcgatttcatgaacaaaggtaaatgctacaaatatggagattataaaatagttaaagatgatatagagataaagagagaacagaacatcaagctcttaaaagtttttcaaccaaatgataaaggcaaaattgaaaatcttgcatacgttgcgtggggaaattgcatccaaaacatcaaaaaaatatgcgttgaaaagtatggtgatccaaaagatccagaagttgaagagaaatacgctaaacaacgcgcttgtgttgtaaccaactacatgagagaggccagacaaaaccttatcagagtagcagagattaaaacagatacagagaaattcttcaaaaacagagggacaagaagctttcaaacagatgtagaacaatacagtggaggaaaaatcaaaggagagaaaaatacagacgaattaaccagtatcacttcaagtgatttttcaaaaaattttgatgaagagaatgaattgttagttaaaaaatttaatgaggagtgtaaggaagaaaaagaagaagattattgcaagaagtttattctctttaaggatgacaaagagaaactgacagagcttttaaacgagtacaaacttagacgtagagcaatggagaataaaattgaaaagaatattaagccaagcaccttagataataaagaacaacttgaaacatatctctttgaagaaagatatactaaggatgaaatagaggagatggtagcgtcgaaagagagagttaacgagataaaggaaaaaaatatttatagatccaaagaagagactaggggaataacagcaagcatt

SEQ ID NO: 9478 - protein, 286 aa, Unknown
  Obtained from environmental sample
  misc_feature (1)..(286): Xaa is any amino acid
MDANLVEEVERFQTADDCDFMNKGKCYKYGDYKIVKDDIEIKREQNIKLLKVFQPNDKGKIENLAYVAWGNCIQNIKKICVEKYGDPKDPEVEEKYAKQRACVVTNYMREARQNLIRVAEIKTDTEKFFKNRGTRSFQTDVEQYSGGKIKGEKNTDELTSITSSDFSKNFDEENELLVKKFNEECKEEKEEDYCKKFILFKDDKEKLTELLNEYKLRRRAMENKIEKNIKPSTLDNKEQLETYLFEERYTKDEIEEMVASKERVNEIKEKNIYRSKEETRGITASI

SEQ ID NO: 9479 - DNA, 660 bp, Unknown
  Obtained from environmental sample
  misc_feature (1)..(660): n is a, c, g, or t
gtgggcccatatgaagagacagttcacaattacatcctagcaaataatataagtgaacgagcaaaacatttagatgagattacaatttttgatgtgggatacgggcttggcattggacttttatgcacactggatttcctttcaaaactcgaatctcctccatttttaagatacatctcagttgaaattgatccagaacttgtaaaattttcttataagacaatctttaaaaactctccctacagtcaatctcttaaagatttgaaaaaaaggtttattgctaaaggaaaaagttttgaaattgaaattctcataggcgatgctcgaaaatctataaaaaaacttcaaacaagagagaactttaataaatttgacgttatctaccaggacgccttttctccacagagaaacccacgtttatggagtgttgagtggtttaaagatctaaaaaatctttcaaaaaagagcaccactttatcaacctacagttcggccacgccttttcgaaaatcacttctagaagcgggttggttattcgaaaatatcgatggtttttcaaccaaaaagactatgacaaaggcatttcttaaaggagagatggatcaagctcttcatacaaaaacaacaagctcgccgctttgcagcatgcaggacaaatag

SEQ ID NO: 9480 - protein, 219 aa, Unknown
  Obtained from environmental sample
  DOMAIN (1)...(197): Protein of unknown function (DUF752)
  misc_feature (1)..(219): Xaa is any amino acid
MGPYEETVHNYILANNISERAKHLDEITIFDVGYGLGIGLLCTLDFLSKLESPPFLRYISVEIDPELVKFSYKTIFKNSPYSQSLKDLKKRFIAKGKSFEIEILIGDARKSIKKLQTRENFNKFDVIYQDAFSPQRNPRLWSVEWFKDLKNLSKKSTTLSTYSSATPFRKSLLEAGWLFENIDGFSTKKTMTKAFLKGEMDQALHTKTTSSPLCSMQDK

SEQ ID NO: 9481 - DNA, 861 bp, Unknown
  Obtained from environmental sample
  misc_feature (1)..(861): n is a, c, g, or t
atgctcaaaaagtggattggccgaatttatatgtttgagcttactcctgtggcattaattctagcagcaataggatttctttatatgtttattattgctccaatcttattgccaaaaagaaataaaaacaatgatgctactttaattcaacaagcagaaaaatatatggcagaaatcatattaattgacttatgtcctgatattaataagaaattaagcgaaacaaaattagtagtagattacaaaattcagttattaaccgttataagagggtctacacgtattagagattgttcttcagattttattttggaaaaaaacgatattttaaaagtagttattagccccgaaaacctaatcaatttaaaggacactaaaggctatagtattcaaggagataaattagaagaaaatgaagcaaaggaaattgatattagtccaacagaatccactaaagatattcctaacaatctaaggaaaatttatgaagtacttatccctgttggatctaagttagcatcaaaatcattaaaagaattacgttttagagatgctcacagaagttctgtattaggaataagacaaagaaatgagatggtaatgcaaaacttaagcgatatgaaattaaaagaaggagatatgcttttagtttattcaacagaaaaagatattgcccgtcttacctcccaacatttggtttttatgctctctaattatgaaaaaaaacaggtaaattataaaaaagccattccagcattattaattgctattggcgttattggtgctgcggcacttaatattacttctattttaatgagtgctatgataggttgtttgttgcttattacacttctattctaa

SEQ ID NO: 9482 - protein, 286 aa, Unknown
  Obtained from environmental sample
  DOMAIN (161)...(232): TrkA-C domain
  misc_feature (1)..(286): Xaa is any amino acid
MLKKWIGRIYMFELTPVALILAAIGFLYMFIIAPILLPKRNKNNDATLIQQAEKYMAEIILIDLCPDINKKLSETKLVVDYKIQLLTVIRGSTRIRDCSSDFILEKNDILKVVISPENLINLKDTKGYSIQGDKLEENEAKEIDISPTESTKDIPNNLRKIYEVLIPVGSKLASKSLKELRFRDAHRSSVLGIRQRNEMVMQNLSDMKLKEGDMLLVYSTEKDIARLTSQHLVFMLSNYEKKQVNYKKAIPALLIAIGVIGAAALNITSILMSAMIGCLLLITLLF

SEQ ID NO: 9483 - DNA, 471 bp, Unknown
  Obtained from environmental sample
  misc_feature (1)..(471): n is a, c, g, or t
atgaaagtaaaatttattagttcactagtaggaggagagcaagattatcatatagatggtcttgcagattttgaaactgaaaaagcattaagacttattgatgctggtatttgtataccaacaagcaaaaaagcctatgatgatgcagttgaaaagtctatagctgaaaaaaaagaacagcttgaaaaagagaaaaaagcagcagctattctttataaagatgagttgttaggtgaaaagcaaaacttgttgtcaagagttgatgagatcaataaagaccttgaaatagaagatatgattatcactaaagctgagtatgaaaatttagttggttttagtgagatggttgctgttccaaaagataagtttatatcacttattgaaaatacagagatgataaatattcaaaaaacagagtatgaaaaattaactgtagttgaagaggaagagtctaaaggtggagataaatag

SEQ ID NO: 9484 - protein, 156 aa, Unknown
  Obtained from environmental sample
  misc_feature (1)..(156): Xaa is any amino acid
MKVKFISSLVGGEQDYHIDGLADFETEKALRLIDAGICIPTSKKAYDDAVEKSIAEKKEQLEKEKKAAAILYKDELLGEKQNLLSRVDEINKDLEIEDMIITKAEYENLVGFSEMVAVPKDKFISLIENTEMINIQKTEYEKLTVVEEEESKGGDK

SEQ ID NO: 9485 - DNA, 678 bp, Unknown
  Obtained from environmental sample
  misc_feature (1)..(678): n is a, c, g, or t
atgaaacttgatactagtgcagcagtagtgcatgaaactatctatcgttatatctacgctaataaatccaatggtggcaagttgtatacatatctcagacataaaaacaagaagtatcatcatagaagtaatgactatcattcccgtggtacaatcatagaccgtgtaatgatagataaaagaccaaagatagtagagaaaaaaagtagaattggagaccttgagatagatacagttattggtaaagatcataaaggtgcgttagtcacggttgttgatagaaaatcaaagtttgtgcttatcaaaaatgttccatctaaagaagcaagtgtagttacccaagctctcatagaaatgatacaaccagtcaaagctattactaaaataatcacaagcgataatggtaaagagttcgcatatcataagcaagtatcggctgcacttgatactgatttttactttgctaatccatatcactcttgggagagaggattaaatgaacatattaatggtttaatcagacaatatttaccaaaaaaaagtgtatttataggtgtatctaaggaagagattattatgattcaaaacagactcaaccatagacctagaaaagtactaaagtacaaaactccatatgaagtattttttagtgaaatgagtaaaaaactagctgtttaa

SEQ ID NO: 9486 - protein, 225 aa, Unknown
  Obtained from environmental sample
  DOMAIN (66)...(216): Integrase core domain
  misc_feature (1)..(225): Xaa is any amino acid
MKLDTSAAVVHETIYRYIYANKSNGGKLYTYLRHKNKKYHHRSNDYHSRGTIIDRVMIDKRPKIVEKKSRIGDLEIDTVIGKDHKGALVTVVDRKSKFVLIKNVPSKEASVVTQALIEMIQPVKAITKIITSDNGKEFAYHKQVSAALDTDFYFANPYHSWERGLNEHINGLIRQYLPKKSVFIGVSKEEIIMIQNRLNHRPRKVLKYKTPYEVFFSEMSKKLAV

SEQ ID NO: 9487 - DNA, 777 bp, Unknown
  Obtained from environmental sample
  misc_feature (1)..(777): n is a, c, g, or t
atgagtctgtggagaagatttttatcagttagagttgctcttattacagtactaatctactcagttttgggttttgttatcatacccttggttctgaagtatgctctgcctataattttaaaaaagaacctaaatgctgaatctaatatggagagtctctattttaatccatatagtttcgaacttgaactaaaaggctttaatcttctcgataattcaaatagattgctctttggctttggtagcttttatgtgaaccttgaaccttccgccctttttaataagttaatagttattaaaaaaatagacctgaatggactctactcaactgtaagagtcaacgataaaaaagtggcaaattttcagtacattttagactttttaaatcaaaaacctaaagtaaagagtgtaccttccaagctaaaaataccatatataacaattaacacttttaatatcaaagactcaacactctatttcaaagatgaatcaaaagttatcccatatgtagcagaatcaaaatcttttaatctgagcgccacgaacatcagtacaacacccaacactaaagctacagttgagctaaatctggatttagaaaacactctctcactaaaatcatccaactctataactcccatccctttagagatagaaggggacttagaactttcagatctacagatagataaactttttacctatgtaaaagatagatttgagtttaatattgagggtaaaactctctcaaatacacttcatatcactgagccataa

SEQ ID NO: 9488 - protein, 258 aa, Unknown
  Obtained from environmental sample
  misc_feature (1)..(258): Xaa is any amino acid
MSLWRRFLSVRVALITVLIYSVLGFVIIPLVLKYALPIILKKNLNAESNMESLYFNPYSFELELKGFNLLDNSNRLLFGFGSFYVNLEPSALFNKLIVIKKIDLNGLYSTVRVNDKKVANFQYILDFLNQKPKVKSVPSKLKIPYITINTFNIKDSTLYFKDESKVIPYVAESKSFNLSATNISTTPNTKATVELNLDLENTLSLKSSNSITPIPLEIEGDLELSDLQIDKLFTYVKDRFEFNIEGKTLSNTLHITEP

SEQ ID NO: 9489 - DNA, 783 bp, Unknown
  Obtained from environmental sample
  misc_feature (1)..(783): n is a, c, g, or t
ttgcaaatccctatgatctctcttaatgttaatgatataaattttgacgaaccacaagatcgctcattggagcccatgcagacacaatcgatcacaattgagcagaaaattccatattttggaaagagagatgccaaaaaaagtattgctcagaaaaatgaaactatcttatataacacgctagagagtgcaagatctgaacttatcttttccataaaaaaaacagcatacaatatttggagagtctctaagtttaaagatattttagatgagtatatctctataacaaagcaagagttggagcttcatgcttcatatacaaaagagtcactaaatcaccatatagatatggcttcatctgaactatcactttacaatttagaacttgaaatgagtacactagaatcaaaaatgagagcactctatgcatcgcttagttatttgagcgctgaaaagatagaaaatttagagctctctttggagatgcaaaatcctccaacattagagagttttttatcttcgctaaattcaaaccctacattaaaagtaaaagagagtattgttgatcttcaattcgcagatatggcactgaaaaagttagagtttatgcctgatatctcttttaaagcaggctactataatcgtgaaaaatttgatgattatctctctgtaggagttgcattttctttgcctatctactcaagtgaaaaatataactacgagagttcaagatataagatgttggaaaaagagagtgaaaaaagtgatttgaaaacagaataa

SEQ ID NO: 9490 - protein, 260 aa, Unknown
  Obtained from environmental sample
  misc_feature (1)..(260): Xaa is any amino acid
MQIPMISLNVNDINFDEPQDRSLEPMQTQSITIEQKIPYFGKRDAKKSIAQKNETILYNTLESARSELIFSIKKTAYNIWRVSKFKDILDEYISITKQELELHASYTKESLNHHIDMASSELSLYNLELEMSTLESKMRALYASLSYLSAEKIENLELSLEMQNPPTLESFLSSLNSNPTLKVKESIVDLQFADMALKKLEFMPDISFKAGYYNREKFDDYLSVGVAFSLPIYSSEKYNYESSRYKMLEKESEKSDLKTE

SEQ ID NO: 9491 - DNA, 687 bp, Unknown
  Obtained from environmental sample
  misc_feature (1)..(687): n is a, c, g, or t
gtgaaaaacagtttgtggagcaacccaatgtttaagattaaaagagatctgatgtctgtgatagaaaaatggcttttcaaaggaaaggttttgacgatctatggtccccggcaggttgggaaaacaactttggcacttgatattttaaaaaaatatggatctgttgatgattattttgattgtgatattccgtcaatagccactaagttacaaagtccggagcccgttttacttaaaagacttatgggggatgcaaagttggtggtaattgatgaggcacagcggattaaaaatattggtttgactttaaaaataatacatgatcacatgccggatgttcagattattgcgacagggtcaagcagttttagtcttaggaactcaattaacgagccgcttacaggaagaggaatggaatttctgcttcttccattttctgttagtgaaattagtcagttgtacaaaaatcacgaaattgattcgcttattaaatcctttatgatttacggtctttatcctgatgttantaaaaagaatgaaaatgatgcagctaaacttattgaaaatttagcagtgaaatatctgtataaagatattcttgaagtcgaaaatcttaaaaaacctgagttgctgatgaatattctgccacttttagcatttcaggccaggttcagaatttttcagaaa

SEQ ID NO: 9492 - protein, 229 aa, Unknown
  Obtained from environmental sample
  DOMAIN (16)...(227): Archaeal ATPase
  misc_feature (1)..(229): Xaa is any amino acid
MKNSLWSNPMFKIKRDLMSVIEKWLFKGKVLTIYGPRQVGKTTLALDILKKYGSVDDYFDCDIPSIATKLQSPEPVLLKRLMGDAKLVVIDEAQRIKNIGLTLKIIHDHMPDVQIIATGSSSFSLRNSINEPLTGRGMEFLLLPFSVSEISQLYKNHEIDSLIKSFMIYGLYPDVXKKNENDAAKLIENLAVKYLYKDILEVENLKKPELLMNILPLLAFQARFRIFQK

SEQ ID NO: 9493 - DNA, 744 bp, Unknown
  Obtained from environmental sample
  misc_feature (1)..(744): n is a, c, g, or t
ttgatcaaaggtttttcatttttctattgcaacccggaagggtcatttgagacttctggtcatattttaagaaaactaaccctcaagtatccggttgtgttatttgatggtgcaattatctatgacctgaaatctggaaaaaaactgcgaaatatttttctttcaacagattctgctaaaagagttcttgatcaatatgatgaattcggtgtgtctccgcttatttataccatgaatgaaaagtcagagaataagatctactataaaaatattgataacaacgccattgaaaattacatcaatctctgtgtttctaagggtgataagcgttttgccagagtttcaaattatgaagaagtgctgaaagaggatgttgttacaataaatatgatagagcatcctgaaatccttaaaccaattgccgaagagatgagaaagaatgcaacatcagaaaagattctctatgttgattcaattgatgacagtcgttataaatttctaatgataatgaaccaggatgcagagaaaggaaaaggtgttcagttcctgaaaaattatgtcggagcaacacatctcacatcttttggtgatcagctaaatgacctctcaatgtttgaagtctcagacgaatcctatgcaacagaaaatgcagataaagccataaaagaaaaagctacggcggttttacgatcaaatgatgaagatgcagttgctaagtttttgcaaattaatgttgaggggtaa

SEQ ID NO: 9494 - protein, 247 aa, Unknown
  Obtained from environmental sample
  misc_feature (1)..(247): Xaa is any amino acid
MIKGFSFFYCNPEGSFETSGHILRKLTLKYPVVLFDGAIIYDLKSGKKLRNIFLSTDSAKRVLDQYDEFGVSPLIYTMNEKSENKIYYKNIDNNAIENYINLCVSKGDKRFARVSNYEEVLKEDVVTINMIEHPEILKPIAEEMRKNATSEKILYVDSIDDSRYKFLMIMNQDAEKGKGVQFLKNYVGATHLTSFGDQLNDLSMFEVSDESYATENADKAIKEKATAVLRSNDEDAVAKFLQINVEG

SEQ ID NO: 9495 - DNA, 600 bp, Unknown
  Obtained from environmental sample
  misc_feature (1)..(600): n is a, c, g, or t
atggtatcgagagctttaagtgaagaagaaaaaaacaaagatataagtgtacatctcataggatatgatgggatagcgctcattgtaaataaagagaatcctattacaaacctttcaactaaagatattcaaaatttatatagtggaaaaacaactaactggaaagagttaaatggtaacaatcaagagattatacttatagctaaacgagataatcattctacaagagagttattcgacgtgtattttaacattaataaattgagtatcaatgcagattttgtcggtgcaaatattgaaggaattgttatggttgcattggagaaaaatgctattacatacgtatctattggtacagcattaaaggctatacagagcggtgcaaatataaaaattttaaatttaaatgatattccagcgactctttatggtaaattaaatacatcatacccttttgtacgtcatcttaatttaatcacaaaagttaagatagataaaaagattaaagatatcatatctactatctattcagatgtgggaaaagagattattattaatcaacgttttattccgtacaacaggattcatgatgttaaataa

SEQ ID NO: 9496 - protein, 199 aa, Unknown
  Obtained from environmental sample
  misc_feature (1)..(199): Xaa is any amino acid
MVSRALSEEEKNKDISVHLIGYDGIALIVNKENPITNLSTKDIQNLYSGKTTNWKELNGNNQEIILIAKRDNHSTRELFDVYFNINKLSINADFVGANIEGIVMVALEKNAITYVSIGTALKAIQSGANIKILNLNDIPATLYGKLNTSYPFVRHLNLITKVKIDKKIKDIISTIYSDVGKEIIINQRFIPYNRIHDVK

SEQ ID NO: 9497 - DNA, 453 bp, Unknown
  Obtained from environmental sample
  misc_feature (1)..(453): n is a, c, g, or t
atgttaaacaatagacaaataagtgaacactttgaggttcaagtaaatactttatacaattggcaaaaacataagccaaaactgtataaatatctacaaaatgctgattataataaacagagaaatgatgagataaatattcttcttagtgagtattctacttcaatacaaaaagagtttttaattggtgaaattgaatatctcatacaatctcctattaaacttgtatcgatggatgaagtaaaaaactttcaaaaaatatttatagaaaaagagtactctcatatccctacaagtagcgataaaattctttctatttatgataaaatctcaggattanatattatagaaaaatatattttatataaaaaagtacataanattagagaaaaccacaatagaacagatgaagatataaaactattctttcaagaatttatcagtaactcttga

SEQ ID NO: 9498 - protein, 150 aa, Unknown
  Obtained from environmental sample
  misc_feature (1)..(150): Xaa is any amino acid
MLNNRQISEHFEVQVNTLYNWQKHKPKLYKYLQNADYNKQRNDEINILLSEYSTSIQKEFLIGEIEYLIQSPIKLVSMDEVKNFQKIFIEKEYSHIPTSSDKILSIYDKISGLXIIEKYILYKKVHXIRENHNRTDEDIKLFFQEFISNS

SEQ ID NO: 9499 - DNA, 852 bp, Unknown
  Obtained from environmental sample
  misc_feature (1)..(852): n is a, c, g, or t
atgtatgctaatatgcagttttattcagagaacttaactcctatttctaaagaatggtttgatactataattacaaattcaaattttgcccagtttgatacattgagaaaaaaagctattactattaataattcccatttaaaagtttttccaacaataagtaaaatattttatgaccctaaacaagctggagaaggtttcccttttgattacaacgaaaattcaagtataaagataaatactcctctttttatctcacatttatcaaaagatagattatgggcttatgttgaatcaagtgttactaatggatggatacagataagtgatattgcgtatgtagacaataaatttagaaagatatttgaaaatggcaactattatataaacttaaaagatgacacaaatatttataaaaatggttatttattaaatagtgtagagttaggaacactttttccaaaagcaaaaaaaagtggttttataatagcttcaaaagattataaaaacaatggatttataagaaccattgatgcaaataataattttgtaaaactagggataacttttactttagataatattaaaaaactaagtgatgaacttataggggaaagatatggctggggaggattgcttgaaaatagagattgttctttaatgataaaagatttttatgctccctttgggatatttttacaaagaaattcaagtatgcaaaaaaatgatggagagtctattgacctaagcactttggataatgagatgaaaaaacaatttatcattgaaaaagcaatcccatttcaaacattgatatatttacctggacatattatgatttatgtggggtaa

SEQ ID NO: 9500 - protein, 283 aa, Unknown
  Obtained from environmental sample
  misc_feature (1)..(283): Xaa is any amino acid
MYANMQFYSENLTPISKEWFDTIITNSNFAQFDTLRKKAITINNSHLKVFPTISKIFYDPKQAGEGFPFDYNENSSIKINTPLFISHLSKDRLWAYVESSVTNGWIQISDIAYVDNKFRKIFENGNYYINLKDDTNIYKNGYLLNSVELGTLFPKAKKSGFIIASKDYKNNGFIRTIDANNNFVKLGITFTLDNIKKLSDELIGERYGWGGLLENRDCSLMIKDFYAPFGIFLQRNSSMQKNDGESIDLSTLDNEMKKQFIIEKAIPFQTLIYLPGHIMIYVG

SEQ ID NO: 9501 - DNA, 570 bp, Unknown
  Obtained from environmental sample
  misc_feature (1)..(570): n is a, c, g, or t
atgtggaatcgctttaatataaaaactcaacttattatatttatgacaatagttgttactgttgtagagataagtacactcttttttgtatataacttgcaacaaaaagagaatcaaaaaaatgctattttagaagttgaggctataacaaagtctttaaataatgacctcttaaaagtgatgttaaatcccaatgctgatatgttatcagatattacttatagattgacagcatttcccaagattgatggtcttattttgtatgatgaaaataaaaatagtatttataaatatgctcatgaaattgatataaaaaatcaaaaagaggagatatttactaaaaatataatttttactgaaaatcatctttttattaaaaatgagataaaagcagaagggtatacttttggttttttacttttagatataaatctctcttcatacaaacaaaaacaattacaaacagcctatacaattttagcaatcttcccatttgcattattatttggatttatggttagtagcatttttagtaaaaactatacaaaaccttttataaatctcccttga

SEQ ID NO: 9502 - protein, 189 aa, Unknown
  Obtained from environmental sample
  misc_feature (1)..(189): Xaa is any amino acid
MWNRFNIKTQLIIFMTIVVTVVEISTLFFVYNLQQKENQKNAILEVEAITKSLNNDLLKVMLNPNADMLSDITYRLTAFPKIDGLILYDENKNSIYKYAHEIDIKNQKEEIFTKNIIFTENHLFIKNEIKAEGYTFGFLLLDINLSSYKQKQLQTAYTILAIFPFALLFGFMVSSIFSKNYTKPFINLP

SEQ ID NO: 9503 - DNA, 537 bp, Unknown
  Obtained from environmental sample
  misc_feature (1)..(537): n is a, c, g, or t
atgactgaaaaacaatatcaagataaaataagctctttagaaaggcaacttaaggccttgcagaactcttcacaaaaagaatgcgaacaacataataaaatcttaacccaacaatcaaaaatggcagcaatgggtgagatgataggaaatattgctcatcagtggagacaacctttgatggaactctcttctatacttataaatactgaagccaaaattagaatacaagaaaatatttcaaatgatgagattttagaagtgattaataggtcaaatcatatcttaaaatatatgtctaatactattgatgactttcgaaatttctttgcaaaagataaagaaaaaacacaatttaaaatatcagatcagataaaaagaacagtaaatattcttagtagtaccctagataataaaaatatcaaagtcaatatcatactcaaacataatccaaccatatatggatataaaaatgagtattcacaagttcttatcaatatcatatctaatgcaaaagatgtattagtcaaagagggataa

SEQ ID NO: 9504 - protein, 178 aa, Unknown
  Obtained from environmental sample
  misc_feature (1)..(178): Xaa is any amino acid
MTEKQYQDKISSLERQLKALQNSSQKECEQHNKILTQQSKMAAMGEMIGNIAHQWRQPLMELSSILINTEAKIRIQENISNDEILEVINRSNHILKYMSNTIDDFRNFFAKDKEKTQFKISDQIKRTVNILSSTLDNKNIKVNIILKHNPTIYGYKNEYSQVLINIISNAKDVLVKEG

SEQ ID NO: 9505 - DNA, 825 bp, Unknown
  Obtained from environmental sample
  misc_feature (1)..(825): n is a, c, g, or t
ttgatgcttggcagatttggttttgatacagttaaatcattggcgttgaagataaaagcctataccaaggctgtaccgattccgtttgacctctatgttgactctggtggatacagtatcattaccggtgatgtgcagtttgatagtacgcataaattcatcgaaagttaccaccaatatttggagcaccataatcaggattttaattatattttttcacttgatatcccgatttggggtggtcaagatgagcataatactgctgaaaatctgtataagttcaataaaatttctcaatcttattcgatgaagttgctccagcagtttcctgaaaagcttcaggataagttcctttatgtctggcagtttaaaattatagatcaatataaggcatggagtaagatttatgatgagcttgaggtaaaccagtggatcaagaatagagctattggcggtcttgttagtatccgtgatgcggttgcccatcttgattgctctgtgttcattcctatggcgtataggtgcttttctgatcacctggatagtccctatgccaaagaggtgttcaagctgcatttcttggggatcaatctttaccaagacaggtttgcaattgctctacttgagaaaatgttccagttttattcgaaaggtgaagaaaccaccgatatcacatatgactccatcaattataaaatgagtggacaattccaagcacgttccctacaggtttatgattattgtgatggtcatcttatcctgtacaaaactgtaaatcatttgccagaagagattgttgataaggtctattacacccagagctga

SEQ ID NO: 9506 - protein, 274 aa, Unknown
  Obtained from environmental sample
  misc_feature (1)..(274): Xaa is any amino acid
MMLGRFGFDTVKSLALKIKAYTKAVPIPFDLYVDSGGYSIITGDVQFDSTHKFIESYHQYLEHHNQDFNYIFSLDIPIWGGQDEHNTAENLYKFNKISQSYSMKLLQQFPEKLQDKFLYVWQFKIIDQYKAWSKIYDELEVNQWIKNRAIGGLVSIRDAVAHLDCSVFIPMAYRCFSDHLDSPYAKEVFKLHFLGINLYQDRFAIALLEKMFQFYSKGEETTDITYDSINYKMSGQFQARSLQVYDYCDGHLILYKTVNHLPEEIVDKVYYTQS

SEQ ID NO: 9507 - DNA, 351 bp, Unknown
  Obtained from environmental sample
  misc_feature (1)..(351): n is a, c, g, or t
ttgcttctaaatagcgataaggcccgtggaatagggaaacttcaactcaccagtcggtatggagatgcagaatatgccttgaaatttgacaaacaacaaggctgctgggaatatcttggtgactttgaagaagttaacctatcgcaagagcgccaggacattctggaactccttggagatgcttgtggtccggtacaggtcaagcagatcgccaaagaactcgggaagaacattccagcaacgagtaacttgttgataaaattaaacaaacaaggctttgtgcgcaagccgacatatcggatctatgaattaaccgaggcaggtcataaggtcattgcaacccagttatag

SEQ ID NO: 9508 - protein, 116 aa, Unknown
  Obtained from environmental sample
  misc_feature (1)..(116): Xaa is any amino acid
MLLNSDKARGIGKLQLTSRYGDAEYALKFDKQQGCWEYLGDFEEVNLSQERQDILELLGDACGPVQVKQIAKELGKNIPATSNLLIKLNKQGFVRKPTYRIYELTEAGHKVIATQL

SEQ ID NO: 9509 - DNA, 465 bp, Unknown
  Obtained from environmental sample
  misc_feature (1)..(465): n is a, c, g, or t
ttggttaaagatattatcacatacccaacacctccgagtgttgagtatgcaactgatgtaagagttttcgatgatgatttatttactttaattgaggacttaaaagatacgattaaagcaaatcaattggatggacttgcagcttatcaaataggaaactattttaatgttgttattataaagcaagatgatgattttttggaacttattaatccaagggttataaaccctataggaaaggtaactacagaagaaactacatcttatttcccaaatcttagtgcaaaagtaccaagatatgaaaaaataagtgtgatttatcaagatagagactcaaatcaacattcactcaaagctgatggttctctctctattttattacaacgaaagattgattacacttttggttcaacatttttaaataaattaactaaagatgagaaaaaaaggtttgnaaaaaactag

SEQ ID NO: 9510 - protein, 154 aa, Unknown
  Obtained from environmental sample
  DOMAIN (2)...(149): Polypeptide deformylase
  misc_feature (1)..(154): Xaa is any amino acid
MVKDIITYPTPPSVEYATDVRVFDDDLFTLIEDLKDTIKANQLDGLAAYQIGNYFNVVIIKQDDDFLELINPRVINPIGKVTTEETTSYFPNLSAKVPRYEKISVIYQDRDSNQHSLKADGSLSILLQRKIDYTFGSTFLNKLTKDEKKRFXKN

SEQ ID NO: 9511 - DNA, 459 bp, Unknown
  Obtained from environmental sample
  misc_feature (1)..(459): n is a, c, g, or t
atggctggaactattgttaaagttgtttatgattctattggaagattttataatggatatgcaaagattgaagttaataataaatttggtttaattaatgaaaattttgaagttgtagtaaaacctatctatgatgaagctttggagtttgtttataattctattattgtgaaaaaatttgggaaatatggatgtatcaacaaaaacttagagcttaaaatcgcaccagaaatggatatgatctatttacaacaagagggattaaaaagatttgaacaaaacaacaaatggggatttttagatactcattgtgattttgttacaaaacctatttatgattatgcttatgatttttcaaatggatttgctaaagtaaaaagtggtaaaaactggggatttttagatactgaaggtaatttattaacaaaacctatctttgaggatgcagatagattttag

SEQ ID NO: 9512 - protein, 152 aa, Unknown
  Obtained from environmental sample
  misc_feature (1)..(152): Xaa is any amino acid
MAGTIVKVVYDSIGRFYNGYAKIEVNNKFGLINENFEVVVKPIYDEALEFVYNSIIVKKFGKYGCINKNLELKIAPEMDMIYLQQEGLKRFEQNNKWGFLDTHCDFVTKPIYDYAYDFSNGFAKVKSGKNWGFLDTEGNLLTKPIFEDADRF

SEQ ID NO: 9513 - DNA, 708 bp, Unknown
  Obtained from environmental sample
  misc_feature (1)..(708): n is a, c, g, or t
atgtcaatcattattaataaaacttcatacgaaaaggctaaatcaaatgataaatattcaaataaactcgatttagatttaacactttcaacattaaaatcgctgtctaaactaataggtagtactttaattggtgataagggggttgatgaattggaatttgtttttgaaaaattaatggaacttggtgttaaatccgctaacattaaattcgacccgactttatctcgtggattgggttactatacaggaaccattatagaagtaaaagtagataattttccgagtatttgtggtggaggaagatacgatgatttaacgggtaaatttggcttaaaagatgtttctggagtaggtatttcttttggtgcagatagaatttatgatgtattattagacaataatttatatcctgaatttgagggcgattctacgcaagtattattcgtaaattttggagaaaaagaacaagattattgtctgcctttattgtttcaattaagagatgcagatattaatgcagaaatttaccctgaagcagcaaagcttaaaaaacaaatgacttttgccaacaacaaaaacattaactatgtggtgttggtgggtagtgatgaaatggcttcaggaaaattaacggtaaaaaacatgaaaacaggagagcaacatgctttcactattgaggaattaattcaagaattaaaaaaatga

SEQ ID NO: 9514 - protein, 235 aa, Unknown
  Obtained from environmental sample
  DOMAIN (146)...(235): Anticodon binding domain
  misc_feature (1)..(235): Xaa is any amino acid
MSIIINKTSYEKAKSNDKYSNKLDLDLTLSTLKSLSKLIGSTLIGDKGVDELEFVFEKLMELGVKSANIKFDPTLSRGLGYYTGTIIEVKVDNFPSICGGGRYDDLTGKFGLKDVSGVGISFGADRIYDVLLDNNLYPEFEGDSTQVLFVNFGEKEQDYCLPLLFQLRDADINAEIYPEAAKLKKQMTFANNKNINYVVLVGSDEMASGKLTVKNMKTGEQHAFTIEELIQELKK

SEQ ID NO: 9515 - DNA, 588 bp, Unknown
  Obtained from environmental sample
  misc_feature (1)..(588): n is a, c, g, or t
atgagtagcaataagccaagtttaccaaaaggaacaagagatttttcgccaatagaaatggctcgcagaaactatatttttgataccattaaaaaagtatataaaaaatatggctttcagcaaatagaaacgcctgccatggaaaaccttagtacattagttggtactggtggagatgaaagcgataagttgatttttaagattttgaatagtggggattatttagctaaagctgatgaaaaagccttacaagagaaaaatgctaatggattaactaagtctattgccgaaaaagctcttcattacgatttaaccgtaccatttgctcgttatgtagtacaaaatcaaaatgacattacctttccatttcgtaggtttcaaatacaacctgtttggcgtgccgacagaccacaaaaaggacgttacagagaattttaccaatgcgatgcggatattattggttccgattctttattgaatgaagtagatttaatcaaaattattgatgatgtttttagtgaattgtttcaaggtaaactgaattatacggtttcggtgaatataggaagatttacaaggtattgttga

SEQ ID NO: 9516 - protein, 195 aa, Unknown
  Obtained from environmental sample
  DOMAIN (11)...(178): tRNA synthetase class II core domain (G, H, P, S and T)
  misc_feature (1)..(195): Xaa is any amino acid
MSSNKPSLPKGTRDFSPIEMARRNYIFDTIKKVYKKYGFQQIETPAMENLSTLVGTGGDESDKLIFKILNSGDYLAKADEKALQEKNANGLTKSIAEKALHYDLTVPFARYVVQNQNDITFPFRRFQIQPVWRADRPQKGRYREFYQCDADIIGSDSLLNEVDLIKIIDDVFSELFQGKLNYTVSVNIGRFTRYC

SEQ ID NO: 9517 - DNA, 735 bp, Unknown
  Obtained from environmental sample
  misc_feature (1)..(735): n is a, c, g, or t
atgagaagtacaagggaagttaacttaatgacgagttacactaaaactcttcttttatatcaaccacaaaatgggtattgctataacagcgatacccattttttatataattttatacaaattaatctagcacattataaaaatattcaaggagaacttctagatattggaagtggaagtggaatattaggacttcttgtagctagaaactatcctaaactacagttaaatcaatgtgaaatacaaaatagttttcagtttttatcacaaaaaaatagtgagataaatagtattcaaaacatcctgtataaagagagttttatagcgtgtgattttaataaagagtttgattatattgtatcaaatcccccattttatcacagtgatgtgataaaaagtgaaaatgaaaatttaaaaattgcaagatattgtgatagtttacccctagttactcttctgtcaaaagcaacaaaactactcaaaccacaagggaaatttttcttttgttatgatgcaaaacaattggataacattatccttatagcaaaagaaaataaactcaatattgaatcaattcagtttttacatccaaattcaaaaaaagaggcaagcttagttatgataatgggaagaaaaaactcaaaatcaaaacttaaaatacttcctcctcttattatgtttgaaaataatggagagtttaaatctgaaataaatcaaatatatcaaaacgtgtaa

SEQ ID NO: 9518 - protein, 244 aa, Unknown
  Obtained from environmental sample
  misc_feature (1)..(244): Xaa is any amino acid
MRSTREVNLMTSYTKTLLLYQPQNGYCYNSDTHFLYNFIQINLAHYKNIQGELLDIGSGSGILGLLVARNYPKLQLNQCEIQNSFQFLSQKNSEINSIQNILYKESFIACDFNKEFDYIVSNPPFYHSDVIKSENENLKIARYCDSLPLVTLLSKATKLLKPQGKFFFCYDAKQLDNIILIAKENKLNIESIQFLHPNSKKEASLVMIMGRKNSKSKLKILPPLIMFENNGEFKSEINQIYQNV

SEQ ID NO: 9519 - DNA, 531 bp, Unknown
  Obtained from environmental sample
  misc_feature (1)..(531): n is a, c, g, or t
ttgtttgttgtgcgacgagctttgcatgtttgtacaactgtttgccccaacctggcattaaaatattacgaggttgaacctatcagttatcagcttcaaaaagtaaaaattaccgatgggaaaattgagattttagaaggcaaaacattttcaataagccagccagttcaaatcctacatcttgccgattggtgcaaccagtgcggtaactgtacaactttttgcccaacggaagagtcgccctatcttgaaaagccacatcaatacttcagcaaaaaagcatttgatgaagcagatgaggggtattggtccgacgcaaaaaattcggagttgctaggcaaaaagtcagggcaggaattcagcctaaaggaaaaggaaaattgctttctatttagaataaaggatattgaaattagcatcagcaaacaggattttcggataattgatgttcaatcgaaaggaaaaatgaattgtgaaattgatatgagaatagcagtagagatgagtctggtaatgcaaggaataatataa

SEQ ID NO: 9520 - protein, 176 aa, Unknown
  Obtained from environmental sample
  misc_feature (1)..(176): Xaa is any amino acid
MFVVRRALHVCTTVCPNLALKYYEVEPISYQLQKVKITDGKIEILEGKTFSISQPVQILHLADWCNQCGNCTTFCPTEESPYLEKPHQYFSKKAFDEADEGYWSDAKNSELLGKKSGQEFSLKEKENCFLFRIKDIEISISKQDFRIIDVQSKGKMNCEIDMRIAVEMSLVMQGII

SEQ ID NO: 9521 - DNA, 759 bp, Unknown
  Obtained from environmental sample
  misc_feature (1)..(759): n is a, c, g, or t
gtgatgctgaggcctcttncattttattatggtgcggatagagaacagtttagtataggaacagataatcaaaaagcttttataaatactccatctgttttcaatttaccatataaaataggttatttttggaatggaagaagcgaaactttagaagaacagatgatagatggaccattttttaataaacatgagatggcaagtagtaaagagataattgaaaaaagattattaaatagtccaaaatatattcatatgtttcaaaatgcatatcatcaaaaaccaaattttaagttagttcttgatgctattgttgagtttcagaatactcttatttctaaaaattcaaaatttgataagtatcttcgtcatgaattagagctatctttggaagagcaaaaggggctggaactatttatctcttatggttgtgcttcttgtcataatgggattaatttaggtggtaactcttatcaaaaatttggtactgttattgaacttagagataatttgggtcaatgggaagatagatacaaagtgactggaaaacttgaagacaaaaatgtttttattgttccaggtttacgaaatgtagcaaaaactgcaccatactttcatagtggacatataaaaactttaaaagaagcaattatgttaatggggtattacaatattggtgttgttttgacaaaagacgagattcactatattgaaaagtttttacaaacagttactggggatttaccagaaacattttaa

SEQ ID NO: 9522 - protein, 252 aa, Unknown
  Obtained from environmental sample
  DOMAIN (2)...(128): Di-haem cytochrome c peroxidase
  misc_feature (1)..(252): Xaa is any amino acid
MMLRPLXFYYGADREQFSIGTDNQKAFINTPSVFNLPYKIGYFWNGRSETLEEQMIDGPFFNKHEMASSKEIIEKRLLNSPKYIHMFQNAYHQKPNFKLVLDAIVEFQNTLISKNSKFDKYLRHELELSLEEQKGLELFISYGCASCHNGINLGGNSYQKFGTVIELRDNLGQWEDRYKVTGKLEDKNVFIVPGLRNVAKTAPYFHSGHIKTLKEAIMLMGYYNIGVVLTKDEIHYIEKFLQTVTGDLPETF

SEQ ID NO: 9523 - DNA, 522 bp, Unknown
  Obtained from environmental sample
  misc_feature (1)..(522): n is a, c, g, or t
atggatttttatatgagtaataaaatagagataaaaaatgaattgattcattcatttttgttaatgactagaatgatgaatcttgaaataagttatgatgatattcttcataaggttggaagtgaagaagaaattatagaggaagatatagtttatgttgccaatgaatattttggtttaaaaataaaagtagtaaatgttaagttagaaaagttatcaaaaaatcctctccctgcaattgtgaaattaaaaggtgataaatattctatacttttttctatagatgataaagagtgtgaaatatatgattttaatgaatcaaaaaagataaaacttgcattagaagattttgaaaatatatatcatggggatataattttagtagctaaagatggaacaaacacaacttcaatatctgattttggtctaacttggtttataaagtcatttttcaaacaagatagacttatatatcatgtactatttgccgcatttataattcaaatattttgcacttggtaa

SEQ ID NO: 9524 - protein, 173 aa, Unknown
  Obtained from environmental sample
  DOMAIN (27)...(134): Peptidase C39 family
  misc_feature (1)..(173): Xaa is any amino acid
MDFYMSNKIEIKNELIHSFLLMTRMMNLEISYDDILHKVGSEEEIIEEDIVYVANEYFGLKIKVVNVKLEKLSKNPLPAIVKLKGDKYSILFSIDDKECEIYDFNESKKIKLALEDFENIYHGDIILVAKDGTNTTSISDFGLTWFIKSFFKQDRLIYHVLFAAFIIQIFCTW

SEQ ID NO: 9525 - DNA, 702 bp, Unknown
  Obtained from environmental sample
  misc_feature (1)..(702): n is a, c, g, or t
atgagtaaggtttatgatcttgctaaagaatttaatctcagagttattgaagatgcggcacaggcatttggctctaaacgagatggaaagaatattggttgcgatggagatataatttgttttagttttgatggaataaaaaatattacatcaggagagggtggtgcaatattgtcatcagacaaagagttaatacaaaaacttcaagatgcaagattgctaggtgttgaaaaagatactgataaaagattttcaggacagagaagctgggattttgatgttaaagagcagggttttagatatcacatgagtaatatcatggctgcgataggaatagtacaaattgatagagtagatgagtttaaaacaaaaagacaacaaattgcaaaaacttatacagaaatgttgaataacataaatgctatagcactattaaattttgattttaatgatgtgttgcctcatatatttgtaattaaagctgaaaatagagatgaacttagagaatttttaataaagcataacattgagtgcggggttcactataaaccaaatcatctgttaagtaaatataaccttggatatgctttgcaagtgacagaaaaaatatatgaacaaattttaactctaccttgtcattatgatttaacagaagatgaacaacactatgtaattgaaaagatcaaggatttttatgaataa

SEQ ID NO: 9526 - protein, 233 aa, Unknown
  Obtained from environmental sample
  DOMAIN (1)...(229): DegT/DnrJ/EryC1/StrS aminotransferase family
  misc_feature (1)..(233): Xaa is any amino acid
MSKVYDLAKEFNLRVIEDAAQAFGSKRDGKNIGCDGDIICFSFDGIKNITSGEGGAILSSDKELIQKLQDARLLGVEKDTDKRFSGQRSWDFDVKEQGFRYHMSNIMAAIGIVQIDRVDEFKTKRQQIAKTYTEMLNNINAIALLNFDFNDVLPHIFVIKAENRDELREFLIKHNIECGVHYKPNHLLSKYNLGYALQVTEKIYEQILTLPCHYDLTEDEQHYVIEKIKDFYE

SEQ ID NO: 9527 - DNA, 390 bp, Unknown
  Obtained from environmental sample
  misc_feature (1)..(390): n is a, c, g, or t
ttgttatgggtggtaaaaaaagagtatatgcttttaaatatcaataaaacaactgaactttataaaataagagataatggtgaggtagcaaataactttgtattactattccaaaatactcaaagagaaaactatacatataatttagaagtaataggtgaatatgcaggaaaaattgagataaaaaggtttacaccttttaaattaagtcataataagatggcaaaaaaagttatccaacttgctactacagaaaggttagttgacagtgttgaaaaagatacaccaatcactgttacacttaaatcatatgcaattgaaaatcctgaagagatttttgttataagaaaagctgtatttatctatccaagagcagataaactaaaataa

SEQ ID NO: 9528 - protein, 129 aa, Unknown
  Obtained from environmental sample
  misc_feature (1)..(129): Xaa is any amino acid
MLWVVKKEYMLLNINKTTELYKIRDNGEVANNFVLLFQNTQRENYTYNLEVIGEYAGKIEIKRFTPFKLSHNKMAKKVIQLATTERLVDSVEKDTPITVTLKSYAIENPEEIFVIRKAVFIYPRADKLK

SEQ ID NO: 9529 - DNA, 639 bp, Unknown
  Obtained from environmental sample
  misc_feature (1)..(639): n is a, c, g, or t
gtgcaagaatcaagacgcaatagatggtttgagatatataccactttatcatataatgccactatgacttcaaaacaatcaacaagagataagatactagatgctgttttttcactggtctacatcaatggctacaacggtacaagcatgtctatgatacttaaagagtgtgacatccctaaaggctccttgtatcacttcttcaagtctaaaaaagagatggtattagctgttttaaaagaaagaatttctccacgaatggatgaattttatgagtttaaaataattgaaaatgagcacggtattgatacgataatcaacactattttaaaagtggcgaataaagatgcgcttgtgcaatatggatgtcctctcaatagactcaatcaagagatgtcgccagtagataaagactttgaactggagataaatgttatttacaacaccttaaaaaataaaataaaaaacttacttcaaaacgccactttcaatcaagagccagatatagactcactttcagagttcatcattgcaacagtatgggggaacctttctcttagctcaacgcaatcttcaaaagatagatatttacgctctatttctcatctaattaactacttgaaatcactcanaatttaa

SEQ ID NO: 9530 - protein, 212 aa, Unknown
  Obtained from environmental sample
  DOMAIN (32)...(78): Bacterial regulatory proteins, tetR family
  misc_feature (1)..(212): Xaa is any amino acid
MQESRRNRWFEIYTTLSYNATMTSKQSTRDKILDAVFSLVYINGYNGTSMSMILKECDIPKGSLYHFFKSKKEMVLAVLKERISPRMDEFYEFKIIENEHGIDTIINTILKVANKDALVQYGCPLNRLNQEMSPVDKDFELEINVIYNTLKNKIKNLLQNATFNQEPDIDSLSEFIIATVWGNLSLSSTQSSKDRYLRSISHLINYLKSLXI

SEQ ID NO: 9531 - DNA, 546 bp, Unknown
  Obtained from environmental sample
  misc_feature (1)..(546): n is a, c, g, or t
ttgtctataaataaaggagttacaatgtttatcatagaaccaattaaaaaagagcaagcgacaggtgagttaaaacttttatataagatgattgaaaaatctttaggatttatacctcctcattttgagctttttgcaactatcgacttacaagcaatgaaagagtttgtggaatataaccagaatattatgatgcgtgataaaatcgatgcaaatcttttgccataccttaggctctatatcgctacaactgaatgtagaagctactgcacaaacttcaatacaaagatgttactagctatgggagcggacaaagagcttctaagtaacataaaagatgaaatcctgaatattccattttctcataagcaaaaactactactacaaaaagttatcaaggctctgtataaagcagaaaagttttctaaagaagatttgcaagaactatatgcacttggatttaacgacagagacttttttattctccttagttacgcctcaaactttatgagtaaaagtaagataattgaagcttatttgaaataa

SEQ ID NO: 9532 - protein, 181 aa, Unknown
  Obtained from environmental sample
  misc_feature (1)..(181): Xaa is any amino acid
MSINKGVTMFIIEPIKKEQATGELKLLYKMIEKSLGFIPPHFELFATIDLQAMKEFVEYNQNIMMRDKIDANLLPYLRLYIATTECRSYCTNFNTKMLLAMGADKELLSNIKDEILNIPFSHKQKLLLQKVIKALYKAEKFSKEDLQELYALGFNDRDFFILLSYASNFMSKSKIIEAYLK

SEQ ID NO: 9533 - DNA, 708 bp, Unknown
  Obtained from environmental sample
  misc_feature (1)..(708): n is a, c, g, or t
atgagacggatattttgtgaatatcaggcaattatcgatacaaatactaacaaagtatacaaatatgaagcactggtaaggattatagagcatgatggtcaaatcttatacccaaacagttttttatatatcatcaaagatacaaatatctatacggatttaacaaaaaaagtaattgacattaccacaaagaaatttttactattggataatcagctattcagcattaatttaggtttacaagatttcaataatagagagattgttaactatatcttagaagttgttgaagagaatccacaattaattgatattatgagtatagaagttttagagtacgataaagttgataatgagaaaaactgtattgaggtaattaaattacttcaaaatagaggtttaaatatctcactagatgattttggaagcggatatgcaaacttttcaactatactctcttataactttgattttataaaaattgacggttctattatttcgcaagtagtcgctgatgataaagctataaaaatcatacaatctattattgaatttgcaaaggcacatgaaatgaaagttatttgtgagtttgtcagttctaaggagatatatgatattttacaatctatcggagctgaatatatgcaagggttttatctctctaaacctcatagagagttacaccatagcttagtaataaaagagtag

SEQ ID NO: 9534 - protein, 235 aa, Unknown
  Obtained from environmental sample
  DOMAIN (1)...(223): EAL domain
  misc_feature (1)..(235): Xaa is any amino acid
MRRIFCEYQAIIDTNTNKVYKYEALVRIIEHDGQILYPNSFLYIIKDTNIYTDLTKKVIDITTKKFLLLDNQLFSINLGLQDFNNREIVNYILEVVEENPQLIDIMSIEVLEYDKVDNEKNCIEVIKLLQNRGLNISLDDFGSGYANFSTILSYNFDFIKIDGSIISQVVADDKAIKIIQSIIEFAKAHEMKVICEFVSSKEIYDILQSIGAEYMQGFYLSKPHRELHHSLVIKE

SEQ ID NO: 9535 - DNA, 402 bp, Unknown
  Obtained from environmental sample
  misc_feature (1)..(402): n is a, c, g, or t
ttgatccgcgaagacggttatttttacttttcaaaagagatccctcagtcccaaaaagaggacaagcttcagatgatcctcgaatatattgatctggtcgaactgatgcttcagttctcggcgacgtttggggtagggtttcgtacaacggtaggcgaactctccgatgcggtacagtccaatgtcgtcttgaaagacaggctggacagacttaagaacattgccaagccgcagaccctgcatgcccaatgcgcgaaggtctttgagaagttcaaaaaaggcggctttatggccttggaggatgagcatgaagagcgctatatcgttttgaactcctaccactacatcgagacattcttgaatgccatccaagtcagcagcgaaacagaaggagctaattaa

SEQ ID NO: 9536 - protein, 133 aa, Unknown
  Obtained from environmental sample
  misc_feature (1)..(133): Xaa is any amino acid
MIREDGYFYFSKEIPQSQKEDKLQMILEYIDLVELMLQFSATFGVGFRTTVGELSDAVQSNVVLKDRLDRLKNIAKPQTLHAQCAKVFEKFKKGGFMALEDEHEERYIVLNSYHYIETFLNAIQVSSETEGAN

SEQ ID NO: 9537 - DNA, 690 bp, Unknown
  Obtained from environmental sample
  misc_feature (1)..(690): n is a, c, g, or t
atgaccaagtcatttagtagcacattcattcagattattcaccctgtttgttgcggattggacgttcataaagataaaatttccgcctgtctcattaccctggatgacaacggcaaagaaaagtatgagataaaggagttttcaacatttagcaaagatttgttaaaaatgaaaaaatggttgattaagaatgattgtcccattttagcaatggaaagtacgggggtttactggcaccccattcacaacatcattgaaggcaccatggaagtcattcttgtaaatgccaggcatattaaaaatgttccaggccgtaaaacagatataagtgatagcaaatggcttgcagggcttctccggcatggattattaaggggtagttttattcctccagaaaacatacgagagtggcgggagttaacccggttaagaaaaacgtatacagagtcctttgcagattacaaaagacgagttcataaattattcatcaccgctaatattaaaattgattcagttgtttctgatttgttcgggctaacaggtcgcaacctcataaatttgttatgcaatgaagccgatatgacccttaagaacattgaaacatgtacaaaaggtagtcttaagaaaaagtctctggaactttatgaaagtcttcaagctttttcaaagagcatcatcgttttcaactga

SEQ ID NO: 9538 - protein, 229 aa, Unknown
  Obtained from environmental sample
  misc_feature (1)..(229): Xaa is any amino acid
MTKSFSSTFIQIIHPVCCGLDVHKDKISACLITLDDNGKEKYEIKEFSTFSKDLLKMKKWLIKNDCPILAMESTGVYWHPIHNIIEGTMEVILVNARHIKNVPGRKTDISDSKWLAGLLRHGLLRGSFIPPENIREWRELTRLRKTYTESFADYKRRVHKLFITANIKIDSVVSDLFGLTGRNLINLLCNEADMTLKNIETCTKGSLKKKSLELYESLQAFSKSIIVFN

SEQ ID NO: 9539 - DNA, 762 bp, Unknown
  Obtained from environmental sample
  misc_feature (1)..(762): n is a, c, g, or t
atgatcgctcggagtttgcatgtgatggcctcgcttacctacgctgaagatgatttacgtaagattattgaacccaatgcttcagtggtttatgagcggataaaacttttggaagagtgcagcaaagctggtataagcagtggcgttttgtccatgccatttattccatatataacagatgatgagcagaatctgagaagtttgtttagtaaagttaaagatgcaggtgtcagttatattatgccaggattgttaactttgaaggtgggcaggcagaaggatctttttttagaagttattggaaaacactttccagataaattagataaaatcaccaatttatatagagcagaagatccatatggaaatcccaaccagaattactgtagaaaaaagtatcaattgatttcaattttgatttcagaggttgagttgccagaggtaatgccgcactccgtttatcatgggcgatttcaaaagtatcaggagatcctgattttgcttaatgatatgcgtcgattgtataaacgaaaaggaatagatacccgacgtttgaaagcagctcaagaaagtttccagaattggcttaacccagaaaaacagtatatcgccagaagacgcaacttgctctataacgaaatcgatgagaagctgatggaagcactgaacagtggcaaatttgaagagaatttcccgaaaaatttaaactccccgatttcttcccgcgaatattctgggaaggaatggttttcgattatatga

SEQ ID NO: 9540 - protein, 253 aa, Unknown
  Obtained from environmental sample
  misc_feature (1)..(253): Xaa is any amino acid
MIARSLHVMASLTYAEDDLRKIIEPNASVVYERIKLLEECSKAGISSGVLSMPFIPYITDDEQNLRSLFSKVKDAGVSYIMPGLLTLKVGRQKDLFLEVIGKHFPDKLDKITNLYRAEDPYGNPNQNYCRKKYQLISILISEVELPEVMPHSVYHGRFQKYQEILILLNDMRRLYKRKGIDTRRLKAAQESFQNWLNPEKQYIARRRNLLYNEIDEKLMEALNSGKFEENFPKNLNSPISSREYSGKEWFSII

SEQ ID NO: 9541 - DNA, 597 bp, Unknown
  Obtained from environmental sample
  misc_feature (1)..(597): n is a, c, g, or t
ttgtttgaaaggataaatgctgccaacgattattttattccgctattaaaaaaacaatctgaatctatttttgaacatattgaacacttaaagaccaaaaccaaagtaaaaaaatacattactgaacttaaagagttagaagcttacctttttaagcaaatacaacaattacaaaaagctaaaacactagtagaatctgcaattaacaatcaggaatttgataaaagtaaattaacctttaaggaagaaactgaaaaccgcactgaaaaactaaaaaaagtagaaaagaaagctccaaaagttgacaccaaaaaagtgagttttgatttatacaaagcaggcaaaaatgtaaaagaaattgccaaagaaagagggtttgtagaaggcaccattatcgggcatttggctcattatgttggcgaaggagaaattgacattgcaacattattaccaaaaaaaaccatagatgccgttacaaaagtttacaaaaagaataaagaaatttctggacttaacgaactcaaatctcaactagataacagtatttcttataatgatattaaaatggtgttggcggctttacaaaaggaaggttaa

SEQ ID NO: 9542 - protein, 198 aa, Unknown
  Obtained from environmental sample
  misc_feature (1)..(198): Xaa is any amino acid
MFERINAANDYFIPLLKKQSESIFEHIEHLKTKTKVKKYITELKELEAYLFKQIQQLQKAKTLVESAINNQEFDKSKLTFKEETENRTEKLKKVEKKAPKVDTKKVSFDLYKAGKNVKEIAKERGFVEGTIIGHLAHYVGEGEIDIATLLPKKTIDAVTKVYKKNKEISGLNELKSQLDNSISYNDIKMVLAALQKEG

SEQ ID NO: 9543 - DNA, 483 bp, Unknown
  Obtained from environmental sample
  misc_feature (1)..(483): n is a, c, g, or t
atggcactccttatacgagaatgtagtggtatcgtttgtctttgtctcacttctgcaaaagtaaaagaactccaactcccaatgatggtacaaacaaataactcaaaatatcaaacaccatttacaatctctattgaagcaaaagaaaatgttacaacaggtgtttcagccaaagatagggtaacaacaattcaatctgcattaaaaaaagatggtattaatcatattgtttcacctggtcatatttttccattaaaagcaagagatggcggtgttttagaaagagaaggacatactgaagctagtatagatttaatgaaactttcaaacttagaacctagtgctattttatgtgaacttacaaatgaagatggaactatgactcaaggggaaggtgttattcaattttcaaaaaaatattctatgccaatactaagtgtacaagatattataaactatcgtaatttttatctaaaagaatag

SEQ ID NO: 9544 - protein, 160 aa, Unknown
  Obtained from environmental sample
  DOMAIN (1)...(159): 3,4-dihydroxy-2-butanone 4-phosphate synthase
  misc_feature (1)..(160): Xaa is any amino acid
MALLIRECSGIVCLCLTSAKVKELQLPMMVQTNNSKYQTPFTISIEAKENVTTGVSAKDRVTTIQSALKKDGINHIVSPGHIFPLKARDGGVLEREGHTEASIDLMKLSNLEPSAILCELTNEDGTMTQGEGVIQFSKKYSMPILSVQDIINYRNFYLKE

SEQ ID NO: 9545 - DNA, 408 bp, Unknown
  Obtained from environmental sample
  misc_feature (1)..(408): n is a, c, g, or t
atggattattcctctttaaaagaacgattgaaaatggcagatatagaggtattaccactacttaatagcaagtttcttaacatagcaaaatatcaccaaaacaataaaaaactctataactttgtaatcattgaaaaacaatataatgaaaatatttataatactttattcaatcataaagaaattttagagcaaaaacaattttattacgaaatagacgatacaatacttacatttataccattagggagtattgagaaagaaactgtagggtatttagtagctagttttaaaaataaaaatcaagattttaattatctcccaaactaccaatataagggtaatataaatacaactacaactcctcaagaaaatatacacgataaaaaaaagataataataaagtga

SEQ ID NO: 9546 - protein, 135 aa, Unknown
  Obtained from environmental sample
  misc_feature (1)..(135): Xaa is any amino acid
MDYSSLKERLKMADIEVLPLLNSKFLNIAKYHQNNKKLYNFVIIEKQYNENIYNTLFNHKEILEQKQFYYEIDDTILTFIPLGSIEKETVGYLVASFKNKNQDFNYLPNYQYKGNINTTTTPQENIHDKKKIIIK

SEQ ID NO: 9547 - DNA, 741 bp, Unknown
  Obtained from environmental sample
  misc_feature (1)..(741): n is a, c, g, or t
gtgatcgctcggagaatgaattttaataagcactatggtataaaaaatattaagattatagatgagatgtttgttcttgatgaaagacactacatgaagatagtagatttacttatagaaaaaaaattagatctgaatatctgggcttatgctagagtagacactgttcacgaggagactctattaaaaatgaaacaagctggatttaattggttagctcttggtatagaatcagcaaatgcagatgtaagagatggcgcatctaaaaaaatgagagtcaaagatatacaaaaagttgtaacaaagatacaagatgcaagaatacgagtaattggtaattatatctttggattgcctgatgatacacatgagtccatgcaagagacactagatatggcaaaagagttaaattgtgaatttgcgaatttttactgtgctatggcatacccaggatcagagctttatagcatagctttacaagagggttggaaacttccaaaagagtggacaggttattctcaacactcttataatatccaaccactcccatcaaaaacagtaagtgcaagagaaattgtagagtttagagataatgcttttcatgagtataatgaaaatggtagatatttagatatgttagaaaaaaagtttggaaaagatgtaaaagagcatatgcaagagataactaanactaaattaaaaagaaaaatattacaagaggatagatccgtatgtctgtaa

SEQ ID NO: 9548 - protein, 246 aa, Unknown
  Obtained from environmental sample
  misc_feature (1)..(246): Xaa is any amino acid
MIARRMNFNKHYGIKNIKIIDEMFVLDERHYMKIVDLLIEKKLDLNIWAYARVDTVHEETLLKMKQAGFNWLALGIESANADVRDGASKKMRVKDIQKVVTKIQDARIRVIGNYIFGLPDDTHESMQETLDMAKELNCEFANFYCAMAYPGSELYSIALQEGWKLPKEWTGYSQHSYNIQPLPSKTVSAREIVEFRDNAFHEYNENGRYLDMLEKKFGKDVKEHMQEITXTKLKRKILQEDRSVCL

SEQ ID NO: 9549 - DNA, 678 bp, Unknown
  Obtained from environmental sample
  misc_feature (1)..(678): n is a, c, g, or t
ttggcaatccaagagggaatttccaataatgaagcaaaatctctgatagatagaggtttggtatatgtaggaaataaaaaagtcatgatagctcgcggtgatatttcacaaaagagcaactttatagttcaaaagatagagaaggtaaaaactatttttgaaaatagtgatattttggttgtagataagcctgcatttttaaactctgatgagattgagagacagtatccagagactcagcttcttcatagacttgatcgtgaaacaagcggtgtattaatgcttgtaaaaaatgaagagtttcgtgagcgtgctatacaagcttttaaaaatgatgaagtctataaagagtatgttgctattgtagatggaaaattcatagaagagatggagatagataagcctatattgactcaaaaagttaaaaacaaagcattttccaaaatttcaaaagctggaaaagaggcaagaagtgaagtttttccggaatctgtaagtggaaaattgtctaaagttaaagtaataattcataatggacgtactcatcaaattcgtgttcatttaaatagtataggttttccgattgtcggagatgaacagtacggtggaagaagatataaacgtgtaatgcttcatgcgagaaaagtagaattattaggtatgaacttttgtttctaa

SEQ ID NO: 9550 - protein, 225 aa, Unknown
  Obtained from environmental sample
  DOMAIN (57)...(190): RNA pseudouridylate synthase
  misc_feature (1)..(225): Xaa is any amino acid
MAIQEGISNNEAKSLIDRGLVYVGNKKVMIARGDISQKSNFIVQKIEKVKTIFENSDILVVDKPAFLNSDEIERQYPETQLLHRLDRETSGVLMLVKNEEFRERAIQAFKNDEVYKEYVAIVDGKFIEEMEIDKPILTQKVKNKAFSKISKAGKEARSEVFPESVSGKLSKVKVIIHNGRTHQIRVHLNSIGFPIVGDEQYGGRRYKRVMLHARKVELLGMNFCF

SEQ ID NO: 9551 - DNA, 363 bp, Unknown
  Obtained from environmental sample
  misc_feature (1)..(363): n is a, c, g, or t
ttgatcgctgactcaaaaacactatatcaaatggtggaaaaaaataaagaatctcttactcaaaaacaaaaaaagtgtaatcaacatataaaaattatgcagtatgcattgtcttatgttacaaaagaatttgagaagggatattttcatcaaaatgatttaataggtgctaaagcacaactatttttaattgaaaatagatcaccaaatatatttgcacaaaatattaatgaagcacaaaaagcatacgatacagaatataatttagcacaaaaaaataattgtgatatagataagtttacagtatctcctatccaaaaagttaaaaatacaataaaaactttatcaaagggtcaaaaatga

SEQ ID NO: 9552 - protein, 120 aa, Unknown
  Obtained from environmental sample
  misc_feature (1)..(120): Xaa is any amino acid
MIADSKTLYQMVEKNKESLTQKQKKCNQHIKIMQYALSYVTKEFEKGYFHQNDLIGAKAQLFLIENRSPNIFAQNINEAQKAYDTEYNLAQKNNCDIDKFTVSPIQKVKNTIKTLSKGQK

SEQ ID NO: 9553 - DNA, 300 bp, Unknown
  Obtained from environmental sample
  misc_feature (1)..(300): n is a, c, g, or t
ttggttaatgcgcaggatacaaagcttccaagtaagacaatagttaattcttcaaattatatctctacaaatagtgaaataacaaaagaatttttacaatatgggataggaattgaaaatatggagttctattctgtagtaaaaattgccaaagaatttgagatagatgtgaagggaatttttgtagtgacaaactacacaaataaagaagcacataaagactttatatcanatcataataaagcaatggataatttggtaaagtatttagaagaaaaaaatatcatcataaaaaactag

SEQ ID NO: 9554 - protein, 99 aa, Unknown
  Obtained from environmental sample
  misc_feature (1)..(99): Xaa is any amino acid
MVNAQDTKLPSKTIVNSSNYISTNSEITKEFLQYGIGIENMEFYSVVKIAKEFEIDVKGIFVVTNYTNKEAHKDFISXHNKAMDNLVKYLEEKNIIIKN

SEQ ID NO: 9555 - DNA, 546 bp, Unknown; identical to SEQ ID NO: 8171
  Obtained from environmental sample
  misc_feature (1)..(546): n is a, c, g, or t

SEQ ID NO: 9556 - protein, 181 aa, Unknown; identical to SEQ ID NO: 8172
  Obtained from environmental sample
  DOMAIN (98)...(178): PRC-barrel domain
  misc_feature (1)..(181): Xaa is any amino acid

SEQ ID NO: 9557 - DNA, 540 bp, Unknown
  Obtained from environmental sample
  misc_feature (1)..(540): n is a, c, g, or t
atgaaaacagatttcgatatacctagtgttaaaattcatttgcacaaagttattcctgtaggtgccggacttggtggaggttcgtctgatgcagcatttactttaaaattattaaacgctttatttactttgaatctttctgaagagaaattaatcacttatgcacaaaagttaggcagcgattgtgctttcttcattaaaaacaaacctgtttatgcctataacaaaggtgatgattttatcgattatgatttaaatttagaggattataaaattgaagttctttttccaaatattcatgtgtccacaaaagaagcttatgatggaattcaagtaagaaaaagtgatgcagacataagaagtcaacttcatttaccaatagagcagtggaaaaatgtagttaaaaatgattttgaaaagtcaattttttcaaaatataaaaccataaaagaagtaaaagcatcattatataaccaaggagcagtttatgcctcaatgacaggtagtggatctgcagtttatggaatttttaataagtaa

SEQ ID NO: 9558 - protein, 179 aa, Unknown
  Obtained from environmental sample
  DOMAIN (9)...(179): GHMP kinases putative ATP-binding protein
  misc_feature (1)..(179): Xaa is any amino acid
MKTDFDIPSVKIHLHKVIPVGAGLGGGSSDAAFTLKLLNALFTLNLSEEKLITYAQKLGSDCAFFIKNKPVYAYNKGDDFIDYDLNLEDYKIEVLFPNIHVSTKEAYDGIQVRKSDADIRSQLHLPIEQWKNVVKNDFEKSIFSKYKTIKEVKASLYNQGAVYASMTGSGSAVYGIFNK

SEQ ID NO: 9559 - DNA, 687 bp, Unknown
  Obtained from environmental sample
  misc_feature (1)..(687): n is a, c, g, or t
ttggaaagacgagacagatcggctgagatgactctttcaaaaattgaaaaagataatgcagcactttatgaaaaagctataggtttattcaatatattaaatgaaaaagtatctcatactatatataaacaatcatctgtagaagatatattatctacttgtaaaaatgaattttatttagttaaaaatgcaattgaaaatacgcaagaaataaaattcagttttttttatgatgacaacattaaacatgtccaaccattgaaaattgcgaatttagaaaagtattggtatctattatgttttgatattgatgaaaaaagattttcaaagtatcactttaaaggtgtaaaaaatgttaaagtcttagatagacaattcgatataaagaaacatgattatttagataaattggaatatgcaataaatgcatattttaatattgaagatactaatagagtaaagttaaaattatcaaaagaggcaaaaaaagtcttatctagaaaaaaactaaatccatctcaagaaatatataaaaatgatgaagatgaatatatattagatataacggtttctgatttgagggaaatatcaccaatagtacaacagtggattccccatattcaagttattaaaccagaagaattaaaaaacttgataaaagaaaatttaaaaaactatgaaatttaa

SEQ ID NO: 9560 - protein, 228 aa, Unknown
  Obtained from environmental sample
  misc_feature (1)..(228): Xaa is any amino acid
MERRDRSAEMTLSKIEKDNAALYEKAIGLFNILNEKVSHTIYKQSSVEDILSTCKNEFYLVKNAIENTQEIKFSFFYDDNIKHVQPLKIANLEKYWYLLCFDIDEKRFSKYHFKGVKNVKVLDRQFDIKKHDYLDKLEYAINAYFNIEDTNRVKLKLSKEAKKVLSRKKLNPSQEIYKNDEDEYILDITVSDLREISPIVQQWIPHIQVIKPEELKNLIKENLKNYEI

SEQ ID NO: 9561 - DNA, 528 bp, Unknown
  Obtained from environmental sample
  misc_feature (1)..(528): n is a, c, g, or t
atgaaaaaagcaaagttacttactttaatactatttataggaattatttccaacctttctgctcaagaaagtgaagatagaaaatttagatttggcttacactttacgcctaatattgcttggctaaatccttcttctgatggttatgaaaaaaatggatcttcagttggtttttcatatggactttctgccgaatttttcttagctaaaaactatttattttcaactgggttgtcaattagtaaattaggaggaaacctatcttatgtagattatttttatgataaagataatgatgtttatttgcttactcagatagaccaatcttacaacataaaatacattgaaattccatttaccttaaaattaagaactaatgaaattggttacatgacttactatggtaattttggtgtaaaggcaggttttaactacagctctaatggtgattttgattacaaaaatgtaagcggaggaatttctaaaagtgatgtagatataaaagatgatattaaatttttcaactct

SEQ ID NO: 9562 - protein, 176 aa, Unknown
  Obtained from environmental sample
  misc_feature (1)..(176): Xaa is any amino acid
MKKAKLLTLILFIGIISNLSAQESEDRKFRFGLHFTPNIAWLNPSSDGYEKNGSSVGFSYGLSAEFFLAKNYLFSTGLSISKLGGNLSYVDYFYDKDNDVYLLTQIDQSYNIKYIEIPFTLKLRTNEIGYMTYYGNFGVKAGFNYSSNGDFDYKNVSGGISKSDVDIKDDIKFFNS

SEQ ID NO: 9563 - DNA, 849 bp, Unknown
  Obtained from environmental sample
  misc_feature (1)..(849): n is a, c, g, or t
gtgcaaattgccaaaaataaaaaaaaacactgggaaatacgtagtgctgctctagaaaaaatatctaaaaaaaaatatctattagatattataaaaaaagagaataataaaaaaatagttgaatttaccaatgaaaaaataaaggttcttaatggaagttcagtacaattagaaaagctttcaaatcactcaaaattttggagaataagaagaagtgctgtaaaaaacattattgatcaaaaagctttatcatacattgcacaaaatgatgaagattgggaagttcgttgtgcagctgtaagcaataaaagctttaaggatcagaagattttaggaaaaatcattgataatgatgaaaacttatttgtatgtctggcaacaattaataatattacagatcaaaaattaattttaaaaattgaaaaacaaaatagttccccatggatacgtggagctatcttagataaaattattagtcagaaattattagaagatatagcattaaatgataaagattcacatgtcaggcttaaagcaatagaattgatttctaatccaaaaattttaatagacgttgcattaaatgacgatgataattctgttagaagatatgcaatagaaaacaaaaattttattgatcaaaatgtccttaaagaaattgtcttgaatgacaaagattattttgtaatagaagacgcattaaaaaagatttttaatcagaagttattaatggaaatagtaaaaaaaacctctataaataagtttttaaaagtagtcagaggaggagaagccataaggctcgtatctgcaaaaatgctttatcaaggattacagatcaagcttttttag

SEQ ID NO: 9564 - protein, 282 aa, Unknown
  Obtained from environmental sample
  misc_feature (1)..(282): Xaa is any amino acid
MQIAKNKKKHWEIRSAALEKISKKKYLLDIIKKENNKKIVEFTNEKIKVLNGSSVQLEKLSNHSKFWRIRRSAVKNIIDQKALSYIAQNDEDWEVRCAAVSNKSFKDQKILGKIIDNDENLFVCLATINNITDQKLILKIEKQNSSPWIRGAILDKIISQKLLEDIALNDKDSHVRLKAIELISNPKILIDVALNDDDNSVRRYAIENKNFIDQNVLKEIVLNDKDYFVIEDALKKIFNQKLLMEIVKKTSINKFLKVVRGGEAIRLVSAKMLYQGLQIKLF

SEQ ID NO: 9565 - DNA, 681 bp, Unknown
  Obtained from environmental sample
  misc_feature (1)..(681): n is a, c, g, or t
ttggatgaaatgcttgaggaaattgaaaattacaaaaacccaaaggttaccctaacttcggaggcaggtccctctattgccgattatgccttaccatgtacacttattgaagcaaaacgcgcttatcccaatcataaatatgaattattaactagtttttcagatgaaattattactgatgttgaaaacaacatttgtgatgttggttttacatacagaacacaattcgcaaacaaaggtggtgttgatatcctatccactaaaacaggaacaaatcgcattgtattagttggactatatgatgagaacatacctgatgaaatgtctgtagaggagttactaaatgcttgtattattacatttaccagtagaagtgaaattacaaatagtttatttagaaaccttaataaactaggatataacaaaaataatattaactgcaaactagaggtagagggtattgaaggtgctaaaatgctagtcactagaaaatatggtttagcctttttaccttacatctcagtaaaagaagaattatacaaaaagcaattcaaggaaataaaagttcctggttttaatatggatctagaagtagatattgtcttcaaaaaaaatccaagtgaacacgttaaagaatttgttgcctggtttagtaaaaaaggagcaaatagtttttgttaa

SEQ ID NO: 9566 - protein, 226 aa, Unknown
  Obtained from environmental sample
  DOMAIN (11)...(222): LysR substrate binding domain
  misc_feature (1)..(226): Xaa is any amino acid
MDEMLEEIENYKNPKVTLTSEAGPSIADYALPCTLIEAKRAYPNHKYELLTSFSDEIITDVENNICDVGFTYRTQFANKGGVDILSTKTGTNRIVLVGLYDENIPDEMSVEELLNACIITFTSRSEITNSLFRNLNKLGYNKNNINCKLEVEGIEGAKMLVTRKYGLAFLPYISVKEELYKKQFKEIKVPGFNMDLEVDIVFKKNPSEHVKEFVAWFSKKGANSFC

SEQ ID NO: 9567 - DNA, 591 bp, Unknown; identical to SEQ ID NO: 8101
  Obtained from environmental sample
  misc_feature (1)..(591): n is a, c, g, or t

SEQ ID NO: 9568 - protein, 196 aa, Unknown; identical to SEQ ID NO: 8102
  Obtained from environmental sample
  DOMAIN (1)...(191): alpha/beta hydrolase fold
  misc_feature (1)..(196): Xaa is any amino acid

SEQ ID NO: 9569 - DNA, 591 bp, Unknown
  Obtained from environmental sample
  misc_feature (1)..(591): n is a, c, g, or t
atgcaagattacacaacaaaattaacaacacacagagaactttatcctatacttgaccttgattggtctgtggagagtgatagaggtcgtatcatctcttcaccctcttttagacggttacaaaaaagaacgcaagtatttgcactagagctaaatgctgctatacgaagtcggcttactcattcacttgaagtatctcaaacatcacgatttatcgctaaaactatcttaaaaaagctcgatgataaaaacctcaaagagatggaaaatgcttttgtttcaactgctgagatggctagtttacttcatgatataggcaatccaccttttggtcactttggtgaaacggctattaatgaatggatggataaggtgtgtgataaatactttatgaacatagaaggtgacaaaactcttaaaaatcaattgaaaaaagatctttcctcttatgatggaaatgccccagctataagaatcatacataaactacaacgccttaacctttcctatacacaaaccgcttcagtattaaaatacacaagaggtgcttttgagaataagaataaagacgaatcccttttcataccttaa

SEQ ID NO: 9570 - protein, 196 aa, Unknown
  Obtained from environmental sample
  DOMAIN (58)...(153): HD domain
  misc_feature (1)..(196): Xaa is any amino acid
MQDYTTKLTTHRELYPILDLDWSVESDRGRIISSPSFRRLQKRTQVFALELNAAIRSRLTHSLEVSQTSRFIAKTILKKLDDKNLKEMENAFVSTAEMASLLHDIGNPPFGHFGETAINEWMDKVCDKYFMNIEGDKTLKNQLKKDLSSYDGNAPAIRIIHKLQRLNLSYTQTASVLKYTRGAFENKNKDESLFIP

SEQ ID NO: 9571 - DNA, 750 bp, Unknown
  Obtained from environmental sample
  misc_feature (1)..(750): n is a, c, g, or t
atggatatagagtgggcaaaagacgctaaaagcgaggaactttttatagtacaagcgcgaccagaaactgtacaaagtaaaaaagaaaaatatatacttaaaaactataatctgttagtaaaagaggatgaaagaaaaactattattaaagggcaggcaattggagataagattggtgcaggtgttgttaaaatcatcactaaattgtctgattctcatatctttaaagagggagatattttagttgctgatacaactgatccagattgggaacctttgatgaaaaaagcatcagcagttataacaaacaaaggtggacgaacttgccatgcagctattgttgcaagggagataggtgttcctgctatagtgggttgtatcaatgctacaaagctattaaaagatggagacaaagtgacagttagctgtgctggtggagaaaatggttatgtatataagggtattttaaagtatgagattcaaaagatagatattgataatttacaagaacctaaaacaaaactgtttatgaatgtaggtgatccacataaagctttcctgtttgcaaaacttccaaatcaaggggttggattggctagaatggaatttattatcaataacttcataaaagcacatccaatgncactttttgatatctacaatggaaaaaaagtagaagatgaaaaagagataaaaaattttataaaagggtataaagaacccaaaaagtttttttataaagaaacctag

SEQ ID NO: 9572 - protein, 249 aa, Unknown
  Obtained from environmental sample
  DOMAIN (56)...(149): PEP-utilising enzyme, mobile domain
  misc_feature (1)..(249): Xaa is any amino acid
MDIEWAKDAKSEELFIVQARPETVQSKKEKYILKNYNLLVKEDERKTIIKGQAIGDKIGAGVVKIITKLSDSHIFKEGDILVADTTDPDWEPLMKKASAVITNKGGRTCHAAIVAREIGVPAIVGCINATKLLKDGDKVTVSCAGGENGYVYKGILKYEIQKIDIDNLQEPKTKLFMNVGDPHKAFLFAKLPNQGVGLARMEFIINNFIKAHPMXLFDIYNGKKVEDEKEIKNFIKGYKEPKKFFYKET

SEQ ID NO: 9573 - DNA, 693 bp, Unknown
  Obtained from environmental sample
  misc_feature (1)..(693): n is a, c, g, or t
atgaataaaaaaataactcaaatgttgatttatgttcttgtagttgttgcttttgttttaattattaattttgcaatacgttatgattataataaaactaaagatcaagttactaaaatgaatgttagtgaaaatttatttgataaagatgaaaatgtaaataaagatgttaaaatagatgttggtgaaattatggatgatgaaaatacaataatagttataaaaactaataaaggtaaaattgttttagaattaaatgataaaaaagcacctattactgttaaaaattttatgagctatgtaaataatgaattttataatggtactgtttttcatagagttataaaaggatttatgattcaaggtggtgggtttatgcctaatggagaacaaaaagaaactcttgaatctattatattagaatctaataatggtcttaaaaatttaaaaggtactgttgctatggcaagaactaatgatcctgattcagcaacaagtcaattttttataaatactgttgataatgattttttagattataatcctcaaagtgaaggttatgctgtatttggaaaagttattgagggtttagatattgttttagaaattgaaaaggtttctacttctactaaccatggtatgcaagattggccaactgaagctgtaattatagaagatgtttatttacaatag

SEQ ID NO: 9574 - protein, 230 aa, Unknown
  Obtained from environmental sample
  DOMAIN (69)...(230): Cyclophilin type peptidyl-prolyl cis-trans isomerase
  misc_feature (1)..(230): Xaa is any amino acid
MNKKITQMLIYVLVVVAFVLIINFAIRYDYNKTKDQVTKMNVSENLFDKDENVNKDVKIDVGEIMDDENTIIVIKTNKGKIVLELNDKKAPITVKNFMSYVNNEFYNGTVFHRVIKGFMIQGGGFMPNGEQKETLESIILESNNGLKNLKGTVAMARTNDPDSATSQFFINTVDNDFLDYNPQSEGYAVFGKVIEGLDIVLEIEKVSTSTNHGMQDWPTEAVIIEDVYLQ

SEQ ID NO: 9575 - DNA, 945 bp, Unknown
  Obtained from environmental sample
  misc_feature (1)..(945): n is a, c, g, or t
atgacaaatattatattatgtggtgggagtggtacgaggttatggccaatcagccgtactttaatgccaaaacaatttgtaaaattatttgaagacaaatcactatttcaacttacagttgaaagaaactctaaagtttgtgatagtcaatttattgtttcaaatgccgagcaatacttcctagctttagatcaactagaagagatgataaaagaagatacaaaggtatcttttggctcatcaaatctaaataaaacaaacaataaatatctccttgaaccaataggaagaaatacagctcctgcaattgcattagcttgtatggatttagcttatgatgagatagtattagtaactccatcagatcatcttatcaaagatgaaacagaatatgaaaaagttttaagtaaagcaaaagagtttacaaaggatgataagttagtaacgtttggaataagacctacatttcctgaaactggatttgggtatattcaggcagtgcctgaaaatgatgaatgtttgattttaaatgttgaattatttaaagaaaaaccaaattttgaaacggctactcaatatatagaagaaaattcaaaattaagcattcaaaatttaccattaaaatactactggaactctggaatgtttatgtttaaagcaggtgtttttctagaagaacttcaaaaatactctcctgaaatatttgatacttctaaacaagctttagaaaatgcctcanaagagggaatgattagaataaaatatgaagatatgataaatatccctgaagatagtatagactatgcagtgatggaaaaatcttcaaaagttaaagtgataccatcagatataaattggtcagatgtcggaagttttgattctctttatgatgagttacccaaagatgaaaatggtaatactcaaataaaaatcatattagtataa

SEQ ID NO: 9576 - protein, 314 aa, Unknown
  Obtained from environmental sample
  DOMAIN (2)...(305): Nucleotidyl transferase
  misc_feature (1)..(314): Xaa is any amino acid
MTNIILCGGSGTRLWPISRTLMPKQFVKLFEDKSLFQLTVERNSKVCDSQFIVSNAEQYFLALDQLEEMIKEDTKVSFGSSNLNKTNNKYLLEPIGRNTAPAIALACMDLAYDEIVLVTPSDHLIKDETEYEKVLSKAKEFTKDDKLVTFGIRPTFPETGFGYIQAVPENDECLILNVELFKEKPNFETATQYIEENSKLSIQNLPLKYYWNSGMFMFKAGVFLEELQKYSPEIFDTSKQALENASXEGMIRIKYEDMINIPEDSIDYAVMEKSSKVKVIPSDINWSDVGSFDSLYDELPKDENGNTQIKIILV

SEQ ID NO: 9577 - DNA, 435 bp, Unknown
  Obtained from environmental sample
  misc_feature (1)..(435): n is a, c, g, or t
gtgnttgacaataccgaagtcccctcatcatatgttccattcagaaatgcaagcatattaacctcatgcgtaagctgggcggaagtaattggggcggaagcaatttttatgggagctgtatttgaagattcatcagggtacccggattgcagacccgatttttttaaggcctttgaaaagattgtggaggaaggcactaagccggatacacatatatcaattgaaactccaatcatccatttaaataaaactgagattattaaaaaaggtatggagttaaatgctccaattaatttaacttggtcttgttataaagaggaagaagaggcatgcggagtttgtgatagttgtgcattacgtttaagaggatttcaaaaaataggaattgatgacccaattaattataaaattaaaccagattattcgaataaataa

SEQ ID NO: 9578 - protein, 144 aa, Unknown
  Obtained from environmental sample
  DOMAIN (1)...(58): ExsB
  misc_feature (1)..(144): Xaa is any amino acid
MXDNTEVPSSYVPFRNASILTSCVSWAEVIGAEAIFMGAVFEDSSGYPDCRPDFFKAFEKIVEEGTKPDTHISIETPIIHLNKTEIIKKGMELNAPINLTWSCYKEEEEACGVCDSCALRLRGFQKIGIDDPINYKIKPDYSNK

SEQ ID NO: 9579 - DNA, 783 bp, Unknown
  Obtained from environmental sample
  misc_feature (1)..(783): n is a, c, g, or t
ttggaaataggacaaaaaggtgaatttatcactcttattggtgaaacggaaagtggaaaatcaactttagttcagcacatgaatgctttaattagaccggtatcaggatcagtaacaatctatggaataaaaattgagaaaaatacaaataaaaacaaaaaaattaaacttaatcctcttcgtcaaaaagtaggacttgtttttcaattccctgagtatcaattgtttgaagagacagttttaaaagacattatctttgggccaaagaattttggagttcctgaaaaaaaagctattgaaagagcaaaggaaataattaaacaagttggattgaatgaaagctacttagaaagaagtccttttaatttatcaggtggagagaaaaaaagagtttctattgcgggaattttagcaatggagcctgatatactagtgcttgatgaacctacaagtggattagatcccaaaggaagagacgctttactaggtttatttacttcgattcataaagatcttaataaaacagtaatcatcattacacatgatatgaatactgtttataagtatgcaagtagagttcttgtaatgcatgaaggaaaattagtatatgatgggaaaccaaatgagttgtttgaagaagattgcatcgcagaatggaatcttgatcttccagatatcattgaaattacaaatcaattgcaaactaaactcaatattaaatttaaatctaaaccccataatgtcgatgagttatttgaactcattaagggggaattattatga

SEQ ID NO: 9580 - protein, 260 aa, Unknown
  Obtained from environmental sample
  DOMAIN (7)...(199): ABC transporter
  misc_feature (1)..(260): Xaa is any amino acid
MEIGQKGEFITLIGETESGKSTLVQHMNALIRPVSGSVTIYGIKIEKNTNKNKKIKLNPLRQKVGLVFQFPEYQLFEETVLKDIIFGPKNFGVPEKKAIERAKEIIKQVGLNESYLERSPFNLSGGEKKRVSIAGILAMEPDILVLDEPTSGLDPKGRDALLGLFTSIHKDLNKTVIIITHDMNTVYKYASRVLVMHEGKLVYDGKPNELFEEDCIAEWNLDLPDIIEITNQLQTKLNIKFKSKPHNVDELFELIKGELL

SEQ ID NO: 9581 - DNA, 525 bp, Unknown
  Obtained from environmental sample
  misc_feature (1)..(525): n is a, c, g, or t
ttgaaggaaattattatttcaagagataataaaataacttccgaaattctttatttatttaatcaaaaattcaatgaaattattaactctgctaagattattgaagatgcagattatattgatttggcattaatctctttggatattaaaaataaaaaacttgaatattctggagctaaaataccattgtatttggtgcgaaaagagcatcagtttgttgtttatacttatgaagctgatagaattagcattggaacagatactcaaaaagaatttactaatcaatttacaaatttacaaaataacgataaaatatatataacaacagacggcttgataaatcaatttggtaaatttggtcaaaaaaaatacactcgcaaaaaactaaaggattttttactatctatacaagattataatatgaacgaacaggaggttctttttgaacaagagtttgatctatggagaggtaattttgaacaaattgatgatgttcttatttttggagccgaaataaaattgtaa

SEQ ID NO: 9582 - protein, 174 aa, Unknown
  Obtained from environmental sample
  misc_feature (1)..(174): Xaa is any amino acid
MKEIIISRDNKITSEILYLFNQKFNEIINSAKIIEDADYIDLALISLDIKNKKLEYSGAKIPLYLVRKEHQFVVYTYEADRISIGTDTQKEFTNQFTNLQNNDKIYITTDGLINQFGKFGQKKYTRKKLKDFLLSIQDYNMNEQEVLFEQEFDLWRGNFEQIDDVLIFGAEIKL

SEQ ID NO: 9583 - DNA, 411 bp, Unknown
  Obtained from environmental sample
  misc_feature (1)..(411): n is a, c, g, or t
gtgctttttgcatattttaattacaaattctccgagtataaatttatagacttcaaggattggatattttacgaaaaacaagatctttttaaccnagatcaaaagagttatttagtagtattttacagttctaaagagcctcatattgttgataaaatacgagagacaaaaaattcattacctattttagcaattgactattatcagagaaattttatctcagatgagaatgtaacatttcttaagtctggcacggaaactacacttaaatttattcagcgatttaacatttatgatgtaccaacagtttttattataaaaaaagtaaaagagagcctttataaacaagatagtatgatacagaaattaaaaaatttagattatttatcaaaaaaagcagaggatttgtag

SEQ ID NO: 9584 - protein, 136 aa, Unknown
  Obtained from environmental sample
  misc_feature (1)..(136): Xaa is any amino acid
MLFAYFNYKFSEYKFIDFKDWIFYEKQDLFNXDQKSYLVVFYSSKEPHIVDKIRETKNSLPILAIDYYQRNFISDENVTFLKSGTETTLKFIQRFNIYDVPTVFIIKKVKESLYKQDSMIQKLKNLDYLSKKAEDL

SEQ ID NO: 9585 - DNA, 405 bp, Unknown
  Obtained from environmental sample
  misc_feature (1)..(405): n is a, c, g, or t
ttgtggtataatattgttaataaggatttaataatgtattatattaatgataaagagtataagtgttctgtttcagtgacactagatgtattcaatgatagatggaaattagcaatcatatggcatctacttgatggggataaaagatttaaagagttacatgaaattattagtgagattacacaaaaaactcttactgtaaaactcaaagaacttgaagaaaaaaacattatccatagagaagtattccccgaagttccaccaaaagttgtttattcgttaacaactattggaaaagagctagagtcagtactagctgccatgcacaaatggggaatatcatatacctcagcacatggtaagataacagatgaaaataagtgtgaaagcactttttgttcttga

SEQ ID NO: 9586 - protein, 134 aa, Unknown
  Obtained from environmental sample
  DOMAIN (30)...(120): Transcriptional regulator
  misc_feature (1)..(134): Xaa is any amino acid
MWYNIVNKDLIMYYINDKEYKCSVSVTLDVFNDRWKLAIIWHLLDGDKRFKELHEIISEITQKTLTVKLKELEEKNIIHREVFPEVPPKVVYSLTTIGKELESVLAAMHKWGISYTSAHGKITDENKCESTFCS

SEQ ID NO: 9587 - DNA, 645 bp, Unknown
  Obtained from environmental sample
  misc_feature (1)..(645): n is a, c, g, or t
atgaaaaacatcatagatagagtagattggcaaaagcaggagcttcttcctgttattgttcaagatataactacaaatgaagtacttatgatggcatacatgaacagtgaagctttagagttatctctaaaaacttcacaagcccactatttctcaagaagtaaacaacgtatctggaaaaaaggtgaaagctctaatcatatccaacatataaaatctttttttatagattgtgataacgacactcttttaatcaaagttgtacaagatggcgttgcttgtcacacaggaagaaaatcttgttttttcactgagttgcaaagtggtgaagcatctgacaatgtagaggtagatacaactgccatgtatggtgttatagatgagctataccatgtaattcaggagagaaagagtgctgatccagactcatcgtggacagcaaaacttctgcaaagcggtgaaaatactattttgaaaaaagttgttgaagaggctggcgagtttgcttttgcgatcaaagatgacaatgaaagtgaaataatttatgaagctgccgatctaacgtatcatgtcttagtagctcttggatataaaaatatctctcctgatagaatcaaacaagaacttgctcgtagattaatatga

SEQ ID NO: 9588 - protein, 214 aa, Unknown
  Obtained from environmental sample
  DOMAIN (126)...(214): Phosphoribosyl-ATP pyrophosphohydrolase
  misc_feature (1)..(214): Xaa is any amino acid
MKNIIDRVDWQKQELLPVIVQDITTNEVLMMAYMNSEALELSLKTSQAHYFSRSKQRIWKKGESSNHIQHIKSFFIDCDNDTLLIKVVQDGVACHTGRKSCFFTELQSGEASDNVEVDTTAMYGVIDELYHVIQERKSADPDSSWTAKLLQSGENTILKKVVEEAGEFAFAIKDDNESEIIYEAADLTYHVLVALGYKNISPDRIKQELARRLI

SEQ ID NO: 9589 - DNA, 501 bp, Unknown
  Obtained from environmental sample
  misc_feature (1)..(501): n is a, c, g, or t
gtgctttcctcagcagtgataatatttatactcacggtatatgtcataatcgtttctgcagaaaagagaatacgagttatgttaatagttacatcatttatagctattgcaatggtgacattttttgtatttacagccatcgataaatatacaaaaaaggctgaaataagaaatcttaaaaagactagaatgctctcttcagaacagatcatatattcaggttttgtaaaaaatattggtaaatatacaattggaaaagttgttataaatattgaacttgaaaataattcaggtgactctcttgcagatagaaacttttttcaaacaagaggtttcggtaatttttttgattttgggagttctaatcctcaaaatattaaacactcatttacagtagcaacagatcttaaacccggtggtataaagttttttagggctagtataacactaccttcatatttcaaacaaccaacagaaaccatggagttgcaagctaactag

SEQ ID NO: 9590 - protein, 166 aa, Unknown
  Obtained from environmental sample
  misc_feature (1)..(166): Xaa is any amino acid
MLSSAVIIFILTVYVIIVSAEKRIRVMLIVTSFIAIAMVTFFVFTAIDKYTKKAEIRNLKKTRMLSSEQIIYSGFVKNIGKYTIGKVVINIELENNSGDSLADRNFFQTRGFGNFFDFGSSNPQNIKHSFTVATDLKPGGIKFFRASITLPSYFKQPTETMELQAN

SEQ ID NO: 9591 - DNA, 714 bp, Unknown
  Obtained from environmental sample
  misc_feature (1)..(714): n is a, c, g, or t
gtgaatgagcttgttgataatatcggctatgtgaagtctcatattcgatatattctcgacgcggttgtcagcggggttctcgtggtttcgaacgatggcgtaatcacctatgccaatcgcaagttttatcagttatttaaacatcttgataaggatgtgcatggcaggcagtcacgtgagattttcggaaaaacggtcaaggccatcatcgatggcggtttgcttgacaatgaatgcactgatggcaaggagttgaacctctccgatcaaatcattaaggtgttgagcaactttgtcatcgatgaacggggcaaaagacttgggctgatcctgatttttcaggatattacccttatcaggcaataccagagcgatctgagggagaaggaaaaaatcgctgctcttggtgagatgagtctcggtgttgcccatgagattaagaacccgctgacatctgttaaggggtttgcccagatgcttcagcgtccggctctgaaagaagagaaaagagtagaatatcttcagattatggacgaagagttaaacagagtgaaccggctgcttgatgatctgctgttatatggtggacaatcccctctgaagaagcaggatgagaatcttgtggctattctcgatggtttgatagcgggacatcgtaccgttaatcccgaaattgtatttgaaaagaatatattacaaaatggaaattcataa

SEQ ID NO: 9592 - protein, 237 aa, Unknown
  Obtained from environmental sample
  DOMAIN (134)...(200): His Kinase A (phosphoacceptor) domain
  misc_feature (1)..(237): Xaa is any amino acid
MNELVDNIGYVKSHIRYILDAVVSGVLVVSNDGVITYANRKFYQLFKHLDKDVHGRQSREIFGKTVKAIIDGGLLDNECTDGKELNLSDQIIKVLSNFVIDERGKRLGLILIFQDITLIRQYQSDLREKEKIAALGEMSLGVAHEIKNPLTSVKGFAQMLQRPALKEEKRVEYLQIMDEELNRVNRLLDDLLLYGGQSPLKKQDENLVAILDGLIAGHRTVNPEIVFEKNILQNGNS

SEQ ID NO: 9593 - DNA, 894 bp, Unknown
  Obtained from environmental sample
  misc_feature (1)..(894): n is a, c, g, or t
ttgccaaaagatattccatcaaatttacttttttataaatttgatccaacgagtttctcaaaattaaaatttatattaaataagtctttgtatcaagatgctttaatagcgttagatacaaaagaggatacattggcagtagtttataatatacgagtaaaatacaaagacttaaattttacagtatatgatcagtggggattggatttaaaagataaaaatgtccaatattacagaggaaatgatattatctccaatggattaattgagcagctaccaaatattcctgtttttgcccaaaatattggtttaagacaaggtgaaataatggagattaaaattccatttggtagtacttatgcatatagatatattggaagtataggacaaaaagattggaaaatagtagctttatatagaaatgaaaagcttataaatataaaaccatcattgattataaaaccaaatgatgtaataatcattattggaaaaccagatgtattgattcaagtgtacaatgctatttcaaaatcaagtacacagtttcctatgccttttggtaagaatatttatctttatgttgatatgtttgttcaagatgaagatgagataataagtgctattgaagatgtaaagattttacaccagagaatgaaaaataatctattagttgtaaaaataacgcgaccaactacagtagaatcattaaataaaataaaatttaatctaaatcaaattccagatatgaaactagagatagattatcataatatagggatacatgctattctgaaagaggataaggtacgctttgatataggacttcttgtattaacaaaaaatattttaaaacataaagaagctataaaaatggaacttaaagctcccaattaa

SEQ ID NO: 9594 - protein, 297 aa, Unknown
  Obtained from environmental sample
  DOMAIN (109)...(176): TrkA-C domain
  misc_feature (1)..(297): Xaa is any amino acid
MPKDIPSNLLFYKFDPTSFSKLKFILNKSLYQDALIALDTKEDTLAVVYNIRVKYKDLNFTVYDQWGLDLKDKNVQYYRGNDIISNGLIEQLPNIPVFAQNIGLRQGEIMEIKIPFGSTYAYRYIGSIGQKDWKIVALYRNEKLINIKPSLIIKPNDVIIIIGKPDVLIQVYNAISKSSTQFPMPFGKNIYLYVDMFVQDEDEIISAIEDVKILHQRMKNNLLVVKITRPTTVESLNKIKFNLNQIPDMKLEIDYHNIGIHAILKEDKVRFDIGLLVLTKNILKHKEAIKMELKAPN

SEQ ID NO: 9595 - DNA, 666 bp, Unknown
  Obtained from environmental sample
  misc_feature (1)..(666): n is a, c, g, or t
atgatgggtacaatagaagagggtgcaagattacacagccaaattggatgtgataatgtgatgataaaaattcctgcaacagaagctggatatggtgcaatggagcatctaacttcaattggaattagtgttaatgcaactttaatattttcaccacaacaagcattaaaatcagcaactgcccttaacaatggtataaaaaagagtggaaaagatacaaaaggtgttgtatctatttttgtaagtagatttgatagaactcttgatgataaattaaaaaaacttgaattagaaactgctcaaacaggaattatcaatgcaacgctatgttatcacgagatagaatcaattggaagcaaaaatataagaacactttttgcaagtacaggagtaaaggggaaagaactggttccaagttattatatagatgaattaattttccctaattgtattaatactgcaccattagatactattaatgcttggttaaaagagggcaaacaaaaacaatctgaaatacttgaaaaagatgattgtatcaaatattttgaagttttaaaaagtcaccatattgatattgaaaaagtatataatgaactacttcaagatggattgagtgcctttaaggtatcatttcaagagttattaaaaaaagtaaaactataa

SEQ ID NO: 9596 - protein, 221 aa, Unknown
  Obtained from environmental sample
  DOMAIN (2)...(219): Transaldolase
  misc_feature (1)..(221): Xaa is any amino acid
MMGTIEEGARLHSQIGCDNVMIKIPATEAGYGAMEHLTSIGISVNATLIFSPQQALKSATALNNGIKKSGKDTKGVVSIFVSRFDRTLDDKLKKLELETAQTGIINATLCYHEIESIGSKNIRTLFASTGVKGKELVPSYYIDELIFPNCINTAPLDTINAWLKEGKQKQSEILEKDDCIKYFEVLKSHHIDIEKVYNELLQDGLSAFKVSFQELLKKVKL

SEQ ID NO: 9597 - DNA, 678 bp, Unknown
  Obtained from environmental sample
  misc_feature (1)..(678): n is a, c, g, or t
atgaagctagatattggagtcagtgttgctcatgagagtatttatcgttatatctatgctaataaagcaaatggtggaaaactatacacatacctgagacacaaaaataagaagtatcataaacgttcaaatgtgtataaagctagaggtaccatcatagaccgagttatgatagacaaacgacctaagatagtagagaagaagaatagaattggtgatcttgaaatagatactgtcataggaaaaaatcatattggtgcattagtcactgttgtagatagaaaatctaaatttacaatgattaaaaatgttcaatcaaaagaagccaaagtggttacagaagctctaatagagatgatacaaccaatcaaaaatataactcatacaatcacaagtgacaatggaaaagagtttgcatatcacaaagagatttcagctgcactagacactaagttttacttcgctaatccatatcattcatgggaaagaggattaaatgaacacaccaatggtttaatacgtcaatacttaccaaagaaaagtgtgtttacaaatgtttctaaggatgaaattattatgattcagaacagacttaatcacagacctagaaaagtgttaggttataaaacaccttatgaagtttttttcaaggagctgagtcgaaaattagctagttaa

SEQ ID NO: 9598 - protein, 225 aa, Unknown
  Obtained from environmental sample
  DOMAIN (66)...(216): Integrase core domain
  misc_feature (1)..(225): Xaa is any amino acid
MKLDIGVSVAHESIYRYIYANKANGGKLYTYLRHKNKKYHKRSNVYKARGTIIDRVMIDKRPKIVEKKNRIGDLEIDTVIGKNHIGALVTVVDRKSKFTMIKNVQSKEAKVVTEALIEMIQPIKNITHTITSDNGKEFAYHKEISAALDTKFYFANPYHSWERGLNEHTNGLIRQYLPKKSVFTNVSKDEIIMIQNRLNHRPRKVLGYKTPYEVFFKELSRKLAS

SEQ ID NO: 9599 - DNA, 879 bp, Unknown
  Obtained from environmental sample
  misc_feature (1)..(879): n is a, c, g, or t
atgagggcggacaaaaaagaacttgttcaagcaaaggatncaagtaaagaaaagggaacgatagcaaatgaaaatttaaatgaggtagaaattggaaataaaaccatcaaaattgcaccagaacagcaatcggttattcaggatatgataaataagaaagaaattgtagtacttgaatgtgatgaagatggtcatatagaaagacttagttgtaaaggagaaattccacttgggattgttgaattgtctcaattaaaaaatctttctgcaaaagaagcgacgagtattccttcgttggataatttagtcacattacttgtatcagataaagttgatatacagtttactaaatttccgcaattaaaaaatatatatgagagagatactattaatagtagagtaccaacagaaattgatcgagaaaaatattcagggtatgtgaatggagaatttgtagagaaaccagcctttgggggaaacattgctgcttttggtgaaaaacaaacattaaatcaagacggaggggaagttattgaagaagccaaagattcattttcagtagatcaaattacattaaatagtttgccagaaaaaatcacagaatattctgattcagcaaataaatatttagatgacagtcttcaaaccattaaacaaatcatattgcaacgacaagattttgaacaaaactatgaatctacaagtgctagagaagctgttaaaggagctgttgatgaaatgttggcagaaaaattaaaaacattaaaaagcaatatgcaaagatgtattagcgataatttattaaaatttgccgtaacaggtgaatccaatccaacagtagctgctgcatcagaatttgtgaaacttcgtggtgaatag

SEQ ID NO: 9600 - protein, 292 aa, Unknown
  Obtained from environmental sample
  misc_feature (1)..(292): Xaa is any amino acid
MRADKKELVQAKDXSKEKGTIANENLNEVEIGNKTIKIAPEQQSVIQDMINKKEIVVLECDEDGHIERLSCKGEIPLGIVELSQLKNLSAKEATSIPSLDNLVTLLVSDKVDIQFTKFPQLKNIYERDTINSRVPTEIDREKYSGYVNGEFVEKPAFGGNIAAFGEKQTLNQDGGEVIEEAKDSFSVDQITLNSLPEKITEYSDSANKYLDDSLQTIKQIILQRQDFEQNYESTSAREAVKGAVDEMLAEKLKTLKSNMQRCISDNLLKFAVTGESNPTVAAASEFVKLRGE

SEQ ID NO: 9601 - DNA, 807 bp, Unknown
  Obtained from environmental sample
  misc_feature (1)..(807): n is a, c, g, or t
atggatagagaatcttttaaagagctttgggatacagtaaaatcaaaaaaaccatggacgggtattgtaacaaatatggcaaaagatgggagttcttatgttgttgatacaacagttattcctatacttgatgttgatggagatattgtagagtttattgcagtaagacatgacataacggatttcgagaaaacaaaagagcagttgcaaaatattaataaagtgatgaaaaataaagttgatgaactgtatagcgtaacatcttcactagaagaaaaagctacaagagatgaactcactggactttataatagagcaaaatttgaagagatattttcttatgagataaataaagcgaaacactataataatcaattgagtgttatactctttgatattgatcactttaaaaatatcaatgatacttatgggcatcaagctggagatgtgactttaaaagagctttcaagtttaattacaaaaaatattaaaacaagtgatatatttgctagatggggtggagaagagtttattatacttttaccagatacaaatagagatggagcaatgcaatttgcccaaaaattacgaaaaataataaaagaaaataaattttcagatatagaatatatgacagctagttttggagtagcacaatttgaagaatacgaagataagcttactttatttgaaaaagttgataaagcattatatatagcaaaaaataatggtagagatagggtagaacaaagtctttttaattgtgtgcattanaaaaatataacatttaaaattaatttttactaa

SEQ ID NO: 9602 - protein, 268 aa, Unknown
  Obtained from environmental sample
  DOMAIN (20)...(62): PAC motif
  misc_feature (1)..(268): Xaa is any amino acid
MDRESFKELWDTVKSKKPWTGIVTNMAKDGSSYVVDTTVIPILDVDGDIVEFIAVRHDITDFEKTKEQLQNINKVMKNKVDELYSVTSSLEEKATRDELTGLYNRAKFEEIFSYEINKAKHYNNQLSVILFDIDHFKNINDTYGHQAGDVTLKELSSLITKNIKTSDIFARWGGEEFIILLPDTNRDGAMQFAQKLRKIIKENKFSDIEYMTASFGVAQFEEYEDKLTLFEKVDKALYIAKNNGRDRVEQSLFNCVHXKNITFKINFY

SEQ ID NO: 9603 - DNA, 399 bp, Unknown
  Obtained from environmental sample
  misc_feature (1)..(399): n is a, c, g, or t
ttgagtgttatactctntgatattgatcactttaaaaatatcaatgatacttatgggcatcaagctggagatgtgactttaaaagagctttcaagtttaattacaaaaaatattaaaacaagtgatatatntgctagatggggtggagaagagtttattatacttttaccagatacaaatagagatggagcaatgcaatttgcccaaaaattacgaaaaataataaaagaaaataaattttcagatatagaatatatgacagctagttttggagtagcacaatttgaagaatacgaagataagcttactttatttgaaaaagttgataaagcattatatatagcaaaaaataatggtagagatagggtagaacaaagtctttttaattgtgtgcattaa

SEQ ID NO: 9604 - protein, 132 aa, Unknown
  Obtained from environmental sample
  DOMAIN (1)...(122): GGDEF domain
  misc_feature (1)..(132): Xaa is any amino acid
MSVILXDIDHFKNINDTYGHQAGDVTLKELSSLITKNIKTSDIXARWGGEEFIILLPDTNRDGAMQFAQKLRKIIKENKFSDIEYMTASFGVAQFEEYEDKLTLFEKVDKALYIAKNNGRDRVEQSLFNCVH

SEQ ID NO: 9605 - DNA, 519 bp, Unknown
  Obtained from environmental sample
  misc_feature (1)..(519): n is a, c, g, or t
ttgcgtcccggacgacagaaagctgtctatatggacatcataaaagaacattatccacatttaacagattattaccagaatatgtatgcaaatgagttaccctcaggatcaccaattcgaaccttctctaaagatctgtacgccactttggataaacttcttaagaaatatcaaatacctcagcagatacctcattatatttatcaaaactgctttactcgctatgatgagatctatgtcttattgaatcatatgttacaattatataacgatgccggggtaaacacaatccccttagaagttgcgataaagcgatatttttcctggctgaaagaggagcgtaaatcttatctcaggaaaagaaaacaacctactaacagattggaggaaacctttgttaatctcatcgaatccaatcagataaatgacattattggaaatccaaaactatctgattttataaaaaaagtggtattagagagaaaaaagtttgactatattaatttaaatctctattaa

SEQ ID NO: 9606 - protein, 172 aa, Unknown
  Obtained from environmental sample
  misc_feature (1)..(172): Xaa is any amino acid
MRPGRQKAVYMDIIKEHYPHLTDYYQNMYANELPSGSPIRTFSKDLYATLDKLLKKYQIPQQIPHYIYQNCFTRYDEIYVLLNHMLQLYNDAGVNTIPLEVAIKRYFSWLKEERKSYLRKRKQPTNRLEETFVNLIESNQINDIIGNPKLSDFIKKVVLERKKFDYINLNLY

SEQ ID NO: 9607 - DNA, 381 bp, Unknown
  Obtained from environmental sample
  misc_feature (1)..(381): n is a, c, g, or t
atgcggaagcggataagcatttgcaccgcttctgtgcaatatatcaaaagtctgggcaaaaaagcgggtgtatctttaaaccctgcgacaccggaaagcgcgcttgagtacgtgttggacgatattgatctgattttggtcatgagtgtgaaccccggttttggcgggcaaaagttcatctcctcacaacttgataaaatccgtcgcctacgggacaagattggagatcgccagattgatattcaggtcgatggcggggtaaatccggatacaatcaagagtgttgtcgacgccggcgcgaatgtggtcgtggcaggttctgcggtctttggtggtgattataaaacaaatattcaggcgattcgcgacaaatctgtttaa

SEQ ID NO: 9608 - protein, 126 aa, Unknown
  Obtained from environmental sample
  DOMAIN (3)...(113): Ribulose-phosphate 3 epimerase family
  misc_feature (1)..(126): Xaa is any amino acid
MRKRISICTASVQYIKSLGKKAGVSLNPATPESALEYVLDDIDLILVMSVNPGFGGQKFISSQLDKIRRLRDKIGDRQIDIQVDGGVNPDTIKSVVDAGANVVVAGSAVFGGDYKTNIQAIRDKSV

SEQ ID NO: 9609 - DNA, 516 bp, Unknown
  Obtained from environmental sample
  misc_feature (1)..(516): n is a, c, g, or t
gtgagcagttcaaagcaattaacagaattttacactcctatgctaacttatttacaagtttcaaaagcgttgtctagagagttattattaaataaaccaaaagactttaatttattatgctatcttcttgataaaaattataagtttgatggaggcaaggttgtagtaatttctgacaaagaaaaacaattaattaaagaagttataactatatcagatgaaatttcagaaatcttagtgaacaagggaggtcttgtagaggatactagattgactataaattatgagccaaatccagaaattactgatataaaacttgatgacgataataaggatattggtttaaatggattgttgctggttcattacaaaattattaaaagtgctgagaaagaagaaatttctggaaatatagaatattataaacaatttatatttcctagggagattgtaacagtgattaaagaaaattatcataaattaaaagatgaacttgaaagtatcactcttgtataa

SEQ ID NO: 9610 - protein, 171 aa, Unknown
  Obtained from environmental sample
  misc_feature (1)..(171): Xaa is any amino acid
MSSSKQLTEFYTPMLTYLQVSKALSRELLLNKPKDFNLLCYLLDKNYKFDGGKVVVISDKEKQLIKEVITISDEISEILVNKGGLVEDTRLTINYEPNPEITDIKLDDDNKDIGLNGLLLVHYKIIKSAEKEEISGNIEYYKQFIFPREIVTVIKENYHKLKDELESITLV

SEQ ID NO: 9611 - DNA, 834 bp, Unknown
  Obtained from environmental sample
  misc_feature (1)..(834): n is a, c, g, or t
ttgtcttacatagaactacctctacttctaaataagaaattaaaagagtcaatgaatactgatattaacaagaactataagggaaatatcactatatctaaagatattattgcaattaagaagcaagagtttttaaaacaaatagatactaatgaacaaagtaacatagagaaaatatttgacaaagtatttaattctgatgagaactttcaaagtgtaccttttgctgattctattaaaattgaatcacaatttaaatctttacatgaattagacattaagcagttgttagacaacttaattacactaaaagaacaaatcaaatatagtgagaatgagatatattcattagaactgaaaattcaagaagataaaattgaatatgaaaatgattttaaacaagtaaaagtaatagcagaaaatataggtattaaaaaatcagaaatagaaaatattcaagcgcaaatagatagtttagaaattactcaaactgagataaacagagaaataagtcgaacaagtgtaaaagaacataaaaatagtttatctaaattgaaaataaaatctttagaatcggttattcaagtagcatctgctatgaaaataaaaataaaagaagataaaaaagagttacttgaaaagtcaataaatataaagtttaatctacttaaaaaagatgattatgaagcagattgcataaaattggactctgactttaatatttatatttttgacattaacttaaatcctagggatatattatctagctcttcaggacagaaacagattattgcaactgctttaatttggggtaatatcggagtatatacctga

SEQ ID NO: 9612 - protein, 277 aa, Unknown
  Obtained from environmental sample
  misc_feature (1)..(277): Xaa is any amino acid
MSYIELPLLLNKKLKESMNTDINKNYKGNITISKDIIAIKKQEFLKQIDTNEQSNIEKIFDKVFNSDENFQSVPFADSIKIESQFKSLHELDIKQLLDNLITLKEQIKYSENEIYSLELKIQEDKIEYENDFKQVKVIAENIGIKKSEIENIQAQIDSLEITQTEINREISRTSVKEHKNSLSKLKIKSLESVIQVASAMKIKIKEDKKELLEKSINIKFNLLKKDDYEADCIKLDSDFNIYIFDINLNPRDILSSSSGQKQIIATALIWGNIGVYT

SEQ ID NO: 9613 - DNA, 783 bp, Unknown
  Obtained from environmental sample
  misc_feature (1)..(783): n is a, c, g, or t
atgaaaatatttagtttaatttttatactactgtttactagtttaagcgctgatgaacttgctcaggcttatgaaaaagagttcacatttttaaaagcacaaaaaaatgagttgaaaaatagacttaataaagaaaaaacgtttcaagacagagagataaaaaaagcaaaaaaacaggtgcaacagttacaaaacaaacttgttgagttatctgaaagcgaaaaaaatatccaaaaacagatagataaatcatcagtagtattagaagataaaagctcaaataaagagatatcttcaagtgtgattattcaggcatcatcactcttaaatgagtatggtattaaagttgatgatagcaaagaagcagatactgtagctgttatgaatagagcatttgcagatactttagaactttataaaaaactatcttcactacacaaagagagtggtaagttttatttaacggatggaacaactgctgagggtcagattgttaaagttggaaatgtcatggcatatggagtttctagtaaggtttcaggtgcactagcgcctgccggcaatggtgagtacaaaatctggaacaaagatacaacagccgatgcgaaagcttttgataaaaataatctaagaaaagagattaaagtatttatctatgaaaaccttgataaagatgttgagtatgcaaaagagaaaacacttcaagatactcttgatggtggaggtactataggttatataattttatctcctggccttttaggcttactccttctgttataa

SEQ ID NO: 9614 - protein, 260 aa, Unknown
  Obtained from environmental sample
  SIGNAL (1)...(17)
  misc_feature (1)..(260): Xaa is any amino acid
MKIFSLIFILLFTSLSADELAQAYEKEFTFLKAQKNELKNRLNKEKTFQDREIKKAKKQVQQLQNKLVELSESEKNIQKQIDKSSVVLEDKSSNKEISSSVIIQASSLLNEYGIKVDDSKEADTVAVMNRAFADTLELYKKLSSLHKESGKFYLTDGTTAEGQIVKVGNVMAYGVSSKVSGALAPAGNGEYKIWNKDTTADAKAFDKNNLRKEIKVFIYENLDKDVEYAKEKTLQDTLDGGGTIGYIILSPGLLGLLLLL

SEQ ID NO: 9615 - DNA, 945 bp, Unknown
  Obtained from environmental sample
  misc_feature (1)..(945): n is a, c, g, or t
atgacagatcggctgagatatgatgcttatgaatttgctaaagatgagatttttcgtgaagttttcgttctagctcatactcaaaacttaaagaacaaagatatttatgagggtggttcaaaaatgattaccttgctcaatccaactaatgatgttaatgagcagtcaataatgtttgaaactcagcgttcaatttgtgccgcctttatatctttaataaactatgacaaaaaagctaaacttaaggacaaaaatatcgttgattatcttggttataaagaaatcattgagattggtccagatgaaaaaatgcttgatataatgattgtttggataagcaattacgccaaaaaagttggctatacgcttggggctggacttatttctggaaaaccagatcagggcattaatcacaaagaattcggggtaacgtcttttggggttcaccaattcttcttgcggacgcttaaggaaataaacattgatccgcttaatgatgagttttcggttaaaatttctggtggtccatatggagatgttgctggtaacgaaataaaattacttttgcaaaaaaatggcaattcatatctttataaaaacgcaaaaattatcgcaattaccgacggtccagccgcagtttatgaccccgcaggtttagatcgagaagagttagccttgctagtactagaaaaaaaccttgactcctttagtcctgacaaacttcaagccgatggtgcctacatgatttttagtcagtcagtagcaacacctgaaggcgatcgttatcgacttgtttacaaaaaggatgggaaaattgcagaaaagatggtcaatcgcgataaatacatgaattattttcaaattatatgtataattatggcgacgtctttatacccttgcggcggacgtccatcaacgataagtatttctaactggcaaaactaa

SEQ ID NO: 9616 - protein, 314 aa, Unknown
  Obtained from environmental sample
  misc_feature (1)..(314): Xaa is any amino acid
MTDRLRYDAYEFAKDEIFREVFVLAHTQNLKNKDIYEGGSKMITLLNPTNDVNEQSIMFETQRSICAAFISLINYDKKAKLKDKNIVDYLGYKEIIEIGPDEKMLDIMIVWISNYAKKVGYTLGAGLISGKPDQGINHKEFGVTSFGVHQFFLRTLKEINIDPLNDEFSVKISGGPYGDVAGNEIKLLLQKNGNSYLYKNAKIIAITDGPAAVYDPAGLDREELALLVLEKNLDSFSPDKLQADGAYMIFSQSVATPEGDRYRLVYKKDGKIAEKMVNRDKYMNYFQIICIIMATSLYPCGGRPSTISISNWQN

SEQ ID NO: 9617 - DNA, 690 bp, Unknown
  Obtained from environmental sample
  misc_feature (1)..(690): n is a, c, g, or t
ttgagtgcatatgatttacagatttttagtgactatattcatgatcaaaaatcagctcccgataaaatagatttaagcaaatttgatataaatagacaagacaatgactttgtgatttctagagacataatcggaaatattatttctaaatttggtgacaataaatggaattttgtaccttacataagcaatccgtcacaatatcctatatgtgattttgaaaaagctgtttataaagatcatattgatgattcaaagaaacttctgcttttgctaatgatttatgggcgtggtagagatggctcacactattctgtatcaacgattactggttattttgcaagtgctataatcccactatctaagtttgctaaaaaattaaatatttcattctgtcaaatatttgaagaaacaaattatactcttcaatatatcaatgaagaatgtacaaacaggacaaaaatatctactattttatcactgttattttttctaaataatcattctaatgataagacaaaaatcaattataaacaagatagtaatgtaattttccaagcaaataaacttcgtacattttttttgaatcaagcaaaacaaacagaaataataccaatccggatattgtcagaaagcttatctcaaagatgggaacaaattgaagaagtagaacaatatctcaataattaa

SEQ ID NO: 9618 - protein, 229 aa, Unknown
  Obtained from environmental sample
  misc_feature (1)..(229): Xaa is any amino acid
MSAYDLQIFSDYIHDQKSAPDKIDLSKFDINRQDNDFVISRDIIGNIISKFGDNKWNFVPYISNPSQYPICDFEKAVYKDHIDDSKKLLLLLMIYGRGRDGSHYSVSTITGYFASAIIPLSKFAKKLNISFCQIFEETNYTLQYINEECTNRTKISTILSLLFFLNNHSNDKTKINYKQDSNVIFQANKLRTFFLNQAKQTEIIPIRILSESLSQRWEQIEEVEQYLNN

SEQ ID NO: 9619 - DNA, 927 bp, Unknown
  Obtained from environmental sample
  misc_feature (1)..(927): n is a, c, g, or t
ttgggaataataacagataaaagaataataatttgccaaattttatataaagaaagagaacttatcaaatcaccttatgggattaaagtaaataaaaaatcattagtaaaatggcgaaaaaaaattaccgaatatatgatagatatttctatatcagactatcagttaggacgtactagctcaacaattaacaggaaaaactctaacattatcgctttttttgattggctagacaaaaataaattaaatttgaacgataaaaaagatagtgcggtacatatttttcaagcatatacattgtttttaaaaagcaagattagggacggttcaataaaaaatcaaactgcctcaatgaaacaagcagatatacgcaatatgctacatatcatttataacgatcaagaaaaccaaatcggtagtagtgcaagtttaataccaagaactaaacaacgaacatctaagaccaaaaaaagctcgtcaacagatcaaaaatatcattatcaattctattatgatttttttcatcaggtaggtgattttatacttgaaaataagcaatttccaataaaactaaaacttgtaaataaagagatttggtgtcttccttcaaaatctatgttctttaatcatgaagataaaattttcccctatggcttcaattacttagatggtactgtcaaagaagtagatgtacttgctaaagaaagagattgtagtttaaaacacgcaaaaatgatgatcaataactttagtaatactctggacaaggtaaataagcatcgttctcaaaagagactgtatctagcaacatatgctttaaaagcattttacatgttatttttagccaatacagggatgaatgattccacagctgcaactttaaagtggaatagtagctattctatcgaaaaacaagacaccagtttc

SEQ ID NO: 9620 - protein, 309 aa, Unknown
  Obtained from environmental sample
  misc_feature (1)..(309): Xaa is any amino acid
MGIITDKRIIICQILYKERELIKSPYGIKVNKKSLVKWRKKITEYMIDISISDYQLGRTSSTINRKNSNIIAFFDWLDKNKLNLNDKKDSAVHIFQAYTLFLKSKIRDGSIKNQTASMKQADIRNMLHIIYNDQENQIGSSASLIPRTKQRTSKTKKSSSTDQKYHYQFYYDFFHQVGDFILENKQFPIKLKLVNKEIWCLPSKSMFFNHEDKIFPYGFNYLDGTVKEVDVLAKERDCSLKHAKMMINNFSNTLDKVNKHRSQKRLYLATYALKAFYMLFLANTGMNDSTAATLKWNSSYSIEKQDTSF

SEQ ID NO: 9621 - DNA, 762 bp, Unknown
  Obtained from environmental sample
  misc_feature (1)..(762): n is a, c, g, or t
atgttaggacttgatcttaaatttggaaaagttcttaaaaatgaagatataaataactatttaaaatcatctaatccgtatatgaagtggttaaatgagcatatggtctatcttcaagagcatattgagcaacaatatattaatccaagagagtttgaaggcgatgagttaattaaacgtcagcgttactttaatatcactcaagaggttatagaacaagttattgaaccaatgcttcgtgatggtaaagaggcagtcggttctatgggtgatgatacgcctctagccgcatttagtacaaagcaacgctcattcagtgattttttcaaacaaaaatttgcacaggttacaaatcctccgattgatccgattcgagaaaaaattgttatgagtttaaatacaggttttggtgaagttcacaatattttggatgaacttccaagcaatgcacaccgtattaaagctatctcacctgttattacacgtgaaaagttagatgttttaaaatcttttggagatgataaatcacctagatatcaagatttctacaaaaatgtaacattctctacagcatacaaaagtgatcttaaaggttcacttcaaaagttggcagatgaggtcatcagatcagttaaagaagatggcgcaagagtgataattttagaagatagcggatttgataaagatcataagatcattccaatgcttatggcagttggaaaaataaatcaacttttactaaaaatcaagtacgacacttga

SEQ ID NO: 9622 - protein, 253 aa, Unknown
  Obtained from environmental sample
  DOMAIN (57)...(253): Glutamate synthase central domain
  misc_feature (1)..(253): Xaa is any amino acid
MLGLDLKFGKVLKNEDINNYLKSSNPYMKWLNEHMVYLQEHIEQQYINPREFEGDELIKRQRYFNITQEVIEQVIEPMLRDGKEAVGSMGDDTPLAAFSTKQRSFSDFFKQKFAQVTNPPIDPIREKIVMSLNTGFGEVHNILDELPSNAHRIKAISPVITREKLDVLKSFGDDKSPRYQDFYKNVTFSTAYKSDLKGSLQKLADEVIRSVKEDGARVIILEDSGFDKDHKIIPMLMAVGKINQLLLKIKYDT

SEQ ID NO: 9623 - DNA, 486 bp, Unknown
  Obtained from environmental sample
  misc_feature (1)..(486): n is a, c, g, or t
ttgtctgaattgacacttattttactcgccgcaggtgaatcgaatcgctttaaactacctgtgaagaagcaatggctaagagttgatcacgatcctttgtggcattttgtcacaaaaaaactttttgaaacaggtaaattcaaaaaaataattattactgcgcacaaagatgaagtaacttttatgcacaacttcagtgattttgaaataattgaaggcggttcaactcgtcaagagtcactaaagaatgcacttaaagaagtaaaaagcgactatgtcttagtaagtgacatcgctagagcttgtataagtgatgatttattagaaaaaatagttgattctcactcaaatgctgactcgattgttccctatctaaacgtcagtgacacaataacatacaataataaaacaatagagagagaacatgtaaaacgtattcaaactcctcaactttcacgtactgaaattctaaaaaaaagcgcttga

SEQ ID NO: 9624 - protein, 161 aa, Unknown
  Obtained from environmental sample
  DOMAIN (4)...(161): Uncharacterized protein family UPF0007
  misc_feature (1)..(161): Xaa is any amino acid
MSELTLILLAAGESNRFKLPVKKQWLRVDHDPLWHFVTKKLFETGKFKKIIITAHKDEVTFMHNFSDFEIIEGGSTRQESLKNALKEVKSDYVLVSDIARACISDDLLEKIVDSHSNADSIVPYLNVSDTITYNNKTIEREHVKRIQTPQLSRTEILKKSA

SEQ ID NO: 9625 - DNA, 765 bp, Unknown
  Obtained from environmental sample
  misc_feature (1)..(765): n is a, c, g, or t
gtgttagtgggtaaatcactctatgaagagtataatttaaatcttgatgataaacttatctatatctttacacaactagagccaggtggactcagtgcaacaccaaaaattaaaagattcaaagttaaaagtttttttgattctggattatctgcttatgataaagcatatagctatacaacactagagtctttacaaaaaatattgagaatgccatataatcaatatgacggaatacatatcttctcaaaaaatccacaagaagatattaaaaaaattgctgaagttttgccaaattctgtatttataaaaggctggtgggaagataatgctaacttttttgcagcattagagctagaaaaaaaatctctctttattgtattgatgttaattatacttatagcctccataaacataatatcttcacttttaatgaccgttatgaacagaagaagcgaaatagcacttttactctctcttggggctagtaaactagaaataaagcagctgtttctatatttgggtattgttatcggcatagggggaatattaacaggtatatttttaggtcttagcggtttgtggatattaagcagttttgatatcgtatctttaccaaaagatgtttatcctacatctactcttccactagaacttagtatggtggactttttctctattattacaggtgcttttgtgattgtgattttatcatcttattatcctgcaaaaaaagctagtgaagttgatattttacagttttaa

SEQ ID NO: 9626 - protein, 254 aa, Unknown
  Obtained from environmental sample
  DOMAIN (76)...(251): Predicted permease
  misc_feature (1)..(254): Xaa is any amino acid
MLVGKSLYEEYNLNLDDKLIYIFTQLEPGGLSATPKIKRFKVKSFFDSGLSAYDKAYSYTTLESLQKILRMPYNQYDGIHIFSKNPQEDIKKIAEVLPNSVFIKGWWEDNANFFAALELEKKSLFIVLMLIILIASINIISSLLMTVMNRRSEIALLLSLGASKLEIKQLFLYLGIVIGIGGILTGIFLGLSGLWILSSFDIVSLPKDVYPTSTLPLELSMVDFFSIITGAFVIVILSSYYPAKKASEVDILQF

SEQ ID NO: 9627 - DNA, 516 bp, Unknown
  Obtained from environmental sample
  misc_feature (1)..(516): n is a, c, g, or t
ttgtatctatctgataaaagaaatattttatttgatgaactctcttttgaaaaaaaagataataatagagtagaaggttctctcttctttggcgaaggtagtgctaatatcatctatcaagatgaacaatttttacttgtgggtgctaactttggtgattttttcatgaatgccatatcttctctttcagaatttgagggaggtatatttagttttgccatgggtggaaaactagatgcttttagtggctatctagagttagatgagtctactcttatgaattataagcttgtaaataacatgctcgctttcataaatactataccatctcttataactttttctatccctgaatataataataaaggtctctatgcaaaaaaagttttactgaacttctcaacaaaaaattcacttatactgcttgatagtgcaagattagactcaaaagagctaaagatgaatggtacaggctcacttgattacaaaaaaaatagtattgatgctctgctttga

SEQ ID NO: 9628 - protein, 171 aa, Unknown
  Obtained from environmental sample
  misc_feature (1)..(171): Xaa is any amino acid
MYLSDKRNILFDELSFEKKDNNRVEGSLFFGEGSANIIYQDEQFLLVGANFGDFFMNAISSLSEFEGGIFSFAMGGKLDAFSGYLELDESTLMNYKLVNNMLAFINTIPSLITFSIPEYNNKGLYAKKVLLNFSTKNSLILLDSARLDSKELKMNGTGSLDYKKNSIDALL

SEQ ID NO: 9629 - DNA, 345 bp, Unknown
  Obtained from environmental sample
  misc_feature (1)..(345): n is a, c, g, or t
atgaacagaggtaaaaaactagatatttttatcggagctgatatagataatagttgggcagaagttcaaacgcctcgcaagtctaaggtatctaatgaaatattagaaccatcaaagcattttcttgtttttaaaaaagaaaaaagacgaggcaaaacagttactcttatcggtgaatttcaaattccaaaaaaagatattacagatacgctaaaacgactcaaaaaaaagcttggttgcggtggagcttttaaagatggttggatggagtttcaaggtgagctaaaagataaacttagagttcttttagtaaatgaaggttttagatttaaacacggtcactaa

SEQ ID NO: 9630 - protein, 114 aa, Unknown
  Obtained from environmental sample
  DOMAIN (36)...(112): Translation initiation factor SUI1
  misc_feature (1)..(114): Xaa is any amino acid
MNRGKKLDIFIGADIDNSWAEVQTPRKSKVSNEILEPSKHFLVFKKEKRRGKTVTLIGEFQIPKKDITDTLKRLKKKLGCGGAFKDGWMEFQGELKDKLRVLLVNEGFRFKHGH

SEQ ID NO: 9631 - DNA, 525 bp, Unknown
  Obtained from environmental sample
  misc_feature (1)..(525): n is a, c, g, or t
ttgggagcttaccaacggcttgtttttataagagtttttcggggccaagcaaaattcagggataagaaaaactggggagaaaattcaaaagggctcagtaccactcttataaaaatagataagtttgaaaaaggtggaataatggattcttattctatctgtagttttcttcgtcatgacggagaacttcatgcctatggagaagatgtaaaactaaatggttatagctatttttatgacaaacttcttgattggatgactaaccagataaatgtccaagaaaactttggtccgctagagccactaagcgaatacgttgcagcttgttctaatcccaaagaagcaatcataagtattggtgctaccagatatacccaatatggtgaaaacacatttttacaaaaagatgatgaagtaatcatagctctttataacagaaatgatttttctaaagaagaagtcactcagaatataaaaaacaattcatatgacaaaatgagtgttttagctcaaaaagttatctaa

SEQ ID NO: 9632 - protein, 174 aa, Unknown
  Obtained from environmental sample
  misc_feature (1)..(174): Xaa is any amino acid
MGAYQRLVFIRVFRGQAKFRDKKNWGENSKGLSTTLIKIDKFEKGGIMDSYSICSFLRHDGELHAYGEDVKLNGYSYFYDKLLDWMTNQINVQENFGPLEPLSEYVAACSNPKEAIISIGATRYTQYGENTFLQKDDEVIIALYNRNDFSKEEVTQNIKNNSYDKMSVLAQKVI

SEQ ID NO: 9633 - DNA, 828 bp, Unknown
  Obtained from environmental sample
  misc_feature (1)..(828): n is a, c, g, or t
atgtttcagtatgctatagcaaaagctatggctaaaaaaaatagtgatatattcaaacttgatatatctttttatcctacacaaactctaagaaagtatgaattaaattttttcaatatcgaagaaaatatcgcaacagaagatgaatatataaaatttagaggcagagaaaagtttgtttttaaagtaaaaaatagattaggtttaaatgtaaatagaccttcttcatatattttagagaatcatttaactaaatttgacagtgaaatatacaaaaaaaaaggtgatatctatttagatggtttttggcaaaatgaaaagtactttaagagtattaaagatgaaatactagaagactttacacttaaaagtaagattaccaatgaggtgaatgagcatttagttaatatgaaaaactccaacaccgttagtctgcacgtaagaagaggggattatgtagatgatactaatacaaacagtatccatggggtttgtggtattgattattataaaaaagctacagagtatataatcaaaaaagtacaaaatcctgttttttatatcttttcagatgatttgtcatggtgtaagaaaaatttcgattttttagaaaacagagtttttgtagataatacaaaaagtgcatttgatgacttagaactaatgaaaaattgcaaacataatattattgcaaatagtacttttagttggtggggtgcatggctaagtgactattgtaaaaaaatagttgtagttcctaaaatatggtttgttgaagagaaatggaaaaatttgagcttggctaatgatgaatggataagattgtag

SEQ ID NO: 9634 - protein, 275 aa, Unknown
  Obtained from environmental sample
  DOMAIN (1)...(274): Glycosyl transferase family 11
  misc_feature (1)..(275): Xaa is any amino acid
MFQYAIAKAMAKKNSDIFKLDISFYPTQTLRKYELNFFNIEENIATEDEYIKFRGREKFVFKVKNRLGLNVNRPSSYILENHLTKFDSEIYKKKGDIYLDGFWQNEKYFKSIKDEILEDFTLKSKITNEVNEHLVNMKNSNTVSLHVRRGDYVDDTNTNSIHGVCGIDYYKKATEYIIKKVQNPVFYIFSDDLSWCKKNFDFLENRVFVDNTKSAFDDLELMKNCKHNIIANSTFSWWGAWLSDYCKKIVVVPKIWFVEEKWKNLSLANDEWIRL

SEQ ID NO: 9635 - DNA, 444 bp, Unknown
  Obtained from environmental sample
  misc_feature (1)..(444): n is a, c, g, or t
gtgaactccactcctaaaatctatgctaatgaaaatataatcgtacttataggtggtatnggaaaagaaaacactgatagttcattagagtatatatttgaaaaatatactataacaaaagcttttaatattgggattgctggttgtagtgatacaactatagagataggggagttattttgtaccaataggaagttagatgatataaagtttatggattgtaaaacagtagatactccccaacttccatctaatgtaacaccaaataccctttatgatatggaagcttcttattatttagaaatagtaaacgaacacttaaagcaaaaagatatctatatattcaaaatagtatctgaccatcttgatagtaccatcccaaaaaaagactttataaaaaaacttatcaatgacaaatttactcaaatctcaaaatacctctaa

SEQ ID NO: 9636 - protein, 147 aa, Unknown
  Obtained from environmental sample
  misc_feature (1)..(147): Xaa is any amino acid
MNSTPKIYANENIIVLIGGXGKENTDSSLEYIFEKYTITKAFNIGIAGCSDTTIEIGELFCTNRKLDDIKFMDCKTVDTPQLPSNVTPNTLYDMEASYYLEIVNEHLKQKDIYIFKIVSDHLDSTIPKKDFIKKLINDKFTQISKYL

SEQ ID NO: 9637 - DNA, 486 bp, Unknown
  Obtained from environmental sample
  misc_feature (1)..(486): n is a, c, g, or t
gtggtacaaagtggattttatagtagttttagtatctttgaacatcaagatttcacagaacaacagcacaaaaaagttcatgaaacattggaatttttagagatagaccactgnaaagaaaaaagagtaagtactatgtccacaggggagttacgaaagtgtatcattgcacgagcacttatccataatccacaagcatttatcctagatgaaccaacagttggacttgatatcaaagcacaaatcaattttttgaagatgttacaaaagctagcacttcaaagctctattatcttagtgacacatcatttagaggagatatttgaagatattaccaatatagctttgatttatgataatactatctataaaagtggattaaaagaggatattcttacaagtgaaaatctctcaactatctttgatacaaaactaaaaatcaatgaaaagaaccatagatatttcgtagaggagatttatgagtag

SEQ ID NO: 9638 - protein, 161 aa, Unknown
  Obtained from environmental sample
  DOMAIN (4)...(120): ABC transporter
  misc_feature (1)..(161): Xaa is any amino acid
MVQSGFYSSFSIFEHQDFTEQQHKKVHETLEFLEIDHXKEKRVSTMSTGELRKCIIARALIHNPQAFILDEPTVGLDIKAQINFLKMLQKLALQSSIILVTHHLEEIFEDITNIALIYDNTIYKSGLKEDILTSENLSTIFDTKLKINEKNHRYFVEEIYE

SEQ ID NO: 9639 - DNA, 825 bp, Unknown
  Obtained from environmental sample
  misc_feature (1)..(825): n is a, c, g, or t
atgtggctggatggggccacttggccaaaaaatttaatcagaaaatgtgaaaacactttggggtcagatgaaccattactaaataactttgaagcaactcagttaaggaatatgcttgagcaaagcggcaatagtaaaaaggttatcaccatatgcaatggtattttatctcaaagtggaaatgatgaactatttttggaagagatgaagaaatcattaaacgatgataaagttgaatcaactaatccaaaactaaaaacttacagagatctctttaatctgaatggcatctttgtcacaacaaatgcggatagacatattgaccaaatctttacgccccaaaatatcatcaaaaaagattttacagcaagtacggctctcgtaaataaaaatctatacaaaatacatggaagtatagatgaccctgccagcctaatttttacagtagaacaatattttacaaggtataaagacaaggaatttattcaatttttgagatctctttttaataaaactgttttattcgtagggtatggattgggagaatttgatctgttagaacacatgtataaaaatatcactcttagtgagaatcattattattaccttggtgggtactatagacatgaaaaaagactttgtgattttgagcagatgtattttgatcaaatgaaggtggagctcataccttattcaaaagacaaaaaaggatttaagcagttgcctatagttatagaggaatgggtaaaacaaattcaaaccacaacaaatgtcttacaaaataattttgatgagatagacgaagtgttgaggaatccattttga

SEQ ID NO: 9640 - protein, 274 aa, Unknown
  Obtained from environmental sample
  misc_feature (1)..(274): Xaa is any amino acid
MWLDGATWPKNLIRKCENTLGSDEPLLNNFEATQLRNMLEQSGNSKKVITICNGILSQSGNDELFLEEMKKSLNDDKVESTNPKLKTYRDLFNLNGIFVTTNADRHIDQIFTPQNIIKKDFTASTALVNKNLYKIHGSIDDPASLIFTVEQYFTRYKDKEFIQFLRSLFNKTVLFVGYGLGEFDLLEHMYKNITLSENHYYYLGGYYRHEKRLCDFEQMYFDQMKVELIPYSKDKKGFKQLPIVIEEWVKQIQTTTNVLQNNFDEIDEVLRNPF

SEQ ID NO: 9641 - DNA, 618 bp, Unknown
  Obtained from environmental sample
  misc_feature (1)..(618): n is a, c, g, or t
atggaaactccaaataaactactttatattgatagagaagctgtagcaacacttgctatggctagagatgggttactacaacctgttactaaattaatgaataaacaagaatctgaagaggtaaataaaacaggtttttataaagactctattttccctttctcttttatcctttcacctgctggaaaaagaaacaatgctgtcctaaaaaatgccaaagaaggggatacacttactttaatatgtgaaaataaagagtgtggtacactgattgtagactcagtatttgagataaataaagatgaacgaatccaaaagatttatggtacaaataatccagaacaccctggtgtgaaagatacctataaaagattagganacttagcagtttgcggtgaatatacagtagagtttgatgatattaaaaataatattaaaaaaataaacaaaactattactaaccttgaagcaaagaatgtttcctctataattttatcaggaaaaccatttcatagagttcatgaaagacttattagaactgcattggttaaatgtgacttattaattatattcttacaaaagccatatcatgatgatggaagattaggtataaagtaa

SEQ ID NO: 9642 - protein, 205 aa, Unknown
  Obtained from environmental sample
  misc_feature (1)..(205): Xaa is any amino acid
METPNKLLYIDREAVATLAMARDGLLQPVTKLMNKQESEEVNKTGFYKDSIFPFSFILSPAGKRNNAVLKNAKEGDTLTLICENKECGTLIVDSVFEINKDERIQKIYGTNNPEHPGVKDTYKRLGXLAVCGEYTVEFDDIKNNIKKINKTITNLEAKNVSSIILSGKPFHRVHERLIRTALVKCDLLIIFLQKPYHDDGRLGIK

SEQ ID NO: 9643 - DNA, 642 bp, Unknown
  Obtained from environmental sample
  misc_feature (1)..(642): n is a, c, g, or t
ttgaaatatgagccaagtataaaagaattgtttgatttgatttttgatgaagagattgaaaaagatggaaaaaaagaaaaaaaatataaagatttagagcaatataaagaagtcattttaaaaaccattgaagaaactgaagagttaaatgcaaggatttatatccagatattagataatataattgaatggatagacaaaaaacaagaagcacagaataatattttaagatgtttaatcttagtaaatataaactttattaatagtcacataatatttaagtttgaaggttataaagatgaatatgtcgattggttattacctataaattttagtaaattagatttattacctatggggattcttttaaaattaaatgaaatgataagctcaatggattatataaaaaataaagtagaaattattgatgaattaaaatttagggcaattcataacattgataaaagggttaaaaatagtaattctgaaagagaaataattgaactaacaaacttatattcagaatttatttggatatattggaaaatggaagcaatttataattataaagaaaatatttcttctacaatattaatgaaaataaataacttcattgaaacaggtattttaatagatgaataa

SEQ ID NO: 9644 - protein, 213 aa, Unknown
  Obtained from environmental sample
  misc_feature (1)..(213): Xaa is any amino acid
MKYEPSIKELFDLIFDEEIEKDGKKEKKYKDLEQYKEVILKTIEETEELNARIYIQILDNIIEWIDKKQEAQNNILRCLILVNINFINSHIIFKFEGYKDEYVDWLLPINFSKLDLLPMGILLKLNEMISSMDYIKNKVEIIDELKFRAIHNIDKRVKNSNSEREIIELTNLYSEFIWIYWKMEAIYNYKENISSTILMKINNFIETGILIDE

SEQ ID NO: 9645 - DNA, 702 bp, Unknown
  Obtained from environmental sample
  misc_feature (1)..(702): n is a, c, g, or t
ttgaagattctcaaaggtttgaaaaattatgctcaaaatggcaaagatagttttatcaaagtaggagttatctcatatccttatatgagtaattacaacgattttgagcctttgattgctgatagtagtataaacttggagtttatagaaaataatatctcccttgataagtttgatatgataatactaccaggttcaaaattagtgataaaagaccttttatggcttaaatcaaatggattatttgaaaagataaaagagtaccaaaaaactattttagggctttgtggtggctatgagatgatgtttaacactcttgatgataaatatgcattagaaaatagtgaagcttgtatagaagagggctttggttttatcgatgatgaaatagtatttgaaaaagagaaaattttaaaaaaagctacttatgcaatctttgattgcaaaattgaaggctttgaaatacatcatggagtttcaaaaaaacattcaatatcttatgaaaaagagaacataaaaggtactttcattcacgctatttttgataatgacaatatcagaacaaaactattcaaagctgtaaatagtgagtacaaagagtttgattttaaagcatataaaaaagatacaatagataattttatttcaaatatgagaaatagacttgatgtaaataaaatattggaaaatataaatgaataa

SEQ ID NO: 9646 - protein, 233 aa, Unknown
  Obtained from environmental sample
  DOMAIN (51)...(186): CobB/CobQ-like glutamine amidotransferase domain
  misc_feature (1)..(233): Xaa is any amino acid
MKILKGLKNYAQNGKDSFIKVGVISYPYMSNYNDFEPLIADSSINLEFIENNISLDKFDMIILPGSKLVIKDLLWLKSNGLFEKIKEYQKTILGLCGGYEMMFNTLDDKYALENSEACIEEGFGFIDDEIVFEKEKILKKATYAIFDCKIEGFEIHHGVSKKHSISYEKENIKGTFIHAIFDNDNIRTKLFKAVNSEYKEFDFKAYKKDTIDNFISNMRNRLDVNKILENINE

SEQ ID NO: 9647 - DNA, 351 bp, Unknown
  Obtained from environmental sample
  misc_feature (1)..(351): n is a, c, g, or t
gtggaattttcatcatctttaacaatatttaacagcgatacaccacttttattggaaaaacgaattaagcttataggctatatagagatagaaggatctataagtaaagcagccaaaaaagtacccatgagctataaagctgcatgggatgctatcgatgccataaacaacctttgtccaacacttgttgtagaaaaatctacaggtggtgttggaggagggggagctgtcgtaactccatatggtaaaaacttaattaaaacatattcgactcttaaaaaagaacatgaaaagtttttatcacaattgacaaagatgacagattttaacacaggagccctaaatctctga

SEQ ID NO: 9648 - protein, 116 aa, Unknown
  Obtained from environmental sample
  DOMAIN (30)...(83): Bacterial regulatory helix-turn-helix protein, lysR family
  misc_feature (1)..(116): Xaa is any amino acid
MEFSSSLTIFNSDTPLLLEKRIKLIGYIEIEGSISKAAKKVPMSYKAAWDAIDAINNLCPTLVVEKSTGGVGGGGAVVTPYGKNLIKTYSTLKKEHEKFLSQLTKMTDFNTGALNL

SEQ ID NO: 9649 - DNA, 582 bp, Unknown
  Obtained from environmental sample
  misc_feature (1)..(582): n is a, c, g, or t
atggatatttctcgcgtttctataagtgcccttgaaaaattacaaaaagagaaatctactactttagctccaaaatcaataaaccatatattctctctattgggtgctatttataaccatacaataaataaaggtacttacaaaggtgttaaccctattttaaaactcaaaaaattaaggattgataacaaaagagaaagatatctaaatactgaagagataaaattactcattaatgaagtaagacataatgagttattatatattttttgtttactagcattatcaacaggtggaagagctacaacaataataaatattcaaaagaagcatatagatatatttagtagaaccattacattaaccgattttaaaaatggaacaacttacaaaggatttataactcaagagatagccaatatcttagttccaaaactagaacttttaaatgtaaatgattacatattacaaattaataataagcaaatatcaatcagtcaaatacaaaaaagaatgaagcctattttagatgatctatttaaccagggactagatgctaatgattctaaaaatagagtttaa

SEQ ID NO: 9650 - protein, 193 aa, Unknown
  Obtained from environmental sample
  misc_feature (1)..(193): Xaa is any amino acid
MDISRVSISALEKLQKEKSTTLAPKSINHIFSLLGAIYNHTINKGTYKGVNPILKLKKLRIDNKRERYLNTEEIKLLINEVRHNELLYIFCLLALSTGGRATTIINIQKKHIDIFSRTITLTDFKNGTTYKGFITQEIANILVPKLELLNVNDYILQINNKQISISQIQKRMKPILDDLFNQGLDANDSKNRV

SEQ ID NO: 9651 - DNA, 498 bp, Unknown
  Obtained from environmental sample
  misc_feature (1)..(498): n is a, c, g, or t
atgattataaaagggttaggtatgaatatagtaaaacttattattgtaagtagcttcatattatttaatatagcccttgccaaaactcaagaaaaaaagatttataatgtagtagtttctaaagattggaagccttattattctgttgattctaatggaaaagcagatggttttgcagtcaatttatttgaagcgatagcaaaagatattgggattgaatatagatacaaagtaattaacgaatggagtgagttttggaaacttcttcaacatgagcaaatagatattattccagatattggtgtgaccaataaaagaaaagattttttactattttctcaacctacaaatacctttgaaattaaaatttataaacgagtgaattcaaaacatattcaatttttaaaagatttagaaaataaaaaagtagctgtagtagggaaaaatgttggaataacattaatgaataaatatccaaatattttaataaaagaatag

SEQ ID NO: 9652 - protein, 165 aa, Unknown
  Obtained from environmental sample
  misc_feature (1)..(165): Xaa is any amino acid
MIIKGLGMNIVKLIIVSSFILFNIALAKTQEKKIYNVVVSKDWKPYYSVDSNGKADGFAVNLFEAIAKDIGIEYRYKVINEWSEFWKLLQHEQIDIIPDIGVTNKRKDFLLFSQPTNTFEIKIYKRVNSKHIQFLKDLENKKVAVVGKNVGITLMNKYPNILIKE

SEQ ID NO: 9653 - DNA, 531 bp, Unknown
  Obtained from environmental sample
  misc_feature (1)..(531): n is a, c, g, or t
atgatgagagatttagcaacttttaataaaacattagttgcaaaaggaagacctattattgaaattggtattggtattaattctggagagatgtctgttggtaatatgggatctgaacaacgttttgattatactgttatgggagatcatgttaatttaggttctagactagagggaattaataaacaatataaaacaaatattattgtaagtgagtacacatatgaaatgattaaagattcatatacttgtagattgttagattctgttagagttaaaggtaaaaaacttcctgttacaatatatgaattaattggtccaaaagtagaagacgaatttataaatctatcaaaaaaagcaataagtttatatcatgcaagagaatgggataatgcaatagctatttttaatgaattaaaatctcaaagagatgattatttatcagatatatatatagaaagatgtaatgtttataaaaataatccacctagtgaagattgggatggagcatatataatgacaacgaaataa

SEQ ID NO: 9654 - protein, 176 aa, Unknown
  Obtained from environmental sample
  misc_feature (1)..(176): Xaa is any amino acid
MMRDLATFNKTLVAKGRPIIEIGIGINSGEMSVGNMGSEQRFDYTVMGDHVNLGSRLEGINKQYKTNIIVSEYTYEMIKDSYTCRLLDSVRVKGKKLPVTIYELIGPKVEDEFINLSKKAISLYHAREWDNAIAIFNELKSQRDDYLSDIYIERCNVYKNNPPSEDWDGAYIMTTK

SEQ ID NO: 9655 - DNA, 459 bp, Unknown
  Obtained from environmental sample
  misc_feature (1)..(459): n is a, c, g, or t
atgagaaaagtaaaagaaatactgggaggaatatggaaattacacgtaattgtgtgctttattgtatttttattactcttctatccgttttatagtaactaccttagaaaaggaaaagaacgaaagtttaaaaaagcgtttaggttattatatttccacaccaaaatattattaattctgtcgggaataagagttaagctttataatggacataacatagataaaaatcaaacctatgttatagcacctaatcatacttcttttttagatattgtaattctttatcaaacatttaaaaattattttgtttttatggggaaagaagaattggctaaagttccaatcttcaatatattctttaaaaatatgaatattacggtaaatagaaaaagtagaatttctggcaaaagagcaatggacagatgtgaagaggaacttaaaaaggaaatagtgtggtag

SEQ ID NO: 9656 - protein, 152 aa, Unknown
  Obtained from environmental sample
  misc_feature (1)..(152): Xaa is any amino acid
MRKVKEILGGIWKLHVIVCFIVFLLLFYPFYSNYLRKGKERKFKKAFRLLYFHTKILLILSGIRVKLYNGHNIDKNQTYVIAPNHTSFLDIVILYQTFKNYFVFMGKEELAKVPIFNIFFKNMNITVNRKSRISGKRAMDRCEEELKKEIVW

SEQ ID NO: 9657 - DNA, 537 bp, Unknown
  Obtained from environmental sample
  misc_feature (1)..(537): n is a, c, g, or t
atgagtaagcaacatgttgacgtaataataattggaggtggtgcagctggtttttttactgctatcaatattgctgaacttcaccctcatctttctgtggctattgtagaaaaaacttcacaactactaaaaaaagtaaagatttctggtggtggaagatgtaatgttacccacgcttgttttgaccctaaagaacttagtaattattatcccagaggaggaaaagaattgttaggtgctttttatcaatttcagccacttaacactattgaatggttcagctcaaaaaatattgaactaacaacagaaagtgatggacgaatgtttcctgtttccaacacttccgaaaccatagtaaattgctttttacaccttgctaaaaaacataaaatagctattattaccgaaaccaaagtagaaaaaattctgcccttaactgatggttttgaaattcaaaccaataacggagaatttactaccaacaaagtagtggttacagctggaggttttaacaaagcagaacaatatcagttttaa

SEQ ID NO: 9658 - protein, 178 aa, Unknown
  Obtained from environmental sample
  DOMAIN (52)...(178): HI0933-like protein
  misc_feature (1)..(178): Xaa is any amino acid
MSKQHVDVIIIGGGAAGFFTAINIAELHPHLSVAIVEKTSQLLKKVKISGGGRCNVTHACFDPKELSNYYPRGGKELLGAFYQFQPLNTIEWFSSKNIELTTESDGRMFPVSNTSETIVNCFLHLAKKHKIAIITETKVEKILPLTDGFEIQTNNGEFTTNKVVVTAGGFNKAEQYQF

SEQ ID NO: 9659 - DNA, 852 bp, Unknown
  Obtained from environmental sample
  misc_feature (1)..(852): n is a, c, g, or t
atgttagaaaatatcttaaaccaatattatctaaaacatcaaaatagtaaaacagtacaatcagaacttatcgatatcgttaaaaatagtaaatatggtaaaagtggttatttttggataaataacactgatgcaaaaatggttatgcatccaattaaaccaagtcttgatggaaaagatttatctaatttaaaagaccctaatggtaaaaaattttttatagagatggttaacctttctaaaaacaactcgcaagggtttgtagattatcaatggccaaaaccaggatttgataaaccacaagataaagtttcttatatttttacatttaaaccatttaattggattataggaactggtgaataccttgataatgtaacagctcaaatgcaaaaagaagctttaaaaactatctctaaaatgagatatggtaaagatagtagtaactatttttggataaatgacactgaaccaaaaatggttatgcatcccattaagccttcattaaataataccaatatatcaagtgtaaaagatccaaatggaaaactattatttgtcgaaatggcaaaagttgctaaaacaaaagggagtgggtatattaattatcaatgggcaaagcctggttttgataaacctcaaaataaaatctcttatgtagcatattttaaagagtgggattgggtagtaggaactggtgtttatatagatgatattgaaacagaagttataaacatggaaaatcaagcttcggaaaatgtagcaactattgttatatcatttattgttcttacactattactattagctatttcattggctcttctctattttgctattataaaagtgtaa

SEQ ID NO: 9660 - protein, 283 aa, Unknown
  Obtained from environmental sample
  misc_feature (1)..(283): Xaa is any amino acid
MLENILNQYYLKHQNSKTVQSELIDIVKNSKYGKSGYFWINNTDAKMVMHPIKPSLDGKDLSNLKDPNGKKFFIEMVNLSKNNSQGFVDYQWPKPGFDKPQDKVSYIFTFKPFNWIIGTGEYLDNVTAQMQKEALKTISKMRYGKDSSNYFWINDTEPKMVMHPIKPSLNNTNISSVKDPNGKLLFVEMAKVAKTKGSGYINYQWAKPGFDKPQNKISYVAYFKEWDWVVGTGVYIDDIETEVINMENQASENVATIVISFIVLTLLLLAISLALLYFAIIKV

SEQ ID NO: 9661 - DNA, 774 bp, Unknown
  Obtained from environmental sample
  misc_feature (1)..(774): n is a, c, g, or t
atgctcgtgggatctatctcccgacctttgattaaaaccattgtaaaagtagtagcccctgaaattggagatacaatctatgatggagcagtcggctctgctggcttcctagtggaagcttttgagtatctaaagaccgtaaagacgcattgccatgcgtctcattgccatgtgtctctctctgatgatgccgtacagacacattgcaatgtgtctctttccacagacgacatcatcaccctccaaaaaaacaccttctacggaaaagagaagaaatctctcgcttacatcattggtataatgaatatgatcttgcatggcattgaagcacccaacattatccataccaatactttggcagagaatttaagcgatatccaagaaaaagaccgctatagtgtgatcttagctaatccaccttttggtgggaaagaacgtgccgaagtacagcagaacttccctatcaaaaccggtgaaaccgcttctctctttctacaacatttcattaagatcttaaaggctgatggtaaagctggtgttgttataaaaaatacttttttgagtaataccgataatgcttcaattgctctgcgcaaagagcttttatccaattgtaacttgcatacagttctggatctaccgggtggaacatttaccggtgccggagttaaaaccgtggtactcttctttgaaaaaggaagctctacaaaaaagacttggttctatcaattaaaccttaaacgtaatttgggtaaaaccaatccctctcaatga

SEQ ID NO: 9662 - protein, 257 aa, Unknown
  Obtained from environmental sample
  DOMAIN (143)...(254): N-6 DNA Methylase
  misc_feature (1)..(257): Xaa is any amino acid
MLVGSISRPLIKTIVKVVAPEIGDTIYDGAVGSAGFLVEAFEYLKTVKTHCHASHCHVSLSDDAVQTHCNVSLSTDDIITLQKNTFYGKEKKSLAYIIGIMNMILHGIEAPNIIHTNTLAENLSDIQEKDRYSVILANPPFGGKERAEVQQNFPIKTGETASLFLQHFIKILKADGKAGVVIKNTFLSNTDNASIALRKELLSNCNLHTVLDLPGGTFTGAGVKTVVLFFEKGSSTKKTWFYQLNLKRNLGKTNPSQ

SEQ ID NO: 9663 - DNA, 522 bp, Unknown
  Obtained from environmental sample
  misc_feature (1)..(522): n is a, c, g, or t
atgcacttcatagatgttgagagcactaaagagatgcatgagtacataacagactcaatcagaattgccaaaaaaggtgttattacaaaggctacattaatcggggatgcacatattgaacatataaaaaaagaaccttatcttttcatggttgcagctgttagtgattatgtgccaaaatttactcaaataggtaaactgaaaaaaaatcttttaggagagagttatttacttgagatgaaacaaaatattgatatattaagttcattagataaaaccggtattaaaacagtagcatttaaagcagagatggatgagataaatgcacacaaaaatgctctttcacttttagaaaaaaaaggtgctgatgcagtatgtttgaacattttaaaagattcaagcagctttggaagcgaagacaatgagatagagtttatctcaaaaaactcatcaaaaaaacttcctaaagaggacaaactctcactatcatttaaaatagtagatagttcaaaggctctttaa

SEQ ID NO: 9664 - protein, 173 aa, Unknown
  Obtained from environmental sample
  DOMAIN (10)...(159): DNA / pantothenate metabolism flavoprotein
  misc_feature (1)..(173): Xaa is any amino acid
MHFIDVESTKEMHEYITDSIRIAKKGVITKATLIGDAHIEHIKKEPYLFMVAAVSDYVPKFTQIGKLKKNLLGESYLLEMKQNIDILSSLDKTGIKTVAFKAEMDEINAHKNALSLLEKKGADAVCLNILKDSSSFGSEDNEIEFISKNSSKKLPKEDKLSLSFKIVDSSKAL

SEQ ID NO: 9665 - DNA, 918 bp, Unknown
  Obtained from environmental sample
  misc_feature (1)..(918): n is a, c, g, or t
gtgatggctggctacacagttgggtttgagttgatagataaagaaggttatcaatttgaagattcaacatttttggttattggaaccggaaatatggcgaaccttattaatactgtgttggacagaacacctataaaaaaattgtatgtagccagtcatgattttgatagagcaaaagaaatggctacagaatggaatggtgaagctgtacagatgagtaatatgcatgcagctctttcggaagcgaacatagttataggaggaactcaaggagaaattaatttgcttcatgaagaaaccatggcagaaagtaaatgtcctagagctaattttgcacttcaaacgggagattgtaaattgtttttagactttggtgttccaagaaattttaaccctagcttaaaaaaccatgataatattaagttatttgatttagatgatataaagaaaattacttatgacggtttattaaaacgttatgatgaaattccattagccagaaccattgtaaataaagaagtagaatggttttctatttggttaaagaatagaaaagtagctccggttattgaagcttattggaataatttagatgaaattagaaatgaagaactgaagtggttattacctaaattggggaatgtagatgaacacaccgaaattattcttaaaagatttacacatcgtttacttagaaaaatttcaaacccttccattgaagcaattaaagaaatggctcanaatcttcatgaaaaagataacccaataaatactgccaaaaatatattagcagttaatgacgtttctatcttcgttccaaataaaaaaattattgtaggaacaagaggaagtaagttagctttgactcaaactaactgggtggttgagcaattgaaaaaaattggaccccgntatgaa

SEQ ID NO: 9666 - protein, 306 aa, Unknown
  Obtained from environmental sample
  DOMAIN (164)...(266): Glutamyl-tRNAGlu reductase, dimerisation domain
  misc_feature (1)..(306): Xaa is any amino acid
MMAGYTVGFELIDKEGYQFEDSTFLVIGTGNMANLINTVLDRTPIKKLYVASHDFDRAKEMATEWNGEAVQMSNMHAALSEANIVIGGTQGEINLLHEETMAESKCPRANFALQTGDCKLFLDFGVPRNFNPSLKNHDNIKLFDLDDIKKITYDGLLKRYDEIPLARTIVNKEVEWFSIWLKNRKVAPVIEAYWNNLDEIRNEELKWLLPKLGNVDEHTEIILKRFTHRLLRKISNPSIEAIKEMAXNLHEKDNPINTAKNILAVNDVSIFVPNKKIIVGTRGSKLALTQTNWVVEQLKKIGPRYE

SEQ ID NO: 9667 - DNA, 462 bp, Unknown
  Obtained from environmental sample
  misc_feature (1)..(462): n is a, c, g, or t
gtggaaaaaaaaactgccgattgcatagaagataatggattggaaattgactttataccatcagattttactgctgaaactttaggaaacgaaattcctgtattgcctaacgaaaaagtatttattcctcattcagaattgtcaaataatagcttagaggaacaacttaaaattaaaaatgcgttggttgaaacgttagtaatttacgataatcaaataattagttataccactgatgaattaagtaaagtacttaataaacctatagattttattacatttacgagtggctcgtgtgttaaagcatatatcaataataagatacatttgccaaacgcaaaaataatttgtattggaccatctactgctaaagtagctagagaaaataacttagaagttgctgccatccctaatgaatacacagttgaaggaatggtagaggaaataaagaaattaagttaa

SEQ ID NO: 9668 - protein, 153 aa, Unknown
  Obtained from environmental sample
  misc_feature (1)..(153): Xaa is any amino acid
MEKKTADCIEDNGLEIDFIPSDFTAETLGNEIPVLPNEKVFIPHSELSNNSLEEQLKIKNALVETLVIYDNQIISYTTDELSKVLNKPIDFITFTSGSCVKAYINNKIHLPNAKIICIGPSTAKVARENNLEVAAIPNEYTVEGMVEEIKKLS

SEQ ID NO: 9669 - DNA, 894 bp, Unknown
  Obtained from environmental sample
  misc_feature (1)..(894): n is a, c, g, or t
atgaagagaaatgggaatagttatttgcatggattagatatctatgaaacagagagggaaagaatctatccttatgaagataccctcacccctgtacttggatatataaaagagcaaaactcaaagcagggaaaacaaagagttagaggtttaaatgggatagaaagagagtttgataagcagctcaataattttcaagatggattactagagggggagaaagatatcctttcttatataatatttaacaaagactcaaaaattatcaaaagaaaagatggggataacatacaaattaccattccattaaaattacaaaaaaatattgagttgatgttagatagatataaaaaggagtttgaagctcaagagatactggtatctgttatggatagcactaccggaaaagttttatcactagctagttcaaatcgatataatccttctcatataaaacaaaatgagatagaacatctaaaaataaatgcaattgaatataattttgaaccaggttcagttataaagccattatctatatccttagcaattgatgcaaataaaataaaaaaagatgaactcttttttgcccataatgttggaaaaaagaataaaaaaggggagttcccaaagggaaaatataaaattgggagatatattattaaagatgatcataggtttgaaaaaaactatttaaccctagaagatattattatctactctagtaacataggaacccttactattgcaaatagattaagtgcggaacagttttataatggctatttaaattttggactatctcagaaaacagggatagacctaccttttgaatctaaggggattattcataaactctaccaatatcgagcagggaagacaagggagcgagcataa

SEQ ID NO: 9670 - protein, 297 aa, Unknown
  Obtained from environmental sample
  DOMAIN (125)...(296): Penicillin binding protein transpeptidase domain
  misc_feature (1)..(297): Xaa is any amino acid
MKRNGNSYLHGLDIYETERERIYPYEDTLTPVLGYIKEQNSKQGKQRVRGLNGIEREFDKQLNNFQDGLLEGEKDILSYIIFNKDSKIIKRKDGDNIQITIPLKLQKNIELMLDRYKKEFEAQEILVSVMDSTTGKVLSLASSNRYNPSHIKQNEIEHLKINAIEYNFEPGSVIKPLSISLAIDANKIKKDELFFAHNVGKKNKKGEFPKGKYKIGRYIIKDDHRFEKNYLTLEDIIIYSSNIGTLTIANRLSAEQFYNGYLNFGLSQKTGIDLPFESKGIIHKLYQYRAGKTRERA

SEQ ID NO: 9671 - DNA, 348 bp, Unknown
  Obtained from environmental sample
  misc_feature (1)..(348): n is a, c, g, or t
atggatactaaaactactaacactaccaataagggaaaatattttgaaactaaggctgttgatttcttgcagtcaaatggttttaaaataatagagcaaaactatcatgcaaaaaaactaggtgagatagatattattgcacaaaaagatagtgtatatcattttgtagaggtgaaaagtggagaaagttttgaagctgtttacaacataacacctcaaaagctttataaactttatagggcaatagattattatcttaaagagaaaaaactagatgttgcctactgtatagatgcgataatatttgccaaagaagaattagaatatttggagaatattactctttag

SEQ ID NO: 9672 - protein, 115 aa, Unknown
  Obtained from environmental sample
  DOMAIN (14)...(103): Uncharacterised protein family UPF0102
  misc_feature (1)..(115): Xaa is any amino acid
MDTKTTNTTNKGKYFETKAVDFLQSNGFKIIEQNYHAKKLGEIDIIAQKDSVYHFVEVKSGESFEAVYNITPQKLYKLYRAIDYYLKEKKLDVAYCIDAIIFAKEELEYLENITL

SEQ ID NO: 9673 - DNA, 441 bp, Unknown
  Obtained from environmental sample
  misc_feature (1)..(441): n is a, c, g, or t
ttgcgcttgatggcccnagaacatcatgggtatattcacagcttcggaaataattttgtaaaaacaatgattaaacttggagatgaaaaaaatgaacttggtgtggtctacgatcaaattggaactccaacatatgcttatgatttagctaaaataattttagatataataccaagcataaacaatcaaaaagtagaaatatacaatttttcaaatgaaggagttgttagttggtatgactttgcaaaagagattatgaaaatggcaaaaattaattgcgagataaatccaattgaaacatttcaatatccaacaccagctattagaccacattattcagtattgaataaaagtaaaataaaacaaaaatttaacatagaaattccatattggaaagatagtttagataaatgcttacgaattttaggagaaagaagataa

SEQ ID NO: 9674 - protein, 146 aa, Unknown
  Obtained from environmental sample
  DOMAIN (14)...(135): RmlD substrate binding domain
  misc_feature (1)..(146): Xaa is any amino acid
MRLMAXEHHGYIHSFGNNFVKTMIKLGDEKNELGVVYDQIGTPTYAYDLAKIILDIIPSINNQKVEIYNFSNEGVVSWYDFAKEIMKMAKINCEINPIETFQYPTPAIRPHYSVLNKSKIKQKFNIEIPYWKDSLDKCLRILGERR

SEQ ID NO: 9675 - DNA, 504 bp, Unknown
  Obtained from environmental sample
  misc_feature (1)..(504): n is a, c, g, or t
atggttaataatagtaataagacaatattagtaacaggatgtgctggctttattggaagtaattttgtaccgtattttttagaaaaatataataattataatattgtaaatattgatttacttacatatgcaggtaatttagaaaatctaaaagagtgtgataataataaaagatataaatttataaaaggtgatatttgtaatagagaacttatagagtttatttttgatgaatatgatatacaaggtgttattcactttgcagcggaatcacatgtagataactctattaaaaacccaggagtatttgtgcaaacaaatgtaaatggtacttttactcttcttgatgtagcatataaatattggatggacaaaccatttaaatttaagaaaaatatcanaattgtagatttcatcatatatctacagatgaagtgtatggaactcttaatgaaaccgacctatttacagaaactacaccttaggcctcaaatttcaccttat

SEQ ID NO: 9676 - protein, 168 aa, Unknown
  Obtained from environmental sample
  DOMAIN (9)...(167): NAD dependent epimerase/dehydratase family
  misc_feature (1)..(168): Xaa is any amino acid
MVNNSNKTILVTGCAGFIGSNFVPYFLEKYNNYNIVNIDLLTYAGNLENLKECDNNKRYKFIKGDICNRELIEFIFDEYDIQGVIHFAAESHVDNSIKNPGVFVQTNVNGTFTLLDVAYKYWMDKPFKFKKNIXIVDFIIYLQMKCMELLMKPTYLQKLHLRPQISPY

SEQ ID NO: 9677 - DNA, 651 bp, Unknown
  Obtained from environmental sample
  misc_feature (1)..(651): n is a, c, g, or t
atgaagtatagtaaaataataaaaggtaattgtatgaatatttcagatgagactatagaaaaaataagaaaagtcagttgtcaaacagacaatacattttttcaagcggttgaagaggtactagagagtttacaaccagttttagaaagtgatccaatatataaaagacattctatattagatagattaacaactccagatagagaatttaagtttaaagtagtttggatggatgataatcaaaatattcaagtaaatacaggatatagagtacagtttaataatgctttaggaccatataaaggtggtttgagatttcatcctagtgtaaatagcggtatcttaaaatttttaggttttgaacaaatatttaaaaactcacttacaggtcttccaataggtggagctaagggtggaagtgactttgatccaaaaggaaaatctgattttgaagtgatgaagttttgtagtgcatttatgacagaacttcataaacatataggttctagaattgatgtaccagctggagatattggagtaggtgcaagggaaattggatatctttttggtgagtataaaaaaatcactttctctttatggaaggggtatttaactgggaaagccattttatgtttggggggaaagttttga

SEQ ID NO: 9678 - protein, 216 aa, Unknown
  Obtained from environmental sample
  DOMAIN (66)...(196): Glu/Leu/Phe/Val dehydrogenase, dimerisation domain
  misc_feature (1)..(216): Xaa is any amino acid
MKYSKIIKGNCMNISDETIEKIRKVSCQTDNTFFQAVEEVLESLQPVLESDPIYKRHSILDRLTTPDREFKFKVVWMDDNQNIQVNTGYRVQFNNALGPYKGGLRFHPSVNSGILKFLGFEQIFKNSLTGLPIGGAKGGSDFDPKGKSDFEVMKFCSAFMTELHKHIGSRIDVPAGDIGVGAREIGYLFGEYKKITFSLWKGYLTGKAILCLGGKF

SEQ ID NO: 9679 - DNA, 687 bp, Unknown
  Obtained from environmental sample
  misc_feature (1)..(687): n is a, c, g, or t
atggctgagtatcataaaggaactggtactatgaaaatacttttactcgaagatgatgtaattctaaatgaaattattgaagagtttttattaacgttaaattatgaagtagtaagcactcatgatggagaaatagctgaagaattaatttatgaagagttatatgatttattaatctttgatgtaaatgtaccttcattaaatggatttgctttattagagaaattaagaaacaataatattaatatacctacaatatttattacatctttaaatactattgaagatctacaaactggatttaaagtaggttgtgatgattatattaaaaaaccttttgaactcgctgagttaaattttgtaattgaaaatatgatgaaatcatcaatcactttgtcaaataatattattaagttatctaatactatatatttagataagaaaaatatgctcattaaaaaagataaaaaagtgttccctttacccaaaaaagagtatgaaatattattatatttaatcaaaaagaaagatatagttaacattaaagatttacattctaatatctggaaaaatgaaaagtatccaggtgattctacaattagaacatatataaagaatttaagaaaaattcttggaaaagaatatattcttaataaaagaggatatggctataaatttaacaactag

SEQ ID NO: 9680 - protein, 228 aa, Unknown
  Obtained from environmental sample
  DOMAIN (155)...(226): Transcriptional regulatory protein, C terminal
  misc_feature (1)..(228): Xaa is any amino acid
MAEYHKGTGTMKILLLEDDVILNEIIEEFLLTLNYEVVSTHDGEIAEELIYEELYDLLIFDVNVPSLNGFALLEKLRNNNINIPTIFITSLNTIEDLQTGFKVGCDDYIKKPFELAELNFVIENMMKSSITLSNNIIKLSNTIYLDKKNMLIKKDKKVFPLPKKEYEILLYLIKKKDIVNIKDLHSNIWKNEKYPGDSTIRTYIKNLRKILGKEYILNKRGYGYKFNN

SEQ ID NO: 9681 - DNA, 552 bp, Unknown
  Obtained from environmental sample
  misc_feature (1)..(552): n is a, c, g, or t
atgtcctcagaatctgaagtattaacaattaaacaaatagaaagaattagattaagtgcaaaaagaatttctgaaatttataaagacttaacatatacttttcttgaaaataatataaataatacaataatagaagaattagaccttaaaaacgaaataaatgaacaattggaatattttgaaccattagcattaaagaaaaagattttaattaaatgtgatatagaaagcttcaagtttactataaataaagatgactttataagagtttttaataatttgatttcaaatgcaattaaatataataaagtgggaggagaaatacatataattctcaaagaaaaaaatttagtagtcagtgacacaggaataggaattagtaacgaaaaaataaataatatatttgaaagatattacagagcaacatctgaacaaggtggttttgggataggtttaaatatagtaaatagaatttgtagaaaatataatataaatattactgttgattctaaaataaaaaatggcacaagttttactttatattttaaataa

SEQ ID NO: 9682 - protein, 183 aa, Unknown
  Obtained from environmental sample
  DOMAIN (82)...(183): Histidine kinase-, DNA gyrase B-, and HSP90-like ATPase
  misc_feature (1)..(183): Xaa is any amino acid
MSSESEVLTIKQIERIRLSAKRISEIYKDLTYTFLENNINNTIIEELDLKNEINEQLEYFEPLALKKKILIKCDIESFKFTINKDDFIRVFNNLISNAIKYNKVGGEIHIILKEKNLVVSDTGIGISNEKINNIFERYYRATSEQGGFGIGLNIVNRICRKYNINITVDSKIKNGTSFTLYFK

SEQ ID NO: 9683 - DNA, 324 bp, Unknown
  Obtained from environmental sample
  misc_feature (1)..(324): n is a, c, g, or t
gtgaagaagagggtggtaatgatgaatcagtttaagacacaggatggttcagagactcgcgtcgttgaccaggacgatatccttgaacaggttatttccgcaaccaaacaaaccagtgcagatgatacccgtgacctgatccgtaatctggtagacgaagtccaggaaggcacagtggtgtgggatcgcaatattgccaagaccattaaccgtgctatagctcagattgacagtaagatctcgtcgcaactggcggagatcatgcacgcagacgaattcaaaaaattggaaggttcgtggcgtggcctctctcagccaatctga

SEQ ID NO: 9684 - protein, 107 aa, Unknown
  Obtained from environmental sample
  misc_feature (1)..(107): Xaa is any amino acid
MKKRVVMMNQFKTQDGSETRVVDQDDILEQVISATKQTSADDTRDLIRNLVDEVQEGTVVWDRNIAKTINRAIAQIDSKISSQLAEIMHADEFKKLEGSWRGLSQPI

SEQ ID NO: 9685 - DNA, 480 bp, Unknown
  Obtained from environmental sample
  misc_feature (1)..(480): n is a, c, g, or t
atgctacaaaatgaaatagatagttttttacatttgattgaaggttctacgaaaaatcataatataaaagtaattttagattttcaaaaagatattctcattactggatatgaacatgctttaacgcaatcttttataaatatattcaacaattccaaagatgcttttcaagaaaaaaagattcaagataaatatattttcatatcaacatcagtaaaaaataataatgctattatcacaataaaagataacggtggcggtatcccattagatgtattaccaaaaatatttgaaccatattttactacaaaacatcaaggtcaaggtacgggacttgggcttcatatgacatataaactcatagttgaaggtatggatggaacaattaaagctactaatgtgaagtatagatacaataaaaccaactatactggttctgaatttcttataacattacctcttgcaacaaataataattga

SEQ ID NO: 9686 - protein, 159 aa, Unknown
  Obtained from environmental sample
  DOMAIN (36)...(155): Histidine kinase-, DNA gyrase B-, and HSP90-like ATPase
  misc_feature (1)..(159): Xaa is any amino acid
MLQNEIDSFLHLIEGSTKNHNIKVILDFQKDILITGYEHALTQSFINIFNNSKDAFQEKKIQDKYIFISTSVKNNNAIITIKDNGGGIPLDVLPKIFEPYFTTKHQGQGTGLGLHMTYKLIVEGMDGTIKATNVKYRYNKTNYTGSEFLITLPLATNNN

SEQ ID NO: 9687 - DNA, 750 bp, Unknown
  Obtained from environmental sample
  misc_feature (1)..(750): n is a, c, g, or t
ttggagccccttatgaaaaaacaatttatcttttattattttttcataataattttattatttatttttttaaatgtattttcaaattcaaaagttgaaaaattaatggatgaaaaataccttaacattgcaactcaaatacaacaagaaactcaaacattacttgaacaaaaacaagaaacaactcttatacttgctttagcattatcaaaagatacccttgtacaaaatgctttaataaaaaatgattacactttgctctcacttgaggatatctcaaaaatgtatgcaactgattcctctttaaaatatgtgtggttacatattatcaaaagtgatggtattagttttataaaaagttggtcaaagcaaaaaggtgaaagtgttttaggttttagaaaagatgttgtcaagtttttaaaaaaaccaaaaatcacacaaactataagtgtaggcaaatttgacataactataaaagcccaagtaccaatttataaagataaacaattcttaggaatttttgaggtcattacaaaattaaattctatagcaaataaattagaaaaagaaaactcaatccctattatcctagcagataaatcatataanaagcaattaaaatttccttttacaaaaatgtttattgaagactattatgttgcaaatatagatgctgataaaaaaatattagaattattaaaaaagcacatattgaagaattataaaaacacgaaaattatcgatttatag

SEQ ID NO: 9688 - protein, 249 aa, Unknown
  Obtained from environmental sample
  misc_feature (1)..(249): Xaa is any amino acid
MEPLMKKQFIFYYFFIIILLFIFLNVFSNSKVEKLMDEKYLNIATQIQQETQTLLEQKQETTLILALALSKDTLVQNALIKNDYTLLSLEDISKMYATDSSLKYVWLHIIKSDGISFIKSWSKQKGESVLGFRKDVVKFLKKPKITQTISVGKFDITIKAQVPIYKDKQFLGIFEVITKLNSIANKLEKENSIPIILADKSYXKQLKFPFTKMFIEDYYVANIDADKKILELLKKHILKNYKNTKIIDL

SEQ ID NO: 9689 - DNA, 831 bp, Unknown
  Obtained from environmental sample
  misc_feature (1)..(831): n is a, c, g, or t
ttgttattagattacaaaaaagatgtagagcattttggagagacaggaaaactaatttacaatacgcatcaagcacaattagaattagacaatattaacttactctatgttgtactaactagagctgtggagcaattgtacattatttcgaaaaaagatattagctcaaaaggtgaagtaaataataacacctattctgggaagtttattaactttttaattaaggaaaataaatggaatgacaaccaactgagttatagttacggtacaaaaacaccaaataaaaattcagaagaacaagagactacaccaagtgctctaaagctaatatcagttcctaaagaagaccataatttaaaaattgttaccaaatctggcttactttgggacacacatcaagaagcggcaatagaacgtggtaatctagttcatttaatgttatctaaaatcaagacctttgaagacttagactttgcctttaatgatttattaatttctggagacattactaccgaaaacagtacaattttaaaggacttagctttacaagttataaagcaccctaaattagagggttattttaaagacgattatacgatatataatgaacgtgatatcattacgagttctggtcaacttataagaccagaccgactaaatattaattcaaaaaatgaagctattattatagattacaaaactggtgaagccaaagagtcttatgcaaatcagcttaacaattatgaagttattttaaatcagatgaatttaaccgtgatgcataaattattggtttatataaatgacacaattgaagttattgaagtctga

SEQ ID NO: 9690 - protein, 276 aa, Unknown
  Obtained from environmental sample
  misc_feature (1)..(276): Xaa is any amino acid
MLLDYKKDVEHFGETGKLIYNTHQAQLELDNINLLYVVLTRAVEQLYIISKKDISSKGEVNNNTYSGKFINFLIKENKWNDNQLSYSYGTKTPNKNSEEQETTPSALKLISVPKEDHNLKIVTKSGLLWDTHQEAAIERGNLVHLMLSKIKTFEDLDFAFNDLLISGDITTENSTILKDLALQVIKHPKLEGYFKDDYTIYNERDIITSSGQLIRPDRLNINSKNEAIIIDYKTGEAKESYANQLNNYEVILNQMNLTVMHKLLVYINDTIEVIEV

SEQ ID NO: 9691 - DNA, 411 bp, Unknown
  Obtained from environmental sample
  misc_feature (1)..(411): n is a, c, g, or t
gtgattgacgatgatacgacctcatactttagtggtcgctcaggtgatacacttagaaaaatgatagagaatgttttagagttaaatatttcagatgtctatataactcatggtgttaagtgtaaatcattgggtagtaatagaccctctgagtctgaattaagcagttgtaaaccatatctgctaaaacagatagagcttgtaaatcctaaagttatcgtcgctttaggagaagaggcttataaaatgttaagtgatgatgatatagattttgaacaagttcgcggacataaaatcaatttcaattcatcattgatagtaccaatttatcatccaaattttttgcttagaaatccatcacttaagaagatggcactctatgacttacaaaatataaagagagttttatga

SEQ ID NO: 9692 - protein, 136 aa, Unknown
  Obtained from environmental sample
  DOMAIN (1)...(134): Uracil DNA glycosylase superfamily
  misc_feature (1)..(136): Xaa is any amino acid
MIDDDTTSYFSGRSGDTLRKMIENVLELNISDVYITHGVKCKSLGSNRPSESELSSCKPYLLKQIELVNPKVIVALGEEAYKMLSDDDIDFEQVRGHKINFNSSLIVPIYHPNFLLRNPSLKKMALYDLQNIKRVL

SEQ ID NO: 9693 - DNA, 345 bp, Unknown
  Obtained from environmental sample
  misc_feature (1)..(345): n is a, c, g, or t
ttgagtgtcaacctcttctggtatactcccccaatttgtcaagacaacattttcaaaaatccaatttacagacaatctggtacttctattcagtctggttatagaattgctaagtctgggtcaagtctttatcgtagcgtactttttatgtcagttttcactgcagttcagcatgatgaaaattttaaatctttttatgagcgactgaaatcaaaaggaaaacatacaactttagttcaaattgctgtgatgagaaaaataatattaactgctcattctctttataaaaataacaaaaaatatgatgaaaatttcaactctcaagaagcttcaaatatggaatag

SEQ ID NO: 9694 - protein, 114 aa, Unknown
  Obtained from environmental sample
  misc_feature (1)..(114): Xaa is any amino acid
MSVNLFWYTPPICQDNIFKNPIYRQSGTSIQSGYRIAKSGSSLYRSVLFMSVFTAVQHDENFKSFYERLKSKGKHTTLVQIAVMRKIILTAHSLYKNNKKYDENFNSQEASNME

SEQ ID NO: 9695 - DNA, 768 bp, Unknown
  Obtained from environmental sample
  misc_feature (1)..(768): n is a, c, g, or t
atgggtgatattgtaggtgatagtttagaattagctaaaaaatctatggaggcacctacggaaaacattatcttttgtggcgtaggatttatggggcaaagtgtgaaagtattagcacctcaaaaaagagtacttatgcctaaaatcgcatgctgtgctatggcgaagatgattgatgtagattattacaatatgaatttaaaaatattaaatgatgcaggaatagcaaatgatgatattttaccaataacatatattaactctagtgctgaagtaaaagctgaagttggaaaaatgggtggatatgtttgtacaagttcaaatgcctataaaattatcaacaaaggattagaaagtggcaaaaaaatattctttgttccagatagatgtttagggcaaaactttgcaaaacagattggattaaaatcagcagttgtaggaattgatgatattgaagatgtaaaaaatgcggatatcatttgttttaatggtttttgctcagttcatcaactttttacccctgaagatgtagatttttatagagaaaaatatccagatattttagtagctgttcatccagaatgtgatccatcagttgttgaaaaagctgactttgtggggagtacttctcaacttataaaatatataactgaagagattcctgttgatcaaaaagttgtggtaggaactgagtttaatatggttaatcgtttaagaagaaaaaatactttcctattaagttctacaaaccagagtgtcccactatga

SEQ ID NO: 9696 - protein, 255 aa, Unknown
  Obtained from environmental sample
  DOMAIN (2)...(253): Quinolinate synthetase A protein
  misc_feature (1)..(255): Xaa is any amino acid
MGDIVGDSLELAKKSMEAPTENIIFCGVGFMGQSVKVLAPQKRVLMPKIACCAMAKMIDVDYYNMNLKILNDAGIANDDILPITYINSSAEVKAEVGKMGGYVCTSSNAYKIINKGLESGKKIFFVPDRCLGQNFAKQIGLKSAVVGIDDIEDVKNADIICFNGFCSVHQLFTPEDVDFYREKYPDILVAVHPECDPSVVEKADFVGSTSQLIKYITEEIPVDQKVVVGTEFNMVNRLRRKNTFLLSSTNQSVPL

SEQ ID NO: 9697 - DNA, 624 bp, Unknown
  Obtained from environmental sample
  misc_feature (1)..(624): n is a, c, g, or t
atgaaaccagatgctataattataagacatagtgagtgtggtttaccaaatagtttaaaaagttatgtagattgtccaatccttaatgccggggatggtaaaaatgcacatcctactcaagctctcttagacctctttacaataatggaacattttaattatgatgtaaaagataaaaatatagcaatagtgggtgatgtatttaattcacgagttgcatcttcaaatcttgaattattacctagatttggtttaaaaccaattcttgtaacacctaaagagtttagagtagtatcacaatacaaaacagtaaaaaatattaataaagtgatagataaacttgatatcataatgagtttacgagtgcagcatgaaagacacacttttactctctctgataatgaattagaggagaatacaaaaaaatatagcaaaaaatattgtatcacaaaaaaaatgatgggtagtagagatatcttacttatgcatccaggaccagtgaataggaatatcgatataagtgatgagatgttagaagatcctcgttcaaaagttctagaacaagtgagaaatggtgtagcagtaagaatggcttgtttaaaaaaactaatactaaatcaataa

SEQ ID NO: 9698 - protein, 207 aa, Unknown
  Obtained from environmental sample
  DOMAIN (56)...(204): Aspartate/ornithine carbamoyltransferase, Asp/Orn binding domain
  misc_feature (1)..(207): Xaa is any amino acid
MKPDAIIIRHSECGLPNSLKSYVDCPILNAGDGKNAHPTQALLDLFTIMEHFNYDVKDKNIAIVGDVFNSRVASSNLELLPRFGLKPILVTPKEFRVVSQYKTVKNINKVIDKLDIIMSLRVQHERHTFTLSDNELEENTKKYSKKYCITKKMMGSRDILLMHPGPVNRNIDISDEMLEDPRSKVLEQVRNGVAVRMACLKKLILNQ

SEQ ID NO: 9699 - DNA, 852 bp, Unknown
  Obtained from environmental sample
  misc_feature (1)..(852): n is a, c, g, or t
atgattgttctatgtggaacaatcattaaatttaaaattaaggaaataatcatgggaaataatgacaatgacgaacacaaaacaagactaaataagtttatatcacacaatagtagattcagtagaagagaagctgatgaactaattaaaactggaaaagtttcaattgatggaaaagttattagtgacttatctacaaaagtaaatgataaaactattgtaaaagttaatggaagaactgtaaaagttgattataaaagagcatcaactgtaatagtttataataaactaaaaggtgaaatagtatcaaaaaaagaccctcaaggtcgtaaaataatctatgatacaattccaaaaaaattcaatcattttataccagtagggcgacttgactttgctagtgaggggatgcttttacttacagatgatccaaaaatagcaacatctctcatgaactcaaatcttgagagagtttataaacttaaaattgaaggtgaagtaacagcttcaatgattagtgcaatggaaaatggtataactcttgatgatgcaacagctggtgcttgggataaaacaaaaacaattagtatggagttttcaaaatttttaggatatcaggtacaaacgaatacacctaaattctcaaaactaaaagttgcaatatctgaggggaaaaatagagagcttagaagattctttgcacactttggatcaaaagtagtagatttaaaaacgggtagttttggtggaataaatctaaataatctcccttccaggaaagttagatatcttgaaagtgatgaatatgaaaaccttacaaccctttatgaaagaaccaacaaaactaaataa

SEQ ID NO: 9700 - protein, 283 aa, Unknown
  Obtained from environmental sample
  DOMAIN (90)...(235): RNA pseudouridylate synthase
  misc_feature (1)..(283): Xaa is any amino acid
MIVLCGTIIKFKIKEIIMGNNDNDEHKTRLNKFISHNSRFSRREADELIKTGKVSIDGKVISDLSTKVNDKTIVKVNGRTVKVDYKRASTVIVYNKLKGEIVSKKDPQGRKIIYDTIPKKFNHFIPVGRLDFASEGMLLLTDDPKIATSLMNSNLERVYKLKIEGEVTASMISAMENGITLDDATAGAWDKTKTISMEFSKFLGYQVQTNTPKFSKLKVAISEGKNRELRRFFAHFGSKVVDLKTGSFGGINLNNLPSRKVRYLESDEYENLTTLYERTNKTK

SEQ ID NO: 9701 - DNA, 459 bp, Unknown
  Obtained from environmental sample
  misc_feature (1)..(459): n is a, c, g, or t
ttgcatggacataggaaagatgaagttttatctttgcaatggaaagataagggtaaaacaatgattgattttgataatatggtatataaaataccatatataaaaaataagataaaaaaaaataagatacacccaattactcaagagctgtatgagatattgataaatatagatgatagaactgattatgtttttaaaaatccaaaaacaggtactcgttttcatgatgtacgaaaagtatggaatagaataaaaattaaggctaatataaataaaccttttagaatccatgatataagacatttgataggatatacaactttgaatgagctaggattatcttctaatatcgggagtagtataattggaaatagtcctaaagtttttgaagatagatatagtggtattaaagttgagactgttagaaaaactagtgaatttaatgttggaacattttaa

SEQ ID NO: 9702 - protein, 152 aa, Unknown
  Obtained from environmental sample
  misc_feature (1)..(152): Xaa is any amino acid
MHGHRKDEVLSLQWKDKGKTMIDFDNMVYKIPYIKNKIKKNKIHPITQELYEILINIDDRTDYVFKNPKTGTRFHDVRKVWNRIKIKANINKPFRIHDIRHLIGYTTLNELGLSSNIGSSIIGNSPKVFEDRYSGIKVETVRKTSEFNVGTF

SEQ ID NO: 9703 - DNA, 768 bp, Unknown
  Obtained from environmental sample
  misc_feature (1)..(768): n is a, c, g, or t
gtggaaccatcatgtgatgcggaaacaaaggcgtggacctttattcagtgttttcaaggccaaaccgaaagtcctgttagcttgtggttctggcgaaacttggtttctcatgttgtcgagactatcagtgctttcgtccgtataaattatattagagtttctagggtgccttaccttggtggagggattcgagagattgaaaaggtattctcaaaggtcactgaaactttatttaattacaaactaaagtttgggaaagcccttaaaaagataaagcaagataaatggattaatgactatggggcgcagccccttcatcccttatatgcggaatcgtgcgctattaatggtgagatttcagaggttataaagtgcattgaaagtcccaaaaattttgttatttttaatgagtgctacagaataaatatcgcaaacaatgtaagcaaactgacgggtaaggagacaaaagcattctttgacatcaaatatgctggccgcatcctgacgaaagaaagtccctttgccgcatatgatacaattttgatcattgataaaagcattaatccaaaagacctttggaaaatgttaaaaatcatagatcatgagaatactgataatatcatccttgttatcttgggagtaaagacaaatctgaggttttcgcagagaacggatagtaaatattttacgcaaataagttccattttaacaaaatctgaactaaaatatttaacatatatatatattacgggtcagggtgttttttga

SEQ ID NO: 9704 - protein, 255 aa, Unknown
  Obtained from environmental sample
  misc_feature (1)..(255): Xaa is any amino acid
MEPSCDAETKAWTFIQCFQGQTESPVSLWFWRNLVSHVVETISAFVRINYIRVSRVPYLGGGIREIEKVFSKVTETLFNYKLKFGKALKKIKQDKWINDYGAQPLHPLYAESCAINGEISEVIKCIESPKNFVIFNECYRINIANNVSKLTGKETKAFFDIKYAGRILTKESPFAAYDTILIIDKSINPKDLWKMLKIIDHENTDNIILVILGVKTNLRFSQRTDSKYFTQISSILTKSELKYLTYIYITGQGVF

SEQ ID NO: 9705 - DNA, 465 bp, Unknown
  Obtained from environmental sample
  misc_feature (1)..(465): n is a, c, g, or t
atgaaaatcatactggggatttttcttccacacctactcaacaaagatgtagtagaatacgcttttgatatcaaagatacttttaaagtttttcgtgaagttatagatactattaaagagaaaaacatctatgtagatacccctattgaggtacgatttgtgcaaaaagacagttactggttaagtcctacaggagatactaacagttgttggatagggacaaaaatacattttccttatgggaaaaaaccagagtatttagaatatttcactacaatagatgagatacttctaaaatacaacggacgaccacattggggaaaacaatttcgaatatctcaagaggattttaaaaaagcataccctaagtgggatgatttttggaactttgcagacaaagaagatccaaataaaattttacaaaatgattttgttaaaaggttacgaaaaagagaattatcctaa

SEQ ID NO: 9706 - protein, 154 aa, Unknown
  Obtained from environmental sample
  misc_feature (1)..(154): Xaa is any amino acid
MKIILGIFLPHLLNKDVVEYAFDIKDTFKVFREVIDTIKEKNIYVDTPIEVRFVQKDSYWLSPTGDTNSCWIGTKIHFPYGKKPEYLEYFTTIDEILLKYNGRPHWGKQFRISQEDFKKAYPKWDDFWNFADKEDPNKILQNDFVKRLRKRELS

SEQ ID NO: 9707 - DNA, 594 bp, Unknown
  Obtained from environmental sample
  misc_feature (1)..(594): n is a, c, g, or t
atgagaataaatagaaaaataacacaaaactgggcaaaaacctatgaatcaaaaccaagagatatcttctatctaaaaacagaaaaagagattatccacctagtaaagtattgtaacaaatatcaaactccacttaaaattgtaggtggggcagatagttacaatgatatattttgccctggggagtatgggtttttagtaagcttagaaaagttcaataagcttttagatgtggataaagagaatcataccgctacctttgaagcgggtatgatgatgcctgatttaataaaacaactcaaaagatataatctagctatctcaaatttaggtacaaatatcttcgattgtgttgctggaagctgtagtaccggttatcatggaagtggtattaactataagatatttagctcttttgtaaaaacttttgaacttatcactcaaactggggagaaaaaagtaattcactctgatgatgaaaaatttgacatctatgcagttggactaggagttttaggaattatactaaaatccctttacaggggaaccacttttaaccctgaggtagttgagaaaaaaataattttaaaaaaa

SEQ ID NO: 9708 - protein, 198 aa, Unknown
  Obtained from environmental sample
  DOMAIN (19)...(174): FAD binding domain
  misc_feature (1)..(198): Xaa is any amino acid
MRINRKITQNWAKTYESKPRDIFYLKTEKEIIHLVKYCNKYQTPLKIVGGADSYNDIFCPGEYGFLVSLEKFNKLLDVDKENHTATFEAGMMMPDLIKQLKRYNLAISNLGTNIFDCVAGSCSTGYHGSGINYKIFSSFVKTFELITQTGEKKVIHSDDEKFDIYAVGLGVLGIILKSLYRGTTFNPEVVEKKIILKK

SEQ ID NO: 9709 - DNA, 582 bp, Unknown
  Obtained from environmental sample
  misc_feature (1)..(582): n is a, c, g, or t
atgcatgagatgaaaatgccaattgcaaaagggatgttttatctaaaacaagagccttctaaatatacacatgataaattcaatatcttactaaatagattgaataatgaactagatgaattttcagtaattgagagtttaatcgtatatcaaaataatatagaactaatacctcataatacccataatattttaaccttagctattgaaaaagttggcatggaaaacaaaaataatatattaatagaaaattgtgataattttgaaatacaaggtgataaagagttatggatattatgttttaaaaatttaattgacaatgctttaaaatatgcagatgataaaaaattaattataaaatgctcaaagaatagtatctcatttattaatattggtgataaactaccagttgatttatcccaagatctaaagaattggaaaatagataaaaatcaaagacataaaagttctacgggatatggttttggattatttattataaaaaatattattgcattaaatggttatgctttagaatatagttatagtgatagtagtattgaattaaagattataagatga

SEQ ID NO: 9710 - protein, 193 aa, Unknown
  Obtained from environmental sample
  misc_feature (1)..(193): Xaa is any amino acid
MHEMKMPIAKGMFYLKQEPSKYTHDKFNILLNRLNNELDEFSVIESLIVYQNNIELIPHNTHNILTLAIEKVGMENKNNILIENCDNFEIQGDKELWILCFKNLIDNALKYADDKKLIIKCSKNSISFINIGDKLPVDLSQDLKNWKIDKNQRHKSSTGYGFGLFIIKNIIALNGYALEYSYSDSSIELKIIR

SEQ ID NO: 9711 - DNA, 654 bp, Unknown
  Obtained from environmental sample
  misc_feature (1)..(654): n is a, c, g, or t
gtggatactgatacccagggacagtcctcctatattcttgggaaaaggccgggtgccggcttgacagaacttttaacccgggaactgacgatttcagactgcctgactgaggcccgtaaaaatctgtggttgctttcgggtggaaaatccctggcaggcgttaagcgtattattgacaaaaaaagttttggggcggagtttactttgtccgaagccctaagtcctttggacaatcagtttgactttattttgcttgatacatctccaggatgggatcagttgattgttaatgtccttttttattcaaccgaggtgttggtgcctgttgccttagaagccatgcctttgcatgggatgtccgagttcataaaaagtcttggtgccatccagaagtacaaaaatgaaattcaactaaaatacattgtgcccacattccttgacttgcggatcaaggggcccaaagtgctgtatgatcagcttaaaaaactgtatccccggcaattatgtaaacccattcgctataacgaaaatctggccgatgcgccttcctttgggaaaaccatctttgaatttgctccaggctcaacagcctcggaagactatcggagtctggttcgtacggtgtccggaaacgaattcgctcttcttaaatag

SEQ ID NO: 9712 - protein, 217 aa, Unknown
  Obtained from environmental sample
  DOMAIN (43)...(180): CobQ/CobB/MinD/ParA nucleotide binding domain
  misc_feature (1)..(217): Xaa is any amino acid
MDTDTQGQSSYILGKRPGAGLTELLTRELTISDCLTEARKNLWLLSGGKSLAGVKRIIDKKSFGAEFTLSEALSPLDNQFDFILLDTSPGWDQLIVNVLFYSTEVLVPVALEAMPLHGMSEFIKSLGAIQKYKNEIQLKYIVPTFLDLRIKGPKVLYDQLKKLYPRQLCKPIRYNENLADAPSFGKTIFEFAPGSTASEDYRSLVRTVSGNEFALLK

SEQ ID NO: 9713 - DNA, 666 bp, Unknown
  Obtained from environmental sample
  misc_feature (1)..(666): n is a, c, g, or t
atgaaaaaagtaataacactctcactaataacactaaatatactatttgcaaatgagtttagtgttgaaaaatctaaagagttttcaatagaagcgacacctacaatcatggagacaactttttcaatctctaaacactccatgtcatataactctattcaaaaaacttttaatgagatagtagaagatataaaaaaagagcagatctgtaaaggtggtcaatacagcatttcacctcactacaactgggataagaacaaaagagtctttgacggatatgatggaagagtctcattcaagtgtcagtttaaagcctctgatgagtttaataaaatcttaaaaaatatagacaataaggctattgagttctccctctcaccgattcagtggaaaatagaggataaagagcagactattttagagagaagtgtagaaaaacaagcgcttcactacgtaaaagatgaagcaaaatttctctcacatgagttaaatgcaagttgtaaaataacaaatatatcatttaacaaatcanaccagtttaatccacaacccatggcatatgctgagcagaacctaatgatgagtaaaagcataacaacatctccaataaaaagagaatctgaaatcacccaaaaaagtgcttataaatttagttgtactaaatag

SEQ ID NO: 9714 - protein, 221 aa, Unknown
  Obtained from environmental sample
  SIGNAL (1)...(17)
  misc_feature (1)..(221): Xaa is any amino acid
MKKVITLSLITLNILFANEFSVEKSKEFSIEATPTIMETTFSISKHSMSYNSIQKTFNEIVEDIKKEQICKGGQYSISPHYNWDKNKRVFDGYDGRVSFKCQFKASDEFNKILKNIDNKAIEFSLSPIQWKIEDKEQTILERSVEKQALHYVKDEAKFLSHELNASCKITNISFNKSXQFNPQPMAYAEQNLMMSKSITTSPIKRESEITQKSAYKFSCTK

SEQ ID NO: 9715 - DNA, 465 bp, Unknown
  Obtained from environmental sample
  misc_feature (1)..(465): n is a, c, g, or t
atgatttcaaatgactccattgaggcacttaaaagccgactagatatcgttgatgttgttggctcttatttggaactcaaaaaaaatggagcaaatttcaaagcaccttgtccttttcatgacgagaaatcaccctcttttgtagtctctccctcaaagcagatttatcactgtttcggttgcggtgccggtggtgatagcattaaatttgtcatggagtatgagaagctaaactaccctgaagcgattgagaagttagcacaagatagtaatttttcacttgagtacacaaaaaatgcaccctcacaaaacagctcaaaactcatggagaaggtaaatgattggtttatctctttgttaaatcaaaatcccactgcaaaaaagtatcttcatgatcgtggtatctacgagtcttccattgagaagtttggcatcggctatgcaccaagttctaacgagaggtaa

SEQ ID NO: 9716 - protein, 154 aa, Unknown
  Obtained from environmental sample
  DOMAIN (2)...(99): CHC2 zinc finger
  misc_feature (1)..(154): Xaa is any amino acid
MISNDSIEALKSRLDIVDVVGSYLELKKNGANFKAPCPFHDEKSPSFVVSPSKQIYHCFGCGAGGDSIKFVMEYEKLNYPEAIEKLAQDSNFSLEYTKNAPSQNSSKLMEKVNDWFISLLNQNPTAKKYLHDRGIYESSIEKFGIGYAPSSNER

SEQ ID NO: 9717 - DNA, 759 bp, Unknown
  Obtained from environmental sample
  misc_feature (1)..(759): n is a, c, g, or t
atgagcaatagtttcaccgatggaataaagaacgtttttaaccaactcatcaacaggcgaaacgcaacgtctaataatgttgttgatagtccacgattgttagttgagcagatgaaggcaatctaccgaagcggattaggtagcaagattgttagaatcaaagcaggtcaatcacttaacgacacgatcacgtttgaatcaaagcaagattctgaattttacaagttaaaactggaagcctcagtgaagaaagctaccaaattcatgatcgggtttggtcgtggaatcatagttatccactcaagaggagacgacttatcctcgccactcggtaaggtcgataacactctggctaaggttagcgtattcagcggtgatatggtaactgcccacagcgttagccttgacttgctaaaccctagatacctaaagcctgaagcctatatcgtgcgcgggaatacgatacattggacaagggtagttgactttacttacgtcgaacctgttgaaatggatttacctacatatcaatacggaggcattagcgagtttgaactcatttacaaccagattatcaatgacgggatcgttgaacgtgcaagccccgctatcatcgaaaaggctagcaactttatttacaagattgaagggtttaaggattctcttaggcaaaaaaaagacaaagaacttcaggagtacataggcgcaactgaggacatgccgtcaatttacggagcggtggtcgttgataaaaatgat

SEQ ID NO: 9718 - protein, 253 aa, Unknown
  Obtained from environmental sample
  misc_feature (1)..(253): Xaa is any amino acid
MSNSFTDGIKNVFNQLINRRNATSNNVVDSPRLLVEQMKAIYRSGLGSKIVRIKAGQSLNDTITFESKQDSEFYKLKLEASVKKATKFMIGFGRGIIVIHSRGDDLSSPLGKVDNTLAKVSVFSGDMVTAHSVSLDLLNPRYLKPEAYIVRGNTIHWTRVVDFTYVEPVEMDLPTYQYGGISEFELIYNQIINDGIVERASPAIIEKASNFIYKIEGFKDSLRQKKDKELQEYIGATEDMPSIYGAVVVDKND

SEQ ID NO: 9719 - DNA, 807 bp, Unknown
  Obtained from environmental sample
  misc_feature (1)..(807): n is a, c, g, or t
atgaggcaattaattgaaactttcttagattccggtctacgtgtcgaagatgtttttttaaactgcactattttgaaaaatgtgataatagagatgctgtttgaaaacggtattgataaactgaaaattgctaaaacaacatctatctttgatcaaaatcttcattctgttttaggtatatatacaaagaaaagagtgattaaagatagacaatacacactctattcaaaactgatagaagaacatttggctatgagtattacagatactaaagggatcattacctatgttactgatgcattttgtacattaactggatacagtgcaaaagagcttgttggtaaatctcataagacaatccgtcataaagatatgagtagcacatttttcaaagttatgtggagcaaactgattaaaaacggcagttggaaaggaaaagtaaaaaatataaaaaaagatggtggagaatttatagcaaaaactgaaattatctcttttaaaaatgagaataatgagactatagagtatctagcaattcgtcatgatataactgatagagaacactccaatatagaccctctcacagagttaaataacagaagggtatattttaataaaattgacaaaattttagagtgctgtgatgatatctcacttatgtacatcgatatagatcacttcaaacaaatcaatgatacatacggacacaatattggtgatgtagtattaaagaagtttgcagagattttaaaaatagagtacgtgatcaagatttttgcttcagatggggaggagaagagtttttag

SEQ ID NO: 9720 - protein, 268 aa, Unknown
  Obtained from environmental sample
  DOMAIN (185)...(266): GGDEF domain
  misc_feature (1)..(268): Xaa is any amino acid
MRQLIETFLDSGLRVEDVFLNCTILKNVIIEMLFENGIDKLKIAKTTSIFDQNLHSVLGIYTKKRVIKDRQYTLYSKLIEEHLAMSITDTKGIITYVTDAFCTLTGYSAKELVGKSHKTIRHKDMSSTFFKVMWSKLIKNGSWKGKVKNIKKDGGEFIAKTEIISFKNENNETIEYLAIRHDITDREHSNIDPLTELNNRRVYFNKIDKILECCDDISLMYIDIDHFKQINDTYGHNIGDVVLKKFAEILKIEYVIKIFASDGEEKSF

SEQ ID NO: 9721 - DNA, 819 bp, Unknown
  Obtained from environmental sample
  misc_feature (1)..(819): n is a, c, g, or t
ttgtatgaaactggattgagtaagttcttcattgaaaaagagctccttgatgctgagttcaataagatgtttggaaacgagagtaaagagaaacaagcaatacttaaaaccaaagctacacagttagataagaatgctactcgtagagttgaagagatcgctaaaagtattgttgaacactataaaaataagagctacttggatggctttaaagctatgatagtctgtcatggtaggccacaagcaatagcctataaaaaagcatttaataagttaacagatcaaggtcaaaacaactttcaatcaaaggttataatgagttttgatatgaagaaagactcacaagaattttatgatttggctacgccagaagcagatgtaaagcaagctattgaagactttaaactaccatttggagatgagaacgataaaagtcgtggaggaaagagacaatttgataacactgcttttctaattgtaagtgatatgctactaacgggatatgatgctccaatacttcaaactctttatgtcgataagatactaaaagagcataatctacttcaagcaatagcaagagttaatagaacccgaaaaggtaaaaatgccgggtatgttgtggactttgcaggtataactaaacaccttgttgatgctcttgaaatatttagtggagatttagaaccaagtgatgtaatggtggatattgagagtgaaaaaancacacttgaaaatagacatactaagcttgtgaattattcaaatcaatccagaaaaatagagaaaccccgagagatgattttatacttcaagctataa

SEQ ID NO: 9722 - protein, 272 aa, Unknown
  Obtained from environmental sample
  misc_feature (1)..(272): Xaa is any amino acid
MYETGLSKFFIEKELLDAEFNKMFGNESKEKQAILKTKATQLDKNATRRVEEIAKSIVEHYKNKSYLDGFKAMIVCHGRPQAIAYKKAFNKLTDQGQNNFQSKVIMSFDMKKDSQEFYDLATPEADVKQAIEDFKLPFGDENDKSRGGKRQFDNTAFLIVSDMLLTGYDAPILQTLYVDKILKEHNLLQAIARVNRTRKGKNAGYVVDFAGITKHLVDALEIFSGDLEPSDVMVDIESEKXTLENRHTKLVNYSNQSRKIEKPREMILYFKL

SEQ ID NO: 9723 - DNA, 540 bp, Unknown
  Obtained from environmental sample
  misc_feature (1)..(540): n is a, c, g, or t
atgaatgtaaaaagatttcttgttgattttgattttttaacgattcatccagataagaattattactttatcaataaacaatatattaatttatttaacgaacatatattatcacaaataggtcatgatgaaaataatcaagaagttgatatcgatgagaataaagagataccaccaaaagttttcatttcttattcttgggatagtgaagatcataaagattgggtattgaatttagcacataaattagctgagaatggtgtaaatcctatattagatagatatgagttacgaggaggttctaacgcaccatattttatggaaacagcattgaaagaatcagataaagtacttataacatttactgagaattatcaaataaaagccatgaaacgaagtggtggtgtgggatatgaatactcaattttaaatgcagagatgtgtaaaaatattacggatgataaaaaatatattcccatattaagaagtggcacaaatgagacgagtatcccttcatttcttcaacaattaacttcaata

SEQ ID NO: 9724 - protein, 180 aa, Unknown
  Obtained from environmental sample
  misc_feature (1)..(180): Xaa is any amino acid
MNVKRFLVDFDFLTIHPDKNYYFINKQYINLFNEHILSQIGHDENNQEVDIDENKEIPPKVFISYSWDSEDHKDWVLNLAHKLAENGVNPILDRYELRGGSNAPYFMETALKESDKVLITFTENYQIKAMKRSGGVGYEYSILNAEMCKNITDDKKYIPILRSGTNETSIPSFLQQLTSI

SEQ ID NO: 9725 - DNA, 615 bp, Unknown
  Obtained from environmental sample
  misc_feature (1)..(615): n is a, c, g, or t
ttgatgtttgatgttagaaatgttagaatatccatcttgcttgttgtaaataatgttagaaaaggtgggccaatgttcaaatatgaagacctgtattcacactctctttttgagaaaatcatggacaggagtaatgacggaataaatgttgtagatgaaaacggaatcatagtctatgtaaaccagatttcagcagactatgctaacaataaggctgaagatatggtaggtagtcatatctccaaattttatcctgatgccgtactattaaacgtacttaaaaacaaacatgctatcttcgacaaaaagattcattacgttggcaacaagaaatatattgtaagttcataccctatttatatagacagtaaatttataggtgcattctcagtttttaaagacgtcctggaaatcgacgaactgaatcgaaagataaaaaatttggaaattcaggtatccatcaacaaacctgaaggcagattttcatcagtaatcggtaatgaaggaagtctcaatgatgttctgataaaggcaaagagaacagtcggctcactagcaggtccgagacattcaataattaatggcgagtccggaaccggaaaaccatgcttgcaa

SEQ ID NO: 9726 - protein, 205 aa, Unknown
  Obtained from environmental sample
  misc_feature (1)..(205): Xaa is any amino acid
MMFDVRNVRISILLVVNNVRKGGPMFKYEDLYSHSLFEKIMDRSNDGINVVDENGIIVYVNQISADYANNKAEDMVGSHISKFYPDAVLLNVLKNKHAIFDKKIHYVGNKKYIVSSYPIYIDSKFIGAFSVFKDVLEIDELNRKIKNLEIQVSINKPEGRFSSVIGNEGSLNDVLIKAKRTVGSLAGPRHSIINGESGTGKPCLQ

SEQ ID NO: 9727 - DNA, 489 bp, Unknown
  Obtained from environmental sample
  misc_feature (1)..(489): n is a, c, g, or t
atgcaaacaactactaattcatctgttttatacttatttacagacggcagtgccaatcctcaaaaaaagattggctttggtgcttacctgcttctaactgaaaatgaactcctctctactactttgtctaaagatagtgtaattactaaaaaatttgaggacacaagctcatctaaacttgagttagaagctatgctttgggcactgaatgaaatagacactgaaaacagtaaagttgttatttttacagattgtcaaaatattataggtctcaaagatagaagagagaggtttgagcagaacaactataaaagcaagaaaaaagttctaataagaaatcatgaactatacaaagagttttatatacttacagatgcaatagagtgcgattttgtaaaagtcaaaggtcacaaaaaaagtgaagaaaaaaacatgatagacaaaatcttcactctagtggacaaagctgctanctcagccgaattctga

SEQ ID NO: 9728 - protein, 162 aa, Unknown
  Obtained from environmental sample
  DOMAIN (7)...(162): RNase H
  misc_feature (1)..(162): Xaa is any amino acid
MQTTTNSSVLYLFTDGSANPQKKIGFGAYLLLTENELLSTTLSKDSVITKKFEDTSSSKLELEAMLWALNEIDTENSKVVIFTDCQNIIGLKDRRERFEQNNYKSKKKVLIRNHELYKEFYILTDAIECDFVKVKGHKKSEEKNMIDKIFTLVDKAAXSAEF

SEQ ID NO: 9729 - DNA, 690 bp, Unknown
  Obtained from environmental sample
  misc_feature (1)..(690): n is a, c, g, or t
atgcccctttgtgaacaaaatatagatgcactagaattagtactagaaaaatttgaaaaaaattttagtaaatatttttctcaacttcaatggctcaattttggtggaggtcatcatattacaagagatgattatgatgttgaaaaattaataactgtcttaaaaaactttaaatccaaatatccccatctaacaatctatatggaaccaggtgaagctgtagggtggcaaacaggatatttagaagcgacagtacttgatatagtacataatggtatggatatagctattcttgatacaagtgctgaatgtcatatgccggatactcttgctatgccttacaaagcacaaatacgagatgctgctgaaccatttgaaaaagcatatacctatagacttggtggaaacacttgtcttgctggagatattataggagattactcttttgataaaaaactagaggttggtgataaaattatattagaggatatgatacattatactatggtaaaaactactacatttaatggtattaatttaccatcaatagctattaaaaaacctgatggtagttttaaaattataagaaactatgattaccaaagctataaagatagattgtcatanatatatttttataaaacatctatatatacagtataccctgctataaaagcatcctcattatag

SEQ ID NO: 9730 - protein, 229 aa, Unknown
  Obtained from environmental sample
  DOMAIN (80)...(187): Pyridoxal-dependent decarboxylase, C-terminal sheet domain
  misc_feature (1)..(229): Xaa is any amino acid
MPLCEQNIDALELVLEKFEKNFSKYFSQLQWLNFGGGHHITRDDYDVEKLITVLKNFKSKYPHLTIYMEPGEAVGWQTGYLEATVLDIVHNGMDIAILDTSAECHMPDTLAMPYKAQIRDAAEPFEKAYTYRLGGNTCLAGDIIGDYSFDKKLEVGDKIILEDMIHYTMVKTTTFNGINLPSIAIKKPDGSFKIIRNYDYQSYKDRLSXIYFYKTSIYTVYPAIKASSL

SEQ ID NO: 9731 - DNA, 822 bp, Unknown
  Obtained from environmental sample
  misc_feature (1)..(822): n is a, c, g, or t
gtgtatgattttgactatattacaaaacagtatcaagaattaaaaggtgcttttaaagctagaaaatctttgatatcgtatgcggtaaaagcaaattcaaatttaagtgttgtaaaacatcttggagatcaaggtagtggcgcagattgtgtgagtattggtgaagttaaacgagcattaaaagctgggattccaaaatataagattatattttctggtgttgggaagattgataatgagattagagaagctttacaacttgatattttgatgataaatgttgagagtgaagcagaactaaaaagagttgatatcatagccaaagaacttaaggtagaagctagaatatctatacgagtaaatccaaatgtagatccaaaaacccatccatatatttcaactggactccatgagaataaatttggtgtagatatcaatactgcaaaaagaatgtatatctttgctaaacaaagtgaaaacttagaccctctaggtatccactgtcacatagggagtcagcttacagagttagcacctatcaaagaagctgtaaatatcgttgcagatttagttagaaatataaaatctgcactaaaaattgagttaaagttttttgatgttggtggtggacttggtattgtctatgatgatgagaagcttatagatacttacgaatatgctcaaactgtattagatgctctttttggactggatatcacggtagtgtgtgaaccaggaagatttatcgttggaaatagcggtgtatttgttacgaaagttttatatgaaaaagtaaatggtagcaaaagatttttatcgtga

SEQ ID NO: 9732 - protein, 273 aa, Unknown
  Obtained from environmental sample
  DOMAIN (3)...(252): Pyridoxal-dependent decarboxylase, pyridoxal binding domain
  misc_feature (1)..(273): Xaa is any amino acid
MYDFDYITKQYQELKGAFKARKSLISYAVKANSNLSVVKHLGDQGSGADCVSIGEVKRALKAGIPKYKIIFSGVGKIDNEIREALQLDILMINVESEAELKRVDIIAKELKVEARISIRVNPNVDPKTHPYISTGLHENKFGVDINTAKRMYIFAKQSENLDPLGIHCHIGSQLTELAPIKEAVNIVADLVRNIKSALKIELKFFDVGGGLGIVYDDEKLIDTYEYAQTVLDALFGLDITVVCEPGRFIVGNSGVFVTKVLYEKVNGSKRFLS

SEQ ID NO: 9733 - DNA, 549 bp, Unknown
  Obtained from environmental sample
  misc_feature (1)..(549): n is a, c, g, or t
atgttaattaataaacttattagtggtaataagaagttcaaggatacccatttcccaaatttagagaataaatttgaaaatttagttacatttggacaatcaccagatgtattatttattggatgtagtgatagtagagttgtacctgatttgattgttgatagtaaaccaggtgatatgtttattattagaaatattggtaactttgttcctccttataaaaatgacaatgattttcatggttcaacagcagcaatagaatatgctgtaagtgtattaaatgttaaagatataattgtatgcggacatagtcattgtggtgcttgtgcagcattatatgaagatttaagtaataaacctaacttaatacatgtgcataaatggttagaacttggtagaaaagcaaaagaatatactttatctaatattacagataaacatactactgaagataagttgcgtattacagaaaaaatatcaattaaacatcaattagaaaatctattaacttatccagaagtttttaaaagagtgaagaaggaaagttag

SEQ ID NO: 9734 - protein, 182 aa, Unknown
  Obtained from environmental sample
  DOMAIN (30)...(182): Carbonic anhydrase
  misc_feature (1)..(182): Xaa is any amino acid
MLINKLISGNKKFKDTHFPNLENKFENLVTFGQSPDVLFIGCSDSRVVPDLIVDSKPGDMFIIRNIGNFVPPYKNDNDFHGSTAAIEYAVSVLNVKDIIVCGHSHCGACAALYEDLSNKPNLIHVHKWLELGRKAKEYTLSNITDKHTTEDKLRITEKISIKHQLENLLTYPEVFKRVKKES

SEQ ID NO: 9735 - DNA, 507 bp, Unknown
  Obtained from environmental sample
  misc_feature (1)..(507): n is a, c, g, or t
ttgtattatcactataaaaataaagaggatattttagttgatatatatctagatatgtccgaaaagtttgaaagttttgagagctttgatactattttaactagtgaaaatccactaaaaagtttatatgagatgtatgatgtttacggggaacttttttgggagtttagatttcttatgagagattctgttgtacttatgagacttaatcctaaacttaaagagatgtttttagaaagacaaacgaaaagaatttttcaaattgaatctcttataaattattttgtctctaaagagatattcactgatatcccaaaacaagagatttctctaagagcaaagcttaattggttcatctctgcatattggcaaacctttgtttctactgatgatgagcttacaaaagagtctataaaagagataaaagatatagtatttacaatcaatatttatccttttttaacagacaaagggaaacttctagcaaaagaattcaaaaaagaataa

SEQ ID NO: 9736 - protein, 168 aa, Unknown
  Obtained from environmental sample
  misc_feature (1)..(168): Xaa is any amino acid
MYYHYKNKEDILVDIYLDMSEKFESFESFDTILTSENPLKSLYEMYDVYGELFWEFRFLMRDSVVLMRLNPKLKEMFLERQTKRIFQIESLINYFVSKEIFTDIPKQEISLRAKLNWFISAYWQTFVSTDDELTKESIKEIKDIVFTINIYPFLTDKGKLLAKEFKKE

SEQ ID NO: 9737 - DNA, 810 bp, Unknown
  Obtained from environmental sample
  misc_feature (1)..(810): n is a, c, g, or t
atgagtatagttgtttaccagttgcaggaaggtttttatatgacaaaccaaaaaatactaaatggtaaagtgtatatggttcaaaatccaaaactcccatttgcagcacttcatggtgatccagatattttggaaaatggtcttacacgatttggaccaactgctttagttttgccaaaactggaaagatttaaatctggtacttataaagacttttggacaacattacgatttgataaaaagattgtaaagatatttatagatttactgaaagatagtgatataagaaactatatatttagaaacttcttatttgagataccttttataaacaaaaaactttttgtaagagatgctaaaaaaatcataccagctcttagggctgatgagatagagtatgcccaagggtttggaggtgttagaccacaggttttaaataaaaaagaggaaaaactgatgctaggagaagcttctatcaatacaggtgaagggatagtatttaatatgaccccatcaccgggggctactagctgtttgggaaatgcaaaaagggatgtaataaatgtaacaaaatacttaaataaaaactttgatattaaaaagtttgaagatgagttagttgaagaaaatatctctcaaagtgctattgatgcaaatgaacaaaaacaatatgttagtaaaataagagaagagataaaagctcacgaagaggagtattatcaaaatataaatgatggacaagagttgcctagctattggaataaaccttacagtccatggagaaataagagagaccattgggctttttaa

SEQ ID NO: 9738 - protein, 269 aa, Unknown
  Obtained from environmental sample
  misc_feature (1)..(269): Xaa is any amino acid
MSIVVYQLQEGFYMTNQKILNGKVYMVQNPKLPFAALHGDPDILENGLTRFGPTALVLPKLERFKSGTYKDFWTTLRFDKKIVKIFIDLLKDSDIRNYIFRNFLFEIPFINKKLFVRDAKKIIPALRADEIEYAQGFGGVRPQVLNKKEEKLMLGEASINTGEGIVFNMTPSPGATSCLGNAKRDVINVTKYLNKNFDIKKFEDELVEENISQSAIDANEQKQYVSKIREEIKAHEEEYYQNINDGQELPSYWNKPYSPWRNKRDHWAF

SEQ ID NO: 9739 - DNA, 591 bp, Unknown
  Obtained from environmental sample
  misc_feature (1)..(591): n is a, c, g, or t
gtgcctaatcctttttacgaaggggacacgctcagtataacaaccaatcatattgcagcaaaagccggtatctcttctggaaatttgtattatcactataaaaataaagaggatattttagttgatatatatctagatatgtccgaaaagtttgaaagttttgagagctttgatactattttaactagtgaaaatccactaaaaagtttatatgagatgtatgatgtttacggggaacttttttgggagtttagatttcttatgagagattctgttgtacttatgagacttaatcctaaacttaaagagatgtttttagaaagacaaacgaaaagaatttttcaaattgaatctcttataaattattttgtctctaaagagatattcactgatatcccaaaacaagagatttctctaagagcaaagcttaattggttcatctctgcatattggcaaacctttgtttctactgatgatgagcttacaaaagagtctataaaagagataaaagatatagtatttacaatcaatatttatccttttttaacagacaaagggaaacttctagcaaaagaattcaaaaaagaataa

SEQ ID NO: 9740 - protein, 196 aa, Unknown
  Obtained from environmental sample
  DOMAIN (5)...(43): Bacterial regulatory proteins, tetR family
  misc_feature (1)..(196): Xaa is any amino acid
MPNPFYEGDTLSITTNHIAAKAGISSGNLYYHYKNKEDILVDIYLDMSEKFESFESFDTILTSENPLKSLYEMYDVYGELFWEFRFLMRDSVVLMRLNPKLKEMFLERQTKRIFQIESLINYFVSKEIFTDIPKQEISLRAKLNWFISAYWQTFVSTDDELTKESIKEIKDIVFTINIYPFLTDKGKLLAKEFKKE

SEQ ID NO: 9741 - DNA, 477 bp, Unknown
  Obtained from environmental sample
  misc_feature (1)..(477): n is a, c, g, or t
atgaattttaaaataaaatttgtaatttttagtgaagatcaaaaaaagtttataaaagatgataatgagtatattttcgagttagatgaagagtttgaagagagttatacaactttagaaaaaaatgataaaaatatctacaatttttttaaaaatgagaagagtttcttaaaatggctaaaagaggaagtttatccagattatgaatctgcagagataggaatatcatttatagatgatattagctatttgcgtttttggttctttaaagttgagagtggtgatgctcattacgaatattttatggactattttagtatattttatgatgatctatatgattcaagagccggtataggtgaggagatagttgaaaaactaaagattgagagaaaaggaatggttataaatttagactctatagttatcgaagaagagattgaagttgaagttgctgaggaagaggttgagtcttaa

SEQ ID NO: 9742 - protein, 158 aa, Unknown
  Obtained from environmental sample
  misc_feature (1)..(158): Xaa is any amino acid
MNFKIKFVIFSEDQKKFIKDDNEYIFELDEEFEESYTTLEKNDKNIYNFFKNEKSFLKWLKEEVYPDYESAEIGISFIDDISYLRFWFFKVESGDAHYEYFMDYFSIFYDDLYDSRAGIGEEIVEKLKIERKGMVINLDSIVIEEEIEVEVAEEEVES

SEQ ID NO: 9743 - DNA, 606 bp, Unknown
  Obtained from environmental sample
  misc_feature (1)..(606): n is a, c, g, or t
atgaaggaaacaattttaaaaaaagctagtgaaatatttttaaagtacggctttaaaagtgttacaatggatgatattgcgaacgatttaggtatctcaaaaaaaactatttataaacattttaaaaataaggcctcacttgttgatagcactattagctaccttcataaaagtttacataatacagtaatgtgcgtatgtgataaaggatttgatgctattcaagaaaactttgaaattaaaaaaatattctctgaactatttaaaaattcagataattcaccaatgtatcagcttcaaaaatactatccagaaacatacattaaaattataaaagatgaattttcaatgtttaaagattgcatattaaaaaatattgagaaaggaattaacgaaggtatttatagaaaaaatttagaaaaagaattaattacaaaattctatttttcattaatgatgagtgttcatgatagaaatctatacacgtataacaaaaacactatcaataaattagaactaagagcacttgaatatcacttaagagctattgccacaacaaaaggattaaaaattttagaagaacaattaggacaaaacgcaatttaa

SEQ ID NO: 9744 - protein, 201 aa, Unknown
  Obtained from environmental sample
  DOMAIN (5)...(51): Bacterial regulatory proteins, tetR family
  misc_feature (1)..(201): Xaa is any amino acid
MKETILKKASEIFLKYGFKSVTMDDIANDLGISKKTIYKHFKNKASLVDSTISYLHKSLHNTVMCVCDKGFDAIQENFEIKKIFSELFKNSDNSPMYQLQKYYPETYIKIIKDEFSMFKDCILKNIEKGINEGIYRKNLEKELITKFYFSLMMSVHDRNLYTYNKNTINKLELRALEYHLRAIATTKGLKILEEQLGQNAI

SEQ ID NO: 9745 - DNA, 765 bp, Unknown
  Obtained from environmental sample
  misc_feature (1)..(765): n is a, c, g, or t
atgctgccgggaataaaagatattttaataatttcaactcctaaagatattcatttatatcaggatttactgggtgatggtagtcagatagggataaatttacagtataaaattcagccatcgcctgatggtttagcacaggcgtttattttgggcgatgaatttattggaaacgataatgtttgccttattttgggcgataatatttactttggttttggttttacaaatgttttgcaacaagcagcaaaaataaaagacggtgcaattgtttttggctattatgttaaaagcccaagtagatacggtgttgttgaatttgatcaaaatgaaaaagttattagtcttgaggaaaaaccccaaaatccaaaatctaactatgctgtaacgggtctttatttttatagtaatgatgtaatacaaaaagccaaaaatttgaaaccctcagctcgtggcgaattagaaataaccgacttaaaccgattatatcttgaagaggatcgtttgcaggtgaaattattaggaagaggaatggcatggcttgatacaggcactcacgaaagcctgttaaaagcatcgaattatattgcaactatagaatatagacaaggattgaaagtggcttgtcttgaggaaattgcttataaaatgaactttattaataaacagcaattacttgtgcttgccgagccattaaaaaataatcaatatggagaatacctccagtatattgcaaatgaaaaaacaatgacaatagaatattaa

SEQ ID NO: 9746 - protein, 254 aa, Unknown
  Obtained from environmental sample
  DOMAIN (1)...(199): Nucleotidyl transferase
  misc_feature (1)..(254): Xaa is any amino acid
MLPGIKDILIISTPKDIHLYQDLLGDGSQIGINLQYKIQPSPDGLAQAFILGDEFIGNDNVCLILGDNIYFGFGFTNVLQQAAKIKDGAIVFGYYVKSPSRYGVVEFDQNEKVISLEEKPQNPKSNYAVTGLYFYSNDVIQKAKNLKPSARGELEITDLNRLYLEEDRLQVKLLGRGMAWLDTGTHESLLKASNYIATIEYRQGLKVACLEEIAYKMNFINKQQLLVLAEPLKNNQYGEYLQYIANEKTMTIEY

SEQ ID NO: 9747 - DNA, 480 bp, Unknown
  Obtained from environmental sample
  misc_feature (1)..(480): n is a, c, g, or t
atgaattatttacgaaccagcttaacccaagaatttggcagcaaaaatagcgttaccggagctgtgggacttattggaaaattaagtaaagaaattaccttaggtgctcacatttacaatcctaccagaagcaaattagccgaatacaacaatgaacgcattcccacaataatgaaaatgggattagattatcgtttttctgataaattaatttttgccttagaaactgaaaaagatgttgattttaatcctgttgtcaaattcggaattgaataccatattatagatattctttacataagaggtggaatttctaacaatccaacctctagcgcttttggttttggtttaattatgaaaaactttattttggaagcttcatcctctttccaccaaacattgggtatgactcccggaatttcgctgatatacaaaaaatctgattccaaatcttctaacaaagtaaaaacagatttttaa

SEQ ID NO: 9748 - protein, 159 aa, Unknown
  Obtained from environmental sample
  misc_feature (1)..(159): Xaa is any amino acid
MNYLRTSLTQEFGSKNSVTGAVGLIGKLSKEITLGAHIYNPTRSKLAEYNNERIPTIMKMGLDYRFSDKLIFALETEKDVDFNPVVKFGIEYHIIDILYIRGGISNNPTSSAFGFGLIMKNFILEASSSFHQTLGMTPGISLIYKKSDSKSSNKVKTDF

SEQ ID NO: 9749 - DNA, 690 bp, Unknown
  Obtained from environmental sample
  misc_feature (1)..(690): n is a, c, g, or t
ttgggtattatacctaaaattaatttaaaaggcttatacaaaatggcaaattgcggtaataaaaactttgcttatgatgagatgatggtacatgtaccattatgttctcataaagatataaaaaaaatattagtagtaggtgaagtatcatctgactttaaaaatgaattagcaaaacataaatgtaaagatgttacatttagtgataatttaaatatagaagatacttttgatattattctttacaataaagaagaaaattttgatgatatgtttatggcatcagttgatagatgtttagagcaaacaaaaggtatttttgtaacaaaagcttcttttatatataaagatttagaagtttctaaaaaagagttagaaattgttggtaaaaatttctggatctgtatgccatatagttttggacataatactttaatatttgcttcaaaaaaataccatcctcaagctgaaatagtacttcatacttcagatttgcttgaaggttgtgagtattacaatacagagttacaaaatgcaagttttgtatatcctacatatataacaaaagggataactggtattgcccaaaagatatcaagagtttaccaatgctgttgtcttaacagggtggcattgcaacagggaaaaagtacctgtgcatccccttttaaaactacatggcttttttga

SEQ ID NO: 9750 - protein, 229 aa, Unknown
  Obtained from environmental sample
  misc_feature (1)..(229): Xaa is any amino acid
MGIIPKINLKGLYKMANCGNKNFAYDEMMVHVPLCSHKDIKKILVVGEVSSDFKNELAKHKCKDVTFSDNLNIEDTFDIILYNKEENFDDMFMASVDRCLEQTKGIFVTKASFIYKDLEVSKKELEIVGKNFWICMPYSFGHNTLIFASKKYHPQAEIVLHTSDLLEGCEYYNTELQNASFVYPTYITKGITGIAQKISRVYQCCCLNRVALQQGKSTCASPFKTTWLF

SEQ ID NO: 9751 - DNA, 834 bp, Unknown
  Obtained from environmental sample
  misc_feature (1)..(834): n is a, c, g, or t
atgacagaattcggctcgagatattcccttgatgtaactgatcaaaaacatatgaataaagagttgttcgaagctaaaaaccgtgctgaacttattaatgaacttgttcccagttctcttttcacaattgataaagattgcaaggtaacaagttggaataataaaattgaagaagtgacaggttacagcgctgatgaagtcattggtgaaaagtgtatactctttgccgaaagcccctgtaaaaatggttgcagtttgtttgatgatgatgttgaaaaaccgataactggtgttgaatgcactatcagaagaaaagatggagaattgaggataatctccaaaaacagcgatgtaataacagatgacacggggaaaattattggtggaatagaaagttttgaagatattacagatagaaaaatagcagaaaaagagatccaaaaatccactgagaaatataaaaatatgtttgagttatccccggaagcaatagttcttacaaatagtgatggaattataatagatgtcaacaggagaattaatgattggcttggctatgatacagagttaatgatgggtaaacatattcttgaattgccaatttttaaggctggatctaaacgaactatctttgaaaaatatcgagattccataaaaaaagataatagaaaaccgtatgaagtagaatttgtgtctcaaaatggagagatcaaaataggtttgatattctcgacaaaaatgaaagatgctgatggaaacagaaccggagaccttattcttgtacatgatatcaccgaaagtaagaaagaagagtccttaaaactgctgttttag

SEQ ID NO: 9752 - protein, 277 aa, Unknown
  Obtained from environmental sample
  DOMAIN (97)...(139): PAC motif
  misc_feature (1)..(277): Xaa is any amino acid
MTEFGSRYSLDVTDQKHMNKELFEAKNRAELINELVPSSLFTIDKDCKVTSWNNKIEEVTGYSADEVIGEKCILFAESPCKNGCSLFDDDVEKPITGVECTIRRKDGELRIISKNSDVITDDTGKIIGGIESFEDITDRKIAEKEIQKSTEKYKNMFELSPEAIVLTNSDGIIIDVNRRINDWLGYDTELMMGKHILELPIFKAGSKRTIFEKYRDSIKKDNRKPYEVEFVSQNGEIKIGLIFSTKMKDADGNRTGDLILVHDITESKKEESLKLLF

SEQ ID NO: 9753 - DNA, 783 bp, Unknown
  Obtained from environmental sample
  misc_feature (1)..(783): n is a, c, g, or t
ttgtttttgccgaaaacaaaaaatgttaatgaaataaaatcaaaactatcatctntgaaagaagaaagcatagtttttatattaggtcttgaaaaaatatttttaaataccgctcaaagcaattttcaaataaaaagtggaacaaagctaattaattatcattcttatgacaatgtcgactcaatggaattaatttcatttatagaaaatttgtacgaagaatataattttcattttctttttttacttcaatcaaatatatctgttagcgaaagaataacaactgagttagaggaatacgatatagaaatattgagtattaaatacgaaaatgatgattctaaagacatacaaaaagatatctttaaagcactagaaaatgcaacatataaagaagcattaacagtattggaaaaatataaagcctccctagataaacattcaattagaaatttacaagttatgatatggcaacaacatggtcttcaaaacaaggctattgagtttttgaaagaaaattttgaaatactatataacagtgaaaaaaaacagttagcagatttatattattttgatgaaaaatattatgaagcttatactatcagcagtacaatatttaaagaaaaccctttaaccattggcttgaatactcttttcctaaatacggcaataaagttaggcaagtttgaagaaatatatgagcaggtgcttgaagtggactcaaaagatgtaaaagtcctagaagtatgtgctaattattttacaaaagagaggaacttttga

SEQ ID NO: 9754 - protein, 260 aa, Unknown
  Obtained from environmental sample
  misc_feature (1)..(260): Xaa is any amino acid
MFLPKTKNVNEIKSKLSSXKEESIVFILGLEKIFLNTAQSNFQIKSGTKLINYHSYDNVDSMELISFIENLYEEYNFHFLFLLQSNISVSERITTELEEYDIEILSIKYENDDSKDIQKDIFKALENATYKEALTVLEKYKASLDKHSIRNLQVMIWQQHGLQNKAIEFLKENFEILYNSEKKQLADLYYFDEKYYEAYTISSTIFKENPLTIGLNTLFLNTAIKLGKFEEIYEQVLEVDSKDVKVLEVCANYFTKERNF

SEQ ID NO: 9755 - DNA, 501 bp, Unknown
  Obtained from environmental sample
  misc_feature (1)..(501): n is a, c, g, or t
atgaaaaacttagaacattacaacttactttcagaacttttcatctatcctaaaacggatatttttgaaaaagtagttgaaattcaggaatttttaaataaaaattatcctgaagctggaaaagagtttgttcgtttttcagaatttattgccaattccactttttatcaaatagaagaaatttttcaaaaaacctttcatatccaagccatttgctttttagatttagggtatgtgatttttgccgaagactacaaaagaggtgagtttttagtaaacatgaaagtagaacaagaaaaatacaacaacgattacgaacatgaactagcagataacctaccctatgttttgaggttgcttccgctacacaaagaggaaagtttcatcaatgaattggtagtaatggtaatgattcctgcattagaaaaaatgttgtcagaattcgatgcagctaaagtaaaaattagagaaaaggtaatgaacaaaaaacagaaagtgtaa

SEQ ID NO: 9756 - protein, 166 aa, Unknown
  Obtained from environmental sample
  misc_feature (1)..(166): Xaa is any amino acid
MKNLEHYNLLSELFIYPKTDIFEKVVEIQEFLNKNYPEAGKEFVRFSEFIANSTFYQIEEIFQKTFHIQAICFLDLGYVIFAEDYKRGEFLVNMKVEQEKYNNDYEHELADNLPYVLRLLPLHKEESFINELVVMVMIPALEKMLSEFDAAKVKIREKVMNKKQKV

SEQ ID NO: 9757 - DNA, 603 bp, Unknown
  Obtained from environmental sample
  misc_feature (1)..(603): n is a, c, g, or t
atgatagctactaaataccttgcgattgataaaagtgttattactgaaggtatgacatttaaattcaatatatatatacaatcatcagaaacaaatatggactgttttaaagaaaatggttcaactttaaacagtgacgataaaataatcatcgacactcagcatgctttgtatgtagaagaaactgaactttctaagtatgaatctttttacaaaaactttttactcactcaacaagagctaaagaatatcaaacttgataataaaccatctgctttatatgcaaatgcttctaatgttcttaatgaactttttgctaaccctgaattactaagtaattatacatccactaaggaagttatacaggatatgatagataccatattaagggatagttttactattaaatctttgatggatattgcaactcatgattaccatactcatacccattcgataaatgtttctatatatgcactaagtttaggtgcttttatgaaaatgcagcctgagacactttctgaactttgggaatccgctcttttgcatgatattggaaaaagtaaaatagactctgcaatactaaataaaaacggaacttaa

SEQ ID NO: 9758 - protein, 200 aa, Unknown
  Obtained from environmental sample
  misc_feature (1)..(200): Xaa is any amino acid
MIATKYLAIDKSVITEGMTFKFNIYIQSSETNMDCFKENGSTLNSDDKIIIDTQHALYVEETELSKYESFYKNFLLTQQELKNIKLDNKPSALYANASNVLNELFANPELLSNYTSTKEVIQDMIDTILRDSFTIKSLMDIATHDYHTHTHSINVSIYALSLGAFMKMQPETLSELWESALLHDIGKSKIDSAILNKNGT

SEQ ID NO: 9759 - DNA, 714 bp, Unknown
  Obtained from environmental sample
  misc_feature (1)..(714): n is a, c, g, or t
atgagtcatattgataacacacaaatatccaatatcattgaaaatcataaaaagatatttggaacacctaaagatttaaaattaggaagttatttagatattaaagataatatcttctctctttacagactattctgtcttttagatgacagctatgataataaactaaatagaagttttttatatgatacgttagctaccatatctgtgttaaatgatatagtcaaagatagtaatactcaattccaagagatcttaacagcgattgcagatactagactatactattttgaccaacttatatgtcgtagagctaatcattctacagaaacaaaaaactatttaagaactagacatatttacaaacttttaagcacgcagcactttatggacataacaaaaaaagagtttaaccatactgtacattcagagcatctctcaacaaactcatatcccacaataacatataagaaaagtattataaactatatactttctatcccagagttaaataaaaaagctaatagctttgatcctattctaaataaactcatagaatcaaaaagtaaaatcgcactctttaaagatatgatagatgatgatataagaaaccttatcactatatttaaatttacagtttatcaacctggtgagacaattataaaagaaggtgaagttagcacagatatatttttcatattagaaggtgaatga

SEQ ID NO: 9760 - protein, 237 aa, Unknown
  Obtained from environmental sample
  misc_feature (1)..(237): Xaa is any amino acid
MSHIDNTQISNIIENHKKIFGTPKDLKLGSYLDIKDNIFSLYRLFCLLDDSYDNKLNRSFLYDTLATISVLNDIVKDSNTQFQEILTAIADTRLYYFDQLICRRANHSTETKNYLRTRHIYKLLSTQHFMDITKKEFNHTVHSEHLSTNSYPTITYKKSIINYILSIPELNKKANSFDPILNKLIESKSKIALFKDMIDDDIRNLITIFKFTVYQPGETIIKEGEVSTDIFFILEGE

SEQ ID NO: 9761 - DNA, 552 bp, Unknown
  Obtained from environmental sample
  misc_feature (1)..(552): n is a, c, g, or t
atgaaaaatcaagaatacaaatactatagtgtagagggagtatatgccgatgaaaaatcacgatttagtatcctatatactaatgtaaaaatagaaaactttatatactttagtccagttggttttatcaatattgacgaccatacaattaaaacacaaaattggatttttgattatacttatgagttgtctgcaaagcataaactgcaattaaactattatagaacaagtttgagtgagacactaaataattcaagcaaaggtggatatataaaattcacaggtgagtttgataaatttgattattttacttcattaatttatagaaatggttatagttttacaacagtaaatgttccaaatagttataactttaatttaggtgccacttatcacttttcgaaagatatatctataagtttaaaaggggaaaatctccttaataaatccacaaaatccctttataaagatggactatttgatacaggtacaaacttcgctttagaggattatcaaagagaagtaactcttagtatgaagtgggtgttttaa

SEQ ID NO: 9762 - protein, 183 aa, Unknown
  Obtained from environmental sample
  misc_feature (1)..(183): Xaa is any amino acid
MKNQEYKYYSVEGVYADEKSRFSILYTNVKIENFIYFSPVGFINIDDHTIKTQNWIFDYTYELSAKHKLQLNYYRTSLSETLNNSSKGGYIKFTGEFDKFDYFTSLIYRNGYSFTTVNVPNSYNFNLGATYHFSKDISISLKGENLLNKSTKSLYKDGLFDTGTNFALEDYQREVTLSMKWVF

SEQ ID NO: 9763 - DNA, 750 bp, Unknown
  Obtained from environmental sample
  misc_feature (1)..(750): n is a, c, g, or t
ttgagtattgccaaaaaaatatatgaaatctctattgctcgacttgagagcggtacaatttctcagggtataaaacttcaagctcaagtagattatgaaatgagtaaaaactcaaaaagtactttatctttagctgcaatggatagctattactcactcttaaagattgcaggaataagcaaagaaatagagcttgaaaatgattatgaatttaaaataaactctaatatagagaatattgaaaatcctacaattaaggtcttgcgaagtcaacaatatcaagcactatcagaagcacaactaaattctaacactgttgaatcgatagacttatttgcagagatagaaaatgaaccagagcaagatgtacttagagttggagtgaatcttccattagctatttttaacaacaggtctcaagaaaagacgatagcaatgcttcaagcttcacgtatagagcttttaatgaagaatgagaacgctcgtttaaatatggactttattagacttaaaaaagaaagaaaagcactagttgagttaaatgtaaataatgaaaaaatattgaaaactcaactaaaacttttaaaaatgtatgaagatggatataagatttcaaatataaatctactacaactccaagacattaaacataaagttattcaaacaaaaagagctcttatacaaatctatacagcattaaatcaaaatgctatatatacaaatttttatcaaggaacttacaatgaatag

SEQ ID NO: 9764 - protein, 249 aa, Unknown
  Obtained from environmental sample
  misc_feature (1)..(249): Xaa is any amino acid
MSIAKKIYEISIARLESGTISQGIKLQAQVDYEMSKNSKSTLSLAAMDSYYSLLKIAGISKEIELENDYEFKINSNIENIENPTIKVLRSQQYQALSEAQLNSNTVESIDLFAEIENEPEQDVLRVGVNLPLAIFNNRSQEKTIAMLQASRIELLMKNENARLNMDFIRLKKERKALVELNVNNEKILKTQLKLLKMYEDGYKISNINLLQLQDIKHKVIQTKRALIQIYTALNQNAIYTNFYQGTYNE

SEQ ID NO: 9765 - DNA, 432 bp, Unknown
  Obtained from environmental sample
  misc_feature (1)..(432): n is a, c, g, or t
gtggaagagcaaaacccttctaaagttatttttaatgaagagagtgcttatgtacttttagtacttaaaaagaaacaagccaacaggtttaacggaattttagggattgttcccgatgaaacaggaaaggttagattaaacggagatgtaaaacttaatttaatgaactcttttaagcgtggagaagaaatttcgttcaattggagagccatgcaaaacaattcacaagatttaaaattgactacagcttatccttttttattcagcagtccttttggagccgaataccaactaaatatttataaaagagacagtacctatatagatgtctttaataaaattggagcaagatacattctaaaaggaaataattatttcaatatattctatcacaacaaaagttctagcttattatctcaaaagaggttttga

SEQ ID NO: 9766 - protein, 143 aa, Unknown
  Obtained from environmental sample
  misc_feature (1)..(143): Xaa is any amino acid
MEEQNPSKVIFNEESAYVLLVLKKKQANRFNGILGIVPDETGKVRLNGDVKLNLMNSFKRGEEISFNWRAMQNNSQDLKLTTAYPFLFSSPFGAEYQLNIYKRDSTYIDVFNKIGARYILKGNNYFNIFYHNKSSSLLSQKRF

SEQ ID NO: 9767 - DNA, 342 bp, Unknown
  Obtained from environmental sample
  misc_feature (1)..(342): n is a, c, g, or t
atgcaaaacaatcatttttataacaatgatttcttctctagcaacctcaacaaatggttgttcgtttttatatttagcttatttatactttctactttaacaaattcttttgctcaaagtaaaaaagttagtgtaatttttaatgatactattctttcctcaaaacaacaaaaagaacttttattaacaagtacaaacagtagttttatcaatataaacaatgttgtaaaaaatataaaccaacggctttataaaaatgcttatttaacagctcatatagatagtataacctccgattctaccacatattttctccactatccttttaggaaaaccaaataa

SEQ ID NO: 9768 - protein, 113 aa, Unknown
  Obtained from environmental sample
  misc_feature (1)..(113): Xaa is any amino acid
MQNNHFYNNDFFSSNLNKWLFVFIFSLFILSTLTNSFAQSKKVSVIFNDTILSSKQQKELLLTSTNSSFININNVVKNINQRLYKNAYLTAHIDSITSDSTTYFLHYPFRKTK

SEQ ID NO: 9769 - DNA, 858 bp, Unknown
  Obtained from environmental sample
  misc_feature (1)..(858): n is a, c, g, or t
atggaggtaaagcattggcttttcgaaaatacaggaacggacttccctattcttattaatgcttttggttcgcttaagcgaatgcaattatctataggagttaaggatttagatgatataggaaaagaaatggaagccatattcaaggaacttactggacctaaagagaatcttttatcaaaattaaaattcctaccacaactggggaaaattgcttcttggatgccaaaacaaatatcaggaaaaggaatttgtcaagaagtagttcatcatgaccctgatttaagtataatacctgttttaaaaacttggcccaatgatggtggaaagtttgtaacactcccaatggttaatactattgacccacatactaacatcaggaatattggcatgtatcgtttgcaaattctagataagaattcaacggggatgcattggcacaagcacaaagttggagctagacattataacgaatataaaaagctaggaaagagaatgccaatagcagtaactctaggtggggatcctgcatatacttattcagctacagctcctctacctgacaatatcgacgaatacatgttagcgggatttcttcgaaagaaaaaagtagagcttgtaaaatgcataagcaataatatttacgttcccaaagatgtagattttgtgatagaaggttatgtagatactgatgaagatttcatatgggaaggcccttttggcgaccatactggcttttattctcttgcagattggtatcccaaatttcacgtcacttgcatcactcacaagaaaaatgcaatctaccctgcgacnaatgtagggatccctccgatggaagacgcttaccttgggtaa

SEQ ID NO: 9770 - protein, 285 aa, Unknown
  Obtained from environmental sample
  DOMAIN (1)...(285): 3-octaprenyl-4-hydroxybenzoate carboxy-lyase
  misc_feature (1)..(285): Xaa is any amino acid
MEVKHWLFENTGTDFPILINAFGSLKRMQLSIGVKDLDDIGKEMEAIFKELTGPKENLLSKLKFLPQLGKIASWMPKQISGKGICQEVVHHDPDLSIIPVLKTWPNDGGKFVTLPMVNTIDPHTNIRNIGMYRLQILDKNSTGMHWHKHKVGARHYNEYKKLGKRMPIAVTLGGDPAYTYSATAPLPDNIDEYMLAGFLRKKKVELVKCISNNIYVPKDVDFVIEGYVDTDEDFIWEGPFGDHTGFYSLADWYPKFHVTCITHKKNAIYPATNVGIPPMEDAYLG

SEQ ID NO: 9771 - DNA, 621 bp, Unknown
  Obtained from environmental sample
  misc_feature (1)..(621): n is a, c, g, or t
atgttacacttcgaaaccatcgacccctcacactgggaacttttaactcatcttcaaaaaatcgaaggtttaaatcgatctcgtttagttggaggaaccggtttatcgctgcaaatggggcaccgtaaatctgtcgacctcgacttttttgcctacgaactaaaggaggattttttatctattcttgcatctataaaaaacgaagggtttaaagtagaaataagaagccagtcctcaaatatcctgataacaatgattgagaatgtaaaagttgacattgtaaattatccttatccatggatcgacaaacaaatatctgaagacaacatcattttagcttctgacaaggacattgcagcgatgaagctctctgcaattacaaacagaggaagcaaaaaggattttatcgatttatattatctattaaaaaaatactccttagaaaaaatgctttctttctattcccaaaaatacaacgatggctctgactttatggtgctaaaaagcttaacatatttcgacgatgcagaaatagaagcgccaccacttttgtttgacaaatcaattacctgggcaaacataaaagagaaaataaacgtggaagtaaagaaactgatataa

SEQ ID NO: 9772 - protein, 206 aa, Unknown
  Obtained from environmental sample
  misc_feature (1)..(206): Xaa is any amino acid
MLHFETIDPSHWELLTHLQKIEGLNRSRLVGGTGLSLQMGHRKSVDLDFFAYELKEDFLSILASIKNEGFKVEIRSQSSNILITMIENVKVDIVNYPYPWIDKQISEDNIILASDKDIAAMKLSAITNRGSKKDFIDLYYLLKKYSLEKMLSFYSQKYNDGSDFMVLKSLTYFDDAEIEAPPLLFDKSITWANIKEKINVEVKKLI

SEQ ID NO: 9773 - DNA, 693 bp, Unknown
  Obtained from environmental sample
  misc_feature (1)..(693): n is a, c, g, or t
ttgccaaaatatctactttacatatcaattatagtgccttcggtgttggtgtgtttggggttggtaatatacttgtatcaagagtatttaatattttatcctgaaaagctttctgagaaacatatttttaaatttagtgaaccctttgaagagtttgacatacacacctcagatggtgaaaagataaatataataatgtttaaagctgaaaatgctaaagggttggtttattatcatcatggaaatgcaggtagtttagagcattggggattaaaagctgttgattttactaaaagaggttacgatgtgttaatgtatgattacagaggtttcggaaaaagcacaggaaaaattaagaatgaaagaatgctttataaagatgcacttttaatttataaagaaatagaaaaaagatatacgtttgataaaattattttttatggaatatcattagggtctggtattgcagcaaagttggctcatgaaataacaccaagcacattaattttagaaacaccttattataatttttatgaggtttctaaatttcattatccttatttacccaactctatattattacattatcagtttaaaactaataaaaggttgccagaaataaatgttcctatttttttaatacacgggctagaagatgaaattgttttattngaaaccctctgtggtccgtaa

SEQ ID NO: 9774 - protein, 230 aa, Unknown
  Obtained from environmental sample
  misc_feature (1)..(230): Xaa is any amino acid
MPKYLLYISIIVPSVLVCLGLVIYLYQEYLIFYPEKLSEKHIFKFSEPFEEFDIHTSDGEKINIIMFKAENAKGLVYYHHGNAGSLEHWGLKAVDFTKRGYDVLMYDYRGFGKSTGKIKNERMLYKDALLIYKEIEKRYTFDKIIFYGISLGSGIAAKLAHEITPSTLILETPYYNFYEVSKFHYPYLPNSILLHYQFKTNKRLPEINVPIFLIHGLEDEIVLXETLCGP

SEQ ID NO: 9775 - DNA, 660 bp, Unknown
  Obtained from environmental sample
  misc_feature (1)..(660): n is a, c, g, or t
atgaaatatacagcgataatattagctgcaggaagcggcaaaagaacagggctaaaaatcaataaaattttgcatgaaattaacggtaaaagagtaatagaatatagccttgattttttcaaattagataagaattgcatcgacattatattggtcgcatctagtgttgattttaatttttttgtggaacattataacataggaaaagcaaaagtagttttaggtggagatacaaggcaagatagtgttagattagcacttggaaatgctgaatgtgattatgtccttatacatgatggagctagaccatatattacaaaaaaatcagttgatcatatccttgctagtttaagcaataacccctcagttaccttaggagttaaagtcaaagaaactattcaagaagttgaaggaaactatgtagttaaaactttagatagaagtaatctaatcattactcaaacccctcaaggttttaataaaaagatacttattgaagcacatgatattgctttgaagagagaatattatggaactgatgacactgtacttcttgaagagtttatgtatacgaaagcggcttttatagaaggtgactatagaaacataaagttaacaacaattggagatattaaattgttagaggtgattttgttttga

SEQ ID NO: 9776 - protein, 219 aa, Unknown
  Obtained from environmental sample
  DOMAIN (3)...(218): Uncharacterized protein family UPF0007
  misc_feature (1)..(219): Xaa is any amino acid
MKYTAIILAAGSGKRTGLKINKILHEINGKRVIEYSLDFFKLDKNCIDIILVASSVDFNFFVEHYNIGKAKVVLGGDTRQDSVRLALGNAECDYVLIHDGARPYITKKSVDHILASLSNNPSVTLGVKVKETIQEVEGNYVVKTLDRSNLIITQTPQGFNKKILIEAHDIALKREYYGTDDTVLLEEFMYTKAAFIEGDYRNIKLTTIGDIKLLEVILF

SEQ ID NO: 9777 - DNA, 381 bp, Unknown
  Obtained from environmental sample
  misc_feature (1)..(381): n is a, c, g, or t
atgctcacatattttgaagcacaagcagatagtttattaagtcaaattgagaatgattcatggtttaataagatagaaaaagagatattgaaaaatattggagataaagatatatctataaattttattgcctcgtatttaaatataagtgctagaactttacaaaattatttaaaatcagaatcaaaaacttttagtgaggctttgggaaatgtaagaaagaaactagcgaaacattatattttaaatactaaattagatgatgcaacaatatcttttttgttaggatattctgaggtaagtgctttttatagagcctataaaaaatggaatggcacaacgccaaaagagttaagggaaaaaagtaaactatttaattaa

SEQ ID NO: 9778 - protein, 126 aa, Unknown
  Obtained from environmental sample
  DOMAIN (76)...(120): Bacterial regulatory helix-turn-helix proteins, AraC family
  misc_feature (1)..(126): Xaa is any amino acid
MLTYFEAQADSLLSQIENDSWFNKIEKEILKNIGDKDISINFIASYLNISARTLQNYLKSESKTFSEALGNVRKKLAKHYILNTKLDDATISFLLGYSEVSAFYRAYKKWNGTTPKELREKSKLFN

SEQ ID NO: 9779 - DNA, 591 bp, Unknown
  Obtained from environmental sample
  misc_feature (1)..(591): n is a, c, g, or t
gtgggaagtatcatccataattgtcttgaagaagctgtaaaaaaaagtgaattgaataatcaatttattcataagtatttggtatcgtttcaaaaatcaaatccttatcttgtactagaacttgaactttggaagaaaaagcttgaaaaacttgtagagttcgaaaaagtaagagctgcaaatgggattacaatccaaagtgtagaacaaccgtttaatttagtttataatggtgttacaatcaaaggaaaaattgatagaatagataagcatagtgatggtacttttgagatacttgactataaaacatcatcgagtttaaaaatagacacaccaaaaacttatgaagattctgtagattttcaactagaattttattatttaagtcaaagagataagatgataaaaagtgtagggtattatgatcttaacgatagttctataaaaagtgaagtggtacttaatgagaagttagaatatcttgatatgcattttcaaagactaaaaacgacaagtgtaaattttgctttgaccgataaactctcaagttgtcaattttgtccatatagtattatttgtcaaagagattaa

SEQ ID NO: 9780 - protein, 196 aa, Unknown
  Obtained from environmental sample
  misc_feature (1)..(196): Xaa is any amino acid
MGSIIHNCLEEAVKKSELNNQFIHKYLVSFQKSNPYLVLELELWKKKLEKLVEFEKVRAANGITIQSVEQPFNLVYNGVTIKGKIDRIDKHSDGTFEILDYKTSSSLKIDTPKTYEDSVDFQLEFYYLSQRDKMIKSVGYYDLNDSSIKSEVVLNEKLEYLDMHFQRLKTTSVNFALTDKLSSCQFCPYSIICQRD

SEQ ID NO: 9781 - DNA, 510 bp, Unknown
  Obtained from environmental sample
  misc_feature (1)..(510): n is a, c, g, or t
atggctcggtggtttatatttggacatcgctacacaatgaaatcagatgtggggcaagatgcagataatgcttttttatctacttatcaagatgtagatagaaactataataatatgatggaatcaaataaaatatttggtagtaaatataatgtgaagtttttatttaataatcaagaggtagtagggctttctatagaagatgtttttttagctcaaagatctattcaggcgagaaaagatagaaaagatatggtaaatgttggagagaataaatttacaatattagtacaagataaagatggaaatgatataacaaataagactgtgaagatattagtaacaaagaatactacacatacagaagatgtgaaattagagtatcaaaatgaagatacaaaagagtttacaataaactcaataggatattggaatataactggaactattgatatccaaggagataagggattcttttatataaaaacaaatgctaaaaaagaatcttaa

SEQ ID NO: 9782 - protein, 169 aa, Unknown
  Obtained from environmental sample
  misc_feature (1)..(169): Xaa is any amino acid
MARWFIFGHRYTMKSDVGQDADNAFLSTYQDVDRNYNNMMESNKIFGSKYNVKFLFNNQEVVGLSIEDVFLAQRSIQARKDRKDMVNVGENKFTILVQDKDGNDITNKTVKILVTKNTTHTEDVKLEYQNEDTKEFTINSIGYWNITGTIDIQGDKGFFYIKTNAKKES

SEQ ID NO: 9783 - DNA, 444 bp, Unknown
  Obtained from environmental sample
  misc_feature (1)..(444): n is a, c, g, or t
atgctaaaaaagaatcttaaaaattcacttgtagtttttcctacatcaagagctataaggtatcaccttggctctttaaaaaatcaaaatctacttttaaataaaaatattgctataggagagtttttctctcttgttacacttgaaaaagataacaaaaacttttgtgataaaaatcttaaaattctttatctcaaagaagctattagttctattgatatagaaactttaggttttagtggagatttcagtacttttttaaaacaaagtgattatatctttcgattttttactgaaactgcaaatgagtatatagagtttgaaaaacttttagagtttgatacatatgccttgtatagtgaccatattgagatactgaaaaatattcaccaaaactatatagagatttttagaaaaaaatggttatacagatactattttaat

SEQ ID NO: 9784 - protein, 148 aa, Unknown
  Obtained from environmental sample
  misc_feature (1)..(148): Xaa is any amino acid
MLKKNLKNSLVVFPTSRAIRYHLGSLKNQNLLLNKNIAIGEFFSLVTLEKDNKNFCDKNLKILYLKEAISSIDIETLGFSGDFSTFLKQSDYIFRFFTETANEYIEFEKLLEFDTYALYSDHIEILKNIHQNYIEIFRKKWLYRYYFN

SEQ ID NO: 9785 - DNA, 906 bp, Unknown
  Obtained from environmental sample
  misc_feature (1)..(906): n is a, c, g, or t
gtggagagttttgctggtgcaggggatttatttagattaaaaacattagctaattgttttgttacagttattaaagaagataacattgaatctatctacaatgctgcatatgattgtgcaagaacttattcatatggtggtggaattggtgtggacatcacccctttaagaccaaaggattctattgtacataatgcagcagataaatctactggtgcagtttcatttatggacttgtattctatgactactggtttaataggtcaatcaggaagacgtggtgctttaatgataactcttgacgttaaacatcctgatgttattgattttattaaagttaaacaggaatcaaattggataacaaatcaaattgttgatcaatgtacttggtcaggtaaatttgatgataatcaattatctgaaattaaaaaacaagttagagaaaatactcaagttagattcgctaatattagtttaaaagttagcgatgaatttatgaatgctgttgatgaaactcataaatataaaaaaggttcattcctattatataaaaaattaacagaagaaaagatttatgaagctcctcaaaatgaagagattcattatgcatttaagattccttctaaaactttatcagattatgaatttataaaagattttgaaacattagaagaattaaatactcatattaatgcaaatattacaaaagaagatttagatgattctcataaaagagatttatttggtgattatttagtagaagattttgcagttcatagatgtggagattttatgacttattttggttctgaaaatacagaaggaacaaaagaaaatgtagatgtcacagaaatttggaatgcatttgtggcaggaaattataccactgcagaacccggtccttaa

SEQ ID NO: 9786 - protein, 301 aa, Unknown
  Obtained from environmental sample
  misc_feature (1)..(301): Xaa is any amino acid
MESFAGAGDLFRLKTLANCFVTVIKEDNIESIYNAAYDCARTYSYGGGIGVDITPLRPKDSIVHNAADKSTGAVSFMDLYSMTTGLIGQSGRRGALMITLDVKHPDVIDFIKVKQESNWITNQIVDQCTWSGKFDDNQLSEIKKQVRENTQVRFANISLKVSDEFMNAVDETHKYKKGSFLLYKKLTEEKIYEAPQNEEIHYAFKIPSKTLSDYEFIKDFETLEELNTHINANITKEDLDDSHKRDLFGDYLVEDFAVHRCGDFMTYFGSENTEGTKENVDVTEIWNAFVAGNYTTAEPGP

SEQ ID NO: 9787 - DNA, 675 bp, Unknown
  Obtained from environmental sample
  misc_feature (1)..(675): n is a, c, g, or t
gtggtggaaatctctgaaatgcatctatctcttcatgagcaaatccatgaaacttttgctgagatacggggagaatttgaagaacttataaaagatttaaaaggggaacagctagatgaacttgctcttcttaattttcaaatccctgtagtagttttacactttcatactcttgttgaaaatattaaagccaatttagaagaagaccataatggtgaggataaatctaatgagaaaaacaaagagttattttcaggttttcctaaatttgaggattggtggattaaagagttatggataaatcatcaggcttattttggattatataaatggaaaactatcatctcttccttatgtcaatcatctgatcaacaaagagcatgggaagttatttttgcgaactgggtaaatataaaaaaacaaatcacatctaaaggtgcattagcatttgaatataactatgcttttgacacccttatacgaaactatagtggtttagaagaggagttagcaacaacaagtttagagtctatggaaaagttgataaactatttaactaataaagaagattttacaaaaatggcatctccgaatgaacatgaacttataacaaaatatacaaaatttaaaagagaaaaaattgattataaagatgtaaaaggtaaaaaatcttaa

SEQ ID NO: 9788 - protein, 224 aa, Unknown
  Obtained from environmental sample
  misc_feature (1)..(224): Xaa is any amino acid
MVEISEMHLSLHEQIHETFAEIRGEFEELIKDLKGEQLDELALLNFQIPVVVLHFHTLVENIKANLEEDHNGEDKSNEKNKELFSGFPKFEDWWIKELWINHQAYFGLYKWKTIISSLCQSSDQQRAWEVIFANWVNIKKQITSKGALAFEYNYAFDTLIRNYSGLEEELATTSLESMEKLINYLTNKEDFTKMASPNEHELITKYTKFKREKIDYKDVKGKKS

SEQ ID NO: 9789 - DNA, 846 bp, Unknown
  Obtained from environmental sample
  misc_feature (1)..(846): n is a, c, g, or t
ttgcggccgaaaatatgccgggaatttattgagaatccctatgtaaagtcccatgtgatcgggtttctggatgatgatgtttccaaaataggaaaaaagattcatggggtatctgttttaaatgtgattgatgagcttgaacatacggtgaaatccgcagatgtggatgaggttattattgcaatttccaatgcaagttcggaacggatgagacagattatggaggcatgcaaaaaaacagatattaattttaaaattattcccaatatgggggaagtgattgatggaaaaataaatatcagctccatcagaaatgttgagtatcgggatcttttaggcagggagcctgttaagcttgataaagctgaaattggaaaatatcttggcaataagcgggtgcttgttacgggggcaggcggctccataggaagcggtctttgccgtcagatctgcagatattctcctgaaaaaattatcctttttgaaagagctgaaagtcccctttatgagattgatcttgagcttaagaaaaactttcaggatgttgaggtcataccggtgttgggggatatccagaataagacggagttgaataaaatatttgaagagtttttgcctgatattgtattccatgccgcagcatacaagcatgttcccatgctggaaaatcatccctggaaggcagtggagaataatattaaagggacccggaaccttgttgaggttacccataaattcaaatgtgaaagatttgtttttgtttccaccgataaagcagtaaaccccgaccatgtcatgggaacccgtaagcggatctctgaaattttggtccagaatatgaaataa

SEQ ID NO: 9790 - protein, 281 aa, Unknown
  Obtained from environmental sample
  DOMAIN (1)...(281): Polysaccharide biosynthesis protein
  misc_feature (1)..(281): Xaa is any amino acid
MRPKICREFIENPYVKSHVIGFLDDDVSKIGKKIHGVSVLNVIDELEHTVKSADVDEVIIAISNASSERMRQIMEACKKTDINFKIIPNMGEVIDGKINISSIRNVEYRDLLGREPVKLDKAEIGKYLGNKRVLVTGAGGSIGSGLCRQICRYSPEKIILFERAESPLYEIDLELKKNFQDVEVIPVLGDIQNKTELNKIFEEFLPDIVFHAAAYKHVPMLENHPWKAVENNIKGTRNLVEVTHKFKCERFVFVSTDKAVNPDHVMGTRKRISEILVQNMK

SEQ ID NO: 9791 - DNA, 534 bp, Unknown
  Obtained from environmental sample
  misc_feature (1)..(534): n is a, c, g, or t
ttggtttttgacccttgggtattatttcatattctggaccaaaatttcagagatccgcttacgggttcccatgacatggtcggggtttactgctttatcggtggaaacaaaaacaaatctttcacatttgaatttatgggtaacctcaacaaggttccgggtccctttaatattattctccactgccttccagggatgattttccagcatgggaacatgcttgtatgctgcggcatggaatacaatatcaggcaaaaactcttcaaatattttattcaactccgtcttattctggatatcccccaacaccggtatgacctcaacatcctgaaagtttttcttaagctcaagatcaatctcataaaggggactttcagctctttcaaaaaggataattttttcaggagaatatctgcagatctgacggcaaagaccgcttcctatggagccgcctgcccccgtaacaagcacccgcttattgccaagatattttccaatttcagctttatcaagcttaacaggctccctgcctaa

SEQ ID NO: 9792 - protein, 177 aa, Unknown
  Obtained from environmental sample
  misc_feature (1)..(177): Xaa is any amino acid
MVFDPWVLFHILDQNFRDPLTGSHDMVGVYCFIGGNKNKSFTFEFMGNLNKVPGPFNIILHCLPGMIFQHGNMLVCCGMEYNIRQKLFKYFIQLRLILDIPQHRYDLNILKVFLKLKINLIKGTFSSFKKDNFFRRISADLTAKTASYGAACPRNKHPLIAKIFSNFSFIKLNRLPA

SEQ ID NO: 9793 - DNA, 723 bp, Unknown
  Obtained from environmental sample
  misc_feature (1)..(723): n is a, c, g, or t
atggtatctaagaaggtcacagttattactaaaggtgcaaatgagacacaagcttataaatggactagtgaaggtactagtagttatacaataagtgaaacagaaaaagatgagataggtactactataattttaaatattagagataacaatgaagagttagaagaaaactttgatgagtacttaagagaatatacaattaagaacttagttaagaagtatagtgattatgttaggtatccaattaagatggatgtaacgaaaactgattatcctgaagatgataaagaaaaagcagttgaatatagtgaaactgaaatactaaattcaatgattcctgtatggaaaaaaagtaaatcggatattaaagatgaagattttaatgagttttataaacatcaatttaatgattataccgatccattaaaagtaattcattcaaaagtagaaggattaacaacttatacaagtcttttattcattccaaaaaaagcacctgtagatttatattctgagaagtttgaaaaagggcttcagttatatagtaaaggtgtattcatcatggataagaacaaagaacttatacctgaccatttccgctttgtaagagggttggttgattcaagtgacttatcattaaatatctcaagagagatgttacaacatgatcgtcaattgaaaaagatagctagtcatttagagaaaaaaattaatccgagttag

SEQ ID NO: 9794 - protein, 240 aa, Unknown
  Obtained from environmental sample
  DOMAIN (60)...(240): Hsp90 protein
  misc_feature (1)..(240): Xaa is any amino acid
MVSKKVTVITKGANETQAYKWTSEGTSSYTISETEKDEIGTTIILNIRDNNEELEENFDEYLREYTIKNLVKKYSDYVRYPIKMDVTKTDYPEDDKEKAVEYSETEILNSMIPVWKKSKSDIKDEDFNEFYKHQFNDYTDPLKVIHSKVEGLTTYTSLLFIPKKAPVDLYSEKFEKGLQLYSKGVFIMDKNKELIPDHFRFVRGLVDSSDLSLNISREMLQHDRQLKKIASHLEKKINPS

SEQ ID NO: 9795 - DNA, 606 bp, Unknown
  Obtained from environmental sample
  misc_feature (1)..(606): n is a, c, g, or t
ttgggtgcagcttatatgccatatatcgaagaagctttaaaacaaaagttgataaaaaaaccttttaaagattataaatttcctatatttgattttagaataaaagagatacactcaatctccatgagcggacacaaatatattggctcgccttggcctacaggtatttatatgtcaaaagtaaaatatcagttaaaaccagttgatgaccctatgtatattggctctcctgacactacttttgcaggttctagaaatgcattttctccgttaatattttgggaatatttatcaaacaactcatctaaagatcatataaaagatgttgtaaagtgtgaaaacatggcacaatatgcttttgataaattaaatgctttagataaaaacaataaagcatggattcaaagatcacctttttctttaactattagaatgaaaataccaaataaaaagcttgtatttaagtattcattgtcaacagaagagttgtatgtaaatggtaaaaaaagagaatatgcacatatttatattatgagtcatgtttcaaaaaaattgattaatagctttattaaagatttagaaaaatcaaattactttattggataa

SEQ ID NO: 9796 - protein, 201 aa, Unknown
  Obtained from environmental sample
  misc_feature (1)..(201): Xaa is any amino acid
MGAAYMPYIEEALKQKLIKKPFKDYKFPIFDFRIKEIHSISMSGHKYIGSPWPTGIYMSKVKYQLKPVDDPMYIGSPDTTFAGSRNAFSPLIFWEYLSNNSSKDHIKDVVKCENMAQYAFDKLNALDKNNKAWIQRSPFSLTIRMKIPNKKLVFKYSLSTEELYVNGKKREYAHIYIMSHVSKKLINSFIKDLEKSNYFIG

SEQ ID NO: 9797 - DNA, 903 bp, Unknown
  Obtained from environmental sample
  misc_feature (1)..(903): n is a, c, g, or t
ttggcaattcatgggctaccaacattagttcagctgttggagcatgtggaaaaggaaaaatgccttttcgggcagttaaaaattctgaacgtagggctttttctaagagttggctggtttgcattattttgttttatatttcctaatttcgcttttcaaaattacgataaaaatacgatggaatttaaaaaagcgagcaaattagaccctaaagaaaacttgatttttcttatcacgaatgaaaaagaattaacaacatcatctttttcaaaagatgagctatcatatattaaaaaagaacttaaaaacgaacaaaaacaagttgaaattaatagactaaatagctatgcttttgttattttatgtgataaagaaaatgattataaagctgctgaaaaaattagaatttccgctagtaacttgctaactacattaaacaataagaaaatacaatcagccacattaataggtgatgatattaaaattactccctttattgaaggaatagggttagctaattatcaatttttaaaatattattctgataaaaaagaaaacacttttaaaaccctaagctatttcacaaagagcaaaactgacaatataaaagagacccaagctgttgttgaagctaccaatttcgctaaagatttggtaaatgaacctttgtcttttttaacagcaacacaactttctaaagaaatagagtcatatggaaaagcttatggttttaaagtggaagtattaaataaagctaaaattgaagccttaaaaatgggtggattattagctgtaaataaaggtagtattgatccgccaacattttctattttagaatggaagccagccaaagctaaaaataaaaaaccgatagttttagtcggaaaagggtgttgtttatga

SEQ ID NO: 9798 - protein, 300 aa, Unknown
  Obtained from environmental sample
  DOMAIN (212)...(298): Cytosol aminopeptidase family, catalytic domain
  misc_feature (1)..(300): Xaa is any amino acid
MAIHGLPTLVQLLEHVEKEKCLFGQLKILNVGLFLRVGWFALFCFIFPNFAFQNYDKNTMEFKKASKLDPKENLIFLITNEKELTTSSFSKDELSYIKKELKNEQKQVEINRLNSYAFVILCDKENDYKAAEKIRISASNLLTTLNNKKIQSATLIGDDIKITPFIEGIGLANYQFLKYYSDKKENTFKTLSYFTKSKTDNIKETQAVVEATNFAKDLVNEPLSFLTATQLSKEIESYGKAYGFKVEVLNKAKIEALKMGGLLAVNKGSIDPPTFSILEWKPAKAKNKKPIVLVGKGCCL

SEQ ID NO: 9799 - DNA, 723 bp, Unknown
  Obtained from environmental sample
  misc_feature (1)..(723): n is a, c, g, or t
gtgggaaaagtcggaccacaacatatggagtattttaaaactctagataatattaaaaagacgaaattagagcttatgagctcaaagagattggaagctgcatttatacataactcagtaacagatgaagagcactcaaaagtgactttctttggtgataagataacaaatatagattcagatttggatggtacatcttttaatgtagtgattaacagaaaaccttatcaccttgagactaaagttttaggtagctttcaaactatgaatataaatgctgctcttctaatagcaaatagactgaacttttctccagatgagatgattgtagctgttgaatcacttaagagtgtagaacaccgtcttgaaagaatagatgcaggaggaaagataattttagatgatggttataatggaaatatagatggaatgctagaaggtattcgtctgtgttcacttcataatggcagaaaagtgattgtaactcctggacttgttgagagtagtgaagagttaaatatgaaacttattgattccattaataaaaactttgatgtagctatagttacaggagttttaaatgcaaaactatttgataagaatctaaatgtatcacaaaagattttactaaatgataagagtgcattagagagtattttggcaaaagtaacatatagcggtgatattatatattttgcaaatgatgcaccaaactttatatag

SEQ ID NO: 9800 - protein, 240 aa, Unknown
  Obtained from environmental sample
  DOMAIN (118)...(200): Mur ligase family, glutamate ligase domain
  misc_feature (1)..(240): Xaa is any amino acid
MGKVGPQHMEYFKTLDNIKKTKLELMSSKRLEAAFIHNSVTDEEHSKVTFFGDKITNIDSDLDGTSFNVVINRKPYHLETKVLGSFQTMNINAALLIANRLNFSPDEMIVAVESLKSVEHRLERIDAGGKIILDDGYNGNIDGMLEGIRLCSLHNGRKVIVTPGLVESSEELNMKLIDSINKNFDVAIVTGVLNAKLFDKNLNVSQKILLNDKSALESILAKVTYSGDIIYFANDAPNFI

SEQ ID NO: 9801 - DNA, 813 bp, Unknown
  Obtained from environmental sample
  misc_feature (1)..(813): n is a, c, g, or t
atgggcgagtttttttggtacgggaacggaagtgatagtattgagttcatagagtattacatatcaaactaccgagattttatggactataaacaaggtgaaaacgcccctgttttgggtgcgtatggttctagaatgtttggtataaagaatcaatttaaagcgattaaagatcttctcaaacgaaagcctgaaacacgaagagctgtaatatcgatatatgataaagaagatctttttagggacgactctagagacattccttgtacctgttcattacagttcttcgtcagagataatgctctccacttgactacaataatgagatctaatgatgctactaagggcctaatacatgacttatttagttttacccttatccaagaactcatgtgggcagagttagcgaaggataatgaagcgttagaattaggcatctatacacacttcgttggcagtctacatatctatcatgaggataaaactacagttgataattttttacatattgaaggatggcaaaacaaagctacgatggaacccataaacccttcttatttagagaatgattttaataccattaaagaattagaagaaaagctgagaacaaagtctttacaggacgactttgatatccacagcattaaagatatattttggcaagagatagctataattctattgtcttattcatacgctaagcaaggtagacaaagcgaattaaaagagcttagagatttatgtagaagtgaccctatactctattttctagataaaaaaattaatgaaattaacagaaaaaattttaagtag

SEQ ID NO: 9802 - protein, 270 aa, Unknown
  Obtained from environmental sample
  DOMAIN (1)...(225): Thymidylate synthase
  misc_feature (1)..(270): Xaa is any amino acid
MGEFFWYGNGSDSIEFIEYYISNYRDFMDYKQGENAPVLGAYGSRMFGIKNQFKAIKDLLKRKPETRRAVISIYDKEDLFRDDSRDIPCTCSLQFFVRDNALHLTTIMRSNDATKGLIHDLFSFTLIQELMWAELAKDNEALELGIYTHFVGSLHIYHEDKTTVDNFLHIEGWQNKATMEPINPSYLENDFNTIKELEEKLRTKSLQDDFDIHSIKDIFWQEIAIILLSYSYAKQGRQSELKELRDLCRSDPILYFLDKKINEINRKNFK

SEQ ID NO: 9803 - DNA, 462 bp, Unknown
  Obtained from environmental sample
  misc_feature (1)..(462): n is a, c, g, or t
atgaaaaaaacgattaaaatcgaattcatatataaaagcattgttgcccttattggggtgacaatgcttttgtcttgtgaaaacaatattaaagaagttgagagtataactactcaagaaactcgtcctgaagtttatggagaaaatgttgcgtttacttatacagactcaacacgaattcaatataaagcattcgcaattgaatttttacaaataaaaactgaggaagaagaatataatgagtttcctaaaggagggagtgttgtttattacaataaagatggttcgcaagcatggacaataaaatgtaactatgctaagaatgtggttgctgataaattatgggagcttccaaacgacgttgttgctgntagtgatgacggtaaaaccaataaactccgaactgatgtattgggatcagaagaaacaaaagaactattcaaatcaatatgttcccatcac

SEQ ID NO: 9804 - protein, 154 aa, Unknown
  Obtained from environmental sample
  misc_feature (1)..(154): Xaa is any amino acid
MKKTIKIEFIYKSIVALIGVTMLLSCENNIKEVESITTQETRPEVYGENVAFTYTDSTRIQYKAFAIEFLQIKTEEEEYNEFPKGGSVVYYNKDGSQAWTIKCNYAKNVVADKLWELPNDVVAXSDDGKTNKLRTDVLGSEETKELFKSICSHH

SEQ ID NO: 9805 - DNA, 576 bp, Unknown
  Obtained from environmental sample
  misc_feature (1)..(576): n is a, c, g, or t
ttgaataaagggttaagctatactaaaaagatgttacaaaaagataataaaacagaatatttgatttttacagatttagatggaacactattggatcatgaaacatatgattttagtgaagctaaaataatgcttgattttatagataagcaaaaaatacctcttatcattgttacaagtaaaacaaaagatgaagttttagaacttcaaaaaaaactaaatatatcaatgccttttattatagaaaatggtgcaggaatctttattcctaaaaatgatgcctttgagcttattgctttaggaaaaacttacgagactacaattacaacttttaaaaaatattcaaaaaactttcccttaaaaggttttcaccaaatgagtgatacagaggtatccctatatactgaacttcccctagaaaaagcaaagttagctagaaaaagaacatttagtgaaccttttattttagaagatgagagtaaattagaggctttgaaaaaacttgcaattgaagatggatttgatgtggtaaaagngtggcagattttatcacttaattacttttggacaagataa

SEQ ID NO: 9806 - protein, 191 aa, Unknown
  Obtained from environmental sample
  misc_feature (1)..(191): Xaa is any amino acid
MNKGLSYTKKMLQKDNKTEYLIFTDLDGTLLDHETYDFSEAKIMLDFIDKQKIPLIIVTSKTKDEVLELQKKLNISMPFIIENGAGIFIPKNDAFELIALGKTYETTITTFKKYSKNFPLKGFHQMSDTEVSLYTELPLEKAKLARKRTFSEPFILEDESKLEALKKLAIEDGFDVVKXWQILSLNYFWTR

SEQ ID NO: 9807 - DNA, 747 bp, Unknown
  Obtained from environmental sample
  misc_feature (1)..(747): n is a, c, g, or t
atgatattcagatttaatctccctgccctcttcgataaaaaatcactcgatcatgatagggtactaaaagatgaaaagagtgtactaaaccttttagaagcggtacgtgatcacagggcagagataaaactacataacttttataaaggtctaaccattacaaacagcgctcttgttactggagtgtcaaaagataaaattaccataaaaacagcttacattcaacaaaaggctgttgatcttgaaaaaaaagttattctaacatctgacctttttccgtttgatatagagtcaactgatattaaggcggtaaacttagataatcagagcatagaactcggagtatgtgcaatgatcagatcaactccaacagatagaaagtttattacactggatccagatccaaatcataatgtaacactcttttatgatgaacataagtttgcaactgagctgagaatattaaatatatcagtaaactcagtacgactctctcttagttttttaccagctggagtaaaagagtcagatgaaatgatggtagatatggtttttaatgaagatagacaaccgttcataattaacacaaaagcaaaagtactaagaatatttgaattcaaaaagagctttgaacttacgcttatactagaacccgataaaactacccataaaaagttagtagattatatagctaaacgacagattaaacttattaaagaatttagaggactacaatatacagaataa

SEQ ID NO: 9808 - protein, 248 aa, Unknown
  Obtained from environmental sample
  misc_feature (1)..(248): Xaa is any amino acid
MIFRFNLPALFDKKSLDHDRVLKDEKSVLNLLEAVRDHRAEIKLHNFYKGLTITNSALVTGVSKDKITIKTAYIQQKAVDLEKKVILTSDLFPFDIESTDIKAVNLDNQSIELGVCAMIRSTPTDRKFITLDPDPNHNVTLFYDEHKFATELRILNISVNSVRLSLSFLPAGVKESDEMMVDMVFNEDRQPFIINTKAKVLRIFEFKKSFELTLILEPDKTTHKKLVDYIAKRQIKLIKEFRGLQYTE

SEQ ID NO: 9809 - DNA, 426 bp, Unknown
  Obtained from environmental sample
  misc_feature (1)..(426): n is a, c, g, or t
atgaataaacatttaaccgatatagaaatttttgaatttagcaaccaattattggatgataaaactcaacttgttgctataaatgaacatctaaccaattgcgaagcttgtcagctaaaagtagatgaagaaacgttatttagcaaagctattcaaaacaatttagcagtaagcgaaaaaattgatatcagcgaaaaagtattaagccatttccaaacggagataaaacctgtttttattgatttaaaatggacgatttatacctccattattgtagctgtaatttatatgctaaacaccattccgaattttattgatgttgcattgccaaaaatcgaaaacgtaaacaccatagtttctgcggtattcttaattctaatggtagatgtggttgttaaatatttcaggtttagaaagtctcattaa

SEQ ID NO: 9810 - protein, 141 aa, Unknown
  Obtained from environmental sample
  misc_feature (1)..(141): Xaa is any amino acid
MNKHLTDIEIFEFSNQLLDDKTQLVAINEHLTNCEACQLKVDEETLFSKAIQNNLAVSEKIDISEKVLSHFQTEIKPVFIDLKWTIYTSIIVAVIYMLNTIPNFIDVALPKIENVNTIVSAVFLILMVDVVVKYFRFRKSH

SEQ ID NO: 9811 - DNA, 402 bp, Unknown
  Obtained from environmental sample
  misc_feature (1)..(402): n is a, c, g, or t
atggtcagatcggctcgggatctaatctttatgtcaaagagccaagtgctctctttttcagcaacgcatatacatgaagatacacgtatcccatataaatacttgacgatgctgctgactaaacttgcaaaagcccagatactcaaggcaacccgcggacgcaatggcggtttttctcttaataaaaaaacagatgagatatatttagtgaacattctcgatgcgatcggagagaacaactgttcgaattgtgcgctgggggaaaaagagtgcaacgttgatcaaccctgctctttgcatgagtcttataaacttccaaaaatagccctggaagagatgttgaacacgacgactttggacaagcttgatccgtccttaatggaaaacacctacaaacactaa

SEQ ID NO: 9812 - protein, 133 aa, Unknown
  Obtained from environmental sample
  DOMAIN (4)...(114): Transcriptional regulator
  misc_feature (1)..(133): Xaa is any amino acid
MVRSARDLIFMSKSQVLSFSATHIHEDTRIPYKYLTMLLTKLAKAQILKATRGRNGGFSLNKKTDEIYLVNILDAIGENNCSNCALGEKECNVDQPCSLHESYKLPKIALEEMLNTTTLDKLDPSLMENTYKH

SEQ ID NO: 9813 - DNA, 321 bp, Unknown
  Obtained from environmental sample
  misc_feature (1)..(321): n is a, c, g, or t
gtggtagatcaaaaaatcacagagctaaaatacagagactcacacaacgacatcatagaagaggatgagtatatccagagtgatgcatacgccgataccataaaaaaagagtnttcagacacctacaaaaatatacttctagcaaaaaatatttatgacaaatacagtgataaaatattngcaaaaaatgaaaacggactaaataatcagctatctcaaaagagtgagattacaaaatatagaattgtgaattctcaaaaagagagtgcaactaaagagagtgctagtgggtcattggagagtttgattcagcagaaataa

SEQ ID NO: 9814 - protein, 106 aa, Unknown
  Obtained from environmental sample
  misc_feature (1)..(106): Xaa is any amino acid
MVDQKITELKYRDSHNDIIEEDEYIQSDAYADTIKKEXSDTYKNILLAKNIYDKYSDKIXAKNENGLNNQLSQKSEITKYRIVNSQKESATKESASGSLESLIQQK

SEQ ID NO: 9815 - DNA, 861 bp, Unknown
  Obtained from environmental sample
  misc_feature (1)..(861): n is a, c, g, or t
atgtcacatcatcaaccaacactgcaaccctacgtctctaaatacatacctccaactgaggagaaaagagtagtctcctcgtttgataaagagctagaaaaagcgaaagaggaagagtcagataaaattgatgccattatcaaagagtatcgcgcgcagcctggcatggatggcatttacgtagagggaacttttgaaaaagatgcggaagatttcataaaaagacatgaagagcagtttaaaaaagatttccctctttatgagaagtacaaagatatttttactcccatgtacagcaactacacaagcgaaaaagcagataagatctgtaaagctatggatgagcactttcctgattatcaagaagttaagaacagagctttcctcggtggaacagatgaagataaagccgcatgggaagatatgttttatgattatcaggcttataacaaatatttaagagagataaataaccttgaaatgacaggtatgggtttctctgaagaggcgacaagagcttacaatttagctgtgtatgagcagctagagagcggcatagatataggtgatgcaaaaagcagcgcttcgtcggtagcttttacatttggcggtggggaggcttggtcatttagtatctcgctcatgatgggattaccaaaaggaatagatgagctaactcaagctactcccccagaagatataaactatgataaacagatagatctaagagatgtaggttttgagcataacttctcctacacagactacacaaatatctacggaacagatgctgagggcattttagagagactactttacgacatagccctctactcttttttaaacataatgaagatgtag

SEQ ID NO: 9816 - protein, 286 aa, Unknown
  Obtained from environmental sample
  misc_feature (1)..(286): Xaa is any amino acid
MSHHQPTLQPYVSKYIPPTEEKRVVSSFDKELEKAKEEESDKIDAIIKEYRAQPGMDGIYVEGTFEKDAEDFIKRHEEQFKKDFPLYEKYKDIFTPMYSNYTSEKADKICKAMDEHFPDYQEVKNRAFLGGTDEDKAAWEDMFYDYQAYNKYLREINNLEMTGMGFSEEATRAYNLAVYEQLESGIDIGDAKSSASSVAFTFGGGEAWSFSISLMMGLPKGIDELTQATPPEDINYDKQIDLRDVGFEHNFSYTDYTNIYGTDAEGILERLLYDIALYSFLNIMKM

SEQ ID NO: 9817 - DNA, 522 bp, Unknown
  Obtained from environmental sample
  misc_feature (1)..(522): n is a, c, g, or t
ttgaacgtcggcaaggcctttttggatggaatagtaattacaggggggggaacctacaattccatacagatttgcccagaattgatgaaaaaaataaaagaattggggtacaagataaagttggatactaatggcacaaatccaacaatgttgaggagggtgatcgatcagggtttggttgattacatcgcgatggactacaaggctccgctgaataagtataatgaggttgtgcgtgcagatgtcaatttgcatgatatagtggagtccatggagacaattaaaaattctggaattgagtacgaatttcgtacaactattgtagaacaattgctctctcccgtcgatgtagaaataatcaaagccgaaatcggatcaggagaaaaatactgtatacagaaattcaatccaactaaaactctggataaagactttttaaaatgcagtactttttctcctcaaattatgcaaaatctaattaatacaaccaaaggtgtgttcaaagaagaaattttaagataa

SEQ ID NO: 9818 - protein, 173 aa, Unknown
  Obtained from environmental sample
  misc_feature (1)..(173): Xaa is any amino acid
MNVGKAFLDGIVITGGGTYNSIQICPELMKKIKELGYKIKLDTNGTNPTMLRRVIDQGLVDYIAMDYKAPLNKYNEVVRADVNLHDIVESMETIKNSGIEYEFRTTIVEQLLSPVDVEIIKAEIGSGEKYCIQKFNPTKTLDKDFLKCSTFSPQIMQNLINTTKGVFKEEILR

SEQ ID NO: 9819 - DNA, 912 bp, Unknown
  Obtained from environmental sample
  misc_feature (1)..(912): n is a, c, g, or t
ttgtttnnttttgtggctggcgacatcatttgcacttctagtctgctgaaatgggattctttaattgaaaaagaacaaggaaagtatttaattcaatctcaaaataagttaaaagaaatattacaaaaagaaaatcagttattaaagaaatacgaaaagcttattaactataaataccatacattcaatctattgctcctgtcaaaaaataaaattgttgctcagcttcatgaagaaatggagtattacaccaagttatttaaagcaggtttttttgaaataaatgctaaccacacttttgaagaaaagctttatttactcaatttcaaaggaatgtattacatgagtaaaggcaaaattgaaaaatgcctattagcttatgttcaacttgttgaagaaatagaatcttctgaaaaaaagaacatcctaaaatcaaatgaatattttttagccttaaacaacctattattactggaagtattaaacaaaaattatgatcgctatagaaccactttaaaaaaaattcatgcaaattttgataatttagttggttataaacctcttttatttaatataacaacttgttacgaactaggtatatattgcgaaattggagatgaaaaaaaagcattagcactaattccggaaattgaaaaaaacttaaaattatttgatgaagaaaccaatgaaataagtaaattactcttctatcttaatattgctattacttatctattcaatgaaaattattcaaaatctatttattggctaaacgtctttttaaacgactatagcattaaaagaaatgatgtaagttctaatatttattactatggacacatcattaatataattgctcattatgaagcaaaaaactacgaatcattacctatttgtacaatcaatctgtaa

SEQ ID NO: 9820 - protein, 303 aa, Unknown
  Obtained from environmental sample
  misc_feature (1)..(303): Xaa is any amino acid
MFXFVAGDIICTSSLLKWDSLIEKEQGKYLIQSQNKLKEILQKENQLLKKYEKLINYKYHTFNLLLLSKNKIVAQLHEEMEYYTKLFKAGFFEINANHTFEEKLYLLNFKGMYYMSKGKIEKCLLAYVQLVEEIESSEKKNILKSNEYFLALNNLLLLEVLNKNYDRYRTTLKKIHANFDNLVGYKPLLFNITTCYELGIYCEIGDEKKALALIPEIEKNLKLFDEETNEISKLLFYLNIAITYLFNENYSKSIYWLNVFLNDYSIKRNDVSSNIYYYGHIINIIAHYEAKNYESLPICTINL

SEQ ID NO: 9821 - DNA, 627 bp, Unknown
  Obtained from environmental sample
  misc_feature (1)..(627): n is a, c, g, or t
ttgggttataaacctctttttatttattatacaaacttgttacgaactaggtatatattgcgaattggagatgaaaaaaaagcattagcactaattccggaaattgaaaaaaacttaaaattatttgatgaagaaaccaatgaaataagtaaattactcttctatcttaatattgctattacttatctattcaatgaaaattattcaaaatctatttattggctaaacgtctttttaaacgactatagcattaaaagaaatgatgtaagttctaatatttattactatggacacatcattaatataattgctcattatgaagcaaaaaactacgaatccattacctatttgtacaatcaatctgtaaataatcttaaaaaaattagacctttaaatcaattcgatgagactattttaaaatttattaaaaagactgcatcaagaaaattcttagattcaaaagaacaaacagcgtcctttaaaacactaaaagaaaaattagaactcttaatagaagatcccaaagaaactatttcactacaattttttgatttttttgcatggatagatagttacttacaaaaagaaaaaatagcaactcttattaaaaaaaagaaattgggttaa

SEQ ID NO: 9822 - protein, 208 aa, Unknown
  Obtained from environmental sample
  misc_feature (1)..(208): Xaa is any amino acid
MGYKPLFIYYTNLLRTRYILRIGDEKKALALIPEIEKNLKLFDEETNEISKLLFYLNIAITYLFNENYSKSIYWLNVFLNDYSIKRNDVSSNIYYYGHIINIIAHYEAKNYESITYLYNQSVNNLKKIRPLNQFDETILKFIKKTASRKFLDSKEQTASFKTLKEKLELLIEDPKETISLQFFDFFAWIDSYLQKEKIATLIKKKKLG

SEQ ID NO: 9823 - DNA, 675 bp, Unknown
  Obtained from environmental sample
  misc_feature (1)..(675): n is a, c, g, or t
ttggggatcaccgcatcaatggcggggatcaatccgtttagggaatcgtatgagcggaaaaaatctcatttactcagccgcccggaaattgcgttcagcaatattctgacgactgaaggaaaatcagacaaatattccacggtaatcatagataaaaatcattattcagttccgatcgaatatgcatatctaaaggtccgtgcgattctaaccgtaaatcagataaacatatattacggcggtaaaaagatcgctatgcatgatcgcctgtataacaacaaccagtggcagcttgatcccgctcattatttgaaacttatccaacaacgaccacaggcttttgacagtgcccgcccgataaaacaatggagaaaaaactggccgtcctgttatgaaaagcttcttgtgcgattttgcatcaagcaaggtaatacaaaagggactcgggattttatatccgtattgatgctacacagtgaacacaaggctgagggtataaaagaatcaatcgagaaggctttaatggccggcgtcagtaccagtcatgcagttgtgcagatcctgcaaaatgcgtcggataataaaaaaatggcgattactccccttaaaaaaaactggcagacgtttccacctccggacatctcgatatatggcaaaataggaggtgcggtatga

SEQ ID NO: 9824 - protein, 224 aa, Unknown
  Obtained from environmental sample
  misc_feature (1)..(224): Xaa is any amino acid
MGITASMAGINPFRESYERKKSHLLSRPEIAFSNILTTEGKSDKYSTVIIDKNHYSVPIEYAYLKVRAILTVNQINIYYGGKKIAMHDRLYNNNQWQLDPAHYLKLIQQRPQAFDSARPIKQWRKNWPSCYEKLLVRFCIKQGNTKGTRDFISVLMLHSEHKAEGIKESIEKALMAGVSTSHAVVQILQNASDNKKMAITPLKKNWQTFPPPDISIYGKIGGAV

SEQ ID NO: 9825 - DNA, 474 bp, Unknown
  Obtained from environmental sample
  misc_feature (1)..(474): n is a, c, g, or t
atggatgattattatgcaggtgatgctcatatagatagttatcaaaaagagttaaatacgatgcaaaacagaggatttacagatgcttatttagtaaatcgtccgtttgagaagcatgatactcagagtttagacttcacaattactatgggaactcatcaagttagcgggatggttgagagtgatggggagtactttatgtgtaaatataagacattcccgaatgaagccattgaagttgttttacctcctaaaagcgaaattgagttagttgataatgatataggtaaaatagagctaaaagatggaatatactatttaactttttacaaattagaagcaaaaaatggtaaagtttgggattctgttcatagtggtaatttaaatcctattaaattgccaattaagttgccggcttatacatttttacgtatagttgcaactccggaaatgactgttttaccaaaaaattag

SEQ ID NO: 9826 - protein, 157 aa, Unknown
  Obtained from environmental sample
  misc_feature (1)..(157): Xaa is any amino acid
MDDYYAGDAHIDSYQKELNTMQNRGFTDAYLVNRPFEKHDTQSLDFTITMGTHQVSGMVESDGEYFMCKYKTFPNEAIEVVLPPKSEIELVDNDIGKIELKDGIYYLTFYKLEAKNGKVWDSVHSGNLNPIKLPIKLPAYTFLRIVATPEMTVLPKN

SEQ ID NO: 9827 - DNA, 459 bp, Unknown
  Obtained from environmental sample
  misc_feature (1)..(459): n is a, c, g, or t
atgtttaagacacccatgcagcaaaccgaaaatcccatagaccccaaaatcatcgagttcatcatggagcaccatgttttcactctggccacatcaaatcaaaaccggccctatacctgctcttgtttttatatctatctcgaaagtgataacctttttgtttttacctccgaccggcacacaaaacacattaaagatatggagcagcaaaactatgttgccggggcagttgcacttgaaaccacaatgattggaaaaatccagggaattcaatttaccggcccaatgtatgaactggaaggggaaatcctgaaaaaggcgaacaaagcctatctgaaaaattttcccatagcaaggctcaaagatttactgctctggggcatcggaactgagtttataaaaatgacacctaacccgctgggaattggcaaaaagctcattttgaaaagtgaaaagtaa

SEQ ID NO: 9828 - protein, 152 aa, Unknown
  Obtained from environmental sample
  misc_feature (1)..(152): Xaa is any amino acid
MFKTPMQQTENPIDPKIIEFIMEHHVFTLATSNQNRPYTCSCFYIYLESDNLFVFTSDRHTKHIKDMEQQNYVAGAVALETTMIGKIQGIQFTGPMYELEGEILKKANKAYLKNFPIARLKDLLLWGIGTEFIKMTPNPLGIGKKLILKSEK

SEQ ID NO: 9829 - DNA, 519 bp, Unknown
  Obtained from environmental sample
  misc_feature (1)..(519): n is a, c, g, or t
atgaaaaatattctaaaaattatatttattatttttcttttttcatcttgtcaaacagtagatgaagaagagcataagattgtcaaatctactgatttagaaggtcgaaaaacggaaataactgattttaaaaatttggctcatggtaaatcgtatttacctgtttattctcagatttatcctgtttacgaaaatcggtcttttgatcttgttattacagtaagtattcggaatatttcaatcactgacacgatttatattttaaaagtagattattttaatactgatggtgaaaatattagacaatatataaaaaagccaatttatctaaaacctatggaaactgtagaaataattattgcagaagacgataccgaaggaggtactggggcaaattttgtttttgattgggctgtcaaaaatcataaaaatccacctttattcgaggctgttatgatttcaacttatggtcaacaaggattgtcttttacaaccagaggtgtgcaaatatttgaatga

SEQ ID NO: 9830 - protein, 172 aa, Unknown
  Obtained from environmental sample
  SIGNAL (1)...(19)
  misc_feature (1)..(172): Xaa is any amino acid
MKNILKIIFIIFLFSSCQTVDEEEHKIVKSTDLEGRKTEITDFKNLAHGKSYLPVYSQIYPVYENRSFDLVITVSIRNISITDTIYILKVDYFNTDGENIRQYIKKPIYLKPMETVEIIIAEDDTEGGTGANFVFDWAVKNHKNPPLFEAVMISTYGQQGLSFTTRGVQIFE

SEQ ID NO: 9831 - DNA, 621 bp, Unknown
  Obtained from environmental sample
  misc_feature (1)..(621): n is a, c, g, or t
atgggacaaacggaggagatagtcgtgtcatcttgtacttgtagttggagtgagaaacttacttcaaaaattaaagatgtgaaagttataaagcgtgattatgctaaagctttcccacagaattataaagacgactttgatgttaaaaaagctgttgaagatgtcatcaaaattgaagaagctattaaatgcaaaggcattagcgttctatcatataaaaaagatgatgcaaaagataacgaactaagttttaaaatatttaattcgcaagaaaaattacgtttatctgatatcgttccaatgcttgaaaatatggggttcttggttgttgtagaacaagcatatttcatggaattcgaagataaaaatcatgcatggatacgtgatatttctctggtttctgccggatgtgaacatgttgatgttaaaaaaattaaacataatattgaaaaaacattcataaaactttggcgtggcgattttgaaaatggtgccatgaaccagttggttgttaaagttgggatgtcgtggcaagacgttaatattcttagagcttactctcgatatcttaaacaaataggttttttctctttccccaaaatatataacaaactgcattag

SEQ ID NO: 9832 - protein, 206 aa, Unknown
  Obtained from environmental sample
  misc_feature (1)..(206): Xaa is any amino acid
MGQTEEIVVSSCTCSWSEKLTSKIKDVKVIKRDYAKAFPQNYKDDFDVKKAVEDVIKIEEAIKCKGISVLSYKKDDAKDNELSFKIFNSQEKLRLSDIVPMLENMGFLVVVEQAYFMEFEDKNHAWIRDISLVSAGCEHVDVKKIKHNIEKTFIKLWRGDFENGAMNQLVVKVGMSWQDVNILRAYSRYLKQIGFFSFPKIYNKLH

SEQ ID NO: 9833 - DNA, 483 bp, Unknown
  Obtained from environmental sample
  misc_feature (1)..(483): n is a, c, g, or t
gtgagagaagatagaattggtgatcttgaaatagatactgtcataggaaaaaatcatattggtgcattagtcactgttgtagatagaaaatctaaatttacaatgattaaaaatgttcaatcaaaagaagccaaagtggttacagaagctctaatagagatgatacaaccaatcaaaaatataactcatacaatcacaagtgacaatggaaaagagtttgcatatcacaaagagatttcagctgcactagacactaagttttacttcgctaatccatatcattcatgggaaagaggattaaatgaacacaccaatggtttaatacgtcaatacttaccaaagaaaagtgtgtttacaaatgtttctaaggatgaaattattatgattcagaacagacttaatcacagacctagaaaagtgttaggttataaaacaccttatgaagtttttttcaaggagctgagtcgaaaattagctagttaa

SEQ ID NO: 9834 - protein, 160 aa, Unknown
  Obtained from environmental sample
  DOMAIN (1)...(151): Integrase core domain
  misc_feature (1)..(160): Xaa is any amino acid
MREDRIGDLEIDTVIGKNHIGALVTVVDRKSKFTMIKNVQSKEAKVVTEALIEMIQPIKNITHTITSDNGKEFAYHKEISAALDTKFYFANPYHSWERGLNEHTNGLIRQYLPKKSVFTNVSKDEIIMIQNRLNHRPRKVLGYKTPYEVFFKELSRKLAS

SEQ ID NO: 9835 - DNA, 408 bp, Unknown
  Obtained from environmental sample
  misc_feature (1)..(408): n is a, c, g, or t
gtgggcgagaggttttccaaaaaagccatattgatttcggacgcacataaaagtataggagcatttgcccaagcaaataagatatcccattacagctttaaggctacagagcacacatactgtgtagggaaaggagttccattattaaatagtactgctgaaagagtagatacactcctgaatagaagatttagaggcgtatcgacaaaatacctaccgctatatgtcaactggtttaagttcaaagaaaaccacaatgggcaagaaggggaaattgacctgcaaaacgaaatattgtcaaagaaacctacttgggatctattttcaaatatagagaaggtttacgaagcttttattcgaaacccttcccgacggacatattcggttcccccattcagaaaaatttaa

SEQ ID NO: 9836 - protein, 135 aa, Unknown
  Obtained from environmental sample
  misc_feature (1)..(135): Xaa is any amino acid
MGERFSKKAILISDAHKSIGAFAQANKISHYSFKATEHTYCVGKGVPLLNSTAERVDTLLNRRFRGVSTKYLPLYVNWFKFKENHNGQEGEIDLQNEILSKKPTWDLFSNIEKVYEAFIRNPSRRTYSVPPFRKI

SEQ ID NO: 9837 - DNA, 321 bp, Unknown
  Obtained from environmental sample
  misc_feature (1)..(321): n is a, c, g, or t
atgctgattcaaccttatgttgaaaatgccatttggcacggaatatcgcataaagagggaaatggaataataagaatacagtttttaccagagaatgaacatttgctaaaatgcgtggtagaagacaacggaattggacgtgaaaacgctattaaactcaagaaaaacactacttctccttcttttgggatgaatattactaaagaacgggtagaactgttaaactcgctcaatggcaatcaactttcggtaaaaataaacgaccttaaaataaacaaccagccggcaggaacaagagtggaattatatgtaccaatttaa

SEQ ID NO: 9838 - protein, 106 aa, Unknown
  Obtained from environmental sample
  misc_feature (1)..(106): Xaa is any amino acid
MLIQPYVENAIWHGISHKEGNGIIRIQFLPENEHLLKCVVEDNGIGRENAIKLKKNTTSPSFGMNITKERVELLNSLNGNQLSVKINDLKINNQPAGTRVELYVPI

SEQ ID NO: 9839 - DNA, 645 bp, Unknown
  Obtained from environmental sample
  misc_feature (1)..(645): n is a, c, g, or t
gtgatgcaaatgcttgctgggtggagaaagcttctttcgaatcggttatttatgactttttttgctgtggctttgatagctggttgtggttcatcggacgatgattacaaaataatcaaagatgaaaaaatgggttcaatcaagcggacggtagagattgaattgattgaacgagtcgatgaaaaacgacttagggaaattgccacaaacgtctacgaaaaaggttttgagcgcacctttattggttatcgggtgaaaggggagaaccgtcctacatattgggccactacacattacaatccgaaccttgaagtcaaaatactcgccaaatcactcccggataaggaggcgatggaaaccgatttttatcaaggaaacgtgttgggtagctggacggttcattatggttttgaatacattgtgacgtttgttgaagttgatggcaaaattaacatcaatagtaaatttgccgatggatcatcttcaaattacacggcaatcattgaggtgattaatgggcaacagcgttactataccgaaagcagtaaagaccacggcgaatattatgtgatttcggaatctggcgatttggaaatgtggagtccgaacgggaactattacactgctaaacgtaagggaatctag

SEQ ID NO: 9840 - protein, 214 aa, Unknown
  Obtained from environmental sample
  misc_feature (1)..(214): Xaa is any amino acid
MMQMLAGWRKLLSNRLFMTFFAVALIAGCGSSDDDYKIIKDEKMGSIKRTVEIELIERVDEKRLREIATNVYEKGFERTFIGYRVKGENRPTYWATTHYNPNLEVKILAKSLPDKEAMETDFYQGNVLGSWTVHYGFEYIVTFVEVDGKININSKFADGSSSNYTAIIEVINGQQRYYTESSKDHGEYYVISESGDLEMWSPNGNYYTAKRKGI

SEQ ID NO: 9841 - DNA, 528 bp, Unknown
  Obtained from environmental sample
  misc_feature (1)..(528): n is a, c, g, or t
ttgcaattaatttatttgtgggaaatcttgaaggaaaatgaagctgagtttaagaaagaatgttcaaaaattctttctgataatcttgttcatttaataagtgaactaaaaggtttatataattcaggctattataatgaagttgaatatgaaaaaatgattagcatgattgaacgtgattacaaaaaaattatcgaatattttaaaattggaaatatcagggaatataaacccgacaataaacacaaatccaaaacagcaaaacagctttttaactatcttaaaaataaaaataaagatattgaaagcataaaagcctatgaattgtatatgctattttcaaaatttgaccatctcggtattttatcacttacttttcaacataatgacaatctgtttgaaatgatattaaattcaattagaattttattaaaaggaaatgagcttatttatagtttattacaaaaaaaagaacaatctgaagaaattggaatagttataaattcgataaatcaattaaaatattaa

SEQ ID NO: 9842 - protein, 175 aa, Unknown
  Obtained from environmental sample
  misc_feature (1)..(175): Xaa is any amino acid
MQLIYLWEILKENEAEFKKECSKILSDNLVHLISELKGLYNSGYYNEVEYEKMISMIERDYKKIIEYFKIGNIREYKPDNKHKSKTAKQLFNYLKNKNKDIESIKAYELYMLFSKFDHLGILSLTFQHNDNLFEMILNSIRILLKGNELIYSLLQKKEQSEEIGIVINSINQLKY

SEQ ID NO: 9843 - DNA, 432 bp, Unknown
  Obtained from environmental sample
  misc_feature (1)..(432): n is a, c, g, or t
atggacaagatcggctcgagtcaaatttgggcttgccgcaggcgtaacacaagcccaaattttgaaaacgctgcatgttggctgttcgatagcttaaaaaaaaaaataaaacaacacccaaaaataaatccaaatatgacgatacaagaatatttagatagtataaataaacgatacaaactcggaaatgcaaccgagcatacttttcgtggcgacttgcaacaattgattgaaagtttagttccaacaattagagctaccaacgaaccaaaacggcaaacttgtggagcacctgattatattttgacaaaaaaagatattccggttggatttatcgaagcaaaggacattggcaacaaagacctcgatggtaaaaagaaatcgggcaacaaagaacagtttgaccgatacaaagcatcattgataaaatag

SEQ ID NO: 9844 - protein, 143 aa, Unknown
  Obtained from environmental sample
  misc_feature (1)..(143): Xaa is any amino acid
MDKIGSSQIWACRRRNTSPNFENAACWLFDSLKKKIKQHPKINPNMTIQEYLDSINKRYKLGNATEHTFRGDLQQLIESLVPTIRATNEPKRQTCGAPDYILTKKDIPVGFIEAKDIGNKDLDGKKKSGNKEQFDRYKASLIK

SEQ ID NO: 9845 - DNA, 357 bp, Unknown
  Obtained from environmental sample
  misc_feature (1)..(357): n is a, c, g, or t
atgtcactgaatattaatttacttaaagaaattgctgaagctgctggagctccaggtcatgaacaaagaattagagaaattgtcatcagagaggtaactcctttggttgacgaagtttctgttgataatatgggcaacgtttatgctattaaaaaaggaaaagaatccaaaaaagtaatgattggcgcccacatgnatganatcggatttattgttacccatattgatgacaacggatttgttcgttttcataccttaggaagtttcgacccgaaaaccataactgcacaaagattatcattcacggaaaaaaagactttattggtgggatgggttctaagcccgtacatgttatga

SEQ ID NO: 9846 - protein, 118 aa, Unknown
  Obtained from environmental sample
  misc_feature (1)..(118): Xaa is any amino acid
MSLNINLLKEIAEAAGAPGHEQRIREIVIREVTPLVDEVSVDNMGNVYAIKKGKESKKVMIGAHMXXIGFIVTHIDDNGFVRFHTLGSFDPKTITAQRLSFTEKKTLLVGWVLSPYML

SEQ ID NO: 9847 - DNA, 723 bp, Unknown
  Obtained from environmental sample
  misc_feature (1)..(723): n is a, c, g, or t
gtgatgggttctaagcccgtacatgttatgacagctgaggaaaaaaccaaacaattaaaaactaccgacttttttattgatttaggaatgaataaaaaagaagtagaaaaaattgtaagcattggcgaccctattactagagacagaaatcttatagaaatgggcaactgtgttaactgtaaatctttagataacaggttagcagtttttatccttattgaatcattaagagacttaaaaaacaaaaaagttccttatgatgtttatggtgttttcactgttcaggaagaagttggtattagaggggcaagtgtagcttcattaaagatacagccagatttcggctttggtttagatactactattgcttacgatgtgccaggagccaaagctgaggagatgattactaaattaggtgacggaacagctataaaagtaatggatagttctaccatttgtgattatagaatggtgaagtttatggaaggtgttgctaaaaaacataaaattacctatcaaaaagaaattttaactgctgggggaacagatacagctggaatacaacgaatgagtgctggtggtgctatttctggcgctatctctattccaaccagacatatacaccaagttattgaaatggcaaacaaagatgatattcaaagaagtatcgatttgctttctaattgcttattagaaattaattcttacgactggaaattttaa

SEQ ID NO: 9848 - protein, 240 aa, Unknown
  Obtained from environmental sample
  DOMAIN (3)...(225): M42 glutamyl aminopeptidase
  misc_feature (1)..(240): Xaa is any amino acid
MMGSKPVHVMTAEEKTKQLKTTDFFIDLGMNKKEVEKIVSIGDPITRDRNLIEMGNCVNCKSLDNRLAVFILIESLRDLKNKKVPYDVYGVFTVQEEVGIRGASVASLKIQPDFGFGLDTTIAYDVPGAKAEEMITKLGDGTAIKVMDSSTICDYRMVKFMEGVAKKHKITYQKEILTAGGTDTAGIQRMSAGGAISGAISIPTRHIHQVIEMANKDDIQRSIDLLSNCLLEINSYDWKF

SEQ ID NO: 9849 - DNA, 774 bp, Unknown
  Obtained from environmental sample
  misc_feature (1)..(774): n is a, c, g, or t
gtgataaatagtaaaaacctacaaccatacttagtagatcatcaggtgcatttagtacatggtgaacaaacattaatggtacgagctggatttaatcatgtactaaaatgtaaagtattagatagaagtcaaagtggatttttttatgtattacctcatagtgtaggtgaattaaaacaaaaacaatcagatttgataaatttaaaagaggatattttatacaaaataactcaagagtttagctcaatattaacaaaacatcttatgtttttacgatttataaataaagagtttgacaggtatgatcactatcaagcaagaatacaatttgctaaaaataaaaacttaacatttatacttcctaccaataaagcaaataaagtacaaaaattagttgactttaaacatcctgcattagaacatgcaaaaagtgttacagtagattttacaaaaaatgtaataatgataacaggtgtaaatgctggtgggaaaactatgcttttaaaatcaattttaagtgcagtgtatatgtcaaaatatcttatcccttatagttgtgataaatcaactattgttggaagttataaagatatcaatgcaattcttgatgacccacaaaatgtgaaaaatgatatctcaacatttgcagggcgtatggttgaatttagtaaactatttacaaaacaaaatgcaatagttggtgttgatgagatagaactaggtacagatagcgatgaggctgctagtttatttaaagtgattatgaagagctaa

SEQ ID NO: 9850 - protein, 257 aa, Unknown
  Obtained from environmental sample
  misc_feature (1)..(257): Xaa is any amino acid
MINSKNLQPYLVDHQVHLVHGEQTLMVRAGFNHVLKCKVLDRSQSGFFYVLPHSVGELKQKQSDLINLKEDILYKITQEFSSILTKHLMFLRFINKEFDRYDHYQARIQFAKNKNLTFILPTNKANKVQKLVDFKHPALEHAKSVTVDFTKNVIMITGVNAGGKTMLLKSILSAVYMSKYLIPYSCDKSTIVGSYKDINAILDDPQNVKNDISTFAGRMVEFSKLFTKQNAIVGVDEIELGTDSDEAASLFKVIMKS

SEQ ID NO: 9851 - DNA, 309 bp, Unknown
  Obtained from environmental sample
  misc_feature (1)..(309): n is a, c, g, or t
atgacaataagaaaagctacacaagaggatatagaagatattacaaaacttttatatcatctttttaaccaagaggtagagtttaattttaataaaaaactccataaaaaagctttacgaaaaattatcaacgataaaaatatcggtgaaatttttgttgtagtgaaaaaagagaaaaatataggttgtgtccatatactttatactatcagtagtgcacttggtggtaaagtagcatttttagaggatatgattatctcccctaaatatagaggaaagtccttaggtacaaaacttttacaatataca

SEQ ID NO: 9852 - protein, 103 aa, Unknown
  Obtained from environmental sample
  misc_feature (1)..(103): Xaa is any amino acid
MTIRKATQEDIEDITKLLYHLFNQEVEFNFNKKLHKKALRKIINDKNIGEIFVVVKKEKNIGCVHILYTISSALGGKVAFLEDMIISPKYRGKSLGTKLLQYT

SEQ ID NO: 9853 - DNA, 828 bp, Unknown
  Obtained from environmental sample
  misc_feature (1)..(828): n is a, c, g, or t
atgagagaagttataaacatctataaaaaacataaaataaatgttgacaattttatatcaattgttataaaaacattacctaaagattatatcaaaaactcgaaatatattttggataataatagatatattcagttactgtatagtgtagatgataactataaacaaagtagtccagtgatttgtagaaaagatacagatgatatgaatattaatagtgataaaagtcattattttatgaaattagacttagatgaagataatttatatatatctaatccttacattcattacaaaacagggaaagctagcttatcagttgtcaaaaaacaaggtgatcattactttatctttgattttgatttgatatttttacttgaagagttaaaacttattgactataatactacctatgacagattaaaaagaatggtttatatccttggttctgtgatgttaggtatcatagctatagtacttattggtcatggtggatatacttttttaactatgtcaataggtacaaatgagtttgatttttttgaagcaacatttaaggctattatatcagttacacttggtattgctatttttgatttggcaaaacagatatttgaacatgaagttatctttcactcatttagccatggaaacgatagacaatataaagttttaggaaaattcttaatctcaattattattgcattatcaattgagactttaatggttgtttttaaaattactttagacgattataaaaatatggattctgcattctatttattatttggtacaacaattatgtttataggattggcgtatttataa

SEQ ID NO: 9854 - protein, 275 aa, Unknown
  Obtained from environmental sample
  misc_feature (1)..(275): Xaa is any amino acid
MREVINIYKKHKINVDNFISIVIKTLPKDYIKNSKYILDNNRYIQLLYSVDDNYKQSSPVICRKDTDDMNINSDKSHYFMKLDLDEDNLYISNPYIHYKTGKASLSVVKKQGDHYFIFDFDLIFLLEELKLIDYNTTYDRLKRMVYILGSVMLGIIAIVLIGHGGYTFLTMSIGTNEFDFFEATFKAIISVTLGIAIFDLAKQIFEHEVIFHSFSHGNDRQYKVLGKFLISIIIALSIETLMVVFKITLDDYKNMDSAFYLLFGTTIMFIGLAYL

SEQ ID NO: 9855 - DNA, 366 bp, Unknown
  Obtained from environmental sample
  misc_feature (1)..(366): n is a, c, g, or t
cataaagaaaggggtatctatgatcgcaatgacgaacgaaaaggtaaaaaatatacataccaaagtgtacgggtaaacaccctccccgcggataaaaaaatctcggaagaactgtggctatcttatcatcaaaaaaataatgattttattttttcagacactgaagttattacactttctactttttattattttaaaaacagtaaaacgtcttattttattgatgcagccgatgatccaggaggcttctccagtgaaatactgttcgattattataaacaatatggtattgccgaggtagtgacaaagcggatagatagcacaggagaactaaaaactgaaattaatctcgcacacacgcaatag

SEQ ID NO: 9856 - protein, 121 aa, Unknown
  Obtained from environmental sample
  misc_feature (1)..(121): Xaa is any amino acid
MKERGIYDRNDERKGKKYTYQSVRVNTLPADKKISEELWLSYHQKNNDFIFSDTEVITLSTFYYFKNSKTSYFIDAADDPGGFSSEILFDYYKQYGIAEVVTKRIDSTGELKTEINLAHTQ

SEQ ID NO: 9857 - DNA, 312 bp, Unknown
  Obtained from environmental sample
  misc_feature (1)..(312): n is a, c, g, or t
gtgacaggaaagtacgatctgataacagctaatcccccgtatttatctgaaaaagatatgggaatctactgtaaaaacgaacttgaatttgagccaaaagaagctcttctgagtggggaaacaggttttgaaattactgaaaaaatcattgaacaggccgctgaatatcttaataaaaacggaatattaatgcttgagctcggttatcagggaagtgggtttttaaatgatactgaaaatctaaaacttgataaggtcataaaagacctaaatggaataaatagagtcgcagtctttaagaaattatcctaa

SEQ ID NO: 9858 - protein, 103 aa, Unknown
  Obtained from environmental sample
  misc_feature (1)..(103): Xaa is any amino acid
MTGKYDLITANPPYLSEKDMGIYCKNELEFEPKEALLSGETGFEITEKIIEQAAEYLNKNGILMLELGYQGSGFLNDTENLKLDKVIKDLNGINRVAVFKKLS

SEQ ID NO: 9859 - DNA, 726 bp, Unknown
  Obtained from environmental sample
  misc_feature (1)..(726): n is a, c, g, or t
atgaaatatcttgttacatccgctcttccttatgcaaacggccccatccatcttggacacatcgcaggcgcatatcttcctgctgacatttatgtccgttatcttcgcagcatgaaacgagaagttctctacatttgcggaactgatgaacacggtgttccgatcactctgaacgctgaaggaagaggaattacacccgaagatgttattaaggaaaatcacgaaaagataaaaaaagggtttgagctgatgcagatgtcttttgatattttcagcggaactcataatgaaacccatagtgaactttctcaggaattttttctcactcttcaaaaggaaggatttatttctgaaaaagaaatcgagcaattctactgcgagcatgacaagatgtttctcccggatagatatgttgaaggaatttgtccactttgtaaggctgaaggagcaagaggcgaccaatgcgatgcctgcggtaacgccttgaatacattagaccttattaatccaaaatgcaaaatatgcaacgctgtacctgttgtaaaaacatcaaagcactggtttcttgacctcgataaatttgaaaaagatcttagccagtggctcgattcaaaaacccactggaaaaataatgtcagagctttttgccaacagtggtttgaaagaggactggaacctcgagggatcaccagagatcttaaatggggcgttcctgttcccggttga

SEQ ID NO: 9860 - protein, 241 aa, Unknown
  Obtained from environmental sample
  DOMAIN (2)...(241): tRNA synthetases class I (I, L, M and V)
  misc_feature (1)..(241): Xaa is any amino acid
MKYLVTSALPYANGPIHLGHIAGAYLPADIYVRYLRSMKREVLYICGTDEHGVPITLNAEGRGITPEDVIKENHEKIKKGFELMQMSFDIFSGTHNETHSELSQEFFLTLQKEGFISEKEIEQFYCEHDKMFLPDRYVEGICPLCKAEGARGDQCDACGNALNTLDLINPKCKICNAVPVVKTSKHWFLDLDKFEKDLSQWLDSKTHWKNNVRAFCQQWFERGLEPRGITRDLKWGVPVPG

SEQ ID NO: 9861 - DNA, 879 bp, Unknown
  Obtained from environmental sample
  misc_feature (1)..(879): n is a, c, g, or t
atgacagaattcggcctgagggaagatgattgtcagattttcttacaaggcttaatgtggatgacaaccctttctgaaaaagagacgaatcaactggcaaaaatgcataaagctattgctattatccagtttaaattggaagggatgataataaaatcccgtcctaagttccgtatggaagatcgcctactgctggataagatagattttgataaaggtgagatttttattgccggaatcagttataaactgaaagatattaacctgccaacaatcgatcctaaacagccatatcaactttccgaaagtgaacttgaagtggttaagaagcttaaggtttcatttgaaaaaagtgagaaacttcaacgacatatcaggttcttgttcacacatggtagcttgtatttgaaatgtaactccaatttgctttttcacggttgtatcctgatgaattccgataagactctgcaaactctaacgattaacggggaagaatttagtggtaaaaatctgatggataaattcgatcgtttagcaagacagggatattttgataaagatgaaaaacgtaagagttatggtcgagatctgatgtggtatctctggtctggcgttgattctccacttttcgggaaaaccaagatggcaacattcgaacgctattttatcgatgaaaaagagacgcataaagaggagaaaaatccttattacagtttcagagaagatgaggatacttgtcgaaatattttggttgagtttgggctaaatcctgacacttcgcatatcattaatggacacgttcccgttaaagcagttaaaggtgaacaaccggtgaaaacaggaaagaagctgatagtgattgatggcggtttatcctaa

SEQ ID NO: 9862 - protein, 292 aa, Unknown
  Obtained from environmental sample
  DOMAIN (1)...(292): Firmicute fructose-1,6-bisphosphatase
  misc_feature (1)..(292): Xaa is any amino acid
MTEFGLREDDCQIFLQGLMWMTTLSEKETNQLAKMHKAIAIIQFKLEGMIIKSRPKFRMEDRLLLDKIDFDKGEIFIAGISYKLKDINLPTIDPKQPYQLSESELEVVKKLKVSFEKSEKLQRHIRFLFTHGSLYLKCNSNLLFHGCILMNSDKTLQTLTINGEEFSGKNLMDKFDRLARQGYFDKDEKRKSYGRDLMWYLWSGVDSPLFGKTKMATFERYFIDEKETHKEEKNPYYSFREDEDTCRNILVEFGLNPDTSHIINGHVPVKAVKGEQPVKTGKKLIVIDGGLS

SEQ ID NO: 9863 - DNA, 750 bp, Unknown
  Obtained from environmental sample
  misc_feature (1)..(750): n is a, c, g, or t
atggttatgcatccaattaaaccaagtcttgatggaaaagatttatctaatttaaaagaccctaatggtaaaaaattttttatagagatggttaacctttctaaaaacaactcgcaagggtttgtagattatcaatggccaaaaccaggatttgataaaccacaagataaagtttcttatatttttacatttaaaccatttaattggattataggaactggtgaataccttgataatgtaacagctcaaatgcaaaaagaagctttaaaaactatctctaaaatgagatatggtaaagatagtagtaactatttttggataaatgacactgaaccaaaaatggttatgcatcccattaagccttcattaaataataccaatatatcaagtgtaaaagatccaaatggaaaactattatttgtcgaaatggcaaaagttgctaaaacaaaagggagtgggtatattaattatcaatgggcaaagcctggttttgataaacctcaaaataaaatctcttatgtagcatattttaaagagtgggattgggtagtaggaactggtgtttatatagatgatattgaacaagaagttataaacatggaaaatcaagcttcggaaaatgtagcaactattgttatatcatttattgttcttacactattactattagctatttcattgtctcctctctattttgctattataaaaagtgtaattacgcccgctaaagaacttacaagttggatttaa

SEQ ID NO: 9864 - protein, 249 aa, Unknown
  Obtained from environmental sample
  misc_feature (1)..(249): Xaa is any amino acid
MVMHPIKPSLDGKDLSNLKDPNGKKFFIEMVNLSKNNSQGFVDYQWPKPGFDKPQDKVSYIFTFKPFNWIIGTGEYLDNVTAQMQKEALKTISKMRYGKDSSNYFWINDTEPKMVMHPIKPSLNNTNISSVKDPNGKLLFVEMAKVAKTKGSGYINYQWAKPGFDKPQNKISYVAYFKEWDWVVGTGVYIDDIEQEVINMENQASENVATIVISFIVLTLLLLAISLSPLYFAIIKSVITPAKELTSWI

SEQ ID NO: 9865 - DNA, 711 bp, Unknown
  Obtained from environmental sample
  misc_feature (1)..(711): n is a, c, g, or t
gtgcaacttaagattcttctatataaaacaacacaatcaattagtgatcataaattagttagcactttttataaacaagtagaagatttaaatatgaaacttcatgaacaaaatgaagaaatcaataaagaaaaattaaagttagaagagcaggtaaggttactaaaaattcaggttaatactactaatactaaacatcatcaggttgaacagttgcttaaacaacaaacacttaaaaatgaagagtctactttaagtgagtattttacaaaagatgaagatgatggagatgaaaaagttatttttttaaatgatgattgtgatgagatgtctgaaattttaaatgagcttcctgaacttttaatgcagtttggtgaaactaaagatatagatcttattcatacaatggctcatgaattatcaaaagtttcatcgatattgctacgttatacaccttttttagatcctcttgctaaaagttttagtgaactatcttctgctattgatgataatattgatctatttataaacatattagataaaaatttagatagtaccatgatgatttatgatgccgtaagtgttgatatggaactttacatacagcgttttagtgttgaaagtatggctatgaagaatattcaccatatccatcatccaacgactttaagtattcaacaaattatcagctttattctccagaggaagtga

SEQ ID NO: 9866 - protein, 236 aa, Unknown
  Obtained from environmental sample
  misc_feature (1)..(236): Xaa is any amino acid
MQLKILLYKTTQSISDHKLVSTFYKQVEDLNMKLHEQNEEINKEKLKLEEQVRLLKIQVNTTNTKHHQVEQLLKQQTLKNEESTLSEYFTKDEDDGDEKVIFLNDDCDEMSEILNELPELLMQFGETKDIDLIHTMAHELSKVSSILLRYTPFLDPLAKSFSELSSAIDDNIDLFINILDKNLDSTMMIYDAVSVDMELYIQRFSVESMAMKNIHHIHHPTTLSIQQIISFILQRK

SEQ ID NO: 9867 - DNA, 540 bp, Unknown
  Obtained from environmental sample
  misc_feature (1)..(540): n is a, c, g, or t
atgtgccaatttacaaaaaaagaagtagaagattattataaagagtatatagagtcaatggcgaccttcggggagatggggttggatcggattttactaggcaagaaaatagtgtcatatatagatgatagtgttgaaaatattttggagataggtacaggtaaagggtctttaacagttttattggctcaacagtcaaaacaagttacatcagtagatatagataaagaaaatcaatataaggcacagcttttagcagctcatcaaggggttagtaaaaatgtgtcttttaaattatcagatgcacaggaaaaattgtatgaagataaaagttttgacctagttatatcagcattttcttttcatcattttgacaaaccatttacggttattgatcagatgataagaatggcaaaaaaacaagtcattattacagagtttaatgaagaaggctttcgtatagttgaaaaaatacataanaaaaagaatagcacacatactcgaatatgtaaaaattttgatgatgtaagtttagtttaa

SEQ ID NO: 9868 - protein, 179 aa, Unknown
  Obtained from environmental sample
  misc_feature (1)..(179): Xaa is any amino acid
MCQFTKKEVEDYYKEYIESMATFGEMGLDRILLGKKIVSYIDDSVENILEIGTGKGSLTVLLAQQSKQVTSVDIDKENQYKAQLLAAHQGVSKNVSFKLSDAQEKLYEDKSFDLVISAFSFHHFDKPFTVIDQMIRMAKKQVIITEFNEEGFRIVEKIHXKKNSTHTRICKNFDDVSLV

SEQ ID NO: 9869 - DNA, 705 bp, Unknown
  Obtained from environmental sample
  misc_feature (1)..(705): n is a, c, g, or t
ttgactgtacgaaaaattgaagatacggcgtatttttatatcaatgaaacgcttcttcacagcatgccgttcaaaccgttttatgggaatcgactcggatttcataccgcggcccattctactatcaatgttgactatattcgggtgtcatatctggacaataagcttatccgggagatcttatcagcgaaaaaaacgaagctttatgccgatgaattttttgataacagcaatgagtggagtgtcgggtccaaaaattccaaagggaaggtgagtcgtggaaactatgaatatgaggggacacatgatgaaagcaaagcctctcaccaagtaatatctattgatacaaaccgggattttgaaattgaaacactgatgaaaatcgcaaaaggtgacaaactgaaggggaacggtctgttatgggggattgggaaaaaaccctatcgcgattatggctttatgtttaacaataacggcagctacgaaatcaatacctatgaaaaaacttacaatcgttatgtcgactggaccaaatcaaaatttgtaaaaaagaacgcatacaacaaactctccgttcgaaaagtcgatgatacgatgtatttttacctgaacgaccattttctcttcagtatgccgttcaaacctttctacggggatcgcatcggattccaggtcgcaggccattctcttatcagggtggattaa

SEQ ID NO: 9870 - protein, 234 aa, Unknown
  Obtained from environmental sample
  misc_feature (1)..(234): Xaa is any amino acid
MTVRKIEDTAYFYINETLLHSMPFKPFYGNRLGFHTAAHSTINVDYIRVSYLDNKLIREILSAKKTKLYADEFFDNSNEWSVGSKNSKGKVSRGNYEYEGTHDESKASHQVISIDTNRDFEIETLMKIAKGDKLKGNGLLWGIGKKPYRDYGFMFNNNGSYEINTYEKTYNRYVDWTKSKFVKKNAYNKLSVRKVDDTMYFYLNDHFLFSMPFKPFYGDRIGFQVAGHSLIRVD

SEQ ID NO: 9871 - DNA, 780 bp, Unknown
  Obtained from environmental sample
  misc_feature (1)..(780): n is a, c, g, or t
atgattcgccttatgacagttcataaggttaatgtaaataataattgtaagaatgtagctatgcaaaatagtctatataaaaaaatattgttaaaaataaaaactcttatagtgtcattttataaatatattaaaaatcctataaaaaaagaaaaaatagatatattatattttacaagaaaatctgaattacaagatattattcatcaaaagttatttaatagatattcagatacactaaaatatttttttgatgaacaatataaaattaaagttttagaaatcaaagataatgagatagatgctgatgtaacatatattgattttctaataaaaatagtacaagttaaaattaaaataaaaaaattatttaagttaaatcagaactttgatgtaagatcaataaatgatgtaataaagagtgagtttaactttacattagatatagttacattaaagaataatttatttttaatttatgaattatctttaatgtttgaaaaaatcctcaaaaaactagatccaaaagtagtctttcttgtatgcttttatagagttgatgctatggctatgtctctagcttgtcataatctagggataaaaaccgttgaataccaacatggtgctcaaaatgacaatcatttaatgtacactagttggttacattgtcctaaaaaaggatatgaacttatacctgatacattttggatgtggggtgatataaataagcaaagaatagataaatgggctacaaagacaaataaacataaagctatatag

SEQ ID NO: 9872 - protein, 259 aa, Unknown
  Obtained from environmental sample
  misc_feature (1)..(259): Xaa is any amino acid
MIRLMTVHKVNVNNNCKNVAMQNSLYKKILLKIKTLIVSFYKYIKNPIKKEKIDILYFTRKSELQDIIHQKLFNRYSDTLKYFFDEQYKIKVLEIKDNEIDADVTYIDFLIKIVQVKIKIKKLFKLNQNFDVRSINDVIKSEFNFTLDIVTLKNNLFLIYELSLMFEKILKKLDPKVVFLVCFYRVDAMAMSLACHNLGIKTVEYQHGAQNDNHLMYTSWLHCPKKGYELIPDTFWMWGDINKQRIDKWATKTNKHKAI

SEQ ID NO: 9873 - DNA, 582 bp, Unknown
  Obtained from environmental sample
  misc_feature (1)..(582): n is a, c, g, or t
gtgggtagttttggagatatttcttgtttttcattttttggtaataaaataattacaacaggtgaaggtggaatgtgtttaaccaattctgttaaaataaatgataaattaagacaattaagagatcatgggatgagtaaaacaagaaaatattggcatgatatgattgggtacaactatagaatgacaaatatacaagcagctattggttgtgctcaacttgaaaggatagatgaaataatagggattagacaagatatagaaaacaagtatcttgatatttttaataaatataattatattaccaaacagaaaaactttcctaacattaaaaaagtatcatggctagtttcagcaatacttgataaaaaggatatggatatatttgttcaacattttaaaagtaatgatatagatgtaagaaactttttttatccactaagtggaatggatatatataaacaatatagttttggtagtaatactatttcaaaaaaattgtcaaaaaaaggtatcaattttccaacgcatagcgatgtggattttaaacgaatagatgaaagttttaaaagttttagataa

SEQ ID NO: 9874 - protein, 193 aa, Unknown
  Obtained from environmental sample
  DOMAIN (1)...(193): DegT/DnrJ/EryC1/StrS aminotransferase family
  misc_feature (1)..(193): Xaa is any amino acid
MGSFGDISCFSFFGNKIITTGEGGMCLTNSVKINDKLRQLRDHGMSKTRKYWHDMIGYNYRMTNIQAAIGCAQLERIDEIIGIRQDIENKYLDIFNKYNYITKQKNFPNIKKVSWLVSAILDKKDMDIFVQHFKSNDIDVRNFFYPLSGMDIYKQYSFGSNTISKKLSKKGINFPTHSDVDFKRIDESFKSFR

SEQ ID NO: 9875 - DNA, 699 bp, Unknown
  Obtained from environmental sample
  misc_feature (1)..(699): n is a, c, g, or t
atgcttagtctagcttttactgataaaagccttgaagttcaacgtcaggtagtaattgaagagtttaaacaaaattatttaaaccaaccttatggcgatgtttggcttttacttaggcctttagcctatgaagttcacccttacaaatgggccactattggaaaagaaattagccacattgaaaatgctactatgcaggatgtaaaagacttttttaatacttattatactccaaataatgctattctatctgttgccggaaatattgaattagatgaaataaaacaacttaccgaaaagtggtttggaggcatctcatcaggaaataacaacaagagaaatttaccaaaagaacctttgcaaaaagaagcaagaagattagaagtaaaaagaaaagtgcctgcaaatgctatttataaagcttacaaaatgtgtagcaaaacacatcctgatttttatgctaccgacttacttacagatattctatctttaggaaactcatctaaactttatatttctctcattaaagaacaaaaactttttagcaatattaatgcgtatgttttgggaagttttgatgacggacttcttattattagcggtcatatttctgaaaacacatcttttaatgatgctgaaaatggaattataaatgaactcgaaaaaataaaaaaactagcggtaactcctaggaattga

SEQ ID NO: 9876 - protein, 232 aa, Unknown
  Obtained from environmental sample
  DOMAIN (62)...(231): Peptidase M16 inactive domain
  misc_feature (1)..(232): Xaa is any amino acid
MLSLAFTDKSLEVQRQVVIEEFKQNYLNQPYGDVWLLLRPLAYEVHPYKWATIGKEISHIENATMQDVKDFFNTYYTPNNAILSVAGNIELDEIKQLTEKWFGGISSGNNNKRNLPKEPLQKEARRLEVKRKVPANAIYKAYKMCSKTHPDFYATDLLTDILSLGNSSKLYISLIKEQKLFSNINAYVLGSFDDGLLIISGHISENTSFNDAENGIINELEKIKKLAVTPRN

SEQ ID NO: 9877 - DNA, 516 bp, Unknown
  Obtained from environmental sample
  misc_feature (1)..(516): n is a, c, g, or t
atgaatagaaaatctagttatacaatttacgatactacaaaaaaagcttgggcagctatgtttgagtctataaaaaatgctgaaaaatcaatttattgggaagtatatattttaattgatgacgaaattggaaataatttttttgatattttaatagaaaaagcaaaaaagggagtagaagtaaaattaattttagattattggggaagtttttggttatctaaaaagaaaattcaagaattaaaaaacggtggagtagacataagactttttcaacaaaagacaattccaattcgtggattaaaagactgggtatttaggagaactcatcgtaaaattttgattattgatgaagaaataggttttattggtggtgtaaatgttttaaaatcaatggaagattggaatgatattcatttgaaagttaaaggtaaaattgttaattccttattaagatctttttctaaatcatacatttcatgtggtggaaaaagaaaaaatgtaaaaaaattttaa

SEQ ID NO: 9878 - protein, 171 aa, Unknown
  Obtained from environmental sample
  DOMAIN (105)...(132): Phospholipase D Active site motif
  misc_feature (1)..(171): Xaa is any amino acid
MNRKSSYTIYDTTKKAWAAMFESIKNAEKSIYWEVYILIDDEIGNNFFDILIEKAKKGVEVKLILDYWGSFWLSKKKIQELKNGGVDIRLFQQKTIPIRGLKDWVFRRTHRKILIIDEEIGFIGGVNVLKSMEDWNDIHLKVKGKIVNSLLRSFSKSYISCGGKRKNVKKF

SEQ ID NO: 9879 - DNA, 897 bp, Unknown
  Obtained from environmental sample
  misc_feature (1)..(897): n is a, c, g, or t
ttgggaaggtttgtttttttgggatttaaggaaggtcggaggcaaaaaaaaattattaccccccaaaaagaaattgtggaagcaaaaactaaagaaataactgatagttttaactatgctaaaaatatacaaaattccattctacctactgagaaggaatttgaatctaccttaaaaaatagtttcatttattatcaaccaaaagacatagttgcaggagatttttattggatggaatctcccccaagttcacaaaaagaaggtgaaactatctactttgctgctgccgattgtacaggacatggggttccaggagccatggtaagtgtagtctgtaatggagcattaaacagagctattggtgagtacaacttaaaacaacctgctgaaatacttaataaagttagggaattagttattaaaactttcgagagaagtggtgatgactctaaacttagagatggaatggacatagctctttgtagtatccaactttcagaaaattacgcaacactacaatatgctggcgctaataacccactttggataattcgtccagttaacaacctcgaaaataaaacttctaactttgagcttgtagagattaaagcagacaaacaacctattggtaaacattttagacataataaatttactaaccatactgttaatttacaaaaaggagatactatttacatttttactgatggatatgctgatcaatttggtggtcctaaaggtaaaaaaatgatgtataaaccttttaaagaatttctaatttcaattcaggataaaaacatgcaagaacaaaaaatagctgttcaaaaccactttaaccaatggaagggagatttggaacaagttgatgatgtttgtgtaattgcagtaagtgtataa

SEQ ID NO: 9880 - protein, 298 aa, Unknown
  Obtained from environmental sample
  DOMAIN (87)...(298): Stage II sporulation protein E (SpoIIE)
  misc_feature (1)..(298): Xaa is any amino acid
MGRFVFLGFKEGRRQKKIITPQKEIVEAKTKEITDSFNYAKNIQNSILPTEKEFESTLKNSFIYYQPKDIVAGDFYWMESPPSSQKEGETIYFAAADCTGHGVPGAMVSVVCNGALNRAIGEYNLKQPAEILNKVRELVIKTFERSGDDSKLRDGMDIALCSIQLSENYATLQYAGANNPLWIIRPVNNLENKTSNFELVEIKADKQPIGKHFRHNKFTNHTVNLQKGDTIYIFTDGYADQFGGPKGKKMMYKPFKEFLISIQDKNMQEQKIAVQNHFNQWKGDLEQVDDVCVIAVSV

SEQ ID NO: 9881 - DNA, 807 bp, Unknown
  Obtained from environmental sample
  misc_feature (1)..(807): n is a, c, g, or t
ttgaataaaaatctaatcacagcagcgcttttatttgtttttggctacactatgttggctcaaaatgctatggaaattaatgctactgtgaaagtagaatcaaaaactataattgttgagcaaaccattgtttataaaaacgagtctaataccgttttaaaagacatttatcttaacgattggaataatagttattctaccaaatccactccattagccaaacgttttgaagaagaatttagcacaaaattccatttagctaaaagtgaacaacgtggctttactgttattacgtctattaaagatgaaaataacattcctttacagtaccaacgcttaaaggatcatattgatgtgattaaagtaaccttagaaacacctttacaacccaatgcctcatattccataaaacttaactaccaactcttaataccagatgctacatttacaggttatggcatttctaaaacaaatgattttgacttaaagtattggtacattacacctaccgtttatgatggtcaatggcaatattacagcaataaaaacttagatgatttatttgtacctaagtccgatatcatcctaagaataacccatccaagaaattataaagtctcttcagaattagattttaatgccgcanattctaataacgaagataaaacgcaaaccaccatacttagcggcaaagaccgcatagacacctacttgtcattaagaaatttcccaaatataattttgtaccgacccataatttttatcctatttctaatattagccgaaaaaggattccaaggccccgcc

SEQ ID NO: 9882 - protein, 269 aa, Unknown
  Obtained from environmental sample
  SIGNAL (1)...(19)
  misc_feature (1)..(269): Xaa is any amino acid
MNKNLITAALLFVFGYTMLAQNAMEINATVKVESKTIIVEQTIVYKNESNTVLKDIYLNDWNNSYSTKSTPLAKRFEEEFSTKFHLAKSEQRGFTVITSIKDENNIPLQYQRLKDHIDVIKVTLETPLQPNASYSIKLNYQLLIPDATFTGYGISKTNDFDLKYWYITPTVYDGQWQYYSNKNLDDLFVPKSDIILRITHPRNYKVSSELDFNAAXSNNEDKTQTTILSGKDRIDTYLSLRNFPNIILYRPIIFILFLILAEKGFQGPA

SEQ ID NO: 9883 - DNA, 924 bp, Unknown
  Obtained from environmental sample
  misc_feature (1)..(924): n is a, c, g, or t
atgccatctagcacaggttccgatagtaacgaaggcggtgagttaagtctggttaatcaggatgaaatggaggagatggtcgccattaccaccatgcacgcaaaagcgatgaacatctatggtgaagaagttagtaatcttgaaacgcgtcttgaatacctggaattgaagtgtgacaacagtatcgacaaagagtcgattgacccaaaacacatctgcgaagttttccagaaaaccatcgaaaatattgaaatagcaatcgaagtaaaactggttttttacaagttattcgaccaggaagtctgttccaaacttggcgtgatgtataaaacacttaatcggatttttatcgacaatgatatcatggcagagatcgttcttaagacgacaaaaccggaagaagtcgatcaagaagatgatgatgaagtttcaacacaggtcgcaagttattacgacccagcggtaaataaatcaacgaattttattccacgatccaatcaagatgtaagccacatcgtcaacgagttcatgagtggtgaaatgacgataacaggtgatgaacttaaactgcctgaatcattctcacgtgtaccgacacaacaagatttagatggaaaaaactgctacgagagaaaggaagtcctaaaggcactatctgctatccaacgtaagatcacatcattacataagagcggagaaaagtgcctgagcacagagcagatcanacaggaattaataacagatataagcaaacaacatggcggcattgttgataagcaggttaacttactccacgaacgaagtatcgattttgtcggtatgatgtttagctctatatcagatgatgacaccatctctgaaaatatgaccaacctcatatatcatttgcagatacctgtgaataaagttgccaatgttaaataa

SEQ ID NO: 9884 - protein, 307 aa, Unknown
  Obtained from environmental sample
  misc_feature (1)..(307): Xaa is any amino acid
MPSSTGSDSNEGGELSLVNQDEMEEMVAITTMHAKAMNIYGEEVSNLETRLEYLELKCDNSIDKESIDPKHICEVFQKTIENIEIAIEVKLVFYKLFDQEVCSKLGVMYKTLNRIFIDNDIMAEIVLKTTKPEEVDQEDDDEVSTQVASYYDPAVNKSTNFIPRSNQDVSHIVNEFMSGEMTITGDELKLPESFSRVPTQQDLDGKNCYERKEVLKALSAIQRKITSLHKSGEKCLSTEQIXQELITDISKQHGGIVDKQVNLLHERSIDFVGMMFSSISDDDTISENMTNLIYHLQIPVNKVANVK

SEQ ID NO: 9885 - DNA, 789 bp, Unknown
  Obtained from environmental sample
  misc_feature (1)..(789): n is a, c, g, or t
atgacaaatctatactaccgggcacgctcatattatcaatatagttatatttggcaaatgtataacgagcttggcggaaagttcatcctaactaacccaacatatatcgacagtattaacaacaaagtaggcaaagaaaatgtttatcttcatccgcggcgtcaagatctaccggaagaagtttccgggcttgttatggaaatgaccctgaacaatcgatactttctagaaagaacaaataagtttaaaaatgtattgatttatcatgggatgggcttggataaaagttttaaaggtcgtaattttcctgtaaaccgctatgattattattttgtttctggtgaaaaagattatttaaaatataagaattattccaaaggattcaagaattttaataaacgggttgttaagattggacatcttagatcagatgatattattaatgaaaaatatgataaagctgaaacaatcaagaaaatcggtataaaagaccaatccagaaagaatattttatttacaccaacctgggagaaaggacatggttctcttttggcaacctacgaaaaattctgcacccatattccaaaagaacataaccttctcattagaacacatccatatgatgttgaaaattatgaaaccatcacacaatatcttaacaagcataagatcgaaaatgtttacctgatctatcctgatgaaataagtttagtgaataatcttgccatagccgatttattgatcggagagaattcatctgtgatgtatgattggttattttttgaatag

SEQ ID NO: 9886 - protein, 262 aa, Unknown
  Obtained from environmental sample
  misc_feature (1)..(262): Xaa is any amino acid
MTNLYYRARSYYQYSYIWQMYNELGGKFILTNPTYIDSINNKVGKENVYLHPRRQDLPEEVSGLVMEMTLNNRYFLERTNKFKNVLIYHGMGLDKSFKGRNFPVNRYDYYFVSGEKDYLKYKNYSKGFKNFNKRVVKIGHLRSDDIINEKYDKAETIKKIGIKDQSRKNILFTPTWEKGHGSLLATYEKFCTHIPKEHNLLIRTHPYDVENYETITQYLNKHKIENVYLIYPDEISLVNNLAIADLLIGENSSVMYDWLFFE

SEQ ID NO: 9887 - DNA, 726 bp, Unknown
  Obtained from environmental sample
  misc_feature (1)..(726): n is a, c, g, or t
ttggactctcgtaaaagcgggagaaataattttaaattttttgataagaattctgaggtcttaaaacagcaagagcgaatgtctatgtggatgcataaaattcaagatgcaatacatgaagatgagttagtgccatattttcagcccattgtaaataacacaacaggtgaagtagagaagtatgagtgtctagctagaataataaaagatgatgaggttcatattccttttgagtttattaaagttgcggaaaaaattggactgcttagcagcattacaaaaaatattatcaataaaagttgtaaaaattttaaagatactaaatttgatttttcaataaatattacttctcatgatcttttgcaggattatttacaaagatatttgaccataaaatgtgatcactatgggattgatcactcaagagtagttttagaagttttagaagatattacttcattaaaagatgatctaatgtgtgaacaactaggtaaacttaaagaggcaggttttaaaattgctatagatgattttggaagtgaaagctctaacttctcaagacttttggagataagccctgattatattaagattgatggttcatttataaaagatattgtaactgacaaaaaatcattacttatagtaaagacaataactgcttttgctaaagagagtggtatcaaagtcatcgctgagtacgtgcataatgagcaaaccttttaa

SEQ ID NO: 9888 - protein, 241 aa, Unknown
  Obtained from environmental sample
  DOMAIN (26)...(241): EAL domain
  misc_feature (1)..(241): Xaa is any amino acid
MDSRKSGRNNFKFFDKNSEVLKQQERMSMWMHKIQDAIHEDELVPYFQPIVNNTTGEVEKYECLARIIKDDEVHIPFEFIKVAEKIGLLSSITKNIINKSCKNFKDTKFDFSINITSHDLLQDYLQRYLTIKCDHYGIDHSRVVLEVLEDITSLKDDLMCEQLGKLKEAGFKIAIDDFGSESSNFSRLLEISPDYIKIDGSFIKDIVTDKKSLLIVKTITAFAKESGIKVIAEYVHNEQTF

SEQ ID NO: 9889 - DNA, 834 bp, Unknown
  Obtained from environmental sample
  misc_feature (1)..(834): n is a, c, g, or t
gtgggtggtattcaaggtgatgaaccaggtggatttatggcagcttcacttatgacaacacactatgagattaaaaaaggttctgtttggatagttccaaaccttaacttttatagtattattaaaagaagtcgtggaccttttggagatatgaatagaaaatttgcaacactttccaaagatgatcccgaatatgaaaccgtacaaagaattaaaaaatatatcaaagatgaccatgtaaaacttatcttaaatcttcatgacgggagcgggttttatagacctacttatatagatagatggcatcagcctcgtacttgggggcaaagtagtgtaatagaccagaaggtattagataatgttgaaaaatatgctaatacttatgagatatcagaacaagtagttgaacatctcaataagtttcttttaaaagaagaagatagatatagaacaaaaaatacccatacaaaatttaacaaaactcatgaagaacaagagatggctaaaactcttacatattatgctgtaaaacaagggaaagcagcttttggacatgaaacaagtaaaagcctaaatgtatcccaaagagtttattataaacttcttgctatggaaaaatatatggatattatggggataaaatatacaagaaaatttcctttaactttaagtggggtaaaacatgcattaaatgatgacattagtatcacttttaacgatacaaatataaaaatgccacttaaagatataagaaatattcaaaaatattttccagtaaaaaaagatggcatagttacatacttacccaagtatcctttaataaaaatcatttaa

SEQ ID NO: 9890 - protein, 277 aa, Unknown
  Obtained from environmental sample
  misc_feature (1)..(277): Xaa is any amino acid
MGGIQGDEPGGFMAASLMTTHYEIKKGSVWIVPNLNFYSIIKRSRGPFGDMNRKFATLSKDDPEYETVQRIKKYIKDDHVKLILNLHDGSGFYRPTYIDRWHQPRTWGQSSVIDQKVLDNVEKYANTYEISEQVVEHLNKFLLKEEDRYRTKNTHTKFNKTHEEQEMAKTLTYYAVKQGKAAFGHETSKSLNVSQRVYYKLLAMEKYMDIMGIKYTRKFPLTLSGVKHALNDDISITFNDTNIKMPLKDIRNIQKYFPVKKDGIVTYLPKYPLIKII

SEQ ID NO: 9891 - DNA, 741 bp, Unknown
  Obtained from environmental sample
  misc_feature (1)..(741): n is a, c, g, or t
ttgtttgaaggtcataagcatcaaggctataaagttggagatatcagaggtggaattagagtctccattccaatcacactgcattctgaatatttgaatattttgaaagaaaaaacaagaaacagcatactagttgtactcataacttcaataacactaattggcatcttatattggttcataaatatgctttttagacgtaagcatgaaatagaacatgcaaaagagatactcgaagaaaaagtttcgcaaagaactcgcgacttagaagttgttgtatctcacgagcagcatctaaaagatgtgctaaaaactataaccgaagtaaatgagatgcttataacatcctactccattcacactatcttaaaaaatgcgacttttaaacttgcaacaaataagtcatactctttagttttaagtggattaattcatgatgatattttagaaatcatatctaagtctgctgatggaaaagatttaataacacagaacatagtttcacttgaaaatggtgaaaaaacaaactttttatttgatgcagttaaaatagctgtcaagttaaaacactccattatagaaaaaatttcgcctgaactagaagacagtaaagtacttagacgagaagatgatataaatctaaattggatgatagttttacccgctatgcaaagtttagatagtgatgtatatggaataattactgtattttgttcaagaaaaaaagggtttgaaggttaa

SEQ ID NO: 9892 - protein, 246 aa, Unknown
  Obtained from environmental sample
  misc_feature (1)..(246): Xaa is any amino acid
MFEGHKHQGYKVGDIRGGIRVSIPITLHSEYLNILKEKTRNSILVVLITSITLIGILYWFINMLFRRKHEIEHAKEILEEKVSQRTRDLEVVVSHEQHLKDVLKTITEVNEMLITSYSIHTILKNATFKLATNKSYSLVLSGLIHDDILEIISKSADGKDLITQNIVSLENGEKTNFLFDAVKIAVKLKHSIIEKISPELEDSKVLRREDDINLNWMIVLPAMQSLDSDVYGIITVFCSRKKGFEG

SEQ ID NO: 9893 - DNA, 834 bp, Unknown
  Obtained from environmental sample
  misc_feature (1)..(834): n is a, c, g, or t
atgagaattacaatatttatgacaatttttttaatagtttttgcgttaattagtttttatgtatcaaaaaggtttatcagtaagttggatataaacactagatataaaaaatatttcaacatatttttagtgataaactttataggtattattggatatataataggacgatattatgctaatatccctaatacaatatactttttattttcacttcctattggtgtactatttttacttttttgtacagcagttatatatgacatctctagagttactatagaaaagataccccttaaatctactagacgaaaattttttaaaaaatctcttgatattttttccctaataggtgcagttgcattaagtggaagagccttatatgaagcaagatttgtaaaaatagaaaaagtaaatataaaattgaaaaatctacaacaaccatataaaatagtacagttaagtgatattcatattggtggacttatagatgagaaatttattggtgatattgtttctcgtgtgaataatttacaaccagacatggtagttattacaggagacttaatagatattaaaattaattctgcaaaaaaagctttaaaagaatttacaaacattgaatcaatttatggtacttatttcatagttggaaatcatgaatattttcatgggattgaagagattattactacaatgaaatctcttggtatagtggtattggaaaatgaaaatgtttatattggagaaaaaggtaaaggatttattttagccggagtatatgatgttttgggctatagaggcaataggtaccaacccggatataaaaaaagc

SEQ ID NO: 9894 - protein, 278 aa, Unknown
  Obtained from environmental sample
  misc_feature (1)..(278): Xaa is any amino acid
MRITIFMTIFLIVFALISFYVSKRFISKLDINTRYKKYFNIFLVINFIGIIGYIIGRYYANIPNTIYFLFSLPIGVLFLLFCTAVIYDISRVTIEKIPLKSTRRKFFKKSLDIFSLIGAVALSGRALYEARFVKIEKVNIKLKNLQQPYKIVQLSDIHIGGLIDEKFIGDIVSRVNNLQPDMVVITGDLIDIKINSAKKALKEFTNIESIYGTYFIVGNHEYFHGIEEIITTMKSLGIVVLENENVYIGEKGKGFILAGVYDVLGYRGNRYQPGYKKS

SEQ ID NO: 9895 - DNA, 876 bp, Unknown
  Obtained from environmental sample
  misc_feature (1)..(876): n is a, c, g, or t
ttgatgtatttaataacttcattttatatgttaaagtcgaatattaagcaggttattaaatcaaaatatgtactatttctttcaatatttcttttaatagggcttgtattttataccgaaaaattcccaacatatcatagtgttattttttcaggaacgatagtatttttatttttaatagtaattggaattttacaaaaaacttcaattaaggtttcattattaattattcctgctatgctatgttgggtgttagcactttcaaacattgtatatttaggagaccaaaaaatattaaattattcaataatagaaacgggatttggaagtgaattttttcgagtagtaaggtcttccggcaggtttttttgggtaacaaacattatatttttaattgcttcattataccttatctttaagtatataaagaggttaatatacttgtattttatagtaatactttgtattggttttcaaatagcagatttttcaaatatttcaaaatatacagaaactaaaaaagggggtgctataaatgttcctaaatactttcaagaattactctcccaagctaagcgaattaattttgttgaagtaaaagattttcatatttcattatttgctataagaaacaagattccaataaactcattttatatggcacatggatatggagaacttacccaaaaaaaattagacgaacaaagtaacttgttggctacaagaaatgatgcattaaatgactcaacagtttatatttttaaaaaatataaggtatcgtcaattaaatctatctttgaggcaaaggtatatgaatataacgatgagctttttattatgacttctgataaattcaatttaagnngaaaaaactga

SEQ ID NO: 9896 - protein, 291 aa, Unknown
  Obtained from environmental sample
  misc_feature (1)..(291): Xaa is any amino acid
MMYLITSFYMLKSNIKQVIKSKYVLFLSIFLLIGLVFYTEKFPTYHSVIFSGTIVFLFLIVIGILQKTSIKVSLLIIPAMLCWVLALSNIVYLGDQKILNYSIIETGFGSEFFRVVRSSGRFFWVTNIIFLIASLYLIFKYIKRLIYLYFIVILCIGFQIADFSNISKYTETKKGGAINVPKYFQELLSQAKRINFVEVKDFHISLFAIRNKIPINSFYMAHGYGELTQKKLDEQSNLLATRNDALNDSTVYIFKKYKVSSIKSIFEAKVYEYNDELFIMTSDKFNLXXKN

SEQ ID NO: 9897 - DNA, 708 bp, Unknown
  Obtained from environmental sample
  misc_feature (1)..(708): n is a, c, g, or t
ttgccgggatatcaatcgctcattattgagaatgtccctgttagagctggaggtaccgcgagcggtcagaacttctttttcaacgaaacatcttcagaggataatattgttgataaaattgatctttctatcctgccaaacccattcagcccagcggggagtggacgtggctctgaaacaaaaacatccttcagtttaacagaagaaagcaatgttaagatagatgtttataatattaaaggacaattggtttcacaacttcttaactcaaaactacctttggggaaacattttatcaattggaacggatgcgattcctataatcagaagctatcttctggaatctatttaatttccttaaaagtagataataaccaagtattaatcaaaaaagcattattgttaaaatattattgctgcttaaggacaaaatgcaaaaaaacaatctttacaccattcccagatattaccgtccatatcgtaaatgccaagctctttgggttatttgccgcctacagaatgtgctttgctgcttggattcaatggtgctggaaagaggactcgaacctctggcctactgattacgaatcagttgctctaccacctgagctattccagcacattcaatggattatcaaaaaagaattaattcttcgctgttccgcacatcanaatgcagccagcttacccccatctctatacctttaa

SEQ ID NO: 9898 - protein, 235 aa, Unknown
  Obtained from environmental sample
  misc_feature (1)..(235): Xaa is any amino acid
MPGYQSLIIENVPVRAGGTASGQNFFFNETSSEDNIVDKIDLSILPNPFSPAGSGRGSETKTSFSLTEESNVKIDVYNIKGQLVSQLLNSKLPLGKHFINWNGCDSYNQKLSSGIYLISLKVDNNQVLIKKALLLKYYCCLRTKCKKTIFTPFPDITVHIVNAKLFGLFAAYRMCFAAWIQWCWKEDSNLWPTDYESVALPPELFQHIQWIIKKELILRCSAHXNAASLPPSLYL

SEQ ID NO: 9899 - DNA, 684 bp, Unknown
  Obtained from environmental sample
  misc_feature (1)..(684): n is a, c, g, or t
gtggataaaacaaaatgggcaaaaaatataagggaaaatactatgaatgatattatagaagcgataaaaagatcaacaattcagatacaacaaactattaaaaaaggtgatactagcaaaagtgaacaacaaaactcaacgggagatactcaactcaaacttgatataaaaagtgatatcattatagaaaataatttcaaacaactatcttgtgtaaaacaaattgtaagtgaagagcaagataatattgtaaatattaatgaaaatggagaataccttatagcatatgacccacttgatggaagtagtttagttgatgtaaacttatctgttggttctatttatggtatctataaaaatgattttactggtgataatatagttgcctctatttatgtggtctttggtccaagagttgagatgattatttgtgatggagagagtgtaaaactttatcgagtaaataatgaagagtttcactatataaaagatatcactatgagtcnaaagggaaatatcaactcgccaggctctacacaacaatgttggtacccacaccataaagagatgataaataatatgtttaaagagggatatgaactcacctatagtggtggaatggtacctgatttacaccatatctttgtacgaggtgggtggattattctcttacccaggtgctag

SEQ ID NO: 9900 - protein, 227 aa, Unknown
  Obtained from environmental sample
  DOMAIN (1)...(225): Fructose-1-6-bisphosphatase
  misc_feature (1)..(227): Xaa is any amino acid
MDKTKWAKNIRENTMNDIIEAIKRSTIQIQQTIKKGDTSKSEQQNSTGDTQLKLDIKSDIIIENNFKQLSCVKQIVSEEQDNIVNINENGEYLIAYDPLDGSSLVDVNLSVGSIYGIYKNDFTGDNIVASIYVVFGPRVEMIICDGESVKLYRVNNEEFHYIKDITMSXKGNINSPGSTQQCWYPHHKEMINNMFKEGYELTYSGGMVPDLHHIFVRGGWIILLPRC

SEQ ID NO: 9901 - DNA, 771 bp, Unknown
  Obtained from environmental sample
  misc_feature (1)..(771): n is a, c, g, or t
atgaaaaatataaaagagcgaatcaaagagaatccatacatcttaacctctattaacggtatcggttttaaaagggcagatgagttagcactcaaaatgggagttgatactaaaagtgaaaaccgcataagctctgctatggattttgtgcttcttgaagagtgcgagcgaaacggcaacagtgccattgaaaagagtaaacttttttcaaaactagatgagcttttaggttttcataactcagagattctctatgaatcgatcttagttatgatggtttcagaagagactatagtacatttagcccatgagaggctctctccaaaaagactctatgatgctgaaaaatatctctacgatcagtttaaaagccgttcctctcttaagtatgagaagatagagaaagatttagatacatttttagagaactccacacttaagttgggagaccagcaaaaagatgcagtccagatcataaacaacggctcaaaacttctctttttagtaggttatgcaggaacaggaaagagcactacttcccgcgctattttagatattttatgtaaaagatactctgctgaaaatattatgacttgtgcactgagtggaattgcatctcanagaattgcagagacgacaggttatgagagtgcaaccatacagtcgcttcttatgaagtttgaagataaagatgagatgccgtactctgttgttttaatcgatgaagcctctatgattaactcatctttgtttgcaaggttagttggctaa

SEQ ID NO: 9902 - protein, 256 aa, Unknown
  Obtained from environmental sample
  misc_feature (1)..(256): Xaa is any amino acid
MKNIKERIKENPYILTSINGIGFKRADELALKMGVDTKSENRISSAMDFVLLEECERNGNSAIEKSKLFSKLDELLGFHNSEILYESILVMMVSEETIVHLAHERLSPKRLYDAEKYLYDQFKSRSSLKYEKIEKDLDTFLENSTLKLGDQQKDAVQIINNGSKLLFLVGYAGTGKSTTSRAILDILCKRYSAENIMTCALSGIASXRIAETTGYESATIQSLLMKFEDKDEMPYSVVLIDEASMINSSLFARLVG

SEQ ID NO: 9903 - DNA, 699 bp, Unknown
  Obtained from environmental sample
  misc_feature (1)..(699): n is a, c, g, or t
ttgtttgtgaatacagatggttctattttttataccctccgcaaagaatcggatacgaatatcaatataaataacaacagcgtgtctttgggtatattggaagaagcaatcaaaaatagaccggatcatgaagtgtttattgattactatgaatataccccttcttctgagccagctgcattttttattgagcctattaagaaacaaggtgttttaaagggatggatagtccttcaatgtacaattaacaattttaattctatcttttctgccacagatgatcttggtcagacaggcgaaacttttttggtgaataagaacggggtaatgttgaccgaatctttttttaaaggccagtcaacaattttaaaaacacaccttgctgatcgaaatattaaggtaaaatttgctgaacgtaaaggtcatcgggtggtcactgactatcgcggggcaacggcgctgagttcttttgaagtttttgagtatctgggaaccagctggctggttgttgcaaaaatagataaggatgagataaccacagatcactataagcaacatcataaatattatgaaaaaatgcttttaaaacatctcagaaacctccagcccatgccgacatccaatacgaaagatcatcatcctcctgcaggtgcattgagagtggacatggatgaattttttaaaagcaacaaaccatga

SEQ ID NO: 9904 - protein, 232 aa, Unknown
  Obtained from environmental sample
  misc_feature (1)..(232): Xaa is any amino acid
MFVNTDGSIFYTLRKESDTNININNNSVSLGILEEAIKNRPDHEVFIDYYEYTPSSEPAAFFIEPIKKQGVLKGWIVLQCTINNFNSIFSATDDLGQTGETFLVNKNGVMLTESFFKGQSTILKTHLADRNIKVKFAERKGHRVVTDYRGATALSSFEVFEYLGTSWLVVAKIDKDEITTDHYKQHHKYYEKMLLKHLRNLQPMPTSNTKDHHPPAGALRVDMDEFFKSNKP

SEQ ID NO: 9905 - DNA, 459 bp, Unknown
  Obtained from environmental sample
  misc_feature (1)..(459): n is a, c, g, or t
ttgtttgggagccaattgaatttaggtgaagatagacttactaaattgggtcgttctgctctcttacatgatcttggtaagagtaagataaaatctagcattcttaataaaacagataaactgacaaacgatgaatatgaagagatgaaaaaacattcatcttacggatgcgatattgcaaaaaatattggaatagttgataaagaaattttagacggcatacgtcatcatcatgaaaaacttgatggaatgggttatccagacaatcttaagaatgatgaaataaacatatttccaagaatcataggtgtatgtgatgtctttgatgcattgactacaaagcgctcttataaagatgcaatgagttcatttaaagctctaaatttaatgaaaacagagatgagcactcaccttgacaagaatatcgtaaatgcttttataaagatgcttcacaaatag

SEQ ID NO: 9906 - protein, 152 aa, Unknown
  Obtained from environmental sample
  DOMAIN (1)...(111): HD domain
  misc_feature (1)..(152): Xaa is any amino acid
MFGSQLNLGEDRLTKLGRSALLHDLGKSKIKSSILNKTDKLTNDEYEEMKKHSSYGCDIAKNIGIVDKEILDGIRHHHEKLDGMGYPDNLKNDEINIFPRIIGVCDVFDALTTKRSYKDAMSSFKALNLMKTEMSTHLDKNIVNAFIKMLHK

SEQ ID NO: 9907 - DNA, 438 bp, Unknown
  Obtained from environmental sample
  misc_feature (1)..(438): n is a, c, g, or t
ttggagagagagaagttggaggacgccgtattttttaaaaatgcatattttaatgaaattaggcaactgccaaatagaacaaatgttgagatactcattggtgagcaaattgaacgctcgcatagacacgagaagccttttttaatcacaactatcgaatatctaaactatgacgaaaactcagttgtcgagttaagcaatctgatatcggagtccataagagatgaagatattctcgcccatatcgaaaatagagtctttttaatcctgtttaacgaatacctagaagataaaaactttacaatcctgctcagacgatttcaaaaaaagttggccgaacataaaaagtttcaagtagagataggaaaaagcaactaccctaaagattcccaaacagcatcaggtctaatagacgaggcgaaaaaacatatccagtag

SEQ ID NO: 9908 - protein, 145 aa, Unknown
  Obtained from environmental sample
  misc_feature (1)..(145): Xaa is any amino acid
MEREKLEDAVFFKNAYFNEIRQLPNRTNVEILIGEQIERSHRHEKPFLITTIEYLNYDENSVVELSNLISESIRDEDILAHIENRVFLILFNEYLEDKNFTILLRRFQKKLAEHKKFQVEIGKSNYPKDSQTASGLIDEAKKHIQ

SEQ ID NO: 9909 - DNA, 834 bp, Unknown
  Obtained from environmental sample
  misc_feature (1)..(834): n is a, c, g, or t
atgactgcggtcaatcaactgagccgaaaaggctatcatgcccaaccgctcagacgtatctacatccccaagaaaaacggcaaactcagacctttaggcattccctgcatgatagacagagcgcagcaagcgctgcatcttctcgccttggagcctatttcagaaacggtagccgacctcaatagctatggctttcgacctaaccgaagcacagcagatgccattgcacagtgcttcaaatgcttgtgtcagaaaagctctagccaatgggttcttgagggtgacattaaagcctgtttcgataagataggtcatcaatggctcatcgacaacattcaattagataaacgaatgctgaaacaatggcttggatgtggttatgttgataaaggattgttctacaaaacagcagaaggaacaccgcaaggcgggataatttccccaacgctgatgttgctcacgctggcagggttagagcagttggttaagactattgcctgtaaaacagggaatagagtcaactttatcggatatgcagatgattttgttatcacaggttcttcgaaggaagtgctcgttaatgacatcaagccgcagctaattggttttctacaggaaagaggcttaacactctctgatgagaaaacgcacataactcatatcgatgatggttttgactttctgggattcaatatcccgaaagtacaaagggcaacctgctcatttaaaccgaagcaaagagccaaccgttctattccattttttgaagtaaatcctaccgtggaaatttttatccagaaaaaaccatccccaacaaaattccccccgttttaa

SEQ ID NO: 9910 - protein, 277 aa, Unknown
  Obtained from environmental sample
  DOMAIN (13)...(232): Reverse transcriptase (RNA-dependent DNA polymerase)
  misc_feature (1)..(277): Xaa is any amino acid
MTAVNQLSRKGYHAQPLRRIYIPKKNGKLRPLGIPCMIDRAQQALHLLALEPISETVADLNSYGFRPNRSTADAIAQCFKCLCQKSSSQWVLEGDIKACFDKIGHQWLIDNIQLDKRMLKQWLGCGYVDKGLFYKTAEGTPQGGIISPTLMLLTLAGLEQLVKTIACKTGNRVNFIGYADDFVITGSSKEVLVNDIKPQLIGFLQERGLTLSDEKTHITHIDDGFDFLGFNIPKVQRATCSFKPKQRANRSIPFFEVNPTVEIFIQKKPSPTKFPPF

SEQ ID NO: 9911 - DNA, 363 bp, Unknown
  Obtained from environmental sample
  misc_feature (1)..(363): n is a, c, g, or t
atgaaattgaatattttaaaatggacattaggtctgttggtgctaatatcattcgtgagttgtaattataactccaacagaatgttaaaaactcctaaagattataagtttgcagcaccgccaaccgatagtaaccctttatatgttattgcagttagtgatatattagagtttaaactttatactaatgatggtacttctttggtagattttactgctattgatggtggtggtgcaggtgtagcaaggcaacaagttagtcaagttcaatatttaatagattatgatggtttttgtaaactacccatagtaggaagaattgaattaagaggaaaaacactaagagaagcagaaaaacattag

SEQ ID NO: 9912 - protein, 120 aa, Unknown
  Obtained from environmental sample
  misc_feature (1)..(120): Xaa is any amino acid
MKLNILKWTLGLLVLISFVSCNYNSNRMLKTPKDYKFAAPPTDSNPLYVIAVSDILEFKLYTNDGTSLVDFTAIDGGGAGVARQQVSQVQYLIDYDGFCKLPIVGRIELRGKTLREAEKH

SEQ ID NO: 9913 - DNA, 594 bp, Unknown
  Obtained from environmental sample
  misc_feature (1)..(594): n is a, c, g, or t
atgaaaataaataaaaactctatactttttacaatcactattacatttattatatcaatattttttatgttgataagctttgttattctttatgaaaactcacaaaagagcactcaagagtttatgtttaaacgatcaatagatgtttctaaaacaattttaagagagtgtagaggtggcgtagttacagaagatttaattgggcaccttcaacggatggatttttctatgtttattgataagaaagaacaagaagagttgctgaacaataaacgaataattattttgatggaaaagcaaaagagatattcaatgatagccttattaaaacttgacggtaaatactatgcccatgttcaaacaccaagtctagatgttttagttaaagataatattgatataccagacaataaaatcacacttattatagtagctatatcagttgtatcgttatttatacttttatatcttctaactttaaagaaactattaaaagtgaatgttctaaaagataaggtgaagcatttagcaaatgaaaattttgatatagattgtgctacagagcatcaagatgagatactcgagccgatctga

SEQ ID NO: 9914 - protein, 197 aa, Unknown
  Obtained from environmental sample
  misc_feature (1)..(197): Xaa is any amino acid
MKINKNSILFTITITFIISIFFMLISFVILYENSQKSTQEFMFKRSIDVSKTILRECRGGVVTEDLIGHLQRMDFSMFIDKKEQEELLNNKRIIILMEKQKRYSMIALLKLDGKYYAHVQTPSLDVLVKDNIDIPDNKITLIIVAISVVSLFILLYLLTLKKLLKVNVLKDKVKHLANENFDIDCATEHQDEILEPI

SEQ ID NO: 9915 - DNA, 351 bp, Unknown
  Obtained from environmental sample
  misc_feature (1)..(351): n is a, c, g, or t
ttgagtttacttgattgtaaagttttgattttatctagtgatttttgtgtaatatttgggtcacttaagagttgtgttaaaaagttcaaagcaagttcatattcacttgttaaacaacttacctctataacaaaagtttcaaatccagttgatgtatttatagatattgcattattttctaattttctagcaaagtttactgcaccatcttttttagtcccttcgttaagaagtttagaaacaatattcgtaatccctggattaactccatcgtttatatatccactgttggtaaatactaattggaggttaaatatggtgagatttttatctttcaaatatgagtgctag

SEQ ID NO: 9916 - protein, 116 aa, Unknown
  Obtained from environmental sample
  misc_feature (1)..(116): Xaa is any amino acid
MSLLDCKVLILSSDFCVIFGSLKSCVKKFKASSYSLVKQLTSITKVSNPVDVFIDIALFSNFLAKFTAPSFLVPSLRSLETIFVIPGLTPSFIYPLLVNTNWRLNMVRFLSFKYEC

SEQ ID NO: 9917 - DNA, 942 bp, Unknown
  Obtained from environmental sample
  misc_feature (1)..(942): n is a, c, g, or t
ttgaaagataaaaatctcaccatatttaacctccaattagtatttaccaacagtggatatataaacgatggagttaatccagggattacgaatattgtttctaaacttcttaacgaagggactaaaaaagatggtgcagtaaactttgctagaaaattagaaaataatgcaatatctataaatacatcaactggatttgaaacttttgttatagaggtaagttgtttaacaagtgaatatgaacttgctttgaactttttaacacaactcttaagtgacccaaatattacacaaaaatcactagataaaatcaaaactttacaatcaagtaaactcaaacaaaaagagaatgattttgactatgttgcatcatcaaatcttaaacaaataacttataaaaacacacctttagcacacacaagtgctggaactgttgatacaatagagaaaataaaacttaaagatgtgaaaaaaagactcaaagatattttaaatatagataaccttatcattgcagttggcggagatataagttttaaagagttttcttcccatagtgagcctattttaaaaaatctgaaatctcaagggaaaacagattttaataaaatagcaatttctagtaaacctaaaaacaaaattatactcaaagaaacagaacaatcatacatatacttttcaagtcctttctatattgattctgattcaaaagagagctataaagcaaaagtagcctcttttatattgggtggtagtggatttggtagtcgacttatggaggagattagagtaaaaaatggtcttgcttacagtgcttatggacatataaaaaataataaatctcacagtgacttctctggatacctaccaaacaaacctagccatacacaaaaaggaaaaagatttgggtgggacctattgtttaaagaactttgtagataa

SEQ ID NO: 9918 - protein, 313 aa, Unknown
  Obtained from environmental sample
  DOMAIN (4)...(145): Insulinase (Peptidase family M16)
  misc_feature (1)..(313): Xaa is any amino acid
MKDKNLTIFNLQLVFTNSGYINDGVNPGITNIVSKLLNEGTKKDGAVNFARKLENNAISINTSTGFETFVIEVSCLTSEYELALNFLTQLLSDPNITQKSLDKIKTLQSSKLKQKENDFDYVASSNLKQITYKNTPLAHTSAGTVDTIEKIKLKDVKKRLKDILNIDNLIIAVGGDISFKEFSSHSEPILKNLKSQGKTDFNKIAISSKPKNKIILKETEQSYIYFSSPFYIDSDSKESYKAKVASFILGGSGFGSRLMEEIRVKNGLAYSAYGHIKNNKSHSDFSGYLPNKPSHTQKGKRFGWDLLFKELCR

SEQ ID NO: 9919 - DNA, 441 bp, Unknown
  Obtained from environmental sample
  misc_feature (1)..(441): n is a, c, g, or t
atgttgcatgatatttcaacagttattagaacagaggaacacttatctaatacacctaaacaaattcatgtgcgagagtctttaggatatgataaagagattcaatatatccatataccaagtatttctaaacttgaagaaaagaacaacttatctgtaaaataccttattgatgaggggtacttaccagttgctattgcaaattattgcgtacttcttggatataatactccacaagaaatatttactattgaagaggctattgagtggtttgatataaataaactctcccatgaacctgtagaatttgatataaataaacttaattttatcaataaagagcatctaaaaactatggataatttaagattatcaaaaattttaggttatgcagatgaagatttaggtaaattaggaaaaatatatttagaaggagtgtaa

SEQ ID NO: 9920 - protein, 146 aa, Unknown
  Obtained from environmental sample
  misc_feature (1)..(146): Xaa is any amino acid
MLHDISTVIRTEEHLSNTPKQIHVRESLGYDKEIQYIHIPSISKLEEKNNLSVKYLIDEGYLPVAIANYCVLLGYNTPQEIFTIEEAIEWFDINKLSHEPVEFDINKLNFINKEHLKTMDNLRLSKILGYADEDLGKLGKIYLEGV

SEQ ID NO: 9921 - DNA, 426 bp, Unknown
  Obtained from environmental sample
  misc_feature (1)..(426): n is a, c, g, or t
atgggtatagacggtgacacgactgccggtatcctctcccgtatgcaccaggtttctcaagccaagatcatcgtcttgatgatcggggtcaacgacatccttaatcagatacctctggtgagaatacaatccaactacaccaagatcttaaagacgttcacacacgatcagaacgtttatatcctttcacttttgcctgttatcgataccaaacagacacgcacgatcaatcaagagatcaaaacgataaacaagtggcttaaggttcaaacacaagcgtatggttttgagtatatagacctttaccctgattttttggatacgcataaaaaaggtcttaaagaagagttgacaaacgatggtattcacctgacacctaaagcctatagactgtggagcaggatattaaaagagagacttaaataa

SEQ ID NO: 9922 - protein, 141 aa, Unknown
  Obtained from environmental sample
  DOMAIN (4)...(136): GDSL-like Lipase/Acylhydrolase
  misc_feature (1)..(141): Xaa is any amino acid
MGIDGDTTAGILSRMHQVSQAKIIVLMIGVNDILNQIPLVRIQSNYTKILKTFTHDQNVYILSLLPVIDTKQTRTINQEIKTINKWLKVQTQAYGFEYIDLYPDFLDTHKKGLKEELTNDGIHLTPKAYRLWSRILKERLK

SEQ ID NO: 9923 - DNA, 315 bp, Unknown
  Obtained from environmental sample
  misc_feature (1)..(315): n is a, c, g, or t
atgccaatatatttttcagattttactttatcatccaatgcattaaagtttttcattgcttctagcgcagttgaaattgttgctatgggtgttttaaattcgtgtgtaatattatttattaagtcattttttacttcggcaagttgcttttgtttgtatatagtttttaacaaatacaccaaactggcaataatacttagcgacaataacaaagaaagcaaaatacttataaacgatttttgtaacaataacttagtttcgttggtaaaaaatagctgtaaattacttttatgtggtaaaaaaggtggattttga

SEQ ID NO: 9924 - protein, 104 aa, Unknown
  Obtained from environmental sample
  misc_feature (1)..(104): Xaa is any amino acid
MPIYFSDFTLSSNALKFFIASSAVEIVAMGVLNSCVILFIKSFFTSASCFCLYIVFNKYTKLAIILSDNNKESKILINDFCNNNLVSLVKNSCKLLLCGKKGGF

SEQ ID NO: 9925 - DNA, 741 bp, Unknown
  Obtained from environmental sample
  misc_feature (1)..(741): n is a, c, g, or t
ttgttacaaaaatcgtttataagtattttgctttctttgttattgtcgctaagtattattgccagtttggtgtatttgttaaaaactatatacaaacaaaagcaacttgccgaagtaaaaaatgacttaataaataatattacacacgaatttaaaacacccatagcaacaatttcaactgcgctagaagcaatgaaaaactttaatgcattggatgataaagtaaaatctgaaaaatatattggcattgctaattctcaggtacaaaaacttcatactatggttgaaaaaatattggaaactgcagttttaaataacgagcaccttattttaactaaaaaacctacaaatatttcagaattaattgaaaatgttattgaaaagtatcagttaattaatactgaaaaatttattacttttaccaataattgtgctgaaactgtgttaaatcttgatacctttcattttgaaaatgcacttggaaatattattgataacgctattaaatatggtggaaataaaatttcagttgaattgtcttcagaaaaaaataagctaattattttagtaaaagacaatggaaacggaattcataaaacacaaaaagataaagtttttgaacagttttacagaattccaacaggaaatacacacaatgtaaaaggttttggaattggtttgtattacacnaaanatattattgaaaaaccaccagggaagcattgctattatttacgataa

SEQ ID NO: 9926 - protein, 246 aa, Unknown
  Obtained from environmental sample
  SIGNAL (1)...(18)
  DOMAIN (39)...(107): His Kinase A (phosphoacceptor) domain
  misc_feature (1)..(246): Xaa is any amino acid
MLQKSFISILLSLLLSLSIIASLVYLLKTIYKQKQLAEVKNDLINNITHEFKTPIATISTALEAMKNFNALDDKVKSEKYIGIANSQVQKLHTMVEKILETAVLNNEHLILTKKPTNISELIENVIEKYQLINTEKFITFTNNCAETVLNLDTFHFENALGNIIDNAIKYGGNKISVELSSEKNKLIILVKDNGNGIHKTQKDKVFEQFYRIPTGNTHNVKGFGIGLYYTKXIIEKPPGKHCYYLR

SEQ ID NO: 9927 - DNA, 708 bp, Unknown
  Obtained from environmental sample
  misc_feature (1)..(708): n is a, c, g, or t
atgagaaaagtaaaagaaatattgggaggaatatggaaactacacgtaattgtgtgctttattgtatttttattactcttctatccgttttatagtaactacctcagaaaaggaaaagaacgaaaatttaaaaaagcgtttaggttattatattttcacaccaaaatattattaattctttcgggaataagagttaaactttacaacggacataacatagataaaaatcaaacctatgttatagcacctaatcatacttcttttttagatattgtaatcctttatcaaacatttaaaaattattttgtttttatgggaaaagaagaattggctaaagttccaatcttcaatatattctttaaaaatatgaatattacggtaaatagaaaaagtagaatttccggtaaaagagcaatggatagatgtgaagaggagcttaaaaaaggaaatagtgtggtagtctttcctgaaggaacaattcctaaaaatacgcctcaattgggtaattttaaaagtggagcttttaagttagctgttgaaaatcaaataccaattattcctattacttttttagataattacaaaagattagagatgaaaggacttttttctggaaaagcagggccaggaatagctagagcaattatacacgagccaatccctacaggtggcttaactgaaaaagatttaataccttttacaagataa

SEQ ID NO: 9928 - protein, 235 aa, Unknown
  Obtained from environmental sample
  DOMAIN (64)...(191): Acyltransferase
  misc_feature (1)..(235): Xaa is any amino acid
MRKVKEILGGIWKLHVIVCFIVFLLLFYPFYSNYLRKGKERKFKKAFRLLYFHTKILLILSGIRVKLYNGHNIDKNQTYVIAPNHTSFLDIVILYQTFKNYFVFMGKEELAKVPIFNIFFKNMNITVNRKSRISGKRAMDRCEEELKKGNSVVVFPEGTIPKNTPQLGNFKSGAFKLAVENQIPIIPITFLDNYKRLEMKGLFSGKAGPGIARAIIHEPIPTGGLTEKDLIPFTR

SEQ ID NO: 9929 - DNA, 513 bp, Unknown
  Obtained from environmental sample
  misc_feature (1)..(513): n is a, c, g, or t
atgactattttaataacaggaattagtagttatgtaggtaactacttaggtaactattatttaagtaaaaactataaagttataggagtatctaggactaatcctaacattacacatgataatttcacttttttacaatttgatttagaaaatagtattttaaacgtagtctgtgatttacttatacattctgcaggagaagcaagacttaatttaccatttgaagactattatgaaaaaaatatacaaatatcttataacataaaaaaatatattgaagtatataaaataaaagcattcttgttctcaacacataaagtatatggtataaataattccccatttatagaagaaactagtgatattataaccccttgtaaatatggtttaagtaaacttgtagcagagaagattttagaaaacaatgctgtaatattacggttacctgcattaattgcaaaaggctctaatggttggatatataaaactatacaaagtttaaatttaaaataa

SEQ ID NO: 9930 - protein, 170 aa, Unknown
  Obtained from environmental sample
  misc_feature (1)..(170): Xaa is any amino acid
MTILITGISSYVGNYLGNYYLSKNYKVIGVSRTNPNITHDNFTFLQFDLENSILNVVCDLLIHSAGEARLNLPFEDYYEKNIQISYNIKKYIEVYKIKAFLFSTHKVYGINNSPFIEETSDIITPCKYGLSKLVAEKILENNAVILRLPALIAKGSNGWIYKTIQSLNLK

SEQ ID NO: 9931 - DNA, 324 bp, Unknown
  Obtained from environmental sample
  misc_feature (1)..(324): n is a, c, g, or t
atgagagcagagaacataacaaccgcttacgataataataaactgtatttatttacagatatgaataaaattggatttatagactatacgataaaagacgaatttttaaaaaagatttatatcaatcaaatatcaatagatgcctattatcagaggcatggtttgggcagctatttaatagactgtttaaaaaaagagtgtaatagcctagcattgctgtcaattagcaaaggcttgaatatattttacgaaaaaaataattttgaagaagatttgttgaaaataaaacaaaggaacagtacaaattatttgtggaccaaatag

SEQ ID NO: 9932 - protein, 107 aa, Unknown
  Obtained from environmental sample
  misc_feature (1)..(107): Xaa is any amino acid
MRAENITTAYDNNKLYLFTDMNKIGFIDYTIKDEFLKKIYINQISIDAYYQRHGLGSYLIDCLKKECNSLALLSISKGLNIFYEKNNFEEDLLKIKQRNSTNYLWTK

SEQ ID NO: 9933 - DNA, 630 bp, Unknown
  Obtained from environmental sample
  misc_feature (1)..(630): n is a, c, g, or t
atgtataaagcaattatagtagatgacgaaaaaggcggaagagagcatttggctaccatcctaaaagaatttttcgatatagaaattaaagctcaagcagccaatgcaaaagaagctatttcggctattgaagaacacaaacccgatttgttgtttttagatattgaaatgccaggagaaaatggttttgatttattggaaaagttagaaactatcaattttgatgtaatttttaccactgcttatgatcattatgctataaaagccattaaatatagtgcattagattacttgttaaaacctattgatgctgatgagttagaagctgccataaacaggtttaaatctaaaattagaaaccaagaattaaccaataacaaactaaaaacactactcaataatttatcttccagtgataatggtcaggaacaaaaaattgttatccatgatggcgaaggattaaattttataaaaattaaggacatcatcaggtttcactccgagggaagttatactgatgtccatgtggttggtcaagaacaacattttgttacttcaaaacaaattggcgaatatgaagaaatgttgcttaatgaacaattttacagaattcaccgctcgtattacata

SEQ ID NO: 9934 - protein, 210 aa, Unknown
  Obtained from environmental sample
  DOMAIN (2)...(119): Response regulator receiver domain
  misc_feature (1)..(210): Xaa is any amino acid
MYKAIIVDDEKGGREHLATILKEFFDIEIKAQAANAKEAISAIEEHKPDLLFLDIEMPGENGFDLLEKLETINFDVIFTTAYDHYAIKAIKYSALDYLLKPIDADELEAAINRFKSKIRNQELTNNKLKTLLNNLSSSDNGQEQKIVIHDGEGLNFIKIKDIIRFHSEGSYTDVHVVGQEQHFVTSKQIGEYEEMLLNEQFYRIHRSYYI

SEQ ID NO: 9935 - DNA, 696 bp, Unknown
  Obtained from environmental sample
  misc_feature (1)..(696): n is a, c, g, or t
atgttgagtaatataataaattttacaattgatggacgtaaggtaaacgctgagggtaatgagtcaattttagaagtagcgcgtcgcgaaggtatctatattcctactatgtgttatcttcctaaaactaaccctggtgcatcttgccgtatgtgtgttgttgaagtaaaagatgttgagggatttgtactaagttgtaatacacctccagttgagggtgctgttatcacaacagacactcaagagttatataagcatcgtcaaaatattatgaaattatataatgtaaatcatccgcttcaatgtggtgtttgtgataaatctggcgagtgtgatctacaaaacaaaacattagagtttggacttgatgagcaatcattctcagcacaagagcacaaaagaaagataaagaagtggggcgttcttagttacgatccatatctgtgtattatgtgtgaaaagtgtacaagtgtatgtaatgaagtagtaggcagtgaagcactatatatgaagcttggtggttataactctgagattgataacaggtactccaaatgtattccgtgtggagagtgtatatctgtatgccctgtaggtgctatgaccagtattgattttaaatacaaagcaaatgcctgggaacttaaaaagattctttcatcttgggcgcactggctccagtgcctggtaacttga

SEQ ID NO: 9936 - protein, 231 aa, Unknown
  Obtained from environmental sample
  DOMAIN (179)...(202): 4Fe-4S binding domain
  misc_feature (1)..(231): Xaa is any amino acid
MLSNIINFTIDGRKVNAEGNESILEVARREGIYIPTMCYLPKTNPGASCRMCVVEVKDVEGFVLSCNTPPVEGAVITTDTQELYKHRQNIMKLYNVNHPLQCGVCDKSGECDLQNKTLEFGLDEQSFSAQEHKRKIKKWGVLSYDPYLCIMCEKCTSVCNEVVGSEALYMKLGGYNSEIDNRYSKCIPCGECISVCPVGAMTSIDFKYKANAWELKKILSSWAHWLQCLVT

SEQ ID NO: 9937 - DNA, 975 bp, Unknown
  Obtained from environmental sample
  misc_feature (1)..(975): n is a, c, g, or t
aagcctgatgattgccataaaaggcttacgaaagggaaatggaagggggttaaaaatcatcttcgaacatatcatcgatttcctccattaaacttttccaagcagataaagaaaaaatatgttaaagatttttcacgtaaaacggaattacgaaattttgacaccattgaggctgctgctgttgctgttgctaaccagaaactttacctaaatcgtgaggaaggctttgctggtactgcgcttaaaaaagatgaatacatttcggaatgttccgacatcgacgatattattgttttcagaatcgatggtacttttatggttactaaggtaagttctaaattatttgttggcaaggatgtccttcatattcaggttttcgacaaaaacgatgacagaacaatctacaaccttatttaccgtgatggcaaactcggcaattactatgtgaaaagatttagcgttacaagcattacacgcgacaaggaatatgatttaacaaagggaggtgcaggtacaaaagttatttatttcacccacaatcccaatggtgaagccgaaattatcagaattcacctacgtcctaaaccaaggttatcaaaaaccagttttgattttaactttagcgaattggccataaaaggtagaaatgccaatggtaatattctaactaaaaatccaattaaaaatattcttaaaaaggaagaaggagtttctacattaggcgcaattgatatttggtacgacgacactgttagacgattaaatactgatgaaagaggcgaatatctgggtgcatttaagggagaagataaaatcctttccattctttcaaccggagagtttaaactcagaggtttcgacttaaattctcatttcgatgatgatttattacatctgggaaagcataatcccaaaaagattattactgccatctatttcgacggagagcaaaagaaacattatgaaaacgtctga

SEQ ID NO: 9938 - protein, 324 aa, Unknown
  Obtained from environmental sample
  misc_feature (1)..(324): Xaa is any amino acid
MPDDCHKRLTKGKWKGVKNHLRTYHRFPPLNFSKQIKKKYVKDFSRKTELRNFDTIEAAAVAVANQKLYLNREEGFAGTALKKDEYISECSDIDDIIVFRIDGTFMVTKVSSKLFVGKDVLHIQVFDKNDDRTIYNLIYRDGKLGNYYVKRFSVTSITRDKEYDLTKGGAGTKVIYFTHNPNGEAEIIRIHLRPKPRLSKTSFDFNFSELAIKGRNANGNILTKNPIKNILKKEEGVSTLGAIDIWYDDTVRRLNTDERGEYLGAFKGEDKILSILSTGEFKLRGFDLNSHFDDDLLHLGKHNPKKIITAIYFDGEQKKHYENV

SEQ ID NO: 9939 - DNA, 357 bp, Unknown
  Obtained from environmental sample
  misc_feature (1)..(357): n is a, c, g, or t
ttgatggatgatattttagatgtttacggaaatcctgaaaaatttgggaaacaagtaggtggagatattttggcaaataaaaaaacatatttgttgctaaaaaccatggaattagccaatggaacattaagaaaagaattggagttttgtttaaactctaaaaccttatctcccgaaaataaaattactagggtaaaatccatctacaatcaattaaagattaaagaaaaatctattgatgagatgaaccacttttacaatacagccattgctcacttagatagcattgaagctgcaaaagagaaaaaagcaatttttgaaaattttgctaaaaaattgatgcacagggaaagttaa

SEQ ID NO: 9940 - protein, 118 aa, Unknown
  Obtained from environmental sample
  misc_feature (1)..(118): Xaa is any amino acid
MMDDILDVYGNPEKFGKQVGGDILANKKTYLLLKTMELANGTLRKELEFCLNSKTLSPENKITRVKSIYNQLKIKEKSIDEMNHFYNTAIAHLDSIEAAKEKKAIFENFAKKLMHRES

SEQ ID NO: 9941 - DNA, 858 bp, Unknown
  Obtained from environmental sample
  misc_feature (1)..(858): n is a, c, g, or t
atgcttagtgaggcgactataacaaaagattttaagatatatgaccctgcatgtggaacagccggatttttgattaactctattgagtacatcaaagataacagaagtgaaatactcaatgatttaagcattagtgagtttgaaaacttgttttatgggaatgattttgatatttccatggctcgtatcgcctctatgaacatgatgcttcactccatagaatcagcacatataaaaaaccaagattcactctcaaaatttgatataaatgaagaaaataaatacgacttgattttagcaaatcctccatttaagggttcactagattttgaagaggttgcaaaaccgattttagatgtagcaaaaacaaaaaaaacagaactgctctttttatcgcttatgttaaaaactttaaaagacagtggcagatgtgcggttattgttcctgatggagttttgtttggttctacaaaatcgcatcaagagataagaagtgaaatagtctcaaaccaacagctagatgctatcatctccatgccaagcggtgtatttaaaccttatgcgggtgtcagcacggctatcatgatttttacaaaaacaaacggacataaaaatgacaaagtttggttttatgacatgcaaaatgacggatacactcttaatgacaacagacaagagtgtgatggttctgacattccagacatactggctaggtttaaaaatttcgatgctgagaaaaaacgagagagaacggacaaaagcttttttgttcccgtgagtgagatagaagcaaataaatatgaccctagtatcaccagataccaagagattgtttaccaaactataaatccggcctag

SEQ ID NO: 9942 - protein, 285 aa, Unknown
  Obtained from environmental sample
  DOMAIN (89)...(268): N-6 DNA Methylase
  misc_feature (1)..(285): Xaa is any amino acid
MLSEATITKDFKIYDPACGTAGFLINSIEYIKDNRSEILNDLSISEFENLFYGNDFDISMARIASMNMMLHSIESAHIKNQDSLSKFDINEENKYDLILANPPFKGSLDFEEVAKPILDVAKTKKTELLFLSLMLKTLKDSGRCAVIVPDGVLFGSTKSHQEIRSEIVSNQQLDAIISMPSGVFKPYAGVSTAIMIFTKTNGHKNDKVWFYDMQNDGYTLNDNRQECDGSDIPDILARFKNFDAEKKRERTDKSFFVPVSEIEANKYDPSITRYQEIVYQTINPA

SEQ ID NO: 9943 - DNA, 552 bp, Unknown
  Obtained from environmental sample
  misc_feature (1)..(552): n is a, c, g, or t
atgcagcatgaagctgacaagttaagctcactgattataagagcacatatgagcggtgaaaagtttgagtttaatagttcaggttcttatagtattgggctgtatagtagtaatcataaactcctttttggtaaagatataaaaaatattgagtttatagatagttttataaaagatgaaaagttttttactttagtatcaactagagcaaatatgcatttagatgttgcatatattgttattcaagatgagagtgttattcaagatgtcaataaattaaaagttgccgtaacgattcttctttgtactttgcttttaatagtcggagtgattggatatatactttcaaaaatatttttaagacctcttcgtttgaaaatggagcagattgagaactttataaaagatattacccatgaacttaatacccctataactgcactgaagttaactacttctagagctttaaaaaaggggtgttattcccaaattcctctaaaaatatatccatttaagtccaatccactttatggacttccatacctcccctga

SEQ ID NO: 9944 - protein, 183 aa, Unknown
  Obtained from environmental sample
  misc_feature (1)..(183): Xaa is any amino acid
MQHEADKLSSLIIRAHMSGEKFEFNSSGSYSIGLYSSNHKLLFGKDIKNIEFIDSFIKDEKFFTLVSTRANMHLDVAYIVIQDESVIQDVNKLKVAVTILLCTLLLIVGVIGYILSKIFLRPLRLKMEQIENFIKDITHELNTPITALKLTTSRALKKGCYSQIPLKIYPFKSNPLYGLPYLP

SEQ ID NO: 9945 - DNA, 426 bp, Unknown
  Obtained from environmental sample
  misc_feature (1)..(426): n is a, c, g, or t
atgatatcgaggtgggatttagctgatattttgaatgaatcgattgaatactattcacaattggcatcatctaaaggtatagagattatctcaaatattgatagcaaaagatttattatagaccatgtaaaagcgaaacttctgttttcaaatttgataagcaatgccataaaatactcatatccaaattcaaagatagagatagagttgaaaaattctatttttaaagtactagattacggcataggaatcgcagcggataagcaagagtttatctttaaaagatttcatagagagagtagctatggaggaggctttggaatagggttagacattgtcaaaaatatttgtgatgagtacggtattaaaattgaagtaaaatcaaaagttgagtgcggaagtacatttagtctgctctttaattaa

SEQ ID NO: 9946 - protein, 141 aa, Unknown
  Obtained from environmental sample
  DOMAIN (40)...(141): Histidine kinase-, DNA gyrase B-, and HSP90-like ATPase
  misc_feature (1)..(141): Xaa is any amino acid
MISRWDLADILNESIEYYSQLASSKGIEIISNIDSKRFIIDHVKAKLLFSNLISNAIKYSYPNSKIEIELKNSIFKVLDYGIGIAADKQEFIFKRFHRESSYGGGFGIGLDIVKNICDEYGIKIEVKSKVECGSTFSLLFN

SEQ ID NO: 9947 - DNA, 681 bp, Unknown
  Obtained from environmental sample
  misc_feature (1)..(681): n is a, c, g, or t
gtgcgaccaatagtagttaaagaagaaaattttaaaggtgtaaatagtaaatttgatttagccacagcagaggtgatacaccaaaataggataaaagagaacttcttaaaagagggtgttattatgagattgcctgatactatttatatagaagagggagtttcaattgaaggtgaaagtattattgaaaatggtgtaacacttcttggaaatagtaagatagtaaattctcatattaaaacaaatagtgtagttgaagatagtatcttagaaaatagtgacataggaccaatggcaagaatacgaccactaagtatattaaaagatacacatattggaaattttgttgaggtgaaaaaatcaactttaactggagtaaaagcagggcacttaagttatctaggagatagtacgatagatgttggctcaaatattggagcaggaacaatcacttgtaactatgatgggataaataaatatagaacaattattggaaaaaatgtttttgttggttcagatacccaacttgtagcacctgtaacaattgaggatgatgtgatgatagcagcaggtagtaccataacaaatgatgtgaaatctggtgatttagcattgagtcgtacaaaacaaaaaacaataacaggatttttttataaatttttcaataaagagaaaaagtaa

SEQ ID NO: 9948 - protein, 226 aa, Unknown
  Obtained from environmental sample
  misc_feature (1)..(226): Xaa is any amino acid
MRPIVVKEENFKGVNSKFDLATAEVIHQNRIKENFLKEGVIMRLPDTIYIEEGVSIEGESIIENGVTLLGNSKIVNSHIKTNSVVEDSILENSDIGPMARIRPLSILKDTHIGNFVEVKKSTLTGVKAGHLSYLGDSTIDVGSNIGAGTITCNYDGINKYRTIIGKNVFVGSDTQLVAPVTIEDDVMIAAGSTITNDVKSGDLALSRTKQKTITGFFYKFFNKEKK

SEQ ID NO: 9949 - DNA, 900 bp, Unknown
  Obtained from environmental sample
  misc_feature (1)..(900): n is a, c, g, or t
ttgggtggatgcactgagggccaggtcgtcaatgcaaaaacaaagggggaactcaggttaaagggtgtaaagaccacaaatcctgttgcggtgggtgatagagtaatcattgaaatgccggaagaccagggtattgggatgataaaagatattttaccacgacaaaaccacatcattcgaaaatccactaacctttcgaaagtatctcacattattgccgcaaatatcgacctggctttgctggtggttaccatcagagagccacgaattgccaccggttttattgatcgttttttaattaatgctgaggcttatcacattgaggcagccattgtgtttaataaaattgatatttatgaacccaaggatatcgagcgattatctgaacttgttaacatatatgaaggggctggttataaaacctataaagtttcagctctaacacaagaaaacattccagagctaaagcaagcaattaaaggtaagacgaatcttttttctggtatttcgggcgttggaaaatcggcattggtaaatagtattgaacccggattgaagctgaaaaccggtgtgataagtagttatcataaaaaaggaaagcataccaccacatatcctgaaatgcatccactctcttttggagggtatatcatcgatacaccgggcattcgtgagtttggccttgtggaatttcaaaaacatgaaattgccgaaagatttcccgaatttcgcaggtatcagcacgagtgccacttcaataattgtacgcatgtacatgagccagagtgtgcggtgaaagaagccctggaaatgggaaaaattgctacttccaggtatgaaaattatcttaggataatgaatgacgattatcttgataaagaactttgggagtgggagtga

SEQ ID NO: 9950 - protein, 299 aa, Unknown
  Obtained from environmental sample
  DOMAIN (134)...(287): Protein of unknown function, DUF258
  misc_feature (1)..(299): Xaa is any amino acid
MGGCTEGQVVNAKTKGELRLKGVKTTNPVAVGDRVIIEMPEDQGIGMIKDILPRQNHIIRKSTNLSKVSHIIAANIDLALLVVTIREPRIATGFIDRFLINAEAYHIEAAIVFNKIDIYEPKDIERLSELVNIYEGAGYKTYKVSALTQENIPELKQAIKGKTNLFSGISGVGKSALVNSIEPGLKLKTGVISSYHKKGKHTTTYPEMHPLSFGGYIIDTPGIREFGLVEFQKHEIAERFPEFRRYQHECHFNNCTHVHEPECAVKEALEMGKIATSRYENYLRIMNDDYLDKELWEWE

SEQ ID NO: 9951 - DNA, 672 bp, Unknown
  Obtained from environmental sample
  misc_feature (1)..(672): n is a, c, g, or t
atgtcaaaaaagtacaacaataaaatagaagaaatcagaggaataatgattaatcttcttgctagtatagtagatgctaataaattatcgctagaagcctatagagataatgatgataaaaagtataaagaggttcaaagtaaactcagtaacataacgactcagggtgatatcatagacaatgaaattattaaaacatttgcattgtttggcccggaagctacagaacttcgttttttagtaacttatttaaaaatgacaaatgaaatagttcgtatcggtgagggtgtaaaaaaatatgctaaccgtatgaaacatctttctgagagtaaatgtaatttagagcctctcaattcgaccataattcaacttcacaaaagtactatttttgcactgcaatacattctagaatgttttaaggaacatgataattgtaatatcgaagacttatacacaaaagttatggttgaagagagtaaaaatgatgatctattttcaatactggaaaaagagattttaactttaattatagatgcaaaagaactttctatagagtatgttaaagtattaggaactcttcgtaaactagagcgttcatgtgatagaagtgtaaatattgcaaaccttatggtgtatgcttctgagggtggagagattcaactatatagttaa

SEQ ID NO: 9952 - protein, 223 aa, Unknown
  Obtained from environmental sample
  misc_feature (1)..(223): Xaa is any amino acid
MSKKYNNKIEEIRGIMINLLASIVDANKLSLEAYRDNDDKKYKEVQSKLSNITTQGDIIDNEIIKTFALFGPEATELRFLVTYLKMTNEIVRIGEGVKKYANRMKHLSESKCNLEPLNSTIIQLHKSTIFALQYILECFKEHDNCNIEDLYTKVMVEESKNDDLFSILEKEILTLIIDAKELSIEYVKVLGTLRKLERSCDRSVNIANLMVYASEGGEIQLYS

SEQ ID NO: 9953 - DNA, 351 bp, Unknown
  Obtained from environmental sample
  misc_feature (1)..(351): n is a, c, g, or t
atggatgagatagaaaaaatattttctataacagatactgttttattttccacagaactagtacccgatacaccgccaaatccagatgattggtggtattattgtctggaacatggacaacatatctctcttttttctaagaaaagtttagagtatatagcaaataaatataattataatctaatctcaaataatagtaatcttcatatattttcaaaaaataaaatttcaaataaaatatttttagttgaaaaaatagtaaaaaaattacagcttgacaaattatttgatcaatcatcgaaaacaaatgatgatatgtataggatgatagaaaagatgaatgaaatatga

SEQ ID NO: 9954 - protein, 116 aa, Unknown
  Obtained from environmental sample
  misc_feature (1)..(116): Xaa is any amino acid
MDEIEKIFSITDTVLFSTELVPDTPPNPDDWWYYCLEHGQHISLFSKKSLEYIANKYNYNLISNNSNLHIFSKNKISNKIFLVEKIVKKLQLDKLFDQSSKTNDDMYRMIEKMNEI

SEQ ID NO: 9955 - DNA, 522 bp, Unknown
  Obtained from environmental sample
  misc_feature (1)..(522): n is a, c, g, or t
ttgaactttttttacattatactcattattttaacaatattatttattataattttattgaaaaaaaacttttcaaataaatcttcttatcaaaaagaatctattgatatactcactaaaacttttggagaacaaaacttttctcaaaatggtgatatatttcaattacaagagaaacttcatattaaatatactccacagaacaactatgaaaaatctattctaactattatagaaagtacaaaacataaacaagatgtaatctataaaaacaatatgagtcacaataaaccttttgaagaaaacacaacttttcaaatattgacaaatgaaattatagattttagtataaagaaaaatatcaacctaaagggttctattagactactgtttttatcattaaacaacaaagctttagaatctttaattgatgatagaaaacaggaaaaagagtatataaaactattttataaacttctaccaagttttgttacaaaatttaacaaaaaactagcagaatag

SEQ ID NO: 9956 - protein, 173 aa, Unknown
  Obtained from environmental sample
  misc_feature (1)..(173): Xaa is any amino acid
MNFFYIILIILTILFIIILLKKNFSNKSSYQKESIDILTKTFGEQNFSQNGDIFQLQEKLHIKYTPQNNYEKSILTIIESTKHKQDVIYKNNMSHNKPFEENTTFQILTNEIIDFSIKKNINLKGSIRLLFLSLNNKALESLIDDRKQEKEYIKLFYKLLPSFVTKFNKKLAE

SEQ ID NO: 9957 - DNA, 438 bp, Unknown
  Obtained from environmental sample
  misc_feature (1)..(438): n is a, c, g, or t
atgaaaacaaaacacataacacttaagcaaaacaattctttaataaggttctgtaatcgctacaatgaatctgttgaatctgtaattaataaagtaataggctctttattaaaatacgagttcctttacgatgaaaaagaagattgcggacaaaacttaaaatatctaattaataattcagattattcaatggatgttttttgcgtttgcactttcggtagctgtgattcaacaatggtaaatcatttaaacggatttatgatttggcacaaagataatgattgtgatgaatgcggttgtaaaattggattagatgaagatttaaacgaagagtgtacaaataaagagtgcgaattaagaattcagatagctcccgaccctgatcaatatagagatgattgtcatgcagaattaattaaggattttcaattaaattaa

SEQ ID NO: 9958 - protein, 145 aa, Unknown
  Obtained from environmental sample
  misc_feature (1)..(145): Xaa is any amino acid
MKTKHITLKQNNSLIRFCNRYNESVESVINKVIGSLLKYEFLYDEKEDCGQNLKYLINNSDYSMDVFCVCTFGSCDSTMVNHLNGFMIWHKDNDCDECGCKIGLDEDLNEECTNKECELRIQIAPDPDQYRDDCHAELIKDFQLN

SEQ ID NO: 9959 - DNA, 300 bp, Unknown
  Obtained from environmental sample
  misc_feature (1)..(300): n is a, c, g, or t
atgcttagaaatagaaaactaatgtactcgaagatagtaaaatgcaaagatgttgatttactacacttcgtagagctagaacagcctaaaggatttaattttgaaggtgcgcaaattctagatgatttactaactgatgaacttgaattcgttggtcaaatgctttacaatgcatttcataggactactatattgtcagatatgcaaattattatcgagatatgcaagaaaataggcattgatacaaacgagaattttatggagcaagattttgaagaaatgaaaaaacaactattgtaa

SEQ ID NO: 9960 - protein, 99 aa, Unknown
  Obtained from environmental sample
  misc_feature (1)..(99): Xaa is any amino acid
MLRNRKLMYSKIVKCKDVDLLHFVELEQPKGFNFEGAQILDDLLTDELEFVGQMLYNAFHRTTILSDMQIIIEICKKIGIDTNENFMEQDFEEMKKQLL

SEQ ID NO: 9961 - DNA, 399 bp, Unknown
  Obtained from environmental sample
  misc_feature (1)..(399): n is a, c, g, or t
ttgaatgaaaaactaactggagcaattaatgaaaatagaagatatgggtgggtcttttactttcttgaaatcaacgatcccgagttgctctataagatagattctataactaggagtcttttttccagactagatatgtttggcagcagacctccaacaaaccttaagaaaatatctaaagcatactttaaggctaagtactcaccacttgatggatatatccataactacaatcaatatgaaagtagttctcaaatgatggattaccttatcaataaaggtattattgatattaatgcacaagaaacctacagtgaagaacagatcattttatacttcaatcagacaaagaacagaatgctatcttctctagagcttgatattggaaaaatgtcataa

SEQ ID NO: 9962 - protein, 132 aa, Unknown
  Obtained from environmental sample
  misc_feature (1)..(132): Xaa is any amino acid
MNEKLTGAINENRRYGWVFYFLEINDPELLYKIDSITRSLFSRLDMFGSRPPTNLKKISKAYFKAKYSPLDGYIHNYNQYESSSQMMDYLINKGIIDINAQETYSEEQIILYFNQTKNRMLSSLELDIGKMS

SEQ ID NO: 9963 - DNA, 711 bp, Unknown
  Obtained from environmental sample
  misc_feature (1)..(711): n is a, c, g, or t
atgggttcaccaaatgctgaagcttatttagcatcaccagcagttgttgcatattctgcaatgaaaggagaaatagattttgattgggaaacaccaattaaacaaataaatggtaaaattgaagtaaatgatccaaaaccaattgaatctaaatctgtgacaattctagatggatttccaaagaaagttgaaggtgatttaatattctgtcatattgataacatgaacaccgatggaatctatcctggtaaatacacatatgtagatgatttcacacctgaagatcaggcaaaagttgctatggaaaattacgatccggaatttcaagatgttgctaaagatggcgacattttaattggtggatataactttggtacaggcagttctagagagcaagcagcaaccgctcttaagtatagaggaattcaattagttattgttggttctgcaagtcagacttacaaaagaaatgctcttaacaatggatttttagtaattgaagttccagaacttgttgacgatttgaaaaacaaatatggatcagataaattaactgtgcaaacttccactaaagcagtattagattataaaaattctgaattactttacgatggcaaaacgtataaattcagttctgtgggaactgctgcccaagaacttgtggtacttggcggtcttgaaaacgtgggtaaaagncaaatcttagaataa

SEQ ID NO: 9964 - protein, 236 aa, Unknown
  Obtained from environmental sample
  DOMAIN (39)...(171): Aconitase C-terminal domain
  misc_feature (1)..(236): Xaa is any amino acid
MGSPNAEAYLASPAVVAYSAMKGEIDFDWETPIKQINGKIEVNDPKPIESKSVTILDGFPKKVEGDLIFCHIDNMNTDGIYPGKYTYVDDFTPEDQAKVAMENYDPEFQDVAKDGDILIGGYNFGTGSSREQAATALKYRGIQLVIVGSASQTYKRNALNNGFLVIEVPELVDDLKNKYGSDKLTVQTSTKAVLDYKNSELLYDGKTYKFSSVGTAAQELVVLGGLENVGKXQILE

SEQ ID NO: 9965 - DNA, 972 bp, Unknown
  Obtained from environmental sample
  misc_feature (1)..(972): n is a, c, g, or t
atgacagaatggctgagagatcaagagttaaatcaaaaagggcaacctgtcttagtagggactgcaagtattgaaaaatctgaaaagttacatgaattattaaaaaaagagaaaatcccacatacagttttaaatgctaaacagcatgaaaaagagggtaaaattgttgaagatgctggacttaaaggtgcagtaacaattgctacaaatatggctggtcgtggggttgatattaaattaccaaaagagtgtttagaacttggagggttggtgattcttggaactgaaagacacgaaagtagaagaattgacaaccaacttcgaggacgagcagggcgacagggtgatgttggtgagtcacaattttatctttctttagaagataatttattacgaatttttggaagtgataaaatcgctggagttatgagtagacttggacttgaagaaggtgagcatattgagtctggtatggttacaagagctgttgaaaacgcacagaaaaaagtagaaactatgcactttgagtcaagaaaacatctattagagtatgatgatgtagcaaatgaacaaagaaaagtaatctatagctttagaaataatcttttaagtgaagattatgatattacatcaaaaattgatgaaaatattggagaatttgtatcagtaactattgagaatgcaaaagatgtaagtacaagtgtaatgattgaagattttaattatgaaaatgtagtacttaaaatcaaagaagatttaaatgttgatatatcaaaagaggatatagaatcagatgattttgatgagatgtatgaaaaacttgttacaatattaaaagatatctatgagcaaaagatgagtgcccctgcaccagaaacaagacatgagatagagaggattctatatcttccagttttagataaggcgtataaagagcattttattcaatggatctctaaaaacaggaattga

SEQ ID NO: 9966 - protein, 323 aa, Unknown
  Obtained from environmental sample
  DOMAIN (33)...(115): Helicase conserved C-terminal domain
  misc_feature (1)..(323): Xaa is any amino acid
MTEWLRDQELNQKGQPVLVGTASIEKSEKLHELLKKEKIPHTVLNAKQHEKEGKIVEDAGLKGAVTIATNMAGRGVDIKLPKECLELGGLVILGTERHESRRIDNQLRGRAGRQGDVGESQFYLSLEDNLLRIFGSDKIAGVMSRLGLEEGEHIESGMVTRAVENAQKKVETMHFESRKHLLEYDDVANEQRKVIYSFRNNLLSEDYDITSKIDENIGEFVSVTIENAKDVSTSVMIEDFNYENVVLKIKEDLNVDISKEDIESDDFDEMYEKLVTILKDIYEQKMSAPAPETRHEIERILYLPVLDKAYKEHFIQWISKNRN

SEQ ID NO: 9967 - DNA, 687 bp, Unknown
  Obtained from environmental sample
  misc_feature (1)..(687): n is a, c, g, or t
ttgaagtcatatttaacttgtaaaagacagtattattttaactatatagcaaaaataaaagagcatacaatcagtattaagcctcaaaattttgaggtgggaagtatcatccataattgtcttgaagaagctgtaaaaaaaagtgaattgaataatcaatttattcataagtatttggtatcgtttcaaaaatcaaatccttatcttgtactagaacttgaactttggaagaaaaagcttgaaaaacttgtagagttcgaaaaagtaagagctgcaaatgggattacaatccaaagtgtagaacaaccgtttaatttagtttataatggtgttacaatcaaaggaaaaattgatagaatagataagcatagtgatggtacttttgagatacttgactataaaacatcatcgagtttaaaaatagacacaccaaaaacttatgaagattctgtagattttcaactagaattttattatttaagtcaaagagataagatgataaaaagtgtagggtattatgatcttaacgatagttctataaaaagtgaagtggtacttaatgagaagttagaatatcttgatatgcattttcaaagactaaaaacgacaagtgtaaattttgctttgaccgataaactctcaagttgtcaattttgtccatatagtattatttgtcaaagagattaa

SEQ ID NO: 9968 - protein, 228 aa, Unknown
  Obtained from environmental sample
  misc_feature (1)..(228): Xaa is any amino acid
MKSYLTCKRQYYFNYIAKIKEHTISIKPQNFEVGSIIHNCLEEAVKKSELNNQFIHKYLVSFQKSNPYLVLELELWKKKLEKLVEFEKVRAANGITIQSVEQPFNLVYNGVTIKGKIDRIDKHSDGTFEILDYKTSSSLKIDTPKTYEDSVDFQLEFYYLSQRDKMIKSVGYYDLNDSSIKSEVVLNEKLEYLDMHFQRLKTTSVNFALTDKLSSCQFCPYSIICQRD

SEQ ID NO: 9969 - DNA, 681 bp, Unknown
  Obtained from environmental sample
  misc_feature (1)..(681): n is a, c, g, or t
atggacaaaagaaaacaagttagaagaatatttgattctatttcatacagatacgattttctaaatcatcttttaagtggtggtgtagatttctactggagaaaaaaagcactgaagttgagcaaaataaataaggatactatccttttggatgtagcttgtgggactggtgattttgcaattgctgcaaaaaagatgggcgttcaaaaaattgttggggctgatttatccttaaatatgctgaaactatttaatcagaagtctaaatggagcaaagggaatcttgttgaaactgtagctgaagaaattccatttaaggataattcttttacaaatattaccgtagctttcggagttcgtaatttctacgatattctagagggttttaaatctttccatcgaatactaaaagtaaacggcaaagcaactgttttagaatttagactcccctctaaccccattataaaagcattttatcttttctattttaaaaatatacttccatttgtaggcaatcttatttcgaaggataaagaggcatacacatatttaccagagtctgttgatgaatttgatgcaaaagtgaatttaaaggatttgctacttcaagcaggatttaaaaaagtagtagtaaaacaagttacatttggaattgttcaaatagcaattgctgaaaaatag

SEQ ID NO: 9970 - protein, 226 aa, Unknown
  Obtained from environmental sample
  DOMAIN (1)...(226): ubiE/COQ5 methyltransferase family
  misc_feature (1)..(226): Xaa is any amino acid
MDKRKQVRRIFDSISYRYDFLNHLLSGGVDFYWRKKALKLSKINKDTILLDVACGTGDFAIAAKKMGVQKIVGADLSLNMLKLFNQKSKWSKGNLVETVAEEIPFKDNSFTNITVAFGVRNFYDILEGFKSFHRILKVNGKATVLEFRLPSNPIIKAFYLFYFKNILPFVGNLISKDKEAYTYLPESVDEFDAKVNLKDLLLQAGFKKVVVKQVTFGIVQIAIAEK

SEQ ID NO: 9971 - DNA, 678 bp, Unknown
  Obtained from environmental sample
  misc_feature (1)..(678): n is a, c, g, or t
atgaaaaaattaacaataataatcccagcatataatgaagcggaatatctcatggttggtttgcctgagatactacaacattgtaaagaaaataattatgcacttatcataaccaatgatgcgtcaagtgataacacaaaacagatacttgtggatgctgctgctacgaacaactttataattattaatcacaaagtcaatcgcgggtatgggggtgcaataaaaagtggaatctgcaaagcccaaacagaatatgtggtaactatggatgccgacggacagcaccagctttctgatattgacaacttactaaaacataccctctatactgacgcagatatgattataggcagcaggcataaaagctactcctcagggatataccgtgagttgggaaaaaaaataattcggacaatagccactatgcttgtatcatacaatgttaaagacctaaactctggcatgaaattgtacaatcgaaaatttgccttaaaatatatgcatttatgccctgatactatggcatttagcgacatcattgcccttctatttattaactataagctactagtaactgaatatcctataaccgtaaaacaaagagtttctggttcaagcactataggcatactaacagccatagaaacggtaaagaaatttaacatgtcccggccataa

SEQ ID NO: 9972 - protein, 225 aa, Unknown
  Obtained from environmental sample
  DOMAIN (5)...(167): Glycosyl transferase
  misc_feature (1)..(225): Xaa is any amino acid
MKKLTIIIPAYNEAEYLMVGLPEILQHCKENNYALIITNDASSDNTKQILVDAAATNNFIIINHKVNRGYGGAIKSGICKAQTEYVVTMDADGQHQLSDIDNLLKHTLYTDADMIIGSRHKSYSSGIYRELGKKIIRTIATMLVSYNVKDLNSGMKLYNRKFALKYMHLCPDTMAFSDIIALLFINYKLLVTEYPITVKQRVSGSSTIGILTAIETVKKFNMSRP

SEQ ID NO: 9973 - DNA, 522 bp, Unknown
  Obtained from environmental sample
  misc_feature (1)..(522): n is a, c, g, or t
atgccacgaatcgatagtgaaaaattttatacttcagctataaatatgcacggggtaaccgctaaaggtgtaaactggaactcaaaagaatctcagcacatcagatttaatatcatcttaaaaatgcttccgaaagacctctcatcacttaccttagtagatgctggttgtggttttggagacttgtacctttatactgaaaaaaagaagagtactcctaaaaaatatattggtatagatgctgtgattgatatgtactccatagcatctgaacgaactggttgtgaaaatattatcgctgatatttgtaaagatgaactcccccgtgcttcttactatgtttgcaggggtgctatgaacgtacctaatacttttgaaacccatcctttttatgcccatttgttacaaaccttcttaaaaaggaatttattttcaatatccctactgggaacccaggggaaggggggatttacaaatttccctaaaaaatccccaaaaaaaacgttaggccatcctgacttt

SEQ ID NO: 9974 - protein, 174 aa, Unknown
  Obtained from environmental sample
  misc_feature (1)..(174): Xaa is any amino acid
MPRIDSEKFYTSAINMHGVTAKGVNWNSKESQHIRFNIILKMLPKDLSSLTLVDAGCGFGDLYLYTEKKKSTPKKYIGIDAVIDMYSIASERTGCENIIADICKDELPRASYYVCRGAMNVPNTFETHPFYAHLLQTFLKRNLFSISLLGTQGKGGFTNFPKKSPKKTLGHPDF

SEQ ID NO: 9975 - DNA, 360 bp, Unknown
  Obtained from environmental sample
  misc_feature (1)..(360): n is a, c, g, or t
atgaaacttaagattaatataataattttacttgtaattatttttgttttttccattttttcggcaaaagcagaaacccgtaaattatcgaaatattcacgtatatcattaattacttgtgctcccggaagtgaattatattctgttttcggacatagtgctgtgtttgtaagcgatccggcacgaggaataaatagtgtatataattatggaacattcgacttttaccaaaaaggtttttatttgaaatttgtacgtggaaaattaaattaccgattagcaaaatcgtcttattcaaattttataaataattatgttgaggaaaaccgaaaactgtcaaaacaaattataaatctttaa

SEQ ID NO: 9976 - protein, 119 aa, Unknown
  Obtained from environmental sample
  misc_feature (1)..(119): Xaa is any amino acid
MKLKINIIILLVIIFVFSIFSAKAETRKLSKYSRISLITCAPGSELYSVFGHSAVFVSDPARGINSVYNYGTFDFYQKGFYLKFVRGKLNYRLAKSSYSNFINNYVEENRKLSKQIINL

SEQ ID NO: 9977 - DNA, 303 bp, Unknown
  Obtained from environmental sample
  misc_feature (1)..(303): n is a, c, g, or t
atgggcacaaatgtggagggcgaaagttttgaatttaacgaaagtgatattggtgaaacatcataccgagctattattgatttagggcttcttgatgtagaaacagatcatattgagttggttgatagtagtttgaaagtagctggtgcgagttcagatatgattgtgattgaccttgacgaaaacaaaaagaaatataaggttggagacttgattgagtttaaattagattatatgggaattcttagaataatgaactcaaaatatatagaaaagaaagtgaaaaatgctagcacaacatag

SEQ ID NO: 9978 - protein, 100 aa, Unknown
  Obtained from environmental sample
  misc_feature (1)..(100): Xaa is any amino acid
MGTNVEGESFEFNESDIGETSYRAIIDLGLLDVETDHIELVDSSLKVAGASSDMIVIDLDENKKKYKVGDLIEFKLDYMGILRIMNSKYIEKKVKNASTT

SEQ ID NO: 9979 - DNA, 417 bp, Unknown
  Obtained from environmental sample
  misc_feature (1)..(417): n is a, c, g, or t
atgattatgaaggatttaattcttacgctgttacttttatccgtttattgtttggtttcagctcaaaattgtaagataagtggtactcttattgataaagtaagtaacaatccattaccttatgcgaatgctatacttaaatctcctgttgattctaccgttttattaggaactattaccgatagtgatgggcactttcttataaaagagattgaatcaggacagtatagtcttaagcttagttttatcggttatcagtctgtcgttatcgataagctaagacttcaaagggggctgcgagatataggtattataaagctcgatgttctttctgaaaatctaagcgagcttgttgtaagagcaacgcctcctgctattagttataaagtcgataagaaggtctcgagccgattctga

SEQ ID NO: 9980 - protein, 138 aa, Unknown
  Obtained from environmental sample
  SIGNAL (1)...(19)
  misc_feature (1)..(138): Xaa is any amino acid
MIMKDLILTLLLLSVYCLVSAQNCKISGTLIDKVSNNPLPYANAILKSPVDSTVLLGTITDSDGHFLIKEIESGQYSLKLSFIGYQSVVIDKLRLQRGLRDIGIIKLDVLSENLSELVVRATPPAISYKVDKKVSSRF

SEQ ID NO: 9981 - DNA, 345 bp, Unknown
  Obtained from environmental sample
  misc_feature (1)..(345): n is a, c, g, or t
atgaaattaagaacaaaatttgtgcaaagctttatatctgtgacatttattcctgtatgcctttttatcgtaataatttcttatgtaatttttgacagagccaaaattgaaatcaaagaaaaaatgattaccgacatcaaccatagaactgatttatttaaagaacatttaaaaaaaataaaaagcaatattaaatttatcgcaaatctgttgaacttgcaggaacttctgaacaattccagaaacggcaactaccctgcttttagattaaataaagtagcaaaagagtttcaagcgtgtattaaagctaacggcttgtttttaaagcttcgtgtatgcagatga

SEQ ID NO: 9982 - protein, 114 aa, Unknown
  Obtained from environmental sample
  misc_feature (1)..(114): Xaa is any amino acid
MKLRTKFVQSFISVTFIPVCLFIVIISYVIFDRAKIEIKEKMITDINHRTDLFKEHLKKIKSNIKFIANLLNLQELLNNSRNGNYPAFRLNKVAKEFQACIKANGLFLKLRVCR

SEQ ID NO: 9983 - DNA, 951 bp, Unknown
  Obtained from environmental sample
  misc_feature (1)..(951): n is a, c, g, or t
gtggattttgatgatttattactcctaacatataagatacttcaaaaaaaccctcaactatcaaaagatacaagtgatagatataaatatattatggtagatgagtatcaagataccaacgagttacaatataaacttttaaaacaactttgtagtgaacacaataatatttgtgtagttggagatgatgatcagtctatatatggttggagaggtgcaactattaaaaatatccttacatttagtgatacttttaatgatacactagttataaaactagaagaaaattatcgttcaactcataaaatactttttcatgcaaatgctttaatagaacacaatagagacagactagggaaaaagcttgtagggactagagaagagggtaactctataaaaatttacgaatcaaacgatgaaaatgatgaaacaagaaaaatcgttgatgatattaaaaaacttatcgaacaaggtgaatcagcaaaagatattgcagtcttatttagggtaaatgctttaagtagggcgttagaagaggggctcaatagatcaaatatcaactataaactagtgggtggtttaaagttctatgaaagagctgaaatcaaagatttaatagcatattttagagttattacaaatgcaaatgacaacttctctataaaaagaattatcaataagccaaaaagaggtattgggaaaacaacaatagataaactagaactagagtcgcacgataaggcaaaatctatctttagtattataaaagagtacactcctgaggagctaggggtgattgttgggaagaaaatagccgaacacttaaagtatttatggcatcagtggaagatttacaagatgttctttctgaagctaaaatgcgatttattgatcttttttgagaaacttttgattttaaatcacctatgcaaaagtgatagatgcagatga

SEQ ID NO: 9984 - protein, 316 aa, Unknown
  Obtained from environmental sample
  DOMAIN (1)...(309): UvrD/REP helicase
  misc_feature (1)..(316): Xaa is any amino acid
MDFDDLLLLTYKILQKNPQLSKDTSDRYKYIMVDEYQDTNELQYKLLKQLCSEHNNICVVGDDDQSIYGWRGATIKNILTFSDTFNDTLVIKLEENYRSTHKILFHANALIEHNRDRLGKKLVGTREEGNSIKIYESNDENDETRKIVDDIKKLIEQGESAKDIAVLFRVNALSRALEEGLNRSNINYKLVGGLKFYERAEIKDLIAYFRVITNANDNFSIKRIINKPKRGIGKTTIDKLELESHDKAKSIFSIIKEYTPEELGVIVGKKIAEHLKYLWHQWKIYKMFFLKLKCDLLIFFEKLLILNHLCKSDRCR

SEQ ID NO: 9985 - DNA, 651 bp, Unknown
  Obtained from environmental sample
  misc_feature (1)..(651): n is a, c, g, or t
ttgaatagactttttgtagtaaaaaagcctgtatttattagttcaaatttttatcttaatagaataaaacgaaaatataaaacaaaaaaagctggctttagtgggactttggatccttttgcttgtggttgtttgatagttgcttttgggcagtattctaagctttttcgatatttgaaaaaaacaccaaaatcatatcgtgctactatttttttaggagcagaaagtagttctttagatattgaaaatgtagaagtgacaaatcataattcaaaagtatttacagaagatgatattaaagaaaaactagaaagtttaaaaggtactttagaatatctaccaccaaaatacagtgcaaaaaagatagatggtcaaagagcttataatctagctcgtgagggtatagagtttgatatgaagaaaatcacttcgcaagtatttgatgtgaagtttatcaactactctcatccttttataacatttgatataactgtaagtgaaggaagctatataagaagtatggctcaaattcttttagagagacttggggaggtgggaactttatcttatcttgaaagattgcacgaggggcagttttattttgataatgaaaaagctttaaaccctttggagtatttggacttaccttga

SEQ ID NO: 9986 - protein, 216 aa, Unknown
  Obtained from environmental sample
  DOMAIN (20)...(171): TruB family pseudouridylate synthase (N terminal domain)
  misc_feature (1)..(216): Xaa is any amino acid
MNRLFVVKKPVFISSNFYLNRIKRKYKTKKAGFSGTLDPFACGCLIVAFGQYSKLFRYLKKTPKSYRATIFLGAESSSLDIENVEVTNHNSKVFTEDDIKEKLESLKGTLEYLPPKYSAKKIDGQRAYNLAREGIEFDMKKITSQVFDVKFINYSHPFITFDITVSEGSYIRSMAQILLERLGEVGTLSYLERLHEGQFYFDNEKALNPLEYLDLP

SEQ ID NO: 9987 - DNA, 732 bp, Unknown
  Obtained from environmental sample
  misc_feature (1)..(732): n is a, c, g, or t
atgatcgcaaaaagattacaatatattacagcacctatggaacttgaagagattttagatattgcaaaaatggaatctttgcaactcaaacaaccaacatttacccctcaaagaacttttatctcccctcatcatagctctacaaaagcttcaatcgtaggtggaacacaaataggggaggtggctttatcaaatcatggggtactattttttgatgaattaccacattatgataaaaatgttttagaagctatgagagaacctttagaagattatgagatatcaatttcaagagtaaatagtaaggtaaaatatcctacaaaatttcttttcgtagcagcacaaaacccatgcccttgtggtaacttactctctcaaacaaaactatgccgatgcaatgatgttgagatacaaagatataaaaataaaatatcggatccttttttagatagaattgatctttatgtggttatgaatgaggtaacaaaagaggataaatctgatgtgacatcagaacaattacacttacaagtattagaagtctttaagcgtcaaaaacttcgtggacaaaaagaacttaatggaaaacttaatgatgaggatataaaaaaatattgtaccatttcaatagaagcacaaaatattttggacctgtctattgaaaaatttgctttatcctttcgctctattaataaaggtattaaaagtatccagaaacaatcgctgatttag

SEQ ID NO: 9988 - protein, 243 aa, Unknown
  Obtained from environmental sample
  misc_feature (1)..(243): Xaa is any amino acid
MIAKRLQYITAPMELEEILDIAKMESLQLKQPTFTPQRTFISPHHSSTKASIVGGTQIGEVALSNHGVLFFDELPHYDKNVLEAMREPLEDYEISISRVNSKVKYPTKFLFVAAQNPCPCGNLLSQTKLCRCNDVEIQRYKNKISDPFLDRIDLYVVMNEVTKEDKSDVTSEQLHLQVLEVFKRQKLRGQKELNGKLNDEDIKKYCTISIEAQNILDLSIEKFALSFRSINKGIKSIQKQSLI

SEQ ID NO: 9989 - DNA, 396 bp, Unknown
  Obtained from environmental sample
  misc_feature (1)..(396): n is a, c, g, or t
atgatgttgggattccaaggatttaaaaataaaatatcggatccttttttagatagaattgatctttatgtggttatgaatggggtaacaaaagaggataaatctgatgtgacatcagaacaattacacttacaagtattagaagtctttaagcgtcaaaaacttcgtggacaaaaagaacttaatggaaaacttaatgatgaggatataaaaaaatattgtaccatttcaatagaagcacaaaatattttggacctgtctattgaaaaatttgctttatcctttcgctctattaataaagtattaaaagtatcaagaacaatcgctgatttagataatagttatacaatagaaaaacagcatattatagaagctttgagttatagaaagagatag

SEQ ID NO: 9990 - protein, 131 aa, Unknown
  Obtained from environmental sample
  misc_feature (1)..(131): Xaa is any amino acid
MMLGFQGFKNKISDPFLDRIDLYVVMNGVTKEDKSDVTSEQLHLQVLEVFKRQKLRGQKELNGKLNDEDIKKYCTISIEAQNILDLSIEKFALSFRSINKVLKVSRTIADLDNSYTIEKQHIIEALSYRKR

SEQ ID NO: 9991 - DNA, 660 bp, Unknown
  Obtained from environmental sample
  misc_feature (1)..(660): n is a, c, g, or t
atgtttacttgtgcaatatcatctacaacttctacagaaaaagagacaaaaactttgcgacaacaacttccctatgtaagtggttgtgattttttagagacaaataagttcatagaagatacttataaaaaaacctgtagttatgagtgtaaagatattgaaaatcctttattttttgataatatacccaaagaacaacttaaaagtattattgtaaatcgtcgttcaattcgagcttttagagaaatacctatagaagaaaatgatttttcttttatcacccaaaatatttttacttttgcaacaacacacaatattgatatattttatacagttcatagaataaatggcatgactcaaggattatataaaaatggaactcttcaaagtgttggcgactttagtgctaaatcaagatatttaagtttagaacaaaatataggtggacaaagtgcagtaacattctacttcacttcaaatgaaaatgaggcttatcaaaaagtaaatattttaagtggatttatcgctcaaatcatatatctaaaatcagaactcaaacaggtaggttgtagtggtattggagcttattatgatcaagagaccaaaaagtttttaaagacagaaaataacattctttacctacttgctattggcaagtaa

SEQ ID NO: 9992 - protein, 219 aa, Unknown
  Obtained from environmental sample
  misc_feature (1)..(219): Xaa is any amino acid
MFTCAISSTTSTEKETKTLRQQLPYVSGCDFLETNKFIEDTYKKTCSYECKDIENPLFFDNIPKEQLKSIIVNRRSIRAFREIPIEENDFSFITQNIFTFATTHNIDIFYTVHRINGMTQGLYKNGTLQSVGDFSAKSRYLSLEQNIGGQSAVTFYFTSNENEAYQKVNILSGFIAQIIYLKSELKQVGCSGIGAYYDQETKKFLKTENNILYLLAIGK

SEQ ID NO: 9993 - DNA, 306 bp, Unknown
  Obtained from environmental sample
  misc_feature (1)..(306): n is a, c, g, or t
atgaaatttactgaaatctttaaaatagattatgtaatgaaacaagggattggtgaactaagtggaggacaacagcaacgactatcgtgtgcaagagttcttacaaaaaaaccaaaaataatttttgctgatgaacctacaggaaacttagaccatgaaacagcaaatgaagttataaatgttttgtttgattatattgaaaaacaaagtgcaggcttaataatagttacacatgaagaagagatagcatttaagtgtgataaagtttacaaattaaatgattataaattggagcaattaaaatga

SEQ ID NO: 9994 - protein, 101 aa, Unknown
  Obtained from environmental sample
  DOMAIN (1)...(95): ABC transporter
  misc_feature (1)..(101): Xaa is any amino acid
MKFTEIFKIDYVMKQGIGELSGGQQQRLSCARVLTKKPKIIFADEPTGNLDHETANEVINVLFDYIEKQSAGLIIVTHEEEIAFKCDKVYKLNDYKLEQLK

SEQ ID NO: 9995 - DNA, 807 bp, Unknown
  Obtained from environmental sample
  misc_feature (1)..(807): n is a, c, g, or t
atgcaaaaagctcgaaagaagtatttacagattttagaatatgatgaatcattatttgaacaaaagaaagatattcaagaaaatatcacatggataaaaaagataaaaagtggaattgcagataatagtttccactctttcttgcaaccaatagttgatgctcaaactcaagagatttataaatatgaagcacttattagatacataggggaagatggtaaagaggtggctcctttttgtttcttacctattgcaaaaaaagctaaactatttccaataattataaaagtgatgcttacaaatgttatctctataattcaagaaaaaaatattcgagttgctattaatttatcttttgatgatattatcaataaagaaacacataattttatttttactactctagaagaacacccccaagaagcaaaactaatagagtttgagatactagaaagtgaagagattgaggattttgatatagtaagagaatttattgctaaaataagaaaatttgggtgtaaaataggtgttgatgattttggtgctggttattctaattttaatatgctagaagctttaaacattgactatgtaaagattgatggctctttaattaaagagatagaccatttgcctaaacaagccttaatagttgaaacaattgcacaattttgtaaaaaacttggtattaaaactgttgcagaatttgtatctagtgaagagatttatcatacagcaaaaaagcttggtattgattatatgcaagggtatcattttggtaaacctgtcaataaagatactatttaa

SEQ ID NO: 9996 - protein, 268 aa, Unknown
  Obtained from environmental sample
  DOMAIN (27)...(262): EAL domain
  misc_feature (1)..(268): Xaa is any amino acid
MQKARKKYLQILEYDESLFEQKKDIQENITWIKKIKSGIADNSFHSFLQPIVDAQTQEIYKYEALIRYIGEDGKEVAPFCFLPIAKKAKLFPIIIKVMLTNVISIIQEKNIRVAINLSFDDIINKETHNFIFTTLEEHPQEAKLIEFEILESEEIEDFDIVREFIAKIRKFGCKIGVDDFGAGYSNFNMLEALNIDYVKIDGSLIKEIDHLPKQALIVETIAQFCKKLGIKTVAEFVSSEEIYHTAKKLGIDYMQGYHFGKPVNKDTI

SEQ ID NO: 9997 - DNA, 327 bp, Unknown
  Obtained from environmental sample
  misc_feature (1)..(327): n is a, c, g, or t
gtgnnggcatcgaaagcaaaaaaatacaaaaacagcaatttaatatattttagttcaattgtttacatttccaaccttattcagcttttaatctatgctgaaatattgttggtcgatagtttttgggttgttggtataatcttactcacttctaaatggcttattgattttatattactatatttggctgcaaacttttttaataagaaaaagtatcttgttctttttgtatttgtagcgtttatttatcctatatacattgtgtttataggattgttggcgttgattacaaatttcaaatggaagggaagaaggtatcatgagtaa

SEQ ID NO: 9998 - protein, 108 aa, Unknown
  Obtained from environmental sample
  misc_feature (1)..(108): Xaa is any amino acid
MXASKAKKYKNSNLIYFSSIVYISNLIQLLIYAEILLVDSFWVVGIILLTSKWLIDFILLYLAANFFNKKKYLVLFVFVAFIYPIYIVFIGLLALITNFKWKGRRYHE

SEQ ID NO: 9999 - DNA, 393 bp, Unknown; identical to SEQ ID NO: 7569
  Obtained from environmental sample
  misc_feature (1)..(393): n is a, c, g, or t

SEQ ID NO: 10000 - protein, 130 aa, Unknown; identical to SEQ ID NO: 7570
  Obtained from environmental sample
  misc_feature (1)..(130): Xaa is any amino acid

SEQ ID NO: 10001 - DNA, 543 bp, Unknown
  Obtained from environmental sample
  misc_feature (1)..(543): n is a, c, g, or t
atgagtaataaaaaaaataatacaaaatcgaagtcgttgagcaaaatggcttggcagaggcttaaaagaaataagctttctgtttttggaatgcttattatttttgtagcagccatggtagctattttaggccctttagcacgtcctgacaatactccaaaagcaaacgaccaaacgttagaattaactacaaaaaagccagggtttaccattgatttattaaaaattaagaaaaaccgaaaagcaatcaatcaatcttggtggtctaaattttctgaagggattgagaacacctatcaaattatccctgtttatgattatagttttgaaggaactaaaattgttgtagaaaaatatactggaggagatgtaaataatgggcctatagaaaaaattgatctagctgacgttgttttttctttagaaaacactcaaatcaatgaaactaatggttctttagaatttacacctatgaaagaggtaagaaaaactatgaccattgaagaacttccaaaagaaattaaatccgaaaaactttattag

SEQ ID NO: 10002 - protein, 180 aa, Unknown
  Obtained from environmental sample
  misc_feature (1)..(180): Xaa is any amino acid
MSNKKNNTKSKSLSKMAWQRLKRNKLSVFGMLIIFVAAMVAILGPLARPDNTPKANDQTLELTTKKPGFTIDLLKIKKNRKAINQSWWSKFSEGIENTYQIIPVYDYSFEGTKIVVEKYTGGDVNNGPIEKIDLADVVFSLENTQINETNGSLEFTPMKEVRKTMTIEELPKEIKSEKLY

SEQ ID NO: 10003 - DNA, 495 bp, Unknown
  Obtained from environmental sample
  misc_feature (1)..(495): n is a, c, g, or t
gtgttaaaagataaatgtaaagagattggattagaatttgatgaattgttctatgaacgatgcgaaaaatttataacacttttacaacaatggggtgcagtgcatagcctttctgctcagttaaaaaaagaggaaatagaagataatattttagatagtatctatcctgtgaagtttttaaatccttttgaaactttagctgatataggtactggtgctggatatcctgggatgcttttagctatcgcatatccagataaaaaaataaatttaatagaacctagagcaaaaagggttgcttttttgaactttgtaaaaagtgctttaaagttagaaaatgtagaggtgataccaaatagagtagaatatctttctcctcaaagttttgaccttattacaagtagagcagttactaatactacattacttttaagtattactaacaatgttgcttcacagatacagagtatcttttttacaaaggagtatttgtaa

SEQ ID NO: 10004 - protein, 164 aa, Unknown
  Obtained from environmental sample
  DOMAIN (17)...(163): Glucose inhibited division protein
  misc_feature (1)..(164): Xaa is any amino acid
MLKDKCKEIGLEFDELFYERCEKFITLLQQWGAVHSLSAQLKKEEIEDNILDSIYPVKFLNPFETLADIGTGAGYPGMLLAIAYPDKKINLIEPRAKRVAFLNFVKSALKLENVEVIPNRVEYLSPQSFDLITSRAVTNTTLLLSITNNVASQIQSIFFTKEYL

SEQ ID NO: 10005 - DNA, 543 bp, Unknown
  Obtained from environmental sample
  misc_feature (1)..(543): n is a, c, g, or t
atgtttaattttggaaagaccgaagaggaagcaggacgattagttgcgatggatgaaaactatgcaatcatatcatttgaaccaaatggtacaataatacatgcaaatgacaattttttaagtgttttaggatatagacttgatgaagttagtggtaaacatcatagaatattttgtaaaagtgaatatacaagctcaacagcatacactaagttttgggatgatttagctaagggtatagcgcaagtagatgagtttgaaagaattagaaaagatggtagttctgtttggattcaagcttcctatagtcctgtaaaaaatagtagtgggaaagtaactcgtgttgttaaatttgctcaagatattactgaagctaaaatagtaacaagtgctgtacaaaaagctattaatatagcaaaaacaggtattatgaaacaaactataactcaatcaactaaaaatgaagggatagaagatcttaaaaatggtggtaatggattgtttaacattgtatcctctaaagttgatggagactttaaataa

SEQ ID NO: 10006 - protein, 180 aa, Unknown
  Obtained from environmental sample
  DOMAIN (83)...(125): PAC motif
  misc_feature (1)..(180): Xaa is any amino acid
MFNFGKTEEEAGRLVAMDENYAIISFEPNGTIIHANDNFLSVLGYRLDEVSGKHHRIFCKSEYTSSTAYTKFWDDLAKGIAQVDEFERIRKDGSSVWIQASYSPVKNSSGKVTRVVKFAQDITEAKIVTSAVQKAINIAKTGIMKQTITQSTKNEGIEDLKNGGNGLFNIVSSKVDGDFK

SEQ ID NO: 10007 - DNA, 972 bp, Unknown
  Obtained from environmental sample
  misc_feature (1)..(972): n is a, c, g, or t
gtgagtgaagcgatagttattgttgatgaaaagcatgatattgttcttgtaaataaagtagcattgaaaaaatttgaagcaattgaggaaaatatcctttatacaaatattgcagagttgattccaattgattatcaagaggatatttttaaaacagtaaaagatagtgatgaaagttattatgatatatttttaaaaaaattcaatgaccatagtctatttcctgcatttgttagtggacaaatgttacaactaaaagatattacttatggaatattaaatattgttgatattacagaactgaaaaaacaagaagagaaaaaattaaaaaaattaaaatcacatattataagtcaagcaactacacatgctcaaaaagcaagtgagataaaagggcaaaatactacagagctaattactcttcaagatgaacttgatcaagcaaaacatgaaatttttaaactcgaaagaaagttgactttatttgaaagagaaaaccatattttaaatggacaagcagaaaaaattcaagagaactctttcagttttgagcaagttttagatagagagatagctttagggaagagatatggtagaaaattttctttagctattgttggaattgatgattataaaacattttcagaacaagttaatagtgaagcaaaaaaagagttaattcttagagcctttaaaaaacactttagaagtactatacgaactactgatgtaatatattatgaaaatagtggattattttatatgattttacctaattcaaatgatgtaaacatcacagatttggtaaagagactattacatgctaaaaaaatagataccagaatcattgtaaaattcaactgtggtattgctcacttttatgagcaagataccagagatcacctcctttatagagncagaaaaaatttagaagaaaacattaaagagaacagctatgtcattaaaatctag

SEQ ID NO: 10008 - protein, 323 aa, Unknown
  Obtained from environmental sample
  DOMAIN (176)...(313): GGDEF domain
  misc_feature (1)..(323): Xaa is any amino acid
MSEAIVIVDEKHDIVLVNKVALKKFEAIEENILYTNIAELIPIDYQEDIFKTVKDSDESYYDIFLKKFNDHSLFPAFVSGQMLQLKDITYGILNIVDITELKKQEEKKLKKLKSHIISQATTHAQKASEIKGQNTTELITLQDELDQAKHEIFKLERKLTLFERENHILNGQAEKIQENSFSFEQVLDREIALGKRYGRKFSLAIVGIDDYKTFSEQVNSEAKKELILRAFKKHFRSTIRTTDVIYYENSGLFYMILPNSNDVNITDLVKRLLHAKKIDTRIIVKFNCGIAHFYEQDTRDHLLYRXRKNLEENIKENSYVIKI

SEQ ID NO: 10009 - DNA, 669 bp, Unknown
  Obtained from environmental sample
  misc_feature (1)..(669): n is a, c, g, or t
atgaagtcatactttttattactgctgtttctcttacctctttttgccgaagaagactttaatatctataagcttcaaggaaagacagaggggcctactcttttaatatttgcgggcatacacggaaatgaacccggcgggtattttgccgcctctattcttgctcaacattacaccatcaacagtggaagcttatgggtagtccccaatacgaataaaaaaagtattatgcaatacagtcgaggtattcacggtgatcttaaccgaaagttctcccatattaaacagcacgacccagatattaagctgatacaggagataaagtcattaatccttgaagacgatgtctcactcatccttaatcttcatgacggacatggtttctttcgacaaaagtacacgaacactatctttaatcctggggcatggggtcagacctgtgtgatagatcaaataaaacttgatcaaaacaacagttatggggatcttgcctgtatagctgagcaagtcagcgataaactcaatgatcatcttctacaggaacatcatagctttaatgttaggaaccccaaaactaaaaagaaaaaaaatgggatgccaccctctttgacttactttgcgattaataacaatagcctgccttttgctatcgagacagtaaagagttga

SEQ ID NO: 10010 - protein, 222 aa, Unknown
  Obtained from environmental sample
  SIGNAL (1)...(16)
  misc_feature (1)..(222): Xaa is any amino acid
MKSYFLLLLFLLPLFAEEDFNIYKLQGKTEGPTLLIFAGIHGNEPGGYFAASILAQHYTINSGSLWVVPNTNKKSIMQYSRGIHGDLNRKFSHIKQHDPDIKLIQEIKSLILEDDVSLILNLHDGHGFFRQKYTNTIFNPGAWGQTCVIDQIKLDQNNSYGDLACIAEQVSDKLNDHLLQEHHSFNVRNPKTKKKKNGMPPSLTYFAINNNSLPFAIETVKS

SEQ ID NO: 10011 - DNA, 708 bp, Unknown
  Obtained from environmental sample
  misc_feature (1)..(708): n is a, c, g, or t
atgcaacactctttgacttactttgcgattaataacaataagcctgcctttgctatcgagacaagtaaagagttgaaaagcactgctatgaaggtctattatcaactgcgtgctatagaagcttttatggagatcatgggaatcgaatacaaaagggactttgaactggattcagaaagtgtcaaaaatataacgaaaagtaatggtgaaatcgtgattaatcgcaatttcacccttaatttggacatcttaagaaaaaatttaagatacattccgctacaatcgaaaaagaacgacctttacttctcccaccccttaggcggttgggtagaaggcaatgggtttatcgatttgtatattggacataaaaagatttctcatctcagtacgacaccttttgtcatacaagaatgcgagggacctattgaagcgatagtagacggaagctttaaatccgttgatttaccttcagaagttaaaattatgtccgatatagtttttaatgcacctgaaggctatcgcctgaacgtgatcggttttactgatcccaggtacaataatgaattgggaataaaaattgctaagtcatccatattaaagcgtttttcactcgacaacgagcaaaaaatgtttagagctgagttttataaacaagatgctttttgtggaatggtagttttaaattatgtagctaggaataaagaatga

SEQ ID NO: 10012 - protein, 235 aa, Unknown
  Obtained from environmental sample
  misc_feature (1)..(235): Xaa is any amino acid
MQHSLTYFAINNNKPAFAIETSKELKSTAMKVYYQLRAIEAFMEIMGIEYKRDFELDSESVKNITKSNGEIVINRNFTLNLDILRKNLRYIPLQSKKNDLYFSHPLGGWVEGNGFIDLYIGHKKISHLSTTPFVIQECEGPIEAIVDGSFKSVDLPSEVKIMSDIVFNAPEGYRLNVIGFTDPRYNNELGIKIAKSSILKRFSLDNEQKMFRAEFYKQDAFCGMVVLNYVARNKE

SEQ ID NO: 10013 - DNA, 480 bp, Unknown
  Obtained from environmental sample
  misc_feature (1)..(480): n is a, c, g, or t
atgacatttagtaatgatctgaaaattaatcatatctctttaatagaggatcttcataaaatcaataatcttgatacaaagttttcagacttcgatatatttaaaaagtactgtaaagatctaaaaaacggttttaaagctacatataactatcaaataagccctcaagacaacactaacaacatctataacattgaaataaacacttcaactggtgtgcagcataaactaactctctctaaatatcaaatcaatgagtcatcatctacggttatacacatatttgatacgagttctaatagacataaacgttattggatagacaaagatagtgagtatgtacccaatatagaatcatacttcaatattaaaagaatggttactcagatagtacaggcaactaaagaagagagaaaagagcaccaacttgatctgagatacaacaaacgatacttcgttacttctaaggagatcatatga

SEQ ID NO: 10014 - protein, 159 aa, Unknown
  Obtained from environmental sample
  misc_feature (1)..(159): Xaa is any amino acid
MTFSNDLKINHISLIEDLHKINNLDTKFSDFDIFKKYCKDLKNGFKATYNYQISPQDNTNNIYNIEINTSTGVQHKLTLSKYQINESSSTVIHIFDTSSNRHKRYWIDKDSEYVPNIESYFNIKRMVTQIVQATKEERKEHQLDLRYNKRYFVTSKEII

SEQ ID NO: 10015 - DNA, 837 bp, Unknown
  Obtained from environmental sample
  misc_feature (1)..(837): n is a, c, g, or t
ttggccaatatgagtcacgaaatacgaactcccatgaacggaattcttggttttgctgatttattaaaaacccccggtcttaccggcgaacagcaacaaaggtatatcggaataatcgaaacaagtggaaagcgaatgcttaatatcatcaacgatattgtgagtatttcgaaaatagaatctggacagatggaagtaaatattacagaaacaaatattaatgagcaaatcgaatacatttacaccttcttcaagcctgaggttgaaggtaaattcctacagttttccttcaaaaactctttgccttcaaagttgagtattctaaaaacagatcgagagaaagtttatgcgatctggacaaaccttgttaaaaatgcaattaaatacaccgaaaaaggctcaatagaattcggctatactaaaaaagggaaatacctcgaattttatgtgaaggacactggaattggcatttacaaaaacagacagaaagtaatttttgaaagatttattcaagccgatatttcaaacaaaaatgcctatcaaggagctggattaggattgtctatttccaaagcttatgttgaaatactgggtggaaaaatttgggttgaatcactggaaggaaaaggaagtactttttattttacgcttcccccacatcacgaaacagtaaaagaaaaaaggcttnaaaaacaaatatcgccttctattgatgcatcccttacaaaaaatctaaaaatactaatcgttgaggacgatgaaacatcagaagaacttattcgcattgctattcaaaattttcggaaccctattgttaatggtaaaacccgaaactga

SEQ ID NO: 10016 - protein, 278 aa, Unknown
  Obtained from environmental sample
  DOMAIN (1)...(62): His Kinase A (phosphoacceptor) domain
  misc_feature (1)..(278): Xaa is any amino acid
MANMSHEIRTPMNGILGFADLLKTPGLTGEQQQRYIGIIETSGKRMLNIINDIVSISKIESGQMEVNITETNINEQIEYIYTFFKPEVEGKFLQFSFKNSLPSKLSILKTDREKVYAIWTNLVKNAIKYTEKGSIEFGYTKKGKYLEFYVKDTGIGIYKNRQKVIFERFIQADISNKNAYQGAGLGLSISKAYVEILGGKIWVESLEGKGSTFYFTLPPHHETVKEKRLXKQISPSIDASLTKNLKILIVEDDETSEELIRIAIQNFRNPIVNGKTRN

SEQ ID NO: 10017 - DNA, 429 bp, Unknown
  Obtained from environmental sample
  misc_feature (1)..(429): n is a, c, g, or t
atgaaaataaaagcttatggtatctgtttgtataaagttgagaaaaatagcattaaaatcttactttgtaaatcaataaccagtaaaaaccgttggggatttttaaaaggtgttcaagaaaaaggggaatctgatttccaaactgcgataagagagtttagagaagagtcttcaataaacattgaaaaaagatatcttgaaaaatattttgaacaaaaaaatagtgaaaaagatataggtacttatctcgttaattataataatattcatagtattgaaaaatatttcaacgatgatatattacacaaaaaatatctttcatgggaaaataatgatgttaaattttttaatattaataccttaccaaatataaagaaaaaacaaaatagtctaatacaggatgttataaaatatttacaaaaggggtaa

SEQ ID NO: 10018 - protein, 142 aa, Unknown
  Obtained from environmental sample
  DOMAIN (2)...(137): NUDIX domain
  misc_feature (1)..(142): Xaa is any amino acid
MKIKAYGICLYKVEKNSIKILLCKSITSKNRWGFLKGVQEKGESDFQTAIREFREESSINIEKRYLEKYFEQKNSEKDIGTYLVNYNNIHSIEKYFNDDILHKKYLSWENNDVKFFNINTLPNIKKKQNSLIQDVIKYLQKG

SEQ ID NO: 10019 - DNA, 939 bp, Unknown
  Obtained from environmental sample
  misc_feature (1)..(939): n is a, c, g, or t
ttgtatgtgatgtacaatgcattttttacttttactattacactgcctttatctttagtatttggatggattgtaactataacagtacttataaaaaataatgaactagtaagtttttattctttgagtatatccaaagctgatatattacaaccaattattgctatctcaatatttatcacttttattttaatagtcttacaagcaaccccccttgcatactcagttgaaaacaaaaacaaaattttagataatagttattttgtgaatgaaaaatcaaatatctttttaaaatataatgactattttatctactttaaaaagctctatcctttagaaaaaaaggctgaagatatccatatttttaaaactaaaaaccatgatattgttgaaatcatagtagcaaaaaaagcatactttcaaaataatagatggtatgtaatagatacaaaaattacaaaaaaaccagaagttattaactggagtcaatcaaaaataactacaactaatgaaaagtttttatacacactagaaggttttgaaccaaaaattataaacaatgtatataaaggagaaacacaattttccattatagatgcagtaagaaccatactactacttgagaatcaagactttaatacaaataagataaaaactatactttattctcaaatctttatgcctttttttgttatacctttgattgtaataatatttttatttacaaatcctagtagtagattttttcatactgctgcttttacctctgtaacaatttttactacactgataacttgggggagtgttatttttacctcaaagcttggatatggaggaatagttttagggggatttgctattataatgccattggttatcctaattttgtataaccttattatatttataataaaaaaaatccctattaatggaaaataa

SEQ ID NO: 10020 - protein, 312 aa, Unknown
  Obtained from environmental sample
  DOMAIN (1)...(306): Predicted permease YjgP/YjgQ family
  misc_feature (1)..(312): Xaa is any amino acid
MYVMYNAFFTFTITLPLSLVFGWIVTITVLIKNNELVSFYSLSISKADILQPIIAISIFITFILIVLQATPLAYSVENKNKILDNSYFVNEKSNIFLKYNDYFIYFKKLYPLEKKAEDIHIFKTKNHDIVEIIVAKKAYFQNNRWYVIDTKITKKPEVINWSQSKITTTNEKFLYTLEGFEPKIINNVYKGETQFSIIDAVRTILLLENQDFNTNKIKTILYSQIFMPFFVIPLIVIIFLFTNPSSRFFHTAAFTSVTIFTTLITWGSVIFTSKLGYGGIVLGGFAIIMPLVILILYNLIIFIIKKIPINGK

SEQ ID NO: 10021 - DNA, 684 bp, Unknown
  Obtained from environmental sample
  misc_feature (1)..(684): n is a, c, g, or t
atgattataaaagggttaggtatgaatatagtaaaacttattattgtaagtagcttcatattatttaatatagcccttgccaaaactcaagaaaaaaagatttataatgtagtagtttctaaagattggaagccttattattctgttgattctaatggaaaagcagatggttttgcagtcaatttatttgaagcgatagcaaaagatattgggattgaatatagatacaaagtaattaacgaatggagtgagttttggaaacttcttcaacatgagcaaatagatattattccagatattggtgtgaccaataaaagaaaagattttttactattttctcaacctacaaatacctttgaaattaaaatttataaacgagtgaattcaaaacatattcaatttttaaaagatttagaaaataaaaaagtagctgtagtagggaaaaatgttggaataacattaatgaataaatatccaaatattttaataaaagaatatgaaaatcgttttgaggctttttatgctttattggctggagatgtagatggtttttgttatccaaagcctttgatagagtattctttaaaaaagttaaatttagaggataaagttgaagcattagatgaaaatatttatgagataaaaagggcagtgggagttgttccttcaataaagagttactag

SEQ ID NO: 10022 - protein, 227 aa, Unknown
  Obtained from environmental sample
  DOMAIN (35)...(227): Bacterial extracellular solute-binding proteins, family 3
  misc_feature (1)..(227): Xaa is any amino acid
MIIKGLGMNIVKLIIVSSFILFNIALAKTQEKKIYNVVVSKDWKPYYSVDSNGKADGFAVNLFEAIAKDIGIEYRYKVINEWSEFWKLLQHEQIDIIPDIGVTNKRKDFLLFSQPTNTFEIKIYKRVNSKHIQFLKDLENKKVAVVGKNVGITLMNKYPNILIKEYENRFEAFYALLAGDVDGFCYPKPLIEYSLKKLNLEDKVEALDENIYEIKRAVGVVPSIKSY

SEQ ID NO: 10023 - DNA, 921 bp, Unknown
  Obtained from environmental sample
  misc_feature (1)..(921): n is a, c, g, or t
atgtccaaaaacgatataaatactttttctgataaagatagtggcgatgatattggttatgcctttaaatttaattcagaaaatattgttgatttgaacaaagaaaaagaagaaagttggaaactgaacattggtactaattacgaatatgtacaagagtattttacaccaattgaaagatttagattagtagaatttgaaagagattggaacattagcaatgctattgtaaataccgaccagcatattgttggagggacagttggtttaaacaaaaccgacaaaggaaatgttgtttatgcctttaactatatgaatacattagagttaattgaaggagctaaaaatgcattagctattaattataaaacgaacgggtttcagttggtgagtaatgccagttttttgcaaaccaaaggcataaataattccgaatttttacgacacaaagctattcttacaaaacaattaggttgggtagtgcttggcgtaggagaagaaaccgaacaaaataaattgtttctaaacactagtgattcgttaactgcctctagttttgagtttgttattttacaagcgtttattcataatgcagataccaccaaaaataaatttatgttgagctacaaacaacgtgatgataatgtgcctgttgctaacgattttttaaaagctaccagagctgaagatattgagctatctatgagtttactgaaaatgaaaaaccataaattgagaagtacttatacgtatagaaaattacatattgtantcaacacatttacccacttaaagcccgaagagactgttttagctagagtggaataccatggggactttttaaagaatttaatttctactaatacctattatgaaattggttcagggttagaaagtaaaaaagaagtttttatttgctga

SEQ ID NO: 10024 - protein, 306 aa, Unknown
  Obtained from environmental sample
  misc_feature (1)..(306): Xaa is any amino acid
MSKNDINTFSDKDSGDDIGYAFKFNSENIVDLNKEKEESWKLNIGTNYEYVQEYFTPIERFRLVEFERDWNISNAIVNTDQHIVGGTVGLNKTDKGNVVYAFNYMNTLELIEGAKNALAINYKTNGFQLVSNASFLQTKGINNSEFLRHKAILTKQLGWVVLGVGEETEQNKLFLNTSDSLTASSFEFVILQAFIHNADTTKNKFMLSYKQRDDNVPVANDFLKATRAEDIELSMSLLKMKNHKLRSTYTYRKLHIVXNTFTHLKPEETVLARVEYHGDFLKNLISTNTYYEIGSGLESKKEVFIC

SEQ ID NO: 10025 - DNA, 339 bp, Unknown
  Obtained from environmental sample
  misc_feature (1)..(339): n is a, c, g, or t
atgactaaaaatgaaaatataaaagagttttacaaaagaaataaactcgaatttatacccatagaacaaaaaaatgatattggtcattttaatatttttaaaagagacagtacacgaaaaaaacctatcacttttaatagacgtgaatactataaaatcacccttttaaaaggtaaaataaaaatagactatgcagataaaagtataataagcgataaatatgctttaatgttttctgatcctctcggtccatatagttgggaacctttagatatagaacaagatggctatttttgcatttttactgaaacattttttcataaatttggactcccttaa

SEQ ID NO: 10026 - protein, 112 aa, Unknown
  Obtained from environmental sample
  misc_feature (1)..(112): Xaa is any amino acid
MTKNENIKEFYKRNKLEFIPIEQKNDIGHFNIFKRDSTRKKPITFNRREYYKITLLKGKIKIDYADKSIISDKYALMFSDPLGPYSWEPLDIEQDGYFCIFTETFFHKFGLP

SEQ ID NO: 10027 - DNA, 636 bp, Unknown
  Obtained from environmental sample
  misc_feature (1)..(636): n is a, c, g, or t
ttgcaaaacttaaaacactcatatataaatccacatgtttttactgagcaaggtgtatcaatgttaagtgctattttaaaaagtgatatagcaataaacagaagtgtacaaataatgagagctttcgtaaatatgaagcaatttatatcatcaaataatgatctttttaaaaagatagatactattgaaaaaagacaaataggatacgagataaaatcagatgaaaagtttgataaacttttcaatgctcttgaagataaatcacttaaatcaactcaaggtatatttttcgatggtcaaatttttgatgcatataattttgtatctgatttgttaagagaaacagataaaaagattatacttatcgacaactatgtggatgatattacacttactattttttctaaaattccaaatataaaagtaaccatttacactagtactatatcaaaacaactcaaactagacctcgaaaaatataatacccaatataataatatcaccattaaaacctttaaaaattctcacgatagatttattatcattgatgataagaagatttaccatataggggctagtttgaaagatcttggtaaaaaatggtttgcttttcaaagaggaatctcagccatctga

SEQ ID NO: 10028 - protein, 211 aa, Unknown
  Obtained from environmental sample
  misc_feature (1)..(211): Xaa is any amino acid
MQNLKHSYINPHVFTEQGVSMLSAILKSDIAINRSVQIMRAFVNMKQFISSNNDLFKKIDTIEKRQIGYEIKSDEKFDKLFNALEDKSLKSTQGIFFDGQIFDAYNFVSDLLRETDKKIILIDNYVDDITLTIFSKIPNIKVTIYTSTISKQLKLDLEKYNTQYNNITIKTFKNSHDRFIIIDDKKIYHIGASLKDLGKKWFAFQRGISAI

SEQ ID NO: 10029 - DNA, 306 bp, Unknown
  Obtained from environmental sample
  misc_feature (1)..(306): n is a, c, g, or t
atgttcgtatatcgcgatgatatttatctgtacaaagatgaaaaagagcgtgagaagcaagccataaaagagggtaaagagtttaaatcaacctatgttgaaaaagaggaagaagaagctgaaattatcatcggtaaacagcgtaacggacctaccggacatgtaaaacttacttttcaaaaaaagtttacacgctttgttgatgccaaaccatcttttggcggaactgagattgtttatgaaaatatcgatacatcttcagcaaacatgggattaaatgaatctgtatccatgccacaaatttaa

SEQ ID NO: 10030 - protein, 101 aa, Unknown
  Obtained from environmental sample
  misc_feature (1)..(101): Xaa is any amino acid
MFVYRDDIYLYKDEKEREKQAIKEGKEFKSTYVEKEEEEAEIIIGKQRNGPTGHVKLTFQKKFTRFVDAKPSFGGTEIVYENIDTSSANMGLNESVSMPQI

SEQ ID NO: 10031 - DNA, 483 bp, Unknown
  Obtained from environmental sample
  misc_feature (1)..(483): n is a, c, g, or t
atgaaacttcaaagagtcaaactttttaaaagttggcactctttagttatcttccttttagctctctcaattatcttctctttcaatctatttttagagtataagaactatcaaaaatatattgagtttacagatattacagttaatgcaaaagttataaatcagtaccttaaaagcaaaaattctaaagagtattatgttctaaaattacgctcagatgatggagtagaattttacacaaccgactcaaaatatataagagatctgaaacttcaccatgttaatataaaactatttattgataaactaactttttatgagtatcttagtggattttatgcaagaagtgagatancaaaagtctatccgatagataaaataagatcaaatatatctacatacattacttctcagcatgaagatgatcacctaaaaagtatattcagtgctctatttttagcacaccccataagagtgagataa

SEQ ID NO: 10032 - protein, 160 aa, Unknown
  Obtained from environmental sample
  misc_feature (1)..(160): Xaa is any amino acid
MKLQRVKLFKSWHSLVIFLLALSIIFSFNLFLEYKNYQKYIEFTDITVNAKVINQYLKSKNSKEYYVLKLRSDDGVEFYTTDSKYIRDLKLHHVNIKLFIDKLTFYEYLSGFYARSEIXKVYPIDKIRSNISTYITSQHEDDHLKSIFSALFLAHPIRVR

SEQ ID NO: 10033 - DNA, 837 bp, Unknown
  Obtained from environmental sample
  misc_feature (1)..(837): n is a, c, g, or t
atgatatgtaagtatattgttttagctgaagtggataagatacttatggttctaagaccctatcagttttatgcagttgaagcaattatagaacaagtaaatacctcaaagagaaatggctatatctggcatacaacaggaagtgggaaaacgctcacttcatttaaaacagcacaaatacttatgaagttgccaaaagtagataaagttgtctttgtggtagatagaaaagatttggactttcaaaccacaaaagagtttaactcttttagtgatggaagtgtagatggaactgataatacaaaggctttagtaagacagtttggtgatgatacaaaactaatagtaacaaccatacaaaaactaaacacagccataaacaaaaaacaataccttgaaaagatggaaaaacaaaaagagaaacatatcgtatttatctttgatgagtgtcatagaagtcagtttggtgaaacccatctaaatatcaataaattttttacaaacaatcagatgataggttttacaggaacgccaatattccccgaaaatgctatgggaaataagctaggcaaaagaaccacagcagacctttttgatgacagactgcatagatatgtgataactgatgctattaatgatgataatgtcttgaagttctcagttgagtatatagggagatacaaagagaaagagggaagtgctacaaatattgatatagaagttgaagatatagatagacaagagcttttagaaagtgatgatagggtagaaaagatagttgaatatatcttggcaaatcatggaagaaaacacatagtaaagattttactggtatga

SEQ ID NO: 10034 - protein, 278 aa, Unknown
  Obtained from environmental sample
  DOMAIN (18)...(184): DEAD/DEAH box helicase
  misc_feature (1)..(278): Xaa is any amino acid
MICKYIVLAEVDKILMVLRPYQFYAVEAIIEQVNTSKRNGYIWHTTGSGKTLTSFKTAQILMKLPKVDKVVFVVDRKDLDFQTTKEFNSFSDGSVDGTDNTKALVRQFGDDTKLIVTTIQKLNTAINKKQYLEKMEKQKEKHIVFIFDECHRSQFGETHLNINKFFTNNQMIGFTGTPIFPENAMGNKLGKRTTADLFDDRLHRYVITDAINDDNVLKFSVEYIGRYKEKEGSATNIDIEVEDIDRQELLESDDRVEKIVEYILANHGRKHIVKILLV

SEQ ID NO: 10035 - DNA, 855 bp, Unknown
  Obtained from environmental sample
  misc_feature (1)..(855): n is a, c, g, or t
atgaaaacncaaaacaagagaatatttgaacttaaatttttaagtatggatgattacgatgaattaaaagagacaatgttactctcctatgaaacaatgcaagatgcttattggaaagaaaatcaacttaaaacattaatcgagaagtttcaagagggacaaattgttataaaaatagatggtgagttagctgcttgtgcgttttctatcattgttaattatgatgaattttcaaatcatcacacttataaagagataactggaaactatacattttctacacattcaaataaaggtgatatactttatggtattgatgtatttgtaaagccaaaatttagaggtctaagacttggaagacggttgtatgactatagaaaagagttgtgtgaaaaacacaatcttaaagggatagcttttggtggaagaatcccaaattatcataagtatgagaatgaacttactccaaaagagtatattgaaaaggtaaaaagaaaagagattcatgatcctgtacttaattttcaaatatctaatgattttcatcccgctaaagttttaaaaggatatttagagggagataaagcttctggagaatttgccgttttactagagtgggataatatctattatgaaaaacctaataaactagcaagtataaataaaaaagtggttcgattaggcttaattcaatggcaaatgagaccctataaaaaccttgaagaattgctacaacaagcagaatactttatagatacagtttcaggatatcgttctgattttgcacttttcccagagttttttaatgccccattaatggctgaaaacaaccatctttcagaaccacaagcttaa

SEQ ID NO: 10036 - protein, 284 aa, Unknown
  Obtained from environmental sample
  DOMAIN (55)...(151): Acetyltransferase (GNAT) family
  misc_feature (1)..(284): Xaa is any amino acid
MKTQNKRIFELKFLSMDDYDELKETMLLSYETMQDAYWKENQLKTLIEKFQEGQIVIKIDGELAACAFSIIVNYDEFSNHHTYKEITGNYTFSTHSNKGDILYGIDVFVKPKFRGLRLGRRLYDYRKELCEKHNLKGIAFGGRIPNYHKYENELTPKEYIEKVKRKEIHDPVLNFQISNDFHPAKVLKGYLEGDKASGEFAVLLEWDNIYYEKPNKLASINKKVVRLGLIQWQMRPYKNLEELLQQAEYFIDTVSGYRSDFALFPEFFNAPLMAENNHLSEPQA

SEQ ID NO: 10037 - DNA, 402 bp, Unknown
  Obtained from environmental sample
  misc_feature (1)..(402): n is a, c, g, or t
gtgatagcaagaacaaaggataggattaaatcgcaattatattattttggggtacaaatacttattcagttttcagagacaaaacattggtcaaaaaggtttactaactggattcatgaagtggaacttcctactgaaagtgcaaagcttacattattaggactcttaggaatggcagaaatacttaggaagaaacagtattttattaccaaagagataaggctgttgcctaataagcataaatacaaagggaattatgatttgttaataagtatacttggtattgctaatttgacagcaatgattttgttaactgagattggggatataacaaggtttaaagatttagataaactttgctcatttataggcttgattcctacaacaaatttatcagaataa

SEQ ID NO: 10038 - protein, 133 aa, Unknown
  Obtained from environmental sample
  misc_feature (1)..(133): Xaa is any amino acid
MIARTKDRIKSQLYYFGVQILIQFSETKHWSKRFTNWIHEVELPTESAKLTLLGLLGMAEILRKKQYFITKEIRLLPNKHKYKGNYDLLISILGIANLTAMILLTEIGDITRFKDLDKLCSFIGLIPTTNLSE

SEQ ID NO: 10039 - DNA, 759 bp, Unknown
  Obtained from environmental sample
  misc_feature (1)..(759): n is a, c, g, or t
ttgagtccattgccacatcagtattatatattaaaaggacaaaaatcatctgtattagctcattataatcctataaataatattttacaaagagttgaaaaacaaagaacttatggtattgatcctagaaatgcagaacaaacattctcattagatgctttactgcgatctgatgttcagctgattgctttgacaggaaaggcagggacgggaaagacccttttggctcttgcagcagctttacaccaagaaaagaaatttaaccagatacttctagcaagacctattgtttctcttgcaaatagagacttaggttttttgcctggtgatgtgaaagagaagattttaccatatatgcagccattgtttgataatttgtcggttattaaaaatcagtttaaatctcaaagtaaggagtatactcaaattgaggaaatgcaaaaaaatgaaaagctcgttattagcccattagcatatattagaggaagaagcttatccaatgtcttttttatagttgacgaagctcaaaacttaacgccacacgaggtaaagacaattattacacgtgcaggggaaggaactaaaatgatttttactggagatattcatcaaattgactctccatacctcgatttaaagtctaatggattaagttatttagctgataaaatgaaaggtcaagatatttttgctcatgtaaatttaataaaaggggagaggagttatttagcagaattagcatcggatctatataaataa

SEQ ID NO: 10040 - protein, 252 aa, Unknown
  Obtained from environmental sample
  DOMAIN (39)...(252): PhoH-like protein
  misc_feature (1)..(252): Xaa is any amino acid
MSPLPHQYYILKGQKSSVLAHYNPINNILQRVEKQRTYGIDPRNAEQTFSLDALLRSDVQLIALTGKAGTGKTLLALAAALHQEKKFNQILLARPIVSLANRDLGFLPGDVKEKILPYMQPLFDNLSVIKNQFKSQSKEYTQIEEMQKNEKLVISPLAYIRGRSLSNVFFIVDEAQNLTPHEVKTIITRAGEGTKMIFTGDIHQIDSPYLDLKSNGLSYLADKMKGQDIFAHVNLIKGERSYLAELASDLYK

SEQ ID NO: 10041 - DNA, 843 bp, Unknown
  Obtained from environmental sample
  misc_feature (1)..(843): n is a, c, g, or t
atgaaaaccataagaaacatcaaaaaagctattggctgggactatagaagttccaagccagagtttgacctcgacaaagagatatactctcaatttaaacactttagacttcctttaatattattacaagtcattatgatggttggtaccattggctatatgataatcgatgattttacaatactcgatgcaatctatcaaacaggtattacatttacaacagttggatttggagaagtttctcctatatcacctgctggaagattatttactataacacttataatatttggatttttaatatttactttatctattactacacttatacaagtattagtaagaggtaaattcctagacctatacaaggagagaaatatgttgtataaaatagcacggcttcgaaatcacttcgtaatattcaatcacaatgaatacacagtacaactagcagaacaatttaaacaaaacaatataccttttgttattgttgaccctactgatgaattagaagagatagctgctaaaaacaactatccttactatgttaaagaagaaacatatacagaaagagctttcttaaaatcacacctttcaagtgcaaaaggggtaatatctttatcaaaaaacatatcagatagtattacaattatcgcatctgttagactctatgaaaaagagctagggagaaaaaatccttttcttatcatttgtaatgcagaatcaaaaaaagatgttgaaagattaaaaaaacttggagctaataaagttgtagctccacctgagcttatggcaaaaagggtagagtgctatggcaataagaccagaaatggaaaatgttag

SEQ ID NO: 10042 - protein, 280 aa, Unknown
  Obtained from environmental sample
  DOMAIN (137)...(260): TrkA-N domain
  misc_feature (1)..(280): Xaa is any amino acid
MKTIRNIKKAIGWDYRSSKPEFDLDKEIYSQFKHFRLPLILLQVIMMVGTIGYMIIDDFTILDAIYQTGITFTTVGFGEVSPISPAGRLFTITLIIFGFLIFTLSITTLIQVLVRGKFLDLYKERNMLYKIARLRNHFVIFNHNEYTVQLAEQFKQNNIPFVIVDPTDELEEIAAKNNYPYYVKEETYTERAFLKSHLSSAKGVISLSKNISDSITIIASVRLYEKELGRKNPFLIICNAESKKDVERLKKLGANKVVAPPELMAKRVECYGNKTRNGKC

SEQ ID NO: 10043 - DNA, 828 bp, Unknown
  Obtained from environmental sample
  misc_feature (1)..(828): n is a, c, g, or t
atgggaatagttgttttagataaagaactgaaatatcaagtttggaatcctttcatgaaggacttatctggtattcctgcaaataaaattttggggaaacatccaacagattttttttcgtttctttccgataataaagtcatagacaaattaaatgatttgctaaaatcaggaaaatattttcaaacagaatttaagtttaaaacaaactataaagagggttgggcaaatgactttagtagagccattattgatgaaaataataaaataaaaggaatcatctcaatcgttactgatattacagagcggaaactaacagaacaaaaattaatagaaagcgaagcaaattataaaaatctgatagaaacagcttccgatgcaatttatttaatgtcggaagatggaacaatcattagtacaaatgaagctgcatgcaatatgctgggaaagtccaaagatgaaattcttggagtaaatatagattctatagatccaaattttccaatagatgtatttttaaaattttgggaaaatatttcttttaatgaacagtttatattcgaaacaagtcatattcgaaaagatggaaccttagttcctgtcgaaattagtggacaaaaatacaagcagaatgaaaaagtattttattatggaattgcacgtgacatatccgagcgtaaacaagcaaataataaattaaaagatagcgaagaaagatttcgggagcttgtaaatacaattaacagcggtgtagcaatttataaagtaataaatgaaggtaaatcaggaagtgattacattattcaagattttaatgactattcgtga

SEQ ID NO: 10044 - protein, 275 aa, Unknown
  Obtained from environmental sample
  DOMAIN (115)...(177): PAS domain
  misc_feature (1)..(275): Xaa is any amino acid
MGIVVLDKELKYQVWNPFMKDLSGIPANKILGKHPTDFFSFLSDNKVIDKLNDLLKSGKYFQTEFKFKTNYKEGWANDFSRAIIDENNKIKGIISIVTDITERKLTEQKLIESEANYKNLIETASDAIYLMSEDGTIISTNEAACNMLGKSKDEILGVNIDSIDPNFPIDVFLKFWENISFNEQFIFETSHIRKDGTLVPVEISGQKYKQNEKVFYYGIARDISERKQANNKLKDSEERFRELVNTINSGVAIYKVINEGKSGSDYIIQDFNDYS

SEQ ID NO: 10045 - DNA, 300 bp, Unknown
  Obtained from environmental sample
  misc_feature (1)..(300): n is a, c, g, or t
ttgatgattggcaaaattccacaatataaaaaagaaaaaaaaactagtgtagattattatcaagatacatattttattattaatttccatgaaagaaaaatggatacatttcctttaccatgttttgatagtgatttagaacaagtcttttttcttccatttgatcgatttagaataacaaaatggataaatagtattaagaatcttgataaatttatttattcaaatgaagatagtttagaaacttatattacaaaagaagaatatacaaaatatttggaggcaatgaatgagttatga

SEQ ID NO: 10046 - protein, 99 aa, Unknown
  Obtained from environmental sample
  misc_feature (1)..(99): Xaa is any amino acid
MMIGKIPQYKKEKKTSVDYYQDTYFIINFHERKMDTFPLPCFDSDLEQVFFLPFDRFRITKWINSIKNLDKFIYSNEDSLETYITKEEYTKYLEAMNEL

SEQ ID NO: 10047 - DNA, 423 bp, Unknown
  Obtained from environmental sample
  misc_feature (1)..(423): n is a, c, g, or t
atgagttatgagttaatgaaacgttataataagtctaagcatatagaaagtataaaagttaaaaactttaaatttgagtatctattttcaaaaaattggaaaaaagaggaagatataccttatgtattaagaacacatttattggattcttattattgtttacctgaacgaccagatatggcttttacttttttgtggaaatgtattaataatacatatagtacttatcaaagaaaaacttcaagtgaaattataactggagacgctaagttacttgaaaatatgagtaaagggatagttgaaaagttaagtgantacataactgcaacagatacnatcaaaaagttaataggaaaatatattgataaggttcctgataaaattttaagttttcttcctaaatatattttaaatcttacgtga

SEQ ID NO: 10048 - protein, 140 aa, Unknown
  Obtained from environmental sample
  misc_feature (1)..(140): Xaa is any amino acid
MSYELMKRYNKSKHIESIKVKNFKFEYLFSKNWKKEEDIPYVLRTHLLDSYYCLPERPDMAFTFLWKCINNTYSTYQRKTSSEIITGDAKLLENMSKGIVEKLSXYITATDTIKKLIGKYIDKVPDKILSFLPKYILNLT

SEQ ID NO: 10049 - DNA, 525 bp, Unknown
  Obtained from environmental sample
  misc_feature (1)..(525): n is a, c, g, or t
gtgataaaacaacaaatcgttgatgaacgctatgtttattcatcatacaatacatttaaaaagaaattcaaaagtatacatgacagtatcatatcaacatatggtcaagaatatttaagtatatgttcttctactatttgcaacggagaagttaatttaaatattactgatcaagataaaagtataaaaattatacgtagtttaagtgaaaaactgaaagaactcattaaaaaaagagaagttattttgaagcatgatggtaaagaatatcaattaaagttaaactctaatgacgaacatattcaatttattttatttaatattctatatgcaataagaaataacacagttcatggaaagattgcttcaagattaaatagtgattatacaaattctaaaagttataattctagtaagtatatttatctattaggatatatgttcctatctgtaatgctttatgtatcagatgaactagaacttgaagatttaacttttaatattgttaatctacaagaattgtaa

SEQ ID NO: 10050 - protein, 174 aa, Unknown
  Obtained from environmental sample
  misc_feature (1)..(174): Xaa is any amino acid
MIKQQIVDERYVYSSYNTFKKKFKSIHDSIISTYGQEYLSICSSTICNGEVNLNITDQDKSIKIIRSLSEKLKELIKKREVILKHDGKEYQLKLNSNDEHIQFILFNILYAIRNNTVHGKIASRLNSDYTNSKSYNSSKYIYLLGYMFLSVMLYVSDELELEDLTFNIVNLQEL

SEQ ID NO: 10051 - DNA, 738 bp, Unknown
  Obtained from environmental sample
  misc_feature (1)..(738): n is a, c, g, or t
atgccggcaatgactctcaaattatatacaaaatataagcttgtatttgatgaaagttttgaagataattttagattgctagtagataaaaaagatcagtttataaaaaatgaatctctaaaaaaagagtgtgatacaaaacttcaaacaatagctgtagaattaaaagaattggagactaagatatcatctaaagagacaaatctcaaagagcaaaatgaacaacttcaaagtttaatacaagagctaaaagaattagagcaaaaaagtaaagctatcttagatatacaagatatagatacctttgaaaaagagataacaaatagttttaatgtcataaatgaaaactacaacaacttgtcaaaagagctagtgaatttaagctcaaaagatgagtccctaactaaacagataaaagatttggtagaaaaacaaagtgcagatagtataaaactagatgagctaaaacaaagttttgaaaaagctttaaaagaaaacgactttatctcaattgaagagtttgaaaaagcacttttatcanaagatcaaagagaagaactaaaccaaatatgtaaaactatagaagagagatactctcaaatacaaactctaaaaatagacacagcaaaaaaactaaaagagcaaaaaaagttagcttttagtgatagagaactagagaaagtaaatgaagagctaatagagttacaaagctcaatagatgaacttcaaagtccatag

SEQ ID NO: 10052 - protein, 245 aa, Unknown
  Obtained from environmental sample
  misc_feature (1)..(245): Xaa is any amino acid
MPAMTLKLYTKYKLVFDESFEDNFRLLVDKKDQFIKNESLKKECDTKLQTIAVELKELETKISSKETNLKEQNEQLQSLIQELKELEQKSKAILDIQDIDTFEKEITNSFNVINENYNNLSKELVNLSSKDESLTKQIKDLVEKQSADSIKLDELKQSFEKALKENDFISIEEFEKALLSXDQREELNQICKTIEERYSQIQTLKIDTAKKLKEQKKLAFSDRELEKVNEELIELQSSIDELQSP

SEQ ID NO: 10053 - DNA, 762 bp, Unknown
  Obtained from environmental sample
  misc_feature (1)..(762): n is a, c, g, or t
ttgatcagatcggctcgagattataaagattttactattgaggtaggtcattttaataatgagatttcttctgacattattggagcttgtgtagacgctcaacaagacttgtcatcgctagaattaggtatactcattagtgagctagaattaaaatatggacgtaatcttaaagaaaaagaacttaaagagttactaccttacgagaaatctaaatttgccatctctaacgctagaaaagcgcaaaggctttatactgaataccccaaactgtttgaagtattcccggttgtttcattggtaggtaaaactaccatttcaaaattagatcatatagttaaatgggctaatgataactttcaaatggaaactcttttgaagttttgtgaggatgatatttttgattatgagctagatcatgatgatccgcttttatcgattgaagaattgcaaaactttaacgcgaaatctaataatattattcttggggcaatgtatgaaaggttaggtattcctgataaagagccaaaaaagaaagttcttaccaatgttacagattatgttgggtatgaattaaagtcgaataacaaagctgtgcctaaaacagaaaagcttgttgtgtttgaagcggaattaacagatgaagagcgttatattactgaggcgttctttaagttacttcatgatccagatgttcaaaaaggaagtaaagacgtttcattgacaagacgttttgaaatgttatttagacaattggcttag

SEQ ID NO: 10054 - protein, 253 aa, Unknown
  Obtained from environmental sample
  misc_feature (1)..(253): Xaa is any amino acid
MIRSARDYKDFTIEVGHFNNEISSDIIGACVDAQQDLSSLELGILISELELKYGRNLKEKELKELLPYEKSKFAISNARKAQRLYTEYPKLFEVFPVVSLVGKTTISKLDHIVKWANDNFQMETLLKFCEDDIFDYELDHDDPLLSIEELQNFNAKSNNIILGAMYERLGIPDKEPKKKVLTNVTDYVGYELKSNNKAVPKTEKLVVFEAELTDEERYITEAFFKLLHDPDVQKGSKDVSLTRRFEMLFRQLA

SEQ ID NO: 10055 - DNA, 738 bp, Unknown
  Obtained from environmental sample
  misc_feature (1)..(738): n is a, c, g, or t
gtgggtttcagtataaaactacattgtaagatgcttccaggtacatctaaaattgtggttattataataactaaatttatttatagggaaacgattaatatattactagttgacgatcacacattaattagagaaggacttaaacttatattaaaaaagaataagagttttaaaataattggagaggcatctaatggagtagaagcaattaagtatatagataaaaatgcttcgaaaattcatgtagtaatgttagatattactatgccggaattagatggttttgaagtagcgaagattgttaggcaaaatcatcctgagattaaaattttagcacttaccatgcatagcgaagaatcttacattacaaaaatgatagatgttggtgttcatggatatgtattaaaagattctaatttagaagatttgtcaacagctattaaaactattttagagggtaagccttattatagtagcgatgtatctgctattatgataaacagtttaatgaataaagataaaaagaaagaaaacaacgaattagaaaatcttacagagagagaaattcaaattatcaatttaattaccgaaggttttaaaagcagtgaaatcgcagatcaactaaagttatctaccagaaccattgaggtgcacagaagaaatttaatgaaaaaattagatgttaaaaatacagcagaactagttagttttgtattgaagagtaaattaattttatag

SEQ ID NO: 10056 - protein, 245 aa, Unknown
  Obtained from environmental sample
  DOMAIN (181)...(238): Bacterial regulatory proteins, luxR family
  misc_feature (1)..(245): Xaa is any amino acid
MGFSIKLHCKMLPGTSKIVVIIITKFIYRETINILLVDDHTLIREGLKLILKKNKSFKIIGEASNGVEAIKYIDKNASKIHVVMLDITMPELDGFEVAKIVRQNHPEIKILALTMHSEESYITKMIDVGVHGYVLKDSNLEDLSTAIKTILEGKPYYSSDVSAIMINSLMNKDKKKENNELENLTEREIQIINLITEGFKSSEIADQLKLSTRTIEVHRRNLMKKLDVKNTAELVSFVLKSKLIL

SEQ ID NO: 10057 - DNA, 342 bp, Unknown; identical to SEQ ID NO: 8251
  Obtained from environmental sample
  misc_feature (1)..(342): n is a, c, g, or t

SEQ ID NO: 10058 - protein, 113 aa, Unknown; identical to SEQ ID NO: 8252
  Obtained from environmental sample
  DOMAIN (1)...(113): Hydrogenase expression/synthesis hypA family
  misc_feature (1)..(113): Xaa is any amino acid

SEQ ID NO: 10059 - DNA, 579 bp, Unknown
  Obtained from environmental sample
  misc_feature (1)..(579): n is a, c, g, or t
ttgattttagcagcaggtacttcaagtagactaggaaaacctaacnagcttttaaaactaaatataaatncattggtacaattaacagtagaaaaagcactgaaactaaatcctaatgtaacagttgttttgggagacaaaagtgatttaatactaaaagagataattaattatccaatatcaactattatcaatcctgattatacaaaaggtattggtaatagtcttgcttttggaattttgcatattcaaaaaaaagagaaaaaagttttgattatgctttgtgatcaacctttaattccaataaaacattatcaaacacttataaaaaaatcaaacaataatccaaatctaatcatagcctcaaaatattattcaaaattatctgttcccgtgctatttcctaaaaaatattttaaagaattagtactacttaatggtgataaaggtgctaaaaagttatttgaagagtatccaacagattttatactcttagaagatagcttagcacaagatattgatatagaagaagattacaaaaaaattttaaggagaaaaaatgaaagcagtaattattaa

SEQ ID NO: 10060 - protein, 192 aa, Unknown
  Obtained from environmental sample
  misc_feature (1)..(192): Xaa is any amino acid
MILAAGTSSRLGKPNXLLKLNINXLVQLTVEKALKLNPNVTVVLGDKSDLILKEIINYPISTIINPDYTKGIGNSLAFGILHIQKKEKKVLIMLCDQPLIPIKHYQTLIKKSNNNPNLIIASKYYSKLSVPVLFPKKYFKELVLLNGDKGAKKLFEEYPTDFILLEDSLAQDIDIEEDYKKILRRKNESSNY

SEQ ID NO: 10061 - DNA, 648 bp, Unknown
  Obtained from environmental sample
  misc_feature (1)..(648): n is a, c, g, or t
atgccaaaggttatgcgtgcccccgaggatatcgaagtggtcaagaaaagaatcctggacacagccgccgatatcatctgtgagcaggggtttgacagtctcagtatgagaaaactggcctcaaagcttgggatgacggctgctaatatttataactactactcaaaccaggatgagctctacctgagcattcaaatcagaggtttttccaggttttacgaacagtttttcaaagcctatgcccgccatgaaaatcccattgaaaagctcaaggagctaataaacacatatctcgactttggaataaccaatcccggttattacgaaatcatgatggacagcaatacacccaggtacaccgaatatgtcggtacaaaaatggaaccgttggcttataaagataaactattatctttgaagcttgtggaaattgccacaactgtgtttgaagagattgccgagttagacaaccattttttgaaaaaagatgccccctaccgagccctgcaactctggagcagtatccatgggatcgtgaccctgcgcaacaggaaaatatggcgggaggtggttgatgatcctgacctaatcattaaaaggatggcggatgacctcctgctacaattttccggcaagacttctgtttga

SEQ ID NO: 10062 - protein, 215 aa, Unknown
  Obtained from environmental sample
  DOMAIN (18)...(64): Bacterial regulatory proteins, tetR family
  misc_feature (1)..(215): Xaa is any amino acid
MPKVMRAPEDIEVVKKRILDTAADIICEQGFDSLSMRKLASKLGMTAANIYNYYSNQDELYLSIQIRGFSRFYEQFFKAYARHENPIEKLKELINTYLDFGITNPGYYEIMMDSNTPRYTEYVGTKMEPLAYKDKLLSLKLVEIATTVFEEIAELDNHFLKKDAPYRALQLWSSIHGIVTLRNRKIWREVVDDPDLIIKRMADDLLLQFSGKTSV

SEQ ID NO: 10063 - DNA, 414 bp, Unknown
  Obtained from environmental sample
  misc_feature (1)..(414): n is a, c, g, or t
gtgaatatcgaatataaactaaacccaaatatttcatcatctgaatttattgagattttaaaaaactcaacattaggtaaaagaagacctattgatgatttagaaacaatcaagggcatgattgaaaatgcagatataatagtgacggctacaatagatgataaaataattggtgtggcaagagcagtgactgattttaattattgctgttatctctcagacttagcagtagatgaacaataccaaaaaaatggtattggtaaaaagcttatctcaaaagttcaagaacaattaaatgataaatgtaaaatcatattgctatcagcacctgatgcaacagagtattatccaaaaattggatttactcaacataattcagcttggacacttggaagacaagataaattaaactaa

SEQ ID NO: 10064 - protein, 137 aa, Unknown
  Obtained from environmental sample
  DOMAIN (48)...(122): Acetyltransferase (GNAT) family
  misc_feature (1)..(137): Xaa is any amino acid
MNIEYKLNPNISSSEFIEILKNSTLGKRRPIDDLETIKGMIENADIIVTATIDDKIIGVARAVTDFNYCCYLSDLAVDEQYQKNGIGKKLISKVQEQLNDKCKIILLSAPDATEYYPKIGFTQHNSAWTLGRQDKLN

SEQ ID NO: 10065 - DNA, 513 bp, Unknown
  Obtained from environmental sample
  misc_feature (1)..(513): n is a, c, g, or t
gtgcgcgcacttgattacttacttaaacccgttaagttagaccgtttagctgaagcgattgatagagttattaatactgcaaagcttaatagtaaaaacgagctaattgaagtacagcagtcattggtgaaaaatgaccccgacgaaatcgccgtttctgctaattctgactataaatttgaagccgaaaacttagtgatccaagatgctaaaaacccgattcaaataattccgtttaaagatattttatggatcgacgccgctggcgattatatgtgtgttcatacactgatagaaacctatgtaatgcgagcgcgtttaaaagatcttgaaaaaaacaccttaccagaagacttcttacgcatacataaatcaaccattgttaatttaagccacatcaaacagctcaacccattacgtaactctgaatacatggcagtgttagataatgaaaaaaacctaaaggtgagtagaacgtacagtaaaaattttaaaagcttaataaaacaataa

SEQ ID NO: 10066 - protein, 170 aa, Unknown
  Obtained from environmental sample
  DOMAIN (72)...(169): LytTr DNA-binding domain
  misc_feature (1)..(170): Xaa is any amino acid
MRALDYLLKPVKLDRLAEAIDRVINTAKLNSKNELIEVQQSLVKNDPDEIAVSANSDYKFEAENLVIQDAKNPIQIIPFKDILWIDAAGDYMCVHTLIETYVMRARLKDLEKNTLPEDFLRIHKSTIVNLSHIKQLNPLRNSEYMAVLDNEKNLKVSRTYSKNFKSLIKQ

SEQ ID NO: 10067 - DNA, 441 bp, Unknown
  Obtained from environmental sample
  misc_feature (1)..(441): n is a, c, g, or t
gtggatagcagtttagtatatttgactcaaactgataccactgtgggttttttatcctcggatgataaaaaactctcaatgataaaaaaaagagatataaacaaaaaaattcttcaagtagttgatagttttaaaactttacaaaaaaatataagagttcctaaaaaatttagaaaaatagttagaaactctaaaaaaaccacttttatttatcctaaaaaagaagcttttagggtagtaaatcaagaacaacaacatcactcttttttaaaaaagtttcatactttgtactcaacatctgcaaatattacacaaaacaattttgatgaaaagtttgcaacacaaactgctgatattattgtttataacaaagagtttaaagaatcaactcccctctgtatatntatactttctaagtctaaaaagaaacaaatcagatga

SEQ ID NO: 10068 - protein, 146 aa, Unknown
  Obtained from environmental sample
  misc_feature (1)..(146): Xaa is any amino acid
MDSSLVYLTQTDTTVGFLSSDDKKLSMIKKRDINKKILQVVDSFKTLQKNIRVPKKFRKIVRNSKKTTFIYPKKEAFRVVNQEQQHHSFLKKFHTLYSTSANITQNNFDEKFATQTADIIVYNKEFKESTPLCIXILSKSKKKQIR

SEQ ID NO: 10069 - DNA, 570 bp, Unknown
  Obtained from environmental sample
  misc_feature (1)..(570): n is a, c, g, or t
ttggtgggctctaagctttgtataaaagctgttcacaaagcaaaaataggcgattcaattgccattaatggagcttgtcttactgttgtggatttaaatagtgatggtttttgtgttgaactctctccagaatcacaaaaacttttggctattgagaactataaaggaagtgtacatatagaacctgccatgatgatgggtgatagatttgaaggtcatgttgtacaaggtcatgtcgatactattggaacaataaaatccataaaaaatagcggcaacagttttgatgtactcatttcacttgaaagtaagtatatgcgttatgttatagctaaaggctcaattactattgatggtatcagcttgactgtaaatgatgtacatagtgactactttagattaacgatcattccacacactatgaaagagacgctttttgctgagtataaagtagggtcaaaagtaaatgtggaaactgatatgtttgcaagatatgtagatcatctactaaaatttaaagacaactccacttcatgggatacggttgatcatataagttcactctactaa

SEQ ID NO: 10070 - protein, 189 aa, Unknown
  Obtained from environmental sample
  DOMAIN (76)...(160): Lumazine binding domain
  misc_feature (1)..(189): Xaa is any amino acid
MVGSKLCIKAVHKAKIGDSIAINGACLTVVDLNSDGFCVELSPESQKLLAIENYKGSVHIEPAMMMGDRFEGHVVQGHVDTIGTIKSIKNSGNSFDVLISLESKYMRYVIAKGSITIDGISLTVNDVHSDYFRLTIIPHTMKETLFAEYKVGSKVNVETDMFARYVDHLLKFKDNSTSWDTVDHISSLY

SEQ ID NO: 10071 - DNA, 771 bp, Unknown
  Obtained from environmental sample
  misc_feature (1)..(771): n is a, c, g, or t
atggccttggaagaaaaactagatctcaataagattcatatcatttcccccaagtcctacgaaaactttcccttccttatctcgacaaaactttatccggaatggccccttgcaaaactaaaacatacatcagatgaactatcaaaacaggtcgctattgctctgatgcagatgtcatcttcttgtgaagctgctgtaaaagcgaacatcgacggatggaacacgcctctgagttaccagcccgtgcatgcctgttttaagatcctggagatccctccctattatcagccgatagaattctggaaagtcatagacaaatataagttttggattctattctatcttttcggagccattgctgggatcagtatgcttgtgtatcaagtccgtctgacatcttttttgaaaaaaacccaaaatgaattggtccagacggaaaagatggcagctttagggcggctcgtcgcaggaatagcccatgaggtcaacacccctataggcataggtgtgactgccgcttctcacctcaaaaaagagatcaaaaacttcaatgagcactacatgaacgaatccctcagcaaacaatctttcgaagacttcatagacacctctacgcaaagcagcaatatccttcttaacaatttggaacgtgctgctaacatcatacaaaacttcaaacaagtctccgttgatcaaagcagtgacacgatacgacacttttttttaaaagagtatcttgacagcattgtcataaacttaaaccctcattaa

SEQ ID NO: 10072 - protein, 256 aa, Unknown
  Obtained from environmental sample
  misc_feature (1)..(256): Xaa is any amino acid
MALEEKLDLNKIHIISPKSYENFPFLISTKLYPEWPLAKLKHTSDELSKQVAIALMQMSSSCEAAVKANIDGWNTPLSYQPVHACFKILEIPPYYQPIEFWKVIDKYKFWILFYLFGAIAGISMLVYQVRLTSFLKKTQNELVQTEKMAALGRLVAGIAHEVNTPIGIGVTAASHLKKEIKNFNEHYMNESLSKQSFEDFIDTSTQSSNILLNNLERAANIIQNFKQVSVDQSSDTIRHFFLKEYLDSIVINLNPH

SEQ ID NO: 10073 - DNA, 777 bp, Unknown
  Obtained from environmental sample
  misc_feature (1)..(777): n is a, c, g, or t
ttgctgacttctcaaatttgggtatccaaatttttaaaatacactttaataatattttttatgatcatcatcttcaatataattattaatccatacaacacatttctttttatctaccaaggagaactcaaccattataaaaaacgtgtcttgtctgaccggatgactaaattctatgaaatcagacacatcaatccaaaaactattattatgggaacttcacgagtcggtattttcccttctaaccaactaaagccctattccaataaaccgatttacaacttggctctagccggttcatctatagaagaacaaagtcattatcttgaatactcaattgaaaaccttaatccaaacaccataatctggtccttagatttttttgcattcaaccctagcaaaccacaaaatatcagttttaatctagagcgtcttaaaacaaatatctattggcccgatatcactggctctttgctctcttttcaagcaacaagtaaaagtataaatactatcaaagacagtcttcgtaattctattaataagatttccaaaacttatttatatgaaacgatgcaatacatgaacatgcaaggccaaaaatttaaaccctcacggattcaaaagaatataaagcagactattgagatgtataaaaaatcaaccagacttcctaaaattcgaaagattttaaaaacagggactccatacgtactaaacctcaataatcttcccaaccttgatccccgtggcaaagccaaaaggaataaaacttattgg

SEQ ID NO: 10074 - protein, 259 aa, Unknown
  Obtained from environmental sample
  misc_feature (1)..(259): Xaa is any amino acid
MLTSQIWVSKFLKYTLIIFFMIIIFNIIINPYNTFLFIYQGELNHYKKRVLSDRMTKFYEIRHINPKTIIMGTSRVGIFPSNQLKPYSNKPIYNLALAGSSIEEQSHYLEYSIENLNPNTIIWSLDFFAFNPSKPQNISFNLERLKTNIYWPDITGSLLSFQATSKSINTIKDSLRNSINKISKTYLYETMQYMNMQGQKFKPSRIQKNIKQTIEMYKKSTRLPKIRKILKTGTPYVLNLNNLPNLDPRGKAKRNKTYW

SEQ ID NO: 10075 - DNA, 408 bp, Unknown
  Obtained from environmental sample
  misc_feature (1)..(408): n is a, c, g, or t
atgggtaaaaaattattagatattatgaaagataaaattagatttaaacactatagcataaaaacagagcaaagttatatcggatgggcaaaaagatatatactttatcataataaaaggcaccctaaagatatgggaaaaattgagatcgaacaatttctcacccaccttgcttcaaaattaaatgtatctccaaccactcaaaatcaagcgttcaatgcaatattatttttatatgagcaagttttaaatatatcattaaaagatcagaatatacaagctttaagagcacaagaaaggaagcatattcctatagtgcttacaatggatgaagttaaaaatataatcataaatatgaaaggtatctatcagcttatgataaagcntaatgtacggatgtggtcttag

SEQ ID NO: 10076 - protein, 135 aa, Unknown
  Obtained from environmental sample
  misc_feature (1)..(135): Xaa is any amino acid
MGKKLLDIMKDKIRFKHYSIKTEQSYIGWAKRYILYHNKRHPKDMGKIEIEQFLTHLASKLNVSPTTQNQAFNAILFLYEQVLNISLKDQNIQALRAQERKHIPIVLTMDEVKNIIINMKGIYQLMIKXNVRMWS

SEQ ID NO: 10077 - DNA, 873 bp, Unknown
  Obtained from environmental sample
  misc_feature (1)..(873): n is a, c, g, or t
ttgaaaaatttaaaggggcataaaactgcaatagagtttttgtctaaaaatttatctttgaaaagaattgctaacggatatttatttgtgggtcctgatggtgttggaaaggccttaacagcgaaagcttttgttttggagttattgtgctctaaaggagccttaagtagctctgagggggggctttttgatgggtttgaggcttctagtgttgatgatagtaatgttgcttgtggggtatgttcaagttgtaaaaaaatagaacagggaaatcatcctgacctactttggataaagccggagaagaataaaaaggttaaaatagaacagataaggcaggcaaaagtgcagcttacgtataagccatatgagtctgcatacaatatatgtgttattgaagatgctcatttgatgacacaagaagcatcaaatgcattactcaagatactggaagaaccgcctggacattcgttaataattttggttacgagtaaaagagagtggttattacctacggtcatatctaggtgtcttgatgttaaatttcatcctctttctattgatattacgaagcaaataattctagagaatgtcgatgagattaatgaagaagatgcgctaatgttagcgtctatttctgctggttcaccaggacgagctttgaaatatgagttggaagttgtgttggaaaggcgggctcgtgtttttgaggtacttaaaaagtttgttatctcgcgaaacccatattgtttttcttgggatagtgacaaaaaggatgaaatacttgaggatatcgagatgcttattatgttttttagggatcttgttatagcgagggaagtaggagaagggttgttttataaaaaatgctga

SEQ ID NO: 10078 - protein, 290 aa, Unknown
  Obtained from environmental sample
  DOMAIN (26)...(239): ATPase family associated with various cellular activities (AAA)
  misc_feature (1)..(290): Xaa is any amino acid
MKNLKGHKTAIEFLSKNLSLKRIANGYLFVGPDGVGKALTAKAFVLELLCSKGALSSSEGGLFDGFEASSVDDSNVACGVCSSCKKIEQGNHPDLLWIKPEKNKKVKIEQIRQAKVQLTYKPYESAYNICVIEDAHLMTQEASNALLKILEEPPGHSLIILVTSKREWLLPTVISRCLDVKFHPLSIDITKQIILENVDEINEEDALMLASISAGSPGRALKYELEVVLERRARVFEVLKKFVISRNPYCFSWDSDKKDEILEDIEMLIMFFRDLVIAREVGEGLFYKKC

SEQ ID NO: 10079 - DNA, 546 bp, Unknown
  Obtained from environmental sample
  misc_feature (1)..(546): n is a, c, g, or t
gtgtctgaatatgatgtagatataattagagattcaggcgagaaaattccaacttttgtgctcgaaatagacaaacggttgtatgagaattatatgcgattaataaccaataaaggaccaattgcttgtgctgaatttttacccgaaatagatacattttatataaaacattggcaaaataggctaattgttgagcgattgaagagaaaatctgatgatgtattagaaaaattgaaacaaaataataattcttgggaagaaacattctatcaattattagccaagaactttggattcaaacaaaatgccctcccgtttgaaatgcttgcaaagtcacttaaaatgaagagtattgcaaaacaaaaagatgatattttgcaaattgaaaagcatgtatttgggcaggctggttttttaggcatagactgtgatgacgaatattttttatataaaaagagaatacattttttgaaagaaatatcgctgactctatgcaaaacctttgtggagtttatgcaatgcctccaagtaatttcccaacattaa

SEQ ID NO: 10080 - protein, 181 aa, Unknown
  Obtained from environmental sample
  misc_feature (1)..(181): Xaa is any amino acid
MSEYDVDIIRDSGEKIPTFVLEIDKRLYENYMRLITNKGPIACAEFLPEIDTFYIKHWQNRLIVERLKRKSDDVLEKLKQNNNSWEETFYQLLAKNFGFKQNALPFEMLAKSLKMKSIAKQKDDILQIEKHVFGQAGFLGIDCDDEYFLYKKRIHFLKEISLTLCKTFVEFMQCLQVISQH

SEQ ID NO: 10081 - DNA, 783 bp, Unknown
  Obtained from environmental sample
  misc_feature (1)..(783): n is a, c, g, or t
atggctgagtactttttctacgctcttgttccttctgatctatgggttcctgcaacaaaaaaagcaattccctcgcatgcaaatcaatttactattggatacaatacaagttttaacaacaataacttctctttttcttgtgacgtttaccacaaaacattaaaaaatttaatcgaattaaataaattcaacgatattactaataataattctgataataattgggaaacacaaattgaaacaaatggaacaggggaaatttatggtttagaaattttattacaaaaaaacaaaggacaattaaagggttggattgcatatacgctaatgaaaaatagtcgccaattcaagaatacaaattcagggctcagttttccttattattacgaacgccgccataatttatccatagtaggaaattatcaagtatctcccaaaataactatttctgctacttttatctatgcttccggatacccttacaccgtcgaaatgcaaaaacaaaatataatanatttattttatacatcaactgctgtcggttatactgaaaacttaaacttttataaaaatattgatttttcagaacaacacaatctttttaatagtattaataaatataaaaatgcagcttatcacagggctgatatttctttgaaatctaataaaagagtaaagttaggaaaagaaacatggtcctttagtgtttacaatgcatataatcctaaaaacgcaaattttatctttctaaaaaaagatgaaaatccaaaaattcccccttaa

SEQ ID NO: 10082 - protein, 260 aa, Unknown
  Obtained from environmental sample
  misc_feature (1)..(260): Xaa is any amino acid
MAEYFFYALVPSDLWVPATKKAIPSHANQFTIGYNTSFNNNNFSFSCDVYHKTLKNLIELNKFNDITNNNSDNNWETQIETNGTGEIYGLEILLQKNKGQLKGWIAYTLMKNSRQFKNTNSGLSFPYYYERRHNLSIVGNYQVSPKITISATFIYASGYPYTVEMQKQNIIXLFYTSTAVGYTENLNFYKNIDFSEQHNLFNSINKYKNAAYHRADISLKSNKRVKLGKETWSFSVYNAYNPKNANFIFLKKDENPKIPP

SEQ ID NO: 10083 - DNA, 489 bp, Unknown
  Obtained from environmental sample
  misc_feature (1)..(489): n is a, c, g, or t
atggttaccaacaacatttctgtaaacaaatctgtatggaattatctcgctaacgatgtaattaattattcttatttataccaagaattagccaaaattaatcgtctagaattatttcctgaagatgaaaatttaaaacaaaatatagcaaaatctatgttatactcaagtagttttaactttagcaaagatactttagagtttataactgctaaagaagtaagtattcaaaacaaagttggtcacgtttatttttttaaaagtaaaaaaccaaaagacgacaattggagtttagattatattgggatacaccaaaacaaagacaacttgattcacgaagaagatttagtaaaagaaaaaaacaacaaaattgccaaagacaaagacatagatgaatttataaaagaaaaagtaaaaaccattgaaataattggtcacaaaagagcaagagaagaagacagttccaactcttattttgatttcttttaa

SEQ ID NO: 10084 - protein, 162 aa, Unknown
  Obtained from environmental sample
  misc_feature (1)..(162): Xaa is any amino acid
MVTNNISVNKSVWNYLANDVINYSYLYQELAKINRLELFPEDENLKQNIAKSMLYSSSFNFSKDTLEFITAKEVSIQNKVGHVYFFKSKKPKDDNWSLDYIGIHQNKDNLIHEEDLVKEKNNKIAKDKDIDEFIKEKVKTIEIIGHKRAREEDSSNSYFDFF

SEQ ID NO: 10085 - DNA, 741 bp, Unknown
  Obtained from environmental sample
  misc_feature (1)..(741): n is a, c, g, or t
atgggctacagcgttacaagcccagtgccaaaaacaatcttaggaccaaacgactgctacaaaagcacgcactggtcgaactacctcacagtcgaccccgataagaacaaacaagctgctgataaatggataacgtacttccagaatattaaaaaaatgcccgacagatacctgcccctaaataccgctcaactgtattcgcagtacctctataaaaagttctgcaaatttaccatcacaagcaacaccgtgacaattgataataccaaaatgcctgattggacttataaatttggtcaacttggaaaccttttattcaaagttccacttgcagaaaacacccatgtctcatctgccaaactaaataataacaacatcgcatgctattatgaagaaatgggctttggtcatatcctcctgccaaggcttgataaaaaaatctacgaatttaaattttccatctcaccgcaactgatgtcgaatcacctcatcaacgctggtacatataatattaaaaatttctcagtagatgctaaaaaggcaatagcctcagttgaaatgtatggaaccggcaatcttttagttaaactcgataaattcaaacctgcaaaagttatatcattgaacaaatcgatctcaattaaggcttcaaattatgatcgatacaaaaaaatactgaatgtaaaactaaaagcccataatgttcaaggctcgcaatccgatattgttattactgcttga

SEQ ID NO: 10086 - protein, 246 aa, Unknown
  Obtained from environmental sample
  misc_feature (1)..(246): Xaa is any amino acid
MGYSVTSPVPKTILGPNDCYKSTHWSNYLTVDPDKNKQAADKWITYFQNIKKMPDRYLPLNTAQLYSQYLYKKFCKFTITSNTVTIDNTKMPDWTYKFGQLGNLLFKVPLAENTHVSSAKLNNNNIACYYEEMGFGHILLPRLDKKIYEFKFSISPQLMSNHLINAGTYNIKNFSVDAKKAIASVEMYGTGNLLVKLDKFKPAKVISLNKSISIKASNYDRYKKILNVKLKAHNVQGSQSDIVITA

SEQ ID NO: 10087 - DNA, 780 bp, Unknown
  Obtained from environmental sample
  misc_feature (1)..(780): n is a, c, g, or t
ttgttcgttgaactaacacttattgcttatataatagataaaatctttggagaattcaaatttctcaaacatcctattgtttttatgggtgattttattttattttttgaaaaacatttttataaagatagtattttaagaggtgctatgcttactatttcacttctacttatagtgtttatcataacttttacttttgattattttattgacaatgtttttattctagcttttttagcctcttttgggatagcttcaaagatgttgtatgagagtgtcaaagacattattcaaaatcctcaaaatataaaatacctcgtaagccgagatactcaaaacctatctcaaagtgatataaataaagcagccatagaaacttatagtgaaaatctaagcgatgctgttatagcacctttgttttatctcttattttttgggattgttggtttatttatctacaaagctattaatacccttgattctatggtgggatatagaaatccaagatatgaaaagtttggcaaaataagtgcgatactagatgatatagtcaattatatcccatcaagaattacagctattataatatctaccctattacttagtaaaaaagcactgttacattttagtaaatatgggaaacttcacgaaagtccaaatgcaggataccctatatctgctatggcactaagcctaggnttaaaacttggtggggatacttcttattttggagttataaaacataagccctacctttggagatgggtaaaaaaattatag

SEQ ID NO: 10088 - protein, 259 aa, Unknown
  Obtained from environmental sample
  DOMAIN (3)...(256): CobD/Cbib protein
  misc_feature (1)..(259): Xaa is any amino acid
MFVELTLIAYIIDKIFGEFKFLKHPIVFMGDFILFFEKHFYKDSILRGAMLTISLLLIVFIITFTFDYFIDNVFILAFLASFGIASKMLYESVKDIIQNPQNIKYLVSRDTQNLSQSDINKAAIETYSENLSDAVIAPLFYLLFFGIVGLFIYKAINTLDSMVGYRNPRYEKFGKISAILDDIVNYIPSRITAIIISTLLLSKKALLHFSKYGKLHESPNAGYPISAMALSLGLKLGGDTSYFGVIKHKPYLWRWVKKL

SEQ ID NO: 10089 - DNA, 552 bp, Unknown
  Obtained from environmental sample
  misc_feature (1)..(552): n is a, c, g, or t
atgactgaaaaacaatatcaagataaaataagctctttagaaaggcaacttaaggccttgcagaactcttcacaaaaagaatgcgaacaacataataaaatcttaacccaacaatcaaaaatggcagcaatgggtgagatgataggaaatattgctcatcagtggagacaacctttgatggaactctcttctatacttataaatactgaagccaaaattagaatacaagaaaatatttcaaatgatgagattttagaagtgattaataggtcaaatcatatcttaaaatatatgtctaatactattgatgactttcgaaatttctttgcaaaagataaagaaaaaacacaatttaaaatatcagatcagataaaaagaacagtaaatattcttagtagtaccctagataataaaaatatcaaagtcaatatcatactcaaacataatccaaccatatatggatataaaaatgagtattcacaagttcttatcaatatcatatctaatgcaaaagatgtattagttcaaagagggataaaaatggacttatag

SEQ ID NO: 10090 - protein, 183 aa, Unknown
  Obtained from environmental sample
  misc_feature (1)..(183): Xaa is any amino acid
MTEKQYQDKISSLERQLKALQNSSQKECEQHNKILTQQSKMAAMGEMIGNIAHQWRQPLMELSSILINTEAKIRIQENISNDEILEVINRSNHILKYMSNTIDDFRNFFAKDKEKTQFKISDQIKRTVNILSSTLDNKNIKVNIILKHNPTIYGYKNEYSQVLINIISNAKDVLVQRGIKMDL

SEQ ID NO: 10091 - DNA, 462 bp, Unknown
  Obtained from environmental sample
  misc_feature (1)..(462): n is a, c, g, or t
ttgagagtttttgataatgtggttctgtatcaaaaaggtgagactgctcctatactttgtaaaaagattagtgatattgactcaaatgccaagatattagcagttgaaaatggtgaaacatttttaaatatagcttccacaatgtcgaagtttggatttgatgagtatatctatttaggtggattctcaaacctcttaacaaaagagtttctaaagagtagagatgtagtcttctttttagattatgacatcgaagctataagaatctatgatagttttgagtgtaagagtaaatcattttttagacatcctaatattgagtattattttaaaaactatggaaatcagaagctctacttaaaacagagagctacttttgttaaagagcatgatgaactacagtggcttattgatttgattgacaaatatagtgtagtggttgagcaggagatagtagagtga

SEQ ID NO: 10092 - protein, 153 aa, Unknown
  Obtained from environmental sample
  misc_feature (1)..(153): Xaa is any amino acid
MRVFDNVVLYQKGETAPILCKKISDIDSNAKILAVENGETFLNIASTMSKFGFDEYIYLGGFSNLLTKEFLKSRDVVFFLDYDIEAIRIYDSFECKSKSFFRHPNIEYYFKNYGNQKLYLKQRATFVKEHDELQWLIDLIDKYSVVVEQEIVE

SEQ ID NO: 10093 - DNA, 465 bp, Unknown
  Obtained from environmental sample
  misc_feature (1)..(465): n is a, c, g, or t
atgaatagagtgttattgaaacaaattttaatgtttaatgatgataaccgtccaactcatggacagatagcgaagctatataaagtagcaaatgagtatcaaaaagagtctcataacctttttttaaaatcaaaatatagacaaagagcgcagattacggattatgctctattttttgaatttgttagtgaagtagttttaaacggtaaagaagtcactacttttgaagagattgaaaatatattaaactctacaactagaaaagagagtattaaaaactctggagatagtaaatcaaactatttgagagtttttgataatgtgggtctgtatcaaaaaggggagactgctcctatactttgtaaaaagattagtgatattgactcaaatgccaagatattagcagttgaaaatggtgaaacattttttaaaatagcctccccaaagtcgaaatttggaatttga

SEQ ID NO: 10094 - protein, 154 aa, Unknown
  Obtained from environmental sample
  misc_feature (1)..(154): Xaa is any amino acid
MNRVLLKQILMFNDDNRPTHGQIAKLYKVANEYQKESHNLFLKSKYRQRAQITDYALFFEFVSEVVLNGKEVTTFEEIENILNSTTRKESIKNSGDSKSNYLRVFDNVGLYQKGETAPILCKKISDIDSNAKILAVENGETFFKIASPKSKFGI

SEQ ID NO: 10095 - DNA, 303 bp, Unknown
  Obtained from environmental sample
  misc_feature (1)..(303): n is a, c, g, or t
atggaactttttaacgaatcagtatctttaaaaacaaaaataccaaatggaaaggtatttagtgtatttaaagggcaaattgtttatgcaaaagaaaactctggacttttagctaaagttgttattgtaaagcatagtaatggattgcacactatatattcacacctagataaaatatctcctacacttaaagtagggaaatggataccaaaagggtatgttgtaggacgagtaagtgatactttagagtttcaagcaacaaaagatagtaaatatatagatccaatgagattaataaaatag

SEQ ID NO: 10096 - protein, 100 aa, Unknown
  Obtained from environmental sample
  DOMAIN (3)...(95): Peptidase family M23
  misc_feature (1)..(100): Xaa is any amino acid
MELFNESVSLKTKIPNGKVFSVFKGQIVYAKENSGLLAKVVIVKHSNGLHTIYSHLDKISPTLKVGKWIPKGYVVGRVSDTLEFQATKDSKYIDPMRLIK

SEQ ID NO: 10097 - DNA, 606 bp, Unknown
  Obtained from environmental sample
  misc_feature (1)..(606): n is a, c, g, or t
gtgaatattaatgggaaagagctgacaataaaagagctgagaaagtatcgtagcaagatatcaaggtcaaggtcgatgaaactatattactaccaatacactggagaattagatggcatgaaagtgaaaatatttatcactaaacgtggagtaaatggagcttggcataccatcctttcaaccgacacaagtttaactttcattaaagctatggaggtctataatactcgatggactatagaagtgttttttaaggaagccaagcagcttttaggattaggaaaatgtcaatcaaccaattttgacgtacaggtagcacagactacaattacgatgattcagtaccttatgctaagcttgaagcatcggatggaagcctacgaaacaattggagggatgtttaaagatgtaaaacaagattttattgaacataaacttaatgaaagaatattggcagttattaatgaaatattgaatgttttggaattaattatcggaaatattgattttaatgaagttatagagaaattgatggttaatagtgaagtactcggtctcttgaacaaaacgtgtgaacagaagaatttcagtatattgactgcttaa

SEQ ID NO: 10098 - protein, 201 aa, Unknown
  Obtained from environmental sample
  misc_feature (1)..(201): Xaa is any amino acid
MNINGKELTIKELRKYRSKISRSRSMKLYYYQYTGELDGMKVKIFITKRGVNGAWHTILSTDTSLTFIKAMEVYNTRWTIEVFFKEAKQLLGLGKCQSTNFDVQVAQTTITMIQYLMLSLKHRMEAYETIGGMFKDVKQDFIEHKLNERILAVINEILNVLELIIGNIDFNEVIEKLMVNSEVLGLLNKTCEQKNFSILTA

SEQ ID NO: 10099 - DNA, 729 bp, Unknown
  Obtained from environmental sample
  misc_feature (1)..(729): n is a, c, g, or t
ttgagattttcgaaaatttttctaatccggttttacccaagctgcaaaatacggatggggacccgctcgtccccgataaagctgtattatgccctcaactgtacaccggcaaaagcggtcgattgtttaaaagaactgacagatgacctggatgatgaagagttgttttttgatgccgagtttgatgataatggtgtgcttgaaaaaatccggtttccctggttaaaaaaagggaacccgaaacatccggaatggaataatacggtgatgggaaatattgatatcaatcaaaacagtctcaccatcgaggtaaactctggaattcgttcaaaactcatacaaatagaaatcaaaaaccgattacaggaccatgcggtctataaaaattccgtaatgacttccattaaaaaaaccatcgaagagaagacaggcaacgggccatccccgaaagccgaagcgctggccaggacgcacgaagaattgatgcagaatcccgaaatcaggcaacaagtcaatcagatggcgaaaaaacactgggatgagtggctggatatcgcagtacccatgcttggtaacatgtcaccgcgggaagcggcaaaagatcccattggcagggaaaaactcgacgggctttttctccattatgaatccatgaaccggcagcagccgaaaaacgatttttcgccggatattccgaagttaaaacaaatcctgggaataaagatgtaa

SEQ ID NO: 10100 - protein, 242 aa, Unknown
  Obtained from environmental sample
  misc_feature (1)..(242): Xaa is any amino acid
MRFSKIFLIRFYPSCKIRMGTRSSPIKLYYALNCTPAKAVDCLKELTDDLDDEELFFDAEFDDNGVLEKIRFPWLKKGNPKHPEWNNTVMGNIDINQNSLTIEVNSGIRSKLIQIEIKNRLQDHAVYKNSVMTSIKKTIEEKTGNGPSPKAEALARTHEELMQNPEIRQQVNQMAKKHWDEWLDIAVPMLGNMSPREAAKDPIGREKLDGLFLHYESMNRQQPKNDFSPDIPKLKQILGIKM

SEQ ID NO: 10101 - DNA, 633 bp, Unknown
  Obtained from environmental sample
  misc_feature (1)..(633): n is a, c, g, or t
atgaaaatactacttttagaagatgatgctattttagcacaaactatgattcaaattttggaacaagaaaattatgatgtaacattggtagaagatggtgaagaggtacttgaagctacatatgaaaatagatttgatctttatttatttgatattaatgttcccttactcaatgggatgaatactttaaaacttttgcgtagtgctgatgataatacaccaactttttttattacagcattaagagataccgcttcaattttagaaggatttgattgtggttgtaatgattatattaaaaaaccatttgatttagatgagcttttggctcgtatcaaagcaattctaaaaagacaaaatccaataattaaatataacgatataacatttgatttatttgaaaacaggataataaaagcagataaagaggtctcattggggattgtagaaaaagagattttttcattacttataaaaaatatcaataccacagtgaataaatcaacattttttgaatatatgaataaaccaagtgatactgctttacgagtattaattagtaaattaaaaaaggttttagagcttaatataacaaatacaaaaggtataggatataagcttgaaacattatga

SEQ ID NO: 10102 - protein, 210 aa, Unknown
  Obtained from environmental sample
  DOMAIN (141)...(207): Transcriptional regulatory protein, C terminal
  misc_feature (1)..(210): Xaa is any amino acid
MKILLLEDDAILAQTMIQILEQENYDVTLVEDGEEVLEATYENRFDLYLFDINVPLLNGMNTLKLLRSADDNTPTFFITALRDTASILEGFDCGCNDYIKKPFDLDELLARIKAILKRQNPIIKYNDITFDLFENRIIKADKEVSLGIVEKEIFSLLIKNINTTVNKSTFFEYMNKPSDTALRVLISKLKKVLELNITNTKGIGYKLETL

SEQ ID NO: 10103 - DNA, 636 bp, Unknown
  Obtained from environmental sample
  misc_feature (1)..(636): n is a, c, g, or t
ttggcgttttattctttaagaccaatgagacaagcactgcatcttttagaagattttcttaaagatttaattcatgacttaaataccccagcaacctcaattttattaaattcaaaattgttaagaaagcgtggagattttgaagagatagagagaatagaacttagtgctaaagggattgcatctttatataaaaatttagaatttatgaatcctaatgatatagtaaatgatgaggcagttgcattggatgagttaataaatgaaaaaataaatattctacaaaaaatttatccaaatataaaatttacaaagagtatgcctaatactattataaaaagtaatagaagtggagtggatcgtattatagacaatttgttaacaaattcttgtaaatataataaaaaaaatggacaagtacatatagagataaaaaatcaaaaactgataatagaagatacaggtgtagggataaaaaatacaacaaaagtttttaaacgatattataaagaaagtacaaatggtttgggtattggtatgaatattgttaaacagctaagtgatattttaaatatatctattgatataaaaagtgttgttggtaaagggacttgcgtagagcttacttttaaataa

SEQ ID NO: 10104 - protein, 211 aa, Unknown
  Obtained from environmental sample
  DOMAIN (15)...(75): His Kinase A (phosphoacceptor) domain
  misc_feature (1)..(211): Xaa is any amino acid
MAFYSLRPMRQALHLLEDFLKDLIHDLNTPATSILLNSKLLRKRGDFEEIERIELSAKGIASLYKNLEFMNPNDIVNDEAVALDELINEKINILQKIYPNIKFTKSMPNTIIKSNRSGVDRIIDNLLTNSCKYNKKNGQVHIEIKNQKLIIEDTGVGIKNTTKVFKRYYKESTNGLGIGMNIVKQLSDILNISIDIKSVVGKGTCVELTFK

SEQ ID NO: 10105 - DNA, 816 bp, Unknown
  Obtained from environmental sample
  misc_feature (1)..(816): n is a, c, g, or t
atggttcaaaatgctacaacaaaagcaaatgaaggtaaaagcattgctacaaaaatgatcactggctatgagtcattaaatactataatcacagatactaaagttattgtagataatgtaacaactgcatcaaaagagcaagagttagggatagttcaaatcaatgatgctgtaagtactcttgataaagctacacaacaaaatgcttcaaatgctactgatattgcagaattagcaaaaggggtaaaaagattatctgatgaccttacagatgtagcagcaaatgcaaaatttgatgaaaatacaattggtcaaatttgtgatgttggattagtatatgaattaaatgatcttttctttgaccatgtaatttttaaaggagaatacttcaagtcacttgatgagaagaaaacatggagtgttcaaaaacctactgaatgtaatattggtaaatggatagcaatagaagagaataatcaaacaccatttacaaaaacatctgcgtggtcatctttaaaagagatacatacaaaataccaccaaagtgttcaaaattatttagatcataatgcaaaaggtgagacaaaccaacaattaacaaaattatcaaatgaagtagagaaagacatttncaatatatttgatgttcttaatgaaactaaatttgncaattgtaaactagatgctccctgcactgaaaatatagacataaaaagtagagcttatatatcaaaacatatcaaaagatgtacaagtagtacactaaaccagcactattataaaagatacagttctgatgagagtggccacttttaa

SEQ ID NO: 10106 - protein, 271 aa, Unknown
  Obtained from environmental sample
  misc_feature (1)..(271): Xaa is any amino acid
MVQNATTKANEGKSIATKMITGYESLNTIITDTKVIVDNVTTASKEQELGIVQINDAVSTLDKATQQNASNATDIAELAKGVKRLSDDLTDVAANAKFDENTIGQICDVGLVYELNDLFFDHVIFKGEYFKSLDEKKTWSVQKPTECNIGKWIAIEENNQTPFTKTSAWSSLKEIHTKYHQSVQNYLDHNAKGETNQQLTKLSNEVEKDIXNIFDVLNETKFXNCKLDAPCTENIDIKSRAYISKHIKRCTSSTLNQHYYKRYSSDESGHF

SEQ ID NO: 10107 - DNA, 735 bp, Unknown
  Obtained from environmental sample
  misc_feature (1)..(735): n is a, c, g, or t
gtgaacttaaaaaagatactcaataattatggctccaaaaaagagccatttttttttatgattagttatgatttaaaaaactatgaagtgattccattaaaagatattccaaaagatattcaatataaaataaattcaaaagagctattttcaaaaaaaaatcaaacaataacaaaaacaccaataagttatgaaaactatttaacaaaatataactccatacaaaatgagataaaaaatggaaatacctatcttatcaatctaacaacaccaacaaaagtgaacggaaaattagatttaaaaaatatctatgataatgcaaatagcaaatataaattgttgtataaaaatcaatttatttgtttctcacctgaaagtttttgtacaattgatgaaaacaaaatctacacctatccaatgaaaggtacaatagatgccaatataaaaaatgcaaaagagttaattctaaaagatccaaaagaattagctgaacatacaatggttgttgatctattacgaaatgatctatcaatcgtttcaaaaaaagtaaaagttgaaaaatttcgatattgtgaaaaaataaaagcaggggagaaagaactttttcaaataagttcaaaaatatctggtgaactagaaaatagttggcaagatagagtaggagatattatcacctctttattgccagcaggaagcatcacagggactccaaagaaaaaaacatacaaatcatag

SEQ ID NO: 10108 - protein, 244 aa, Unknown
  Obtained from environmental sample
  DOMAIN (63)...(244): chorismate binding enzyme
  misc_feature (1)..(244): Xaa is any amino acid
MNLKKILNNYGSKKEPFFFMISYDLKNYEVIPLKDIPKDIQYKINSKELFSKKNQTITKTPISYENYLTKYNSIQNEIKNGNTYLINLTTPTKVNGKLDLKNIYDNANSKYKLLYKNQFICFSPESFCTIDENKIYTYPMKGTIDANIKNAKELILKDPKELAEHTMVVDLLRNDLSIVSKKVKVEKFRYCEKIKAGEKELFQISSKISGELENSWQDRVGDIITSLLPAGSITGTPKKKTYKS

SEQ ID NO: 10109 - DNA, 744 bp, Unknown
  Obtained from environmental sample
  misc_feature (1)..(744): n is a, c, g, or t
ttgaacttagaagaaatccgtaaagaacgtgaaaaatggatgacgtggaaaaatattgctcccctgcgtgaagcactggataaactcgaagatatcgaatgtgagtacgctttgggcgatgtggtaaaggttcacagcaaggtacctctgtcggaggagatacgatcatctatcgaagcaacagccaagaagatgatgccatggcgtaaaggtccttttgagctttttgatatctttatcgacacagagtggcagagttttttaaaatataatcttttagagccctattgtgatcttgaaggcagacgtgttgccgatgtcggctgcaataacggttactatatgtttcggatgctttcacaggaccctgcatccatcgtcggttttgatccctcggctctgtataagacacaattcgactttatcaaccattttataaaaagtgagatcacatacgaacttttgggtgttgaacaccttcctttttatgagcagaagtttgatacggtcttttgcctgggtgtcctgtatcaccgtcccgatcccgtaggcacattgaaggcattggccaaaggcatggaaaaaggtgcagaactattcttggatacttttatgatagatggagatgaagatatctgtctcacgccggaaaagacatactccaagatcccaaacatctattttgtacccactgtaaaagcactaaaaaacctggtgtacacgttgccggttttatcgatatag

SEQ ID NO: 10110 - protein, 247 aa, Unknown
  Obtained from environmental sample
  misc_feature (1)..(247): Xaa is any amino acid
MNLEEIRKEREKWMTWKNIAPLREALDKLEDIECEYALGDVVKVHSKVPLSEEIRSSIEATAKKMMPWRKGPFELFDIFIDTEWQSFLKYNLLEPYCDLEGRRVADVGCNNGYYMFRMLSQDPASIVGFDPSALYKTQFDFINHFIKSEITYELLGVEHLPFYEQKFDTVFCLGVLYHRPDPVGTLKALAKGMEKGAELFLDTFMIDGDEDICLTPEKTYSKIPNIYFVPTVKALKNLVYTLPVLSI

SEQ ID NO: 10111 - DNA, 432 bp, Unknown
  Obtained from environmental sample
  misc_feature (1)..(432): n is a, c, g, or t
atgaaatatatttttattatcttagtatttttaacaactactctttttgcacaaaagcctgagctggttttactgaacaactatagtgatgataaaaatattacttcatggtttatgagtgaaaaattagatggcgtaagagcttactggaatggaaaagagttgatctctcgttcaggtaaagttttttcagctccaacttttttcacaaaagattttccttcgtttgagcttgatggcgaactttggagtaaaagagaagattttgcaaatgttgtctcaatagtaaacaaaaaagagccacatagcggttggagagagttaacatataatatttttgaagttcccaatagtgatggaaatttaacacaaagattagataaaataaaaaattatatacaaaatcatcaatataaatatatcaaaatttag

SEQ ID NO: 10112 - protein, 143 aa, Unknown
  Obtained from environmental sample
  SIGNAL (1)...(17)
  misc_feature (1)..(143): Xaa is any amino acid
MKYIFIILVFLTTTLFAQKPELVLLNNYSDDKNITSWFMSEKLDGVRAYWNGKELISRSGKVFSAPTFFTKDFPSFELDGELWSKREDFANVVSIVNKKEPHSGWRELTYNIFEVPNSDGNLTQRLDKIKNYIQNHQYKYIKI

SEQ ID NO: 10113 - DNA, 636 bp, Unknown
  Obtained from environmental sample
  misc_feature (1)..(636): n is a, c, g, or t
atggctcaagcatctgattatgacctattggaactaagaattaaggaattagaaaaagaaaattcctatttaaagttgtttaaattcggtatggataacatgccaaatgcccgatttgcaattggcaacagggactattgttttgtagcggtcagcaaaggatattttgaggcattgaataagcgggaagatcaaattgttggaaaaccagccattgaaacactaggcgcgaaaatgtttcaagaaattgtcaaacccaattttgatcgggccttgaagggtgaagttgtcaatgattcatcctggtttgagttgccgggtttaaaaaaaagatttttgaatgtccaatactatcctgttcacagcgaagatgagatcaatttggttgcaattttgatccaggacattaccgaaaaaaagaaaatccaggaatcccttaaaagaagtgaaatccgataccgggatctgtttgagggggcacccatgatgtatgtggtgattgaaaatcaccaggggctccccattattaccgattgtaatcataagttcctggtcaccctggggtacgatcgtgaagaggtgatcggaaagtccatgtctgagttttacacccgggnattcacaaaaaaaaaatga

SEQ ID NO: 10114 - protein, 211 aa, Unknown
  Obtained from environmental sample
  misc_feature (1)..(211): Xaa is any amino acid
MAQASDYDLLELRIKELEKENSYLKLFKFGMDNMPNARFAIGNRDYCFVAVSKGYFEALNKREDQIVGKPAIETLGAKMFQEIVKPNFDRALKGEVVNDSSWFELPGLKKRFLNVQYYPVHSEDEINLVAILIQDITEKKKIQESLKRSEIRYRDLFEGAPMMYVVIENHQGLPIITDCNHKFLVTLGYDREEVIGKSMSEFYTRXFTKKK

SEQ ID NO: 10115 - DNA, 993 bp, Unknown
  Obtained from environmental sample
  misc_feature (1)..(993): n is a, c, g, or t
ttgtatcggctaagtgagtatgttatcactataggtattgatataacagataagagacattatgaagatgagctaattcttcagaaaaatgaagccgaaaaagcaaatagagcaaaaagtgactttttagcaaatatgagtcatgagattaggacacctttgaatggtgtactaggtcttacagatctagttttgaagacagaactcaatgagttgcaaagagagtatcttgagaagtcaaaaatatcatcaaaagcacttcttcatgtaatcaacgatatcttagactactctaaaatagaagcgggcaaattagatcttgaagatagagtttttaatttatcggaggttatgaaaaatattagtgaactttttggatatcaggcacagagcaaaaatattaaattaagtgtagataatagggatttaattataagcggtgatccacttcgtcttacacaagttttgacaaacttagttggaaatgccattaaatttacagattctggagaagttaagctaaaagttagtgaaatatttgatgatgaaaactacaaaaagcttcaattttctattaaagatagtgggatagggatagacgatgagattcaaaaaaacctatttcaagagtttacacaagctgatagctctataactagaaaatatggtggatcaggattaggtcttgctatatctaaacagcttgttgagatgatgagcggtgaaatacgtgtaatgagtgagttaggtataggtagtgagtttatttttagtgctgttttttctaatgtagatgctaagagtgaagaagttcaaaaaattgaagagatagagttagatgaaaaccaaaaaatatattttaaagatataaaagtactgcttgctgaagaaaataagataaatcaaatggtaccagtttgcttgctggaaaatattggactgaaagttgatttagcaaaaaatggccaaaaaggctgtagaataaggttttag

SEQ ID NO: 10116 - protein, 330 aa, Unknown
  Obtained from environmental sample
  DOMAIN (38)...(103): His Kinase A (phosphoacceptor) domain
  misc_feature (1)..(330): Xaa is any amino acid
MYRLSEYVITIGIDITDKRHYEDELILQKNEAEKANRAKSDFLANMSHEIRTPLNGVLGLTDLVLKTELNELQREYLEKSKISSKALLHVINDILDYSKIEAGKLDLEDRVFNLSEVMKNISELFGYQAQSKNIKLSVDNRDLIISGDPLRLTQVLTNLVGNAIKFTDSGEVKLKVSEIFDDENYKKLQFSIKDSGIGIDDEIQKNLFQEFTQADSSITRKYGGSGLGLAISKQLVEMMSGEIRVMSELGIGSEFIFSAVFSNVDAKSEEVQKIEEIELDENQKIYFKDIKVLLAEENKINQMVPVCLLENIGLKVDLAKNGQKGCRIRF

SEQ ID NO: 10117 - DNA, 684 bp, Unknown
  Obtained from environmental sample
  misc_feature (1)..(684): n is a, c, g, or t
atgagaattcttttattcggatgtggatggcttggaaaacaagttgtgaatcaactattagctgataagcattttgttttagcacttacaaaatcatctaaagtaaaaattccgaactccaaatttgagcatggtaattttgacgtggaaagtgacgattttaataagttagatttcgcttcttttgataaaataatactttgtttaaatcctcaatacttaaatcctccttttctagattccctgaaactacatccccatattcttgtaattagttcgatttcaatttatggaaaccaaggacttgtagatgaaaccaccacccctacaccattttcaaccaatgggaaaaggcttttccaactcgaaaatcaatatcctagtttcacttttttaagattgggcggattggtaggtccaggtcggaatccctctcaatttttaaagcaaaaggaaaatgtaactctgaaaaacgaagtcattaatcttgtccactcctttgatgttgtttctattttagcaaaattaattcaggagaatgatcttgcgaaaaaaatcaaccttgttgccccttttcatcctaaaaaagaagtgttttatggcgctttacttccccatttaattattaaaacagaattaaatgaaactgggaaacaggtgaagtcagtttatgaaaaggattag

SEQ ID NO: 10118 - protein, 227 aa, Unknown
  Obtained from environmental sample
  misc_feature (1)..(227): Xaa is any amino acid
MRILLFGCGWLGKQVVNQLLADKHFVLALTKSSKVKIPNSKFEHGNFDVESDDFNKLDFASFDKIILCLNPQYLNPPFLDSLKLHPHILVISSISIYGNQGLVDETTTPTPFSTNGKRLFQLENQYPSFTFLRLGGLVGPGRNPSQFLKQKENVTLKNEVINLVHSFDVVSILAKLIQENDLAKKINLVAPFHPKKEVFYGALLPHLIIKTELNETGKQVKSVYEKD

SEQ ID NO: 10119 - DNA, 678 bp, Unknown
  Obtained from environmental sample
  misc_feature (1)..(678): n is a, c, g, or t
gtggctattattttcatttttctgaaaataccctatttacgttctctgggtactggattatttgcaggagcaggaattatcgcaatggtaattggttttgcctcacaaaaagctttttccaatattatcagcggaatttttatcctgatattcaaacctttcagagtgaaagataccattgaattcctggattccaccaatggagtagtggaggaaattaccttaaggcataccatcattcgtaattacgaaaacagaagggtaattattcccaatggaaacataagtgatgacacgattattaacagtagtattatggatcaaaagattcggataggcatcgtctttggtatcagctatgattccaatatcgaaaaagctaccaaaataatgcaggaagagtgcatgaaacatgctagttttattgataacagaagtaaggaggaaaagcaaaataatcagcccgcagttgttgtaagattaatcgacctggcagattttgcagttaaactaaaagcccaggcatggaccagtaataatgataatgcctgggtcttaaaatgcgatgttatgaaatctgttttcgaccgctttaataaagaaggtattgaagtacccttcccatacaggaccgtcgtatataagaaagatattgaagcacaaaaaacaacattataa

SEQ ID NO: 10120 - protein, 225 aa, Unknown
  Obtained from environmental sample
  DOMAIN (2)...(206): Mechanosensitive ion channel
  misc_feature (1)..(225): Xaa is any amino acid
MAIIFIFLKIPYLRSLGTGLFAGAGIIAMVIGFASQKAFSNIISGIFILIFKPFRVKDTIEFLDSTNGVVEEITLRHTIIRNYENRRVIIPNGNISDDTIINSSIMDQKIRIGIVFGISYDSNIEKATKIMQEECMKHASFIDNRSKEEKQNNQPAVVVRLIDLADFAVKLKAQAWTSNNDNAWVLKCDVMKSVFDRFNKEGIEVPFPYRTVVYKKDIEAQKTTL

SEQ ID NO: 10121 - DNA, 354 bp, Unknown
  Obtained from environmental sample
  misc_feature (1)..(354): n is a, c, g, or t
ttgagaatgtccatatttgacaaagaatcaaagtatccctcgcacagctacaaaagcataaattttgctgggaaatggcagaaaaagttcattgatgagtacattgattcaatattcaaaattggcattgataaaacgcatggcatattttcagattcaaaagaagagcattttcctcaatttttatataaattttacacaccctctatctataatttagcttgtattcaaagcaatactgttcatttttcattaccaaggagttttaatgatccattcgatagctatatatgtgttgatgatcagttatacataaagcattatatattacatgcaattgaacaaaaatgctga

SEQ ID NO: 10122 - protein, 117 aa, Unknown
  Obtained from environmental sample
  misc_feature (1)..(117): Xaa is any amino acid
MRMSIFDKESKYPSHSYKSINFAGKWQKKFIDEYIDSIFKIGIDKTHGIFSDSKEEHFPQFLYKFYTPSIYNLACIQSNTVHFSLPRSFNDPFDSYICVDDQLYIKHYILHAIEQKC

SEQ ID NO: 10123 - DNA, 666 bp, Unknown
  Obtained from environmental sample
  misc_feature (1)..(666): n is a, c, g, or t
atggatcaaatcaaagaactcattgcatcaggtgaatacaaaccgggtgataaaatacctactgaaatggaattagccaaggatttcggtctgggccgctcttccattagagaagccattaaaatattcaattatctcggtgttctagaatcgagagctgcaattggaacaatcgtcagagaaagatcacaaatatcaacagaagcactaacatggtcccttcttttaggtgaagatgaatttgaagaaatggttgatctcagaggagctatcgaactccgttgtatgtgtaagatttcatccaaaatcactaaaagagaaaaagaggcaatagaattagttcataaactggaagatattgttgataaaatgaaaactgctgcttcaaaaaaggattacggtaaaatcagtgatctggatttaaattttcattttcttattattgattctactgataacgagttatttaattccctttatgagactctgaaagccttcttaaaagaggaagttgaaacaacaaacctcaattatcaaaatccagaagatatctggcaggaacatcgcaatctgctcgatgcccttaaatcaggtgataatctaattattctcagtgaatatgaaaatcatctgaaaaatattctacttcatctcaacagaaaataa

SEQ ID NO: 10124 - protein, 221 aa, Unknown
  Obtained from environmental sample
  DOMAIN (2)...(59): Bacterial regulatory proteins, gntR family
  misc_feature (1)..(221): Xaa is any amino acid
MDQIKELIASGEYKPGDKIPTEMELAKDFGLGRSSIREAIKIFNYLGVLESRAAIGTIVRERSQISTEALTWSLLLGEDEFEEMVDLRGAIELRCMCKISSKITKREKEAIELVHKLEDIVDKMKTAASKKDYGKISDLDLNFHFLIIDSTDNELFNSLYETLKAFLKEEVETTNLNYQNPEDIWQEHRNLLDALKSGDNLIILSEYENHLKNILLHLNRK

SEQ ID NO: 10125 - DNA, 624 bp, Unknown
  Obtained from environmental sample
  misc_feature (1)..(624): n is a, c, g, or t
atggccggntacatttttattggattgattttacatcaatttatctctatgaaatataaaaatgaattggctcatagtgaaatcttacagacaaaattagaagccttagagagtgagttaaatccacattttttatttaatgctctaaattcaatatcagaacttatttatcaagacaaaaaaaaagcagaagagtctgttttaaagctatcaaaatttttaagaaatgcaatcacaaaaaaaggattaattgatttaaaaagtgaaattgatatgttaaatacatatttacatatagaaaatataagattcgatgaaaaaatagttttcaatctagattgtgatgagaaacattatgagatgcttttacccaaattttcaatacaacttttagttgaaaatgcaataaaacatggttttacaggggagactttatatatagatgtaagagtttatgataataaaatagaagtaacaaatagtggaaaaataacttcagaggtagtatttggagtagggttgagtaatttacaaaaaagattacagatactaaaaattgggtatttagaagatactattgaggatgacaaaatgaaatttacaatttataggagtaataaatga

SEQ ID NO: 10126 - protein, 207 aa, Unknown
  Obtained from environmental sample
  DOMAIN (32)...(113): Histidine kinase
  misc_feature (1)..(207): Xaa is any amino acid
MAGYIFIGLILHQFISMKYKNELAHSEILQTKLEALESELNPHFLFNALNSISELIYQDKKKAEESVLKLSKFLRNAITKKGLIDLKSEIDMLNTYLHIENIRFDEKIVFNLDCDEKHYEMLLPKFSIQLLVENAIKHGFTGETLYIDVRVYDNKIEVTNSGKITSEVVFGVGLSNLQKRLQILKIGYLEDTIEDDKMKFTIYRSNK

SEQ ID NO: 10127 - DNA, 456 bp, Unknown
  Obtained from environmental sample
  misc_feature (1)..(456): n is a, c, g, or t
atgaaaaagtacgtaaaaacttcacttgtctcttgtagtgtagaagagttatttgaatttcacttggattcaaataatataaaaaagattactccaaaagatacaaaggtagagttattaaataaagattttataccagcagagggtgaaattttagagataaaaactacaaagttttgtttaccaattttttgggcagttgaaataagtttgataaaagaaccaaatatgttggttgatacagcacttaaatcaccctttgatttttggagacattctcatgtttttacaaaaaagggaaatgtatgtgaactaaaagatatagttgaatatgaaataccctttggaattttaggaaatattttttctggttttattgaaaagcaacttgataatatgtttagatatagacataaacagacaaaacttatattagaaaaaaaggataaagcttga

SEQ ID NO: 10128 - protein, 151 aa, Unknown
  Obtained from environmental sample
  misc_feature (1)..(151): Xaa is any amino acid
MKKYVKTSLVSCSVEELFEFHLDSNNIKKITPKDTKVELLNKDFIPAEGEILEIKTTKFCLPIFWAVEISLIKEPNMLVDTALKSPFDFWRHSHVFTKKGNVCELKDIVEYEIPFGILGNIFSGFIEKQLDNMFRYRHKQTKLILEKKDKA

SEQ ID NO: 10129 - DNA, 804 bp, Unknown
  Obtained from environmental sample
  misc_feature (1)..(804): n is a, c, g, or t
gtggggaaatcttggttcagcctatttactgcagagggagatatcactgataacaaagagtcagctataaaattctcagcccatgcagcctcactcaatacactgctaagtgagtttgaattaactccacaagataaagagctctttattgatggagaggttgatattaatgcgacacttaagttatctgagaagatggaactgaaaagccatattttcatgccgtggtatattttaaaacccgatccgcaaacaaactatgttggagagaacatctatattgactcaacttttatagacaaagagctaacagttaatagatatagccttaatgttctaaatcatcatatctactccgaaaaaccttcaaaaatcaactttgacacaaatgcaacagttacatttgaaaagttttggatttatgacaacatacttctaagcggagtgattgatccgctacagatgcaaggtaatctagagctgcagagtgatcgttttacatataactcagatgatggaaatgttactgcaaaagctgagataagagctgactttgaacctgatggaacacaaaatattacaggggagataactcttcttgaagggattatcacatataaaccaactacagattactccatctctgatgatatcatcataattcaggatattaaaccgattaaaaaatcaaaacgtacgataaatatacatgtaaactcactaaaaccaatctcttacaagagtgatgatatcgaaattaatttcaaacccagatattactattggcagcagcctgagcgataa

SEQ ID NO: 10130 - protein, 267 aa, Unknown
  Obtained from environmental sample
  misc_feature (1)..(267): Xaa is any amino acid
MGKSWFSLFTAEGDITDNKESAIKFSAHAASLNTLLSEFELTPQDKELFIDGEVDINATLKLSEKMELKSHIFMPWYILKPDPQTNYVGENIYIDSTFIDKELTVNRYSLNVLNHHIYSEKPSKINFDTNATVTFEKFWIYDNILLSGVIDPLQMQGNLELQSDRFTYNSDDGNVTAKAEIRADFEPDGTQNITGEITLLEGIITYKPTTDYSISDDIIIIQDIKPIKKSKRTINIHVNSLKPISYKSDDIEINFKPRYYYWQQPER

SEQ ID NO: 10131 - DNA, 420 bp, Unknown
  Obtained from environmental sample
  misc_feature (1)..(420): n is a, c, g, or t
atgaaatttagtgaagcattagaatcgttccttaactttcaacaggcaatatcatcatcaggaaattacggttacctaaattcaaaaatcaaaactattaataagtttatgggaactatcaatgtaaattcaattgatagatcttcaggaacagacttcattagaaaactaagagaaagaaatccaagcatttctgaatctacgatcaataaatatatagacataataaaaagagtattaaaagtcgaatgcgatattaagtttagtttttccaaactcaaggaaaacaaaaaagtatttgaggttgttcccgatgaagtagtgccaaaagatatccagcactatcggaagaatctaaaccataaacacaggttaaagaaaatacctttttgtttaggatgttacttgaaactgggatga

SEQ ID NO: 10132 - protein, 139 aa, Unknown
  Obtained from environmental sample
  misc_feature (1)..(139): Xaa is any amino acid
MKFSEALESFLNFQQAISSSGNYGYLNSKIKTINKFMGTINVNSIDRSSGTDFIRKLRERNPSISESTINKYIDIIKRVLKVECDIKFSFSKLKENKKVFEVVPDEVVPKDIQHYRKNLNHKHRLKKIPFCLGCYLKLG

SEQ ID NO: 10133 - DNA, 420 bp, Unknown
  Obtained from environmental sample
  misc_feature (1)..(420): n is a, c, g, or t
atggaaatgtgtaattatgttgtatctgatggatttatgtgtgatttagttgatttagataatagttggtttgttgataaaaatacaattgatttaaatgcaactagttatgatagaaatactacagtacaaactatagatctcaatacaatttataaaaaaagagattcaaaagagatagtaaaagagacaagagaagagatatatatacaaagcaatagtgataaaaaaccagctatacaaaaatcattaaatgaaaaaccaaaagagggtaatggcttaataaaaagttttaaaatagatgatctattagagaatacagatgttaatacaactataaagcctaagaaaaaaataaaatacttagatgaaaaaatgcctcaagaggtaaatttagataacaataatacgaatggataa

SEQ ID NO: 10134 - protein, 139 aa, Unknown
  Obtained from environmental sample
  misc_feature (1)..(139): Xaa is any amino acid
MEMCNYVVSDGFMCDLVDLDNSWFVDKNTIDLNATSYDRNTTVQTIDLNTIYKKRDSKEIVKETREEIYIQSNSDKKPAIQKSLNEKPKEGNGLIKSFKIDDLLENTDVNTTIKPKKKIKYLDEKMPQEVNLDNNNTNG

SEQ ID NO: 10135 - DNA, 321 bp, Unknown
  Obtained from environmental sample
  misc_feature (1)..(321): n is a, c, g, or t
gtggtttgcattcatcctatttttgttttctcgtggctttattcaaacatttatgttcaaaaatatcaacagaaaattgaactaaaagaaaataatcaatcgtataaatacgataataatcaaatagttaagaaactgttaataaaaaacgatttttttattgctaaaatgcatgttttcttcgaattatgtattatatttggaatgcactcttcacttcattttgttactttttcatgggttaattatcaagtgcgaaaatttttgggctgcctccccggcagccccacacttgtcttcccagaagaattcaaaacttaa

SEQ ID NO: 10136 - protein, 106 aa, Unknown
  Obtained from environmental sample
  misc_feature (1)..(106): Xaa is any amino acid
MVCIHPIFVFSWLYSNIYVQKYQQKIELKENNQSYKYDNNQIVKKLLIKNDFFIAKMHVFFELCIIFGMHSSLHFVTFSWVNYQVRKFLGCLPGSPTLVFPEEFKT

SEQ ID NO: 10137 - DNA, 576 bp, Unknown
  Obtained from environmental sample
  misc_feature (1)..(576): n is a, c, g, or t
ttgggacattatggcacaatcataccaggaacaacttgtatttcatgtgaacttgaaaaaactaactcttattttgaaaaaacactaagtcattcattaatgccaaataaattaactggaaatttaggagaaaatgcaaaatgtaaaaagccttataaagcaagtacggcatttgatttaaaatttattgctattcctgtaccaataccaacaactccaaatgttgatattgttgtaggaggtaacccaatttctgaatggaataaactgatgaatagaaatggatatagtgatgcaactataaaaccatcagaaatcatcgctaaacaaggtggtaatagtggtattgaagaggaatctgaaaagattgtagaagaaaatgagaaggctcaggaaaaatctgaacgtataaaaaatacagctcaaataactgaaaaacttaataatgtttctacttttacaaatgctgtatatgctgagctagatcaatttcatatatatttaaagaatgaactagaattaatgaaaaaatctaataatgcttgctctgaaacattatcaaaaccaaccatataa

SEQ ID NO: 10138 - protein, 191 aa, Unknown
  Obtained from environmental sample
  misc_feature (1)..(191): Xaa is any amino acid
MGHYGTIIPGTTCISCELEKTNSYFEKTLSHSLMPNKLTGNLGENAKCKKPYKASTAFDLKFIAIPVPIPTTPNVDIVVGGNPISEWNKLMNRNGYSDATIKPSEIIAKQGGNSGIEEESEKIVEENEKAQEKSERIKNTAQITEKLNNVSTFTNAVYAELDQFHIYLKNELELMKKSNNACSETLSKPTI

SEQ ID NO: 10139 - DNA, 729 bp, Unknown
  Obtained from environmental sample
  misc_feature (1)..(729): n is a, c, g, or t
ttggcacaaaatataactgaaaaagtaaagatagaaaaacaaaaagaagatgataggcaagttagaagtgtactaaaccaaatgctttcacttactttagaagataaaacgttaaaatgttttattgatgaagcattgactttagtattatcactaccttatttcaaaaacttatcaaaagcagccatttttactaaaaaagatgaaaataccttagagttaatatcacatgtgaactttgaacaggaactaattaatagatgtagtttggtagagaaaggcttttgtatgtgtggtttaacctttgaaaaaaaggaaattcaatatgcttgttgtaatgaaaaccaatacaaagtggatgtggttgcaaatcaggatattggaaattataatataccaatattaaacaaaggtaatgttatgggggtgttgagtatttacttggaaaaacatcataagaaagatgataatgaattagatgttttaaaaaccatagctaatacacttggaataatcttgatgcgaaaaactaatcaggaagcattattgcgtagtgaaaatagatttagagagttagcagaaaccataaaagagatattttggttagttgactgtaaaacacaaaagctaatatatgttagtccagcttatgaagatatttatgagcaaacaattgattcgctatataatgatggaactgtttgggaactaatgatacatccccgatga

SEQ ID NO: 10140 - protein, 242 aa, Unknown
  Obtained from environmental sample
  misc_feature (1)..(242): Xaa is any amino acid
MAQNITEKVKIEKQKEDDRQVRSVLNQMLSLTLEDKTLKCFIDEALTLVLSLPYFKNLSKAAIFTKKDENTLELISHVNFEQELINRCSLVEKGFCMCGLTFEKKEIQYACCNENQYKVDVVANQDIGNYNIPILNKGNVMGVLSIYLEKHHKKDDNELDVLKTIANTLGIILMRKTNQEALLRSENRFRELAETIKEIFWLVDCKTQKLIYVSPAYEDIYEQTIDSLYNDGTVWELMIHPR

SEQ ID NO: 10141 - DNA, 963 bp, Unknown
  Obtained from environmental sample
  misc_feature (1)..(963): n is a, c, g, or t
gtgaatatgtccaaagagttatcaacacactcactaagtagtacattttcacatatttacgtggaaaaaagagttttagatcatgagaaaacaaaagatattttaaaaaagtttaaaaattctcatatcatcatgatagatcactataaagatatttttaaccgttcacaccaaagtttttcagagcagtctcttagtaaaaatcttattttagctgcgagagatgagaactttttaatagaaggctcatattttagtgatggttttgagtatgaaaacttcttctacacaccatcgattttagggtgtctgtatgattgtgattactgttacttacaaggcatgtacaactctgcgaacagtgtcatttttgtaaatatagaagatttcataaatgatagtaaaaaatatttagacaaacctaccctcatagcaatctcttacgatacagatacatcagccatagagtccatcgcaaaacataatgaagtttggttaaatgaggcaaaaaaagagccaaatctaaatcttgaaatcagaacaaaaagtgcaaatacaaaactctttttaaaaaatgaacctcttaaaaatgtagttatcgcatggacactttcacctcaaactatcattgatttgtatgagcactttacaccttcaatagttcagagactaaaagcgataaaaagtgtagcagatctgggatggagtgttcgcataagcatagatccagtcatttacaatgaagattttgacaaaatctaccctgaagctattgataaaatatttgaatatatagagccgacaaagctattctctctaacattgggcagttttagaatgagccctaatcctctaaaaaagattaaaaagatggggaggaggggatttagcccttctacccatacgaataccacttccaaacagggcaagtttccccaaaaagagattggggccaaatatttt

SEQ ID NO: 10142 - protein, 321 aa, Unknown
  Obtained from environmental sample
  misc_feature (1)..(321): Xaa is any amino acid
MNMSKELSTHSLSSTFSHIYVEKRVLDHEKTKDILKKFKNSHIIMIDHYKDIFNRSHQSFSEQSLSKNLILAARDENFLIEGSYFSDGFEYENFFYTPSILGCLYDCDYCYLQGMYNSANSVIFVNIEDFINDSKKYLDKPTLIAISYDTDTSAIESIAKHNEVWLNEAKKEPNLNLEIRTKSANTKLFLKNEPLKNVVIAWTLSPQTIIDLYEHFTPSIVQRLKAIKSVADLGWSVRISIDPVIYNEDFDKIYPEAIDKIFEYIEPTKLFSLTLGSFRMSPNPLKKIKKMGRRGFSPSTHTNTTSKQGKFPQKEIGAKYF

SEQ ID NO: 10143 - DNA, 918 bp, Unknown
  Obtained from environmental sample
  misc_feature (1)..(918): n is a, c, g, or t
ttggcaaaaacagataaagcggaagaggctttgcttaagatattttctgcagaaggagatattcttagacatcaattgtcatttgataaaacgactacagctgagttaaaaggttataccgatggcaaaagttttgtagccaactatccatttataccttatcactacttgcttgttcaaaaagtatttgaatctataagaactaaaggtgcgacagggaagcacttggccatgggagagcgctcgctgctagacgcgttccaaaatgcagcaaagcaaattaaaaatgaagagttgaatgtcttagttccttttcatagtttttatgcccctatagagagcttcttagaaccagcggtcaaaagaaccattgatcaagccttagagttggactcactttcagattttgatggtcaaatcctaaaaaccttatttctaatacgctatgtcgacacggtcaaaagcactttagacaatctagtaactttatctattagtaagatagatgaagataagatagtgttacgaaagaaaatagaagatagccttgagcgtcttgagcgccaacttcttattgctagaaatggagaagagtttatatttctaacgaatgaagaaaaagagatagaaaacgagatccgtaatacagattgtgagatatctgagttatctagcaagctatcttccatagtgtttgataatattctaaaaggcaaccgagtttatcgttacccagttaacaaacaagacttttctngtagtcgattttgcaatggacatccaaaagatgggcttattcttgaagacttggttttaaaaaatcacctccacctttggacacagattataatagttttttcgacggactatgaatgtcctgagtacacgcttaaaagacgaccggtgtatgttaagtaa

SEQ ID NO: 10144 - protein, 305 aa, Unknown
  Obtained from environmental sample
  misc_feature (1)..(305): Xaa is any amino acid
MAKTDKAEEALLKIFSAEGDILRHQLSFDKTTTAELKGYTDGKSFVANYPFIPYHYLLVQKVFESIRTKGATGKHLAMGERSLLDAFQNAAKQIKNEELNVLVPFHSFYAPIESFLEPAVKRTIDQALELDSLSDFDGQILKTLFLIRYVDTVKSTLDNLVTLSISKIDEDKIVLRKKIEDSLERLERQLLIARNGEEFIFLTNEEKEIENEIRNTDCEISELSSKLSSIVFDNILKGNRVYRYPVNKQDFSXSRFCNGHPKDGLILEDLVLKNHLHLWTQIIIVFSTDYECPEYTLKRRPVYVK

SEQ ID NO: 10145 - DNA, 378 bp, Unknown
  Obtained from environmental sample
  misc_feature (1)..(378): n is a, c, g, or t
atgagaaaaaaaactaaaattataattgttcttacaatactattttttttaataaattttacagtctactttattattaaatataatgaaaatcagagaatcaaaatagcactaaataatcatcttcaaaagttagagacaaattacgaaatattctatcatttccaagaaaaaactgcaaaaaatatgtataaagctactatagaagatgatagagttattaaaataatctcaaaagcaaatcgtgtaacttcaaaacaagataaaaagcttttaagagatgaactctatgagttggtaaaacataggtatgagagagctaaagtcaagggtgtactgcagtaccacttttttttaaaaacagtgagtcatttctaa

SEQ ID NO: 10146 - protein, 125 aa, Unknown
  Obtained from environmental sample
  misc_feature (1)..(125): Xaa is any amino acid
MRKKTKIIIVLTILFFLINFTVYFIIKYNENQRIKIALNNHLQKLETNYEIFYHFQEKTAKNMYKATIEDDRVIKIISKANRVTSKQDKKLLRDELYELVKHRYERAKVKGVLQYHFFLKTVSHF

SEQ ID NO: 10147 - DNA, 870 bp, Unknown
  Obtained from environmental sample
  misc_feature (1)..(870): n is a, c, g, or t
atgaataagattcttatttttattattatctcgcttttttcattgaatatttctgctcaaacaatgtattttacagattctctttttgtagaagaattgggtgtatttatggggaaagtttataaggttcacccagaaatagaacaaacctatttggaatttcaagcaaattgggaaagcggaagtttagataatcaaaaatttggaattatttatcttgcaaattcaatgaaagatagtcgttcaaaagcttatcctgattactcaaactatttgatgacattgaatgctcttgttctaaaaaatgaaatgaattattacaaggaatgggaaattgggcttgtaggagtagtgacgtcaaaaaaatctaaagatataagagaatacctttctttctcaaaattactgatcattgacagtattcttattcaaacgcaatctattacttggaaagcaaattccactgattatgtcattggaaatgatctcgaaactcaaaatttatttattaaatttaataatgaaattgatttaatgtgctttaatactaatggtcaaactattgacacattcttgattgaaaatactaagggaatttgctttccaacagaacatatctggaaaggaaataaaggtagagtttcatggcaacaggctaaattagataattcaaaagtttttgcaaaattcgatgaatatcaacttgatatgagacaaagtaaatttgtgattgaggacgcactttttaccaatgaatttttaaatatacatcaaattcctggaaaactcgaagttaaattatcgcaaacaaaaaacttaactaatagtcctattttgaatctcgagccgctcagccatcaagccnnntaa

SEQ ID NO: 10148 - protein, 289 aa, Unknown
  Obtained from environmental sample
  SIGNAL (1)...(19)
  misc_feature (1)..(289): Xaa is any amino acid
MNKILIFIIISLFSLNISAQTMYFTDSLFVEELGVFMGKVYKVHPEIEQTYLEFQANWESGSLDNQKFGIIYLANSMKDSRSKAYPDYSNYLMTLNALVLKNEMNYYKEWEIGLVGVVTSKKSKDIREYLSFSKLLIIDSILIQTQSITWKANSTDYVIGNDLETQNLFIKFNNEIDLMCFNTNGQTIDTFLIENTKGICFPTEHIWKGNKGRVSWQQAKLDNSKVFAKFDEYQLDMRQSKFVIEDALFTNEFLNIHQIPGKLEVKLSQTKNLTNSPILNLEPLSHQAX

SEQ ID NO: 10149 - DNA, 810 bp, Unknown
  Obtained from environmental sample
  misc_feature (1)..(810): n is a, c, g, or t
ttgaagttatcggagaaactgacaaactggtacaataatcattttaaaccagatgcaactatttttactgtaacagaatataattttgatattttagctcaaagattaagagaattagcattcttgaacaaaggaattactctttctttagaagataaaagaaaatttgaaaaaccagaaatagaagtagagggagaagaaaaaggtgacagaaaagttgtttttcattctgaaacaggattgaacgaatttatagaatatcttgacgaaactcgtgatccaattattgacgtaattcatacttcaacagaaaaaaatggtattccagttgaaatagctcttgaatataatacaagttactccgaaaatgtttattcctatgtaaataatattaatacacaagaaggaggaactcacttaacaggtttcaaaagaggattaacaagaacattaaaacaatacgccgaagaatctggaatattgacaaaaaagaaaattataattaatggagatgactttagagaaggattaactgccgtaatttctgttaaagttcaagatccacaatttgagggtcaaacaaaaacaaaattaggtaatagtgaagtatctcttgcagttgatcaagctgttagtcagatgattagaaattatcttgaagaaaatccaaaagatgcaaaaattattgttgagaaagtaattttggctgcacaagctcgattagccgccagaaaagcaagagaacttattcaaaataaatctgttcttaaagngtggtggtttaccaggaaaactttcagattctcttga

SEQ ID NO: 10150 - protein, 269 aa, Unknown
  Obtained from environmental sample
  DOMAIN (80)...(249): DNA gyrase B
  misc_feature (1)..(269): Xaa is any amino acid
MKLSEKLTNWYNNHFKPDATIFTVTEYNFDILAQRLRELAFLNKGITLSLEDKRKFEKPEIEVEGEEKGDRKVVFHSETGLNEFIEYLDETRDPIIDVIHTSTEKNGIPVEIALEYNTSYSENVYSYVNNINTQEGGTHLTGFKRGLTRTLKQYAEESGILTKKKIIINGDDFREGLTAVISVKVQDPQFEGQTKTKLGNSEVSLAVDQAVSQMIRNYLEENPKDAKIIVEKVILAAQARLAARKARELIQNKSVLKXWWFTRKTFRFS

SEQ ID NO: 10151 - DNA, 450 bp, Unknown
  Obtained from environmental sample
  misc_feature (1)..(450): n is a, c, g, or t
atgcagggagaattgatgtctagtattgatgataatgtaaaagtatctttgagtgaaaaacaaaagcagataataaaaaaccatctcaatgataatggaaaactatcatgtataaaagcttttaaagttgctaggttaattgatgttgagccttttgcaatatctgcaattacaaaaagtcttaatattaggattacagattgtgaacttggggtatttgggaatttagagttctcaaataaagatgagaatatttataatgatttagtacaacagtatgaaaaagaaaagaaactagactgtaaagtttattgggatgaggcaaaaaaatcaagcttacataaagttggttcaactgttaaaaacagtgattttgaagttataaattgtcaacttggatgttttagattaaaagaaagcaaaggagataaaaatggaagtaagagttaa

SEQ ID NO: 10152 - protein, 149 aa, Unknown
  Obtained from environmental sample
  misc_feature (1)..(149): Xaa is any amino acid
MQGELMSSIDDNVKVSLSEKQKQIIKNHLNDNGKLSCIKAFKVARLIDVEPFAISAITKSLNIRITDCELGVFGNLEFSNKDENIYNDLVQQYEKEKKLDCKVYWDEAKKSSLHKVGSTVKNSDFEVINCQLGCFRLKESKGDKNGSKS

SEQ ID NO: 10153 - DNA, 885 bp, Unknown
  Obtained from environmental sample
  misc_feature (1)..(885): n is a, c, g, or t
atgggactacttaaaagaaaaatagcaatcaaccttaaaaaagaaaaagaactaattattagtataactctccaaggtgaaaaactaaaaaaagaaggatttttagaagaaaaatttctaaaaaaagaatttccaatcaaagtaaatgcattaaatgacattgaaaaacatacttatttagaattaaaaaaaagaaaaggaatcctaatcacagaagaagaaaaaacaacaactatagaattaacaaatttaggcaaaaaattaatttctaaagaaaatttaaaagaaataaataaaccagtaataaacagattaaccaaatcaatgttaaaaagtaaagaatggaaaaataaaaaattccgtgcttatgatatagaaataaatgttccaaaaatttatccaggtaaaaaacattttgttaatcaagcagtagattatattagaactatttggttagaattaggattcaaagaaatgagtggaaattatgttcaatcatcattttgggatttagatgccctctttgttcctcaagaccatcccgcaagagaaatgcaagacacattttatcttaatggaaaagccaaattaccagaattttggaaaaatataaaagaaacacatgaaacaggtggtaacaccaaaagtaaaggttggaactataaattctcaaaaaaagaaactgaaactttactccttagaactcataccacagttctatcagcaaaaacaatttctaaactaaaaaaagaagatcttcctgcaaaattttttgccataggaaaagtatttagaaatgaaactcttgactggaaacacctttttgaattttatcaagtagaaggaatagttatagatccaaatgcaaatcctcagccattctga

SEQ ID NO: 10154 - protein, 294 aa, Unknown
  Obtained from environmental sample
  DOMAIN (139)...(293): tRNA synthetases class II core domain (F)
  misc_feature (1)..(294): Xaa is any amino acid
MGLLKRKIAINLKKEKELIISITLQGEKLKKEGFLEEKFLKKEFPIKVNALNDIEKHTYLELKKRKGILITEEEKTTTIELTNLGKKLISKENLKEINKPVINRLTKSMLKSKEWKNKKFRAYDIEINVPKIYPGKKHFVNQAVDYIRTIWLELGFKEMSGNYVQSSFWDLDALFVPQDHPAREMQDTFYLNGKAKLPEFWKNIKETHETGGNTKSKGWNYKFSKKETETLLLRTHTTVLSAKTISKLKKEDLPAKFFAIGKVFRNETLDWKHLFEFYQVEGIVIDPNANPQPF

SEQ ID NO: 10155 - DNA, 810 bp, Unknown
  Obtained from environmental sample
  misc_feature (1)..(810): n is a, c, g, or t
ttgataagttttaaagatgaatggatagttttaaaaaatgataaacaaaatataacttatcgtttctcacatgataagttacagcaaattgtttattcaagtattgaaaaagatactttaaaaaagatacattttgagattggaagttatttatacaaaacagatattgtaggtaaaaaacttataaactgtacaaatcatcttaatatgggagttgaatttttagatgatttaggggtattaattgaacttaatactagagcctctttacattcaaaaaaaagtggagattttataaatgctttagagtatataaaacaagcaatggatttaataaagcaagaaacttatacaaaaaaagatatttttatacttaaagaaagaggagagtgtgagcatctttgccacaatagccaagaagcgattaaatattatgaaatagcgttgggattaagtgaagatattaagacgcaagctttaatatatgaacttcttattaagttatattctgatatttcagattttaaaaaagcatatgaagtgggaagagttgctactgctctttttggttttaatatgccaaaaggttttattcctcctttatttatacttgactttgcaagggtaaaatttaaattacgaaataaaaaaatagctgagctcatcaatatagaagagtcttttgatgaggagtttaaacttttaataaaaatagcagcaaataccttacaagctgcatatcanattaaaccagaactttgtgtggcanatgctttaaaaatagtagagctttgtttggaaaaagattga

SEQ ID NO: 10156 - protein, 269 aa, Unknown
  Obtained from environmental sample
  misc_feature (1)..(269): Xaa is any amino acid
MISFKDEWIVLKNDKQNITYRFSHDKLQQIVYSSIEKDTLKKIHFEIGSYLYKTDIVGKKLINCTNHLNMGVEFLDDLGVLIELNTRASLHSKKSGDFINALEYIKQAMDLIKQETYTKKDIFILKERGECEHLCHNSQEAIKYYEIALGLSEDIKTQALIYELLIKLYSDISDFKKAYEVGRVATALFGFNMPKGFIPPLFILDFARVKFKLRNKKIAELINIEESFDEEFKLLIKIAANTLQAAYXIKPELCVAXALKIVELCLEKD

SEQ ID NO: 10157 - DNA, 636 bp, Unknown
  Obtained from environmental sample
  misc_feature (1)..(636): n is a, c, g, or t
atgctaaaacgaatttttattctttctcttattgctattttgatttgttcaaatggccattcgcaatttttgcttccattgaaccagagcatgactgatcgctattcgtttttcttttacaatgatacaatccagtctcatactgctattaaaccttttacgcttgagctcgcaatacaaaaagaattgttagatacaagcttgctatattccgacaaagagaacccattaaaagctttgttaaattatgattttgtgagccttaagaacaacaacatcagttttaagcttaatccaataattaaaggattatactcttttgatgtaagtgacaatattggatacaaaaaacaaaaaataggattctcccggagattaaatctttttgaaaaatacgaatttttctatgctcatgaattcaataaatctcctttttacccaaatacagaaaagatagattcacccaggttatcctcatttcggatcttctccgcaaaaacattattactctatcaaatatttccctcaggtttatttaagcgggcagtattccagtttccccgggaattgcaacatttcggggggaagggtaccgcccttacttcttccgaaattcccgaaattcccctttcttaa

SEQ ID NO: 10158 - protein, 211 aa, Unknown
  Obtained from environmental sample
  SIGNAL (1)...(19)
  misc_feature (1)..(211): Xaa is any amino acid
MLKRIFILSLIAILICSNGHSQFLLPLNQSMTDRYSFFFYNDTIQSHTAIKPFTLELAIQKELLDTSLLYSDKENPLKALLNYDFVSLKNNNISFKLNPIIKGLYSFDVSDNIGYKKQKIGFSRRLNLFEKYEFFYAHEFNKSPFYPNTEKIDSPRLSSFRIFSAKTLLLYQIFPSGLFKRAVFQFPRELQHFGGKGTALTSSEIPEIPLS

SEQ ID NO: 10159 - DNA, 375 bp, Unknown
  Obtained from environmental sample
  misc_feature (1)..(375): n is a, c, g, or t
gtgcaaagtgcaggatttgaaccagcagggattaatcctctagcaattgaaatattaagagaggaaaacattaatatagatgggaaagaaacaaactctgtttttgacctttttaaggcggggaaaactttcaattatgttattacagtatgtgatgagggaaatgcccaaagatgtccattatttccaggtcttaactatcgaattcattggagttttgaagacccaagtagttttacaggaagggatgaggagagattagcaaaaacaagaaccgtaaaagagcagataaaaaaagaagttcttcaacttatagagcttgtaaaaactggtcagttaaaagataattttccaacaacatggaaagtaggataa

SEQ ID NO: 10160 - protein, 124 aa, Unknown
  Obtained from environmental sample
  misc_feature (1)..(124): Xaa is any amino acid
MQSAGFEPAGINPLAIEILREENINIDGKETNSVFDLFKAGKTFNYVITVCDEGNAQRCPLFPGLNYRIHWSFEDPSSFTGRDEERLAKTRTVKEQIKKEVLQLIELVKTGQLKDNFPTTWKVG

SEQ ID NO: 10161 - DNA, 468 bp, Unknown
  Obtained from environmental sample
  misc_feature (1)..(468): n is a, c, g, or t
ttgttacagatgcttatcttagcagatatggggtataaactcgacanccatatgagaacatcactttgcacagatgcgctcgctatggctattaaaaataggaaataccctgataaaaagcttatccatcattcagatagagggtttcaatactgcagccccaaatacacacagtttgctgaagataatggaattacaatgagtatgactgaacaatacgatccttacgaaaatgctgttgcagaacgcattaatagaactcttaaatatgaatatggattaaaacaaatcattaaaaacactgaattagcacaaaaaatgacacaacaagctgtatatatttataacaatttgagaacacattttagcctggatctcagaaaacctgctgaagtccatctcaatccaaacatcaaatacaaatcctatcgaaaaaataatgtaaatttacctgaacttacaatttaa

SEQ ID NO: 10162 - protein, 155 aa, Unknown
  Obtained from environmental sample
  DOMAIN (1)...(134): Integrase core domain
  misc_feature (1)..(155): Xaa is any amino acid
MLQMLILADMGYKLDXHMRTSLCTDALAMAIKNRKYPDKKLIHHSDRGFQYCSPKYTQFAEDNGITMSMTEQYDPYENAVAERINRTLKYEYGLKQIIKNTELAQKMTQQAVYIYNNLRTHFSLDLRKPAEVHLNPNIKYKSYRKNNVNLPELTI

SEQ ID NO: 10163 - DNA, 504 bp, Unknown
  Obtained from environmental sample
  misc_feature (1)..(504): n is a, c, g, or t
atgggtggagcagaaatggcttacagaaccaattatcaattatatgttttgtataagcctttatctaatccatattttaatcaactaatcaataataagcgaacaaggtttggaataaagataatagccatgcaggaagccttacgtaaaatgctttctttaaaagatagtgaagaactaagtgctactacttttattgctgatcaaacaccatcacctaaaaatgcttattggaccacttttttaaatcaggacacgcctatattttggggtacagaattaattgctaaaaaattaaattatcctatagtttatatttgtgtacaacaatataaaagaggtttttatgaaatgacagctgaaatgctttgcgaaaacccaaaggaaactactaaaggagaaatctctgaaatgcataccagaagactagaaaaagacattattgctcaacctgaattttggttatggtcgcataaaagatggaagcataaaagacctcaataa

SEQ ID NO: 10164 - protein, 167 aa, Unknown
  Obtained from environmental sample
  misc_feature (1)..(167): Xaa is any amino acid
MGGAEMAYRTNYQLYVLYKPLSNPYFNQLINNKRTRFGIKIIAMQEALRKMLSLKDSEELSATTFIADQTPSPKNAYWTTFLNQDTPIFWGTELIAKKLNYPIVYICVQQYKRGFYEMTAEMLCENPKETTKGEISEMHTRRLEKDIIAQPEFWLWSHKRWKHKRPQ

SEQ ID NO: 10165 - DNA, 660 bp, Unknown
  Obtained from environmental sample
  misc_feature (1)..(660): n is a, c, g, or t
atgaaaaatattaaagaagcagtaatttccttagatattatgccaaaagaaacttatgataagtttagtaaatactccaaacttcaaaacgcttctcctgatgaaatttggaaacattatccatcaactggattaaataattatgatccaaacactatggtattggaagcttctattattgagacatacctccttcttaactaccttaaagaccatgatataaaagcaagactttggtataacaaccctctttttatacataatgatgacttatatagaatcaaaggtgacgaagttataaaagagtcaatagataacctctattttgtatcgctgagagaagctctatcccatccatttttcagaatattaaaaattattttagagcgtagaggaggagatctagtcaaaccaaatatgcagacaatggaaaatgccggctgtatgaataagttttacgcaaaaagagaactatataaaaaaagagaaaaatatctaggtgatatcatcattcctttcaacataacacaaagagaccatgaagtatttatgaaatatgtaaaagaaaatttaggtgataaaatagtactaaaaaaagattgtgtacaagagggaaaaggtgtaatatttaaagacttaacagagaaaaccgatgcttag

SEQ ID NO: 10166 - protein, 219 aa, Unknown
  Obtained from environmental sample
  misc_feature (1)..(219): Xaa is any amino acid
MKNIKEAVISLDIMPKETYDKFSKYSKLQNASPDEIWKHYPSTGLNNYDPNTMVLEASIIETYLLLNYLKDHDIKARLWYNNPLFIHNDDLYRIKGDEVIKESIDNLYFVSLREALSHPFFRILKIILERRGGDLVKPNMQTMENAGCMNKFYAKRELYKKREKYLGDIIIPFNITQRDHEVFMKYVKENLGDKIVLKKDCVQEGKGVIFKDLTEKTDA

SEQ ID NO: 10167 - DNA, 774 bp, Unknown
  Obtained from environmental sample
  misc_feature (1)..(774): n is a, c, g, or t
ttgactcaaaacnccaacatatccactgggagaagttttgaaaattacaaaaatccatggtacaaaanagatacgtttaatggaatgaatgtatatagagtaaaagcagttaccggatataaaaagagtctgtttaaaaaattactaaaatattttacttttatgtttttaggaagtatagtagctgtttttatcggtaaaaaatatgattatatttttggatttaacatgagtgctttaacaggtatggttccggctattgtaataaaaaagttgtataataagcctttaacattttgggctcttgatatttggccagatagtgtctatgcgtatggatttaaaaaaacaaaaattctctcactgtttttagatacatttgttaaatttatgtatcataatattacggcaattgctatttcaggaaaaggttttgaaactaaattgaagccttatgtcagagaaaatttaaagtttcactatattcctaactgggctgatgagttagatatgagtttgaaagtgtatgagttttcaaaagagtcaaaagttcattttacttttgcaggtaatataggaaaagtacaaaatttagagaatattataaaagcatactctctattaccaagtgagtatagagaaaaatcacagttaaatatcataggtgatggttcaaatttggaatcactgaaaaaaataagcagtaataaaaatattgtttttcatggtaaaaaaccacgtgaagagatggcaaaattttataaagctaggtga

SEQ ID NO: 10168 - protein, 257 aa, Unknown
  Obtained from environmental sample
  misc_feature (1)..(257): Xaa is any amino acid
MTQNXNISTGRSFENYKNPWYKXDTFNGMNVYRVKAVTGYKKSLFKKLLKYFTFMFLGSIVAVFIGKKYDYIFGFNMSALTGMVPAIVIKKLYNKPLTFWALDIWPDSVYAYGFKKTKILSLFLDTFVKFMYHNITAIAISGKGFETKLKPYVRENLKFHYIPNWADELDMSLKVYEFSKESKVHFTFAGNIGKVQNLENIIKAYSLLPSEYREKSQLNIIGDGSNLESLKKISSNKNIVFHGKKPREEMAKFYKAR

SEQ ID NO: 10169 - DNA, 684 bp, Unknown
  Obtained from environmental sample
  misc_feature (1)..(684): n is a, c, g, or t
atgacagatcggctgagattgcacatggtgttatacattactcatgaattggaaattcaggtaaataatgaaaatgcagagttaaatcttgtctatgtagatgatgttgttgcatcttttattgaaaaattgcatataaagagtgatgataactattttgaaattgtaactacatataaaaaaacattagctcagattaaagagttgctatacaaatttaaaagtagtagagatactcttttagttcctcaagttggaagtggattcgagagagctatgtatggaacttatttgagctatctgcctacggaaagattttcttatgaattaaaaggtcataaagatgatagaggtacattttatgagatgctaaaaactgaacgtagcggacaagtatcaatatcaacgacagctccaggtataactcgaggcggacactatcatcatacaaaaaatgaaaagtttttagttataaaaggaaaggcagttatacagcttagaaatatactcaatgaagagatcatagaatacaatgtctctgatgagaagatggaagttgtagagatgattcctggatatacacacaatataaaaaatattggagaagatgagctgattttacttctttgggcaaatgagaactatgataaaacagctccagatacatattttttagaagtataa

SEQ ID NO: 10170 - protein, 227 aa, Unknown
  Obtained from environmental sample
  misc_feature (1)..(227): Xaa is any amino acid
MTDRLRLHMVLYITHELEIQVNNENAELNLVYVDDVVASFIEKLHIKSDDNYFEIVTTYKKTLAQIKELLYKFKSSRDTLLVPQVGSGFERAMYGTYLSYLPTERFSYELKGHKDDRGTFYEMLKTERSGQVSISTTAPGITRGGHYHHTKNEKFLVIKGKAVIQLRNILNEEIIEYNVSDEKMEVVEMIPGYTHNIKNIGEDELILLLWANENYDKTAPDTYFLEV

SEQ ID NO: 10171 - DNA, 468 bp, Unknown
  Obtained from environmental sample
  misc_feature (1)..(468): n is a, c, g, or t
gtgggtgttccgtatttatgggaggggcagcaagccgagtgttatgcatttcgatcgaccattagaaatatcactaaaatccctgaaaaattattcttcttaagttatcccgctaaaatagaaaaccgtcagcttcgcactcatcaacgttttgtgactcatatacctgcatctattgtcacaagagacgatgatgatgtaaaaaaattatcccaattaaaaggcattatttcggatatttctgccaaaggctgtggttttgttttcaaaactgataactcgaaagttaaagttaatccgaaggatattttcatcattatgcgttcacccaacgatactgaaataaccattcccgcgaaggtgtgcaatagtcgctttgagaacggaaaagttaacgtaggtattcaatttgcagaggatgatgaacaagttagggccctattgaatcagctttctattgagttatag

SEQ ID NO: 10172 - protein, 155 aa, Unknown
  Obtained from environmental sample
  misc_feature (1)..(155): Xaa is any amino acid
MGVPYLWEGQQAECYAFRSTIRNITKIPEKLFFLSYPAKIENRQLRTHQRFVTHIPASIVTRDDDDVKKLSQLKGIISDISAKGCGFVFKTDNSKVKVNPKDIFIIMRSPNDTEITIPAKVCNSRFENGKVNVGIQFAEDDEQVRALLNQLSIEL

SEQ ID NO: 10173 - DNA, 771 bp, Unknown
  Obtained from environmental sample
  misc_feature (1)..(771): n is a, c, g, or t
atgggagtagatgcaaaaaagatcttaacactaacatttacaaataaagcctcaaatgagatgtctgagcggatcattaagacactaaatacacttgaagatagagatgagttagatgtgatcgtaaaagtaagttcactttcacgtgagcagattttagagcaaaaagagagagtgcttgaacatttcttaaactcagatacaaagatcatgacaatagataaatttttcgcacaaattttgcgtaaattttctcttcatgcaggactaatgccgacttttaacacctatgaatcacaacatcaactgaagcttctttcacgttttttaaaagaggttatggtagaaaatcgtgaaagttcacttatacgactaacactcatggcaaatgatagattgagtaatattttcgatattatcgatcagcttcatgtaaaacagcatgagatagcagggtttgagtataaagagttagattataagatatttgaggtagaggctttaagtgcagtgaatgagcttaaaattttggttcaatcctcaagagatgcctcagcaacagcaaaaaactccatggatatagatagttatgatgatctgatgagtaaaagttggataacaaaagagtccctaaattatagaacatactcaaagtgttttatcccagccatggatgaacttcttcacaagattcaagatgctacatataagcgcatgagagcgtatgagcagagctttttttatgagatcacttcacttcttaaaatttag

SEQ ID NO: 10174 - protein, 256 aa, Unknown
  Obtained from environmental sample
  misc_feature (1)..(256): Xaa is any amino acid
MGVDAKKILTLTFTNKASNEMSERIIKTLNTLEDRDELDVIVKVSSLSREQILEQKERVLEHFLNSDTKIMTIDKFFAQILRKFSLHAGLMPTFNTYESQHQLKLLSRFLKEVMVENRESSLIRLTLMANDRLSNIFDIIDQLHVKQHEIAGFEYKELDYKIFEVEALSAVNELKILVQSSRDASATAKNSMDIDSYDDLMSKSWITKESLNYRTYSKCFIPAMDELLHKIQDATYKRMRAYEQSFFYEITSLLKI

SEQ ID NO: 10175 - DNA, 951 bp, Unknown
  Obtained from environmental sample
  misc_feature (1)..(951): n is a, c, g, or t
ttgacaaattttgaactaaaaattttacaagagtgttgtgaaatatgcaacattgttttagagtttaaaacatcacactacaatcaaaagatgcagagtaaactctcatttgataagcttgagtttacaaacggatatattttcgagatagatttaaataataaagagatattaacagagataaaagagtctataaactttaacataaattgtgaatctatctcacaaagaagtttgcaagtcgcatttattaaagagaaagttcattcatttgtaaagagtggtattgaagtagagaagattgcagttgttcttcctgatgaggagtttgcctcatacataaaagagtttgatgatgaaaataattttaactttgctatggggatatcacttaaagagagttatatatacagaaatataaaagctattacagactatttggataataaaacaatacaaaaccgtgatagattaaacagatatgataaacagctttttgagcttatatcaaaaaattatcaaaaaaatctgcaagatatgaatttcagtgatttgcttgaaaaaatgcttagtgttgagagtaacagagatgtaaaaaagattcttcttgaagagatacacagattcaaagagttagtgaagattttggcaactacaactctaaaatcatctctgcatctatttttgaatcgtgtaagcgagagaagcatagatgacacaagaggtggtagaatctcagttattggtcttttagagacaagagacgttgcatatgagggtgtaatagttgtagattttaatgactctaaagctcccaaaaaggatgaaaaagatatgtttttaaactcctctctgcgcgccattgaaggacttcctacaaccctgaagagggaggcttaccaaaaaaattattataaatcacttttttcccaaagcctcaaaggttgctta

SEQ ID NO: 10176 - protein, 317 aa, Unknown
  Obtained from environmental sample
  misc_feature (1)..(317): Xaa is any amino acid
MTNFELKILQECCEICNIVLEFKTSHYNQKMQSKLSFDKLEFTNGYIFEIDLNNKEILTEIKESINFNINCESISQRSLQVAFIKEKVHSFVKSGIEVEKIAVVLPDEEFASYIKEFDDENNFNFAMGISLKESYIYRNIKAITDYLDNKTIQNRDRLNRYDKQLFELISKNYQKNLQDMNFSDLLEKMLSVESNRDVKKILLEEIHRFKELVKILATTTLKSSLHLFLNRVSERSIDDTRGGRISVIGLLETRDVAYEGVIVVDFNDSKAPKKDEKDMFLNSSLRAIEGLPTTLKREAYQKNYYKSLFSQSLKGCL

SEQ ID NO: 10177 - DNA, 387 bp, Unknown
  Obtained from environmental sample
  misc_feature (1)..(387): n is a, c, g, or t
atgaaaaaaacaaataacaacaatgtattttatgatccatcgttagctaaaagacatagaaaagcaaaggtatttaaaggattagctttaagtgccctagttatatcactactatttttagcaatttttttatcagatatggtaataaaagggaaaagtgcttttttacaaacatatattcaagttgaagtaacttataatgaatcaactgtaaaaagctatagaaaagctattgagagaaaatatcttaacctagtaagtcgttctgatattagagatattcctcttaaaatggaacatgacccctctcttatgggaaacaaaaagcttcaatggatattagctgatgatcaagttgatatgtatttgaaagaaaaatactattaa
